United States Patent 8,461,315 (MICRORNAS AND USES THEREOF) - sequence listing, part 19

SEQ ID NO: 529372 - RNA, 64 nt, Homo Sapiens; identical to SEQ ID NO: 116258

SEQ ID NO: 529373 - RNA, 64 nt, Homo Sapiens; identical to SEQ ID NO: 116259

SEQ ID NO: 529374 - RNA, 64 nt, Homo Sapiens; identical to SEQ ID NO: 116260

SEQ ID NO: 529375 - RNA, 64 nt, Homo Sapiens; identical to SEQ ID NO: 116261

SEQ ID NO: 529376 - RNA, 64 nt, Homo Sapiens; identical to SEQ ID NO: 116262

SEQ ID NO: 529377 - RNA, 64 nt, Homo Sapiens; identical to SEQ ID NO: 116263

SEQ ID NO: 529378 - RNA, 64 nt, Homo Sapiens; identical to SEQ ID NO: 116264

SEQ ID NO: 529379 - RNA, 64 nt, Homo Sapiens; identical to SEQ ID NO: 116265

SEQ ID NO: 529380 - RNA, 64 nt, Homo Sapiens; identical to SEQ ID NO: 116266

SEQ ID NO: 529381 - RNA, 64 nt, Homo Sapiens; identical to SEQ ID NO: 116267

SEQ ID NO: 529382 - RNA, 64 nt, Homo Sapiens; identical to SEQ ID NO: 116268

SEQ ID NO: 529383 - RNA, 64 nt, Homo Sapiens; identical to SEQ ID NO: 116269

SEQ ID NO: 529384 - RNA, 64 nt, Homo Sapiens; identical to SEQ ID NO: 116270

SEQ ID NO: 529385 - RNA, 64 nt, Homo Sapiens; identical to SEQ ID NO: 116271

SEQ ID NO: 529386 - RNA, 64 nt, Homo Sapiens; identical to SEQ ID NO: 116272

SEQ ID NO: 529387 - RNA, 64 nt, Homo Sapiens; identical to SEQ ID NO: 116273

SEQ ID NO: 529388 - RNA, 64 nt, Homo Sapiens; identical to SEQ ID NO: 116274

SEQ ID NO: 529389 - RNA, 64 nt, Homo Sapiens; identical to SEQ ID NO: 116275

SEQ ID NO: 529390 - RNA, 64 nt, Homo Sapiens; identical to SEQ ID NO: 116276

SEQ ID NO: 529391 - RNA, 64 nt, Homo Sapiens; identical to SEQ ID NO: 116277

SEQ ID NO: 529392 - RNA, 64 nt, Homo Sapiens; identical to SEQ ID NO: 116278

SEQ ID NO: 529393 - RNA, 64 nt, Homo Sapiens; identical to SEQ ID NO: 116279

SEQ ID NO: 529394 - RNA, 64 nt, Homo Sapiens; identical to SEQ ID NO: 116280

SEQ ID NO: 529395 - RNA, 64 nt, Homo Sapiens; identical to SEQ ID NO: 116281

SEQ ID NO: 529396 - RNA, 64 nt, Homo Sapiens; identical to SEQ ID NO: 116282

SEQ ID NO: 529397 - RNA, 64 nt, Homo Sapiens; identical to SEQ ID NO: 116283

SEQ ID NO: 529398 - RNA, 64 nt, Homo Sapiens; identical to SEQ ID NO: 116284

SEQ ID NO: 529399 - RNA, 64 nt, Homo Sapiens; identical to SEQ ID NO: 116285

SEQ ID NO: 529400 - RNA, 64 nt, Homo Sapiens; identical to SEQ ID NO: 116286

SEQ ID NO: 529401 - RNA, 64 nt, Homo Sapiens; identical to SEQ ID NO: 116287

SEQ ID NO: 529402 - RNA, 64 nt, Homo Sapiens; identical to SEQ ID NO: 116288

SEQ ID NO: 529403 - RNA, 64 nt, Homo Sapiens; identical to SEQ ID NO: 116289

SEQ ID NO: 529404 - RNA, 64 nt, Homo Sapiens; identical to SEQ ID NO: 116290

SEQ ID NO: 529405 - RNA, 64 nt, Homo Sapiens; identical to SEQ ID NO: 116291

SEQ ID NO: 529406 - RNA, 64 nt, Homo Sapiens; identical to SEQ ID NO: 116292

SEQ ID NO: 529407 - RNA, 64 nt, Homo Sapiens; identical to SEQ ID NO: 116293

SEQ ID NO: 529408 - RNA, 64 nt, Homo Sapiens; identical to SEQ ID NO: 116294

SEQ ID NO: 529409 - RNA, 64 nt, Homo Sapiens; identical to SEQ ID NO: 116295

SEQ ID NO: 529410 - RNA, 64 nt, Homo Sapiens; identical to SEQ ID NO: 116296

SEQ ID NO: 529411 - RNA, 64 nt, Homo Sapiens; identical to SEQ ID NO: 116297

SEQ ID NO: 529412 - RNA, 64 nt, Homo Sapiens; identical to SEQ ID NO: 116298

SEQ ID NO: 529413 - RNA, 64 nt, Homo Sapiens; identical to SEQ ID NO: 116299

SEQ ID NO: 529414 - RNA, 64 nt, Homo Sapiens; identical to SEQ ID NO: 116300

SEQ ID NO: 529415 - RNA, 64 nt, Homo Sapiens; identical to SEQ ID NO: 116301

SEQ ID NO: 529416 - RNA, 64 nt, Homo Sapiens; identical to SEQ ID NO: 116302

SEQ ID NO: 529417 - RNA, 64 nt, Homo Sapiens; identical to SEQ ID NO: 116303

SEQ ID NO: 529418 - RNA, 64 nt, Homo Sapiens; identical to SEQ ID NO: 116304

SEQ ID NO: 529419 - RNA, 64 nt, Homo Sapiens; identical to SEQ ID NO: 116305

SEQ ID NO: 529420 - RNA, 64 nt, Homo Sapiens; identical to SEQ ID NO: 116306

SEQ ID NO: 529421 - RNA, 64 nt, Homo Sapiens; identical to SEQ ID NO: 116307

SEQ ID NO: 529422 - RNA, 64 nt, Homo Sapiens; identical to SEQ ID NO: 116308

SEQ ID NO: 529423 - RNA, 64 nt, Homo Sapiens; identical to SEQ ID NO: 116309

SEQ ID NO: 529424 - RNA, 64 nt, Homo Sapiens; identical to SEQ ID NO: 116310

SEQ ID NO: 529425 - RNA, 64 nt, Homo Sapiens; identical to SEQ ID NO: 116311

SEQ ID NO: 529426 - RNA, 64 nt, Homo Sapiens; identical to SEQ ID NO: 116312

SEQ ID NO: 529427 - RNA, 64 nt, Homo Sapiens; identical to SEQ ID NO: 116313

SEQ ID NO: 529428 - RNA, 64 nt, Homo Sapiens; identical to SEQ ID NO: 116314

SEQ ID NO: 529429 - RNA, 64 nt, Homo Sapiens; identical to SEQ ID NO: 116315

SEQ ID NO: 529430 - RNA, 64 nt, Homo Sapiens; identical to SEQ ID NO: 116316

SEQ ID NO: 529431 - RNA, 64 nt, Homo Sapiens; identical to SEQ ID NO: 116317

SEQ ID NO: 529432 - RNA, 64 nt, Homo Sapiens; identical to SEQ ID NO: 116318

SEQ ID NO: 529433 - RNA, 64 nt, Homo Sapiens; identical to SEQ ID NO: 116319

SEQ ID NO: 529434 - RNA, 64 nt, Homo Sapiens; identical to SEQ ID NO: 116320

SEQ ID NO: 529435 - RNA, 64 nt, Homo Sapiens; identical to SEQ ID NO: 116321

SEQ ID NO: 529436 - RNA, 64 nt, Homo Sapiens; identical to SEQ ID NO: 116322

SEQ ID NO: 529437 - RNA, 64 nt, Homo Sapiens; identical to SEQ ID NO: 116323

SEQ ID NO: 529438 - RNA, 64 nt, Homo Sapiens; identical to SEQ ID NO: 116324

SEQ ID NO: 529439 - RNA, 64 nt, Homo Sapiens; identical to SEQ ID NO: 116325

SEQ ID NO: 529440 - RNA, 64 nt, Homo Sapiens; identical to SEQ ID NO: 116326

SEQ ID NO: 529441 - RNA, 64 nt, Homo Sapiens; identical to SEQ ID NO: 116327

SEQ ID NO: 529442 - RNA, 64 nt, Homo Sapiens; identical to SEQ ID NO: 116328

SEQ ID NO: 529443 - RNA, 64 nt, Homo Sapiens; identical to SEQ ID NO: 116329

SEQ ID NO: 529444 - RNA, 64 nt, Homo Sapiens; identical to SEQ ID NO: 116330

SEQ ID NO: 529445 - RNA, 64 nt, Homo Sapiens; identical to SEQ ID NO: 116331

SEQ ID NO: 529446 - RNA, 64 nt, Homo Sapiens; identical to SEQ ID NO: 116332

SEQ ID NO: 529447 - RNA, 64 nt, Homo Sapiens; identical to SEQ ID NO: 116333

SEQ ID NO: 529448 - RNA, 64 nt, Homo Sapiens; identical to SEQ ID NO: 116334

SEQ ID NO: 529449 - RNA, 64 nt, Homo Sapiens; identical to SEQ ID NO: 116335

SEQ ID NO: 529450 - RNA, 64 nt, Homo Sapiens; identical to SEQ ID NO: 116336

SEQ ID NO: 529451 - RNA, 64 nt, Homo Sapiens; identical to SEQ ID NO: 116337

SEQ ID NO: 529452 - RNA, 64 nt, Homo Sapiens; identical to SEQ ID NO: 116338

SEQ ID NO: 529453 - RNA, 64 nt, Homo Sapiens; identical to SEQ ID NO: 116339

SEQ ID NO: 529454 - RNA, 64 nt, Homo Sapiens; identical to SEQ ID NO: 116340

SEQ ID NO: 529455 - RNA, 64 nt, Homo Sapiens; identical to SEQ ID NO: 116341

SEQ ID NO: 529456 - RNA, 64 nt, Homo Sapiens; identical to SEQ ID NO: 116342

SEQ ID NO: 529457 - RNA, 64 nt, Homo Sapiens; identical to SEQ ID NO: 116343

SEQ ID NO: 529458 - RNA, 64 nt, Homo Sapiens; identical to SEQ ID NO: 116344

SEQ ID NO: 529459 - RNA, 64 nt, Homo Sapiens; identical to SEQ ID NO: 116345

SEQ ID NO: 529460 - RNA, 64 nt, Homo Sapiens; identical to SEQ ID NO: 116346

SEQ ID NO: 529461 - RNA, 64 nt, Homo Sapiens; identical to SEQ ID NO: 116347

SEQ ID NO: 529462 - RNA, 64 nt, Homo Sapiens; identical to SEQ ID NO: 116348

SEQ ID NO: 529463 - RNA, 64 nt, Homo Sapiens; identical to SEQ ID NO: 116349

SEQ ID NO: 529464 - RNA, 64 nt, Homo Sapiens; identical to SEQ ID NO: 116350

SEQ ID NO: 529465 - RNA, 64 nt, Homo Sapiens; identical to SEQ ID NO: 116351

SEQ ID NO: 529466 - RNA, 64 nt, Homo Sapiens; identical to SEQ ID NO: 116352

SEQ ID NO: 529467 - RNA, 64 nt, Homo Sapiens; identical to SEQ ID NO: 116353

SEQ ID NO: 529468 - RNA, 64 nt, Homo Sapiens; identical to SEQ ID NO: 116354

SEQ ID NO: 529469 - RNA, 64 nt, Homo Sapiens; identical to SEQ ID NO: 116355

SEQ ID NO: 529470 - RNA, 64 nt, Homo Sapiens; identical to SEQ ID NO: 116356

SEQ ID NO: 529471 - RNA, 64 nt, Homo Sapiens; identical to SEQ ID NO: 116357

SEQ ID NO: 529472 - RNA, 64 nt, Homo Sapiens; identical to SEQ ID NO: 116358

SEQ ID NO: 529473 - RNA, 64 nt, Homo Sapiens; identical to SEQ ID NO: 116359

SEQ ID NO: 529474 - RNA, 64 nt, Homo Sapiens; identical to SEQ ID NO: 116360

SEQ ID NO: 529475 - RNA, 64 nt, Homo Sapiens; identical to SEQ ID NO: 116361

SEQ ID NO: 529476 - RNA, 64 nt, Homo Sapiens; identical to SEQ ID NO: 116362

SEQ ID NO: 529477 - RNA, 64 nt, Homo Sapiens; identical to SEQ ID NO: 116363

SEQ ID NO: 529478 - RNA, 64 nt, Homo Sapiens; identical to SEQ ID NO: 116364

SEQ ID NO: 529479 - RNA, 64 nt, Homo Sapiens; identical to SEQ ID NO: 116365

SEQ ID NO: 529480 - RNA, 64 nt, Homo Sapiens; identical to SEQ ID NO: 116366

SEQ ID NO: 529481 - RNA, 64 nt, Homo Sapiens; identical to SEQ ID NO: 116367

SEQ ID NO: 529482 - RNA, 64 nt, Homo Sapiens; identical to SEQ ID NO: 116368

SEQ ID NO: 529483 - RNA, 64 nt, Homo Sapiens; identical to SEQ ID NO: 144868

SEQ ID NO: 529484 - RNA, 64 nt, Homo Sapiens; identical to SEQ ID NO: 144869

SEQ ID NO: 529485 - RNA, 64 nt, Homo Sapiens; identical to SEQ ID NO: 144870

SEQ ID NO: 529486 - RNA, 64 nt, Homo Sapiens; identical to SEQ ID NO: 144871

SEQ ID NO: 529487 - RNA, 64 nt, Homo Sapiens; identical to SEQ ID NO: 144872

SEQ ID NO: 529488 - RNA, 64 nt, Homo Sapiens; identical to SEQ ID NO: 144873

SEQ ID NO: 529489 - RNA, 64 nt, Homo Sapiens; identical to SEQ ID NO: 144874

SEQ ID NO: 529490 - RNA, 64 nt, Homo Sapiens; identical to SEQ ID NO: 144875

SEQ ID NO: 529491 - RNA, 64 nt, Homo Sapiens; identical to SEQ ID NO: 144876

SEQ ID NO: 529492 - RNA, 64 nt, Homo Sapiens; identical to SEQ ID NO: 144877

SEQ ID NO: 529493 - RNA, 64 nt, Homo Sapiens; identical to SEQ ID NO: 144878

SEQ ID NO: 529494 - RNA, 64 nt, Homo Sapiens; identical to SEQ ID NO: 144879

SEQ ID NO: 529495 - RNA, 64 nt, Homo Sapiens; identical to SEQ ID NO: 144880

SEQ ID NO: 529496 - RNA, 64 nt, Homo Sapiens; identical to SEQ ID NO: 144881

SEQ ID NO: 529497 - RNA, 64 nt, Homo Sapiens; identical to SEQ ID NO: 144882

SEQ ID NO: 529498 - RNA, 64 nt, Homo Sapiens; identical to SEQ ID NO: 144883

SEQ ID NO: 529499 - RNA, 64 nt, Homo Sapiens; identical to SEQ ID NO: 144884

SEQ ID NO: 529500 - RNA, 64 nt, Homo Sapiens; identical to SEQ ID NO: 144885

SEQ ID NO: 529501 - RNA, 64 nt, Homo Sapiens; identical to SEQ ID NO: 144886

SEQ ID NO: 529502 - RNA, 64 nt, Homo Sapiens; identical to SEQ ID NO: 144887

SEQ ID NO: 529503 - RNA, 64 nt, Homo Sapiens; identical to SEQ ID NO: 144888

SEQ ID NO: 529504 - RNA, 64 nt, Homo Sapiens; identical to SEQ ID NO: 144889

SEQ ID NO: 529505 - RNA, 64 nt, Homo Sapiens; identical to SEQ ID NO: 144890

SEQ ID NO: 529506 - RNA, 64 nt, Homo Sapiens; identical to SEQ ID NO: 144891

SEQ ID NO: 529507 - RNA, 64 nt, Homo Sapiens; identical to SEQ ID NO: 144892

SEQ ID NO: 529508 - RNA, 64 nt, Homo Sapiens; identical to SEQ ID NO: 144893

SEQ ID NO: 529509 - RNA, 64 nt, Homo Sapiens; identical to SEQ ID NO: 144894

SEQ ID NO: 529510 - RNA, 64 nt, Homo Sapiens; identical to SEQ ID NO: 144895

SEQ ID NO: 529511 - RNA, 64 nt, Homo Sapiens; identical to SEQ ID NO: 144896

SEQ ID NO: 529512 - RNA, 64 nt, Homo Sapiens; identical to SEQ ID NO: 144897

SEQ ID NO: 529513 - RNA, 64 nt, Homo Sapiens; identical to SEQ ID NO: 144898

SEQ ID NO: 529514 - RNA, 64 nt, Homo Sapiens; identical to SEQ ID NO: 144899

SEQ ID NO: 529515 - RNA, 64 nt, Homo Sapiens; identical to SEQ ID NO: 144900

SEQ ID NO: 529516 - RNA, 64 nt, Homo Sapiens; identical to SEQ ID NO: 144901

SEQ ID NO: 529517 - RNA, 64 nt, Homo Sapiens; identical to SEQ ID NO: 144902

SEQ ID NO: 529518 - RNA, 64 nt, Homo Sapiens; identical to SEQ ID NO: 144903

SEQ ID NO: 529519 - RNA, 64 nt, Homo Sapiens; identical to SEQ ID NO: 144904

SEQ ID NO: 529520 - RNA, 64 nt, Homo Sapiens; identical to SEQ ID NO: 144905

SEQ ID NO: 529521 - RNA, 64 nt, Homo Sapiens; identical to SEQ ID NO: 144906

SEQ ID NO: 529522 - RNA, 64 nt, Homo Sapiens; identical to SEQ ID NO: 144907

SEQ ID NO: 529523 - RNA, 64 nt, Homo Sapiens; identical to SEQ ID NO: 109963

SEQ ID NO: 529524 - RNA, 64 nt, Homo Sapiens; identical to SEQ ID NO: 109964

SEQ ID NO: 529525 - RNA, 64 nt, Homo Sapiens; identical to SEQ ID NO: 109965

SEQ ID NO: 529526 - RNA, 64 nt, Homo Sapiens; identical to SEQ ID NO: 109966

SEQ ID NO: 529527 - RNA, 64 nt, Homo Sapiens; identical to SEQ ID NO: 109967

SEQ ID NO: 529528 - RNA, 64 nt, Homo Sapiens; identical to SEQ ID NO: 109968

SEQ ID NO: 529529 - RNA, 64 nt, Homo Sapiens; identical to SEQ ID NO: 109969

SEQ ID NO: 529530 - RNA, 64 nt, Homo Sapiens; identical to SEQ ID NO: 109970

SEQ ID NO: 529531 - RNA, 64 nt, Homo Sapiens; identical to SEQ ID NO: 109971

SEQ ID NO: 529532 - RNA, 64 nt, Homo Sapiens; identical to SEQ ID NO: 109972

SEQ ID NO: 529533 - RNA, 64 nt, Homo Sapiens; identical to SEQ ID NO: 109973

SEQ ID NO: 529534 - RNA, 64 nt, Homo Sapiens; identical to SEQ ID NO: 109974

SEQ ID NO: 529535 - RNA, 64 nt, Homo Sapiens; identical to SEQ ID NO: 109975

SEQ ID NO: 529536 - RNA, 64 nt, Homo Sapiens; identical to SEQ ID NO: 109976

SEQ ID NO: 529537 - RNA, 64 nt, Homo Sapiens; identical to SEQ ID NO: 109977

SEQ ID NO: 529538 - RNA, 64 nt, Homo Sapiens; identical to SEQ ID NO: 109978

SEQ ID NO: 529539 - RNA, 64 nt, Homo Sapiens; identical to SEQ ID NO: 109979

SEQ ID NO: 529540 - RNA, 64 nt, Homo Sapiens; identical to SEQ ID NO: 109980

SEQ ID NO: 529541 - RNA, 64 nt, Homo Sapiens; identical to SEQ ID NO: 109981

SEQ ID NO: 529542 - RNA, 64 nt, Homo Sapiens; identical to SEQ ID NO: 109982

SEQ ID NO: 529543 - RNA, 64 nt, Homo Sapiens; identical to SEQ ID NO: 109983

SEQ ID NO: 529544 - RNA, 64 nt, Homo Sapiens; identical to SEQ ID NO: 109984

SEQ ID NO: 529545 - RNA, 64 nt, Homo Sapiens; identical to SEQ ID NO: 109985

SEQ ID NO: 529546 - RNA, 64 nt, Homo Sapiens; identical to SEQ ID NO: 109986

SEQ ID NO: 529547 - RNA, 64 nt, Homo Sapiens; identical to SEQ ID NO: 109987

SEQ ID NO: 529548 - RNA, 64 nt, Homo Sapiens; identical to SEQ ID NO: 109988

SEQ ID NO: 529549 - RNA, 64 nt, Homo Sapiens; identical to SEQ ID NO: 109989

SEQ ID NO: 529550 - RNA, 64 nt, Homo Sapiens; identical to SEQ ID NO: 109990

SEQ ID NO: 529551 - RNA, 64 nt, Homo Sapiens; identical to SEQ ID NO: 109991

SEQ ID NO: 529552 - RNA, 52 nt, Homo Sapiens; identical to SEQ ID NO: 109992

SEQ ID NO: 529553 - RNA, 64 nt, Homo Sapiens; identical to SEQ ID NO: 109993

SEQ ID NO: 529554 - RNA, 64 nt, Homo Sapiens; identical to SEQ ID NO: 109994

SEQ ID NO: 529555 - RNA, 64 nt, Homo Sapiens; identical to SEQ ID NO: 109995

SEQ ID NO: 529556 - RNA, 64 nt, Homo Sapiens; identical to SEQ ID NO: 109996

SEQ ID NO: 529557 - RNA, 64 nt, Homo Sapiens; identical to SEQ ID NO: 109997

SEQ ID NO: 529558 - RNA, 64 nt, Homo Sapiens; identical to SEQ ID NO: 109998

SEQ ID NO: 529559 - RNA, 64 nt, Homo Sapiens; identical to SEQ ID NO: 109999

SEQ ID NO: 529560 - RNA, 64 nt, Homo Sapiens; identical to SEQ ID NO: 110000

SEQ ID NO: 529561 - RNA, 64 nt, Homo Sapiens; identical to SEQ ID NO: 206809

SEQ ID NO: 529562 - RNA, 64 nt, Homo Sapiens; identical to SEQ ID NO: 206810

SEQ ID NO: 529563 - RNA, 64 nt, Homo Sapiens; identical to SEQ ID NO: 206811

SEQ ID NO: 529564 - RNA, 64 nt, Homo Sapiens; identical to SEQ ID NO: 206812

SEQ ID NO: 529565 - RNA, 64 nt, Homo Sapiens; identical to SEQ ID NO: 206813

SEQ ID NO: 529566 - RNA, 64 nt, Homo Sapiens; identical to SEQ ID NO: 206814

SEQ ID NO: 529567 - RNA, 64 nt, Homo Sapiens; identical to SEQ ID NO: 206815

SEQ ID NO: 529568 - RNA, 64 nt, Homo Sapiens; identical to SEQ ID NO: 206816

SEQ ID NO: 529569 - RNA, 64 nt, Homo Sapiens; identical to SEQ ID NO: 206817

SEQ ID NO: 529570 - RNA, 64 nt, Homo Sapiens; identical to SEQ ID NO: 206818

SEQ ID NO: 529571 - RNA, 64 nt, Homo Sapiens; identical to SEQ ID NO: 206819

SEQ ID NO: 529572 - RNA, 64 nt, Homo Sapiens; identical to SEQ ID NO: 206820

SEQ ID NO: 529573 - RNA, 64 nt, Homo Sapiens; identical to SEQ ID NO: 206821

SEQ ID NO: 529574 - RNA, 64 nt, Homo Sapiens; identical to SEQ ID NO: 206822

SEQ ID NO: 529575 - RNA, 64 nt, Homo Sapiens; identical to SEQ ID NO: 206823

SEQ ID NO: 529576 - RNA, 64 nt, Homo Sapiens; identical to SEQ ID NO: 206824

SEQ ID NO: 529577 - RNA, 64 nt, Homo Sapiens; identical to SEQ ID NO: 206825

SEQ ID NO: 529578 - RNA, 64 nt, Homo Sapiens; identical to SEQ ID NO: 206826

SEQ ID NO: 529579 - RNA, 64 nt, Homo Sapiens; identical to SEQ ID NO: 206827

SEQ ID NO: 529580 - RNA, 64 nt, Homo Sapiens; identical to SEQ ID NO: 206828

SEQ ID NO: 529581 - RNA, 64 nt, Homo Sapiens; identical to SEQ ID NO: 206829

SEQ ID NO: 529582 - RNA, 56 nt, Homo Sapiens; identical to SEQ ID NO: 206830

SEQ ID NO: 529583 - RNA, 64 nt, Homo Sapiens; identical to SEQ ID NO: 206831

SEQ ID NO: 529584 - RNA, 64 nt, Homo Sapiens; identical to SEQ ID NO: 206832

SEQ ID NO: 529585 - RNA, 64 nt, Homo Sapiens; identical to SEQ ID NO: 206833

SEQ ID NO: 529586 - RNA, 61 nt, Homo Sapiens
aacggaugcauggaaggcgcgccccucguggagagccuauauagcucugggaauggaaugc

SEQ ID NO: 529587 - RNA, 61 nt, Homo Sapiens
aauggacgugcagucagggaucccccuguagagagccuaugaugagccaacagcacuugcu

SEQ ID NO: 529588 - RNA, 61 nt, Homo Sapiens
uacuucucuacccuugacauccagcuucgcgagagccuagagccagaugccuaugcguugu

SEQ ID NO: 529589 - RNA, 61 nt, Homo Sapiens
acaaugccuuuuacgccaagaauaaauguccagagccuaacugcagggugaaaaagucccu

SEQ ID NO: 529590 - RNA, 64 nt, Homo Sapiens
uaaaauucaauuaagguacuucucccucagggacguagaacaauggaaugucagucagucucug

SEQ ID NO: 529591 - RNA, 64 nt, Homo Sapiens; identical to SEQ ID NO: 529590

SEQ ID NO: 529592 - RNA, 64 nt, Homo Sapiens
cuccacagccacagcugguuaggggcggcugccaguagaacagggcagaugccuggacucccaa

SEQ ID NO: 529593 - RNA, 64 nt, Homo Sapiens
acaggaaaaaaugaugcauaaaaacauggcuucuguagaacaauagagacuguaaaagaacaag

SEQ ID NO: 529594 - RNA, 64 nt, Homo Sapiens
gaaugaaauauucagggacuuaggggcgaugauuguagaacaggguacaguccuugacagaauu

SEQ ID NO: 529595 - RNA, 64 nt, Homo Sapiens
uaucaauauggugcuugaauauauuccuauaacuguagaacaguguggaaagugaugguaacuu

SEQ ID NO: 529596 - RNA, 64 nt, Homo Sapiens
auucccuacuaaccuccacccauuuugccuuuuaaacaacuaggaauuuaauuagucaggcauc

SEQ ID NO: 529597 - RNA, 64 nt, Homo Sapiens
ucuauauuuaugggcaauaucugauugagacugcaacaacuacaguucaggauauaugaguugg

SEQ ID NO: 529598 - RNA, 64 nt, Homo Sapiens
uuucaaaaguaaauguaauaacaacuaaccuucuaacaacuaucuuucuuuuuuuuccugaaaa

SEQ ID NO: 529599 - RNA, 64 nt, Homo Sapiens
cuucuaacaacuaucuuucauuuuuuuccugaaaaacaacuaaccauuuuuacaucagauuucu

SEQ ID NO: 529600 - RNA, 64 nt, Homo Sapiens
guugauguaguuuuaaaccauccaacuaguaauaaacaacuacucauuugugugcccuggaauu

SEQ ID NO: 529601 - RNA, 64 nt, Homo Sapiens
uggaguaccaugaggguugcuauuuguuguuuuuaacaacuaaucaagagugagugaacaacua

SEQ ID NO: 529602 - RNA, 64 nt, Homo Sapiens
uuuguuguuuuuaacaacuaaucaagagugagugaacaacuauuuauaaacuagaucuccuauu

SEQ ID NO: 529603 - RNA, 64 nt, Homo Sapiens
acugaagcaugcacaugccacugucaccaaaacaaacaacuaccacuuuccaaauuucauucag

SEQ ID NO: 529604 - RNA, 64 nt, Homo Sapiens
guguuauuuauguuauuuauauuagcuaacaggaaacaacuacuguguuucaacauaauaaaua

SEQ ID NO: 529605 - RNA, 64 nt, Homo Sapiens
ggacccuggaaggagggagagcaggcagcccuucacaggauaggauccgucucuguccuguccu

SEQ ID NO: 529606 - RNA, 64 nt, Homo Sapiens
uguucagacagccacaugaggggacagugcagcuacaggauaugccaucauggcagaaaguucu

SEQ ID NO: 529607 - RNA, 64 nt, Homo Sapiens
guggaaagguuagagacuccgaucuaaaggguuaacaggauaggagccugaguguuauacuaga

SEQ ID NO: 529608 - RNA, 64 nt, Homo Sapiens
uagcagcaacccuggcccaccuauuuugugcauuacaggauauuuuguaaggaaaaccuguuuc

SEQ ID NO: 529609 - RNA, 64 nt, Homo Sapiens
uagaaaauuugaagccauuacuuccagcugguauacaggauaaacuacauacacugaucccuug

SEQ ID NO: 529610 - RNA, 64 nt, Homo Sapiens
uuuuacuuuuuauucccguuaaaacugauguaaaacaggauaaaggcuuguuauagucacuuau

SEQ ID NO: 529611 - RNA, 64 nt, Homo Sapiens
uuaaguuaaaauaguuucucuucagcuguaaauaacaggauacagaauuaacaagagaaaaugu

SEQ ID NO: 529612 - RNA, 64 nt, Homo Sapiens
uucuucgguuuuugaaaaacauaauggaaauaaaacaggauauugacauaauagcacaaaauga

SEQ ID NO: 529613 - RNA, 64 nt, Homo Sapiens; identical to SEQ ID NO: 183774

SEQ ID NO: 529614 - RNA, 64 nt, Homo Sapiens; identical to SEQ ID NO: 183775

SEQ ID NO: 529615 - RNA, 64 nt, Homo Sapiens; identical to SEQ ID NO: 183776

SEQ ID NO: 529616 - RNA, 64 nt, Homo Sapiens; identical to SEQ ID NO: 183777

SEQ ID NO: 529617 - RNA, 64 nt, Homo Sapiens; identical to SEQ ID NO: 183778

SEQ ID NO: 529618 - RNA, 64 nt, Homo Sapiens; identical to SEQ ID NO: 183779

SEQ ID NO: 529619 - RNA, 64 nt, Homo Sapiens; identical to SEQ ID NO: 183780

SEQ ID NO: 529620 - RNA, 64 nt, Homo Sapiens; identical to SEQ ID NO: 183781

SEQ ID NO: 529621 - RNA, 64 nt, Homo Sapiens; identical to SEQ ID NO: 183782

SEQ ID NO: 529622 - RNA, 64 nt, Homo Sapiens; identical to SEQ ID NO: 183783

SEQ ID NO: 529623 - RNA, 64 nt, Homo Sapiens; identical to SEQ ID NO: 183784

SEQ ID NO: 529624 - RNA, 64 nt, Homo Sapiens; identical to SEQ ID NO: 183785

SEQ ID NO: 529625 - RNA, 64 nt, Homo Sapiens; identical to SEQ ID NO: 183786

SEQ ID NO: 529626 - RNA, 64 nt, Homo Sapiens; identical to SEQ ID NO: 183787

SEQ ID NO: 529627 - RNA, 64 nt, Homo Sapiens; identical to SEQ ID NO: 183788

SEQ ID NO: 529628 - RNA, 64 nt, Homo Sapiens; identical to SEQ ID NO: 183789

SEQ ID NO: 529629 - RNA, 64 nt, Homo Sapiens; identical to SEQ ID NO: 183790

SEQ ID NO: 529630 - RNA, 64 nt, Homo Sapiens; identical to SEQ ID NO: 183791

SEQ ID NO: 529631 - RNA, 64 nt, Homo Sapiens; identical to SEQ ID NO: 183792

SEQ ID NO: 529632 - RNA, 64 nt, Homo Sapiens; identical to SEQ ID NO: 183793

SEQ ID NO: 529633 - RNA, 64 nt, Homo Sapiens; identical to SEQ ID NO: 183794

SEQ ID NO: 529634 - RNA, 64 nt, Homo Sapiens; identical to SEQ ID NO: 183795

SEQ ID NO: 529635 - RNA, 64 nt, Homo Sapiens; identical to SEQ ID NO: 183796

SEQ ID NO: 529636 - RNA, 64 nt, Homo Sapiens; identical to SEQ ID NO: 183797

SEQ ID NO: 529637 - RNA, 64 nt, Homo Sapiens; identical to SEQ ID NO: 183798

SEQ ID NO: 529638 - RNA, 64 nt, Homo Sapiens; identical to SEQ ID NO: 183799

SEQ ID NO: 529639 - RNA, 64 nt, Homo Sapiens; identical to SEQ ID NO: 183800

SEQ ID NO: 529640 - RNA, 64 nt, Homo Sapiens; identical to SEQ ID NO: 183801

SEQ ID NO: 529641 - RNA, 64 nt, Homo Sapiens; identical to SEQ ID NO: 183802

SEQ ID NO: 529642 - RNA, 64 nt, Homo Sapiens; identical to SEQ ID NO: 183803

SEQ ID NO: 529643 - RNA, 64 nt, Homo Sapiens; identical to SEQ ID NO: 183804

SEQ ID NO: 529644 - RNA, 64 nt, Homo Sapiens; identical to SEQ ID NO: 183805

SEQ ID NO: 529645 - RNA, 64 nt, Homo Sapiens; identical to SEQ ID NO: 183806

SEQ ID NO: 529646 - RNA, 64 nt, Homo Sapiens; identical to SEQ ID NO: 183807

SEQ ID NO: 529647 - RNA, 64 nt, Homo Sapiens; identical to SEQ ID NO: 183808

SEQ ID NO: 529648 - RNA, 64 nt, Homo Sapiens; identical to SEQ ID NO: 183809

SEQ ID NO: 529649 - RNA, 64 nt, Homo Sapiens; identical to SEQ ID NO: 183810

SEQ ID NO: 529650 - RNA, 64 nt, Homo Sapiens; identical to SEQ ID NO: 183811

SEQ ID NO: 529651 - RNA, 64 nt, Homo Sapiens; identical to SEQ ID NO: 183812

SEQ ID NO: 529652 - RNA, 64 nt, Homo Sapiens; identical to SEQ ID NO: 183813

SEQ ID NO: 529653 - RNA, 64 nt, Homo Sapiens; identical to SEQ ID NO: 183814

SEQ ID NO: 529654 - RNA, 64 nt, Homo Sapiens; identical to SEQ ID NO: 183815

SEQ ID NO: 529655 - RNA, 64 nt, Homo Sapiens; identical to SEQ ID NO: 183816

SEQ ID NO: 529656 - RNA, 64 nt, Homo Sapiens; identical to SEQ ID NO: 183817

SEQ ID NO: 529657 - RNA, 64 nt, Homo Sapiens; identical to SEQ ID NO: 183818

SEQ ID NO: 529658 - RNA, 64 nt, Homo Sapiens; identical to SEQ ID NO: 183819

SEQ ID NO: 529659 - RNA, 64 nt, Homo Sapiens; identical to SEQ ID NO: 183820

SEQ ID NO: 529660 - RNA, 64 nt, Homo Sapiens; identical to SEQ ID NO: 183821

SEQ ID NO: 529661 - RNA, 64 nt, Homo Sapiens; identical to SEQ ID NO: 183822

SEQ ID NO: 529662 - RNA, 64 nt, Homo Sapiens; identical to SEQ ID NO: 183823

SEQ ID NO: 529663 - RNA, 64 nt, Homo Sapiens; identical to SEQ ID NO: 183824

SEQ ID NO: 529664 - RNA, 64 nt, Homo Sapiens; identical to SEQ ID NO: 183825

SEQ ID NO: 529665 - RNA, 64 nt, Homo Sapiens; identical to SEQ ID NO: 183826

SEQ ID NO: 529666 - RNA, 64 nt, Homo Sapiens; identical to SEQ ID NO: 183827

SEQ ID NO: 529667 - RNA, 64 nt, Homo Sapiens; identical to SEQ ID NO: 183828

SEQ ID NO: 529668 - RNA, 64 nt, Homo Sapiens; identical to SEQ ID NO: 183829

SEQ ID NO: 529669 - RNA, 52 nt, Homo Sapiens; identical to SEQ ID NO: 183830

SEQ ID NO: 529670 - RNA, 64 nt, Homo Sapiens; identical to SEQ ID NO: 183831

SEQ ID NO: 529671 - RNA, 64 nt, Homo Sapiens; identical to SEQ ID NO: 183832

SEQ ID NO: 529672 - RNA, 64 nt, Homo Sapiens; identical to SEQ ID NO: 183833

SEQ ID NO: 529673 - RNA, 64 nt, Homo Sapiens; identical to SEQ ID NO: 183834

SEQ ID NO: 529674 - RNA, 64 nt, Homo Sapiens; identical to SEQ ID NO: 183835

SEQ ID NO: 529675 - RNA, 64 nt, Homo Sapiens; identical to SEQ ID NO: 183836

SEQ ID NO: 529676 - RNA, 64 nt, Homo Sapiens; identical to SEQ ID NO: 183837

SEQ ID NO: 529677 - RNA, 64 nt, Homo Sapiens; identical to SEQ ID NO: 183838

SEQ ID NO: 529678 - RNA, 64 nt, Homo Sapiens; identical to SEQ ID NO: 382152

SEQ ID NO: 529679 - RNA, 64 nt, Homo Sapiens; identical to SEQ ID NO: 382153

SEQ ID NO: 529680 - RNA, 64 nt, Homo Sapiens; identical to SEQ ID NO: 382154

SEQ ID NO: 529681 - RNA, 64 nt, Homo Sapiens; identical to SEQ ID NO: 382155

SEQ ID NO: 529682 - RNA, 64 nt, Homo Sapiens; identical to SEQ ID NO: 382156

SEQ ID NO: 529683 - RNA, 64 nt, Homo Sapiens; identical to SEQ ID NO: 382157

SEQ ID NO: 529684 - RNA, 64 nt, Homo Sapiens; identical to SEQ ID NO: 382158

SEQ ID NO: 529685 - RNA, 64 nt, Homo Sapiens; identical to SEQ ID NO: 382159

SEQ ID NO: 529686 - RNA, 64 nt, Homo Sapiens; identical to SEQ ID NO: 382160

SEQ ID NO: 529687 - RNA, 64 nt, Homo Sapiens; identical to SEQ ID NO: 382161

SEQ ID NO: 529688 - RNA, 64 nt, Homo Sapiens; identical to SEQ ID NO: 382162

SEQ ID NO: 529689 - RNA, 64 nt, Homo Sapiens; identical to SEQ ID NO: 382163

SEQ ID NO: 529690 - RNA, 64 nt, Homo Sapiens; identical to SEQ ID NO: 382164

SEQ ID NO: 529691 - RNA, 64 nt, Homo Sapiens; identical to SEQ ID NO: 382165

SEQ ID NO: 529692 - RNA, 64 nt, Homo Sapiens; identical to SEQ ID NO: 382166

SEQ ID NO: 529693 - RNA, 64 nt, Homo Sapiens; identical to SEQ ID NO: 382167

SEQ ID NO: 529694 - RNA, 64 nt, Homo Sapiens; identical to SEQ ID NO: 382168

SEQ ID NO: 529695 - RNA, 64 nt, Homo Sapiens; identical to SEQ ID NO: 382169

SEQ ID NO: 529696 - RNA, 64 nt, Homo Sapiens; identical to SEQ ID NO: 382170

SEQ ID NO: 529697 - RNA, 64 nt, Homo Sapiens; identical to SEQ ID NO: 382171

SEQ ID NO: 529698 - RNA, 64 nt, Homo Sapiens; identical to SEQ ID NO: 382172

SEQ ID NO: 529699 - RNA, 64 nt, Homo Sapiens; identical to SEQ ID NO: 382173

SEQ ID NO: 529700 - RNA, 64 nt, Homo Sapiens; identical to SEQ ID NO: 382174

SEQ ID NO: 529701 - RNA, 64 nt, Homo Sapiens; identical to SEQ ID NO: 382175

SEQ ID NO: 529702 - RNA, 64 nt, Homo Sapiens; identical to SEQ ID NO: 382176

SEQ ID NO: 529703 - RNA, 64 nt, Homo Sapiens; identical to SEQ ID NO: 382177

SEQ ID NO: 529704 - RNA, 64 nt, Homo Sapiens; identical to SEQ ID NO: 382178

SEQ ID NO: 529705 - RNA, 64 nt, Homo Sapiens; identical to SEQ ID NO: 382179

SEQ ID NO: 529706 - RNA, 64 nt, Homo Sapiens; identical to SEQ ID NO: 382180

SEQ ID NO: 529707 - RNA, 64 nt, Homo Sapiens; identical to SEQ ID NO: 382181

SEQ ID NO: 529708 - RNA, 64 nt, Homo Sapiens; identical to SEQ ID NO: 382182

SEQ ID NO: 529709 - RNA, 64 nt, Homo Sapiens; identical to SEQ ID NO: 382183

SEQ ID NO: 529710 - RNA, 64 nt, Homo Sapiens; identical to SEQ ID NO: 382184

SEQ ID NO: 529711 - RNA, 64 nt, Homo Sapiens; identical to SEQ ID NO: 382185

SEQ ID NO: 529712 - RNA, 64 nt, Homo Sapiens; identical to SEQ ID NO: 382186

SEQ ID NO: 529713 - RNA, 64 nt, Homo Sapiens; identical to SEQ ID NO: 382187

SEQ ID NO: 529714 - RNA, 64 nt, Homo Sapiens; identical to SEQ ID NO: 382188

SEQ ID NO: 529715 - RNA, 64 nt, Homo Sapiens; identical to SEQ ID NO: 382189

SEQ ID NO: 529716 - RNA, 64 nt, Homo Sapiens; identical to SEQ ID NO: 382190

SEQ ID NO: 529717 - RNA, 64 nt, Homo Sapiens; identical to SEQ ID NO: 382191

SEQ ID NO: 529718 - RNA, 64 nt, Homo Sapiens; identical to SEQ ID NO: 382192

SEQ ID NO: 529719 - RNA, 64 nt, Homo Sapiens
uaguaguuuguuuauaguguauuaacuuuagcuuauguuggaagguacauagaacucuuuauga

SEQ ID NO: 529720 - RNA, 64 nt, Homo Sapiens
ugggaaucagauccaaguuuauaacagacacuauauguuggaguaaaugacacauuggggguaa

SEQ ID NO: 529721 - RNA, 64 nt, Homo Sapiens
aggaugauccuugaaagcccuuuagaagggugccauguuggaaaccuguacauccacaacaagu

SEQ ID NO: 529722 - RNA, 64 nt, Homo Sapiens
accuguacauccacaacaaguagcuuuuccuccuauguuggaaaaaaagacuguuucuuuguuu

SEQ ID NO: 529723 - RNA, 64 nt, Homo Sapiens
caaaaguuggccugaaacccauggauuuaagaccauguuggaucgggacacagcuucuggcacc

SEQ ID NO: 529724 - RNA, 64 nt, Homo Sapiens
cauuucucucuuggucucugauauauguggugaaauguuggaaccuuagacugcguaagaagaa

SEQ ID NO: 529725 - RNA, 64 nt, Homo Sapiens
cucaaacuuaaacuuggauuugaaguuagaagaaauguuggaagucauuuauauaugaagaaau

SEQ ID NO: 529726 - RNA, 64 nt, Homo Sapiens
gaagaaauguuggaagucauuuauauaugaagaaauguuggaaggacucauauaugcauacauu

SEQ ID NO: 529727 - RNA, 64 nt, Homo Sapiens
cuuucaccucauucugguagcagcauaaagguuaggcaaucacugggacccgcaugguguuccu

SEQ ID NO: 529728 - RNA, 64 nt, Homo Sapiens
accuguaaucccagcacuuugggaggccaaggcaggcaaucaccugaggucaggaguucaagac

SEQ ID NO: 529729 - RNA, 64 nt, Homo Sapiens
guuguggcucaaauccucuauauuuuuagccaauggcaaucaaauucuuucagcuccuuuguuu

SEQ ID NO: 529730 - RNA, 64 nt, Homo Sapiens
uuggggucagaguauauguuguuuggagaaagagggcaaucaggacucuucugggacccagaug

SEQ ID NO: 529731 - RNA, 64 nt, Homo Sapiens
guccaaggaccuucccucuucuccccaguuccugggcaaucacuucaccuuggacaaaggauca

SEQ ID NO: 529732 - RNA, 64 nt, Homo Sapiens
ucucaucaggguagcagcagaggcaggaccagaaggcaaucaagagcuuccagaaaugccacac

SEQ ID NO: 529733 - RNA, 64 nt, Homo Sapiens
ucacuugauguaaccuggaaacuaugcuuuacauggcaaucaaagccuuuugaucauguacauu

SEQ ID NO: 529734 - RNA, 64 nt, Homo Sapiens
agccuauuccacauauuuaaaccgcauuaaucauggcaaucaagcccccuuccagauuacuguc

SEQ ID NO: 529735 - RNA, 64 nt, Homo Sapiens
cuacuggaaaaaaaaaaaauuagcuggacaugguggcaaucagcucuagucccaacuacuugga

SEQ ID NO: 529736 - RNA, 56 nt, Homo Sapiens
accuucaggcaacacuuuaaggguucggcaaucacugucacccccggacagcagaa

SEQ ID NO: 529737 - RNA, 64 nt, Homo Sapiens
gauguaacauaaugaaacacaccugucuaggggcggcaaucaacagucuuacacagagagggua

SEQ ID NO: 529738 - RNA, 64 nt, Homo Sapiens
uugaauacuguucugugaccuucuaaaacaggugggcaaucauuuuacauguaaaauuuuagau

SEQ ID NO: 529739 - RNA, 64 nt, Homo Sapiens
uacugauuugcagugaugaacgaauuucccauuuggcaaucauuauuuuauaaauugugugaag

SEQ ID NO: 529740 - RNA, 64 nt, Homo Sapiens
uauucauucaaaagauauuuuaaaagaaguauaaggcaaucauaucuauuagaagauggggaua

SEQ ID NO: 529741 - RNA, 64 nt, Homo Sapiens
aauuuuaaauacaguuaaugaacauggucaaaaaggcaaucagauuguuuugcuauuuagcaau

SEQ ID NO: 529742 - RNA, 64 nt, Homo Sapiens
gccccagagucuccguggucaccacggagcauuuggcaaucaagguuuaaaggccaguccaaac

SEQ ID NO: 529743 - RNA, 64 nt, Homo Sapiens
cccaauagauucaagagaagguagcccccacagaggcaaucaugaacagucacccgugcuggcu

SEQ ID NO: 529744 - RNA, 64 nt, Homo Sapiens
agcaagugaacacuguucuagucgagacuucacgggcaaucaugagcccauaucacauguggau

SEQ ID NO: 529745 - RNA, 64 nt, Homo Sapiens
ucagcuucuucauaacguuuucaaggaaauucuaggcaaucauuccugucaccaaagaacuaaa

SEQ ID NO: 529746 - RNA, 64 nt, Homo Sapiens
augagcuuauccagaacgguggcagagucuccuuggcaaucaaccaacguugcuaugaaauaug

SEQ ID NO: 529747 - RNA, 64 nt, Homo Sapiens
gucucauucugucacccagacuggagugcaggggggcaaucacggcucacuguagucucgaccu

SEQ ID NO: 529748 - RNA, 64 nt, Homo Sapiens
cugcuuccccgagccugacccuguuccgcccacuggcaaucagggcugcgcacuucccugucca

SEQ ID NO: 529749 - RNA, 64 nt, Homo Sapiens
ccaaagcacuguccccaauuuaugaugcuggcauggcaaucagagccacccuucacagauaaaa

SEQ ID NO: 529750 - RNA, 64 nt, Homo Sapiens
cuacugugguuuuacuauguauucugagucacuaggcaaucaauaacacacacaaaauggaaua

SEQ ID NO: 529751 - RNA, 64 nt, Homo Sapiens
auugauuguauguaucacuucagaagcugucugaggcaaucauggugauuuuauacauaaaggc

SEQ ID NO: 529752 - RNA, 64 nt, Homo Sapiens
gguaaggaggauuaggaaugcuauuuuauuuccuggcaaucacggggaugguaauagaaaaaga

SEQ ID NO: 529753 - RNA, 64 nt, Homo Sapiens
aaacguuucuugagcuagacgcgggucuauaacaggcaaucaacaacccucgguguacacagag

SEQ ID NO: 529754 - RNA, 64 nt, Homo Sapiens
gacacuauugggguuucccagcagcccaggauguggcaaucaauagaggugggcgcuagaagau

SEQ ID NO: 529755 - RNA, 52 nt, Homo Sapiens
caucuggcaagaaagcauaaguggcaaucauaaaaaguaauaaagguucuuu

SEQ ID NO: 529756 - RNA, 64 nt, Homo Sapiens
ccuugucauuccuaucucuugaguucuccccagaggcaaucacugcuacugguuguguaucucu

SEQ ID NO: 529757 - RNA, 64 nt, Homo Sapiens
ugauuuguguaaccugaggccaggauuaaggggaggcaaucaaugcaccuagggaaaaaauuua

SEQ ID NO: 529758 - RNA, 64 nt, Homo Sapiens
ggaagugagucagggagggcggaguuuguuguaaggcaaucaccugucaaaacagaaauugggu

SEQ ID NO: 529759 - RNA, 64 nt, Homo Sapiens
gcaacuuuuguacaguauuuaucgagauaaacauggcaaucaaaauguccauuguuuauaagcu

SEQ ID NO: 529760 - RNA, 64 nt, Homo Sapiens
uauuacagaugccgaauaaauuacaucuaaugcaggcaaucauccuucaccaucaacaggagga

SEQ ID NO: 529761 - RNA, 64 nt, Homo Sapiens
aggauuuuuucacuuguguuuguauaaauaugaaggcaaucauauaaauuaagcacaguaaaug

SEQ ID NO: 529762 - RNA, 64 nt, Homo Sapiens
ugaauuuauaaaggagaauauaugaauugauuugggcaaucaaauugauugaaacgagggcagu

SEQ ID NO: 529763 - RNA, 64 nt, Homo Sapiens
agaaacaucugaauaacaacagugaaaauuaguuggcaaucauaaauuugcugcuuguacagaa

SEQ ID NO: 529764 - RNA, 64 nt, Homo Sapiens
agcauagccuugaaggaccuaaguaaagugugugggcaaucagaguaaaauaugaaauacucag

SEQ ID NO: 529765 - RNA, 64 nt, Homo Sapiens
gcaugcacuuguaacaaugaacuucugacauguuggcaaucaaaagccuugccuuuguaauuug

SEQ ID NO: 529766 - RNA, 64 nt, Homo Sapiens
cuucguagcuuggggagguauagcuaugacuuguggcaaucagggcaggauccauuuuugcaga

SEQ ID NO: 529767 - RNA, 64 nt, Homo Sapiens
augcguuugauucugcccacagggccugugccaaggcaaucagaucuuuaugagagcaguauuu

SEQ ID NO: 529768 - RNA, 64 nt, Homo Sapiens
gccuguaauccuagcacuuugggaggcugaggcaggcaaucacuugaggucaggaguucgagac

SEQ ID NO: 529769 - RNA, 64 nt, Homo Sapiens
ccaacaaacuuaaaaguuuaucuaccucguuuuaggcaaucaagauucuggagagucuugaaca

SEQ ID NO: 529770 - RNA, 64 nt, Homo Sapiens
cccuaccacgagcauuaauauauacccaauguguggcaaucagcuuuauuuuucaucucucuga

SEQ ID NO: 529771 - RNA, 64 nt, Homo Sapiens
gcuaauuuuuggucauagaagucauccacaguugggcaaucauaacuuguuauaaugcucuaua

SEQ ID NO: 529772 - RNA, 64 nt, Homo Sapiens
cuagggcagaaagaaguacagaaaggguugguuaggcaaucauuaaaaaaaaaaaaaacaaggg

SEQ ID NO: 529773 - RNA, 64 nt, Homo Sapiens
auuaaaaaguuuuuuuuuuugccuuaaauaauuuggcaaucagaugcuuuccuuuuuuauaccu

SEQ ID NO: 529774 - RNA, 64 nt, Homo Sapiens
gaugaucauuuuuaugugauaaaauuacugaaauggcaaucaaaaaauaacauacccuguauuc

SEQ ID NO: 529775 - RNA, 64 nt, Homo Sapiens
aagcaaccauacuucaccuagagaagacaguauuggcaaucaugacaccuguaauaaaaacuug

SEQ ID NO: 529776 - RNA, 64 nt, Homo Sapiens
auuggguaccacauuuugagaaccauggggcauuggcaaucaacaaaugcaaugcuugugacuu

SEQ ID NO: 529777 - RNA, 64 nt, Homo Sapiens
uggggucccucuuuuggggugcucauggacaaguggcaaucagcaggcuccucuuaccucccaa

SEQ ID NO: 529778 - RNA, 64 nt, Homo Sapiens
uuucuuccuauacauacaaacaggggugggggguggcaaucauuuuaacuaaaaaaguuggcgg

SEQ ID NO: 529779 - RNA, 64 nt, Homo Sapiens
cagaggcguuccuuaagcauugauucccuuauauggcaaucaggcuccacgauuacuagguucu

SEQ ID NO: 529780 - RNA, 64 nt, Homo Sapiens
ggacagcauggaagaugugucuucuggauuuggaggcaaucagcgggauaaaggauuauuuggu

SEQ ID NO: 529781 - RNA, 64 nt, Homo Sapiens
gaagacgccaucagggaagcuaguccacagauuaggcaaucaagugggagaccccuucucugcc

SEQ ID NO: 529782 - RNA, 64 nt, Homo Sapiens
guucacgcaacuugaaauuagauauauuuuccagggcaaucaauagugguaggaaagccucacu

SEQ ID NO: 529783 - RNA, 64 nt, Homo Sapiens
aaaauuugaacacagacuagaaaaucaauuauuaggcaaucagauccuaauuugagcaaaaucu

SEQ ID NO: 529784 - RNA, 64 nt, Homo Sapiens
gugcucagagcaguguuucgagaggcuacuguaaggcaaucaugaacuaggauuguagucccaa

SEQ ID NO: 529785 - RNA, 64 nt, Homo Sapiens
cagaaaaaaaaauaagcuguuugaauuacaucugggcaaucaggagauaauucauuauggcuga

SEQ ID NO: 529786 - RNA, 64 nt, Homo Sapiens
ugagggcaggagaccagccugggaggccaaggcaggcaaucaccgccuguaaucucagcacuuu

SEQ ID NO: 529787 - RNA, 64 nt, Homo Sapiens
uggguggggugggcauuuuguuuauuuguuugguggcaaucagugguaguagggagugggaggg

SEQ ID NO: 529788 - RNA, 64 nt, Homo Sapiens
ucuggccaaggggugggccugugaaucaauccugggcaaucagacacccucuccuuaaaaacug

SEQ ID NO: 529789 - RNA, 64 nt, Homo Sapiens
gcaacucugagauuauaaaacauguaccugcuuuggcaaucauuuucuucuugcuaagucuuac

SEQ ID NO: 529790 - RNA, 64 nt, Homo Sapiens
augagugcagguugaaagaaaauccagaguuccaggcaaucaaaaaagugggauggaagaauua

SEQ ID NO: 529791 - RNA, 64 nt, Homo Sapiens
gcuguuggccucugcaaaggaaauaccaguucugggcaaucaguguuaccguucaccaguugcc

SEQ ID NO: 529792 - RNA, 64 nt, Homo Sapiens
auaaacuauaucaucaccaagagauguuuauuagggcaaucaaaagauuuauuauuuuaaaaaa

SEQ ID NO: 529793 - RNA, 64 nt, Homo Sapiens
ucagcaguguuaauggaagaaauuccuaccaaugggcaaucaaaaaagccagugugagaagaaa

SEQ ID NO: 529794 - RNA, 64 nt, Homo Sapiens
ggagccagcaggcaggcgggaagggccaaguacaggcaaucacccccaucuucuugguuugaag

SEQ ID NO: 529795 - RNA, 64 nt, Homo Sapiens
ucaucuagaccuggcaagaauguauauagaagcaggcaaucacagaaaagcugaagagaauuuu

SEQ ID NO: 529796 - RNA, 64 nt, Homo Sapiens
uauuuuccuugagcauuuauuguuucaccaucugggcaaucauucauuuuguuugcuuugaccc

SEQ ID NO: 529797 - RNA, 64 nt, Homo Sapiens
aaaaaugaucacuaacagcauuguuccuuuugugggcaaucacucaauuuccucauauccagua

SEQ ID NO: 529798 - RNA, 64 nt, Homo Sapiens
cucuaaaccucuaaguccuuauauucauaauaaaggcaaucaaauuguauuguauguacauuuu

SEQ ID NO: 529799 - RNA, 55 nt, Homo Sapiens
cgcagggggccgagggcugaggccaggcaaucacgggcuaugcccggggagcugu

SEQ ID NO: 529800 - RNA, 64 nt, Homo Sapiens
ccuuugaacaaaggucugugugguugucuucacgggcaaucaggaagggagagagcuggggacc

SEQ ID NO: 529801 - RNA, 64 nt, Homo Sapiens
ugucugugcgucuguguguuuauuuggggaaaagggcaaucagcaaucaacugagguuucuuaa

SEQ ID NO: 529802 - RNA, 64 nt, Homo Sapiens
guuauucagaggaguaagauggugauguucaccuggcaaucagcugaguugagacuuuggaaua

SEQ ID NO: 529803 - RNA, 64 nt, Homo Sapiens
uagaucucacagaucuucaacaucagaaaaucagggcaaucauccaugcuucccauacaaagag

SEQ ID NO: 529804 - RNA, 64 nt, Homo Sapiens
gccugagcaaccaaaaggagggaccuggaugacaggcaaucaagcauagacuucucagaccaag

SEQ ID NO: 529805 - RNA, 64 nt, Homo Sapiens
cagguucccuucuaacaacuauuugaccaagagaggcaaucaggggguuguauacugcacugga

SEQ ID NO: 529806 - RNA, 64 nt, Homo Sapiens
uagugaaaguuuauaagaggagcaggggcucuuaggcaaucacaaaaauguggagcagccaaca

SEQ ID NO: 529807 - RNA, 64 nt, Homo Sapiens
uacccucucugaaccuagguugucucugcuuugaggcaaucaagaggagaccuccuuauuaucc

SEQ ID NO: 529808 - RNA, 64 nt, Homo Sapiens
cagauucacagaaaaaaguugacauuucuaccuaggcaaucaguucacugaggccaccgaaaag

SEQ ID NO: 529809 - RNA, 64 nt, Homo Sapiens
gcacuugccauuuaaaaacauuuauggaugucugggcaaucauauucuuacuccauacaagcag

SEQ ID NO: 529810 - RNA, 64 nt, Homo Sapiens
aaccuuuuuguuuuguagccuuaaauaaggcaaaggcaaucaaagcauauuaccuguaacaugu

SEQ ID NO: 529811 - RNA, 64 nt, Homo Sapiens
agagugaggcuucuuuuuucucacuuauuauaauggcaaucagacaaauucaauaguauagcca

SEQ ID NO: 529812 - RNA, 64 nt, Homo Sapiens
uuuuguuuuucagauuuagcauguagacugcuggggcaaucaauggaugaaaguggauuaccac

SEQ ID NO: 529813 - RNA, 64 nt, Homo Sapiens
gaaaucucuuuguaauugcuguaaaugucaucaaggcaaucauagauuucuuuuccauuuugca

SEQ ID NO: 529814 - RNA, 64 nt, Homo Sapiens
uacaacugauuuugaucacagauaaccauuaauaggcaaucauuaaugguuaaugaugguuaau

SEQ ID NO: 529815 - RNA, 64 nt, Homo Sapiens
aaagugcauagauuucuaucugcugggcaauucuggcaaucauuucucuauuuuacugaagcua

SEQ ID NO: 529816 - RNA, 64 nt, Homo Sapiens
aguacgauuuugccgauggaauaacagauuugccggcaaucacugaaagagugcaaauaucggg

SEQ ID NO: 529817 - RNA, 54 nt, Homo Sapiens
gggcuuugcucuuucagugagcuaggcaaucaagucucacagauugcugccuca

SEQ ID NO: 529818 - RNA, 64 nt, Homo Sapiens
gccacacauccauccagucugagaaagugagagaggcaaucaugccaagaacaagccagcaaag

SEQ ID NO: 529819 - RNA, 64 nt, Homo Sapiens
ggcuuaauaauuccuuauagccaauaucaacaguggcaaucagcacacagaggaaaggacccaa

SEQ ID NO: 529820 - RNA, 64 nt, Homo Sapiens
gaaagagugcaaacaucgggauaacagauuugccggcaaucacuaguacgauuuugccgaugga

SEQ ID NO: 529821 - RNA, 64 nt, Homo Sapiens
guggcaucacccauaaaggguuaugcuugugugaggcaaucaugcagucucucguggcgauuga

SEQ ID NO: 529822 - RNA, 64 nt, Homo Sapiens
ggaguuacagccucaagguuguagcaugugugcuggcaaucagggccgcaguguguucugcgcc

SEQ ID NO: 529823 - RNA, 53 nt, Homo Sapiens
cauuuucuggccaguguuuaaauggcaaucaaauaacuauuuccauguguuga

SEQ ID NO: 529824 - RNA, 64 nt, Homo Sapiens
uaagcguuugucucaggggacaguaagggaacggggcaaucauaaauccgcauuuuuauguaaa

SEQ ID NO: 529825 - RNA, 64 nt, Homo Sapiens
ccacaaaauguaaacccaaccuuuauaccacaaaggcaaucagaucccauccuccuccuucaua

SEQ ID NO: 529826 - RNA, 61 nt, Homo Sapiens
uguuguucucugaagauuaagauuuuaggauggcaaucaugucuugauguccugauuuguu

SEQ ID NO: 529827 - RNA, 64 nt, Homo Sapiens
uggaucaucaaggugaaacacuuugguauucuuuggcaaucagugcuccuguaagucaaaugug

SEQ ID NO: 529828 - RNA, 64 nt, Homo Sapiens
ggugcgaugacucugaugccucacucagucucugggcaaucaucaucuuugccucuagccaccg

SEQ ID NO: 529829 - RNA, 64 nt, Homo Sapiens
gacagcaucuccccauucauuuacuuucuuucugggcaaucaauucuaaccuguugucuuucug

SEQ ID NO: 529830 - RNA, 64 nt, Homo Sapiens
acagcuucauuaucugaguuccucacccccuccuggcaaucaauacagcuggacccugcuucac

SEQ ID NO: 529831 - RNA, 64 nt, Homo Sapiens
aaugcauuugcuaagcaaguuuuacugaguuuguggcaaucagguuguucauuugcagccaguu

SEQ ID NO: 529832 - RNA, 64 nt, Homo Sapiens
agaagaagcacuuuguuuuaucagaccuaaagcuggcaaucaggaauuaauccuguuuuacauu

SEQ ID NO: 529833 - RNA, 64 nt, Homo Sapiens
cugaagcgggucuuccuccaagugaagcaagggaggcaaucacaaacugccuggaacuaaaagc

SEQ ID NO: 529834 - RNA, 64 nt, Homo Sapiens
aacccauggguccaguuuaguaacgagugauuuaggcaaucaaugauagguuuauaaucuuaga

SEQ ID NO: 529835 - RNA, 64 nt, Homo Sapiens
uuuuuauucaauuuauuucauucaguuuauucuuggcaaucaaacaucccauaaacuuugcuuu

SEQ ID NO: 529836 - RNA, 64 nt, Homo Sapiens
ggucaccacccccaccccucucuacagacuccagggcaaucaaaguuucccacagggagcugag

SEQ ID NO: 529837 - RNA, 64 nt, Homo Sapiens
gcagacugccuggaggaguggaacucaagugaagggcaaucagggaugaagagggagaauguca

SEQ ID NO: 529838 - RNA, 64 nt, Homo Sapiens
aaucuuuucaucuuuaguuucagcccuaacccuuggcaaucagauuauagucacaaccucuccu

SEQ ID NO: 529839 - RNA, 64 nt, Homo Sapiens
auaaauuauaauuauggacauguaauuuguuuuaggcaaucacugcauuguugggcaauuaguu

SEQ ID NO: 529840 - RNA, 64 nt, Homo Sapiens
uuauaaucuaaucacaauuugucaauauggucuuggcaaucaucugugcauuacucugguuugc

SEQ ID NO: 529841 - RNA, 64 nt, Homo Sapiens
ggcuaugaaagggagcgagccccucggcucuggaggcaaucaagcagacauagaagagccaaga

SEQ ID NO: 529842 - RNA, 64 nt, Homo Sapiens
uaaaacuccaaagaacuccaccccugcugaguuaggcaaucacucaagaagucaagaccacugu

SEQ ID NO: 529843 - RNA, 64 nt, Homo Sapiens
uuccucgacaucuuccuccucuacugguaaccaaggcaaucaggccuaccagaaucgcccagug

SEQ ID NO: 529844 - RNA, 64 nt, Homo Sapiens
ggggacaugggucgcccaugagagcgcagcccgcggcaaucaauaaacagcaggugauacaagc

SEQ ID NO: 529845 - RNA, 64 nt, Homo Sapiens
cccucuccagcgguuccaguuuguggaagucccaggcaaucacuguguccacaugagcgaaccc

SEQ ID NO: 529846 - RNA, 64 nt, Homo Sapiens
aauauuaaagucgguuuaucacucucagccucuuggcaaucauaguaccggaccucauaaaagg

SEQ ID NO: 529847 - RNA, 64 nt, Homo Sapiens
gacacuuuuuuccccuccacaagauucggcuuuuggcaaucacgcugcuguguaauaauaaaga

SEQ ID NO: 529848 - RNA, 64 nt, Homo Sapiens
ugggcugccuuuguccaaggacuccccgugccugggcaaucagaaaaggcaccuuguagcaugu

SEQ ID NO: 529849 - RNA, 64 nt, Homo Sapiens
aucugcagugaugcaauaaccagcauaauaaaaaggcaaucacauaaaaaagaguuuagucguc

SEQ ID NO: 529850 - RNA, 64 nt, Homo Sapiens
accguuuaguuccuaucaucuguggcaugugaagggcaaucacaguguuaaaagaagacaugcu

SEQ ID NO: 529851 - RNA, 64 nt, Homo Sapiens
aauacauauuacaagaaaacuacaggguccacacggcaaucagaagaaaggagcugagaugagg

SEQ ID NO: 529852 - RNA, 64 nt, Homo Sapiens
gguuuauggggagcuuuuguugcacccaugcaggggcaaucagaucagcaucuucaugcaaaaa

SEQ ID NO: 529853 - RNA, 64 nt, Homo Sapiens
gucucccugggaagagagucggagguuaugcuuuggcaaucagccaggaacacucuuuuuaaug

SEQ ID NO: 529854 - RNA, 64 nt, Homo Sapiens
caccucugagccuccuuucuccaugugacuuuggggcaaucaguuaagcuccaccaacuucaag

SEQ ID NO: 529855 - RNA, 64 nt, Homo Sapiens; identical to SEQ ID NO: 243972

SEQ ID NO: 529856 - RNA, 64 nt, Homo Sapiens; identical to SEQ ID NO: 243973

SEQ ID NO: 529857 - RNA, 64 nt, Homo Sapiens; identical to SEQ ID NO: 243974

SEQ ID NO: 529858 - RNA, 64 nt, Homo Sapiens; identical to SEQ ID NO: 243975

SEQ ID NO: 529859 - RNA, 64 nt, Homo Sapiens; identical to SEQ ID NO: 243976

SEQ ID NO: 529860 - RNA, 64 nt, Homo Sapiens; identical to SEQ ID NO: 243977

SEQ ID NO: 529861 - RNA, 64 nt, Homo Sapiens; identical to SEQ ID NO: 243978

SEQ ID NO: 529862 - RNA, 64 nt, Homo Sapiens; identical to SEQ ID NO: 243979

SEQ ID NO: 529863 - RNA, 64 nt, Homo Sapiens; identical to SEQ ID NO: 243980

SEQ ID NO: 529864 - RNA, 64 nt, Homo Sapiens; identical to SEQ ID NO: 243981

SEQ ID NO: 529865 - RNA, 64 nt, Homo Sapiens; identical to SEQ ID NO: 243982

SEQ ID NO: 529866 - RNA, 64 nt, Homo Sapiens; identical to SEQ ID NO: 243983

SEQ ID NO: 529867 - RNA, 64 nt, Homo Sapiens; identical to SEQ ID NO: 243984

SEQ ID NO: 529868 - RNA, 64 nt, Homo Sapiens; identical to SEQ ID NO: 243985

SEQ ID NO: 529869 - RNA, 64 nt, Homo Sapiens; identical to SEQ ID NO: 243986

SEQ ID NO: 529870 - RNA, 64 nt, Homo Sapiens; identical to SEQ ID NO: 243987

SEQ ID NO: 529871 - RNA, 64 nt, Homo Sapiens; identical to SEQ ID NO: 243988

SEQ ID NO: 529872 - RNA, 64 nt, Homo Sapiens; identical to SEQ ID NO: 243989

SEQ ID NO: 529873 - RNA, 64 nt, Homo Sapiens; identical to SEQ ID NO: 286003

SEQ ID NO: 529874 - RNA, 64 nt, Homo Sapiens; identical to SEQ ID NO: 286004

SEQ ID NO: 529875 - RNA, 64 nt, Homo Sapiens; identical to SEQ ID NO: 286005

SEQ ID NO: 529876 - RNA, 64 nt, Homo Sapiens; identical to SEQ ID NO: 286006

SEQ ID NO: 529877 - RNA, 64 nt, Homo Sapiens; identical to SEQ ID NO: 286007

SEQ ID NO: 529878 - RNA, 64 nt, Homo Sapiens; identical to SEQ ID NO: 286008

SEQ ID NO: 529879 - RNA, 64 nt, Homo Sapiens; identical to SEQ ID NO: 286009

SEQ ID NO: 529880 - RNA, 64 nt, Homo Sapiens; identical to SEQ ID NO: 286010

SEQ ID NO: 529881 - RNA, 64 nt, Homo Sapiens; identical to SEQ ID NO: 286011

SEQ ID NO: 529882 - RNA, 64 nt, Homo Sapiens; identical to SEQ ID NO: 286012

SEQ ID NO: 529883 - RNA, 64 nt, Homo Sapiens; identical to SEQ ID NO: 286013

SEQ ID NO: 529884 - RNA, 64 nt, Homo Sapiens; identical to SEQ ID NO: 286014

SEQ ID NO: 529885 - RNA, 64 nt, Homo Sapiens; identical to SEQ ID NO: 286015

SEQ ID NO: 529886 - RNA, 64 nt, Homo Sapiens; identical to SEQ ID NO: 286016

SEQ ID NO: 529887 - RNA, 64 nt, Homo Sapiens; identical to SEQ ID NO: 286017

SEQ ID NO: 529888 - RNA, 64 nt, Homo Sapiens; identical to SEQ ID NO: 286018

SEQ ID NO: 529889 - RNA, 64 nt, Homo Sapiens; identical to SEQ ID NO: 286019

SEQ ID NO: 529890 - RNA, 64 nt, Homo Sapiens; identical to SEQ ID NO: 286020

SEQ ID NO: 529891 - RNA, 64 nt, Homo Sapiens; identical to SEQ ID NO: 286021

SEQ ID NO: 529892 - RNA, 64 nt, Homo Sapiens; identical to SEQ ID NO: 286022

SEQ ID NO: 529893 - RNA, 64 nt, Homo Sapiens; identical to SEQ ID NO: 286023

SEQ ID NO: 529894 - RNA, 64 nt, Homo Sapiens; identical to SEQ ID NO: 286024

SEQ ID NO: 529895 - RNA, 64 nt, Homo Sapiens
agagaaucgagaaauuugauaaaaucaaauauagcuacagcauaaccuuagaacuuuuuaaggu

SEQ ID NO: 529896 - RNA, 64 nt, Homo Sapiens
cgugaugaaacuuaaauauaaaaaggggggggcucuacagcaguugagugccacuauuaaugua

SEQ ID NO: 529897 - RNA, 64 nt, Homo Sapiens
ccccucuacaacauacagccgaaaggauucagcacuacagcauagauucucagauccagguuag

SEQ ID NO: 529898 - RNA, 64 nt, Homo Sapiens
auuuuugcuuuuagaauuuucaaaggagugcugucuacagcaagucaccagguucuagcucugg

SEQ ID NO: 529899 - RNA, 64 nt, Homo Sapiens
uguacacaguucacucuagcucuuaugaaaucuaaacucauauaaacuccaguaaagcuaagug

SEQ ID NO: 529900 - RNA, 64 nt, Homo Sapiens
uaauuucuuaacccauauaaagauuucuaaagacaacucauaaaugcacacaucuaacauuggu

SEQ ID NO: 529901 - RNA, 64 nt, Homo Sapiens
gagcucaaagcaauuaagugcaaaauauuccaggaacucauagcuaauuauagauuugcuugga

SEQ ID NO: 529902 - RNA, 64 nt, Homo Sapiens
cccaugaaaaggaagaacaacuggcuuuggggaaaacucauaucaggaaagacagccauaaauu

SEQ ID NO: 529903 - RNA, 64 nt, Homo Sapiens
uucaucagaagucagcucuaauuguucaccacagaacucauauaagacagaaacccuaugggug

SEQ ID NO: 529904 - RNA, 64 nt, Homo Sapiens
gagcuagaaaaccuggaguguggcauuagaauagaacucauaucuuuuaaauauauaggaacaa

SEQ ID NO: 529905 - RNA, 64 nt, Homo Sapiens
aauaaugcuaugcuguugugaauaccauguuugaaacucauagcugauauuucacauuguauga

SEQ ID NO: 529906 - RNA, 64 nt, Homo Sapiens
ccguagacuacaagaugaaacagccucuauucgcaacucauaaugauaacacuuggggggaccu

SEQ ID NO: 529907 - RNA, 64 nt, Homo Sapiens
guugauauaaucaagauguaaaauaaacucauaaaacucauaaucacuauucucuuugauuaga

SEQ ID NO: 529908 - RNA, 64 nt, Homo Sapiens
acucauaauguugauauaauuugauuagaaaauaaacucauaaaacaggcugacacuauucucu

SEQ ID NO: 529909 - RNA, 64 nt, Homo Sapiens
gcaaagaagcuaugugaaugcaaggacaugaaagaacucauaccucacucauucccguuuccuu

SEQ ID NO: 529910 - RNA, 64 nt, Homo Sapiens
ggagagaagccauaugaaugcaaaaucaugagacaacucauauguuagugaucuuuauucccuu

SEQ ID NO: 529911 - RNA, 64 nt, Homo Sapiens; identical to SEQ ID NO: 502129

SEQ ID NO: 529912 - RNA, 64 nt, Homo Sapiens; identical to SEQ ID NO: 502130

SEQ ID NO: 529913 - RNA, 64 nt, Homo Sapiens; identical to SEQ ID NO: 502131

SEQ ID NO: 529914 - RNA, 64 nt, Homo Sapiens; identical to SEQ ID NO: 502132

SEQ ID NO: 529915 - RNA, 64 nt, Homo Sapiens; identical to SEQ ID NO: 502133

SEQ ID NO: 529916 - RNA, 64 nt, Homo Sapiens
caucaacgucuagcggccccgcgggacuggggacugagcccaggagguuugcacaagccgggcg

SEQ ID NO: 529917 - RNA, 64 nt, Homo Sapiens
cagcuauucuccaggcugaggugggaggaucgcuugagcccaagagguugaggcugcagugagc

SEQ ID NO: 529918 - RNA, 64 nt, Homo Sapiens
caguauuuugggaggccgagguggaaagaucgcuugagcccaggaguucaagaccagccugggc

SEQ ID NO: 529919 - RNA, 64 nt, Homo Sapiens
cagcuauucaggaggcugaggugggaggaucauuugagcccagagguagaggcugcagugagcc

SEQ ID NO: 529920 - RNA, 64 nt, Homo Sapiens
ucgcgacacugcacuccagcggcagagguuucagugagcccagaagaaucacuuggaccuggga

SEQ ID NO: 529921 - RNA, 64 nt, Homo Sapiens
auggauacacagagguugcagccugugaauggcgugagcccauaauacuaggugcucaauucau

SEQ ID NO: 529922 - RNA, 64 nt, Homo Sapiens
aggucaaggcugcagugagcguugcaggaucacuugagcccaggcaucugcuugggaggcugag

SEQ ID NO: 529923 - RNA, 64 nt, Homo Sapiens
aauuugagguuguaguaagcgcagaaggaucacuugagcccaggcagcacuuuggaaggcugag

SEQ ID NO: 529924 - RNA, 64 nt, Homo Sapiens
aguucaaagcuguagugagcacaagaggaucaauugagcccaggcagcuacucaggaagcugag

SEQ ID NO: 529925 - RNA, 64 nt, Homo Sapiens
agguggagguuacagugagcgcaggagaauugcuugagcccaagcagcuacuugggaggcugag

SEQ ID NO: 529926 - RNA, 64 nt, Homo Sapiens
cuacuuuucaguuuuuaacacaggcgugagccacugagcccagccucccaaagugcuaagauua

SEQ ID NO: 529927 - RNA, 64 nt, Homo Sapiens
aguucaagaccagccuggacuaggaggaucgucuugagcccaggaacacuuugggaggcugaag

SEQ ID NO: 529928 - RNA, 64 nt, Homo Sapiens
guggggagauccugggaaggaugggaguucuggcugagcccaggcauggaacuaagccucccaa

SEQ ID NO: 529929 - RNA, 64 nt, Homo Sapiens
agguccacgauggauccaccgacaccacaccacaugagcccaacucaggaagucacagucuccg

SEQ ID NO: 529930 - RNA, 64 nt, Homo Sapiens
uagcacuuugggaggcugaggaggaaggaucacuugagcccagaaguucgagacuagccugggc

SEQ ID NO: 529931 - RNA, 64 nt, Homo Sapiens
cagcauuccgggaggcugaggugggaggaucacuugagcccagggagguuggggcugcagugag

SEQ ID NO: 529932 - RNA, 64 nt, Homo Sapiens
ccacaaccaccaccagugcuaccaccguugccacugagcccacaucccaagagacaggcccaga

SEQ ID NO: 529933 - RNA, 64 nt, Homo Sapiens
agccuaaaggcaaggacagugccaaaagguucugugagcccaucggggagaagaagaguccagc

SEQ ID NO: 529934 - RNA, 64 nt, Homo Sapiens
aguucagggcugcagugagggcaggaggacugcuugagcccaggcagcuacucaagaggcugag

SEQ ID NO: 529935 - RNA, 64 nt, Homo Sapiens
agggcagagcagcauucugaaccacugcgaccccugagcccacaaggcaggccccagugugacc

SEQ ID NO: 529936 - RNA, 64 nt, Homo Sapiens
agguugaggcuggagugagcgcaggaggaucacuugagcccaggcaguuacucaggaggcugag

SEQ ID NO: 529937 - RNA, 64 nt, Homo Sapiens
aguucgagaccagccugggcugugggcggauaguugagcccaggccagcacuuugggaggcuga

SEQ ID NO: 529938 - RNA, 64 nt, Homo Sapiens
aggucgaggcugcagugugcgugggaaaaucacuugagcccaggcagcuacucaggaggcugag

SEQ ID NO: 529939 - RNA, 64 nt, Homo Sapiens
aauuugagaacaggauuuuggcaagcagguuguuugagcccaggcagcacuaugggaggcugag

SEQ ID NO: 529940 - RNA, 64 nt, Homo Sapiens
agguugaggcuguggugauugugggaggauugcuugagcccagccagcuauucaggaggcugag

SEQ ID NO: 529941 - RNA, 64 nt, Homo Sapiens
aguuugagggcagccugggaauaggcggauugcuugagcccagguagcacuuugagaggccgag

SEQ ID NO: 529942 - RNA, 64 nt, Homo Sapiens
uucugauuacucucaauucuaauuguuauauauuugagcccauacaguguauuagguugaacca

SEQ ID NO: 529943 - RNA, 64 nt, Homo Sapiens
augcaagccccucuucuuaaccguuucuuggcuuugagcccagaaacacagcucucccugucuc

SEQ ID NO: 529944 - RNA, 64 nt, Homo Sapiens
caccagcuuuacagggcaguguuucagauggcccugagcccacggaaaaggccagguagaccuc

SEQ ID NO: 529945 - RNA, 64 nt, Homo Sapiens
uguguccucugagcacucuggcauuugucauugcugagcccauaucaguagguccugggacuug

SEQ ID NO: 529946 - RNA, 64 nt, Homo Sapiens
aguuccagaccagccuggccgcagcaggacgacuugagcccaagccagcuacucaggaggcuca

SEQ ID NO: 529947 - RNA, 64 nt, Homo Sapiens
aguucaaggcugcagugaguauggaagaauuaauugagcccacgcaucuagucaggaagcugag

SEQ ID NO: 529948 - RNA, 64 nt, Homo Sapiens
cagcacuuugggaggcugaggugggagaauugccugagcccaggaguucaagaccagcuugugc

SEQ ID NO: 529949 - RNA, 64 nt, Homo Sapiens
caggugcucaggaagcugaggugggaggaucacuugagcccaauucaaagcugcagugagcugu

SEQ ID NO: 529950 - RNA, 64 nt, Homo Sapiens
aggcagagguugcagugagcgugggaggauugcuugagcccaggcagcuacugaggaggcugag

SEQ ID NO: 529951 - RNA, 64 nt, Homo Sapiens
aauucaagaccagccugggcguggguagauuacuugagcccaggcagcacuuugggaggcugag

SEQ ID NO: 529952 - RNA, 64 nt, Homo Sapiens
aggucgaggcugcagugagcgugggaagaucacuugagcccaggcagcuucucaggaggcuggg

SEQ ID NO: 529953 - RNA, 64 nt, Homo Sapiens
aguuugagaccagcuaaggcucgggaggauagcgugagcccaggaaacacuuugggaggcugag

SEQ ID NO: 529954 - RNA, 64 nt, Homo Sapiens
aagccucuccuggggccacuguugggggugggagugagcccaccacagaggccacaggcaggcc

SEQ ID NO: 529955 - RNA, 64 nt, Homo Sapiens
ggguuggguucguaccagcaaguagacuaggaacugagcccaggaaagggggauguuuuccugg

SEQ ID NO: 529956 - RNA, 64 nt, Homo Sapiens
aguugaagaccagccugggcgugggaggaucguuugagcccaggcagcacuuugggaggccaag

SEQ ID NO: 529957 - RNA, 64 nt, Homo Sapiens
gcacugagaccuccacccacuuucgcugagccccugagcccaagaucuaggccuggccgcggcc

SEQ ID NO: 529958 - RNA, 64 nt, Homo Sapiens
aggcagaggcugcagugagcgcaggaggaucgcuugagcccaggagcuacuuugggagguugag

SEQ ID NO: 529959 - RNA, 64 nt, Homo Sapiens
aguuugagaccagccuaggcgugggaggaucgcuugagcccagacauuacuuugggaggcccag

SEQ ID NO: 529960 - RNA, 64 nt, Homo Sapiens
agguugaggcugcagugagcagaggaggcucacuugagcccaggcggucccagcugcucugaua

SEQ ID NO: 529961 - RNA, 64 nt, Homo Sapiens
agguggagguugcagugagcguggauggaucgcuugagcccaggcaccugcucagguggcuagg

SEQ ID NO: 529962 - RNA, 64 nt, Homo Sapiens
uaggaucuugggaggucgaggcaagcugaucgcuugagcccaggaguuuaagaccggccugagu

SEQ ID NO: 529963 - RNA, 64 nt, Homo Sapiens
gagcuacugggggugcugaggugggaggaucgcuugagcccaggagagugaggcugcagugagc

SEQ ID NO: 529964 - RNA, 64 nt, Homo Sapiens
agauugaggcugcagugagcccuugaggaucacuugagcccagguggugggcuacucuggaggc

SEQ ID NO: 529965 - RNA, 64 nt, Homo Sapiens
aguucgacaccagccuggccggugggcaauggcuugagcccagguuguaaucccagcacuuuga

SEQ ID NO: 529966 - RNA, 64 nt, Homo Sapiens
cagcuacuuggggugcugaggcgggaggauuacuugagcccaggaggauuacuucaaccuggga

SEQ ID NO: 529967 - RNA, 64 nt, Homo Sapiens
cuagcacuuuggaggccaaggcaggaggacugcuugagcccaggaguuugagaccagccugggc

SEQ ID NO: 529968 - RNA, 64 nt, Homo Sapiens
cagcacuuugggaggccgaggcaggaagacugcuugagcccaggaguucaagaccagccugggc

SEQ ID NO: 529969 - RNA, 64 nt, Homo Sapiens
cagcuacucaggagguugaggugggaagauugcuugagcccaggaguuugagguugcagugagc

SEQ ID NO: 529970 - RNA, 64 nt, Homo Sapiens
cagugcuuugggaggccauagcaggaggauugcuugagcccaggaguucgagaccagccagagc

SEQ ID NO: 529971 - RNA, 64 nt, Homo Sapiens
cagcuacuugggagguugaggugggaggauugcuugagcccaggauuucaaggcugcagugagc

SEQ ID NO: 529972 - RNA, 64 nt, Homo Sapiens
caauggaaguggccucauggaugaauccgggguaugagcccaggagaacgugcugcuuuuggua

SEQ ID NO: 529973 - RNA, 64 nt, Homo Sapiens
gagaauggcaugaacccgguaggggagcuugcagugagcccagaucaugccacuguacuccagc

SEQ ID NO: 529974 - RNA, 64 nt, Homo Sapiens
aguugaaguccagccuaagcgcaagaggaucgcuugagcccaggcagccacucaggaggcugau

SEQ ID NO: 529975 - RNA, 64 nt, Homo Sapiens
acuggacugaaguucuugcacugcagaagccaggugagcccagcuuuccuaauggccccaucuc

SEQ ID NO: 529976 - RNA, 64 nt, Homo Sapiens
acagccuacaggggaaaaacucauuugauugguuugagcccagacugucaaaauugguuuucac

SEQ ID NO: 529977 - RNA, 64 nt, Homo Sapiens
gaacuugccccuuuucuccucuguuugccuugggugagcccaaaaggggcaggagacacuuggg

SEQ ID NO: 529978 - RNA, 64 nt, Homo Sapiens
agagaguuuuggaauuugacauuggcuggcuggcugagcccauuuucggcucuggagauuaucc

SEQ ID NO: 529979 - RNA, 64 nt, Homo Sapiens
gguuuggccucuaucguuaugcugcagaucaguuugagcccaaggcauccaugaaacauuacag

SEQ ID NO: 529980 - RNA, 64 nt, Homo Sapiens
cagcacugugggagaccacggugggggaaucccuugagcccaggaguuggagagcaacaucaca

SEQ ID NO: 529981 - RNA, 64 nt, Homo Sapiens
cagcuacuugggaggcugaggcaggagaaucgcuugagcccaagagguagagguugcagugagc

SEQ ID NO: 529982 - RNA, 64 nt, Homo Sapiens
agcacuuugguucaaggggcuguuccuugcuuuaugagcccauuggucacuaaaggggugaccu

SEQ ID NO: 529983 - RNA, 64 nt, Homo Sapiens
gguggaaaggggaacugccucccaccuauuuaucugagcccacacuaucugcacuuccaggugc

SEQ ID NO: 529984 - RNA, 64 nt, Homo Sapiens
cagcacgaugggaggccaagacaggcagaucacuugagcccaggaguuugaggccagccugggc

SEQ ID NO: 529985 - RNA, 64 nt, Homo Sapiens
cagcuacucaggaggcaaagaugggaggauuacuugagcccaggaggucaaggcuacagugagc

SEQ ID NO: 529986 - RNA, 64 nt, Homo Sapiens
aggcccagguuacagugagcgugggaggaucgcuugagcccaugcagcuacuauggagguugag

SEQ ID NO: 529987 - RNA, 64 nt, Homo Sapiens
aguuugagaccagccuggccgugggaggaucgcuugagcccaggcaaaacuuuaggaggccaag

SEQ ID NO: 529988 - RNA, 64 nt, Homo Sapiens
cccggccccacucccaccaucucacaccauccuaugagcccacggagccccacuccuggcccca

SEQ ID NO: 529989 - RNA, 64 nt, Homo Sapiens
cccggccccacucacaccaacucccaccauccugugagcccauggagucccacucccagcccca

SEQ ID NO: 529990 - RNA, 64 nt, Homo Sapiens
accccaaacugcucuuuccaugccuuuauauuguugagcccaugcccuuaccccucacugaauc

SEQ ID NO: 529991 - RNA, 64 nt, Homo Sapiens
aguucaaggcugcaaugagcgugggaggaucacuugagcccagacagcuacucaggagguugag

SEQ ID NO: 529992 - RNA, 64 nt, Homo Sapiens
agguugaggcugcagugaggggcuagaggauccuugagcccaggccagcuacucaggaggcuga

SEQ ID NO: 529993 - RNA, 64 nt, Homo Sapiens
aguucaagacuagccuaggcgcaggaggaucacuugagcccaggcagcacuuugggaggcugag

SEQ ID NO: 529994 - RNA, 64 nt, Homo Sapiens
cccacccuucccugggggcggucacugucagagaugagcccaccccucagguggagagccgcau

SEQ ID NO: 529995 - RNA, 64 nt, Homo Sapiens
gcuuucucagcgucagagccugcgucucgccugcugagcccacccucuuuacuccccaccccag

SEQ ID NO: 529996 - RNA, 64 nt, Homo Sapiens
acccuaggaccauggauaccucugugauucacgcugagcccaaguccccacacuggaaaacugg

SEQ ID NO: 529997 - RNA, 64 nt, Homo Sapiens
caucacuuugggaggugcaggcaggcagauggcuugagcccaggaauucaagaccaguccgagc

SEQ ID NO: 529998 - RNA, 64 nt, Homo Sapiens
agccagccagcauggccacccucaagaggcgagaugagcccacagaggcauauccugcggggau

SEQ ID NO: 529999 - RNA, 64 nt, Homo Sapiens
gaugaaugaaugaaugagccaaagaacaaauaaaugagcccacacacccugaacgcaugcgaca

SEQ ID NO: 530000 - RNA, 64 nt, Homo Sapiens
gugggcaccgggccgucucacuccucuccuauggugagcccagcuggggcccccucccucuccu

SEQ ID NO: 530001 - RNA, 64 nt, Homo Sapiens
ccugcagggguggagggcaggguguggcugacucugagcccagggaagcagggccugccuuaca

SEQ ID NO: 530002 - RNA, 64 nt, Homo Sapiens
cuucugacugcauucagcccggacacgggagacuugagcccagcacccucaaggccacccagcu

SEQ ID NO: 530003 - RNA, 64 nt, Homo Sapiens
cacacgcucaaccccaaguccuugcauggucacuugagcccacauuaggaaggaggugacagca

SEQ ID NO: 530004 - RNA, 64 nt, Homo Sapiens
aaacuguugacuugagcuugcccuauuguagauagaagggaaggugucccugucauaaguaccu

SEQ ID NO: 530005 - RNA, 64 nt, Homo Sapiens
ugccugggugggugcuacuugcuaaaaacuugaggaagggaacccugcuggcuaagaccaggga

SEQ ID NO: 530006 - RNA, 64 nt, Homo Sapiens
aagagaaaaacucaagucuauaaauuauaagaaagaagggaaaauuagaguaaaaagccaaauu

SEQ ID NO: 530007 - RNA, 64 nt, Homo Sapiens
gguaggaggcacugggugcuuaccagcugguauagaagggaaugccagaugugaaaugggagcc

SEQ ID NO: 530008 - RNA, 64 nt, Homo Sapiens
uugcuggaaaggugccuuuuugugaggggcagaugaagggaauguggaguccaggaugcccaga

SEQ ID NO: 530009 - RNA, 64 nt, Homo Sapiens
gacuaaccccgggucagccugcagugcugcuggggaagggaaguggccucagagaagcucugac

SEQ ID NO: 530010 - RNA, 64 nt, Homo Sapiens
aaguguuuguguagaagagagaacgagaggaagagaagggaaggcagagaagggaagagaggaa

SEQ ID NO: 530011 - RNA, 64 nt, Homo Sapiens
gaggaagaacgagaggaagaguuggaugaacagagaagggaagaugguuuucuuuuugaggcaa

SEQ ID NO: 530012 - RNA, 64 nt, Homo Sapiens
ccgcagccgacgcccgcuacagauccagacccgggaagggaaguucucaucugguaggaugaaa

SEQ ID NO: 530013 - RNA, 64 nt, Homo Sapiens
gagcaaagagaaaaaccuccagaugguaaagacugaagggaaagucuugccacaucaauauccc

SEQ ID NO: 530014 - RNA, 64 nt, Homo Sapiens
aacugaaaaggguucuggaguguucauucagagugaagggaaaacuuuauccuucuauuucuua

SEQ ID NO: 530015 - RNA, 64 nt, Homo Sapiens
aaaggaaugagaacuuugcaguuggaugaauagagaagggaaaaguugcuggagcacggaguga

SEQ ID NO: 530016 - RNA, 64 nt, Homo Sapiens
gcuuaagcaacagauaaaguuuuuauuuuccucugaagggaaagggcucuuuuccugcuguuuc

SEQ ID NO: 530017 - RNA, 64 nt, Homo Sapiens
uugucugacaaacucuuguguaccuuuguguaaagaagggaagcuuuguuugaaaauuguauuu

SEQ ID NO: 530018 - RNA, 64 nt, Homo Sapiens
auggguccuccagcuagaggggagggaagagguagaagggaaccgacuugccuuaauuuauaaa

SEQ ID NO: 530019 - RNA, 64 nt, Homo Sapiens
gggcugguagugggugggaauccacugagucucugaagggaauaaaacacucugaucuuccuau

SEQ ID NO: 530020 - RNA, 64 nt, Homo Sapiens
ucagcucugcccagggccagccagguucugcugggaagggaagggaauggggagaagggagaag

SEQ ID NO: 530021 - RNA, 64 nt, Homo Sapiens
ucugcccagggccagccagguucugcugggaagggaagggaauggggagaagggagaagcaagc

SEQ ID NO: 530022 - RNA, 64 nt, Homo Sapiens
cagcaguacccccguuuggcacuugaggcacggagaagggaagggaaguccgcccagccagaac

SEQ ID NO: 530023 - RNA, 64 nt, Homo Sapiens
guacccccguuuggcacuugaggcacggagaagggaagggaaguccgcccagccagaacuccca

SEQ ID NO: 530024 - RNA, 64 nt, Homo Sapiens
uuuuccuuuuggaucauagcuuaacaaggcacaggaagggaagggaucuugacuaagauucaug

SEQ ID NO: 530025 - RNA, 64 nt, Homo Sapiens
ugaaaguuggaaggagaagggagggaagagagcagaagggaagaagguguaagucaagcucuug

SEQ ID NO: 530026 - RNA, 64 nt, Homo Sapiens
gccucugccuggaaccuggcucgugcugugaccagaagggaaaggcggcuguuuggcucuuucu

SEQ ID NO: 530027 - RNA, 64 nt, Homo Sapiens
uuugaacagugaugaguuuggggcugguuucugggaagggaacguuuauuuaguaaagagcaga

SEQ ID NO: 530028 - RNA, 64 nt, Homo Sapiens
cuuugauagaacuaaggaaauagugguuuugagugaagggaaaggaaacccagaaacauuuuac

SEQ ID NO: 530029 - RNA, 64 nt, Homo Sapiens
uggggggaggggcggggcaugguacaaccugugggaagggaagcggguucauggcuuugagggc

SEQ ID NO: 530030 - RNA, 64 nt, Homo Sapiens
aacuucuagaaaaugugugugccguagacacaaagaagggaacaauagacaccaggguauacuu

SEQ ID NO: 530031 - RNA, 64 nt, Homo Sapiens
aaggcugagucuagguggagagugcuaccguugagaagggaagagacuguguugggaaaggaua

SEQ ID NO: 530032 - RNA, 64 nt, Homo Sapiens
accagaaguaauuuguguuugucagaacuugcuugaagggaauucaugagauaacacaucaggu

SEQ ID NO: 530033 - RNA, 64 nt, Homo Sapiens
gcgggugaggugguggcccccugauuuacagagggaagggaagccacagagacccugcacagcc

SEQ ID NO: 530034 - RNA, 64 nt, Homo Sapiens
ccaggcggcucucaggggcucucucccggaacuggaagggaaagggaccugagucgggcagccg

SEQ ID NO: 530035 - RNA, 64 nt, Homo Sapiens
gcguguagaacuguggccaggagugacagguagagaagggaagauaguggccgauuugacuuca

SEQ ID NO: 530036 - RNA, 64 nt, Homo Sapiens
auauuugaaauauaaaauauacuguuuuuaucaagaagggaaauuagcugguuagaaaaaugcc

SEQ ID NO: 530037 - RNA, 64 nt, Homo Sapiens
aaguaucuuuaacagcucuugguaauauuaaugagaagggaaaagcauggggauucuuuucuaa

SEQ ID NO: 530038 - RNA, 64 nt, Homo Sapiens
cuccucagcauaacugcucauaaaaacuauccaugaagggaaaguuuuaauacuuaaggcuuug

SEQ ID NO: 530039 - RNA, 64 nt, Homo Sapiens
ucugugccucucugggagaaaggagagaggauaagaagggaaaguucacaaccugugaacaggg

SEQ ID NO: 530040 - RNA, 64 nt, Homo Sapiens
ugggggacagggcccaucuaccagccuucaucaggaagggaaagggcuuuggggucagguggca

SEQ ID NO: 530041 - RNA, 64 nt, Homo Sapiens
auacuuucugaaaccuggagcugggaauugcggagaagggaaggucuagacuaguuacaucaca

SEQ ID NO: 530042 - RNA, 64 nt, Homo Sapiens
gaaaugaguuuugauggugaauugggguguuaaggaagggaaagauugucauagaugguagggc

SEQ ID NO: 530043 - RNA, 64 nt, Homo Sapiens
gucuuuuuguuuuuuuuaagauagcacuugaauagaagggaaaacugcauggcagauacgugac

SEQ ID NO: 530044 - RNA, 64 nt, Homo Sapiens
gagucucaguaaucaagccaauggccuuugucaggaagggaaggggcucaacacagugauggac

SEQ ID NO: 530045 - RNA, 64 nt, Homo Sapiens
ccugcagagggggccaggaugcccccugcccacagaagggaagguggugcccaggagcccucca

SEQ ID NO: 530046 - RNA, 64 nt, Homo Sapiens
gaaggucaugaguucagggugccugcggucugaggaagggaacacggccuugcccaggcaucuc

SEQ ID NO: 530047 - RNA, 64 nt, Homo Sapiens
ugagugugggugccaguccuccucaggagaaggggaagggaaggaggccacuuugagagggcug

SEQ ID NO: 530048 - RNA, 64 nt, Homo Sapiens
guggauagagcagccugcugcucucaggaccagagaagggaaaugacuucuccaggcagaggca

SEQ ID NO: 530049 - RNA, 64 nt, Homo Sapiens
uguauauuuuugguggugguggguuugggguggggaagggaagggcgggcaaggaguggggagg

SEQ ID NO: 530050 - RNA, 64 nt, Homo Sapiens
gugagagguuugcauccacuucaggagcccuacugaagggaacagccugagccgaacauguuau

SEQ ID NO: 530051 - RNA, 64 nt, Homo Sapiens
ggagcuggcccagggcuguguggggcagagaaaggaagggaacuccaugagcacagggcagggc

SEQ ID NO: 530052 - RNA, 64 nt, Homo Sapiens
ugggggcccacuuuuuuguacuccucugccccuggaagggaaugauuugcuuaccuucccguuu

SEQ ID NO: 530053 - RNA, 64 nt, Homo Sapiens
aucuuuuauguuucauuuaccugaggaagggaaggaagggaauaaugaguacauguggacucac

SEQ ID NO: 530054 - RNA, 64 nt, Homo Sapiens
aagggaauaaucuuuuauguuggacucaccugaggaagggaaggugucuccugaugaguacaug

SEQ ID NO: 530055 - RNA, 64 nt, Homo Sapiens
aauugccguuaggcuucacacacaaaccuccuuugaagggaaauaggccuucucuccagcugga

SEQ ID NO: 530056 - RNA, 64 nt, Homo Sapiens
aauaaaucucgcugaauugagguugcaguucagggaagggaaaccccccgcauggcaguuccua

SEQ ID NO: 530057 - RNA, 64 nt, Homo Sapiens
aagggacaagcagguuuauguguuuaaacagaaagaagggaaaagguacuaugugauaugguac

SEQ ID NO: 530058 - RNA, 64 nt, Homo Sapiens
acuuuucaugaauuuugugaacuugccaaaaggggaagggaaaaaucuuuguguuacuucacuc

SEQ ID NO: 530059 - RNA, 64 nt, Homo Sapiens
aagaaguuuggaaaguagauacauaaagacuugagaagggaauuguuuaagggaaaagaaaaga

SEQ ID NO: 530060 - RNA, 64 nt, Homo Sapiens
uucuauaaccaugccauucacuuaaauaauucaugaagggaaugguuuaauuuaaaggaagacc

SEQ ID NO: 530061 - RNA, 64 nt, Homo Sapiens
auuagagguccuugaguagaaccaaggauguuuugaagggaagggaaguuuaaguuaugcauua

SEQ ID NO: 530062 - RNA, 64 nt, Homo Sapiens
agguccuugaguagaaccaaggauguuuugaagggaagggaaguuuaaguuaugcauuauuaua

SEQ ID NO: 530063 - RNA, 64 nt, Homo Sapiens
acgguguccuguggagaccaugccccuuggaagggaagggaagggggcgagggugcguggggcc

SEQ ID NO: 530064 - RNA, 64 nt, Homo Sapiens
gaaggacgguguccuguggagggccugccccuuggaagggaagguuuuugggcgagggugcgug

SEQ ID NO: 530065 - RNA, 64 nt, Homo Sapiens
cugcaagcugaaauuuacagaagcaaauucaccagaagggaaacaucucaggccaacauaggca

SEQ ID NO: 530066 - RNA, 64 nt, Homo Sapiens
ggauuuccuauggaaguccugcuuuauuccaggugaagggaaggaaguguauauacuuuuggca

SEQ ID NO: 530067 - RNA, 64 nt, Homo Sapiens
cauaugaguguucucaccaccacuuaugccccuagaagggaaggggagagggaaacgugcccuc

SEQ ID NO: 530068 - RNA, 64 nt, Homo Sapiens
ggaucaaaaucuguagagcagggcaaguaacauggaagggaagaaaaggugaaaaauuagaaau

SEQ ID NO: 530069 - RNA, 64 nt, Homo Sapiens
cagcugcgacguacugucacugaugagagacugggaagggaaaagcauauauauauagauauau

SEQ ID NO: 530070 - RNA, 64 nt, Homo Sapiens
gaaaagaaagcaagaacagaaaacgaagccacaggaagggaaguagacauuguaugcuuauggu

SEQ ID NO: 530071 - RNA, 64 nt, Homo Sapiens
ccgacccuuuggccucucccuggcccggcuggaugaagggaauguugagaauggcccauacuuc

SEQ ID NO: 530072 - RNA, 64 nt, Homo Sapiens
aagagcaggucuuucaagccagcaggaggguaaagaagggaacuggagccucaucuccauguca

SEQ ID NO: 530073 - RNA, 64 nt, Homo Sapiens
uacucaccuuccuuuagucucguccugugguguugaagggaaaucagccaguuguaaauuuugc

SEQ ID NO: 530074 - RNA, 64 nt, Homo Sapiens
ugugauacagccaucuguaccuacuggagcugcagaagggaaguccacucagucacauccagaa

SEQ ID NO: 530075 - RNA, 64 nt, Homo Sapiens
uuucaaagcacuguguauaaaacaucuaguuuuagaagggaaacaguugaaacuguuuaaaaau

SEQ ID NO: 530076 - RNA, 64 nt, Homo Sapiens
uauguacauacacauacauacauauuaccauacugaagggaaauggauuuauauuugaauuuga

SEQ ID NO: 530077 - RNA, 64 nt, Homo Sapiens
ugcuggaaagagcaucaguaaauuccuguuuguugaagggaaguucugaggaauggacauuucu

SEQ ID NO: 530078 - RNA, 64 nt, Homo Sapiens
gaaauguuugcugaacauuggcuuaccuugguuggaagggaauaccacuugaguuggggccauu

SEQ ID NO: 530079 - RNA, 64 nt, Homo Sapiens
gcagaaggaaggagggaagagaggggagaagaaggaagggaagguuuccuuugggggaggcgga

SEQ ID NO: 530080 - RNA, 64 nt, Homo Sapiens
gagaggcaagcuggcugugagguggcugggaggggaagggaagguucccgaggcuggggcuggg

SEQ ID NO: 530081 - RNA, 64 nt, Homo Sapiens; identical to SEQ ID NO: 129104

SEQ ID NO: 530082 - RNA, 64 nt, Homo Sapiens; identical to SEQ ID NO: 129105

SEQ ID NO: 530083 - RNA, 64 nt, Homo Sapiens; identical to SEQ ID NO: 129106

SEQ ID NO: 530084 - RNA, 64 nt, Homo Sapiens; identical to SEQ ID NO: 129107

SEQ ID NO: 530085 - RNA, 64 nt, Homo Sapiens; identical to SEQ ID NO: 129108

SEQ ID NO: 530086 - RNA, 64 nt, Homo Sapiens; identical to SEQ ID NO: 129109

SEQ ID NO: 530087 - RNA, 64 nt, Homo Sapiens; identical to SEQ ID NO: 129110

SEQ ID NO: 530088 - RNA, 64 nt, Homo Sapiens; identical to SEQ ID NO: 129111

SEQ ID NO: 530089 - RNA, 64 nt, Homo Sapiens
gggagcacuucuuccuuuguuaggcugugcuuuacugauaaaaccaaguauugaauaaagagag

SEQ ID NO: 530090 - RNA, 64 nt, Homo Sapiens
guguuuaaaaaaauguuaugcaauguuuuccaaacugauaaaguuuguaaagugcuauaaaugu

SEQ ID NO: 530091 - RNA, 64 nt, Homo Sapiens
gaucagaucucaugagacuuaaaagcagaaaccccugauaaacuagaaaaaaugaggaagaagc

SEQ ID NO: 530092 - RNA, 64 nt, Homo Sapiens
cauacccgagacugggaagaccguuuucacgcugcugauaaagauaccaauuuacuguauuagu

SEQ ID NO: 530093 - RNA, 64 nt, Homo Sapiens
cguacccgagacugggaagacuguauuaaugcugcugauaaagacuucaagcaucuguauuagu

SEQ ID NO: 530094 - RNA, 64 nt, Homo Sapiens
cacacuagagaaaaaccuuacaaaugugaagcaucugauaaauccugugaagcgucugauaaau

SEQ ID NO: 530095 - RNA, 64 nt, Homo Sapiens
aaaugugaagcaucugauaaauccugugaagcgucugauaaauccuguaguccaagcucaggca

SEQ ID NO: 530096 - RNA, 64 nt, Homo Sapiens
ucuacaggcuauauaaaagaacauggcuuuuugacugauaaaagugauuacagauguuggcuca

SEQ ID NO: 530097 - RNA, 64 nt, Homo Sapiens
ucuaagcaguuucuaagucuccuuccucucccuccugauaaacaucuggaagucaucuuugacu

SEQ ID NO: 530098 - RNA, 64 nt, Homo Sapiens
cgagugcuauuguagucuugucacacaagcauaacugauaaacgaugaauugcaauaaccagcu

SEQ ID NO: 530099 - RNA, 64 nt, Homo Sapiens
ucucuauggcaaagucuuucaaguucauccauuucugauaaaguugcuuauaagaaauaaugaa

SEQ ID NO: 530100 - RNA, 64 nt, Homo Sapiens
gcuaauacagaaauguucaaauaaauguuauucucugauaaagaaggaaaacuuuccaaauaaa

SEQ ID NO: 530101 - RNA, 64 nt, Homo Sapiens
auauaucugguuguauuagucuguuuucacgcugcugauaaagacauaccugagaccaggaaga

SEQ ID NO: 530102 - RNA, 64 nt, Homo Sapiens
uagcaguuuacuguauuagucuguuuucacacugcugauaaagacauuccucaagauugugaag

SEQ ID NO: 530103 - RNA, 64 nt, Homo Sapiens
agagaaaaugaagaagaagcaaaaguggaaaccccugauaaacccaucagaucucaugagacuu

SEQ ID NO: 530104 - RNA, 64 nt, Homo Sapiens
uuaacccucaguaucaagcacaaaaauugauggacugauaaaagaacuaucuuagaacucagaa

SEQ ID NO: 530105 - RNA, 64 nt, Homo Sapiens
ugauagugauaauuccugauuccaagaaugccaucugauaaaaaagaauagaaauggaaagugg

SEQ ID NO: 530106 - RNA, 64 nt, Homo Sapiens
aauuuucuugucuuaguuauauuucugccuagaucugauaaaaaacuuguaaaugaagaucagu

SEQ ID NO: 530107 - RNA, 64 nt, Homo Sapiens
aaggauuuuuauuauguuguaagaauuuuauaaacugauaaauuccuugagauaugguugacga

SEQ ID NO: 530108 - RNA, 64 nt, Homo Sapiens
gaauauuuagaaaggugagacauaauaagcuuaacugauaaacauccagcaacacucuucagua

SEQ ID NO: 530109 - RNA, 64 nt, Homo Sapiens
ugagucugcccucguaugagagggcaaaggcuuacugauaaacucgucuucauucaguucaugc

SEQ ID NO: 530110 - RNA, 64 nt, Homo Sapiens; identical to SEQ ID NO: 124385

SEQ ID NO: 530111 - RNA, 64 nt, Homo Sapiens; identical to SEQ ID NO: 124386

SEQ ID NO: 530112 - RNA, 64 nt, Homo Sapiens; identical to SEQ ID NO: 124387

SEQ ID NO: 530113 - RNA, 64 nt, Homo Sapiens; identical to SEQ ID NO: 124388

SEQ ID NO: 530114 - RNA, 64 nt, Homo Sapiens; identical to SEQ ID NO: 124389

SEQ ID NO: 530115 - RNA, 64 nt, Homo Sapiens; identical to SEQ ID NO: 124390

SEQ ID NO: 530116 - RNA, 64 nt, Homo Sapiens; identical to SEQ ID NO: 124391

SEQ ID NO: 530117 - RNA, 64 nt, Homo Sapiens; identical to SEQ ID NO: 124392

SEQ ID NO: 530118 - RNA, 64 nt, Homo Sapiens; identical to SEQ ID NO: 196118

SEQ ID NO: 530119 - RNA, 64 nt, Homo Sapiens; identical to SEQ ID NO: 196119

SEQ ID NO: 530120 - RNA, 64 nt, Homo Sapiens; identical to SEQ ID NO: 196120

SEQ ID NO: 530121 - RNA, 64 nt, Homo Sapiens; identical to SEQ ID NO: 196121

SEQ ID NO: 530122 - RNA, 64 nt, Homo Sapiens; identical to SEQ ID NO: 196122

SEQ ID NO: 530123 - RNA, 64 nt, Homo Sapiens; identical to SEQ ID NO: 196123

SEQ ID NO: 530124 - RNA, 64 nt, Homo Sapiens; identical to SEQ ID NO: 196124

SEQ ID NO: 530125 - RNA, 64 nt, Homo Sapiens; identical to SEQ ID NO: 196125

SEQ ID NO: 530126 - RNA, 64 nt, Homo Sapiens; identical to SEQ ID NO: 196126

SEQ ID NO: 530127 - RNA, 64 nt, Homo Sapiens; identical to SEQ ID NO: 196127

SEQ ID NO: 530128 - RNA, 64 nt, Homo Sapiens; identical to SEQ ID NO: 196128

SEQ ID NO: 530129 - RNA, 64 nt, Homo Sapiens; identical to SEQ ID NO: 196129

SEQ ID NO: 530130 - RNA, 64 nt, Homo Sapiens; identical to SEQ ID NO: 196130

SEQ ID NO: 530131 - RNA, 64 nt, Homo Sapiens; identical to SEQ ID NO: 196131

SEQ ID NO: 530132 - RNA, 64 nt, Homo Sapiens; identical to SEQ ID NO: 196132

SEQ ID NO: 530133 - RNA, 64 nt, Homo Sapiens; identical to SEQ ID NO: 196133

SEQ ID NO: 530134 - RNA, 64 nt, Homo Sapiens; identical to SEQ ID NO: 196134

SEQ ID NO: 530135 - RNA, 64 nt, Homo Sapiens; identical to SEQ ID NO: 196135

SEQ ID NO: 530136 - RNA, 64 nt, Homo Sapiens; identical to SEQ ID NO: 196136

SEQ ID NO: 530137 - RNA, 64 nt, Homo Sapiens; identical to SEQ ID NO: 196137

SEQ ID NO: 530138 - RNA, 64 nt, Homo Sapiens; identical to SEQ ID NO: 196138

SEQ ID NO: 530139 - RNA, 64 nt, Homo Sapiens; identical to SEQ ID NO: 196139

SEQ ID NO: 530140 - RNA, 64 nt, Homo Sapiens; identical to SEQ ID NO: 196140

SEQ ID NO: 530141 - RNA, 64 nt, Homo Sapiens; identical to SEQ ID NO: 196141

SEQ ID NO: 530142 - RNA, 64 nt, Homo Sapiens; identical to SEQ ID NO: 196142

SEQ ID NO: 530143 - RNA, 64 nt, Homo Sapiens; identical to SEQ ID NO: 196143

SEQ ID NO: 530144 - RNA, 64 nt, Homo Sapiens; identical to SEQ ID NO: 196144

SEQ ID NO: 530145 - RNA, 64 nt, Homo Sapiens; identical to SEQ ID NO: 196145

SEQ ID NO: 530146 - RNA, 64 nt, Homo Sapiens; identical to SEQ ID NO: 196146

SEQ ID NO: 530147 - RNA, 64 nt, Homo Sapiens; identical to SEQ ID NO: 196147

SEQ ID NO: 530148 - RNA, 64 nt, Homo Sapiens; identical to SEQ ID NO: 196148

SEQ ID NO: 530149 - RNA, 64 nt, Homo Sapiens; identical to SEQ ID NO: 196149

SEQ ID NO: 530150 - RNA, 64 nt, Homo Sapiens; identical to SEQ ID NO: 196150

SEQ ID NO: 530151 - RNA, 64 nt, Homo Sapiens; identical to SEQ ID NO: 196151

SEQ ID NO: 530152 - RNA, 64 nt, Homo Sapiens; identical to SEQ ID NO: 196152

SEQ ID NO: 530153 - RNA, 64 nt, Homo Sapiens; identical to SEQ ID NO: 196153

SEQ ID NO: 530154 - RNA, 64 nt, Homo Sapiens; identical to SEQ ID NO: 196154

SEQ ID NO: 530155 - RNA, 64 nt, Homo Sapiens; identical to SEQ ID NO: 196155

SEQ ID NO: 530156 - RNA, 64 nt, Homo Sapiens; identical to SEQ ID NO: 196156

SEQ ID NO: 530157 - RNA, 64 nt, Homo Sapiens; identical to SEQ ID NO: 196157

SEQ ID NO: 530158 - RNA, 64 nt, Homo Sapiens; identical to SEQ ID NO: 196158

SEQ ID NO: 530159 - RNA, 64 nt, Homo Sapiens; identical to SEQ ID NO: 196159

SEQ ID NO: 530160 - RNA, 64 nt, Homo Sapiens; identical to SEQ ID NO: 196160

SEQ ID NO: 530161 - RNA, 64 nt, Homo Sapiens; identical to SEQ ID NO: 196161

SEQ ID NO: 530162 - RNA, 64 nt, Homo Sapiens; identical to SEQ ID NO: 388383

SEQ ID NO: 530163 - RNA, 64 nt, Homo Sapiens; identical to SEQ ID NO: 388384

SEQ ID NO: 530164 - RNA, 64 nt, Homo Sapiens; identical to SEQ ID NO: 388385

SEQ ID NO: 530165 - RNA, 64 nt, Homo Sapiens; identical to SEQ ID NO: 388386

SEQ ID NO: 530166 - RNA, 64 nt, Homo Sapiens; identical to SEQ ID NO: 388387

SEQ ID NO: 530167 - RNA, 64 nt, Homo Sapiens; identical to SEQ ID NO: 388388

SEQ ID NO: 530168 - RNA, 64 nt, Homo Sapiens; identical to SEQ ID NO: 388389

SEQ ID NO: 530169 - RNA, 64 nt, Homo Sapiens; identical to SEQ ID NO: 388390

SEQ ID NO: 530170 - RNA, 64 nt, Homo Sapiens; identical to SEQ ID NO: 388391

SEQ ID NO: 530171 - RNA, 64 nt, Homo Sapiens; identical to SEQ ID NO: 388392

SEQ ID NO: 530172 - RNA, 64 nt, Homo Sapiens; identical to SEQ ID NO: 388393

SEQ ID NO: 530173 - RNA, 64 nt, Homo Sapiens; identical to SEQ ID NO: 388394

SEQ ID NO: 530174 - RNA, 64 nt, Homo Sapiens; identical to SEQ ID NO: 388395

SEQ ID NO: 530175 - RNA, 64 nt, Homo Sapiens; identical to SEQ ID NO: 388396

SEQ ID NO: 530176 - RNA, 64 nt, Homo Sapiens; identical to SEQ ID NO: 388397

SEQ ID NO: 530177 - RNA, 64 nt, Homo Sapiens; identical to SEQ ID NO: 388398

SEQ ID NO: 530178 - RNA, 64 nt, Homo Sapiens; identical to SEQ ID NO: 388399

SEQ ID NO: 530179 - RNA, 64 nt, Homo Sapiens; identical to SEQ ID NO: 388400

SEQ ID NO: 530180 - RNA, 64 nt, Homo Sapiens; identical to SEQ ID NO: 388401

SEQ ID NO: 530181 - RNA, 64 nt, Homo Sapiens; identical to SEQ ID NO: 388402

SEQ ID NO: 530182 - RNA, 64 nt, Homo Sapiens; identical to SEQ ID NO: 388403

SEQ ID NO: 530183 - RNA, 64 nt, Homo Sapiens; identical to SEQ ID NO: 388404

SEQ ID NO: 530184 - RNA, 64 nt, Homo Sapiens; identical to SEQ ID NO: 388405

SEQ ID NO: 530185 - RNA, 64 nt, Homo Sapiens; identical to SEQ ID NO: 388406

SEQ ID NO: 530186 - RNA, 64 nt, Homo Sapiens; identical to SEQ ID NO: 388407

SEQ ID NO: 530187 - RNA, 64 nt, Homo Sapiens; identical to SEQ ID NO: 388408

SEQ ID NO: 530188 - RNA, 64 nt, Homo Sapiens; identical to SEQ ID NO: 388409

SEQ ID NO: 530189 - RNA, 64 nt, Homo Sapiens; identical to SEQ ID NO: 388410

SEQ ID NO: 530190 - RNA, 64 nt, Homo Sapiens; identical to SEQ ID NO: 388411

SEQ ID NO: 530191 - RNA, 63 nt, Homo Sapiens
uggagggcuuccagcuauaauaucugccuccagggaggggaggggaugggaagcaccaccagc

SEQ ID NO: 530192 - RNA, 64 nt, Homo Sapiens
gggcuuccagcuauaauaucugccuccagggaggggaggggaugggaagcaccaccagccagcg

SEQ ID NO: 530193 - RNA, 64 nt, Homo Sapiens
uugagcagacgguauauuccagaggugggaggugggaggggaagggagaaauccaaaacaaagu

SEQ ID NO: 530194 - RNA, 64 nt, Homo Sapiens
auucucagcucuugggaacccccuugcucccaggggaggggaaaccuuuuucauucaacauugu

SEQ ID NO: 530195 - RNA, 64 nt, Homo Sapiens
gcuuuggugcgcccccugcugaggagcagccccaggaggggaccagaggggaugcugugucgcu

SEQ ID NO: 530196 - RNA, 64 nt, Homo Sapiens
ccaucucuuguaccagcccaggcaauaguguugaggaggggagcaaggcugcuaaguggaagac

SEQ ID NO: 530197 - RNA, 64 nt, Homo Sapiens
accgggcuggccugacacaaugguagcucugaagggaggggaagagagaggccugggugugacc

SEQ ID NO: 530198 - RNA, 64 nt, Homo Sapiens
gcauuaacuuauugucuaggccagagcgggggugggaggggaaugccacagugaagggaguggc

SEQ ID NO: 530199 - RNA, 64 nt, Homo Sapiens
ggagcuuuuaggaugugggaguaaaacuuuaaugggaggggagggcuggcugcuggaagaagga

SEQ ID NO: 530200 - RNA, 64 nt, Homo Sapiens
aaugacacaaauggcagggagcagucaagggcagggaggggaggagaugacugccauguacacu

SEQ ID NO: 530201 - RNA, 64 nt, Homo Sapiens
gccuggggcugcccagagacuagaaucagaguggggaggggacagagguccaaggucuuugucc

SEQ ID NO: 530202 - RNA, 64 nt, Homo Sapiens
augauggugguguugaugguggcggugguaggguggaggggagagaagaagaugcugaugauau

SEQ ID NO: 530203 - RNA, 64 nt, Homo Sapiens
gugauugcaacaaaggcagagggggcggggcgggggaggggagguaggacccgcuccggaaggc

SEQ ID NO: 530204 - RNA, 64 nt, Homo Sapiens
cgcccagcuuucccaggggcacagcucuaggcugggaggggagaaccagccccucccccugccc

SEQ ID NO: 530205 - RNA, 64 nt, Homo Sapiens
agggccccuaccaaccuuugccucugccuuggagggaggggaggucuguuaccacuggggaagg

SEQ ID NO: 530206 - RNA, 64 nt, Homo Sapiens
gggauaggaccgggggaccccagagggaggccuaggaggggacugcacccauacugcuucccua

SEQ ID NO: 530207 - RNA, 64 nt, Homo Sapiens
guuccaacaggacagcgccuucccccaugcgcugggaggggacccuccauuucucccccucacc

SEQ ID NO: 530208 - RNA, 64 nt, Homo Sapiens
cuccuccucccugccuggggagcccaguggccagggaggggagugguggagccagucgcuguaa

SEQ ID NO: 530209 - RNA, 64 nt, Homo Sapiens
cagaggggauuaaagaggggcugaagagcagaagggaggggagaagaggaggaaaggauggggg

SEQ ID NO: 530210 - RNA, 64 nt, Homo Sapiens
aaaagauaaaaagcaagccaccaagacaaagaaaggaggggaaagauucccuccauuaaaacaa

SEQ ID NO: 530211 - RNA, 64 nt, Homo Sapiens
gcgguccuuugauaagacccgcgccccuagucagggaggggaugagccucccuucaaaaagaca

SEQ ID NO: 530212 - RNA, 64 nt, Homo Sapiens
cgaggaagaguaauauuuagcaugaccuaccucaggaggggaggagaccggccaggaauguuug

SEQ ID NO: 530213 - RNA, 64 nt, Homo Sapiens
uaccagaauacaguuuauuucacucuuguugcggggaggggauuaccucaauguagguacauua

SEQ ID NO: 530214 - RNA, 64 nt, Homo Sapiens
gauuuuuuauguucuucugugagugggaggagagggaggggaggacacgggcgccuucccgggg

SEQ ID NO: 530215 - RNA, 64 nt, Homo Sapiens
uguguguuuuuucuuuuuuuuuaaguucuuaugaggaggggaggguaaauaaaccacugugcgu

SEQ ID NO: 530216 - RNA, 64 nt, Homo Sapiens
uuauucucugcuauauauaaaacggugcugugagggaggggaaaagcauuuuucaauauauuga

SEQ ID NO: 530217 - RNA, 64 nt, Homo Sapiens
cuugcuagacaaacauaaaggggcaggguuguggggaggggaacguuuuugguggugugugcag

SEQ ID NO: 530218 - RNA, 64 nt, Homo Sapiens
uaucaguagguccugggacuugacaaaguaugugggaggggaaggaaggacagaacuugacugg

SEQ ID NO: 530219 - RNA, 64 nt, Homo Sapiens
gaggguaacauuuccauuuccuggacagcagggaggaggggaguggcuggagguggcauccaca

SEQ ID NO: 530220 - RNA, 64 nt, Homo Sapiens
gaacacugggguuuaggaccucacccggaaccugggaggggaggauagcgcuucucaaugugug

SEQ ID NO: 530221 - RNA, 64 nt, Homo Sapiens
gcuuucacgcccacccaccccagugcuguccaguggaggggaggcuggucccucagcugggggg

SEQ ID NO: 530222 - RNA, 63 nt, Homo Sapiens
gggcuccuggcaaggccugaccccaugguggggggaggggaggggaggggagggaaugaggca

SEQ ID NO: 530223 - RNA, 64 nt, Homo Sapiens
uccuggcaaggccugaccccaugguggggggaggggaggggaggggagggaaugaggcagcucu

SEQ ID NO: 530224 - RNA, 64 nt, Homo Sapiens
gcaaggccugaccccaugguggggggaggggaggggaggggagggaaugaggcagcucuaggau

SEQ ID NO: 530225 - RNA, 64 nt, Homo Sapiens
cccauuuuggccuccccugccccccuuguuauggggaggggaccccgggugagggggcccuauu

SEQ ID NO: 530226 - RNA, 64 nt, Homo Sapiens
uaggauggaugggguuugggguggguaggccaugggaggggagaagccccuccuuggcaccccc

SEQ ID NO: 530227 - RNA, 64 nt, Homo Sapiens
cuuccgcuccugcccagccugggggaaggagaaaggaggggagaaagcgggcucucacccccuc

SEQ ID NO: 530228 - RNA, 64 nt, Homo Sapiens
auucaccgggcccugugugugucaccgaggugcgggaggggaggagcauuaaagcugaaagauc

SEQ ID NO: 530229 - RNA, 64 nt, Homo Sapiens
caaggcccagggaagaguguauuuggggagcaggggaggggaggguguugagaaagcugaacug

SEQ ID NO: 530230 - RNA, 64 nt, Homo Sapiens
ucaaaguggaugcaauuuuucuuucuuuuguuggggaggggaaugggaggggaaaugggaauau

SEQ ID NO: 530231 - RNA, 64 nt, Homo Sapiens
gcaauuuuucuuucuuuuguuggggaggggaaugggaggggaaaugggaauauaauauugucuc

SEQ ID NO: 530232 - RNA, 64 nt, Homo Sapiens
ggagggcuuuuaauuuauuuaacgaacccuggcuggaggggauaccuggggaguuggggaaagg

SEQ ID NO: 530233 - RNA, 64 nt, Homo Sapiens
auuccauccccaguggagucucagccuacacaagggaggggaacucccccucaucuccagugac

SEQ ID NO: 530234 - RNA, 64 nt, Homo Sapiens
aguguugaugccaaaauaccacugggaugggaggggaggggagcugcaauucuaaacugcagug

SEQ ID NO: 530235 - RNA, 64 nt, Homo Sapiens
ggagcaguguugaugccaaacagugacugggaugggaggggagguggcaugcaauucuaaacug

SEQ ID NO: 530236 - RNA, 64 nt, Homo Sapiens
gaccaaaaagggggaauaugggagggcagaguggggaggggaguccaugggccuggggccccaa

SEQ ID NO: 530237 - RNA, 64 nt, Homo Sapiens
aaucaaaagggguucaaaccccaccucaguagguggaggggagcgccugccauugguuguauuu

SEQ ID NO: 530238 - RNA, 64 nt, Homo Sapiens
uccacguagggggcaggggcaggggcgggcggagggaggggaggggugaaauccauacuguaga

SEQ ID NO: 530239 - RNA, 64 nt, Homo Sapiens
accccuggccacagccuucccucugcauugaccuggaggggagaggucagccuugaccuaauga

SEQ ID NO: 530240 - RNA, 64 nt, Homo Sapiens
auggccaggggccaggaguggggagaguugugauggaggggagaggggucacacccacccccug

SEQ ID NO: 530241 - RNA, 64 nt, Homo Sapiens
uccugaggggacugcugcccuuuccaggcagagaggaggggaggacuacggguucuccagcucc

SEQ ID NO: 530242 - RNA, 64 nt, Homo Sapiens
caccccaguguccacuuuuggaggccgaggugguggaggggaugcuguacugaggacagcggug

SEQ ID NO: 530243 - RNA, 64 nt, Homo Sapiens
gagcaguggcugauggggacacugagauaagaucggaggggagcugucaaugccagaagugguu

SEQ ID NO: 530244 - RNA, 64 nt, Homo Sapiens
ggcggugguggggaggaggggugcgccauggccuggaggggaguguguguuggggugugugugu

SEQ ID NO: 530245 - RNA, 64 nt, Homo Sapiens
agggccugagcuggacaggggagcuccuaguaggggaggggaggggaugcugggaucuagguga

SEQ ID NO: 530246 - RNA, 64 nt, Homo Sapiens
cugagcuggacaggggagcuccuaguaggggaggggaggggaugcugggaucuaggugacaugc

SEQ ID NO: 530247 - RNA, 64 nt, Homo Sapiens
gucugggaacuugcgaguccgccugcugagaugaggaggggagccccacaugccugcgccugcu

SEQ ID NO: 530248 - RNA, 64 nt, Homo Sapiens
gacaggcagcccagcagugugcaagccacaggaaggaggggagaucagggcugucccagccccg

SEQ ID NO: 530249 - RNA, 64 nt, Homo Sapiens
gugugggcaagagacuuccugaaggcggaaggagggaggggaacgaaagccccacgguggguca

SEQ ID NO: 530250 - RNA, 64 nt, Homo Sapiens
gccauggaaaggagaguuugaagccauuggaugaggaggggacucaucucaucgagguguggua

SEQ ID NO: 530251 - RNA, 64 nt, Homo Sapiens
uauauugaauuuuauauuucauauucuuuuggggggaggggaacauuaagguguuguauaaaua

SEQ ID NO: 530252 - RNA, 64 nt, Homo Sapiens
guuuaaaaucccagcugggcugauguagaaugagggaggggaaaaucggagcuuuuuaaagaac

SEQ ID NO: 530253 - RNA, 64 nt, Homo Sapiens
gcccagccagcccgugacagcuucccccuaaucaggaggggacagcugggggcgcaagcuggug

SEQ ID NO: 530254 - RNA, 64 nt, Homo Sapiens
ggaccugcagccaucugugaggcccgcggggaugggaggggaggaggguggccuguugguuucc

SEQ ID NO: 530255 - RNA, 64 nt, Homo Sapiens
cccauccugggggaugcuggguguccugagugaaggaggggaccugcaggucugcggaggggaa

SEQ ID NO: 530256 - RNA, 64 nt, Homo Sapiens
uguccugagugaaggaggggacgugcaggucugcggaggggaagugaaaugagaaaggcccaga

SEQ ID NO: 530257 - RNA, 64 nt, Homo Sapiens
acugcccucgggcgucuggcagccugagguggguggaggggacaguguucuggauagaucuauu

SEQ ID NO: 530258 - RNA, 64 nt, Homo Sapiens
cagugaggugugcaagggugcacugaggguggugggaggggaucaccuggguuccaggccaucc

SEQ ID NO: 530259 - RNA, 64 nt, Homo Sapiens
acuauuccggcuuuuuauauggcaccuuucugagggaggggauuuuacagccgagggaccucca

SEQ ID NO: 530260 - RNA, 64 nt, Homo Sapiens
cugccuguuuuuacuuagaaagcaggcuugggcaggaggggaaauggauuugaaccaucucaga

SEQ ID NO: 530261 - RNA, 64 nt, Homo Sapiens
ucaagguuuggguggggacucccuguuggggaggggaggggagcgagaacccagaggaucuagg

SEQ ID NO: 530262 - RNA, 64 nt, Homo Sapiens
ggagcucaagguuuggguggcuaggcccuguuggggaggggagggcauggagaacccagaggau

SEQ ID NO: 530263 - RNA, 64 nt, Homo Sapiens
ugcccuucuccacuccucucaagucuugagcggaggaggggaucgugggagagagugugguggg

SEQ ID NO: 530264 - RNA, 64 nt, Homo Sapiens
cugaggcguuuggccccggccgauguggacccggggaggggagggccacucccucuccagcccc

SEQ ID NO: 530265 - RNA, 64 nt, Homo Sapiens
acccugagggcucagccagggcccccugccauagggaggggaggaugcacaacgcccggccuga

SEQ ID NO: 530266 - RNA, 64 nt, Homo Sapiens
cugaggcccaaaggcagaacagccagagggggcaggaggggaccaaaaaggaaaaugaggacgu

SEQ ID NO: 530267 - RNA, 64 nt, Homo Sapiens
cuguuggucccuguccuugcugcccaggcagcguggaggggaaggguagggcagccagagaaag

SEQ ID NO: 530268 - RNA, 64 nt, Homo Sapiens
cagguaguaggugccagccuaggggagcuuccaaggaggggaaggcaaagcccuggccccugcc

SEQ ID NO: 530269 - RNA, 64 nt, Homo Sapiens
ccaggauguggcuucucaugaagcucuggccagaggaggggaacuuauugggggagggggggug

SEQ ID NO: 530270 - RNA, 64 nt, Homo Sapiens
ccagaggaggggaacuuauugggggaggggggguggaggggaggaaucuggaccucuaagucau

SEQ ID NO: 530271 - RNA, 64 nt, Homo Sapiens
guaaagcugagaucuaaauggggacaaggcagguggaggggaggccaguguacauguaaaugcc

SEQ ID NO: 530272 - RNA, 64 nt, Homo Sapiens
uagauuuucugccagaggggugggucagagcaguggaggggagacaucgcccaugugcuucugc

SEQ ID NO: 530273 - RNA, 64 nt, Homo Sapiens
gagcacaggaacagccuugauugaaggcuuuguuggaggggacauuuccucauuugucucuaag

SEQ ID NO: 530274 - RNA, 64 nt, Homo Sapiens
gggaagagguacaggcggugggcgggggugggguggaggggagggcgggcuggugcgcggaggg

SEQ ID NO: 530275 - RNA, 64 nt, Homo Sapiens
aguccuuugggguugagggagaugggagcuagggggaggggagggagaugucuuguugugggga

SEQ ID NO: 530276 - RNA, 64 nt, Homo Sapiens
ugucucaaaccaaaguuaacagggagaggaugggggaggggacaaauuagaauaggauagcauc

SEQ ID NO: 530277 - RNA, 64 nt, Homo Sapiens
uaagaccuaucaugccaagaaugucacagaucugggaggggacugaggaaaagacaccugucaa

SEQ ID NO: 530278 - RNA, 64 nt, Homo Sapiens
gaugggcggccccgccccagccugggaggcacagggaggggagacuggcgcuggacuugggcga

SEQ ID NO: 530279 - RNA, 64 nt, Homo Sapiens
cagggagugcggggaugcggaucagcugggaggaggaggggaggggaacuuccacccgagggga

SEQ ID NO: 530280 - RNA, 64 nt, Homo Sapiens
agugcggggaugcggaucagcugggaggaggaggggaggggaacuuccacccgaggggaagaug

SEQ ID NO: 530281 - RNA, 64 nt, Homo Sapiens
uuuguggggagggagcauuuuugguggucuugggggaggggaggggagggaagggcugguguug

SEQ ID NO: 530282 - RNA, 64 nt, Homo Sapiens
ggggagggagcauuuuugguggucuugggggaggggaggggagggaagggcugguguugauuuu

SEQ ID NO: 530283 - RNA, 64 nt, Homo Sapiens
auguuuuguguugguguuuccuauuuucugcacuggaggggaggggacuguugagguucugucu

SEQ ID NO: 530284 - RNA, 64 nt, Homo Sapiens
uuguguugguguuuccuauuuucugcacuggaggggaggggacuguugagguucugucuuuuuu

SEQ ID NO: 530285 - RNA, 64 nt, Homo Sapiens
uccucugaccugaugguguugggguuuggguaggggaggggagcucggcugucagaacuccaug

SEQ ID NO: 530286 - RNA, 64 nt, Homo Sapiens
gcugucagaacuccauggauauguuucuuuggauggaggggagggccuuuguuaccuuuugcac

SEQ ID NO: 530287 - RNA, 64 nt, Homo Sapiens
gagcugaggauuuccuggagcgagggggccggggggaggggacaggggcaggggccugggccgg

SEQ ID NO: 530288 - RNA, 64 nt, Homo Sapiens
uggggaaagcagaacugaagcuucccaggccuuuggaggggaaaccuccggagccucauguucu

SEQ ID NO: 530289 - RNA, 64 nt, Homo Sapiens
caggaccauaggaagguccuuccacccuugguggggaggggaccccuuuuuguguccucggccc

SEQ ID NO: 530290 - RNA, 64 nt, Homo Sapiens
aggcccccuuguccacuccauugcuucuggccagggaggggauccccuugcccaugccuggacc

SEQ ID NO: 530291 - RNA, 64 nt, Homo Sapiens
uaauaaggagggcugcugggcugcauucuggaggggaggggagauagaggcuggaaaguguccc

SEQ ID NO: 530292 - RNA, 64 nt, Homo Sapiens
ggagauaauaaggagggcugguccccugcauucuggaggggaggcaacguagaggcuggaaagu

SEQ ID NO: 530293 - RNA, 64 nt, Homo Sapiens
aagggagauggguagcaucaggagggagggauggggaggggagauuacugguguauuauuuggg

SEQ ID NO: 530294 - RNA, 64 nt, Homo Sapiens
ggggauaaguguuucaaggcacacccaucccaguggaggggaaauuucaagcuguauaguuugc

SEQ ID NO: 530295 - RNA, 64 nt, Homo Sapiens
aaguagggaaggggguggccgggugggcaacagaggaggggagccacuuccaccgugggguugg

SEQ ID NO: 530296 - RNA, 64 nt, Homo Sapiens
cuuuauuuauagaaaugacaaacgcagaagagggggaggggaagccacacuuuauauacgaaua

SEQ ID NO: 530297 - RNA, 64 nt, Homo Sapiens
caauucucugccccaggcuaauauuagggacuggggaggggaccaccagaggggagagggaagc

SEQ ID NO: 530298 - RNA, 64 nt, Homo Sapiens
gucaggccucagcaucucacauccaccaccuccaggaggggagaccacugguaaguccuccucc

SEQ ID NO: 530299 - RNA, 64 nt, Homo Sapiens
cugcaggccaggagggccuccuuccugccacgagggaggggagucgggccccaggucgcccccg

SEQ ID NO: 530300 - RNA, 64 nt, Homo Sapiens
cuguccagagggucuucagaagccccccugggagggaggggaggaugagcacgcccagcucccc

SEQ ID NO: 530301 - RNA, 64 nt, Homo Sapiens
agcuggcggagggagggaagaggagggagugacgggaggggaggaggucagcgaccuggggccg

SEQ ID NO: 530302 - RNA, 64 nt, Homo Sapiens
cggcacuucuaguggucucaccuggaggcaagagggaggggacagaggcccugccacgucccgc

SEQ ID NO: 530303 - RNA, 64 nt, Homo Sapiens
cucuggagguacugagacagggugcugaugggaaggaggggagccuuuggggggccacccgggg

SEQ ID NO: 530304 - RNA, 64 nt, Homo Sapiens
ucccuuccucccaaaaguaucgggggcuggggcaggaggggagugaggcaggugacagugaggu

SEQ ID NO: 530305 - RNA, 64 nt, Homo Sapiens
gcuccucucuaaccuccuuuacccucaucugucuggaggggagcucugucuguccguguuauuu

SEQ ID NO: 530306 - RNA, 64 nt, Homo Sapiens
uuucugaugguggcuggggcuggggugagcucagggaggggaagaggagaauacaugcagaguc

SEQ ID NO: 530307 - RNA, 64 nt, Homo Sapiens
aagucaccugauauucuggccccaggggugggagggaggggagcuuggaaggcuaguccuguag

SEQ ID NO: 530308 - RNA, 64 nt, Homo Sapiens
cacugaggacgcgugacauggugggcaccggaaaggaggggacuucuccugcaccccaagaagu

SEQ ID NO: 530309 - RNA, 64 nt, Homo Sapiens
gguccccuggaccauccagggugcuagggggcagggaggggacacccccuccccgccuuuaccu

SEQ ID NO: 530310 - RNA, 64 nt, Homo Sapiens
acucuuccucucccuugucgccuucacuucuacaggaggggaaggggccagggaggggauucuc

SEQ ID NO: 530311 - RNA, 64 nt, Homo Sapiens
ucgccuucacuucuacaggaggggaaggggccagggaggggauucucccuuuaucaucaccuca

SEQ ID NO: 530312 - RNA, 64 nt, Homo Sapiens
aggguucagcagugacguagucauugcccucugcggaggggaccccuugcccccagaggagcag

SEQ ID NO: 530313 - RNA, 64 nt, Homo Sapiens
gugccacuuccagacaagacccucacacccccaaggaggggacgggaagagcuggcaaaaggag

SEQ ID NO: 530314 - RNA, 64 nt, Homo Sapiens
caucugguugccuuggaggcgggaggggagauguggaggggacaaccugucacaacaauaagca

SEQ ID NO: 530315 - RNA, 64 nt, Homo Sapiens
uguggaggggacacaucuggacaacaauaagcagggaggggagagucccgucguaagaccuguc

SEQ ID NO: 530316 - RNA, 64 nt, Homo Sapiens
accuggggaaggaagaaugagccaacagggcaggggaggggaagucaguuccugacugugcaag

SEQ ID NO: 530317 - RNA, 64 nt, Homo Sapiens
ucuuuuucuaaaacacaaaacacccccaagacugggaggggacuaccgaggccuaggccccugc

SEQ ID NO: 530318 - RNA, 64 nt, Homo Sapiens
aaaaacucuauuuuuguaaaaaaaaaggggggugggaggggaaggaagcagaaacaaaaugaaa

SEQ ID NO: 530319 - RNA, 64 nt, Homo Sapiens
ugcuccugccagaagcuggugggaggggaggccaggaggggagcuuucauuucacacccccgaa

SEQ ID NO: 530320 - RNA, 64 nt, Homo Sapiens
ccaggaggggagcugcuccuucacacccccgaagggaggggagguuccacuccaucauuucauu

SEQ ID NO: 530321 - RNA, 64 nt, Homo Sapiens
aggcccguggcaggaggaggcccccaugagagaaggaggggagccuucccgaggcuacagcaga

SEQ ID NO: 530322 - RNA, 64 nt, Homo Sapiens
auucuuggggcugagcuggggcuucucccugcgaggaggggagagaugagggggccaggcggug

SEQ ID NO: 530323 - RNA, 64 nt, Homo Sapiens
gggaggcagaggaggaacauaaaaggaggggagaggaggggaagaggaaaggaaggaaggaagg

SEQ ID NO: 530324 - RNA, 64 nt, Homo Sapiens
ggaggggaaggggaggcagaggaaggaaggaaaaggaggggagacagugcuccaaggaaaggaa

SEQ ID NO: 530325 - RNA, 64 nt, Homo Sapiens
ccuccauucagguggaggucggggcagggcagguggaggggagaggcuggaugcuuggguaacu

SEQ ID NO: 530326 - RNA, 64 nt, Homo Sapiens
gggaagccuggguuuuuguaguugggguggggacggaggggaaauuuaagcaauuacuuuucau

SEQ ID NO: 530327 - RNA, 64 nt, Homo Sapiens
ggggucccggauucuuggguuggguccccgaggaggaggggacugugggaggcagguggacucc

SEQ ID NO: 530328 - RNA, 64 nt, Homo Sapiens
ugugccagggacuauucucaggcugaagaaggugggaggggagggcggaaccugaggagccacc

SEQ ID NO: 530329 - RNA, 64 nt, Homo Sapiens
ccuucuacggagaugcaggcagugccacgagggaggaggggaccugcaaagcuagaaucuaggg

SEQ ID NO: 530330 - RNA, 64 nt, Homo Sapiens
cucacaucagaccuggggcaggugcgcaguguggggaggggauggggugcgucagggcccagca

SEQ ID NO: 530331 - RNA, 64 nt, Homo Sapiens
cuccaaggcucuagaggguguucagguacacugaggaggggacggcuccgucuucacauugugc

SEQ ID NO: 530332 - RNA, 64 nt, Homo Sapiens
cucugagaauccucggggcggucaggggaugucaggaggggaaggagccgcccucccuaucuug

SEQ ID NO: 530333 - RNA, 64 nt, Homo Sapiens
ccaaaagcucucugguuguaaccuggagacauguggaggggaauggcgaugggauuauaggacu

SEQ ID NO: 530334 - RNA, 64 nt, Homo Sapiens
gcuggggucccaggcagcgcugccugggggcuggggaggggaggcccagaggagggcuggccau

SEQ ID NO: 530335 - RNA, 64 nt, Homo Sapiens
cgcgcgcugacacagugaugggcugcccagggcuggaggggacgcuguuccucccgccgccacu

SEQ ID NO: 530336 - RNA, 64 nt, Homo Sapiens
ugcagaguuugggugcuggugguguggcuguaggggaggggagaccacacccaaggugggggcu

SEQ ID NO: 530337 - RNA, 64 nt, Homo Sapiens
ugccccaucuggggacgauauggggagggagaugggaggggaaaggggagaggguuuuucucac

SEQ ID NO: 530338 - RNA, 64 nt, Homo Sapiens
gccuggaauuagcuuggggccagggaagggacugggaggggagagaagagaaggagggaaggau

SEQ ID NO: 530339 - RNA, 64 nt, Homo Sapiens
guuauguggaaguguguguggcagcaggcagcggggaggggaggaacagggaagggggagcugg

SEQ ID NO: 530340 - RNA, 64 nt, Homo Sapiens
acccacgggugucccugcccacucguguggcaagggaggggagggcaggagggcucggccugag

SEQ ID NO: 530341 - RNA, 64 nt, Homo Sapiens
ggagauggggucucagagcgagagcugcggagggggaggggaagaagaaggccucacuuuugcu

SEQ ID NO: 530342 - RNA, 64 nt, Homo Sapiens
ggaagggagaggcaagcugggcuggggguggcugggaggggaagugccuuuucccgaggcuggg

SEQ ID NO: 530343 - RNA, 64 nt, Homo Sapiens
gugcugggccugacauggcucaagcuccaggucaggaggggaggcaccccauccccagcuagcc

SEQ ID NO: 530344 - RNA, 64 nt, Homo Sapiens
caggcguccuuggaggcagcaaaggguggagaauggaggggaacccucccccaaaucgucaugg

SEQ ID NO: 530345 - RNA, 64 nt, Homo Sapiens
aaaggcgucccucuuggcccucgggggcaggcauggaggggagggugcguuccugagggccagg

SEQ ID NO: 530346 - RNA, 64 nt, Homo Sapiens
aaauauagauaagaaaagguggggcuauacuagcaacaaaaaaagaaugcuguuccugcaccug

SEQ ID NO: 530347 - RNA, 64 nt, Homo Sapiens
agcaaagcauuaguggcuauggucuguaaaaugaaacaaaaaaacuuuauuucacuauaagagu

SEQ ID NO: 530348 - RNA, 64 nt, Homo Sapiens
cauuccucaucaccaucguguuugcaaagguuaaaacaaaaacaaaaaaccacaaaaauaaaaa

SEQ ID NO: 530349 - RNA, 64 nt, Homo Sapiens
ucaucaccaucguguuugcaaagguuaaaacaaaaacaaaaaaccacaaaaauaaaaaacaaaa

SEQ ID NO: 530350 - RNA, 64 nt, Homo Sapiens
guuaaaacaaaaacaaaaaaccacaaaaauaaaaaacaaaaaaaacaaaaaacccaagaaaaaa

SEQ ID NO: 530351 - RNA, 64 nt, Homo Sapiens
aaaacaaaaaaccacaaaaauaaaaaacaaaaaaaacaaaaaacccaagaaaaaaaaaaagagu

SEQ ID NO: 530352 - RNA, 64 nt, Homo Sapiens
cugguuuuaguacucugaaggacaaaaacaagcaaacaaaaaccccugcugcagcauuucaggu

SEQ ID NO: 530353 - RNA, 64 nt, Homo Sapiens
ucugcauguauauuugauaacaugucuuuuguaaaacaaaaauuacaaaaaaauuuguuuacau

SEQ ID NO: 530354 - RNA, 64 nt, Homo Sapiens
ccuuucaugucccauuucagacagaguaaccauuaacaaaaaagaagagaaaaaguuaaagucg

SEQ ID NO: 530355 - RNA, 64 nt, Homo Sapiens
uugagccuuuucuuuuucccuucuccccuuucuaaacaaaaaccuuccuaggauggcaucuuuu

SEQ ID NO: 530356 - RNA, 64 nt, Homo Sapiens
gauuaagaaaaagaaccagcugaaccaugaaacaaacaaaaauccuaaaagugauucuugucau

SEQ ID NO: 530357 - RNA, 64 nt, Homo Sapiens
aauguguaggaaauguucuuuuuuaaaaaaaaauaacaaaaacaaaacaaaacuauuuauuuug

SEQ ID NO: 530358 - RNA, 64 nt, Homo Sapiens
uuaaugaacuugcaaaggaauauugcuaaaaacaaacaaaaaaaacuguuaucgaacuuucuuu

SEQ ID NO: 530359 - RNA, 64 nt, Homo Sapiens
acuuuauuuuuuugugccuucugaaaggaucuaaaacaaaaauauuuugccuuuuuuuccccac

SEQ ID NO: 530360 - RNA, 64 nt, Homo Sapiens
uguuuaaaucaaucuguaaaagguaaaaaugaaaaacaaaaacaagcaaacaaacaaaaaacaa

SEQ ID NO: 530361 - RNA, 64 nt, Homo Sapiens
aaagguaaaaaugaaaaacaaaaacaagcaaacaaacaaaaaacaauggaaaagaugaagcugg

SEQ ID NO: 530362 - RNA, 64 nt, Homo Sapiens
aaauuuuucaguucacuagacuaaaauguuuuacaacaaaaagccuccaguuagccuccuuucu

SEQ ID NO: 530363 - RNA, 64 nt, Homo Sapiens
uaacuaaaaaugcugagaccccuuuuuauagaaaaacaaaaagacaucaagucuucuuaauuca

SEQ ID NO: 530364 - RNA, 64 nt, Homo Sapiens
gaaauacaaccuagggugccuuaaaaauaacaacaacaaaaaaccugugugcaucuggcugaca

SEQ ID NO: 530365 - RNA, 64 nt, Homo Sapiens
cucccauaauuucauauuuccguaccccugaggaaacaaaaaggaaaugaggagagaaaguuac

SEQ ID NO: 530366 - RNA, 64 nt, Homo Sapiens
aaacaaaacaguuuuuaaaaaaaaaaaacaaaaaaacaaaaaaaauaguccugagcaaaaaaaa

SEQ ID NO: 530367 - RNA, 64 nt, Homo Sapiens
caaaaaaaaaacaaaacaguaaaaaaaaaaaaaaaacaaaaaaagaaagcaaauaguccugagc

SEQ ID NO: 530368 - RNA, 64 nt, Homo Sapiens
ccugagaaguuugaauuguaaaaaaacaaacaaaaacaaaaaaaccccaccuccucauuuuagu

SEQ ID NO: 530369 - RNA, 64 nt, Homo Sapiens
aaaaaaccugagaaguuugauuuaguaaaaaacaaacaaaaacagcucuuccccaccuccucau

SEQ ID NO: 530370 - RNA, 64 nt, Homo Sapiens
aaaagcuuuaaaaaaaaaagagggugguugguuuaacaaaaaaauuucacauguggaaacuuuc

SEQ ID NO: 530371 - RNA, 64 nt, Homo Sapiens
aacaccaaaaaaacagcaguaaaaaaaaaaaaaaaacaaaaaacccaccugggcacuuuuagau

SEQ ID NO: 530372 - RNA, 64 nt, Homo Sapiens
aaaucucucuauaaaaugaauuggaacaaaagcaaacaaaaaagcucaaccacucuccuaauga

SEQ ID NO: 530373 - RNA, 64 nt, Homo Sapiens
gcuaaguuauaagugaacugaaaacaaaaaaaacaacaaaaaaauauucuuuggaaaaaaacaa

SEQ ID NO: 530374 - RNA, 64 nt, Homo Sapiens
acaacaaaaaaagcuaaguuggaaaaaaacaaaaaacaaaaaaaauuuuaaggaacuauucuuu

SEQ ID NO: 530375 - RNA, 64 nt, Homo Sapiens
aaaaaaaacaacaaaaaaagauucuuuggaaaaaaacaaaaaacagcauccauuuuaaggaacu

SEQ ID NO: 530376 - RNA, 64 nt, Homo Sapiens
aagaaacuaagaaucuuacugucagauuguaaaaaacaaaaacaaguauaugugucuuaaugca

SEQ ID NO: 530377 - RNA, 60 nt, Homo Sapiens
aaccugaaaacugcuuggcaaaguaaaacaaacaaaaacaacuacaaaagaaaaauauaa

SEQ ID NO: 530378 - RNA, 64 nt, Homo Sapiens
aauaaaaaaguugugccugaugauuuaaaaacaaaacaaaaaaauaggacccgguuucuuuuac

SEQ ID NO: 530379 - RNA, 64 nt, Homo Sapiens
augaaugcacaaacuugcugcauauuuaaacaaaaacaaaaaaacagcagugugauaauuuaaa

SEQ ID NO: 530380 - RNA, 64 nt, Homo Sapiens
aaaaaaaugaaugcacaaacuuuaaacauauuuaaacaaaaacagagugccagcagugugauaa

SEQ ID NO: 530381 - RNA, 64 nt, Homo Sapiens
auguucuuuuuaugcaaaucuuauauauacacagaacaaaaauaaguuaaggaaacaaaaauac

SEQ ID NO: 530382 - RNA, 64 nt, Homo Sapiens
cuuauauauacacagaacaaaaacaaguuaaggaaacaaaaauauaguugugugugggcaacag

SEQ ID NO: 530383 - RNA, 64 nt, Homo Sapiens
gugcuguucaaguuuucagccaaacaacaacaaaaacaaaaaauugauuccaggaggaguuagc

SEQ ID NO: 530384 - RNA, 64 nt, Homo Sapiens
aaaaaugugcuguucaaguuguuagccaaacaacaacaaaaacagaaaggugauuccaggagga

SEQ ID NO: 530385 - RNA, 64 nt, Homo Sapiens
aaccuuguuccuuuauaggugaaaaaaaacaaaaaacaaaaaaauucacuugccuagucuugaa

SEQ ID NO: 530386 - RNA, 64 nt, Homo Sapiens
aaaaaaaaaccuuguuccuuucuugaagaaaaaaaacaaaaaacccacugcuucacuugccuag

SEQ ID NO: 530387 - RNA, 64 nt, Homo Sapiens
uuuacugaguguuauaaguauaaaaauaaaggaaaacaaaaaacaugcacuuuuaugaaguuuu

SEQ ID NO: 530388 - RNA, 64 nt, Homo Sapiens
guuucccaaaacaaucuauucuauaacauuauauaacaaaaaaggaagaaguuaauucuuaaaa

SEQ ID NO: 530389 - RNA, 64 nt, Homo Sapiens
acauauaaaacuagaaaggguuuaauucagcaacaacaaaaaauuuuuugaauuugacauugag

SEQ ID NO: 530390 - RNA, 64 nt, Homo Sapiens
gguaguucuuggcuuuuaacagagaaaagcauaaaacaaaaauaagcuauacuuuaacauuaug

SEQ ID NO: 530391 - RNA, 64 nt, Homo Sapiens
aaagaugagucgcacaucugaaaacaaaaaaaaaaacaaaaaacgcgagacucuaucucaaaaa

SEQ ID NO: 530392 - RNA, 64 nt, Homo Sapiens
aaaacaaaaaacaaagaugacuaucucaaaaaaaaacaaaaaaacugggcaacagagcgagacu

SEQ ID NO: 530393 - RNA, 64 nt, Homo Sapiens
ggguuuuaaaauuaaaguaucuuuucaaguugagaacaaaaauugugaaacaaaaaaguguucc

SEQ ID NO: 530394 - RNA, 64 nt, Homo Sapiens
uguucccuuuucaaguugagcagcuuguuugugaaacaaaaaagcaaaaagaauuccaaccgac

SEQ ID NO: 530395 - RNA, 64 nt, Homo Sapiens
gagaacaccuccagcuuuucaucagggaaaaaacaacaaaaaaaauuuaucacugaauuaagcc

SEQ ID NO: 530396 - RNA, 64 nt, Homo Sapiens
aaugaagaaaauugagaccuuaugaugaccuggcaacaaaaagucauuuaagaauuugaaacgu

SEQ ID NO: 530397 - RNA, 64 nt, Homo Sapiens
aaaagauuccucguuauuguuguugccaaagagaaacaaaaaugauuuugcuuuccaagcuugg

SEQ ID NO: 530398 - RNA, 64 nt, Homo Sapiens
cuauuuaguaagcccggauagacuuauugccaaaaacaaaaaauagcuuucaaaagaaauuuaa

SEQ ID NO: 530399 - RNA, 64 nt, Homo Sapiens
uuagaagucuuaguaauguaacuugaagauguuaaacaaaaaucucaaguaaaaugaaaagcaa

SEQ ID NO: 530400 - RNA, 64 nt, Homo Sapiens
ggcaacagagcgagacucugucucagaaaaaaaaaacaaaaaccaguuuaggcuggguauggug

SEQ ID NO: 530401 - RNA, 64 nt, Homo Sapiens
ccaacuuuuauuuggaauaauaauuuuccuccuaaacaaaaacacauugaguuuaagucucuga

SEQ ID NO: 530402 - RNA, 64 nt, Homo Sapiens
aacuuccuuugacuuauuguccccacuaaaacaaaacaaaaaacuuuuaaugccuuccacauua

SEQ ID NO: 530403 - RNA, 64 nt, Homo Sapiens
aguucuuggcugccguccuguggcagcuuaauggaacaaaaauuacagacuuuggugaaccaag

SEQ ID NO: 530404 - RNA, 64 nt, Homo Sapiens
gaacacucauuuuguuagcgagggugguaaagugaacaaaaaggggaaguaucaaacuacugcc

SEQ ID NO: 530405 - RNA, 64 nt, Homo Sapiens
aaugcaguuccuuucauaauaucucagcaccagaaacaaaaauuaagauuaucaaagcauuuug

SEQ ID NO: 530406 - RNA, 64 nt, Homo Sapiens
aaaucaagaaggccaucacuuagaacgaaccccaaacaaaaaugccauaauauaaaugugugaa

SEQ ID NO: 530407 - RNA, 64 nt, Homo Sapiens
uaggcaucaaaaggcaaaaaucaaaaaaaaaaaaaacaaaaacaaaaaaaaagaugaaccuagg

SEQ ID NO: 530408 - RNA, 64 nt, Homo Sapiens
ucaaaaggcaaaaaucaaaaaaaaaaaaaacaaaaacaaaaaaaaagaugaaccuaggucugug

SEQ ID NO: 530409 - RNA, 64 nt, Homo Sapiens
aguaacaauaccuugcagagcagcaaaaaucaguaacaaaaaaucugaaacaagaagguuauug

SEQ ID NO: 530410 - RNA, 64 nt, Homo Sapiens
acagaggcggaaauaccggaaaaaaggaauuuaaaacaaaaaccaguaucagcacccagaagag

SEQ ID NO: 530411 - RNA, 64 nt, Homo Sapiens
acaaaacauaauaaaacaccaaguuaaacaaacaaacaaaaaaccaaacugagguagcgacaca

SEQ ID NO: 530412 - RNA, 64 nt, Homo Sapiens
ugucucagguuuguuuuguguugcuuuuuuccaaaacaaaaagagcuuugacucuauaagcaaa

SEQ ID NO: 530413 - RNA, 64 nt, Homo Sapiens
gaaugaaaauaacugaauuuagaaaggaaaagaaaacaaaaaacuaugcuuauaaccuaguuaa

SEQ ID NO: 530414 - RNA, 64 nt, Homo Sapiens
agagggcauagaugcaaucaacacaaaauuucaaaacaaaaacagaaauauaaggcacguuuuc

SEQ ID NO: 530415 - RNA, 64 nt, Homo Sapiens
aggggccaauaaauucccuaaaagaaaaacaaaaaacaaaaaacucaugcucuuguuucucaaa

SEQ ID NO: 530416 - RNA, 64 nt, Homo Sapiens
aaaaaacaggggccaauaaaucucaaaaaagaaaaacaaaaaacaaguaucucaugcucuuguu

SEQ ID NO: 530417 - RNA, 64 nt, Homo Sapiens
uuugauugagacaaugaagauuuaaaaaaauaaaaacaaaaaagagagaaaaggguguuuuaaa

SEQ ID NO: 530418 - RNA, 64 nt, Homo Sapiens
caaacaagccuuagcuuuucaaaaccuaaaaauaaacaaaaagcguuaggucaugaggacacca

SEQ ID NO: 530419 - RNA, 64 nt, Homo Sapiens
aaagauuuuuaucaaauguuaaaaaaaaacaaaaaacaaaaacaacagguuuauuuuaguaaaa

SEQ ID NO: 530420 - RNA, 64 nt, Homo Sapiens
aaaaacaaaagauuuuuaucaguaaaaaaaaaaaaacaaaaaaccccccgaacagguuuauuuu

SEQ ID NO: 530421 - RNA, 64 nt, Homo Sapiens
aacaacaacaacaaaauuauaaaaaaacccaaaaaacaaaaacacagagugagacugcaucuca

SEQ ID NO: 530422 - RNA, 64 nt, Homo Sapiens
caaauuagucggguguggugugaaaaacaacaaaaacaaaaacaugguaaaacccugucucuac

SEQ ID NO: 530423 - RNA, 64 nt, Homo Sapiens
aaaacacaaauuagucgggucucuacugaaaaacaacaaaaacaccaacaugguaaaacccugu

SEQ ID NO: 530424 - RNA, 64 nt, Homo Sapiens
acacaaaccaucaucacagaaaaacgaaaacaaaaacaaaaaaagagacuccaucucauuaaaa

SEQ ID NO: 530425 - RNA, 64 nt, Homo Sapiens
aaaaaaacacaaaccaucauuuaaaaaaaacgaaaacaaaaacacagagugagacuccaucuca

SEQ ID NO: 530426 - RNA, 64 nt, Homo Sapiens
aaaaaagucacccuaucagguguccuuaaaacaaaacaaaaaccucaauaaaaaaaagagaaac

SEQ ID NO: 530427 - RNA, 64 nt, Homo Sapiens
aacgagaaaaacaacaaaguuuuuaacaacuaagaacaaaaauuguaaguauuaccuccuuaau

SEQ ID NO: 530428 - RNA, 64 nt, Homo Sapiens
ggcucucgaggcaagcugucaacgucuuguugaaaacaaaaaucaagaaagaauugaaauacug

SEQ ID NO: 530429 - RNA, 64 nt, Homo Sapiens
auaggagcuuauggucaaaaagugcaaaaaaaaaaacaaaaaaaaagcaauagauagagaaauu

SEQ ID NO: 530430 - RNA, 64 nt, Homo Sapiens
uguucuguuggugugauucaaagcaaaacaaacaaacaaaaacaaauuuuaagaacacaacaaa

SEQ ID NO: 530431 - RNA, 64 nt, Homo Sapiens
aaaacaaacaaacaaaaacaaauuuuaagaacacaacaaaaaagauuugacuuccgaauagaau

SEQ ID NO: 530432 - RNA, 64 nt, Homo Sapiens
cuuugacaaaaauguguacuguguaagccuugcaaacaaaaaacaacaaaaaagaagcagcagc

SEQ ID NO: 530433 - RNA, 64 nt, Homo Sapiens
aauguguacuguguaagccuugcaaacaaaaaacaacaaaaaagaagcagcagcagcagccugc

SEQ ID NO: 530434 - RNA, 64 nt, Homo Sapiens
aacucuacuuagagaguguaugucugucuaacagaacaaaaagaugcucuguguaaauuccuuc

SEQ ID NO: 530435 - RNA, 64 nt, Homo Sapiens
uauacauaaaaggguaaaauucacacauacagcaaacaaaaaugcacaaagccugcuucguaac

SEQ ID NO: 530436 - RNA, 64 nt, Homo Sapiens
agacacaagaaaagcauuucagaggcuaauuuaaaacaaaaaguaagcaccuaaaggcaaggac

SEQ ID NO: 530437 - RNA, 64 nt, Homo Sapiens
ccauuuccuagguaauuuuuuaaaagccagucaaaacaaaaacuuuacugaaaauggacagaaa

SEQ ID NO: 530438 - RNA, 51 nt, Homo Sapiens
auuuauuguaucccauguaaaaacaaaaaaacaaaaaacaaagaaaagaaa

SEQ ID NO: 530439 - RNA, 59 nt, Homo Sapiens
auuuauuguaucccauguaaaaacaaaaaaacaaaaaacaaagaaaagaaagagauuuu

SEQ ID NO: 530440 - RNA, 64 nt, Homo Sapiens
uauucaaaagggauugccauuucugagacacaguaacaaaaaaaugaggaaauuauuuugcuuc

SEQ ID NO: 530441 - RNA, 64 nt, Homo Sapiens
acauuuuucaaaacuacugcauguuuaaaacuucaacaaaaaaagagagaaagaacuauacuaa

SEQ ID NO: 530442 - RNA, 64 nt, Homo Sapiens
auguguccauuguugcauuuuauauauaugaacaaacaaaaaaugcacaguucauaauaauuuc

SEQ ID NO: 530443 - RNA, 64 nt, Homo Sapiens
auagacuuauuggaauuuacaagacauacaacauaacaaaaaguguugcuguaaauccaaaaga

SEQ ID NO: 530444 - RNA, 64 nt, Homo Sapiens
uagccugggcaacagugagugagacucggucucaaacaaaaaccaaauugggaaauucuucuug

SEQ ID NO: 530445 - RNA, 64 nt, Homo Sapiens
auauguuucucuuaacaccugaaacuuguuuuaaaacaaaaagcaguauucacuucaaaucaua

SEQ ID NO: 530446 - RNA, 64 nt, Homo Sapiens
ucguacucauaaucagcucugcauacaucugaagaacaaaaacaucaacgucuuuuguccagcc

SEQ ID NO: 530447 - RNA, 64 nt, Homo Sapiens
cuguaguucaaaagucagaaaugauucuaauuuaaacaaaaagauacuaaauauacagaaguua

SEQ ID NO: 530448 - RNA, 64 nt, Homo Sapiens
gggaucucagggagaggccaagcaucaggagaggaacaaaaaaagacaccccacaguggaaggg

SEQ ID NO: 530449 - RNA, 64 nt, Homo Sapiens
gacucccacugucuccagaaugcagaaaaacacaaacaaaaacagaagcaauauaccacuaacc

SEQ ID NO: 530450 - RNA, 64 nt, Homo Sapiens
acauuaaaauuuuaaguuguaaaaaagaauaagaaacaaaaaacgguucaaauuauaucuaaac

SEQ ID NO: 530451 - RNA, 64 nt, Homo Sapiens
aauaagaaacaaaaaacacaucaaauuauaucuaaacaaaaaaggaaaagaaaagaaacauggu

SEQ ID NO: 530452 - RNA, 64 nt, Homo Sapiens
aaauaaauauuuaaauuccauaaucccaccuucuaacaaaaaauacuucaucuuauucuucaug

SEQ ID NO: 530453 - RNA, 64 nt, Homo Sapiens
guuuaggaagcauaauuacguucucuugccguagaacaaaaacaaucugucuuuccacucuugg

SEQ ID NO: 530454 - RNA, 64 nt, Homo Sapiens
uuuaccugugcaaaauaguuaggguaaaauuugaaacaaaaaauauaauuuaguucauuuguuc

SEQ ID NO: 530455 - RNA, 64 nt, Homo Sapiens
cauucauaauguuaggaagaucccuucuguauguaacaaaaagaagaaaaugccauuuacggca

SEQ ID NO: 530456 - RNA, 64 nt, Homo Sapiens
gaguuaaaaaauucugauauaaaauaauauuaagaacaaaaaaacaauuaugauuugucaguca

SEQ ID NO: 530457 - RNA, 64 nt, Homo Sapiens
uuuuaugauguacggaaaaaaaagagcauagagaaacaaaaaucgaugccgaauaaaugauauc

SEQ ID NO: 530458 - RNA, 64 nt, Homo Sapiens
cuauggcacuagaauuuaagacaaaaaacaaacaaacaaaaaagaugaacaaaacaaaacaaca

SEQ ID NO: 530459 - RNA, 64 nt, Homo Sapiens
aaacaaacaaaaaagcuaugcaaaacaaaacaacaacaaaaaaccuuucucucuuucuuaugaa

SEQ ID NO: 530460 - RNA, 64 nt, Homo Sapiens
gagaauuccuuaaauugauuuaauguauuuauuaaacaaaaacucuaaguagauuuuuugacau

SEQ ID NO: 530461 - RNA, 64 nt, Homo Sapiens
auguuaucaaaaacugucagaacacaaauccuuaaacaaaaauccuuucagccuguguagggca

SEQ ID NO: 530462 - RNA, 64 nt, Homo Sapiens
ccaagugugccuugaauugugcaaacaaaaaaccaacaaaaaauaaguuuuccguuguuaaaaa

SEQ ID NO: 530463 - RNA, 64 nt, Homo Sapiens
caacaaaaaauccaagugugguuguuaaaaagcaaacaaaaaacgaauggaguauaaguuuucc

SEQ ID NO: 530464 - RNA, 64 nt, Homo Sapiens
aaccuuuugguaacugugcaaacgaaaaacaaaaaacaaaaacauuugguauuuaaagcaaaaa

SEQ ID NO: 530465 - RNA, 64 nt, Homo Sapiens
aaaaacaaaccuuuugguaagcaaaaaaacgaaaaacaaaaaacuuguaguuuugguauuuaaa

SEQ ID NO: 530466 - RNA, 64 nt, Homo Sapiens
ucugcagaaggaaaaaugugaaaaaaacaaaaagaacaaaaaaaaauuuacaaaguguguauua

SEQ ID NO: 530467 - RNA, 64 nt, Homo Sapiens
acaaaaaaaucugcagaagguguguauuaaaaaaaacaaaaagaaagguuuacaauuuacaaag

SEQ ID NO: 530468 - RNA, 64 nt, Homo Sapiens
auguuaagaaauggguuucuuucaaauguuugaaaacaaaaaaacauacguuuugguguugcuu

SEQ ID NO: 530469 - RNA, 64 nt, Homo Sapiens
ccauguguuaaaauacucagaaaacaaacaaacaaacaaaaaacaaucugaaguaugguauuac

SEQ ID NO: 530470 - RNA, 64 nt, Homo Sapiens
gauguguuuuauuauaaauaauauucaauuaugaaacaaaaaaauuaugauguuuuucaaaaug

SEQ ID NO: 530471 - RNA, 64 nt, Homo Sapiens
cauaguagugguaguaaagaaaaaaaggagaucuaacaaaaacacuugaauauuuuuuauuuuc

SEQ ID NO: 530472 - RNA, 64 nt, Homo Sapiens
aaugguagcuuuugcacagaacuuccaaaagcaaaacaaaaacaaaaucuauuguaguuauaua

SEQ ID NO: 530473 - RNA, 64 nt, Homo Sapiens
ucagaaaauggccuucugugcuuucaaaaaaaaaaacaaaaaaaaaaccacacacacacauaaa

SEQ ID NO: 530474 - RNA, 64 nt, Homo Sapiens
aagucuagcaauugaacucuuuguugauaauaaaaacaaaaagcagaguguaccauuaacuuga

SEQ ID NO: 530475 - RNA, 64 nt, Homo Sapiens
caacaacccagaaagguuuaagaaaccauuaaaaaacaaaaagcaaacaaaaaaguuggaaggc

SEQ ID NO: 530476 - RNA, 64 nt, Homo Sapiens
uuggaaggcagaaaccauuaaaaguaaaaauaaaaacaaaaaagguuuagaaaaaaaagacaaa

SEQ ID NO: 530477 - RNA, 64 nt, Homo Sapiens
acccuuccucuuuucucucaaagaaaaacaaaauaacaaaaacauuuuuaaagcagaagcaaaa

SEQ ID NO: 530478 - RNA, 64 nt, Homo Sapiens
gaaauguccuagguuuucuuauuucccaguuuaaaacaaaaaggucuuccuccaaggaguuaga

SEQ ID NO: 530479 - RNA, 64 nt, Homo Sapiens
accuuccugugauacuuuauaagcaaaaacaaaaaacaaaaaagcauuuguaguaaaacuuaaa

SEQ ID NO: 530480 - RNA, 64 nt, Homo Sapiens
aaaaaagaccuuccugugauacuuaaaaagcaaaaacaaaaaacugucacucauuuguaguaaa

SEQ ID NO: 530481 - RNA, 64 nt, Homo Sapiens
ccaacacaccacucauuggaaaauggaaaaaaaaaacaaaaaaaaaacaaaaaaauguacaaug

SEQ ID NO: 530482 - RNA, 64 nt, Homo Sapiens
cucauuggaaaauggaaaaaaaaaacaaaaaaaaaacaaaaaaauguacaauggaugcauugaa

SEQ ID NO: 530483 - RNA, 64 nt, Homo Sapiens
uagaaagugccagaaaguguuuaacuugucaaaaaacaaaaacccagcaacagaaaaauggagu

SEQ ID NO: 530484 - RNA, 64 nt, Homo Sapiens
uaugcacauauauauauguauuuaaaaaaaucaaaacaaaaaaaaacucauuuauaccugugua

SEQ ID NO: 530485 - RNA, 64 nt, Homo Sapiens
aaaggagcaaagccuuguauuaccucuggaagacaacaaaaacaauuggcaacaacaaaaagcc

SEQ ID NO: 530486 - RNA, 64 nt, Homo Sapiens
uuaccucuggaagacaacaaaaacaauuggcaacaacaaaaagccucuuucuugacuuuaauca

SEQ ID NO: 530487 - RNA, 64 nt, Homo Sapiens
guacuuuucccuuuaaaaacaaaccaaaaaaaaaaacaaaaaaaaacuuuuuaauuaaagaacc

SEQ ID NO: 530488 - RNA, 64 nt, Homo Sapiens
gggacauaucacugauucauuccuaaaaagcaugaacaaaaaguuuuuguucuguuccagcuau

SEQ ID NO: 530489 - RNA, 64 nt, Homo Sapiens
uuaguuuggguccuacuguuguuauuaaaaacagaacaaaaacaaaacacacacacacacaaaa

SEQ ID NO: 530490 - RNA, 64 nt, Homo Sapiens
acaaaaacaaaacacacacacacacaaaaacagaaacaaaaaaaaccagcauuaaaauaauaag

SEQ ID NO: 530491 - RNA, 64 nt, Homo Sapiens
aacacauaguuuuaagcuacuccugccuuaguggaacaaaaaccucccuccuuuuguucuuccu

SEQ ID NO: 530492 - RNA, 64 nt, Homo Sapiens
gaaauaagacaucgugaaaaacgucuuuaaaagcaacaaaaauucccauugcugccaaaaauac

SEQ ID NO: 530493 - RNA, 64 nt, Homo Sapiens
aaucuaguuuagcacuaaaaauuuuucuauuuaaaacaaaaauauuuacuuucgugccugcauu

SEQ ID NO: 530494 - RNA, 64 nt, Homo Sapiens
aaaaccacuuauauugcuagccugucugucucaaaacaaaaaacccugggcaacagagcaagac

SEQ ID NO: 530495 - RNA, 64 nt, Homo Sapiens
agcuaguuaugggaguuaaggaauggcauucuacaacaaaaagauuccaaucccgacaguagca

SEQ ID NO: 530496 - RNA, 64 nt, Homo Sapiens
ugaaaucuugcuagugaagauacaaucauaugagaacaaaaauaaaagaaacaauaaggaccua

SEQ ID NO: 530497 - RNA, 64 nt, Homo Sapiens
caaagugguaaggauucaguaaaaacaggaaaaaaacaaaaaacaaaacaaaacaaaacaaaac

SEQ ID NO: 530498 - RNA, 64 nt, Homo Sapiens
ggaaaaaaacaaaaaaccaaacaaaacaaaacaaaacaaaaacagccucggguaacacugaaaa

SEQ ID NO: 530499 - RNA, 64 nt, Homo Sapiens
cguucaucuugucuauuuuuucucuucauguuguaacaaaaaggaaaaaagaaaaaaaaauccc

SEQ ID NO: 530500 - RNA, 64 nt, Homo Sapiens
acauuuauaagugcugcuuacaucacugaacaacaacaaaaaaauaauaauggaguagcuguug

SEQ ID NO: 530501 - RNA, 64 nt, Homo Sapiens
ucuaagaauacgcggucuccugagaacuucaaaaaacaaaaacaaaaaaacccaaaggcccuuu

SEQ ID NO: 530502 - RNA, 64 nt, Homo Sapiens
aauacgcggucuccugagaacuucaaaaaacaaaaacaaaaaaacccaaaggcccuuuucaggg

SEQ ID NO: 530503 - RNA, 64 nt, Homo Sapiens
uauuuggguuaauauuuaugacauuugacauugaaacaaaaauuuaaaauguuaucuuuuaauu

SEQ ID NO: 530504 - RNA, 64 nt, Homo Sapiens
ugugaaaaagcaaucuauuguguccaaauaaaaaaacaaaaagugugacacugguuaacuuuuu

SEQ ID NO: 530505 - RNA, 64 nt, Homo Sapiens
aauucucuccuucuguuggcugggugcccaauacaacaaaaaggcagaggaaaggcaaauucuu

SEQ ID NO: 530506 - RNA, 64 nt, Homo Sapiens
uccagccugggcaacagagcgagacuccaucucaaacaaaaacaagaacaaaaacaaacauaaa

SEQ ID NO: 530507 - RNA, 64 nt, Homo Sapiens
aacagagcgagacuccaucucaaacaaaaacaagaacaaaaacaaacauaaaguuggcacagaa

SEQ ID NO: 530508 - RNA, 64 nt, Homo Sapiens
caaaucucuacccuuccccaacccuccauaaaaaaacaaaaauggaaaugaaaaaugaaacaaa

SEQ ID NO: 530509 - RNA, 64 nt, Homo Sapiens
uccauaaaaaaacaaaaauggaaaugaaaaaugaaacaaaaaaggacaaaaccaaaaaaaaaag

SEQ ID NO: 530510 - RNA, 64 nt, Homo Sapiens
gaaugacaugaaugcugcuaaaggacuggacucaaacaaaaacgaggucaaucaugccauugac

SEQ ID NO: 530511 - RNA, 64 nt, Homo Sapiens
guguaaauuuuaaaauuuuguauagguauuucauaacaaaaauauguauuucuuuuuuguuauu

SEQ ID NO: 530512 - RNA, 64 nt, Homo Sapiens
uuaauuucuguaauugggaaggaggguaauaaugaacaaaaaguuugagaaaaaaaugcuuuaa

SEQ ID NO: 530513 - RNA, 64 nt, Homo Sapiens
agauauacugugggaugaguaucucaggguaaguaacaaaaaaacaaacaaaaaaaaucacuga

SEQ ID NO: 530514 - RNA, 64 nt, Homo Sapiens
ggaugaguaucucaggguaaguaacaaaaaaacaaacaaaaaaaaucacugaaauuuuucccuc

SEQ ID NO: 530515 - RNA, 64 nt, Homo Sapiens
aaaccuuuguucugggauuuacuguuaaaaaacaaacaaaaaacaacaaaaaagcggugacagg

SEQ ID NO: 530516 - RNA, 64 nt, Homo Sapiens
ucugggauuuacuguuaaaaaacaaacaaaaaacaacaaaaaagcggugacaggaaacaguuaa

SEQ ID NO: 530517 - RNA, 64 nt, Homo Sapiens
cucuagcacaauuauggguuacuuccuuuuucuuaacaaaaaagaauguuugauuuccucuggg

SEQ ID NO: 530518 - RNA, 64 nt, Homo Sapiens
auacuuagauuuucuuuuaaaaaaauuaaaauaaaacaaaaaaaaauuucuaggacuagacgau

SEQ ID NO: 530519 - RNA, 64 nt, Homo Sapiens
cauaucuccaaaaaaagaaagaaaaaauacaaaaaacaaaaacaaaaaaaaaagaggguaaugu

SEQ ID NO: 530520 - RNA, 64 nt, Homo Sapiens
uccaaaaaaagaaagaaaaaauacaaaaaacaaaaacaaaaaaaaaagaggguaauguacaagu

SEQ ID NO: 530521 - RNA, 64 nt, Homo Sapiens
acuaaguugcuuucuuuuuuggggaaaaaacaaaaacaaaaaaauaucucacuuuaaacucuuu

SEQ ID NO: 530522 - RNA, 64 nt, Homo Sapiens
aaaaaaacuaaguugcuuuccucuuuggggaaaaaacaaaaacaguacuguaucucacuuuaaa

SEQ ID NO: 530523 - RNA, 64 nt, Homo Sapiens
agcagauguugaagacagggaaaagagaaacgccaacaaaaaucuguggaaagcaaaauaacaa

SEQ ID NO: 530524 - RNA, 64 nt, Homo Sapiens
agaaacgccaacaaaaaucaguggaaagcaaaauaacaaaaaaguuguauuaauuauuuaaagu

SEQ ID NO: 530525 - RNA, 64 nt, Homo Sapiens
aaauuaaaaaaaaaaacagaaacaaaaaacaaacaacaaaaaaacugcuauguuaaaaacaaac

SEQ ID NO: 530526 - RNA, 64 nt, Homo Sapiens
aaacaacaaaaaaaaaauuauguuaaaaacaaacaacaaaaaacucaccaaagaaguccugcua

SEQ ID NO: 530527 - RNA, 64 nt, Homo Sapiens
aagaagcaaguuguacugcucauuaagaaauaaaaacaaaaaaccaaacaaaaaacaaccuuag

SEQ ID NO: 530528 - RNA, 64 nt, Homo Sapiens
aaccuuagcauuaagaaauauaaacaaacaaacaaacaaaaaacuaagaagccuuaauacucug

SEQ ID NO: 530529 - RNA, 64 nt, Homo Sapiens
cauggaagcaacaaaagagucaaaaaaacaaaaaaacaaaaaccauuguuuuaauaucuuuacu

SEQ ID NO: 530530 - RNA, 64 nt, Homo Sapiens
caaaaacccauggaagcaacucuuuacucaaaaaaacaaaaaaagcaucugaauuguuuuaaua

SEQ ID NO: 530531 - RNA, 64 nt, Homo Sapiens
ccuugccuuugguauggaauacgugguguugcagaacaaaaauuagcagugacuggaaggacaa

SEQ ID NO: 530532 - RNA, 64 nt, Homo Sapiens
cccuuggaaccuuuguacgcuuugcucaaaaaaaaacaaaaaaaaaaaacaaaaaaaaaaaaca

SEQ ID NO: 530533 - RNA, 64 nt, Homo Sapiens
uguacgcuuugcucaaaaaaaaacaaaaaaaaaaaacaaaaaaaaaaaacaacgguggagccuu

SEQ ID NO: 530534 - RNA, 64 nt, Homo Sapiens
auucuggcaaauaacaauuagaaaagauagguuuaacaaaaaaauuuacuuguauauaaugcac

SEQ ID NO: 530535 - RNA, 64 nt, Homo Sapiens
uuguauaauauuacuucaaagauauguaaucacaaacaaaaaaaacuauuuuuuauaaugucau

SEQ ID NO: 530536 - RNA, 64 nt, Homo Sapiens
ggugacagggucugacauggucagucuacuaaaaaacaaaaaaaaaaaacaaaaaaaaaaaaac

SEQ ID NO: 530537 - RNA, 64 nt, Homo Sapiens
gacauggucagucuacuaaaaaacaaaaaaaaaaaacaaaaaaaaaaaaacaaaagaaaaaaau

SEQ ID NO: 530538 - RNA, 64 nt, Homo Sapiens
cagagcaggacucucucucaaaaaaacacaaaaaaacaaaaacaaaaaaccauacacacacaca

SEQ ID NO: 530539 - RNA, 64 nt, Homo Sapiens
aggacucucucucaaaaaaacacaaaaaaacaaaaacaaaaaaccauacacacacacacacaca

SEQ ID NO: 530540 - RNA, 64 nt, Homo Sapiens
cuaaaaaccaccaaggaaaccuacuccaaaaaugaacaaaaaaaaaaaaagcgaaagacugcag

SEQ ID NO: 530541 - RNA, 64 nt, Homo Sapiens
aguugugcuaaaaacaaaacaaaacaaacaaacaaacaaaaaaguaaaaaaagauuacuuucga

SEQ ID NO: 530542 - RNA, 64 nt, Homo Sapiens
uauaaacaaucccauuuuuauauuuuauuauuaaaacaaaaauaccucucuuugcuagagaguu

SEQ ID NO: 530543 - RNA, 64 nt, Homo Sapiens
gccugggaacaagagugaaacucucaaaagcagaaacaaaaacccaacauauaugggcuguuag

SEQ ID NO: 530544 - RNA, 64 nt, Homo Sapiens
caacccaguccccaaccugcaaaacaaaaacaaaaacaaaaaagaaaaauaaaagaaaauguaa

SEQ ID NO: 530545 - RNA, 64 nt, Homo Sapiens
aaaaagcaacccaguccccaauguaaaaaacaaaaacaaaaacaaaugggaaaaauaaaagaaa

SEQ ID NO: 530546 - RNA, 64 nt, Homo Sapiens
aaaacaaaaaagcaacccagaagaaaauguaaaaaacaaaaacauacaaaaaugggaaaaauaa

SEQ ID NO: 530547 - RNA, 64 nt, Homo Sapiens
aacaaaaguaaauuaaaaacaaaacaaaaaaaaaaacaaaaaaagaaaaauagaaauuaaaaac

SEQ ID NO: 530548 - RNA, 64 nt, Homo Sapiens
aaaacaaaaaaaaacaaaaggaaauuaaaaacaaaacaaaaaaacugaguuaaccagaaaaaua

SEQ ID NO: 530549 - RNA, 64 nt, Homo Sapiens
augugauuuguuucugucuuauuuagaaaacaaaaacaaaaaaagaaauuuucucuuguaaaac

SEQ ID NO: 530550 - RNA, 64 nt, Homo Sapiens
aaaaaaaugugauuuguuucuaaaacauuuagaaaacaaaaacagcuuuugaaauuuucucuug

SEQ ID NO: 530551 - RNA, 64 nt, Homo Sapiens
ucuaauggauuuaucaaacuaaagcugauuaaaaaacaaaaauucugccaaaaccauuaagugg

SEQ ID NO: 530552 - RNA, 64 nt, Homo Sapiens
accagcgauacguaaucaaacaaccuauguuuugaacaaaaacauguacuggcagauuaacaua

SEQ ID NO: 530553 - RNA, 64 nt, Homo Sapiens
aaguuugaguugauaguuauuaaaaagaaaacaaaacaaaaaaaaaaggcaaggcacaacaaaa

SEQ ID NO: 530554 - RNA, 64 nt, Homo Sapiens
aaagaaaacaaaacaaaaaaaaaaggcaaggcacaacaaaaaaauauccugggcaauaaaaaaa

SEQ ID NO: 530555 - RNA, 64 nt, Homo Sapiens
caccgcaauaauucgguaaggcaaaccagaacaaaacaaaaagccauucguuucccagugaaaa

SEQ ID NO: 530556 - RNA, 64 nt, Homo Sapiens
aaccaacaaauacaacacaaaaaucuaaaagugaaacaaaaaccauuaaacaauuaaaugaaac

SEQ ID NO: 530557 - RNA, 64 nt, Homo Sapiens
cuucaacugccuuaugcccuaacaaacacaaacaaacaaaaaacgaaagaacaaaacaaaacaa

SEQ ID NO: 530558 - RNA, 64 nt, Homo Sapiens
aaaccuuucuuuuguuuuuuguuuuguaaguaaaaacaaaaagauauacaaagauauucucuau

SEQ ID NO: 530559 - RNA, 64 nt, Homo Sapiens
uucauuuauuguguugugcaaacuuuucauuuuaaacaaaaacauuugguguacucagcaaaua

SEQ ID NO: 530560 - RNA, 64 nt, Homo Sapiens
aacaguaaucuauguguuucuauauguauuuaaaaacaaaaagcguauaccuggcuuuuuaaaa

SEQ ID NO: 530561 - RNA, 64 nt, Homo Sapiens
cugccuucagacauuuggugcucugucuuccacaaacaaaaauuuaggugcaucuaucucuucg

SEQ ID NO: 530562 - RNA, 62 nt, Homo Sapiens
aaaacaauucauuagccucaauuaaaagcaaaaacaaaaaacuucaaggcuuucagguauga

SEQ ID NO: 530563 - RNA, 64 nt, Homo Sapiens
cguguaauaaaguuaguggccaaaaaaaacaaaaaacaaaaaaacaacaauaagcuagaaaaga

SEQ ID NO: 530564 - RNA, 64 nt, Homo Sapiens
aaaaaaacguguaauaaagugaaaagacaaaaaaaacaaaaaacuuucuaccaacaauaagcua

SEQ ID NO: 530565 - RNA, 64 nt, Homo Sapiens
cacuuuucuaaggacugaaguuuuuuuuuuuuuuaacaaaaaaauagaauaguuaucccccccu

SEQ ID NO: 530566 - RNA, 64 nt, Homo Sapiens
ugaaggacuccaacuagaaguucucugaguuggaaacaaaaacaguaucuucauuauucucauu

SEQ ID NO: 530567 - RNA, 64 nt, Homo Sapiens
uacauucguugggcuuuuuucuuuguaccuagaaaacaaaaaauccuggggcuaguuuuuuaug

SEQ ID NO: 530568 - RNA, 64 nt, Homo Sapiens
ccauuuuaaaaaagguguauugcagaaaacaccaaacaaaaaugaaaauauuuccucaguacuu

SEQ ID NO: 530569 - RNA, 64 nt, Homo Sapiens
cuacuaauauaacuacuguuacaaaauuuaucauaacaaaaauaggcucuuaccaaguuuaaac

SEQ ID NO: 530570 - RNA, 64 nt, Homo Sapiens
cauguauuuaacuuuuuuuuaagcacagcaguaaaacaaaaaccuucauuacuucauguauauc

SEQ ID NO: 530571 - RNA, 64 nt, Homo Sapiens
aaacacaaaagcugcaugucaaaaaaaaaacaaaaacaaaaaaaaacugguuuuuuucaaaaaa

SEQ ID NO: 530572 - RNA, 64 nt, Homo Sapiens
aaaaaaaaacacaaaagcugaaaaaaaaaaaaaaaacaaaaacaaaaauaaacugguuuuuuuc

SEQ ID NO: 530573 - RNA, 64 nt, Homo Sapiens
ggaguauaggaacugcuggcucuacaagcaaacaaacaaaaauacuuacaucucucuaugcugu

SEQ ID NO: 530574 - RNA, 64 nt, Homo Sapiens
gugacagagugaaacucguaucuccaaacaaacaaacaaaaaguccuuaaacauaugugaacaa

SEQ ID NO: 530575 - RNA, 64 nt, Homo Sapiens
aaacaaacaaacaaaaaguccuuaaacauaugugaacaaaaauuuugugauggaaggauucuag

SEQ ID NO: 530576 - RNA, 64 nt, Homo Sapiens
ugauuucaaguacccuguauucuggaugcuaaaaaacaaaaacaaacaaaaaaacaaaaacaaa

SEQ ID NO: 530577 - RNA, 64 nt, Homo Sapiens
uacccuguauucuggaugcuaaaaaacaaaaacaaacaaaaaaacaaaaacaaaaaaacaaaac

SEQ ID NO: 530578 - RNA, 64 nt, Homo Sapiens
auucuggaugcuaaaaaacaaaaacaaacaaaaaaacaaaaacaaaaaaacaaaaccagaauca

SEQ ID NO: 530579 - RNA, 64 nt, Homo Sapiens
gaugcuaaaaaacaaaaacaaacaaaaaaacaaaaacaaaaaaacaaaaccagaaucagguaaa

SEQ ID NO: 530580 - RNA, 64 nt, Homo Sapiens
guuuuaaccaguuguagucaaaaugcuacaauaaaacaaaaaagagaaagaaaaugaagagcau

SEQ ID NO: 530581 - RNA, 64 nt, Homo Sapiens
ucuuccauucuuaacaguaugugcccauuugcaaaacaaaaaugcuaauaaucaguaauagucc

SEQ ID NO: 530582 - RNA, 64 nt, Homo Sapiens
aauguuagaaaaagcagaucugucauugcaaaguaacaaaaauuuuaagcuuuuaaaaauguag

SEQ ID NO: 530583 - RNA, 64 nt, Homo Sapiens
cugaauauauugguaguaauuacuguaauuauucaacaaaaagcauauccguucaaaaauuuuu

SEQ ID NO: 530584 - RNA, 64 nt, Homo Sapiens
ucaagaccuaacugcagccgcuuugggaaaaaaaaacaaaaaacaaaaaacagaaaacaaaaaa

SEQ ID NO: 530585 - RNA, 64 nt, Homo Sapiens
cuaacugcagccgcuuugggaaaaaaaaacaaaaaacaaaaaacagaaaacaaaaaaaaaaaaa

SEQ ID NO: 530586 - RNA, 64 nt, Homo Sapiens
ucuguauauuuaugaccagagcaaaaauguaaaaaacaaaaaaaacaacaaaaaaaguuuguua

SEQ ID NO: 530587 - RNA, 64 nt, Homo Sapiens
ugaccagagcaaaaauguaaaaaacaaaaaaaacaacaaaaaaaguuuguuacuuugaauaguc

SEQ ID NO: 530588 - RNA, 64 nt, Homo Sapiens
acauuuuucaaguauuucuaaguauaaaaaacaaaacaaaaaucucuuaggaaaugucuagacc

SEQ ID NO: 530589 - RNA, 64 nt, Homo Sapiens
cuugacaaaauuuaagcugagcuuaaaagcaaaaaacaaaaaguacacagaaauauuuauuaaa

SEQ ID NO: 530590 - RNA, 64 nt, Homo Sapiens
acauauauacugcuguaucacuugucucaaaaaaaacaaaaaaaccuggggacagagcaagacu

SEQ ID NO: 530591 - RNA, 64 nt, Homo Sapiens
aauacaagcgccucaccuuaaguuuccaugaaauaacaaaaaaagcuaugaaaaggcuuccagg

SEQ ID NO: 530592 - RNA, 64 nt, Homo Sapiens
uguauaaaucccuaauauuuaaaaaaaaaaacaaaacaaaaaaagguuacaaaguuuguuaacu

SEQ ID NO: 530593 - RNA, 64 nt, Homo Sapiens
ggauggaaaggacuagccucuacugaugcaaaaaaacaaaaagcaacacaaacguuuccuucuu

SEQ ID NO: 530594 - RNA, 64 nt, Homo Sapiens
cacuccagccugagugacagagagagauucaaaaaacaaaaaaaaagcaaaaauauacuuugcu

SEQ ID NO: 530595 - RNA, 64 nt, Homo Sapiens
guacaaccuugauaacaaaaccuaaaaaaaaaacaacaaaaaaacccauaaagcuauagaccaa

SEQ ID NO: 530596 - RNA, 64 nt, Homo Sapiens
aacaaaacaaaacacaaaauccccuguucaaauaaacaaaaaauccaagauugauucaugaaau

SEQ ID NO: 530597 - RNA, 64 nt, Homo Sapiens
acuuuacacauuucaguuucuaaaauuuuaaauuaacaaaaauuauuucuuguguuauucagag

SEQ ID NO: 530598 - RNA, 64 nt, Homo Sapiens
cucaaugacaaagaccgagucuucuuuuuuuuuaaacaaaaacaaaaaaagcaaccagggcuau

SEQ ID NO: 530599 - RNA, 64 nt, Homo Sapiens
gacaaagaccgagucuucuuuuuuuuuaaacaaaaacaaaaaaagcaaccagggcuauuuguac

SEQ ID NO: 530600 - RNA, 64 nt, Homo Sapiens
auguguauuguuuuuauuuugcgaaacaaaacaaaacaaaaaaaaaagcuuggaacuccaucac

SEQ ID NO: 530601 - RNA, 64 nt, Homo Sapiens
acagggagagguggagaaggaaaaaacccuacaaaacaaaaacaaaccgcauacacguucaccg

SEQ ID NO: 530602 - RNA, 64 nt, Homo Sapiens
ucccccccaucuuuaaaaauaauuaguaauaaaaaacaaaaauuccauaucuagccccauccca

SEQ ID NO: 530603 - RNA, 64 nt, Homo Sapiens
auuuuuuaaagucccaccuuucaauguuuaauaaaacaaaaagagaaauccuuaaucuaaaagc

SEQ ID NO: 530604 - RNA, 64 nt, Homo Sapiens
ggccauuagguaccuagcagaugugcacaauauaaacaaaaagauaucuggccuaccuuacuac

SEQ ID NO: 530605 - RNA, 64 nt, Homo Sapiens
aaaauccucaauccagcuauaaaauugucccuuaaacaaaaauuagaaggcaaacccaucaaca

SEQ ID NO: 530606 - RNA, 64 nt, Homo Sapiens
gucccuuaaacaaaaauuaaaaggcaaacccaucaacaaaaauuaaauuggagcuucauggcag

SEQ ID NO: 530607 - RNA, 64 nt, Homo Sapiens
ucaugggaccacuucuagaacuauguugaagcucaacaaaaaaguaagacaacucuuguguacg

SEQ ID NO: 530608 - RNA, 64 nt, Homo Sapiens
caccuagaaagcauccuuggcccacauaguguggaacaaaaaguuuaagauuguuuaucuggag

SEQ ID NO: 530609 - RNA, 64 nt, Homo Sapiens
aaacaaaacauaaaauauaaaguaaaaaaacaaaaacaaaaacaauguuugaauggaggacgcc

SEQ ID NO: 530610 - RNA, 64 nt, Homo Sapiens
aaaacaaaacaaaacauaaagacgccaguaaaaaaacaaaaacaauguaaauguuugaauggag

SEQ ID NO: 530611 - RNA, 64 nt, Homo Sapiens
cgaaagcaucuucacaaugagacugaaaacaaaaaacaaaaaaacucauucuucagugccucau

SEQ ID NO: 530612 - RNA, 64 nt, Homo Sapiens
aaaaaaacgaaagcaucuucgccucaugacugaaaacaaaaaacagcacaacucauucuucagu

SEQ ID NO: 530613 - RNA, 64 nt, Homo Sapiens
uguugucuaauauaucuacaaaucuaaaaaaaaaaacaaaaaacgcuuauucuuuaacaaagag

SEQ ID NO: 530614 - RNA, 64 nt, Homo Sapiens
aaaaauuaguucccaaguaaauaauaaaacuaaaaacaaaaaguuauuuucauaaucagucaaa

SEQ ID NO: 530615 - RNA, 64 nt, Homo Sapiens
cgauauaauaguuuggguuuuccauugaaaguuaaacaaaaagcauacuuaucucuguuaagac

SEQ ID NO: 530616 - RNA, 64 nt, Homo Sapiens
aguuuuaauaaaacaugcugcaaccaugguauacaacaaaaauacauuucuuuggugauugaaa

SEQ ID NO: 530617 - RNA, 64 nt, Homo Sapiens
uucuggcuuuuaauuuugccagcuaaggacauaaaacaaaaauaaacaaacaaaaacaaauagc

SEQ ID NO: 530618 - RNA, 64 nt, Homo Sapiens
uuugccagcuaaggacauaaaacaaaaauaaacaaacaaaaacaaauagccaucugcuaucagc

SEQ ID NO: 530619 - RNA, 64 nt, Homo Sapiens
gcccccaucagggaccagacuguuccaaaaaaaaaacaaaaaacaaaaacaaacaaaaaaacac

SEQ ID NO: 530620 - RNA, 64 nt, Homo Sapiens
ucagggaccagacuguuccaaaaaaaaaacaaaaaacaaaaacaaacaaaaaaacacuuaaaag

SEQ ID NO: 530621 - RNA, 64 nt, Homo Sapiens
gacuguuccaaaaaaaaaacaaaaaacaaaaacaaacaaaaaaacacuuaaaagcccaaggagu

SEQ ID NO: 530622 - RNA, 64 nt, Homo Sapiens
agcauacugagacccugccuuuaaaaacaaacagaacaaaaacaaaacaccagggacacauuuc

SEQ ID NO: 530623 - RNA, 64 nt, Homo Sapiens
auaaagaauucugugagaaaaaauuuaauaaagcaacaaaaauuacucuuauucuucauugcuu

SEQ ID NO: 530624 - RNA, 64 nt, Homo Sapiens
gucuguaugacagccacuccuaaaaauaaacaacaacaaaaacaaaaaaagaagaaaacuaaau

SEQ ID NO: 530625 - RNA, 64 nt, Homo Sapiens
augacagccacuccuaaaaauaaacaacaacaaaaacaaaaaaagaagaaaacuaaauaaaaau

SEQ ID NO: 530626 - RNA, 64 nt, Homo Sapiens
aauauuuauuguauuuuaguuauucaccauguaaaacaaaaaacucucucuaugguaaagauau

SEQ ID NO: 530627 - RNA, 64 nt, Homo Sapiens
aaccccaaaaugaagauuauuuagaacagaaaacaacaaaaaauuggagaacagugauuuuuuu

SEQ ID NO: 530628 - RNA, 64 nt, Homo Sapiens
ugcucacacuccacaucccgaauuaaggcaacugaacaaaaaaaaugacuagaaagugaauaaa

SEQ ID NO: 530629 - RNA, 64 nt, Homo Sapiens
ugaaccaaaacauuccguuuacacacacacacacaacaaaaauuuuucagaaaacagaaaaaaa

SEQ ID NO: 530630 - RNA, 64 nt, Homo Sapiens
uagaauugaggaguuguaccaaaaaaaaaaaaacaacaaaaacuuagaacaagacccugucuca

SEQ ID NO: 530631 - RNA, 64 nt, Homo Sapiens
cauggaagguuagguuugucguuagagguuugucaacaaaaagaucaacacaaagacauggaag

SEQ ID NO: 530632 - RNA, 64 nt, Homo Sapiens
ugcccgacuugcaaucuaaucacugucugaauuaaacaaaaagcgauugcaaacaaacagugaa

SEQ ID NO: 530633 - RNA, 64 nt, Homo Sapiens
aaacacacaccacacacacggcaguuucuccaaaaacaaaaacaugguuacaauucauaaugca

SEQ ID NO: 530634 - RNA, 64 nt, Homo Sapiens
ucuucauacuuccucaucccaaagaugaaaagacaacaaaaauaagcauuacuuaacacaguau

SEQ ID NO: 530635 - RNA, 64 nt, Homo Sapiens
uugcucaggacauuugagguacccucagcagaauaacaaaaacuuaaagcuuaccaacaaaaga

SEQ ID NO: 530636 - RNA, 64 nt, Homo Sapiens
ucauaaagggcacuaaaaguaaaacucagguuagaacaaaaauguuuccagcacauuuuuuuua

SEQ ID NO: 530637 - RNA, 64 nt, Homo Sapiens
aagcuaaaaugaaucaacgguucagugacugauaaacaaaaauguauuugguuuaguucugugu

SEQ ID NO: 530638 - RNA, 64 nt, Homo Sapiens
acugauaucgcaccuaaauuaaaacaaaaacaaaaacaaaaaaggcaaggcucugucucaaaaa

SEQ ID NO: 530639 - RNA, 64 nt, Homo Sapiens
aaaaagacugauaucgcacccaaaaaaaaacaaaaacaaaaacagacagagcaaggcucugucu

SEQ ID NO: 530640 - RNA, 64 nt, Homo Sapiens
aaaacaaaaaagacugauaucugucucaaaaaaaaacaaaaacacugggugacagagcaaggcu

SEQ ID NO: 530641 - RNA, 64 nt, Homo Sapiens
gaaacaaccuuggccuuaauuauuaaacaaaaauaacaaaaaaaauugacaaaauuugaagaaa

SEQ ID NO: 530642 - RNA, 64 nt, Homo Sapiens
acaaaaaaagaaacaaccuuuugaagaaauauuaaacaaaaauagcuucagcaauugacaaaau

SEQ ID NO: 530643 - RNA, 64 nt, Homo Sapiens
gagaaacccccaagccuggauagaaaacaaaaagaacaaaaaaagggugacggcuucuggcacu

SEQ ID NO: 530644 - RNA, 64 nt, Homo Sapiens
acaaaaaaagagaaacccccucuggcacuuagaaaacaaaaagaagagaggaagggugacggcu

SEQ ID NO: 530645 - RNA, 64 nt, Homo Sapiens
guuuguuuucuuuccuaucuucauguugucugugaacaaaaacaugaguauucuacauagacaa

SEQ ID NO: 530646 - RNA, 64 nt, Homo Sapiens
aaaacugcuacacucacuuaugaauauuaaucaaaacaaaaagcauaaaaauacaauuaauuuu

SEQ ID NO: 530647 - RNA, 64 nt, Homo Sapiens
ugcugcucagaaugccagccuguugaagauaaacaacaaaaaugcauugguaaagcccaggugu

SEQ ID NO: 530648 - RNA, 64 nt, Homo Sapiens
cucuuaaaauuauuauuuuaaguaaaagccaauaaacaaaaacgaaaaggcaaguuacgagacu

SEQ ID NO: 530649 - RNA, 64 nt, Homo Sapiens
uuuauuuauacuaaauaacugucaaccauuuucuaacaaaaaguaagacugaauugacugauua

SEQ ID NO: 530650 - RNA, 64 nt, Homo Sapiens
uuuaacuauuuaaaguuaugaaaaaauagacgucaacaaaaauguguaaggggauauuagguuu

SEQ ID NO: 530651 - RNA, 64 nt, Homo Sapiens
uauuagguuugcuaaauucuuucacagacuauaaaacaaaaaauuuugaggaacaccucucauc

SEQ ID NO: 530652 - RNA, 64 nt, Homo Sapiens
auaaugacaaaaagcacaugcagaguaauacacaaacaaaaaaagugacaguuacuuuuuugug

SEQ ID NO: 530653 - RNA, 64 nt, Homo Sapiens
aucugucuauaucauucauuacguguaaguauuuaacaaaaaagcauucuugaccaugaaugaa

SEQ ID NO: 530654 - RNA, 64 nt, Homo Sapiens
guuucuuucuuuccaaaaucagccuucugucuguaacaaaaauguacuuuauagagauggagga

SEQ ID NO: 530655 - RNA, 64 nt, Homo Sapiens
agaaaguagcacauggaguagcugagguuaaacaaacaaaaaaaaauuuuaaacaaagaaagga

SEQ ID NO: 530656 - RNA, 64 nt, Homo Sapiens
auuauuaauagcucagguuaaaaacacccauuuaaacaaaaacaagagcauuuguaauaggaag

SEQ ID NO: 530657 - RNA, 64 nt, Homo Sapiens
uugauaaauauauaugaucauugaaauacuuuuuaacaaaaaacagauucuauauuauuauaua

SEQ ID NO: 530658 - RNA, 64 nt, Homo Sapiens
agggaagcacaugaucaugggaaugauagcccagaacaaaaagaaaucuugucuuaccacagug

SEQ ID NO: 530659 - RNA, 64 nt, Homo Sapiens
acaguauuguaaucccaucaaaagaugaaagaaaaacaaaaacaaaaaccaacaacaauuagcc

SEQ ID NO: 530660 - RNA, 64 nt, Homo Sapiens
uuguaaucccaucaaaagaugaaagaaaaacaaaaacaaaaaccaacaacaauuagccauaguu

SEQ ID NO: 530661 - RNA, 64 nt, Homo Sapiens
guuuugguuucuguauuuuucacaaugauuaaugaacaaaaacaaagagaaaaaaacacacauc

SEQ ID NO: 530662 - RNA, 64 nt, Homo Sapiens
ugugaacgaaaggaaggaacaucuuucuauggcuaacaaaaacuaaaggggaagugaggaaaca

SEQ ID NO: 530663 - RNA, 64 nt, Homo Sapiens
aaguccaaacugauauaucccaaaaaacaacaacaacaaaaaaccacugaacuucaaaacaaaa

SEQ ID NO: 530664 - RNA, 64 nt, Homo Sapiens
aacaacaacaaaaaacaagugaacuucaaaacaaaacaaaaaacacuguaaaaaaaagugcacu

SEQ ID NO: 530665 - RNA, 64 nt, Homo Sapiens
augcuuauagcuaaacugccaaucauagagcaacaacaaaaauaauagagaggggcuuuauuuc

SEQ ID NO: 530666 - RNA, 64 nt, Homo Sapiens
cccugguggcaaagcuaucauucucagaacaucaaacaaaaaugaaaaguaccaaacauuugca

SEQ ID NO: 530667 - RNA, 64 nt, Homo Sapiens
ugaauuaguucaugagccuuuuugaagagacacgaacaaaaaucacuuuucuaagauagcaauu

SEQ ID NO: 530668 - RNA, 64 nt, Homo Sapiens
acaccucaccaugagugcuaaacaaaaacaaacaaacaaaaaaacucugucucaaaaaaaaaaa

SEQ ID NO: 530669 - RNA, 64 nt, Homo Sapiens
aacaaacaaaaaaaacaccucucaaaaaaaaaaaaacaaaaacagcaacagaguaagacucugu

SEQ ID NO: 530670 - RNA, 64 nt, Homo Sapiens
gcuaucaaucuuauaaauauuuaacauuguucauaacaaaaaauguauguucugagauauaaug

SEQ ID NO: 530671 - RNA, 64 nt, Homo Sapiens
ccuaggagauaaauguagagcacaauauuccgaaaacaaaaaaaguuuggucuuuauuaaaaau

SEQ ID NO: 530672 - RNA, 64 nt, Homo Sapiens
caugagcagugguguucuaaaaaaaacaaaacaaaacaaaaaaaugcuuuguuuaaaaaaacga

SEQ ID NO: 530673 - RNA, 64 nt, Homo Sapiens
acaaugcuguugacaguggacuccacccucucccaacaaaaauauacaaaacguaacuccaguc

SEQ ID NO: 530674 - RNA, 64 nt, Homo Sapiens
cuguccacccuugagaauccaaaacaaacaaacaaacaaaaagcuuccuugaaaauuuuauuaa

SEQ ID NO: 530675 - RNA, 64 nt, Homo Sapiens
acaucuucaguuuuucucccaagucuauaugaaaaacaaaaauacuauauuuuacauucuugga

SEQ ID NO: 530676 - RNA, 64 nt, Homo Sapiens
ggggaaauggggaggggaaacuuaccaugguuugaacaaaaaaaauucugcagaaaucagaacu

SEQ ID NO: 530677 - RNA, 64 nt, Homo Sapiens
gaaaaauguaauaauugauaauguccugguuauuaacaaaaaagaguucuuccaagagacuucc

SEQ ID NO: 530678 - RNA, 64 nt, Homo Sapiens
auaaugcuaguccuagauuacuuauugauuuaaaaacaaaaaaaagauuacuuaauuuugauuu

SEQ ID NO: 530679 - RNA, 64 nt, Homo Sapiens
aaacaaaaaaaagauuacuuaauuuugauuuaaaaacaaaaaaucguaaaauacaaaaaccagu

SEQ ID NO: 530680 - RNA, 64 nt, Homo Sapiens
uaaacacaaggaacauuccauaucauuagucgaaaacaaaaacaaaaaaaaaaccuuuggucau

SEQ ID NO: 530681 - RNA, 64 nt, Homo Sapiens
caaggaacauuccauaucauuagucgaaaacaaaaacaaaaaaaaaaccuuuggucauuuguaa

SEQ ID NO: 530682 - RNA, 64 nt, Homo Sapiens
auuugacugugacuuuaaucuaaauuacuauguaaacaaaaaguagauaguuucacuuuuuaaa

SEQ ID NO: 530683 - RNA, 64 nt, Homo Sapiens
augaauaaaucuuaaaugcuuuguuuaauuaaaaaacaaaaaucaccaauauccaagacaugaa

SEQ ID NO: 530684 - RNA, 64 nt, Homo Sapiens
ucaagucuuuauaguuguaagaacuuucucuuuuaacaaaaaugcacuccccuuaacugucuuu

SEQ ID NO: 530685 - RNA, 64 nt, Homo Sapiens
uuauuugugcccucuuuuauaaaauauuuuuuaaaacaaaaacauuucuauuaaaacuguuguu

SEQ ID NO: 530686 - RNA, 64 nt, Homo Sapiens
aaacccuuugcuguaucacuuaaaaaaaaacaaaaacaaaaacauuuccucuuuccuuuccagu

SEQ ID NO: 530687 - RNA, 64 nt, Homo Sapiens
aaaacaaaacccuuugcuguuccaguuaaaaaaaaacaaaaacacccuucuuuccucuuuccuu

SEQ ID NO: 530688 - RNA, 64 nt, Homo Sapiens
aacugcaaaagucuaaaauacaaaacaaaaagcaaacaaaaaaaugaguauaaaggaaaaacag

SEQ ID NO: 530689 - RNA, 64 nt, Homo Sapiens
aaacaaaaaaaaacugcaaaaggaaaaacagcaaaacaaaaagcgcaagagucccugaguauaa

SEQ ID NO: 530690 - RNA, 64 nt, Homo Sapiens
uuaaaaaaaagguuugcuaaaaaaacaaaaaaaaaacaaaaaauaccaucaauuuaaaaguaaa

SEQ ID NO: 530691 - RNA, 64 nt, Homo Sapiens
aaacaaaaaauuuaaaaaaauuaaaaguaaaaaaaacaaaaaaaugccacgguucaccaucaau

SEQ ID NO: 530692 - RNA, 64 nt, Homo Sapiens
gcuucaacuguucgaauuuuguggcccagcaauuaacaaaaacacaucauccggauuucugguu

SEQ ID NO: 530693 - RNA, 64 nt, Homo Sapiens
gcugcauggcucgcauggaagacuucugacaaaaaacaaaaaguuauuguaaauaaguaacuuu

SEQ ID NO: 530694 - RNA, 64 nt, Homo Sapiens
aaaaaaaaaaaggaaagaaacccugaacaaaaaaaacaaaaagauaugucaaccagugaggcug

SEQ ID NO: 530695 - RNA, 64 nt, Homo Sapiens
acaaaaagaaaaaaaaaaaagugaggcugcccugaacaaaaaaaaaauguuauuaugucaacca

SEQ ID NO: 530696 - RNA, 64 nt, Homo Sapiens
ggacuuuauuguccuguuucuaucaaauuggacuaacaaaaauugauauaauacauucaucaca

SEQ ID NO: 530697 - RNA, 64 nt, Homo Sapiens
cauggugcaaccucgucuuuacuaaaaauacaaaaacaaaaauuagccagggguggugguaugc

SEQ ID NO: 530698 - RNA, 64 nt, Homo Sapiens
cagccugggagacagagcaagacuccaucucaaaaacaaaaacaaaacaaaacaacaacaaaaa

SEQ ID NO: 530699 - RNA, 64 nt, Homo Sapiens
cuccaucucaaaaacaaaaacaaaacaaaacaacaacaaaaaaagaaguuaaauaacuuguuua

SEQ ID NO: 530700 - RNA, 64 nt, Homo Sapiens
guccuuaguuuaauucuauuguaucuguuuauuuaacaaaaaauucaucauaccaaaaagugua

SEQ ID NO: 530701 - RNA, 64 nt, Homo Sapiens
caaaaaguguaagugaaaacccccuuuaaaacaaaacaaaaaaaugaaauaaaauuaggcaaau

SEQ ID NO: 530702 - RNA, 64 nt, Homo Sapiens
uucuguuuaauuauguaaaaaacaaaacuacaacaacaaaaaaagaaaaaaguuaaaaaagaaa

SEQ ID NO: 530703 - RNA, 64 nt, Homo Sapiens
aagaaaaaaguuaaaaaagaaaaaaacaccaaaaaacaaaaacaaacaaaaaaaaaaacccaca

SEQ ID NO: 530704 - RNA, 64 nt, Homo Sapiens
uuaaaaaagaaaaaaacaccaaaaaacaaaaacaaacaaaaaaaaaaacccacaacccuuaucu

SEQ ID NO: 530705 - RNA, 64 nt, Homo Sapiens
augagaauguuguuuuaaaagaaaauagcaaaacaacaaaaaagcaaaccuuaaaaugugaaga

SEQ ID NO: 530706 - RNA, 64 nt, Homo Sapiens
auaccagauuuuaagccgugauuuugauuuaaauaacaaaaauaaugugauuguaauuaaaaau

SEQ ID NO: 530707 - RNA, 64 nt, Homo Sapiens
gaagauggucaaguuuguaaggguuauuuaaaaaaacaaaaaagcagacauucuaguuugugga

SEQ ID NO: 530708 - RNA, 64 nt, Homo Sapiens
uguaaaaauaauuuugagcucacuuuuacaaaaaaacaaaaaccuuuuaccaagauuauaaaaa

SEQ ID NO: 530709 - RNA, 64 nt, Homo Sapiens
ucacuguaaacaggguacguccuaauggccugccaacaaaaaccuuugcuuguuaccauggaaa

SEQ ID NO: 530710 - RNA, 64 nt, Homo Sapiens
acaauucuucauucagaaaaccuaaaaacaaacaaacaaaaaaaaaaaaaaaaaaaaaaaaaau

SEQ ID NO: 530711 - RNA, 64 nt, Homo Sapiens
aguguggcaaaaaaaaaaaaacugaugaggucuuaacaaaaaccauugagggcaagcacccagg

SEQ ID NO: 530712 - RNA, 64 nt, Homo Sapiens
aucaauguguauguggcuguuuguugagaacaaaaacaaaaaguuguuuaacuuuguauuuuga

SEQ ID NO: 530713 - RNA, 64 nt, Homo Sapiens
aaaaguaucaauguguauguuuuugauuguugagaacaaaaacacaauuguguuuaacuuugua

SEQ ID NO: 530714 - RNA, 64 nt, Homo Sapiens
cccaguacuguggcucaggagagggaaacuuuaaaacaaaaacauaugaucuuccauccaagug

SEQ ID NO: 530715 - RNA, 64 nt, Homo Sapiens
aacaggcugccauaauauauaaaaagaaaaaaaaaacaaaaacauuguuagugaauuuggaaau

SEQ ID NO: 530716 - RNA, 64 nt, Homo Sapiens
auucaggaacaacggcuaauugaaugaaaagcaaaacaaaaacaaaguuacaaguugauaucgu

SEQ ID NO: 530717 - RNA, 64 nt, Homo Sapiens
uuauaaacuaauauaugugagagugcuuaguugaaacaaaaaggaguuuuaguagacaguauua

SEQ ID NO: 530718 - RNA, 64 nt, Homo Sapiens
uauuggauuaaaucugauagguuuuccagaaaugaacaaaaaucagcucuaaaaccaaagcuga

SEQ ID NO: 530719 - RNA, 64 nt, Homo Sapiens
uaaauccuuuccaauaauugacugguggaaggaaaacaaaaaacaaaaacuaaaaaccucuuag

SEQ ID NO: 530720 - RNA, 64 nt, Homo Sapiens
uuuccaauaauugacugguggaaggaaaacaaaaaacaaaaacuaaaaaccucuuagcuuuucu

SEQ ID NO: 530721 - RNA, 64 nt, Homo Sapiens
aagugauacucuuuauuacaagaaacaaggaauuaacaaaaauaaggaacuuguugcuaccuuu

SEQ ID NO: 530722 - RNA, 64 nt, Homo Sapiens
ugauuaaaauccaaaacuuuagcuguauuucaguaacaaaaacauaccuuacuagacugugaug

SEQ ID NO: 530723 - RNA, 64 nt, Homo Sapiens
ccuccuuuaacuccuccuaccccccaagguaagaaacaaaaaacaaacaaacaaacaaaaauag

SEQ ID NO: 530724 - RNA, 64 nt, Homo Sapiens
ccccccaagguaagaaacaaaaaacaaacaaacaaacaaaaauagaagacaaaagaaagacaua

SEQ ID NO: 530725 - RNA, 64 nt, Homo Sapiens
augggaaagggcuguugauauuaaaaacaaacaaaacaaaaaagccccacacauaacuguuuug

SEQ ID NO: 530726 - RNA, 64 nt, Homo Sapiens
gguuuaacucuuuaguuuuauuuuaagaggggaaaacaaaaauaucuugcaagcagaaccuugg

SEQ ID NO: 530727 - RNA, 64 nt, Homo Sapiens
augugaaagugcacuuaagaguuuguuuauuauaaacaaaaagcacaaaguuaggaaguuuguu

SEQ ID NO: 530728 - RNA, 64 nt, Homo Sapiens
acucaugccacaguaugucgcacaacaaauuaaaaacaaaaacaccucagaacuuuaguaacag

SEQ ID NO: 530729 - RNA, 64 nt, Homo Sapiens
aggaaggaaaaaaaaagaaaacaaaacaaaauaaaacaaaaaaauuggcaugcuguaaaacaaa

SEQ ID NO: 530730 - RNA, 64 nt, Homo Sapiens
agcucuaaaaccaaagcugaguuuuccagaaaugaacaaaaaucuauuggauuaaaucugauag

SEQ ID NO: 530731 - RNA, 64 nt, Homo Sapiens
aguuuuaguagacaguauuagagugcuuaguugaaacaaaaagguuauaaacuaauauauguga

SEQ ID NO: 530732 - RNA, 64 nt, Homo Sapiens
aaaaaccucuuagcuuuucugaaggaaaacaaaaaacaaaaacuuuuccaauaauugacuggug

SEQ ID NO: 530733 - RNA, 64 nt, Homo Sapiens
aaaaacuaaaaaccucuuagacugguggaaggaaaacaaaaaacuaaauccuuuccaauaauug

SEQ ID NO: 530734 - RNA, 64 nt, Homo Sapiens
accucaugagugcauggauucaaaaaacaaaaaaaacaaaaaaaccugcuaaaaagacaaaaaa

SEQ ID NO: 530735 - RNA, 64 nt, Homo Sapiens
acaaaaaaaaccucaugagugacaaaaaacaaaaaacaaaaaaacccccucuuccugcuaaaaa

SEQ ID NO: 530736 - RNA, 64 nt, Homo Sapiens
aaaaaaaacaaaaaaaaccucuaaaaagacaaaaaacaaaaaacauauucucccccucuuccug

SEQ ID NO: 530737 - RNA, 64 nt, Homo Sapiens
agucuucagaaaugaaaaucuaaaaugaagaacuaacaaaaauuaucauggaccagguccucua

SEQ ID NO: 530738 - RNA, 64 nt, Homo Sapiens
aauugaaauuguuucccaugagaaggagaugcuuaacaaaaaaacaggaaacagcucaucccag

SEQ ID NO: 530739 - RNA, 64 nt, Homo Sapiens
uggcagaugcauauugugucuuaaaaaaaacaaaaacaaaaacauuguugcacuuuuaguuuuu

SEQ ID NO: 530740 - RNA, 64 nt, Homo Sapiens
aaaacauggcagaugcauauguuuuuuuaaaaaaaacaaaaacacugacuuuguugcacuuuua

SEQ ID NO: 530741 - RNA, 64 nt, Homo Sapiens
cucauguggggauguuugugcugcagacaaaaagaacaaaaaaaaauuuuuaaauaccacaaga

SEQ ID NO: 530742 - RNA, 64 nt, Homo Sapiens
aaaaauuuuuaaauaccacaagauggaaaaaaaaaacaaaaaaauuuaaaaagauggaauguag

SEQ ID NO: 530743 - RNA, 64 nt, Homo Sapiens
acuuuuuuuaaucguuguaaaaaaaaaacaaaaaaacaaaaaaaucuccucauccuaguucuuu

SEQ ID NO: 530744 - RNA, 62 nt, Homo Sapiens
caaaaaaaacuuuuuuuaauuucuuuaaaaaaaacaaaaaaacggcucucuccucauccuag

SEQ ID NO: 530745 - RNA, 64 nt, Homo Sapiens
ccaucucuucagaccccuuugccuuuaaaaaaaaaacaaaaacaaaaacaaaaaaacccauaau

SEQ ID NO: 530746 - RNA, 64 nt, Homo Sapiens
cuucagaccccuuugccuuuaaaaaaaaaacaaaaacaaaaacaaaaaaacccauaaugcccac

SEQ ID NO: 530747 - RNA, 64 nt, Homo Sapiens
accccuuugccuuuaaaaaaaaaacaaaaacaaaaacaaaaaaacccauaaugcccacagaaug

SEQ ID NO: 530748 - RNA, 64 nt, Homo Sapiens
acuuggaggguugguccucuugccuccuggaaaaaacaaaaacaaaaaacugcagugaaagaca

SEQ ID NO: 530749 - RNA, 64 nt, Homo Sapiens
aggguugguccucuugccuccuggaaaaaacaaaaacaaaaaacugcagugaaagacaagcugc

SEQ ID NO: 530750 - RNA, 64 nt, Homo Sapiens
auuuaacucugccucggccauucaaaagucuaauaacaaaaaauguaaaccuaauuuggcaguu

SEQ ID NO: 530751 - RNA, 64 nt, Homo Sapiens
cuaauuguccaauucuacgugcucucuauaccaaaacaaaaaaaaaaagcuauccaccuuucca

SEQ ID NO: 530752 - RNA, 64 nt, Homo Sapiens
cccuucugugugaccgaccccuuggccaaaaaaaaacaaaaagcaaaaaacaaaaaccuacccu

SEQ ID NO: 530753 - RNA, 64 nt, Homo Sapiens
cgaccccuuggccaaaaaaaaacaaaaagcaaaaaacaaaaaccuacccuguucugguuuuuuu

SEQ ID NO: 530754 - RNA, 64 nt, Homo Sapiens
cagcacauacaagaaacauagaaaagaaaacaaaaacaaaaaccccccuuauucccgaggccca

SEQ ID NO: 530755 - RNA, 64 nt, Homo Sapiens
aaaacccagcacauacaagaggcccagaaaagaaaacaaaaacaucuccuccccuuauucccga

SEQ ID NO: 530756 - RNA, 64 nt, Homo Sapiens
uguaauguugucuagggauggagucaaaguaaaaaacaaaaaauaaauauuaaagauuuccuug

SEQ ID NO: 530757 - RNA, 64 nt, Homo Sapiens
uuggcaccagccaccugggaaccauuagccuguaaacaaaaaguagaacuuucaggcagauccc

SEQ ID NO: 530758 - RNA, 64 nt, Homo Sapiens
ggaaaaaaaaaaccuuguauaaaaaaaaaacaaaaacaaaaaaugaauaacccuuuuagcauug

SEQ ID NO: 530759 - RNA, 64 nt, Homo Sapiens
aaaaauggaaaaaaaaaaccgcauugaaaaaaaaaacaaaaacaaauucugaauaacccuuuua

SEQ ID NO: 530760 - RNA, 64 nt, Homo Sapiens
aaacccuauuuaaaugaaagcaaaaaacaaaaaaaacaaaaaaaagggaaguaaaaaaacaaaa

SEQ ID NO: 530761 - RNA, 64 nt, Homo Sapiens
acaaaaaaaaaacccuauuuaaaacaaaacaaaaaacaaaaaaaaaaucgaauagggaaguaaa

SEQ ID NO: 530762 - RNA, 64 nt, Homo Sapiens
aaaaaaaacaaaaaaaaaacaaguaaaaaaacaaaacaaaaaacgaaacucaaaucgaauaggg

SEQ ID NO: 530763 - RNA, 64 nt, Homo Sapiens
gaacaaaagaagagagaaggaaaaaaacacacaaaacaaaaacauuucuaaaaaacaaacaaaa

SEQ ID NO: 530764 - RNA, 64 nt, Homo Sapiens
aaaacacacaaaacaaaaacuuuucuaaaaaacaaacaaaaaaaauuucuucucccccaccccu

SEQ ID NO: 530765 - RNA, 64 nt, Homo Sapiens
uaaagggugagaauuugcuugaagaaaaacaaaaaacaaaaaacuuugguuuauuuagaaaaag

SEQ ID NO: 530766 - RNA, 64 nt, Homo Sapiens
aaaaaacuaaagggugagaagaaaaaggaagaaaaacaaaaaacccaagcauuugguuuauuua

SEQ ID NO: 530767 - RNA, 64 nt, Homo Sapiens
ccaagaaaccaagucaacuuacugccugccagaaaacaaaaacaccuccuucaccccuccucuc

SEQ ID NO: 530768 - RNA, 64 nt, Homo Sapiens
aauccuagauaguuuucccuauaaauuacucuaaaacaaaaaagcaaucugucuuuaaguaggg

SEQ ID NO: 530769 - RNA, 64 nt, Homo Sapiens
aaaaacaacaacauaaaaaugcucucacuguuuuaacaaaaaaaauauuccaguaaguuauuuu

SEQ ID NO: 530770 - RNA, 64 nt, Homo Sapiens
uauaguuagaaaaauggaagugggaaaaaacaaaaacaaaaaacguuguuuuuuuuuuaacaac

SEQ ID NO: 530771 - RNA, 64 nt, Homo Sapiens
aaaaacuauaguuagaaaaaaacaacugggaaaaaacaaaaacacugugaguuguuuuuuuuuu

SEQ ID NO: 530772 - RNA, 64 nt, Homo Sapiens
gagcaaaugcuagagcgauuucagcugauagaaaaacaaaaaugaaaaaaaaaacacaaaaaac

SEQ ID NO: 530773 - RNA, 64 nt, Homo Sapiens
auagaaaaacaaaaaugaaaaaaaaaacacaaaaaacaaaaaacauggcacguugcuaguuuac

SEQ ID NO: 530774 - RNA, 64 nt, Homo Sapiens
uugggggaagaaauuggcaacaucaaugaauuaaaacaaaaaucuucuuugauuuauuuuauug

SEQ ID NO: 530775 - RNA, 64 nt, Homo Sapiens
cagaaucuuccuuuuuuuguucuuuaaaaaagaaaacaaaaagcagauuaugaaaggaacaggc

SEQ ID NO: 530776 - RNA, 64 nt, Homo Sapiens
gauggaggaagaucuacgaagcaaauggaaaacaaacaaaaaaagaggcagggguugcaauccu

SEQ ID NO: 530777 - RNA, 64 nt, Homo Sapiens
uuggaaguaaagcacuccucagcaaauguaaaggaacaaaaauuauaacaaacugucucucaga

SEQ ID NO: 530778 - RNA, 64 nt, Homo Sapiens
aaccaaaaaaaaaaaaggaaaaaaaacacaaaacaacaaaaaccaaaaaaaaaaaaaaucacaa

SEQ ID NO: 530779 - RNA, 64 nt, Homo Sapiens
aacaacaaaaaccaaaaaaaaaaaaaaucacaaaaacaaaaaaacuauaaaaaagaaagaauua

SEQ ID NO: 530780 - RNA, 64 nt, Homo Sapiens
guuauggaagaaccgggacauuuuacagaaaaaaaacaaaaaacaacaaaaaauauacguggga

SEQ ID NO: 530781 - RNA, 64 nt, Homo Sapiens
aaccgggacauuuuacagaaaaaaaacaaaaaacaacaaaaaauauacgugggaaaaaaaacga

SEQ ID NO: 530782 - RNA, 64 nt, Homo Sapiens
accgagggaggcucugucucaaaagcaaagcaaaaacaaaaacaaaaacaccuaaaaaaccugc

SEQ ID NO: 530783 - RNA, 64 nt, Homo Sapiens
ggaggcucugucucaaaagcaaagcaaaaacaaaaacaaaaacaccuaaaaaaccugcaguuuu

SEQ ID NO: 530784 - RNA, 64 nt, Homo Sapiens
aauaaaugugauuuaucacauacacagaacuaaaaacaaaaaccacaugaccaugaucaucucu

SEQ ID NO: 530785 - RNA, 64 nt, Homo Sapiens
aaagacuuaaugaugaacaccccaaagcaauugcaacaaaaacaaaaauugacaagugggaccu

SEQ ID NO: 530786 - RNA, 64 nt, Homo Sapiens
uuaaugaugaacaccccaaagcaauugcaacaaaaacaaaaauugacaagugggaccuaauuaa

SEQ ID NO: 530787 - RNA, 64 nt, Homo Sapiens
aaccaccaaauccccaaauuaugcaaaaaacaaaaacaaaaaaacuaaacccaagcacccaaug

SEQ ID NO: 530788 - RNA, 64 nt, Homo Sapiens
aaaaaaaaccaccaaaucccccaaugaugcaaaaaacaaaaacaccuucccuaaacccaagcac

SEQ ID NO: 530789 - RNA, 64 nt, Homo Sapiens
gaaaacacacagaagagauugaggaaaaaaaagcaacaaaaaaaacaaaaaaacacaaacagaa

SEQ ID NO: 530790 - RNA, 64 nt, Homo Sapiens
aaaaaaaucaaaaaagcgaccuucugcugcaaggaacaaaaaagguuauuaaacgucuguggag

SEQ ID NO: 530791 - RNA, 64 nt, Homo Sapiens
cacacacacauuuuguacggaacaaaaaacaaaaaacaaaaaaccccccuuuuucuuguuaaaa

SEQ ID NO: 530792 - RNA, 64 nt, Homo Sapiens
aaaaaaccacacacacauuuguuaaaaaacaaaaaacaaaaaacgcuuuugcccccuuuuucuu

SEQ ID NO: 530793 - RNA, 64 nt, Homo Sapiens
aaaaaacaaaaaaccacacauuuucuuguuaaaaaacaaaaaacauuccuggcuuuugcccccu

SEQ ID NO: 530794 - RNA, 64 nt, Homo Sapiens
auuuaacagcuugaguauugcauuuccuuggccaaacaaaaauagcuacaaauccacaaaaauu

SEQ ID NO: 530795 - RNA, 64 nt, Homo Sapiens
ugaugccuuaggacauguuugaacugcagcaaaaaacaaaaacaaaaaacagugcauuagcaau

SEQ ID NO: 530796 - RNA, 64 nt, Homo Sapiens
cuuaggacauguuugaacugcagcaaaaaacaaaaacaaaaaacagugcauuagcaauuucaua

SEQ ID NO: 530797 - RNA, 64 nt, Homo Sapiens
ggcaacauagcgagaccucaucuccaaaaaagaaaacaaaaaacaaaaaaaggaaugauguucu

SEQ ID NO: 530798 - RNA, 64 nt, Homo Sapiens
uagcgagaccucaucuccaaaaaagaaaacaaaaaacaaaaaaaggaaugauguucuguagaga

SEQ ID NO: 530799 - RNA, 64 nt, Homo Sapiens
cacugauuuaaaacaaaccaaaaaaaaagaaaaaaacaaaaaaaaaaaucccuccuuucuagcu

SEQ ID NO: 530800 - RNA, 64 nt, Homo Sapiens
aaaaacaaaaaaaaaaaucccuccuuucuagcugaacaaaaaugugcaguuaauacuuggcgcu

SEQ ID NO: 530801 - RNA, 64 nt, Homo Sapiens
ugauuuaaauuuauaauuaaguaaauuacauuaaaacaaaaaaauuauacucaaaauucauuac

SEQ ID NO: 530802 - RNA, 64 nt, Homo Sapiens
ucauuguuuuacuuuugucuuccucacuaguguaaacaaaaauuucaaccagcauucaugccga

SEQ ID NO: 530803 - RNA, 64 nt, Homo Sapiens
cuggucugucuuuucuccauuuguuuaaaaaaaaaacaaaaacaaaaaacaacacuuuggugug

SEQ ID NO: 530804 - RNA, 64 nt, Homo Sapiens
ugucuuuucuccauuuguuuaaaaaaaaaacaaaaacaaaaaacaacacuuuggugugguggua

SEQ ID NO: 530805 - RNA, 64 nt, Homo Sapiens
uaugugaugccucuauuuucgacuguaaaacaaaaacaaaaaacugacuuuccucagaacauga

SEQ ID NO: 530806 - RNA, 64 nt, Homo Sapiens
aaaaacuaugugaugccucuacaugagacuguaaaacaaaaacagacuuaugacuuuccucaga

SEQ ID NO: 530807 - RNA, 64 nt, Homo Sapiens
caacuguucuuugccuaauaaaaaaaaacaaaaaaacaaaaaaacuuaaaggaaauguuaaaaa

SEQ ID NO: 530808 - RNA, 64 nt, Homo Sapiens
caaaaaaacaacuguucuuuguuaaaaaaaaaaaaacaaaaaaaccaccuuccuuaaaggaaau

SEQ ID NO: 530809 - RNA, 64 nt, Homo Sapiens
cacacacacacaaaaaaagaacaaaaaaacaaaaaacaaaaaaaaaaaacaaaaaacaaaaaaa

SEQ ID NO: 530810 - RNA, 64 nt, Homo Sapiens
aaaaaaacacacacacacaaaaaaaaaacaaaaaaacaaaaaaccaaaagcaaaaacaaaaaac

SEQ ID NO: 530811 - RNA, 64 nt, Homo Sapiens
caaaaaacaaaaaaacacaccaaaaaacaaaaaaaacaaaaaaaagaccuuccaaaagcaaaaa

SEQ ID NO: 530812 - RNA, 64 nt, Homo Sapiens
acaaaaaaacaaaaaacaaaaagcaaaaacaaaaaacaaaaaaauccgcugggagaccuuccaa

SEQ ID NO: 530813 - RNA, 64 nt, Homo Sapiens
aaaaaaaacaaaaaaacaaacuuccaaaagcaaaaacaaaaaaccagacccuccgcugggagac

SEQ ID NO: 530814 - RNA, 64 nt, Homo Sapiens
aucaaaaaaucaaaaaaauauuaaaaaaacaaaaaacaaaaaaauguuucacaaacaguuuuau

SEQ ID NO: 530815 - RNA, 64 nt, Homo Sapiens
aaaaaaaaucaaaaaaucaaguuuuauuuaaaaaaacaaaaaacaaauagcuguuucacaaaca

SEQ ID NO: 530816 - RNA, 64 nt, Homo Sapiens
uggaaaggcggggaagaaggaugaaaccuuuaaaaacaaaaacaaaaacaucaaugaguaggca

SEQ ID NO: 530817 - RNA, 64 nt, Homo Sapiens
ggcggggaagaaggaugaaaccuuuaaaaacaaaaacaaaaacaucaaugaguaggcauuuuau

SEQ ID NO: 530818 - RNA, 64 nt, Homo Sapiens
ugcagucaacaagaaauaccaauaacacacacagaacaaaaaccaucaaaaucucauauaugaa

SEQ ID NO: 530819 - RNA, 64 nt, Homo Sapiens
aaaagcaguucaaguugacaacagcagaaacaguaacaaaaaaaucugcucagaaaaauguaug

SEQ ID NO: 530820 - RNA, 64 nt, Homo Sapiens
aaagcuauauaaagaaccaaagguuuagucaagaaacaaaaaucuuaaagauuauuauaaccca

SEQ ID NO: 530821 - RNA, 64 nt, Homo Sapiens
gauuagacuacacaaaagcuuccuuccaguauuaaacaaaaagaauuaaacauaacuaugaaaa

SEQ ID NO: 530822 - RNA, 64 nt, Homo Sapiens
caaccugggugacagagugagauuccaucugaaaaacaaaaacaaaaacagaaaacaaacaaac

SEQ ID NO: 530823 - RNA, 64 nt, Homo Sapiens
gggugacagagugagauuccaucugaaaaacaaaaacaaaaacagaaaacaaacaaacaaaaaa

SEQ ID NO: 530824 - RNA, 64 nt, Homo Sapiens
ucugaaaaacaaaaacaaaaacagaaaacaaacaaacaaaaaacaaaaaauccccacaacuuug

SEQ ID NO: 530825 - RNA, 64 nt, Homo Sapiens
aacaaaaacaaaaacagaaaacaaacaaacaaaaaacaaaaaauccccacaacuuugucaaaua

SEQ ID NO: 530826 - RNA, 64 nt, Homo Sapiens
ccuguuccaccaaaaccuauggaaauuuaaaaaaaacaaaaauaaaaagcaaaacaaaaauccc

SEQ ID NO: 530827 - RNA, 64 nt, Homo Sapiens
auggaaauuuaaaaaaaacaaaaauaaaaagcaaaacaaaaaucccaaaaugaauuccauucac

SEQ ID NO: 530828 - RNA, 64 nt, Homo Sapiens
uuuuuuaaauccccucuguuuaaaagguuuguaaaacaaaaacaaaaaacuaagucugcucagu

SEQ ID NO: 530829 - RNA, 64 nt, Homo Sapiens
aaauccccucuguuuaaaagguuuguaaaacaaaaacaaaaaacuaagucugcucagugaaaug

SEQ ID NO: 530830 - RNA, 64 nt, Homo Sapiens
caagucccguucuguagcucaaucaguagggagaaacaaaaauaagagacaugcacacacaaag

SEQ ID NO: 530831 - RNA, 64 nt, Homo Sapiens
acaaacagacaaacaagaaauagcugugaguuuaaacaaaaaccguaaaaaagaaaaauguaua

SEQ ID NO: 530832 - RNA, 64 nt, Homo Sapiens
uuuuaggccaggcacagugguggaaagcauuuuuaacaaaaaaugagccacugcacccggccgg

SEQ ID NO: 530833 - RNA, 64 nt, Homo Sapiens
uuauaggcaugagccacugcccaucuucugaaaaaacaaaaaaaugaaccuaccauguugccuc

SEQ ID NO: 530834 - RNA, 64 nt, Homo Sapiens
gagagcuuuauugcugcauuugucauaauauuugaacaaaaauucauuagcucuggagugaguc

SEQ ID NO: 530835 - RNA, 64 nt, Homo Sapiens
gcucaaaaaagaggagaaaauauauaaacaaacaaacaaaaauugguggauuagacagguuaaa

SEQ ID NO: 530836 - RNA, 64 nt, Homo Sapiens
cugcaaggauaaauguggagggaauaaauauaugaacaaaaaaguucagcuagagaaguuaaca

SEQ ID NO: 530837 - RNA, 64 nt, Homo Sapiens
gaauauuauaagcaagcaaugcuuuaaagcuaucaacaaaaacuagaugaaaagcgugcaauau

SEQ ID NO: 530838 - RNA, 64 nt, Homo Sapiens
ccuuaaaugucaaaaaaaaaaaaaaaaaaacaaaaacaaaaaaaguaaaacuccgacucuauuu

SEQ ID NO: 530839 - RNA, 64 nt, Homo Sapiens
aaaaaaccuuaaaugucaaacuauuuaaaaaaaaaacaaaaacaaaugugguaaaacuccgacu

SEQ ID NO: 530840 - RNA, 64 nt, Homo Sapiens
auguuguaaugacacaaagcguuaaaaaauguuuaacaaaaaaaaacaagugucaaaguugugu

SEQ ID NO: 530841 - RNA, 64 nt, Homo Sapiens
guauaagggaauaaggaugagauagaccuugaacaacaaaaaggcacacauagcccuuuucaug

SEQ ID NO: 530842 - RNA, 64 nt, Homo Sapiens
ugcagucaagaagaaauaccaauaacacacacagaacaaaaaccaucaaaaucucauauaugaa

SEQ ID NO: 530843 - RNA, 64 nt, Homo Sapiens; identical to SEQ ID NO: 530819

SEQ ID NO: 530844 - RNA, 64 nt, Homo Sapiens
guaaaaaauaaaaauguauauagcugugagcucaaacaaaaacugcagacaaacaaaaaagaga

SEQ ID NO: 530845 - RNA, 64 nt, Homo Sapiens
auauagcugugagcucaaacaaaaacugcagacaaacaaaaaagagaaaagcuuuuauuugugu

SEQ ID NO: 530846 - RNA, 64 nt, Homo Sapiens; identical to SEQ ID NO: 428416

SEQ ID NO: 530847 - RNA, 64 nt, Homo Sapiens; identical to SEQ ID NO: 428417

SEQ ID NO: 530848 - RNA, 64 nt, Homo Sapiens; identical to SEQ ID NO: 428418

SEQ ID NO: 530849 - RNA, 64 nt, Homo Sapiens; identical to SEQ ID NO: 428419

SEQ ID NO: 530850 - RNA, 64 nt, Homo Sapiens; identical to SEQ ID NO: 428420

SEQ ID NO: 530851 - RNA, 64 nt, Homo Sapiens; identical to SEQ ID NO: 428421

SEQ ID NO: 530852 - RNA, 64 nt, Homo Sapiens; identical to SEQ ID NO: 428422

SEQ ID NO: 530853 - RNA, 64 nt, Homo Sapiens; identical to SEQ ID NO: 428423

SEQ ID NO: 530854 - RNA, 64 nt, Homo Sapiens; identical to SEQ ID NO: 428424

SEQ ID NO: 530855 - RNA, 64 nt, Homo Sapiens; identical to SEQ ID NO: 428425

SEQ ID NO: 530856 - RNA, 64 nt, Homo Sapiens; identical to SEQ ID NO: 428426

SEQ ID NO: 530857 - RNA, 64 nt, Homo Sapiens; identical to SEQ ID NO: 428427

SEQ ID NO: 530858 - RNA, 64 nt, Homo Sapiens; identical to SEQ ID NO: 428428

SEQ ID NO: 530859 - RNA, 64 nt, Homo Sapiens; identical to SEQ ID NO: 428429

SEQ ID NO: 530860 - RNA, 64 nt, Homo Sapiens; identical to SEQ ID NO: 428430

SEQ ID NO: 530861 - RNA, 64 nt, Homo Sapiens; identical to SEQ ID NO: 428431

SEQ ID NO: 530862 - RNA, 64 nt, Homo Sapiens; identical to SEQ ID NO: 428432

SEQ ID NO: 530863 - RNA, 64 nt, Homo Sapiens; identical to SEQ ID NO: 428433

SEQ ID NO: 530864 - RNA, 64 nt, Homo Sapiens; identical to SEQ ID NO: 428434

SEQ ID NO: 530865 - RNA, 64 nt, Homo Sapiens; identical to SEQ ID NO: 428435

SEQ ID NO: 530866 - RNA, 64 nt, Homo Sapiens; identical to SEQ ID NO: 428436

SEQ ID NO: 530867 - RNA, 64 nt, Homo Sapiens; identical to SEQ ID NO: 428437

SEQ ID NO: 530868 - RNA, 64 nt, Homo Sapiens; identical to SEQ ID NO: 428438

SEQ ID NO: 530869 - RNA, 64 nt, Homo Sapiens; identical to SEQ ID NO: 428439

SEQ ID NO: 530870 - RNA, 64 nt, Homo Sapiens; identical to SEQ ID NO: 428440

SEQ ID NO: 530871 - RNA, 64 nt, Homo Sapiens; identical to SEQ ID NO: 428441

SEQ ID NO: 530872 - RNA, 64 nt, Homo Sapiens; identical to SEQ ID NO: 428442

SEQ ID NO: 530873 - RNA, 64 nt, Homo Sapiens; identical to SEQ ID NO: 428443

SEQ ID NO: 530874 - RNA, 64 nt, Homo Sapiens; identical to SEQ ID NO: 175479

SEQ ID NO: 530875 - RNA, 64 nt, Homo Sapiens; identical to SEQ ID NO: 175480

SEQ ID NO: 530876 - RNA, 64 nt, Homo Sapiens; identical to SEQ ID NO: 175481

SEQ ID NO: 530877 - RNA, 64 nt, Homo Sapiens; identical to SEQ ID NO: 175482

SEQ ID NO: 530878 - RNA, 64 nt, Homo Sapiens; identical to SEQ ID NO: 175483

SEQ ID NO: 530879 - RNA, 64 nt, Homo Sapiens; identical to SEQ ID NO: 175484

SEQ ID NO: 530880 - RNA, 64 nt, Homo Sapiens; identical to SEQ ID NO: 175485

SEQ ID NO: 530881 - RNA, 64 nt, Homo Sapiens; identical to SEQ ID NO: 175486

SEQ ID NO: 530882 - RNA, 64 nt, Homo Sapiens; identical to SEQ ID NO: 175487

SEQ ID NO: 530883 - RNA, 64 nt, Homo Sapiens; identical to SEQ ID NO: 175488

SEQ ID NO: 530884 - RNA, 64 nt, Homo Sapiens; identical to SEQ ID NO: 175489

SEQ ID NO: 530885 - RNA, 64 nt, Homo Sapiens; identical to SEQ ID NO: 175490

SEQ ID NO: 530886 - RNA, 64 nt, Homo Sapiens; identical to SEQ ID NO: 175491

SEQ ID NO: 530887 - RNA, 64 nt, Homo Sapiens; identical to SEQ ID NO: 175492

SEQ ID NO: 530888 - RNA, 64 nt, Homo Sapiens; identical to SEQ ID NO: 175493

SEQ ID NO: 530889 - RNA, 64 nt, Homo Sapiens; identical to SEQ ID NO: 175494

SEQ ID NO: 530890 - RNA, 64 nt, Homo Sapiens; identical to SEQ ID NO: 175495

SEQ ID NO: 530891 - RNA, 64 nt, Homo Sapiens; identical to SEQ ID NO: 175496

SEQ ID NO: 530892 - RNA, 64 nt, Homo Sapiens; identical to SEQ ID NO: 175497

SEQ ID NO: 530893 - RNA, 64 nt, Homo Sapiens; identical to SEQ ID NO: 175498

SEQ ID NO: 530894 - RNA, 64 nt, Homo Sapiens; identical to SEQ ID NO: 175499

SEQ ID NO: 530895 - RNA, 64 nt, Homo Sapiens; identical to SEQ ID NO: 175500

SEQ ID NO: 530896 - RNA, 64 nt, Homo Sapiens; identical to SEQ ID NO: 175501

SEQ ID NO: 530897 - RNA, 64 nt, Homo Sapiens; identical to SEQ ID NO: 175502

SEQ ID NO: 530898 - RNA, 64 nt, Homo Sapiens; identical to SEQ ID NO: 175503

SEQ ID NO: 530899 - RNA, 64 nt, Homo Sapiens; identical to SEQ ID NO: 175504

SEQ ID NO: 530900 - RNA, 64 nt, Homo Sapiens; identical to SEQ ID NO: 175505

SEQ ID NO: 530901 - RNA, 64 nt, Homo Sapiens; identical to SEQ ID NO: 175506

SEQ ID NO: 530902 - RNA, 64 nt, Homo Sapiens; identical to SEQ ID NO: 175507

SEQ ID NO: 530903 - RNA, 64 nt, Homo Sapiens; identical to SEQ ID NO: 175508

SEQ ID NO: 530904 - RNA, 64 nt, Homo Sapiens; identical to SEQ ID NO: 175509

SEQ ID NO: 530905 - RNA, 64 nt, Homo Sapiens; identical to SEQ ID NO: 175510

SEQ ID NO: 530906 - RNA, 64 nt, Homo Sapiens; identical to SEQ ID NO: 175511

SEQ ID NO: 530907 - RNA, 64 nt, Homo Sapiens; identical to SEQ ID NO: 175512

SEQ ID NO: 530908 - RNA, 64 nt, Homo Sapiens; identical to SEQ ID NO: 175513

SEQ ID NO: 530909 - RNA, 64 nt, Homo Sapiens; identical to SEQ ID NO: 175514

SEQ ID NO: 530910 - RNA, 64 nt, Homo Sapiens; identical to SEQ ID NO: 175515

SEQ ID NO: 530911 - RNA, 64 nt, Homo Sapiens; identical to SEQ ID NO: 175516

SEQ ID NO: 530912 - RNA, 64 nt, Homo Sapiens; identical to SEQ ID NO: 175517

SEQ ID NO: 530913 - RNA, 64 nt, Homo Sapiens; identical to SEQ ID NO: 175518

SEQ ID NO: 530914 - RNA, 64 nt, Homo Sapiens; identical to SEQ ID NO: 175519

SEQ ID NO: 530915 - RNA, 64 nt, Homo Sapiens; identical to SEQ ID NO: 175520

SEQ ID NO: 530916 - RNA, 64 nt, Homo Sapiens; identical to SEQ ID NO: 175521

SEQ ID NO: 530917 - RNA, 64 nt, Homo Sapiens; identical to SEQ ID NO: 175522

SEQ ID NO: 530918 - RNA, 64 nt, Homo Sapiens; identical to SEQ ID NO: 175523

SEQ ID NO: 530919 - RNA, 64 nt, Homo Sapiens; identical to SEQ ID NO: 175524

SEQ ID NO: 530920 - RNA, 64 nt, Homo Sapiens; identical to SEQ ID NO: 175525

SEQ ID NO: 530921 - RNA, 64 nt, Homo Sapiens; identical to SEQ ID NO: 175526

SEQ ID NO: 530922 - RNA, 64 nt, Homo Sapiens; identical to SEQ ID NO: 175527

SEQ ID NO: 530923 - RNA, 64 nt, Homo Sapiens; identical to SEQ ID NO: 175528

SEQ ID NO: 530924 - RNA, 64 nt, Homo Sapiens; identical to SEQ ID NO: 175529

SEQ ID NO: 530925 - RNA, 64 nt, Homo Sapiens; identical to SEQ ID NO: 175530

SEQ ID NO: 530926 - RNA, 64 nt, Homo Sapiens; identical to SEQ ID NO: 175531

SEQ ID NO: 530927 - RNA, 64 nt, Homo Sapiens; identical to SEQ ID NO: 175532

SEQ ID NO: 530928 - RNA, 64 nt, Homo Sapiens; identical to SEQ ID NO: 175533

SEQ ID NO: 530929 - RNA, 64 nt, Homo Sapiens; identical to SEQ ID NO: 175534

SEQ ID NO: 530930 - RNA, 64 nt, Homo Sapiens; identical to SEQ ID NO: 175535

SEQ ID NO: 530931 - RNA, 64 nt, Homo Sapiens; identical to SEQ ID NO: 175536

SEQ ID NO: 530932 - RNA, 64 nt, Homo Sapiens; identical to SEQ ID NO: 175537

SEQ ID NO: 530933 - RNA, 64 nt, Homo Sapiens; identical to SEQ ID NO: 175538

SEQ ID NO: 530934 - RNA, 53 nt, Homo Sapiens; identical to SEQ ID NO: 175539

SEQ ID NO: 530935 - RNA, 64 nt, Homo Sapiens; identical to SEQ ID NO: 175540

SEQ ID NO: 530936 - RNA, 64 nt, Homo Sapiens; identical to SEQ ID NO: 175541

SEQ ID NO: 530937 - RNA, 64 nt, Homo Sapiens; identical to SEQ ID NO: 175542

SEQ ID NO: 530938 - RNA, 64 nt, Homo Sapiens; identical to SEQ ID NO: 175543

SEQ ID NO: 530939 - RNA, 64 nt, Homo Sapiens; identical to SEQ ID NO: 175544

SEQ ID NO: 530940 - RNA, 64 nt, Homo Sapiens; identical to SEQ ID NO: 175545

SEQ ID NO: 530941 - RNA, 64 nt, Homo Sapiens; identical to SEQ ID NO: 175546

SEQ ID NO: 530942 - RNA, 64 nt, Homo Sapiens; identical to SEQ ID NO: 175547

SEQ ID NO: 530943 - RNA, 64 nt, Homo Sapiens; identical to SEQ ID NO: 175548

SEQ ID NO: 530944 - RNA, 64 nt, Homo Sapiens; identical to SEQ ID NO: 175549

SEQ ID NO: 530945 - RNA, 64 nt, Homo Sapiens; identical to SEQ ID NO: 175550

SEQ ID NO: 530946 - RNA, 64 nt, Homo Sapiens; identical to SEQ ID NO: 175551

SEQ ID NO: 530947 - RNA, 64 nt, Homo Sapiens; identical to SEQ ID NO: 175552

SEQ ID NO: 530948 - RNA, 64 nt, Homo Sapiens; identical to SEQ ID NO: 175553

SEQ ID NO: 530949 - RNA, 64 nt, Homo Sapiens; identical to SEQ ID NO: 175554

SEQ ID NO: 530950 - RNA, 64 nt, Homo Sapiens; identical to SEQ ID NO: 175555

SEQ ID NO: 530951 - RNA, 64 nt, Homo Sapiens; identical to SEQ ID NO: 175556

SEQ ID NO: 530952 - RNA, 64 nt, Homo Sapiens; identical to SEQ ID NO: 175557

SEQ ID NO: 530953 - RNA, 64 nt, Homo Sapiens; identical to SEQ ID NO: 175558

SEQ ID NO: 530954 - RNA, 64 nt, Homo Sapiens; identical to SEQ ID NO: 175559

SEQ ID NO: 530955 - RNA, 64 nt, Homo Sapiens; identical to SEQ ID NO: 175560

SEQ ID NO: 530956 - RNA, 64 nt, Homo Sapiens; identical to SEQ ID NO: 175561

SEQ ID NO: 530957 - RNA, 64 nt, Homo Sapiens; identical to SEQ ID NO: 175562

SEQ ID NO: 530958 - RNA, 64 nt, Homo Sapiens; identical to SEQ ID NO: 175563

SEQ ID NO: 530959 - RNA, 64 nt, Homo Sapiens; identical to SEQ ID NO: 175564

SEQ ID NO: 530960 - RNA, 64 nt, Homo Sapiens; identical to SEQ ID NO: 175565

SEQ ID NO: 530961 - RNA, 64 nt, Homo Sapiens; identical to SEQ ID NO: 175566

SEQ ID NO: 530962 - RNA, 64 nt, Homo Sapiens; identical to SEQ ID NO: 95478

SEQ ID NO: 530963 - RNA, 64 nt, Homo Sapiens; identical to SEQ ID NO: 95479

SEQ ID NO: 530964 - RNA, 64 nt, Homo Sapiens; identical to SEQ ID NO: 95480

SEQ ID NO: 530965 - RNA, 64 nt, Homo Sapiens; identical to SEQ ID NO: 95481

SEQ ID NO: 530966 - RNA, 64 nt, Homo Sapiens; identical to SEQ ID NO: 95482

SEQ ID NO: 530967 - RNA, 64 nt, Homo Sapiens; identical to SEQ ID NO: 95483

SEQ ID NO: 530968 - RNA, 64 nt, Homo Sapiens; identical to SEQ ID NO: 95484

SEQ ID NO: 530969 - RNA, 64 nt, Homo Sapiens; identical to SEQ ID NO: 95485

SEQ ID NO: 530970 - RNA, 64 nt, Homo Sapiens; identical to SEQ ID NO: 95486

SEQ ID NO: 530971 - RNA, 64 nt, Homo Sapiens; identical to SEQ ID NO: 95487

SEQ ID NO: 530972 - RNA, 64 nt, Homo Sapiens; identical to SEQ ID NO: 95488

SEQ ID NO: 530973 - RNA, 64 nt, Homo Sapiens; identical to SEQ ID NO: 95489

SEQ ID NO: 530974 - RNA, 64 nt, Homo Sapiens; identical to SEQ ID NO: 95490

SEQ ID NO: 530975 - RNA, 64 nt, Homo Sapiens; identical to SEQ ID NO: 95491

SEQ ID NO: 530976 - RNA, 64 nt, Homo Sapiens; identical to SEQ ID NO: 95492

SEQ ID NO: 530977 - RNA, 64 nt, Homo Sapiens; identical to SEQ ID NO: 95493

SEQ ID NO: 530978 - RNA, 64 nt, Homo Sapiens; identical to SEQ ID NO: 95494

SEQ ID NO: 530979 - RNA, 64 nt, Homo Sapiens; identical to SEQ ID NO: 95495

SEQ ID NO: 530980 - RNA, 64 nt, Homo Sapiens; identical to SEQ ID NO: 95496

SEQ ID NO: 530981 - RNA, 64 nt, Homo Sapiens; identical to SEQ ID NO: 95497

SEQ ID NO: 530982 - RNA, 64 nt, Homo Sapiens; identical to SEQ ID NO: 95498

SEQ ID NO: 530983 - RNA, 64 nt, Homo Sapiens; identical to SEQ ID NO: 95499

SEQ ID NO: 530984 - RNA, 64 nt, Homo Sapiens; identical to SEQ ID NO: 95500

SEQ ID NO: 530985 - RNA, 64 nt, Homo Sapiens; identical to SEQ ID NO: 95501

SEQ ID NO: 530986 - RNA, 64 nt, Homo Sapiens; identical to SEQ ID NO: 95502

SEQ ID NO: 530987 - RNA, 64 nt, Homo Sapiens; identical to SEQ ID NO: 95503

SEQ ID NO: 530988 - RNA, 64 nt, Homo Sapiens; identical to SEQ ID NO: 95504

SEQ ID NO: 530989 - RNA, 64 nt, Homo Sapiens; identical to SEQ ID NO: 95505

SEQ ID NO: 530990 - RNA, 64 nt, Homo Sapiens; identical to SEQ ID NO: 95506

SEQ ID NO: 530991 - RNA, 64 nt, Homo Sapiens; identical to SEQ ID NO: 95507

SEQ ID NO: 530992 - RNA, 64 nt, Homo Sapiens; identical to SEQ ID NO: 95508

SEQ ID NO: 530993 - RNA, 64 nt, Homo Sapiens; identical to SEQ ID NO: 95509

SEQ ID NO: 530994 - RNA, 64 nt, Homo Sapiens; identical to SEQ ID NO: 95510

SEQ ID NO: 530995 - RNA, 64 nt, Homo Sapiens; identical to SEQ ID NO: 95511

SEQ ID NO: 530996 - RNA, 64 nt, Homo Sapiens; identical to SEQ ID NO: 95512

SEQ ID NO: 530997 - RNA, 64 nt, Homo Sapiens; identical to SEQ ID NO: 95513

SEQ ID NO: 530998 - RNA, 64 nt, Homo Sapiens; identical to SEQ ID NO: 95514

SEQ ID NO: 530999 - RNA, 64 nt, Homo Sapiens; identical to SEQ ID NO: 95515

SEQ ID NO: 531000 - RNA, 64 nt, Homo Sapiens; identical to SEQ ID NO: 95516

SEQ ID NO: 531001 - RNA, 64 nt, Homo Sapiens; identical to SEQ ID NO: 95517

SEQ ID NO: 531002 - RNA, 64 nt, Homo Sapiens; identical to SEQ ID NO: 95518

SEQ ID NO: 531003 - RNA, 64 nt, Homo Sapiens; identical to SEQ ID NO: 95519

SEQ ID NO: 531004 - RNA, 64 nt, Homo Sapiens; identical to SEQ ID NO: 95520

SEQ ID NO: 531005 - RNA, 64 nt, Homo Sapiens; identical to SEQ ID NO: 95521

SEQ ID NO: 531006 - RNA, 64 nt, Homo Sapiens; identical to SEQ ID NO: 95522

SEQ ID NO: 531007 - RNA, 64 nt, Homo Sapiens; identical to SEQ ID NO: 95523

SEQ ID NO: 531008 - RNA, 64 nt, Homo Sapiens; identical to SEQ ID NO: 95524

SEQ ID NO: 531009 - RNA, 64 nt, Homo Sapiens; identical to SEQ ID NO: 95525

SEQ ID NO: 531010 - RNA, 64 nt, Homo Sapiens; identical to SEQ ID NO: 277303

SEQ ID NO: 531011 - RNA, 64 nt, Homo Sapiens; identical to SEQ ID NO: 277304

SEQ ID NO: 531012 - RNA, 64 nt, Homo Sapiens; identical to SEQ ID NO: 277305

SEQ ID NO: 531013 - RNA, 64 nt, Homo Sapiens; identical to SEQ ID NO: 277306

SEQ ID NO: 531014 - RNA, 64 nt, Homo Sapiens; identical to SEQ ID NO: 277307

SEQ ID NO: 531015 - RNA, 64 nt, Homo Sapiens; identical to SEQ ID NO: 277308

SEQ ID NO: 531016 - RNA, 64 nt, Homo Sapiens; identical to SEQ ID NO: 277309

SEQ ID NO: 531017 - RNA, 64 nt, Homo Sapiens; identical to SEQ ID NO: 277310

SEQ ID NO: 531018 - RNA, 64 nt, Homo Sapiens; identical to SEQ ID NO: 277311

SEQ ID NO: 531019 - RNA, 64 nt, Homo Sapiens; identical to SEQ ID NO: 277312

SEQ ID NO: 531020 - RNA, 64 nt, Homo Sapiens; identical to SEQ ID NO: 277313

SEQ ID NO: 531021 - RNA, 64 nt, Homo Sapiens; identical to SEQ ID NO: 277314

SEQ ID NO: 531022 - RNA, 64 nt, Homo Sapiens; identical to SEQ ID NO: 277315

SEQ ID NO: 531023 - RNA, 64 nt, Homo Sapiens; identical to SEQ ID NO: 277316

SEQ ID NO: 531024 - RNA, 64 nt, Homo Sapiens; identical to SEQ ID NO: 277317

SEQ ID NO: 531025 - RNA, 64 nt, Homo Sapiens; identical to SEQ ID NO: 277318

SEQ ID NO: 531026 - RNA, 64 nt, Homo Sapiens; identical to SEQ ID NO: 277319

SEQ ID NO: 531027 - RNA, 64 nt, Homo Sapiens; identical to SEQ ID NO: 277320

SEQ ID NO: 531028 - RNA, 64 nt, Homo Sapiens; identical to SEQ ID NO: 277321

SEQ ID NO: 531029 - RNA, 64 nt, Homo Sapiens; identical to SEQ ID NO: 277322

SEQ ID NO: 531030 - RNA, 62 nt, Homo Sapiens; identical to SEQ ID NO: 277323

SEQ ID NO: 531031 - RNA, 64 nt, Homo Sapiens; identical to SEQ ID NO: 277324

SEQ ID NO: 531032 - RNA, 64 nt, Homo Sapiens; identical to SEQ ID NO: 277325

SEQ ID NO: 531033 - RNA, 64 nt, Homo Sapiens; identical to SEQ ID NO: 277326

SEQ ID NO: 531034 - RNA, 64 nt, Homo Sapiens; identical to SEQ ID NO: 277327

SEQ ID NO: 531035 - RNA, 64 nt, Homo Sapiens; identical to SEQ ID NO: 277328

SEQ ID NO: 531036 - RNA, 64 nt, Homo Sapiens; identical to SEQ ID NO: 277329

SEQ ID NO: 531037 - RNA, 64 nt, Homo Sapiens; identical to SEQ ID NO: 277330

SEQ ID NO: 531038 - RNA, 64 nt, Homo Sapiens; identical to SEQ ID NO: 277331

SEQ ID NO: 531039 - RNA, 64 nt, Homo Sapiens; identical to SEQ ID NO: 277332

SEQ ID NO: 531040 - RNA, 64 nt, Homo Sapiens; identical to SEQ ID NO: 98595

SEQ ID NO: 531041 - RNA, 64 nt, Homo Sapiens; identical to SEQ ID NO: 98596

SEQ ID NO: 531042 - RNA, 64 nt, Homo Sapiens; identical to SEQ ID NO: 98597

SEQ ID NO: 531043 - RNA, 64 nt, Homo Sapiens; identical to SEQ ID NO: 98598

SEQ ID NO: 531044 - RNA, 64 nt, Homo Sapiens; identical to SEQ ID NO: 98599

SEQ ID NO: 531045 - RNA, 64 nt, Homo Sapiens; identical to SEQ ID NO: 98600

SEQ ID NO: 531046 - RNA, 64 nt, Homo Sapiens; identical to SEQ ID NO: 98601

SEQ ID NO: 531047 - RNA, 64 nt, Homo Sapiens; identical to SEQ ID NO: 98602

SEQ ID NO: 531048 - RNA, 64 nt, Homo Sapiens; identical to SEQ ID NO: 98603

SEQ ID NO: 531049 - RNA, 64 nt, Homo Sapiens; identical to SEQ ID NO: 98604

SEQ ID NO: 531050 - RNA, 64 nt, Homo Sapiens; identical to SEQ ID NO: 98605

SEQ ID NO: 531051 - RNA, 64 nt, Homo Sapiens; identical to SEQ ID NO: 98606

SEQ ID NO: 531052 - RNA, 64 nt, Homo Sapiens; identical to SEQ ID NO: 98607

SEQ ID NO: 531053 - RNA, 64 nt, Homo Sapiens; identical to SEQ ID NO: 98608

SEQ ID NO: 531054 - RNA, 64 nt, Homo Sapiens; identical to SEQ ID NO: 98609

SEQ ID NO: 531055 - RNA, 64 nt, Homo Sapiens; identical to SEQ ID NO: 98610

SEQ ID NO: 531056 - RNA, 64 nt, Homo Sapiens; identical to SEQ ID NO: 98611

SEQ ID NO: 531057 - RNA, 64 nt, Homo Sapiens; identical to SEQ ID NO: 98612

SEQ ID NO: 531058 - RNA, 64 nt, Homo Sapiens; identical to SEQ ID NO: 98613

SEQ ID NO: 531059 - RNA, 64 nt, Homo Sapiens; identical to SEQ ID NO: 98614

SEQ ID NO: 531060 - RNA, 64 nt, Homo Sapiens; identical to SEQ ID NO: 98615

SEQ ID NO: 531061 - RNA, 57 nt, Homo Sapiens; identical to SEQ ID NO: 98616

SEQ ID NO: 531062 - RNA, 64 nt, Homo Sapiens; identical to SEQ ID NO: 98617

SEQ ID NO: 531063 - RNA, 64 nt, Homo Sapiens; identical to SEQ ID NO: 98618

SEQ ID NO: 531064 - RNA, 64 nt, Homo Sapiens; identical to SEQ ID NO: 98619

SEQ ID NO: 531065 - RNA, 64 nt, Homo Sapiens; identical to SEQ ID NO: 98620

SEQ ID NO: 531066 - RNA, 64 nt, Homo Sapiens; identical to SEQ ID NO: 98621

SEQ ID NO: 531067 - RNA, 64 nt, Homo Sapiens; identical to SEQ ID NO: 98622

SEQ ID NO: 531068 - RNA, 64 nt, Homo Sapiens; identical to SEQ ID NO: 98623

SEQ ID NO: 531069 - RNA, 64 nt, Homo Sapiens; identical to SEQ ID NO: 98624

SEQ ID NO: 531070 - RNA, 64 nt, Homo Sapiens; identical to SEQ ID NO: 98625

SEQ ID NO: 531071 - RNA, 64 nt, Homo Sapiens; identical to SEQ ID NO: 98626

SEQ ID NO: 531072 - RNA, 64 nt, Homo Sapiens; identical to SEQ ID NO: 98627

SEQ ID NO: 531073 - RNA, 64 nt, Homo Sapiens; identical to SEQ ID NO: 98628

SEQ ID NO: 531074 - RNA, 64 nt, Homo Sapiens; identical to SEQ ID NO: 98629

SEQ ID NO: 531075 - RNA, 64 nt, Homo Sapiens; identical to SEQ ID NO: 98630

SEQ ID NO: 531076 - RNA, 64 nt, Homo Sapiens; identical to SEQ ID NO: 98631

SEQ ID NO: 531077 - RNA, 64 nt, Homo Sapiens; identical to SEQ ID NO: 98632

SEQ ID NO: 531078 - RNA, 64 nt, Homo Sapiens; identical to SEQ ID NO: 98633

SEQ ID NO: 531079 - RNA, 64 nt, Homo Sapiens; identical to SEQ ID NO: 98634

SEQ ID NO: 531080 - RNA, 64 nt, Homo Sapiens; identical to SEQ ID NO: 98635

SEQ ID NO: 531081 - RNA, 64 nt, Homo Sapiens; identical to SEQ ID NO: 98636

SEQ ID NO: 531082 - RNA, 64 nt, Homo Sapiens; identical to SEQ ID NO: 98637

SEQ ID NO: 531083 - RNA, 64 nt, Homo Sapiens; identical to SEQ ID NO: 98638

SEQ ID NO: 531084 - RNA, 64 nt, Homo Sapiens; identical to SEQ ID NO: 98639

SEQ ID NO: 531085 - RNA, 64 nt, Homo Sapiens; identical to SEQ ID NO: 98640

SEQ ID NO: 531086 - RNA, 64 nt, Homo Sapiens; identical to SEQ ID NO: 98641

SEQ ID NO: 531087 - RNA, 64 nt, Homo Sapiens; identical to SEQ ID NO: 98642

SEQ ID NO: 531088 - RNA, 64 nt, Homo Sapiens; identical to SEQ ID NO: 98643

SEQ ID NO: 531089 - RNA, 64 nt, Homo Sapiens; identical to SEQ ID NO: 98644

SEQ ID NO: 531090 - RNA, 64 nt, Homo Sapiens; identical to SEQ ID NO: 98645

SEQ ID NO: 531091 - RNA, 64 nt, Homo Sapiens; identical to SEQ ID NO: 98646

SEQ ID NO: 531092 - RNA, 64 nt, Homo Sapiens; identical to SEQ ID NO: 98647

SEQ ID NO: 531093 - RNA, 64 nt, Homo Sapiens; identical to SEQ ID NO: 98648

SEQ ID NO: 531094 - RNA, 64 nt, Homo Sapiens; identical to SEQ ID NO: 98649

SEQ ID NO: 531095 - RNA, 64 nt, Homo Sapiens; identical to SEQ ID NO: 98650

SEQ ID NO: 531096 - RNA, 64 nt, Homo Sapiens; identical to SEQ ID NO: 98651

SEQ ID NO: 531097 - RNA, 64 nt, Homo Sapiens; identical to SEQ ID NO: 98652

SEQ ID NO: 531098 - RNA, 64 nt, Homo Sapiens; identical to SEQ ID NO: 98653

SEQ ID NO: 531099 - RNA, 64 nt, Homo Sapiens; identical to SEQ ID NO: 98654

SEQ ID NO: 531100 - RNA, 64 nt, Homo Sapiens; identical to SEQ ID NO: 98655

SEQ ID NO: 531101 - RNA, 64 nt, Homo Sapiens; identical to SEQ ID NO: 98656

SEQ ID NO: 531102 - RNA, 64 nt, Homo Sapiens; identical to SEQ ID NO: 98657

SEQ ID NO: 531103 - RNA, 64 nt, Homo Sapiens; identical to SEQ ID NO: 98658

SEQ ID NO: 531104 - RNA, 64 nt, Homo Sapiens; identical to SEQ ID NO: 98659

SEQ ID NO: 531105 - RNA, 64 nt, Homo Sapiens; identical to SEQ ID NO: 98660

SEQ ID NO: 531106 - RNA, 64 nt, Homo Sapiens; identical to SEQ ID NO: 98661

SEQ ID NO: 531107 - RNA, 64 nt, Homo Sapiens; identical to SEQ ID NO: 98662

SEQ ID NO: 531108 - RNA, 64 nt, Homo Sapiens; identical to SEQ ID NO: 98663

SEQ ID NO: 531109 - RNA, 64 nt, Homo Sapiens; identical to SEQ ID NO: 98664

SEQ ID NO: 531110 - RNA, 64 nt, Homo Sapiens; identical to SEQ ID NO: 98665

SEQ ID NO: 531111 - RNA, 64 nt, Homo Sapiens; identical to SEQ ID NO: 98666

SEQ ID NO: 531112 - RNA, 64 nt, Homo Sapiens; identical to SEQ ID NO: 98667

SEQ ID NO: 531113 - RNA, 64 nt, Homo Sapiens; identical to SEQ ID NO: 98668

SEQ ID NO: 531114 - RNA, 64 nt, Homo Sapiens; identical to SEQ ID NO: 98669

SEQ ID NO: 531115 - RNA, 64 nt, Homo Sapiens; identical to SEQ ID NO: 98670

SEQ ID NO: 531116 - RNA, 64 nt, Homo Sapiens; identical to SEQ ID NO: 98671

SEQ ID NO: 531117 - RNA, 64 nt, Homo Sapiens; identical to SEQ ID NO: 156691

SEQ ID NO: 531118 - RNA, 64 nt, Homo Sapiens; identical to SEQ ID NO: 156692

SEQ ID NO: 531119 - RNA, 64 nt, Homo Sapiens; identical to SEQ ID NO: 156693

SEQ ID NO: 531120 - RNA, 64 nt, Homo Sapiens; identical to SEQ ID NO: 156694

SEQ ID NO: 531121 - RNA, 64 nt, Homo Sapiens; identical to SEQ ID NO: 156695

SEQ ID NO: 531122 - RNA, 64 nt, Homo Sapiens; identical to SEQ ID NO: 156696

SEQ ID NO: 531123 - RNA, 64 nt, Homo Sapiens; identical to SEQ ID NO: 156697

SEQ ID NO: 531124 - RNA, 64 nt, Homo Sapiens; identical to SEQ ID NO: 156698

SEQ ID NO: 531125 - RNA, 64 nt, Homo Sapiens; identical to SEQ ID NO: 156699

SEQ ID NO: 531126 - RNA, 64 nt, Homo Sapiens; identical to SEQ ID NO: 156700

SEQ ID NO: 531127 - RNA, 64 nt, Homo Sapiens; identical to SEQ ID NO: 156701

SEQ ID NO: 531128 - RNA, 64 nt, Homo Sapiens; identical to SEQ ID NO: 156702

SEQ ID NO: 531129 - RNA, 64 nt, Homo Sapiens; identical to SEQ ID NO: 156703

SEQ ID NO: 531130 - RNA, 64 nt, Homo Sapiens; identical to SEQ ID NO: 156704

SEQ ID NO: 531131 - RNA, 64 nt, Homo Sapiens; identical to SEQ ID NO: 156705

SEQ ID NO: 531132 - RNA, 64 nt, Homo Sapiens; identical to SEQ ID NO: 156706

SEQ ID NO: 531133 - RNA, 64 nt, Homo Sapiens; identical to SEQ ID NO: 156707

SEQ ID NO: 531134 - RNA, 64 nt, Homo Sapiens; identical to SEQ ID NO: 156708

SEQ ID NO: 531135 - RNA, 64 nt, Homo Sapiens; identical to SEQ ID NO: 156709

SEQ ID NO: 531136 - RNA, 64 nt, Homo Sapiens; identical to SEQ ID NO: 156710

SEQ ID NO: 531137 - RNA, 64 nt, Homo Sapiens; identical to SEQ ID NO: 156711

SEQ ID NO: 531138 - RNA, 64 nt, Homo Sapiens; identical to SEQ ID NO: 156712

SEQ ID NO: 531139 - RNA, 64 nt, Homo Sapiens; identical to SEQ ID NO: 156713

SEQ ID NO: 531140 - RNA, 64 nt, Homo Sapiens; identical to SEQ ID NO: 156714

SEQ ID NO: 531141 - RNA, 64 nt, Homo Sapiens; identical to SEQ ID NO: 156715

SEQ ID NO: 531142 - RNA, 64 nt, Homo Sapiens; identical to SEQ ID NO: 156716

SEQ ID NO: 531143 - RNA, 64 nt, Homo Sapiens; identical to SEQ ID NO: 156717

SEQ ID NO: 531144 - RNA, 64 nt, Homo Sapiens; identical to SEQ ID NO: 156718

SEQ ID NO: 531145 - RNA, 64 nt, Homo Sapiens; identical to SEQ ID NO: 156719

SEQ ID NO: 531146 - RNA, 64 nt, Homo Sapiens; identical to SEQ ID NO: 156720

SEQ ID NO: 531147 - RNA, 64 nt, Homo Sapiens; identical to SEQ ID NO: 156721

SEQ ID NO: 531148 - RNA, 64 nt, Homo Sapiens; identical to SEQ ID NO: 156722

SEQ ID NO: 531149 - RNA, 64 nt, Homo Sapiens; identical to SEQ ID NO: 156723

SEQ ID NO: 531150 - RNA, 50 nt, Homo Sapiens; identical to SEQ ID NO: 156724

SEQ ID NO: 531151 - RNA, 64 nt, Homo Sapiens; identical to SEQ ID NO: 156725

SEQ ID NO: 531152 - RNA, 64 nt, Homo Sapiens; identical to SEQ ID NO: 156726

SEQ ID NO: 531153 - RNA, 64 nt, Homo Sapiens; identical to SEQ ID NO: 156727

SEQ ID NO: 531154 - RNA, 64 nt, Homo Sapiens; identical to SEQ ID NO: 156728

SEQ ID NO: 531155 - RNA, 64 nt, Homo Sapiens; identical to SEQ ID NO: 156729

SEQ ID NO: 531156 - RNA, 64 nt, Homo Sapiens; identical to SEQ ID NO: 156730

SEQ ID NO: 531157 - RNA, 64 nt, Homo Sapiens; identical to SEQ ID NO: 156731

SEQ ID NO: 531158 - RNA, 64 nt, Homo Sapiens; identical to SEQ ID NO: 156732

SEQ ID NO: 531159 - RNA, 64 nt, Homo Sapiens; identical to SEQ ID NO: 156733

SEQ ID NO: 531160 - RNA, 64 nt, Homo Sapiens; identical to SEQ ID NO: 156734

SEQ ID NO: 531161 - RNA, 64 nt, Homo Sapiens; identical to SEQ ID NO: 156735

SEQ ID NO: 531162 - RNA, 64 nt, Homo Sapiens; identical to SEQ ID NO: 156736

SEQ ID NO: 531163 - RNA, 64 nt, Homo Sapiens; identical to SEQ ID NO: 156737

SEQ ID NO: 531164 - RNA, 64 nt, Homo Sapiens; identical to SEQ ID NO: 156738

SEQ ID NO: 531165 - RNA, 64 nt, Homo Sapiens; identical to SEQ ID NO: 156991

SEQ ID NO: 531166 - RNA, 64 nt, Homo Sapiens; identical to SEQ ID NO: 156992

SEQ ID NO: 531167 - RNA, 64 nt, Homo Sapiens; identical to SEQ ID NO: 156993

SEQ ID NO: 531168 - RNA, 64 nt, Homo Sapiens; identical to SEQ ID NO: 156994

SEQ ID NO: 531169 - RNA, 64 nt, Homo Sapiens; identical to SEQ ID NO: 156995

SEQ ID NO: 531170 - RNA, 64 nt, Homo Sapiens; identical to SEQ ID NO: 156996

SEQ ID NO: 531171 - RNA, 64 nt, Homo Sapiens; identical to SEQ ID NO: 156997

SEQ ID NO: 531172 - RNA, 64 nt, Homo Sapiens; identical to SEQ ID NO: 156998

SEQ ID NO: 531173 - RNA, 64 nt, Homo Sapiens; identical to SEQ ID NO: 156999

SEQ ID NO: 531174 - RNA, 64 nt, Homo Sapiens; identical to SEQ ID NO: 157000

SEQ ID NO: 531175 - RNA, 64 nt, Homo Sapiens; identical to SEQ ID NO: 157001

SEQ ID NO: 531176 - RNA, 64 nt, Homo Sapiens; identical to SEQ ID NO: 157002

SEQ ID NO: 531177 - RNA, 64 nt, Homo Sapiens; identical to SEQ ID NO: 157003

SEQ ID NO: 531178 - RNA, 64 nt, Homo Sapiens; identical to SEQ ID NO: 157004

SEQ ID NO: 531179 - RNA, 64 nt, Homo Sapiens; identical to SEQ ID NO: 157005

SEQ ID NO: 531180 - RNA, 64 nt, Homo Sapiens; identical to SEQ ID NO: 157006

SEQ ID NO: 531181 - RNA, 64 nt, Homo Sapiens; identical to SEQ ID NO: 157007

SEQ ID NO: 531182 - RNA, 64 nt, Homo Sapiens; identical to SEQ ID NO: 157008

SEQ ID NO: 531183 - RNA, 64 nt, Homo Sapiens; identical to SEQ ID NO: 157009

SEQ ID NO: 531184 - RNA, 64 nt, Homo Sapiens; identical to SEQ ID NO: 157010

SEQ ID NO: 531185 - RNA, 64 nt, Homo Sapiens; identical to SEQ ID NO: 157011

SEQ ID NO: 531186 - RNA, 64 nt, Homo Sapiens; identical to SEQ ID NO: 157012

SEQ ID NO: 531187 - RNA, 64 nt, Homo Sapiens; identical to SEQ ID NO: 157013

SEQ ID NO: 531188 - RNA, 64 nt, Homo Sapiens; identical to SEQ ID NO: 157014

SEQ ID NO: 531189 - RNA, 64 nt, Homo Sapiens; identical to SEQ ID NO: 157015

SEQ ID NO: 531190 - RNA, 64 nt, Homo Sapiens; identical to SEQ ID NO: 157016

SEQ ID NO: 531191 - RNA, 64 nt, Homo Sapiens; identical to SEQ ID NO: 157017

SEQ ID NO: 531192 - RNA, 64 nt, Homo Sapiens; identical to SEQ ID NO: 157018

SEQ ID NO: 531193 - RNA, 64 nt, Homo Sapiens; identical to SEQ ID NO: 157019

SEQ ID NO: 531194 - RNA, 64 nt, Homo Sapiens; identical to SEQ ID NO: 157020

SEQ ID NO: 531195 - RNA, 64 nt, Homo Sapiens; identical to SEQ ID NO: 157021

SEQ ID NO: 531196 - RNA, 64 nt, Homo Sapiens; identical to SEQ ID NO: 157022

SEQ ID NO: 531197 - RNA, 64 nt, Homo Sapiens; identical to SEQ ID NO: 157023

SEQ ID NO: 531198 - RNA, 64 nt, Homo Sapiens; identical to SEQ ID NO: 157024

SEQ ID NO: 531199 - RNA, 64 nt, Homo Sapiens; identical to SEQ ID NO: 157025

SEQ ID NO: 531200 - RNA, 64 nt, Homo Sapiens; identical to SEQ ID NO: 157026

SEQ ID NO: 531201 - RNA, 64 nt, Homo Sapiens; identical to SEQ ID NO: 157027

SEQ ID NO: 531202 - RNA, 64 nt, Homo Sapiens; identical to SEQ ID NO: 157028

SEQ ID NO: 531203 - RNA, 64 nt, Homo Sapiens; identical to SEQ ID NO: 157029

SEQ ID NO: 531204 - RNA, 64 nt, Homo Sapiens; identical to SEQ ID NO: 157030

SEQ ID NO: 531205 - RNA, 64 nt, Homo Sapiens; identical to SEQ ID NO: 157031

SEQ ID NO: 531206 - RNA, 64 nt, Homo Sapiens; identical to SEQ ID NO: 157032

SEQ ID NO: 531207 - RNA, 64 nt, Homo Sapiens; identical to SEQ ID NO: 157033

SEQ ID NO: 531208 - RNA, 64 nt, Homo Sapiens; identical to SEQ ID NO: 157034

SEQ ID NO: 531209 - RNA, 64 nt, Homo Sapiens; identical to SEQ ID NO: 157035

SEQ ID NO: 531210 - RNA, 64 nt, Homo Sapiens; identical to SEQ ID NO: 157036

SEQ ID NO: 531211 - RNA, 64 nt, Homo Sapiens; identical to SEQ ID NO: 157037

SEQ ID NO: 531212 - RNA, 64 nt, Homo Sapiens; identical to SEQ ID NO: 157038

SEQ ID NO: 531213 - RNA, 64 nt, Homo Sapiens; identical to SEQ ID NO: 157039

SEQ ID NO: 531214 - RNA, 64 nt, Homo Sapiens; identical to SEQ ID NO: 157040

SEQ ID NO: 531215 - RNA, 64 nt, Homo Sapiens; identical to SEQ ID NO: 157041

SEQ ID NO: 531216 - RNA, 64 nt, Homo Sapiens; identical to SEQ ID NO: 157042

SEQ ID NO: 531217 - RNA, 64 nt, Homo Sapiens; identical to SEQ ID NO: 157043

SEQ ID NO: 531218 - RNA, 64 nt, Homo Sapiens; identical to SEQ ID NO: 157044

SEQ ID NO: 531219 - RNA, 64 nt, Homo Sapiens; identical to SEQ ID NO: 157045

SEQ ID NO: 531220 - RNA, 64 nt, Homo Sapiens; identical to SEQ ID NO: 157046

SEQ ID NO: 531221 - RNA, 64 nt, Homo Sapiens; identical to SEQ ID NO: 157047

SEQ ID NO: 531222 - RNA, 64 nt, Homo Sapiens; identical to SEQ ID NO: 157048

SEQ ID NO: 531223 - RNA, 64 nt, Homo Sapiens; identical to SEQ ID NO: 157049

SEQ ID NO: 531224 - RNA, 64 nt, Homo Sapiens; identical to SEQ ID NO: 157050

SEQ ID NO: 531225 - RNA, 64 nt, Homo Sapiens; identical to SEQ ID NO: 157051

SEQ ID NO: 531226 - RNA, 64 nt, Homo Sapiens; identical to SEQ ID NO: 157052

SEQ ID NO: 531227 - RNA, 64 nt, Homo Sapiens; identical to SEQ ID NO: 157053

SEQ ID NO: 531228 - RNA, 64 nt, Homo Sapiens; identical to SEQ ID NO: 157054

SEQ ID NO: 531229 - RNA, 64 nt, Homo Sapiens; identical to SEQ ID NO: 157055

SEQ ID NO: 531230 - RNA, 64 nt, Homo Sapiens; identical to SEQ ID NO: 157056

SEQ ID NO: 531231 - RNA, 64 nt, Homo Sapiens; identical to SEQ ID NO: 157057

SEQ ID NO: 531232 - RNA, 64 nt, Homo Sapiens; identical to SEQ ID NO: 157058

SEQ ID NO: 531233 - RNA, 64 nt, Homo Sapiens; identical to SEQ ID NO: 157059

SEQ ID NO: 531234 - RNA, 64 nt, Homo Sapiens; identical to SEQ ID NO: 157060

SEQ ID NO: 531235 - RNA, 64 nt, Homo Sapiens; identical to SEQ ID NO: 157061

SEQ ID NO: 531236 - RNA, 64 nt, Homo Sapiens; identical to SEQ ID NO: 157062

SEQ ID NO: 531237 - RNA, 64 nt, Homo Sapiens; identical to SEQ ID NO: 157063

SEQ ID NO: 531238 - RNA, 64 nt, Homo Sapiens; identical to SEQ ID NO: 157064

SEQ ID NO: 531239 - RNA, 64 nt, Homo Sapiens; identical to SEQ ID NO: 157065

SEQ ID NO: 531240 - RNA, 64 nt, Homo Sapiens; identical to SEQ ID NO: 157066

SEQ ID NO: 531241 - RNA, 64 nt, Homo Sapiens; identical to SEQ ID NO: 157067

SEQ ID NO: 531242 - RNA, 64 nt, Homo Sapiens; identical to SEQ ID NO: 157068

SEQ ID NO: 531243 - RNA, 64 nt, Homo Sapiens; identical to SEQ ID NO: 157069

SEQ ID NO: 531244 - RNA, 64 nt, Homo Sapiens; identical to SEQ ID NO: 157070

SEQ ID NO: 531245 - RNA, 64 nt, Homo Sapiens; identical to SEQ ID NO: 157071

SEQ ID NO: 531246 - RNA, 64 nt, Homo Sapiens; identical to SEQ ID NO: 157072

SEQ ID NO: 531247 - RNA, 64 nt, Homo Sapiens; identical to SEQ ID NO: 157073

SEQ ID NO: 531248 - RNA, 64 nt, Homo Sapiens; identical to SEQ ID NO: 157074

SEQ ID NO: 531249 - RNA, 64 nt, Homo Sapiens; identical to SEQ ID NO: 157075

SEQ ID NO: 531250 - RNA, 64 nt, Homo Sapiens; identical to SEQ ID NO: 157076

SEQ ID NO: 531251 - RNA, 64 nt, Homo Sapiens; identical to SEQ ID NO: 157077

SEQ ID NO: 531252 - RNA, 64 nt, Homo Sapiens; identical to SEQ ID NO: 157078

SEQ ID NO: 531253 - RNA, 64 nt, Homo Sapiens; identical to SEQ ID NO: 157079

SEQ ID NO: 531254 - RNA, 64 nt, Homo Sapiens; identical to SEQ ID NO: 157080

SEQ ID NO: 531255 - RNA, 64 nt, Homo Sapiens; identical to SEQ ID NO: 157081

SEQ ID NO: 531256 - RNA, 64 nt, Homo Sapiens; identical to SEQ ID NO: 157082

SEQ ID NO: 531257 - RNA, 64 nt, Homo Sapiens; identical to SEQ ID NO: 157083

SEQ ID NO: 531258 - RNA, 64 nt, Homo Sapiens; identical to SEQ ID NO: 157084

SEQ ID NO: 531259 - RNA, 64 nt, Homo Sapiens; identical to SEQ ID NO: 157085

SEQ ID NO: 531260 - RNA, 64 nt, Homo Sapiens; identical to SEQ ID NO: 157086

SEQ ID NO: 531261 - RNA, 64 nt, Homo Sapiens; identical to SEQ ID NO: 157087

SEQ ID NO: 531262 - RNA, 64 nt, Homo Sapiens; identical to SEQ ID NO: 157088

SEQ ID NO: 531263 - RNA, 64 nt, Homo Sapiens; identical to SEQ ID NO: 157089

SEQ ID NO: 531264 - RNA, 64 nt, Homo Sapiens; identical to SEQ ID NO: 157090

SEQ ID NO: 531265 - RNA, 64 nt, Homo Sapiens; identical to SEQ ID NO: 157091

SEQ ID NO: 531266 - RNA, 64 nt, Homo Sapiens; identical to SEQ ID NO: 157092

SEQ ID NO: 531267 - RNA, 64 nt, Homo Sapiens; identical to SEQ ID NO: 157093

SEQ ID NO: 531268 - RNA, 64 nt, Homo Sapiens; identical to SEQ ID NO: 157094

SEQ ID NO: 531269 - RNA, 64 nt, Homo Sapiens; identical to SEQ ID NO: 157095

SEQ ID NO: 531270 - RNA, 64 nt, Homo Sapiens; identical to SEQ ID NO: 157096

SEQ ID NO: 531271 - RNA, 64 nt, Homo Sapiens; identical to SEQ ID NO: 157097

SEQ ID NO: 531272 - RNA, 64 nt, Homo Sapiens; identical to SEQ ID NO: 157098

SEQ ID NO: 531273 - RNA, 64 nt, Homo Sapiens; identical to SEQ ID NO: 157099

SEQ ID NO: 531274 - RNA, 64 nt, Homo Sapiens; identical to SEQ ID NO: 157100

SEQ ID NO: 531275 - RNA, 64 nt, Homo Sapiens; identical to SEQ ID NO: 157101

SEQ ID NO: 531276 - RNA, 64 nt, Homo Sapiens; identical to SEQ ID NO: 157102

SEQ ID NO: 531277 - RNA, 64 nt, Homo Sapiens; identical to SEQ ID NO: 157103

SEQ ID NO: 531278 - RNA, 64 nt, Homo Sapiens; identical to SEQ ID NO: 157104

SEQ ID NO: 531279 - RNA, 64 nt, Homo Sapiens; identical to SEQ ID NO: 157105

SEQ ID NO: 531280 - RNA, 64 nt, Homo Sapiens; identical to SEQ ID NO: 157106

SEQ ID NO: 531281 - RNA, 64 nt, Homo Sapiens; identical to SEQ ID NO: 157107

SEQ ID NO: 531282 - RNA, 64 nt, Homo Sapiens; identical to SEQ ID NO: 157108

SEQ ID NO: 531283 - RNA, 64 nt, Homo Sapiens; identical to SEQ ID NO: 157109

SEQ ID NO: 531284 - RNA, 64 nt, Homo Sapiens; identical to SEQ ID NO: 157110

SEQ ID NO: 531285 - RNA, 64 nt, Homo Sapiens; identical to SEQ ID NO: 157111

SEQ ID NO: 531286 - RNA, 64 nt, Homo Sapiens; identical to SEQ ID NO: 157112

SEQ ID NO: 531287 - RNA, 64 nt, Homo Sapiens; identical to SEQ ID NO: 157113

SEQ ID NO: 531288 - RNA, 64 nt, Homo Sapiens; identical to SEQ ID NO: 157114

SEQ ID NO: 531289 - RNA, 64 nt, Homo Sapiens; identical to SEQ ID NO: 157115

SEQ ID NO: 531290 - RNA, 64 nt, Homo Sapiens; identical to SEQ ID NO: 157116

SEQ ID NO: 531291 - RNA, 64 nt, Homo Sapiens; identical to SEQ ID NO: 157117

SEQ ID NO: 531292 - RNA, 64 nt, Homo Sapiens; identical to SEQ ID NO: 157118

SEQ ID NO: 531293 - RNA, 64 nt, Homo Sapiens; identical to SEQ ID NO: 157119

SEQ ID NO: 531294 - RNA, 64 nt, Homo Sapiens; identical to SEQ ID NO: 157120

SEQ ID NO: 531295 - RNA, 50 nt, Homo Sapiens; identical to SEQ ID NO: 157121

SEQ ID NO: 531296 - RNA, 52 nt, Homo Sapiens; identical to SEQ ID NO: 157122

SEQ ID NO: 531297 - RNA, 54 nt, Homo Sapiens; identical to SEQ ID NO: 157123

SEQ ID NO: 531298 - RNA, 56 nt, Homo Sapiens; identical to SEQ ID NO: 157124

SEQ ID NO: 531299 - RNA, 58 nt, Homo Sapiens; identical to SEQ ID NO: 157125

SEQ ID NO: 531300 - RNA, 60 nt, Homo Sapiens; identical to SEQ ID NO: 157126

SEQ ID NO: 531301 - RNA, 62 nt, Homo Sapiens; identical to SEQ ID NO: 157127

SEQ ID NO: 531302 - RNA, 64 nt, Homo Sapiens; identical to SEQ ID NO: 157128

SEQ ID NO: 531303 - RNA, 64 nt, Homo Sapiens; identical to SEQ ID NO: 157129

SEQ ID NO: 531304 - RNA, 64 nt, Homo Sapiens; identical to SEQ ID NO: 157130

SEQ ID NO: 531305 - RNA, 64 nt, Homo Sapiens; identical to SEQ ID NO: 157131

SEQ ID NO: 531306 - RNA, 64 nt, Homo Sapiens; identical to SEQ ID NO: 157132

SEQ ID NO: 531307 - RNA, 64 nt, Homo Sapiens; identical to SEQ ID NO: 157133

SEQ ID NO: 531308 - RNA, 64 nt, Homo Sapiens; identical to SEQ ID NO: 157134

SEQ ID NO: 531309 - RNA, 64 nt, Homo Sapiens; identical to SEQ ID NO: 157135

SEQ ID NO: 531310 - RNA, 64 nt, Homo Sapiens; identical to SEQ ID NO: 157136

SEQ ID NO: 531311 - RNA, 64 nt, Homo Sapiens; identical to SEQ ID NO: 157137

SEQ ID NO: 531312 - RNA, 64 nt, Homo Sapiens; identical to SEQ ID NO: 157138

SEQ ID NO: 531313 - RNA, 64 nt, Homo Sapiens; identical to SEQ ID NO: 157139

SEQ ID NO: 531314 - RNA, 64 nt, Homo Sapiens; identical to SEQ ID NO: 157140

SEQ ID NO: 531315 - RNA, 64 nt, Homo Sapiens; identical to SEQ ID NO: 157141

SEQ ID NO: 531316 - RNA, 64 nt, Homo Sapiens; identical to SEQ ID NO: 157142

SEQ ID NO: 531317 - RNA, 64 nt, Homo Sapiens; identical to SEQ ID NO: 157143

SEQ ID NO: 531318 - RNA, 64 nt, Homo Sapiens; identical to SEQ ID NO: 157144

SEQ ID NO: 531319 - RNA, 64 nt, Homo Sapiens; identical to SEQ ID NO: 157145

SEQ ID NO: 531320 - RNA, 64 nt, Homo Sapiens; identical to SEQ ID NO: 157146

SEQ ID NO: 531321 - RNA, 64 nt, Homo Sapiens; identical to SEQ ID NO: 157147

SEQ ID NO: 531322 - RNA, 64 nt, Homo Sapiens; identical to SEQ ID NO: 157148

SEQ ID NO: 531323 - RNA, 64 nt, Homo Sapiens; identical to SEQ ID NO: 157149

SEQ ID NO: 531324 - RNA, 64 nt, Homo Sapiens; identical to SEQ ID NO: 157150

SEQ ID NO: 531325 - RNA, 64 nt, Homo Sapiens; identical to SEQ ID NO: 157151

SEQ ID NO: 531326 - RNA, 64 nt, Homo Sapiens; identical to SEQ ID NO: 157152

SEQ ID NO: 531327 - RNA, 64 nt, Homo Sapiens; identical to SEQ ID NO: 157153

SEQ ID NO: 531328 - RNA, 64 nt, Homo Sapiens; identical to SEQ ID NO: 157154

SEQ ID NO: 531329 - RNA, 64 nt, Homo Sapiens; identical to SEQ ID NO: 157155

SEQ ID NO: 531330 - RNA, 64 nt, Homo Sapiens; identical to SEQ ID NO: 157156

SEQ ID NO: 531331 - RNA, 64 nt, Homo Sapiens; identical to SEQ ID NO: 157157

SEQ ID NO: 531332 - RNA, 64 nt, Homo Sapiens; identical to SEQ ID NO: 157158

SEQ ID NO: 531333 - RNA, 64 nt, Homo Sapiens; identical to SEQ ID NO: 157159

SEQ ID NO: 531334 - RNA, 64 nt, Homo Sapiens; identical to SEQ ID NO: 157160

SEQ ID NO: 531335 - RNA, 64 nt, Homo Sapiens; identical to SEQ ID NO: 157161

SEQ ID NO: 531336 - RNA, 64 nt, Homo Sapiens; identical to SEQ ID NO: 157162

SEQ ID NO: 531337 - RNA, 64 nt, Homo Sapiens; identical to SEQ ID NO: 157163

SEQ ID NO: 531338 - RNA, 64 nt, Homo Sapiens; identical to SEQ ID NO: 157164

SEQ ID NO: 531339 - RNA, 64 nt, Homo Sapiens; identical to SEQ ID NO: 157165

SEQ ID NO: 531340 - RNA, 64 nt, Homo Sapiens; identical to SEQ ID NO: 157166

SEQ ID NO: 531341 - RNA, 64 nt, Homo Sapiens; identical to SEQ ID NO: 157167

SEQ ID NO: 531342 - RNA, 64 nt, Homo Sapiens; identical to SEQ ID NO: 157168

SEQ ID NO: 531343 - RNA, 64 nt, Homo Sapiens; identical to SEQ ID NO: 157169

SEQ ID NO: 531344 - RNA, 64 nt, Homo Sapiens; identical to SEQ ID NO: 157170

SEQ ID NO: 531345 - RNA, 64 nt, Homo Sapiens; identical to SEQ ID NO: 157171

SEQ ID NO: 531346 - RNA, 64 nt, Homo Sapiens; identical to SEQ ID NO: 157172

SEQ ID NO: 531347 - RNA, 64 nt, Homo Sapiens; identical to SEQ ID NO: 157173

SEQ ID NO: 531348 - RNA, 64 nt, Homo Sapiens; identical to SEQ ID NO: 157174

SEQ ID NO: 531349 - RNA, 64 nt, Homo Sapiens; identical to SEQ ID NO: 157175

SEQ ID NO: 531350 - RNA, 64 nt, Homo Sapiens; identical to SEQ ID NO: 157176

SEQ ID NO: 531351 - RNA, 64 nt, Homo Sapiens; identical to SEQ ID NO: 157177

SEQ ID NO: 531352 - RNA, 64 nt, Homo Sapiens; identical to SEQ ID NO: 157178

SEQ ID NO: 531353 - RNA, 64 nt, Homo Sapiens; identical to SEQ ID NO: 157179

SEQ ID NO: 531354 - RNA, 64 nt, Homo Sapiens; identical to SEQ ID NO: 157180

SEQ ID NO: 531355 - RNA, 64 nt, Homo Sapiens; identical to SEQ ID NO: 157181

SEQ ID NO: 531356 - RNA, 64 nt, Homo Sapiens; identical to SEQ ID NO: 157182

SEQ ID NO: 531357 - RNA, 64 nt, Homo Sapiens; identical to SEQ ID NO: 157183

SEQ ID NO: 531358 - RNA, 64 nt, Homo Sapiens; identical to SEQ ID NO: 157184

SEQ ID NO: 531359 - RNA, 64 nt, Homo Sapiens; identical to SEQ ID NO: 157185

SEQ ID NO: 531360 - RNA, 64 nt, Homo Sapiens; identical to SEQ ID NO: 157186

SEQ ID NO: 531361 - RNA, 64 nt, Homo Sapiens; identical to SEQ ID NO: 157187

SEQ ID NO: 531362 - RNA, 64 nt, Homo Sapiens; identical to SEQ ID NO: 157188

SEQ ID NO: 531363 - RNA, 64 nt, Homo Sapiens; identical to SEQ ID NO: 157189

SEQ ID NO: 531364 - RNA, 64 nt, Homo Sapiens; identical to SEQ ID NO: 157190

SEQ ID NO: 531365 - RNA, 64 nt, Homo Sapiens; identical to SEQ ID NO: 157191

SEQ ID NO: 531366 - RNA, 64 nt, Homo Sapiens; identical to SEQ ID NO: 157192

SEQ ID NO: 531367 - RNA, 64 nt, Homo Sapiens; identical to SEQ ID NO: 157193

SEQ ID NO: 531368 - RNA, 64 nt, Homo Sapiens; identical to SEQ ID NO: 157194

SEQ ID NO: 531369 - RNA, 64 nt, Homo Sapiens; identical to SEQ ID NO: 157195

SEQ ID NO: 531370 - RNA, 64 nt, Homo Sapiens; identical to SEQ ID NO: 157196

SEQ ID NO: 531371 - RNA, 64 nt, Homo Sapiens; identical to SEQ ID NO: 157197

SEQ ID NO: 531372 - RNA, 64 nt, Homo Sapiens; identical to SEQ ID NO: 157198

SEQ ID NO: 531373 - RNA, 64 nt, Homo Sapiens; identical to SEQ ID NO: 157199

SEQ ID NO: 531374 - RNA, 64 nt, Homo Sapiens; identical to SEQ ID NO: 157200

SEQ ID NO: 531375 - RNA, 64 nt, Homo Sapiens; identical to SEQ ID NO: 157201

SEQ ID NO: 531376 - RNA, 64 nt, Homo Sapiens; identical to SEQ ID NO: 157202

SEQ ID NO: 531377 - RNA, 64 nt, Homo Sapiens; identical to SEQ ID NO: 157203

SEQ ID NO: 531378 - RNA, 64 nt, Homo Sapiens; identical to SEQ ID NO: 157204

SEQ ID NO: 531379 - RNA, 64 nt, Homo Sapiens; identical to SEQ ID NO: 157205

SEQ ID NO: 531380 - RNA, 64 nt, Homo Sapiens; identical to SEQ ID NO: 157206

SEQ ID NO: 531381 - RNA, 64 nt, Homo Sapiens; identical to SEQ ID NO: 157207

SEQ ID NO: 531382 - RNA, 64 nt, Homo Sapiens; identical to SEQ ID NO: 157208

SEQ ID NO: 531383 - RNA, 64 nt, Homo Sapiens; identical to SEQ ID NO: 157209

SEQ ID NO: 531384 - RNA, 64 nt, Homo Sapiens; identical to SEQ ID NO: 157210

SEQ ID NO: 531385 - RNA, 64 nt, Homo Sapiens; identical to SEQ ID NO: 157211

SEQ ID NO: 531386 - RNA, 64 nt, Homo Sapiens; identical to SEQ ID NO: 157212

SEQ ID NO: 531387 - RNA, 64 nt, Homo Sapiens; identical to SEQ ID NO: 157213

SEQ ID NO: 531388 - RNA, 64 nt, Homo Sapiens; identical to SEQ ID NO: 157214

SEQ ID NO: 531389 - RNA, 64 nt, Homo Sapiens; identical to SEQ ID NO: 157215

SEQ ID NO: 531390 - RNA, 64 nt, Homo Sapiens; identical to SEQ ID NO: 157216

SEQ ID NO: 531391 - RNA, 64 nt, Homo Sapiens; identical to SEQ ID NO: 157217

SEQ ID NO: 531392 - RNA, 64 nt, Homo Sapiens; identical to SEQ ID NO: 157218

SEQ ID NO: 531393 - RNA, 64 nt, Homo Sapiens; identical to SEQ ID NO: 157219

SEQ ID NO: 531394 - RNA, 64 nt, Homo Sapiens; identical to SEQ ID NO: 157220

SEQ ID NO: 531395 - RNA, 64 nt, Homo Sapiens; identical to SEQ ID NO: 157221

SEQ ID NO: 531396 - RNA, 64 nt, Homo Sapiens; identical to SEQ ID NO: 157222

SEQ ID NO: 531397 - RNA, 64 nt, Homo Sapiens; identical to SEQ ID NO: 157223

SEQ ID NO: 531398 - RNA, 64 nt, Homo Sapiens; identical to SEQ ID NO: 157224

SEQ ID NO: 531399 - RNA, 64 nt, Homo Sapiens; identical to SEQ ID NO: 157225

SEQ ID NO: 531400 - RNA, 64 nt, Homo Sapiens; identical to SEQ ID NO: 157226

SEQ ID NO: 531401 - RNA, 64 nt, Homo Sapiens; identical to SEQ ID NO: 157227

SEQ ID NO: 531402 - RNA, 64 nt, Homo Sapiens; identical to SEQ ID NO: 157228

SEQ ID NO: 531403 - RNA, 64 nt, Homo Sapiens; identical to SEQ ID NO: 157229

SEQ ID NO: 531404 - RNA, 64 nt, Homo Sapiens; identical to SEQ ID NO: 157230

SEQ ID NO: 531405 - RNA, 64 nt, Homo Sapiens; identical to SEQ ID NO: 157231

SEQ ID NO: 531406 - RNA, 63 nt, Homo Sapiens; identical to SEQ ID NO: 157232

SEQ ID NO: 531407 - RNA, 64 nt, Homo Sapiens; identical to SEQ ID NO: 157233

SEQ ID NO: 531408 - RNA, 64 nt, Homo Sapiens; identical to SEQ ID NO: 157234

SEQ ID NO: 531409 - RNA, 64 nt, Homo Sapiens; identical to SEQ ID NO: 157235

SEQ ID NO: 531410 - RNA, 64 nt, Homo Sapiens; identical to SEQ ID NO: 157236

SEQ ID NO: 531411 - RNA, 64 nt, Homo Sapiens; identical to SEQ ID NO: 157237

SEQ ID NO: 531412 - RNA, 64 nt, Homo Sapiens; identical to SEQ ID NO: 157238

SEQ ID NO: 531413 - RNA, 64 nt, Homo Sapiens; identical to SEQ ID NO: 157239

SEQ ID NO: 531414 - RNA, 64 nt, Homo Sapiens; identical to SEQ ID NO: 157240

SEQ ID NO: 531415 - RNA, 64 nt, Homo Sapiens; identical to SEQ ID NO: 157241

SEQ ID NO: 531416 - RNA, 64 nt, Homo Sapiens; identical to SEQ ID NO: 157242

SEQ ID NO: 531417 - RNA, 64 nt, Homo Sapiens; identical to SEQ ID NO: 157243

SEQ ID NO: 531418 - RNA, 64 nt, Homo Sapiens; identical to SEQ ID NO: 157244

SEQ ID NO: 531419 - RNA, 64 nt, Homo Sapiens; identical to SEQ ID NO: 157245

SEQ ID NO: 531420 - RNA, 64 nt, Homo Sapiens; identical to SEQ ID NO: 157246

SEQ ID NO: 531421 - RNA, 64 nt, Homo Sapiens; identical to SEQ ID NO: 157247

SEQ ID NO: 531422 - RNA, 64 nt, Homo Sapiens; identical to SEQ ID NO: 157248

SEQ ID NO: 531423 - RNA, 64 nt, Homo Sapiens; identical to SEQ ID NO: 157249

SEQ ID NO: 531424 - RNA, 64 nt, Homo Sapiens; identical to SEQ ID NO: 157250

SEQ ID NO: 531425 - RNA, 64 nt, Homo Sapiens; identical to SEQ ID NO: 157251

SEQ ID NO: 531426 - RNA, 64 nt, Homo Sapiens; identical to SEQ ID NO: 157252

SEQ ID NO: 531427 - RNA, 64 nt, Homo Sapiens; identical to SEQ ID NO: 157253

SEQ ID NO: 531428 - RNA, 64 nt, Homo Sapiens; identical to SEQ ID NO: 157254

SEQ ID NO: 531429 - RNA, 64 nt, Homo Sapiens; identical to SEQ ID NO: 157255

SEQ ID NO: 531430 - RNA, 64 nt, Homo Sapiens; identical to SEQ ID NO: 157256

SEQ ID NO: 531431 - RNA, 64 nt, Homo Sapiens; identical to SEQ ID NO: 157257

SEQ ID NO: 531432 - RNA, 64 nt, Homo Sapiens; identical to SEQ ID NO: 157258

SEQ ID NO: 531433 - RNA, 64 nt, Homo Sapiens; identical to SEQ ID NO: 157259

SEQ ID NO: 531434 - RNA, 64 nt, Homo Sapiens; identical to SEQ ID NO: 157260

SEQ ID NO: 531435 - RNA, 64 nt, Homo Sapiens; identical to SEQ ID NO: 157261

SEQ ID NO: 531436 - RNA, 64 nt, Homo Sapiens; identical to SEQ ID NO: 157262

SEQ ID NO: 531437 - RNA, 64 nt, Homo Sapiens; identical to SEQ ID NO: 157263

SEQ ID NO: 531438 - RNA, 64 nt, Homo Sapiens; identical to SEQ ID NO: 157264

SEQ ID NO: 531439 - RNA, 64 nt, Homo Sapiens; identical to SEQ ID NO: 157265

SEQ ID NO: 531440 - RNA, 64 nt, Homo Sapiens; identical to SEQ ID NO: 157266

SEQ ID NO: 531441 - RNA, 64 nt, Homo Sapiens; identical to SEQ ID NO: 157267

SEQ ID NO: 531442 - RNA, 64 nt, Homo Sapiens; identical to SEQ ID NO: 157268

SEQ ID NO: 531443 - RNA, 64 nt, Homo Sapiens; identical to SEQ ID NO: 157269

SEQ ID NO: 531444 - RNA, 64 nt, Homo Sapiens; identical to SEQ ID NO: 157270

SEQ ID NO: 531445 - RNA, 64 nt, Homo Sapiens; identical to SEQ ID NO: 157271

SEQ ID NO: 531446 - RNA, 64 nt, Homo Sapiens; identical to SEQ ID NO: 157272

SEQ ID NO: 531447 - RNA, 64 nt, Homo Sapiens; identical to SEQ ID NO: 157273

SEQ ID NO: 531448 - RNA, 64 nt, Homo Sapiens; identical to SEQ ID NO: 157274

SEQ ID NO: 531449 - RNA, 64 nt, Homo Sapiens; identical to SEQ ID NO: 157275

SEQ ID NO: 531450 - RNA, 64 nt, Homo Sapiens; identical to SEQ ID NO: 157276

SEQ ID NO: 531451 - RNA, 64 nt, Homo Sapiens; identical to SEQ ID NO: 157277

SEQ ID NO: 531452 - RNA, 64 nt, Homo Sapiens; identical to SEQ ID NO: 157278

SEQ ID NO: 531453 - RNA, 64 nt, Homo Sapiens; identical to SEQ ID NO: 157279

SEQ ID NO: 531454 - RNA, 64 nt, Homo Sapiens; identical to SEQ ID NO: 157280

SEQ ID NO: 531455 - RNA, 64 nt, Homo Sapiens; identical to SEQ ID NO: 157281

SEQ ID NO: 531456 - RNA, 64 nt, Homo Sapiens; identical to SEQ ID NO: 157282

SEQ ID NO: 531457 - RNA, 64 nt, Homo Sapiens; identical to SEQ ID NO: 157283

SEQ ID NO: 531458 - RNA, 64 nt, Homo Sapiens; identical to SEQ ID NO: 157284

SEQ ID NO: 531459 - RNA, 64 nt, Homo Sapiens; identical to SEQ ID NO: 157285

SEQ ID NO: 531460 - RNA, 64 nt, Homo Sapiens; identical to SEQ ID NO: 157286

SEQ ID NO: 531461 - RNA, 64 nt, Homo Sapiens; identical to SEQ ID NO: 157287

SEQ ID NO: 531462 - RNA, 64 nt, Homo Sapiens; identical to SEQ ID NO: 157288

SEQ ID NO: 531463 - RNA, 64 nt, Homo Sapiens; identical to SEQ ID NO: 157289

SEQ ID NO: 531464 - RNA, 64 nt, Homo Sapiens; identical to SEQ ID NO: 157290

SEQ ID NO: 531465 - RNA, 64 nt, Homo Sapiens; identical to SEQ ID NO: 157291

SEQ ID NO: 531466 - RNA, 64 nt, Homo Sapiens; identical to SEQ ID NO: 157292

SEQ ID NO: 531467 - RNA, 64 nt, Homo Sapiens; identical to SEQ ID NO: 157293

SEQ ID NO: 531468 - RNA, 64 nt, Homo Sapiens; identical to SEQ ID NO: 157294

SEQ ID NO: 531469 - RNA, 64 nt, Homo Sapiens; identical to SEQ ID NO: 157295

SEQ ID NO: 531470 - RNA, 64 nt, Homo Sapiens; identical to SEQ ID NO: 157296

SEQ ID NO: 531471 - RNA, 64 nt, Homo Sapiens; identical to SEQ ID NO: 157297

SEQ ID NO: 531472 - RNA, 64 nt, Homo Sapiens; identical to SEQ ID NO: 157298

SEQ ID NO: 531473 - RNA, 64 nt, Homo Sapiens; identical to SEQ ID NO: 157299

SEQ ID NO: 531474 - RNA, 64 nt, Homo Sapiens; identical to SEQ ID NO: 157300

SEQ ID NO: 531475 - RNA, 64 nt, Homo Sapiens; identical to SEQ ID NO: 157301

SEQ ID NO: 531476 - RNA, 64 nt, Homo Sapiens; identical to SEQ ID NO: 157302

SEQ ID NO: 531477 - RNA, 64 nt, Homo Sapiens; identical to SEQ ID NO: 157303

SEQ ID NO: 531478 - RNA, 64 nt, Homo Sapiens; identical to SEQ ID NO: 157304

SEQ ID NO: 531479 - RNA, 64 nt, Homo Sapiens; identical to SEQ ID NO: 157305

SEQ ID NO: 531480 - RNA, 64 nt, Homo Sapiens; identical to SEQ ID NO: 157306

SEQ ID NO: 531481 - RNA, 64 nt, Homo Sapiens; identical to SEQ ID NO: 157307

SEQ ID NO: 531482 - RNA, 64 nt, Homo Sapiens; identical to SEQ ID NO: 157308

SEQ ID NO: 531483 - RNA, 64 nt, Homo Sapiens; identical to SEQ ID NO: 157309

SEQ ID NO: 531484 - RNA, 64 nt, Homo Sapiens; identical to SEQ ID NO: 157310

SEQ ID NO: 531485 - RNA, 64 nt, Homo Sapiens; identical to SEQ ID NO: 157311

SEQ ID NO: 531486 - RNA, 64 nt, Homo Sapiens; identical to SEQ ID NO: 157312

SEQ ID NO: 531487 - RNA, 64 nt, Homo Sapiens; identical to SEQ ID NO: 157313

SEQ ID NO: 531488 - RNA, 64 nt, Homo Sapiens; identical to SEQ ID NO: 157314

SEQ ID NO: 531489 - RNA, 64 nt, Homo Sapiens; identical to SEQ ID NO: 157315

SEQ ID NO: 531490 - RNA, 64 nt, Homo Sapiens; identical to SEQ ID NO: 157316

SEQ ID NO: 531491 - RNA, 64 nt, Homo Sapiens; identical to SEQ ID NO: 157317

SEQ ID NO: 531492 - RNA, 64 nt, Homo Sapiens; identical to SEQ ID NO: 157318

SEQ ID NO: 531493 - RNA, 64 nt, Homo Sapiens; identical to SEQ ID NO: 157319

SEQ ID NO: 531494 - RNA, 64 nt, Homo Sapiens; identical to SEQ ID NO: 157320

SEQ ID NO: 531495 - RNA, 64 nt, Homo Sapiens; identical to SEQ ID NO: 157321

SEQ ID NO: 531496 - RNA, 64 nt, Homo Sapiens; identical to SEQ ID NO: 157322

SEQ ID NO: 531497 - RNA, 64 nt, Homo Sapiens; identical to SEQ ID NO: 157323

SEQ ID NO: 531498 - RNA, 64 nt, Homo Sapiens; identical to SEQ ID NO: 157324

SEQ ID NO: 531499 - RNA, 64 nt, Homo Sapiens; identical to SEQ ID NO: 157325

SEQ ID NO: 531500 - RNA, 64 nt, Homo Sapiens; identical to SEQ ID NO: 157326

SEQ ID NO: 531501 - RNA, 64 nt, Homo Sapiens; identical to SEQ ID NO: 157327

SEQ ID NO: 531502 - RNA, 64 nt, Homo Sapiens; identical to SEQ ID NO: 157328

SEQ ID NO: 531503 - RNA, 64 nt, Homo Sapiens; identical to SEQ ID NO: 157329

SEQ ID NO: 531504 - RNA, 64 nt, Homo Sapiens; identical to SEQ ID NO: 157330

SEQ ID NO: 531505 - RNA, 64 nt, Homo Sapiens; identical to SEQ ID NO: 157331

SEQ ID NO: 531506 - RNA, 64 nt, Homo Sapiens; identical to SEQ ID NO: 157332

SEQ ID NO: 531507 - RNA, 64 nt, Homo Sapiens; identical to SEQ ID NO: 157333

SEQ ID NO: 531508 - RNA, 64 nt, Homo Sapiens; identical to SEQ ID NO: 157334

SEQ ID NO: 531509 - RNA, 64 nt, Homo Sapiens; identical to SEQ ID NO: 157335

SEQ ID NO: 531510 - RNA, 64 nt, Homo Sapiens; identical to SEQ ID NO: 157336

SEQ ID NO: 531511 - RNA, 64 nt, Homo Sapiens; identical to SEQ ID NO: 157337

SEQ ID NO: 531512 - RNA, 64 nt, Homo Sapiens; identical to SEQ ID NO: 157338

SEQ ID NO: 531513 - RNA, 64 nt, Homo Sapiens; identical to SEQ ID NO: 157339

SEQ ID NO: 531514 - RNA, 64 nt, Homo Sapiens; identical to SEQ ID NO: 157340

SEQ ID NO: 531515 - RNA, 64 nt, Homo Sapiens; identical to SEQ ID NO: 157341

SEQ ID NO: 531516 - RNA, 64 nt, Homo Sapiens; identical to SEQ ID NO: 157342

SEQ ID NO: 531517 - RNA, 64 nt, Homo Sapiens; identical to SEQ ID NO: 157343

SEQ ID NO: 531518 - RNA, 64 nt, Homo Sapiens; identical to SEQ ID NO: 157344

SEQ ID NO: 531519 - RNA, 64 nt, Homo Sapiens; identical to SEQ ID NO: 157345

SEQ ID NO: 531520 - RNA, 64 nt, Homo Sapiens; identical to SEQ ID NO: 157346

SEQ ID NO: 531521 - RNA, 64 nt, Homo Sapiens; identical to SEQ ID NO: 157347

SEQ ID NO: 531522 - RNA, 64 nt, Homo Sapiens; identical to SEQ ID NO: 157348

SEQ ID NO: 531523 - RNA, 64 nt, Homo Sapiens; identical to SEQ ID NO: 157349

SEQ ID NO: 531524 - RNA, 64 nt, Homo Sapiens; identical to SEQ ID NO: 157350

SEQ ID NO: 531525 - RNA, 64 nt, Homo Sapiens; identical to SEQ ID NO: 157351

SEQ ID NO: 531526 - RNA, 64 nt, Homo Sapiens; identical to SEQ ID NO: 157352

SEQ ID NO: 531527 - RNA, 64 nt, Homo Sapiens; identical to SEQ ID NO: 157353

SEQ ID NO: 531528 - RNA, 64 nt, Homo Sapiens; identical to SEQ ID NO: 157354

SEQ ID NO: 531529 - RNA, 64 nt, Homo Sapiens; identical to SEQ ID NO: 157355

SEQ ID NO: 531530 - RNA, 64 nt, Homo Sapiens; identical to SEQ ID NO: 157356

SEQ ID NO: 531531 - RNA, 64 nt, Homo Sapiens; identical to SEQ ID NO: 157357

SEQ ID NO: 531532 - RNA, 64 nt, Homo Sapiens; identical to SEQ ID NO: 157358

SEQ ID NO: 531533 - RNA, 64 nt, Homo Sapiens; identical to SEQ ID NO: 157359

SEQ ID NO: 531534 - RNA, 64 nt, Homo Sapiens; identical to SEQ ID NO: 157360

SEQ ID NO: 531535 - RNA, 64 nt, Homo Sapiens; identical to SEQ ID NO: 157361

SEQ ID NO: 531536 - RNA, 64 nt, Homo Sapiens; identical to SEQ ID NO: 157362

SEQ ID NO: 531537 - RNA, 64 nt, Homo Sapiens; identical to SEQ ID NO: 157363

SEQ ID NO: 531538 - RNA, 64 nt, Homo Sapiens; identical to SEQ ID NO: 157364

SEQ ID NO: 531539 - RNA, 64 nt, Homo Sapiens; identical to SEQ ID NO: 157365

SEQ ID NO: 531540 - RNA, 64 nt, Homo Sapiens; identical to SEQ ID NO: 157366

SEQ ID NO: 531541 - RNA, 64 nt, Homo Sapiens; identical to SEQ ID NO: 157367

SEQ ID NO: 531542 - RNA, 64 nt, Homo Sapiens; identical to SEQ ID NO: 157368

SEQ ID NO: 531543 - RNA, 64 nt, Homo Sapiens; identical to SEQ ID NO: 157369

SEQ ID NO: 531544 - RNA, 64 nt, Homo Sapiens; identical to SEQ ID NO: 157370

SEQ ID NO: 531545 - RNA, 64 nt, Homo Sapiens; identical to SEQ ID NO: 157371

SEQ ID NO: 531546 - RNA, 64 nt, Homo Sapiens; identical to SEQ ID NO: 157372

SEQ ID NO: 531547 - RNA, 64 nt, Homo Sapiens; identical to SEQ ID NO: 157373

SEQ ID NO: 531548 - RNA, 64 nt, Homo Sapiens; identical to SEQ ID NO: 157374

SEQ ID NO: 531549 - RNA, 64 nt, Homo Sapiens; identical to SEQ ID NO: 157375

SEQ ID NO: 531550 - RNA, 64 nt, Homo Sapiens; identical to SEQ ID NO: 157376

SEQ ID NO: 531551 - RNA, 64 nt, Homo Sapiens; identical to SEQ ID NO: 157377

SEQ ID NO: 531552 - RNA, 64 nt, Homo Sapiens; identical to SEQ ID NO: 157378

SEQ ID NO: 531553 - RNA, 64 nt, Homo Sapiens; identical to SEQ ID NO: 157379

SEQ ID NO: 531554 - RNA, 64 nt, Homo Sapiens; identical to SEQ ID NO: 157380

SEQ ID NO: 531555 - RNA, 64 nt, Homo Sapiens; identical to SEQ ID NO: 157381

SEQ ID NO: 531556 - RNA, 64 nt, Homo Sapiens; identical to SEQ ID NO: 157382

SEQ ID NO: 531557 - RNA, 64 nt, Homo Sapiens; identical to SEQ ID NO: 157383

SEQ ID NO: 531558 - RNA, 64 nt, Homo Sapiens; identical to SEQ ID NO: 157384

SEQ ID NO: 531559 - RNA, 64 nt, Homo Sapiens; identical to SEQ ID NO: 157385

SEQ ID NO: 531560 - RNA, 64 nt, Homo Sapiens; identical to SEQ ID NO: 157386

SEQ ID NO: 531561 - RNA, 64 nt, Homo Sapiens; identical to SEQ ID NO: 157387

SEQ ID NO: 531562 - RNA, 64 nt, Homo Sapiens; identical to SEQ ID NO: 157388

SEQ ID NO: 531563 - RNA, 64 nt, Homo Sapiens; identical to SEQ ID NO: 157389

SEQ ID NO: 531564 - RNA, 64 nt, Homo Sapiens; identical to SEQ ID NO: 157390

SEQ ID NO: 531565 - RNA, 64 nt, Homo Sapiens; identical to SEQ ID NO: 157391

SEQ ID NO: 531566 - RNA, 64 nt, Homo Sapiens; identical to SEQ ID NO: 157392

SEQ ID NO: 531567 - RNA, 64 nt, Homo Sapiens; identical to SEQ ID NO: 157393

SEQ ID NO: 531568 - RNA, 64 nt, Homo Sapiens; identical to SEQ ID NO: 157394

SEQ ID NO: 531569 - RNA, 64 nt, Homo Sapiens; identical to SEQ ID NO: 157395

SEQ ID NO: 531570 - RNA, 64 nt, Homo Sapiens; identical to SEQ ID NO: 157396

SEQ ID NO: 531571 - RNA, 64 nt, Homo Sapiens; identical to SEQ ID NO: 157397

SEQ ID NO: 531572 - RNA, 64 nt, Homo Sapiens; identical to SEQ ID NO: 157398

SEQ ID NO: 531573 - RNA, 64 nt, Homo Sapiens; identical to SEQ ID NO: 157399

SEQ ID NO: 531574 - RNA, 64 nt, Homo Sapiens; identical to SEQ ID NO: 157400

SEQ ID NO: 531575 - RNA, 64 nt, Homo Sapiens; identical to SEQ ID NO: 157401

SEQ ID NO: 531576 - RNA, 64 nt, Homo Sapiens; identical to SEQ ID NO: 157402

SEQ ID NO: 531577 - RNA, 64 nt, Homo Sapiens; identical to SEQ ID NO: 157403

SEQ ID NO: 531578 - RNA, 64 nt, Homo Sapiens; identical to SEQ ID NO: 157404

SEQ ID NO: 531579 - RNA, 64 nt, Homo Sapiens; identical to SEQ ID NO: 157405

SEQ ID NO: 531580 - RNA, 64 nt, Homo Sapiens; identical to SEQ ID NO: 157406

SEQ ID NO: 531581 - RNA, 64 nt, Homo Sapiens; identical to SEQ ID NO: 157407

SEQ ID NO: 531582 - RNA, 64 nt, Homo Sapiens; identical to SEQ ID NO: 157408

SEQ ID NO: 531583 - RNA, 64 nt, Homo Sapiens; identical to SEQ ID NO: 157409

SEQ ID NO: 531584 - RNA, 64 nt, Homo Sapiens; identical to SEQ ID NO: 157410

SEQ ID NO: 531585 - RNA, 64 nt, Homo Sapiens; identical to SEQ ID NO: 157411

SEQ ID NO: 531586 - RNA, 64 nt, Homo Sapiens; identical to SEQ ID NO: 157412

SEQ ID NO: 531587 - RNA, 64 nt, Homo Sapiens; identical to SEQ ID NO: 157413

SEQ ID NO: 531588 - RNA, 64 nt, Homo Sapiens; identical to SEQ ID NO: 157414

SEQ ID NO: 531589 - RNA, 64 nt, Homo Sapiens; identical to SEQ ID NO: 157415

SEQ ID NO: 531590 - RNA, 64 nt, Homo Sapiens; identical to SEQ ID NO: 157416

SEQ ID NO: 531591 - RNA, 64 nt, Homo Sapiens; identical to SEQ ID NO: 157417

SEQ ID NO: 531592 - RNA, 64 nt, Homo Sapiens; identical to SEQ ID NO: 157418

SEQ ID NO: 531593 - RNA, 64 nt, Homo Sapiens; identical to SEQ ID NO: 157419

SEQ ID NO: 531594 - RNA, 64 nt, Homo Sapiens; identical to SEQ ID NO: 157420

SEQ ID NO: 531595 - RNA, 64 nt, Homo Sapiens; identical to SEQ ID NO: 157421

SEQ ID NO: 531596 - RNA, 64 nt, Homo Sapiens; identical to SEQ ID NO: 157422

SEQ ID NO: 531597 - RNA, 64 nt, Homo Sapiens; identical to SEQ ID NO: 157423

SEQ ID NO: 531598 - RNA, 64 nt, Homo Sapiens; identical to SEQ ID NO: 157424

SEQ ID NO: 531599 - RNA, 64 nt, Homo Sapiens; identical to SEQ ID NO: 157425

SEQ ID NO: 531600 - RNA, 64 nt, Homo Sapiens; identical to SEQ ID NO: 157426

SEQ ID NO: 531601 - RNA, 64 nt, Homo Sapiens; identical to SEQ ID NO: 157427

SEQ ID NO: 531602 - RNA, 64 nt, Homo Sapiens; identical to SEQ ID NO: 157428

SEQ ID NO: 531603 - RNA, 64 nt, Homo Sapiens; identical to SEQ ID NO: 157429

SEQ ID NO: 531604 - RNA, 64 nt, Homo Sapiens; identical to SEQ ID NO: 157430

SEQ ID NO: 531605 - RNA, 64 nt, Homo Sapiens; identical to SEQ ID NO: 157431

SEQ ID NO: 531606 - RNA, 64 nt, Homo Sapiens; identical to SEQ ID NO: 157432

SEQ ID NO: 531607 - RNA, 64 nt, Homo Sapiens; identical to SEQ ID NO: 157433

SEQ ID NO: 531608 - RNA, 64 nt, Homo Sapiens; identical to SEQ ID NO: 157434

SEQ ID NO: 531609 - RNA, 64 nt, Homo Sapiens; identical to SEQ ID NO: 157435

SEQ ID NO: 531610 - RNA, 64 nt, Homo Sapiens; identical to SEQ ID NO: 157436

SEQ ID NO: 531611 - RNA, 64 nt, Homo Sapiens; identical to SEQ ID NO: 157437

SEQ ID NO: 531612 - RNA, 64 nt, Homo Sapiens; identical to SEQ ID NO: 157438

SEQ ID NO: 531613 - RNA, 64 nt, Homo Sapiens; identical to SEQ ID NO: 157439

SEQ ID NO: 531614 - RNA, 64 nt, Homo Sapiens; identical to SEQ ID NO: 157440

SEQ ID NO: 531615 - RNA, 64 nt, Homo Sapiens; identical to SEQ ID NO: 157441

SEQ ID NO: 531616 - RNA, 64 nt, Homo Sapiens; identical to SEQ ID NO: 157442

SEQ ID NO: 531617 - RNA, 64 nt, Homo Sapiens; identical to SEQ ID NO: 157443

SEQ ID NO: 531618 - RNA, 64 nt, Homo Sapiens; identical to SEQ ID NO: 157444

SEQ ID NO: 531619 - RNA, 64 nt, Homo Sapiens; identical to SEQ ID NO: 157445

SEQ ID NO: 531620 - RNA, 64 nt, Homo Sapiens; identical to SEQ ID NO: 157446

SEQ ID NO: 531621 - RNA, 64 nt, Homo Sapiens; identical to SEQ ID NO: 157447

SEQ ID NO: 531622 - RNA, 64 nt, Homo Sapiens; identical to SEQ ID NO: 157448

SEQ ID NO: 531623 - RNA, 64 nt, Homo Sapiens; identical to SEQ ID NO: 157449

SEQ ID NO: 531624 - RNA, 64 nt, Homo Sapiens; identical to SEQ ID NO: 157450

SEQ ID NO: 531625 - RNA, 64 nt, Homo Sapiens; identical to SEQ ID NO: 157451

SEQ ID NO: 531626 - RNA, 64 nt, Homo Sapiens; identical to SEQ ID NO: 157452

SEQ ID NO: 531627 - RNA, 64 nt, Homo Sapiens; identical to SEQ ID NO: 157453

SEQ ID NO: 531628 - RNA, 64 nt, Homo Sapiens; identical to SEQ ID NO: 157454

SEQ ID NO: 531629 - RNA, 64 nt, Homo Sapiens; identical to SEQ ID NO: 157455

SEQ ID NO: 531630 - RNA, 64 nt, Homo Sapiens; identical to SEQ ID NO: 157456

SEQ ID NO: 531631 - RNA, 64 nt, Homo Sapiens; identical to SEQ ID NO: 157457

SEQ ID NO: 531632 - RNA, 64 nt, Homo Sapiens; identical to SEQ ID NO: 157458

SEQ ID NO: 531633 - RNA, 64 nt, Homo Sapiens; identical to SEQ ID NO: 157459

SEQ ID NO: 531634 - RNA, 64 nt, Homo Sapiens; identical to SEQ ID NO: 157460

SEQ ID NO: 531635 - RNA, 64 nt, Homo Sapiens; identical to SEQ ID NO: 157461

SEQ ID NO: 531636 - RNA, 64 nt, Homo Sapiens; identical to SEQ ID NO: 157462

SEQ ID NO: 531637 - RNA, 64 nt, Homo Sapiens; identical to SEQ ID NO: 157463

SEQ ID NO: 531638 - RNA, 64 nt, Homo Sapiens; identical to SEQ ID NO: 157464

SEQ ID NO: 531639 - RNA, 64 nt, Homo Sapiens; identical to SEQ ID NO: 157465

SEQ ID NO: 531640 - RNA, 64 nt, Homo Sapiens; identical to SEQ ID NO: 157466

SEQ ID NO: 531641 - RNA, 64 nt, Homo Sapiens; identical to SEQ ID NO: 157467

SEQ ID NO: 531642 - RNA, 64 nt, Homo Sapiens; identical to SEQ ID NO: 157468

SEQ ID NO: 531643 - RNA, 64 nt, Homo Sapiens; identical to SEQ ID NO: 157469

SEQ ID NO: 531644 - RNA, 64 nt, Homo Sapiens; identical to SEQ ID NO: 157470

SEQ ID NO: 531645 - RNA, 64 nt, Homo Sapiens; identical to SEQ ID NO: 157471

SEQ ID NO: 531646 - RNA, 64 nt, Homo Sapiens; identical to SEQ ID NO: 157472

SEQ ID NO: 531647 - RNA, 64 nt, Homo Sapiens; identical to SEQ ID NO: 157473

SEQ ID NO: 531648 - RNA, 64 nt, Homo Sapiens; identical to SEQ ID NO: 157474

SEQ ID NO: 531649 - RNA, 64 nt, Homo Sapiens; identical to SEQ ID NO: 157475

SEQ ID NO: 531650 - RNA, 64 nt, Homo Sapiens; identical to SEQ ID NO: 157476

SEQ ID NO: 531651 - RNA, 64 nt, Homo Sapiens; identical to SEQ ID NO: 157477

SEQ ID NO: 531652 - RNA, 64 nt, Homo Sapiens; identical to SEQ ID NO: 157478

SEQ ID NO: 531653 - RNA, 64 nt, Homo Sapiens; identical to SEQ ID NO: 157479

SEQ ID NO: 531654 - RNA, 64 nt, Homo Sapiens; identical to SEQ ID NO: 157480

SEQ ID NO: 531655 - RNA, 64 nt, Homo Sapiens; identical to SEQ ID NO: 157481

SEQ ID NO: 531656 - RNA, 64 nt, Homo Sapiens; identical to SEQ ID NO: 157482

SEQ ID NO: 531657 - RNA, 64 nt, Homo Sapiens; identical to SEQ ID NO: 157483

SEQ ID NO: 531658 - RNA, 64 nt, Homo Sapiens; identical to SEQ ID NO: 157484

SEQ ID NO: 531659 - RNA, 64 nt, Homo Sapiens; identical to SEQ ID NO: 157485

SEQ ID NO: 531660 - RNA, 64 nt, Homo Sapiens; identical to SEQ ID NO: 157486

SEQ ID NO: 531661 - RNA, 64 nt, Homo Sapiens; identical to SEQ ID NO: 157487

SEQ ID NO: 531662 - RNA, 64 nt, Homo Sapiens; identical to SEQ ID NO: 157488

SEQ ID NO: 531663 - RNA, 64 nt, Homo Sapiens; identical to SEQ ID NO: 157489

SEQ ID NO: 531664 - RNA, 64 nt, Homo Sapiens; identical to SEQ ID NO: 157490

SEQ ID NO: 531665 - RNA, 64 nt, Homo Sapiens; identical to SEQ ID NO: 157491

SEQ ID NO: 531666 - RNA, 64 nt, Homo Sapiens; identical to SEQ ID NO: 157492

SEQ ID NO: 531667 - RNA, 64 nt, Homo Sapiens; identical to SEQ ID NO: 157493

SEQ ID NO: 531668 - RNA, 64 nt, Homo Sapiens; identical to SEQ ID NO: 157494

SEQ ID NO: 531669 - RNA, 64 nt, Homo Sapiens; identical to SEQ ID NO: 157495

SEQ ID NO: 531670 - RNA, 64 nt, Homo Sapiens; identical to SEQ ID NO: 157496

SEQ ID NO: 531671 - RNA, 64 nt, Homo Sapiens; identical to SEQ ID NO: 157497

SEQ ID NO: 531672 - RNA, 64 nt, Homo Sapiens; identical to SEQ ID NO: 157498

SEQ ID NO: 531673 - RNA, 64 nt, Homo Sapiens; identical to SEQ ID NO: 157499

SEQ ID NO: 531674 - RNA, 64 nt, Homo Sapiens; identical to SEQ ID NO: 157500

SEQ ID NO: 531675 - RNA, 64 nt, Homo Sapiens; identical to SEQ ID NO: 157501

SEQ ID NO: 531676 - RNA, 64 nt, Homo Sapiens; identical to SEQ ID NO: 157502

SEQ ID NO: 531677 - RNA, 64 nt, Homo Sapiens; identical to SEQ ID NO: 157503

SEQ ID NO: 531678 - RNA, 64 nt, Homo Sapiens; identical to SEQ ID NO: 157504

SEQ ID NO: 531679 - RNA, 64 nt, Homo Sapiens; identical to SEQ ID NO: 157505

SEQ ID NO: 531680 - RNA, 64 nt, Homo Sapiens; identical to SEQ ID NO: 157506

SEQ ID NO: 531681 - RNA, 64 nt, Homo Sapiens; identical to SEQ ID NO: 157507

SEQ ID NO: 531682 - RNA, 64 nt, Homo Sapiens; identical to SEQ ID NO: 157508

SEQ ID NO: 531683 - RNA, 64 nt, Homo Sapiens; identical to SEQ ID NO: 157509

SEQ ID NO: 531684 - RNA, 64 nt, Homo Sapiens; identical to SEQ ID NO: 157510

SEQ ID NO: 531685 - RNA, 64 nt, Homo Sapiens; identical to SEQ ID NO: 157511

SEQ ID NO: 531686 - RNA, 64 nt, Homo Sapiens; identical to SEQ ID NO: 157512

SEQ ID NO: 531687 - RNA, 64 nt, Homo Sapiens; identical to SEQ ID NO: 157513

SEQ ID NO: 531688 - RNA, 64 nt, Homo Sapiens; identical to SEQ ID NO: 157514

SEQ ID NO: 531689 - RNA, 64 nt, Homo Sapiens; identical to SEQ ID NO: 157515

SEQ ID NO: 531690 - RNA, 64 nt, Homo Sapiens; identical to SEQ ID NO: 157516

SEQ ID NO: 531691 - RNA, 64 nt, Homo Sapiens; identical to SEQ ID NO: 157517

SEQ ID NO: 531692 - RNA, 64 nt, Homo Sapiens; identical to SEQ ID NO: 157518

SEQ ID NO: 531693 - RNA, 64 nt, Homo Sapiens; identical to SEQ ID NO: 157519

SEQ ID NO: 531694 - RNA, 64 nt, Homo Sapiens; identical to SEQ ID NO: 157520

SEQ ID NO: 531695 - RNA, 64 nt, Homo Sapiens; identical to SEQ ID NO: 157521

SEQ ID NO: 531696 - RNA, 64 nt, Homo Sapiens; identical to SEQ ID NO: 157522

SEQ ID NO: 531697 - RNA, 64 nt, Homo Sapiens; identical to SEQ ID NO: 157523

SEQ ID NO: 531698 - RNA, 64 nt, Homo Sapiens; identical to SEQ ID NO: 157524

SEQ ID NO: 531699 - RNA, 64 nt, Homo Sapiens; identical to SEQ ID NO: 157525

SEQ ID NO: 531700 - RNA, 64 nt, Homo Sapiens; identical to SEQ ID NO: 157526

SEQ ID NO: 531701 - RNA, 64 nt, Homo Sapiens; identical to SEQ ID NO: 157527

SEQ ID NO: 531702 - RNA, 64 nt, Homo Sapiens; identical to SEQ ID NO: 157528

SEQ ID NO: 531703 - RNA, 64 nt, Homo Sapiens; identical to SEQ ID NO: 157529

SEQ ID NO: 531704 - RNA, 64 nt, Homo Sapiens; identical to SEQ ID NO: 157530

SEQ ID NO: 531705 - RNA, 64 nt, Homo Sapiens; identical to SEQ ID NO: 157531

SEQ ID NO: 531706 - RNA, 64 nt, Homo Sapiens; identical to SEQ ID NO: 157532

SEQ ID NO: 531707 - RNA, 64 nt, Homo Sapiens; identical to SEQ ID NO: 157533

SEQ ID NO: 531708 - RNA, 64 nt, Homo Sapiens; identical to SEQ ID NO: 157534

SEQ ID NO: 531709 - RNA, 64 nt, Homo Sapiens; identical to SEQ ID NO: 157535

SEQ ID NO: 531710 - RNA, 64 nt, Homo Sapiens; identical to SEQ ID NO: 157536

SEQ ID NO: 531711 - RNA, 64 nt, Homo Sapiens; identical to SEQ ID NO: 157537

SEQ ID NO: 531712 - RNA, 64 nt, Homo Sapiens; identical to SEQ ID NO: 157538

SEQ ID NO: 531713 - RNA, 64 nt, Homo Sapiens; identical to SEQ ID NO: 157539

SEQ ID NO: 531714 - RNA, 64 nt, Homo Sapiens; identical to SEQ ID NO: 157540

SEQ ID NO: 531715 - RNA, 64 nt, Homo Sapiens; identical to SEQ ID NO: 157541

SEQ ID NO: 531716 - RNA, 64 nt, Homo Sapiens; identical to SEQ ID NO: 157542

SEQ ID NO: 531717 - RNA, 64 nt, Homo Sapiens; identical to SEQ ID NO: 157543

SEQ ID NO: 531718 - RNA, 64 nt, Homo Sapiens; identical to SEQ ID NO: 157544

SEQ ID NO: 531719 - RNA, 64 nt, Homo Sapiens; identical to SEQ ID NO: 157545

SEQ ID NO: 531720 - RNA, 64 nt, Homo Sapiens; identical to SEQ ID NO: 157546

SEQ ID NO: 531721 - RNA, 64 nt, Homo Sapiens; identical to SEQ ID NO: 157547

SEQ ID NO: 531722 - RNA, 64 nt, Homo Sapiens; identical to SEQ ID NO: 157548

SEQ ID NO: 531723 - RNA, 64 nt, Homo Sapiens; identical to SEQ ID NO: 157549

SEQ ID NO: 531724 - RNA, 64 nt, Homo Sapiens; identical to SEQ ID NO: 157550

SEQ ID NO: 531725 - RNA, 64 nt, Homo Sapiens; identical to SEQ ID NO: 157551

SEQ ID NO: 531726 - RNA, 64 nt, Homo Sapiens; identical to SEQ ID NO: 157552

SEQ ID NO: 531727 - RNA, 64 nt, Homo Sapiens; identical to SEQ ID NO: 157553

SEQ ID NO: 531728 - RNA, 64 nt, Homo Sapiens; identical to SEQ ID NO: 157554

SEQ ID NO: 531729 - RNA, 64 nt, Homo Sapiens; identical to SEQ ID NO: 157555

SEQ ID NO: 531730 - RNA, 64 nt, Homo Sapiens; identical to SEQ ID NO: 157556

SEQ ID NO: 531731 - RNA, 64 nt, Homo Sapiens; identical to SEQ ID NO: 157557

SEQ ID NO: 531732 - RNA, 64 nt, Homo Sapiens; identical to SEQ ID NO: 157558

SEQ ID NO: 531733 - RNA, 64 nt, Homo Sapiens; identical to SEQ ID NO: 157559

SEQ ID NO: 531734 - RNA, 64 nt, Homo Sapiens; identical to SEQ ID NO: 157560

SEQ ID NO: 531735 - RNA, 64 nt, Homo Sapiens; identical to SEQ ID NO: 157561

SEQ ID NO: 531736 - RNA, 64 nt, Homo Sapiens; identical to SEQ ID NO: 157562

SEQ ID NO: 531737 - RNA, 64 nt, Homo Sapiens; identical to SEQ ID NO: 157563

SEQ ID NO: 531738 - RNA, 64 nt, Homo Sapiens; identical to SEQ ID NO: 157564

SEQ ID NO: 531739 - RNA, 64 nt, Homo Sapiens; identical to SEQ ID NO: 157565

SEQ ID NO: 531740 - RNA, 64 nt, Homo Sapiens; identical to SEQ ID NO: 157566

SEQ ID NO: 531741 - RNA, 64 nt, Homo Sapiens; identical to SEQ ID NO: 157567

SEQ ID NO: 531742 - RNA, 64 nt, Homo Sapiens; identical to SEQ ID NO: 157568

SEQ ID NO: 531743 - RNA, 64 nt, Homo Sapiens; identical to SEQ ID NO: 157569

SEQ ID NO: 531744 - RNA, 64 nt, Homo Sapiens; identical to SEQ ID NO: 157570

SEQ ID NO: 531745 - RNA, 64 nt, Homo Sapiens; identical to SEQ ID NO: 157571

SEQ ID NO: 531746 - RNA, 64 nt, Homo Sapiens; identical to SEQ ID NO: 157572

SEQ ID NO: 531747 - RNA, 64 nt, Homo Sapiens; identical to SEQ ID NO: 157573

SEQ ID NO: 531748 - RNA, 64 nt, Homo Sapiens; identical to SEQ ID NO: 157574

SEQ ID NO: 531749 - RNA, 64 nt, Homo Sapiens; identical to SEQ ID NO: 157575

SEQ ID NO: 531750 - RNA, 64 nt, Homo Sapiens; identical to SEQ ID NO: 157576

SEQ ID NO: 531751 - RNA, 64 nt, Homo Sapiens; identical to SEQ ID NO: 157577

SEQ ID NO: 531752 - RNA, 64 nt, Homo Sapiens; identical to SEQ ID NO: 157578

SEQ ID NO: 531753 - RNA, 64 nt, Homo Sapiens; identical to SEQ ID NO: 157579

SEQ ID NO: 531754 - RNA, 64 nt, Homo Sapiens; identical to SEQ ID NO: 157580

SEQ ID NO: 531755 - RNA, 64 nt, Homo Sapiens; identical to SEQ ID NO: 157581

SEQ ID NO: 531756 - RNA, 64 nt, Homo Sapiens; identical to SEQ ID NO: 157582

SEQ ID NO: 531757 - RNA, 64 nt, Homo Sapiens; identical to SEQ ID NO: 157583

SEQ ID NO: 531758 - RNA, 64 nt, Homo Sapiens; identical to SEQ ID NO: 157584

SEQ ID NO: 531759 - RNA, 64 nt, Homo Sapiens; identical to SEQ ID NO: 157585

SEQ ID NO: 531760 - RNA, 64 nt, Homo Sapiens; identical to SEQ ID NO: 157586

SEQ ID NO: 531761 - RNA, 64 nt, Homo Sapiens; identical to SEQ ID NO: 157587

SEQ ID NO: 531762 - RNA, 64 nt, Homo Sapiens; identical to SEQ ID NO: 157588

SEQ ID NO: 531763 - RNA, 64 nt, Homo Sapiens; identical to SEQ ID NO: 157589

SEQ ID NO: 531764 - RNA, 64 nt, Homo Sapiens; identical to SEQ ID NO: 157590

SEQ ID NO: 531765 - RNA, 64 nt, Homo Sapiens; identical to SEQ ID NO: 157591

SEQ ID NO: 531766 - RNA, 64 nt, Homo Sapiens; identical to SEQ ID NO: 157592

SEQ ID NO: 531767 - RNA, 64 nt, Homo Sapiens; identical to SEQ ID NO: 157593

SEQ ID NO: 531768 - RNA, 64 nt, Homo Sapiens; identical to SEQ ID NO: 157594

SEQ ID NO: 531769 - RNA, 64 nt, Homo Sapiens; identical to SEQ ID NO: 157595

SEQ ID NO: 531770 - RNA, 64 nt, Homo Sapiens; identical to SEQ ID NO: 157596

SEQ ID NO: 531771 - RNA, 64 nt, Homo Sapiens; identical to SEQ ID NO: 157597

SEQ ID NO: 531772 - RNA, 64 nt, Homo Sapiens; identical to SEQ ID NO: 157598

SEQ ID NO: 531773 - RNA, 64 nt, Homo Sapiens; identical to SEQ ID NO: 157599

SEQ ID NO: 531774 - RNA, 64 nt, Homo Sapiens; identical to SEQ ID NO: 157600

SEQ ID NO: 531775 - RNA, 64 nt, Homo Sapiens; identical to SEQ ID NO: 157601

SEQ ID NO: 531776 - RNA, 64 nt, Homo Sapiens; identical to SEQ ID NO: 157602

SEQ ID NO: 531777 - RNA, 64 nt, Homo Sapiens; identical to SEQ ID NO: 157603

SEQ ID NO: 531778 - RNA, 64 nt, Homo Sapiens; identical to SEQ ID NO: 157604

SEQ ID NO: 531779 - RNA, 64 nt, Homo Sapiens; identical to SEQ ID NO: 157605

SEQ ID NO: 531780 - RNA, 64 nt, Homo Sapiens; identical to SEQ ID NO: 157606

SEQ ID NO: 531781 - RNA, 64 nt, Homo Sapiens; identical to SEQ ID NO: 147132

SEQ ID NO: 531782 - RNA, 64 nt, Homo Sapiens; identical to SEQ ID NO: 147133

SEQ ID NO: 531783 - RNA, 64 nt, Homo Sapiens; identical to SEQ ID NO: 147134

SEQ ID NO: 531784 - RNA, 64 nt, Homo Sapiens; identical to SEQ ID NO: 147135

SEQ ID NO: 531785 - RNA, 64 nt, Homo Sapiens; identical to SEQ ID NO: 147136

SEQ ID NO: 531786 - RNA, 64 nt, Homo Sapiens; identical to SEQ ID NO: 147137

SEQ ID NO: 531787 - RNA, 64 nt, Homo Sapiens; identical to SEQ ID NO: 147138

SEQ ID NO: 531788 - RNA, 64 nt, Homo Sapiens; identical to SEQ ID NO: 147139

SEQ ID NO: 531789 - RNA, 64 nt, Homo Sapiens; identical to SEQ ID NO: 147140

SEQ ID NO: 531790 - RNA, 64 nt, Homo Sapiens; identical to SEQ ID NO: 147141

SEQ ID NO: 531791 - RNA, 64 nt, Homo Sapiens; identical to SEQ ID NO: 147142

SEQ ID NO: 531792 - RNA, 64 nt, Homo Sapiens; identical to SEQ ID NO: 147143

SEQ ID NO: 531793 - RNA, 64 nt, Homo Sapiens; identical to SEQ ID NO: 147144

SEQ ID NO: 531794 - RNA, 64 nt, Homo Sapiens; identical to SEQ ID NO: 147145

SEQ ID NO: 531795 - RNA, 64 nt, Homo Sapiens; identical to SEQ ID NO: 147146

SEQ ID NO: 531796 - RNA, 64 nt, Homo Sapiens; identical to SEQ ID NO: 147147

SEQ ID NO: 531797 - RNA, 64 nt, Homo Sapiens; identical to SEQ ID NO: 147148

SEQ ID NO: 531798 - RNA, 64 nt, Homo Sapiens; identical to SEQ ID NO: 147149

SEQ ID NO: 531799 - RNA, 64 nt, Homo Sapiens; identical to SEQ ID NO: 147150

SEQ ID NO: 531800 - RNA, 64 nt, Homo Sapiens; identical to SEQ ID NO: 147151

SEQ ID NO: 531801 - RNA, 64 nt, Homo Sapiens; identical to SEQ ID NO: 147152

SEQ ID NO: 531802 - RNA, 64 nt, Homo Sapiens; identical to SEQ ID NO: 147153

SEQ ID NO: 531803 - RNA, 64 nt, Homo Sapiens; identical to SEQ ID NO: 147154

SEQ ID NO: 531804 - RNA, 64 nt, Homo Sapiens; identical to SEQ ID NO: 147155

SEQ ID NO: 531805 - RNA, 64 nt, Homo Sapiens; identical to SEQ ID NO: 147156

SEQ ID NO: 531806 - RNA, 64 nt, Homo Sapiens; identical to SEQ ID NO: 147157

SEQ ID NO: 531807 - RNA, 64 nt, Homo Sapiens; identical to SEQ ID NO: 147158

SEQ ID NO: 531808 - RNA, 64 nt, Homo Sapiens; identical to SEQ ID NO: 147159

SEQ ID NO: 531809 - RNA, 64 nt, Homo Sapiens; identical to SEQ ID NO: 147160

SEQ ID NO: 531810 - RNA, 64 nt, Homo Sapiens; identical to SEQ ID NO: 147161

SEQ ID NO: 531811 - RNA, 64 nt, Homo Sapiens; identical to SEQ ID NO: 147162

SEQ ID NO: 531812 - RNA, 64 nt, Homo Sapiens; identical to SEQ ID NO: 147163

SEQ ID NO: 531813 - RNA, 64 nt, Homo Sapiens; identical to SEQ ID NO: 147164

SEQ ID NO: 531814 - RNA, 64 nt, Homo Sapiens; identical to SEQ ID NO: 147165

SEQ ID NO: 531815 - RNA, 64 nt, Homo Sapiens; identical to SEQ ID NO: 147166

SEQ ID NO: 531816 - RNA, 64 nt, Homo Sapiens; identical to SEQ ID NO: 147167

SEQ ID NO: 531817 - RNA, 64 nt, Homo Sapiens; identical to SEQ ID NO: 84335

SEQ ID NO: 531818 - RNA, 64 nt, Homo Sapiens; identical to SEQ ID NO: 84336

SEQ ID NO: 531819 - RNA, 64 nt, Homo Sapiens; identical to SEQ ID NO: 84337

SEQ ID NO: 531820 - RNA, 64 nt, Homo Sapiens; identical to SEQ ID NO: 84338

SEQ ID NO: 531821 - RNA, 64 nt, Homo Sapiens; identical to SEQ ID NO: 84339

SEQ ID NO: 531822 - RNA, 64 nt, Homo Sapiens; identical to SEQ ID NO: 84340

SEQ ID NO: 531823 - RNA, 64 nt, Homo Sapiens; identical to SEQ ID NO: 84341

SEQ ID NO: 531824 - RNA, 64 nt, Homo Sapiens; identical to SEQ ID NO: 84342

SEQ ID NO: 531825 - RNA, 64 nt, Homo Sapiens
augugucugcugaaaugcugauggcuugaccugggauugacaaacagacagcccugccuugagg

SEQ ID NO: 531826 - RNA, 64 nt, Homo Sapiens
augggaucuagaucuuuccugguuaggcaccugagauugacaugaucccuguccuuggguccug

SEQ ID NO: 531827 - RNA, 64 nt, Homo Sapiens
uuaaaucuuuuguggagacaggugcaaaucagaagauugacaaggaagaacuugagcuugcuaa

SEQ ID NO: 531828 - RNA, 64 nt, Homo Sapiens
cagagaauguagugcuucauauauccaugaccaagauugacauguugcucacaacaugucacaa

SEQ ID NO: 531829 - RNA, 64 nt, Homo Sapiens
acagauguaaacaucacuuguaggugauuaaaaagauugacagccgggccugaugucucaagcc

SEQ ID NO: 531830 - RNA, 64 nt, Homo Sapiens
caagagugaaauuccaucucaaaaaacaaaaacagauugacaacaaagacaguuucagaaaaug

SEQ ID NO: 531831 - RNA, 64 nt, Homo Sapiens; identical to SEQ ID NO: 154777

SEQ ID NO: 531832 - RNA, 64 nt, Homo Sapiens; identical to SEQ ID NO: 154778

SEQ ID NO: 531833 - RNA, 64 nt, Homo Sapiens; identical to SEQ ID NO: 154779

SEQ ID NO: 531834 - RNA, 64 nt, Homo Sapiens; identical to SEQ ID NO: 154780

SEQ ID NO: 531835 - RNA, 64 nt, Homo Sapiens; identical to SEQ ID NO: 154781

SEQ ID NO: 531836 - RNA, 64 nt, Homo Sapiens; identical to SEQ ID NO: 154782

SEQ ID NO: 531837 - RNA, 64 nt, Homo Sapiens; identical to SEQ ID NO: 154783

SEQ ID NO: 531838 - RNA, 64 nt, Homo Sapiens; identical to SEQ ID NO: 154784

SEQ ID NO: 531839 - RNA, 64 nt, Homo Sapiens; identical to SEQ ID NO: 154785

SEQ ID NO: 531840 - RNA, 64 nt, Homo Sapiens; identical to SEQ ID NO: 154786

SEQ ID NO: 531841 - RNA, 64 nt, Homo Sapiens; identical to SEQ ID NO: 154787

SEQ ID NO: 531842 - RNA, 64 nt, Homo Sapiens; identical to SEQ ID NO: 154788

SEQ ID NO: 531843 - RNA, 64 nt, Homo Sapiens; identical to SEQ ID NO: 154789

SEQ ID NO: 531844 - RNA, 64 nt, Homo Sapiens; identical to SEQ ID NO: 154790

SEQ ID NO: 531845 - RNA, 64 nt, Homo Sapiens; identical to SEQ ID NO: 154791

SEQ ID NO: 531846 - RNA, 64 nt, Homo Sapiens; identical to SEQ ID NO: 154792

SEQ ID NO: 531847 - RNA, 64 nt, Homo Sapiens; identical to SEQ ID NO: 154793

SEQ ID NO: 531848 - RNA, 64 nt, Homo Sapiens; identical to SEQ ID NO: 154794

SEQ ID NO: 531849 - RNA, 64 nt, Homo Sapiens; identical to SEQ ID NO: 154795

SEQ ID NO: 531850 - RNA, 64 nt, Homo Sapiens; identical to SEQ ID NO: 154796

SEQ ID NO: 531851 - RNA, 64 nt, Homo Sapiens; identical to SEQ ID NO: 154797

SEQ ID NO: 531852 - RNA, 64 nt, Homo Sapiens; identical to SEQ ID NO: 154798

SEQ ID NO: 531853 - RNA, 64 nt, Homo Sapiens; identical to SEQ ID NO: 154799

SEQ ID NO: 531854 - RNA, 64 nt, Homo Sapiens; identical to SEQ ID NO: 154800

SEQ ID NO: 531855 - RNA, 64 nt, Homo Sapiens; identical to SEQ ID NO: 218966

SEQ ID NO: 531856 - RNA, 64 nt, Homo Sapiens; identical to SEQ ID NO: 218967

SEQ ID NO: 531857 - RNA, 64 nt, Homo Sapiens; identical to SEQ ID NO: 218968

SEQ ID NO: 531858 - RNA, 64 nt, Homo Sapiens; identical to SEQ ID NO: 218969

SEQ ID NO: 531859 - RNA, 64 nt, Homo Sapiens; identical to SEQ ID NO: 218970

SEQ ID NO: 531860 - RNA, 64 nt, Homo Sapiens; identical to SEQ ID NO: 218971

SEQ ID NO: 531861 - RNA, 64 nt, Homo Sapiens; identical to SEQ ID NO: 218972

SEQ ID NO: 531862 - RNA, 64 nt, Homo Sapiens; identical to SEQ ID NO: 218973

SEQ ID NO: 531863 - RNA, 64 nt, Homo Sapiens; identical to SEQ ID NO: 218974

SEQ ID NO: 531864 - RNA, 64 nt, Homo Sapiens; identical to SEQ ID NO: 218975

SEQ ID NO: 531865 - RNA, 64 nt, Homo Sapiens; identical to SEQ ID NO: 218976

SEQ ID NO: 531866 - RNA, 64 nt, Homo Sapiens; identical to SEQ ID NO: 218977

SEQ ID NO: 531867 - RNA, 64 nt, Homo Sapiens; identical to SEQ ID NO: 218978

SEQ ID NO: 531868 - RNA, 64 nt, Homo Sapiens; identical to SEQ ID NO: 218979

SEQ ID NO: 531869 - RNA, 64 nt, Homo Sapiens; identical to SEQ ID NO: 218980

SEQ ID NO: 531870 - RNA, 64 nt, Homo Sapiens; identical to SEQ ID NO: 218981

SEQ ID NO: 531871 - RNA, 64 nt, Homo Sapiens; identical to SEQ ID NO: 218982

SEQ ID NO: 531872 - RNA, 64 nt, Homo Sapiens; identical to SEQ ID NO: 218983

SEQ ID NO: 531873 - RNA, 64 nt, Homo Sapiens; identical to SEQ ID NO: 218984

SEQ ID NO: 531874 - RNA, 64 nt, Homo Sapiens; identical to SEQ ID NO: 218985

SEQ ID NO: 531875 - RNA, 64 nt, Homo Sapiens; identical to SEQ ID NO: 218986

SEQ ID NO: 531876 - RNA, 64 nt, Homo Sapiens; identical to SEQ ID NO: 218987

SEQ ID NO: 531877 - RNA, 64 nt, Homo Sapiens; identical to SEQ ID NO: 218988

SEQ ID NO: 531878 - RNA, 64 nt, Homo Sapiens; identical to SEQ ID NO: 218989

SEQ ID NO: 531879 - RNA, 64 nt, Homo Sapiens; identical to SEQ ID NO: 218990

SEQ ID NO: 531880 - RNA, 64 nt, Homo Sapiens; identical to SEQ ID NO: 218991

SEQ ID NO: 531881 - RNA, 64 nt, Homo Sapiens; identical to SEQ ID NO: 218992

SEQ ID NO: 531882 - RNA, 64 nt, Homo Sapiens; identical to SEQ ID NO: 218993

SEQ ID NO: 531883 - RNA, 64 nt, Homo Sapiens; identical to SEQ ID NO: 218994

SEQ ID NO: 531884 - RNA, 64 nt, Homo Sapiens; identical to SEQ ID NO: 218995

SEQ ID NO: 531885 - RNA, 64 nt, Homo Sapiens; identical to SEQ ID NO: 218996

SEQ ID NO: 531886 - RNA, 64 nt, Homo Sapiens
cugacaccaaggacagcacuauggacacugccucuggagccagcggacuagaggugaagaggag

SEQ ID NO: 531887 - RNA, 64 nt, Homo Sapiens
acuacucacaccgugguccuaccaugcccagcccuggagccaucaccucaguguccacacaccc

SEQ ID NO: 531888 - RNA, 64 nt, Homo Sapiens
gcuugauugggcccuggacguugagcccagauguuggagccacaccagccuggauuucaauccc

SEQ ID NO: 531889 - RNA, 64 nt, Homo Sapiens
cuugggcucuugacuccucacuguugucuagagauggagccagcaggcugguagccuggcagcc

SEQ ID NO: 531890 - RNA, 64 nt, Homo Sapiens
cacucuggagauucuagcaagacacccaagucgcuggagccauugagaaugggacguugcugug

SEQ ID NO: 531891 - RNA, 64 nt, Homo Sapiens
gagcuggugcugccgcuggaguuggcccaggaacuggagccacacacgugcagcguccuuggca

SEQ ID NO: 531892 - RNA, 64 nt, Homo Sapiens
cagaaaggggagguggccugcuuggccgacgucauggagccagcugggagcagggcugagcguu

SEQ ID NO: 531893 - RNA, 64 nt, Homo Sapiens
cugcuugugugcucaugaagacaugcccacgccauggagccaggggcuuauagagaggggcagu

SEQ ID NO: 531894 - RNA, 64 nt, Homo Sapiens
aggauacccucacuuugcaugggggccccagggcuggagccacauggagccaaaggugaccgca

SEQ ID NO: 531895 - RNA, 64 nt, Homo Sapiens
ggugaccgcagggggccccacaagaaccagacuguggagccaaaaagcugucugcccuuggguu

SEQ ID NO: 531896 - RNA, 64 nt, Homo Sapiens
agcgggacucagugagcuggggccgucugugugguggagccagggccucucccuuuaguggagc

SEQ ID NO: 531897 - RNA, 64 nt, Homo Sapiens
gucugugugguggagccagggccucucccuuuaguggagccagguugucgggccccgaauguca

SEQ ID NO: 531898 - RNA, 64 nt, Homo Sapiens
cuacgugccaggccccaugccuuauccacggagcuggagccaaccaauucgugacccacucagc

SEQ ID NO: 531899 - RNA, 64 nt, Homo Sapiens
ccuggguuucagagcagagcgcuggucuuagcaguggagccauguucugcuuuuucaaauucuu

SEQ ID NO: 531900 - RNA, 64 nt, Homo Sapiens
auugcgccacugcacuccagggcggagcuugcaguggagccaagagaauggugugaacccggga

SEQ ID NO: 531901 - RNA, 64 nt, Homo Sapiens
gcuuuguccuuuagccagcacucccagccucaguuggagccaaaguuugaaggcccagucuucu

SEQ ID NO: 531902 - RNA, 64 nt, Homo Sapiens
gugcuuagagacaggccacuaggccuuuccuuccuggagccacagccuuggucuaggucucucc

SEQ ID NO: 531903 - RNA, 64 nt, Homo Sapiens
cugcggggucuggguucaaaagcuguugagagcauggagccagguccaacuuuaguuucugcaa

SEQ ID NO: 531904 - RNA, 64 nt, Homo Sapiens
aagcucagugaaaggcuuccuccuuacccucagauggagccaggccaaggcucauacuguccug

SEQ ID NO: 531905 - RNA, 64 nt, Homo Sapiens
ucucuagaaauaaguagugaagaaaugguaaggguggagccaaacuaagcagcagacauccuga

SEQ ID NO: 531906 - RNA, 64 nt, Homo Sapiens
aauccuguucagucaacaagaaggccccauuuaguggagccagccucugaauauaugcaaaaag

SEQ ID NO: 531907 - RNA, 64 nt, Homo Sapiens
gaugacacaaggggaagggucaauaggggaagccuggagccaaagguaauacgugaaagcaaaa

SEQ ID NO: 531908 - RNA, 64 nt, Homo Sapiens
cauucagcaaccuugucuaaugaaucuuggcugcuggagccauuaguugcacuaaauuccucuc

SEQ ID NO: 531909 - RNA, 64 nt, Homo Sapiens
guuggauuggagaaguaauccuagggaagggugguggagccaguaaacagaggaguacagguga

SEQ ID NO: 531910 - RNA, 64 nt, Homo Sapiens
acacaaacaauaguaauucucaggccaucaucaguggagccauguuaauguaaucugauggcuu

SEQ ID NO: 531911 - RNA, 64 nt, Homo Sapiens
aagaguaacaagccaaaugaaaagaaccugcaacuggagccaagaccuacaacucauggaaggu

SEQ ID NO: 531912 - RNA, 64 nt, Homo Sapiens
uggcacaaauacucaugccauucaaacuugcauguggagccaugaaguaucaggguaguucugu

SEQ ID NO: 531913 - RNA, 64 nt, Homo Sapiens
cccaagugcagagucaaggcagggagaggccggcuggagccaggcccccucgcacgcagccccc

SEQ ID NO: 531914 - RNA, 64 nt, Homo Sapiens
gcuggaaccuuccaugggggucugggcuauuggcuggagccaggacaugagucaggggcaccau

SEQ ID NO: 531915 - RNA, 64 nt, Homo Sapiens
auuauuuccugucucagaaagaaugcuaaauauauggagccauuagcugugccuggcacacaau

SEQ ID NO: 531916 - RNA, 64 nt, Homo Sapiens
cugcuugggcucaaguccugagaggcauaggaucuggagccagagacucucuucccuuacuuuc

SEQ ID NO: 531917 - RNA, 64 nt, Homo Sapiens
cagagucgccuuaguccagaaccugacaggccucuggagccaggcgacuucuugggaaacuguc

SEQ ID NO: 531918 - RNA, 64 nt, Homo Sapiens
cguguaggaggaauacuucaggaugagugaaggcuggagccagggagcgcuggaggaaaccagc

SEQ ID NO: 531919 - RNA, 64 nt, Homo Sapiens
cccaggaguugcguguguuuguccuggguacagguggagccaccccccuggaguggcaggcccu

SEQ ID NO: 531920 - RNA, 64 nt, Homo Sapiens
cccacccuaggcaggaagacagcccaggacccacuggagccagcccugccacccccccugccug

SEQ ID NO: 531921 - RNA, 64 nt, Homo Sapiens
gacgcggccgccauggaccccaugggagacacccuggagccacuguccacgauccaguacaacg

SEQ ID NO: 531922 - RNA, 64 nt, Homo Sapiens
gccgcucucuccgcagguggaggcggaacgaggauggagccaucugcaggaagagcauaaagaa

SEQ ID NO: 531923 - RNA, 64 nt, Homo Sapiens; identical to SEQ ID NO: 58780

SEQ ID NO: 531924 - RNA, 64 nt, Homo Sapiens; identical to SEQ ID NO: 58781

SEQ ID NO: 531925 - RNA, 64 nt, Homo Sapiens; identical to SEQ ID NO: 58782

SEQ ID NO: 531926 - RNA, 54 nt, Homo Sapiens; identical to SEQ ID NO: 58783

SEQ ID NO: 531927 - RNA, 64 nt, Homo Sapiens; identical to SEQ ID NO: 58784

SEQ ID NO: 531928 - RNA, 64 nt, Homo Sapiens; identical to SEQ ID NO: 58785

SEQ ID NO: 531929 - RNA, 64 nt, Homo Sapiens; identical to SEQ ID NO: 58786

SEQ ID NO: 531930 - RNA, 64 nt, Homo Sapiens; identical to SEQ ID NO: 58787

SEQ ID NO: 531931 - RNA, 64 nt, Homo Sapiens; identical to SEQ ID NO: 58788

SEQ ID NO: 531932 - RNA, 64 nt, Homo Sapiens; identical to SEQ ID NO: 58788

SEQ ID NO: 531933 - RNA, 64 nt, Homo Sapiens; identical to SEQ ID NO: 58790

SEQ ID NO: 531934 - RNA, 64 nt, Homo Sapiens; identical to SEQ ID NO: 58791

SEQ ID NO: 531935 - RNA, 64 nt, Homo Sapiens; identical to SEQ ID NO: 58792

SEQ ID NO: 531936 - RNA, 64 nt, Homo Sapiens; identical to SEQ ID NO: 58793

SEQ ID NO: 531937 - RNA, 64 nt, Homo Sapiens; identical to SEQ ID NO: 58794

SEQ ID NO: 531938 - RNA, 64 nt, Homo Sapiens; identical to SEQ ID NO: 58795

SEQ ID NO: 531939 - RNA, 64 nt, Homo Sapiens; identical to SEQ ID NO: 58796

SEQ ID NO: 531940 - RNA, 64 nt, Homo Sapiens; identical to SEQ ID NO: 440913

SEQ ID NO: 531941 - RNA, 64 nt, Homo Sapiens; identical to SEQ ID NO: 440914

SEQ ID NO: 531942 - RNA, 64 nt, Homo Sapiens; identical to SEQ ID NO: 440915

SEQ ID NO: 531943 - RNA, 64 nt, Homo Sapiens; identical to SEQ ID NO: 440916

SEQ ID NO: 531944 - RNA, 64 nt, Homo Sapiens; identical to SEQ ID NO: 440917

SEQ ID NO: 531945 - RNA, 64 nt, Homo Sapiens; identical to SEQ ID NO: 440918

SEQ ID NO: 531946 - RNA, 64 nt, Homo Sapiens; identical to SEQ ID NO: 440919

SEQ ID NO: 531947 - RNA, 64 nt, Homo Sapiens; identical to SEQ ID NO: 440920

SEQ ID NO: 531948 - RNA, 64 nt, Homo Sapiens; identical to SEQ ID NO: 440921

SEQ ID NO: 531949 - RNA, 64 nt, Homo Sapiens; identical to SEQ ID NO: 440922

SEQ ID NO: 531950 - RNA, 64 nt, Homo Sapiens; identical to SEQ ID NO: 440923

SEQ ID NO: 531951 - RNA, 64 nt, Homo Sapiens; identical to SEQ ID NO: 440924

SEQ ID NO: 531952 - RNA, 64 nt, Homo Sapiens; identical to SEQ ID NO: 440925

SEQ ID NO: 531953 - RNA, 64 nt, Homo Sapiens; identical to SEQ ID NO: 440926

SEQ ID NO: 531954 - RNA, 64 nt, Homo Sapiens; identical to SEQ ID NO: 440927

SEQ ID NO: 531955 - RNA, 64 nt, Homo Sapiens; identical to SEQ ID NO: 440928

SEQ ID NO: 531956 - RNA, 64 nt, Homo Sapiens; identical to SEQ ID NO: 440929

SEQ ID NO: 531957 - RNA, 64 nt, Homo Sapiens; identical to SEQ ID NO: 440930

SEQ ID NO: 531958 - RNA, 64 nt, Homo Sapiens; identical to SEQ ID NO: 440931

SEQ ID NO: 531959 - RNA, 64 nt, Homo Sapiens; identical to SEQ ID NO: 440932

SEQ ID NO: 531960 - RNA, 64 nt, Homo Sapiens; identical to SEQ ID NO: 440933

SEQ ID NO: 531961 - RNA, 64 nt, Homo Sapiens; identical to SEQ ID NO: 440934

SEQ ID NO: 531962 - RNA, 64 nt, Homo Sapiens; identical to SEQ ID NO: 440935

SEQ ID NO: 531963 - RNA, 64 nt, Homo Sapiens; identical to SEQ ID NO: 440936

SEQ ID NO: 531964 - RNA, 64 nt, Homo Sapiens; identical to SEQ ID NO: 440937

SEQ ID NO: 531965 - RNA, 64 nt, Homo Sapiens; identical to SEQ ID NO: 440938

SEQ ID NO: 531966 - RNA, 64 nt, Homo Sapiens; identical to SEQ ID NO: 440939

SEQ ID NO: 531967 - RNA, 64 nt, Homo Sapiens; identical to SEQ ID NO: 440940

SEQ ID NO: 531968 - RNA, 64 nt, Homo Sapiens; identical to SEQ ID NO: 440941

SEQ ID NO: 531969 - RNA, 64 nt, Homo Sapiens; identical to SEQ ID NO: 440942

SEQ ID NO: 531970 - RNA, 64 nt, Homo Sapiens; identical to SEQ ID NO: 195045

SEQ ID NO: 531971 - RNA, 64 nt, Homo Sapiens; identical to SEQ ID NO: 195046

SEQ ID NO: 531972 - RNA, 64 nt, Homo Sapiens; identical to SEQ ID NO: 195047

SEQ ID NO: 531973 - RNA, 64 nt, Homo Sapiens; identical to SEQ ID NO: 195048

SEQ ID NO: 531974 - RNA, 64 nt, Homo Sapiens; identical to SEQ ID NO: 195049

SEQ ID NO: 531975 - RNA, 64 nt, Homo Sapiens; identical to SEQ ID NO: 195050

SEQ ID NO: 531976 - RNA, 64 nt, Homo Sapiens; identical to SEQ ID NO: 195051

SEQ ID NO: 531977 - RNA, 64 nt, Homo Sapiens; identical to SEQ ID NO: 195052

SEQ ID NO: 531978 - RNA, 64 nt, Homo Sapiens; identical to SEQ ID NO: 195053

SEQ ID NO: 531979 - RNA, 64 nt, Homo Sapiens; identical to SEQ ID NO: 195054

SEQ ID NO: 531980 - RNA, 64 nt, Homo Sapiens; identical to SEQ ID NO: 195055

SEQ ID NO: 531981 - RNA, 64 nt, Homo Sapiens; identical to SEQ ID NO: 195056

SEQ ID NO: 531982 - RNA, 64 nt, Homo Sapiens; identical to SEQ ID NO: 195057

SEQ ID NO: 531983 - RNA, 64 nt, Homo Sapiens; identical to SEQ ID NO: 195058

SEQ ID NO: 531984 - RNA, 64 nt, Homo Sapiens; identical to SEQ ID NO: 195059

SEQ ID NO: 531985 - RNA, 64 nt, Homo Sapiens; identical to SEQ ID NO: 195060

SEQ ID NO: 531986 - RNA, 64 nt, Homo Sapiens; identical to SEQ ID NO: 195061

SEQ ID NO: 531987 - RNA, 64 nt, Homo Sapiens; identical to SEQ ID NO: 195062

SEQ ID NO: 531988 - RNA, 64 nt, Homo Sapiens; identical to SEQ ID NO: 195063

SEQ ID NO: 531989 - RNA, 64 nt, Homo Sapiens; identical to SEQ ID NO: 195064

SEQ ID NO: 531990 - RNA, 64 nt, Homo Sapiens; identical to SEQ ID NO: 195065

SEQ ID NO: 531991 - RNA, 64 nt, Homo Sapiens; identical to SEQ ID NO: 195066

SEQ ID NO: 531992 - RNA, 64 nt, Homo Sapiens; identical to SEQ ID NO: 195067

SEQ ID NO: 531993 - RNA, 64 nt, Homo Sapiens; identical to SEQ ID NO: 195068

SEQ ID NO: 531994 - RNA, 64 nt, Homo Sapiens; identical to SEQ ID NO: 195069

SEQ ID NO: 531995 - RNA, 64 nt, Homo Sapiens; identical to SEQ ID NO: 195070

SEQ ID NO: 531996 - RNA, 64 nt, Homo Sapiens; identical to SEQ ID NO: 195071

SEQ ID NO: 531997 - RNA, 64 nt, Homo Sapiens; identical to SEQ ID NO: 195072

SEQ ID NO: 531998 - RNA, 64 nt, Homo Sapiens; identical to SEQ ID NO: 195073

SEQ ID NO: 531999 - RNA, 64 nt, Homo Sapiens; identical to SEQ ID NO: 195074

SEQ ID NO: 532000 - RNA, 64 nt, Homo Sapiens; identical to SEQ ID NO: 195075

SEQ ID NO: 532001 - RNA, 64 nt, Homo Sapiens; identical to SEQ ID NO: 195076

SEQ ID NO: 532002 - RNA, 64 nt, Homo Sapiens; identical to SEQ ID NO: 195077

SEQ ID NO: 532003 - RNA, 64 nt, Homo Sapiens; identical to SEQ ID NO: 195078

SEQ ID NO: 532004 - RNA, 64 nt, Homo Sapiens; identical to SEQ ID NO: 195079

SEQ ID NO: 532005 - RNA, 64 nt, Homo Sapiens; identical to SEQ ID NO: 195080

SEQ ID NO: 532006 - RNA, 64 nt, Homo Sapiens; identical to SEQ ID NO: 195081

SEQ ID NO: 532007 - RNA, 64 nt, Homo Sapiens; identical to SEQ ID NO: 195082

SEQ ID NO: 532008 - RNA, 64 nt, Homo Sapiens; identical to SEQ ID NO: 195083

SEQ ID NO: 532009 - RNA, 64 nt, Homo Sapiens; identical to SEQ ID NO: 195084

SEQ ID NO: 532010 - RNA, 64 nt, Homo Sapiens; identical to SEQ ID NO: 195085

SEQ ID NO: 532011 - RNA, 64 nt, Homo Sapiens; identical to SEQ ID NO: 195086

SEQ ID NO: 532012 - RNA, 64 nt, Homo Sapiens; identical to SEQ ID NO: 195087

SEQ ID NO: 532013 - RNA, 64 nt, Homo Sapiens; identical to SEQ ID NO: 195088

SEQ ID NO: 532014 - RNA, 64 nt, Homo Sapiens; identical to SEQ ID NO: 195089

SEQ ID NO: 532015 - RNA, 64 nt, Homo Sapiens; identical to SEQ ID NO: 195090

SEQ ID NO: 532016 - RNA, 64 nt, Homo Sapiens; identical to SEQ ID NO: 195091

SEQ ID NO: 532017 - RNA, 64 nt, Homo Sapiens; identical to SEQ ID NO: 195092

SEQ ID NO: 532018 - RNA, 64 nt, Homo Sapiens; identical to SEQ ID NO: 195093

SEQ ID NO: 532019 - RNA, 64 nt, Homo Sapiens; identical to SEQ ID NO: 153150

SEQ ID NO: 532020 - RNA, 64 nt, Homo Sapiens; identical to SEQ ID NO: 153151

SEQ ID NO: 532021 - RNA, 64 nt, Homo Sapiens; identical to SEQ ID NO: 153152

SEQ ID NO: 532022 - RNA, 64 nt, Homo Sapiens; identical to SEQ ID NO: 153153

SEQ ID NO: 532023 - RNA, 64 nt, Homo Sapiens; identical to SEQ ID NO: 153154

SEQ ID NO: 532024 - RNA, 64 nt, Homo Sapiens; identical to SEQ ID NO: 153155

SEQ ID NO: 532025 - RNA, 64 nt, Homo Sapiens; identical to SEQ ID NO: 153156

SEQ ID NO: 532026 - RNA, 64 nt, Homo Sapiens; identical to SEQ ID NO: 153157

SEQ ID NO: 532027 - RNA, 64 nt, Homo Sapiens; identical to SEQ ID NO: 153158

SEQ ID NO: 532028 - RNA, 64 nt, Homo Sapiens; identical to SEQ ID NO: 153159

SEQ ID NO: 532029 - RNA, 64 nt, Homo Sapiens; identical to SEQ ID NO: 153160

SEQ ID NO: 532030 - RNA, 64 nt, Homo Sapiens; identical to SEQ ID NO: 153161

SEQ ID NO: 532031 - RNA, 52 nt, Homo Sapiens; identical to SEQ ID NO: 153162

SEQ ID NO: 532032 - RNA, 64 nt, Homo Sapiens; identical to SEQ ID NO: 153163

SEQ ID NO: 532033 - RNA, 64 nt, Homo Sapiens; identical to SEQ ID NO: 81134

SEQ ID NO: 532034 - RNA, 64 nt, Homo Sapiens; identical to SEQ ID NO: 81135

SEQ ID NO: 532035 - RNA, 64 nt, Homo Sapiens; identical to SEQ ID NO: 81136

SEQ ID NO: 532036 - RNA, 64 nt, Homo Sapiens; identical to SEQ ID NO: 81137

SEQ ID NO: 532037 - RNA, 64 nt, Homo Sapiens; identical to SEQ ID NO: 81138

SEQ ID NO: 532038 - RNA, 64 nt, Homo Sapiens; identical to SEQ ID NO: 81139

SEQ ID NO: 532039 - RNA, 64 nt, Homo Sapiens; identical to SEQ ID NO: 81140

SEQ ID NO: 532040 - RNA, 64 nt, Homo Sapiens; identical to SEQ ID NO: 81141

SEQ ID NO: 532041 - RNA, 64 nt, Homo Sapiens; identical to SEQ ID NO: 81142

SEQ ID NO: 532042 - RNA, 64 nt, Homo Sapiens; identical to SEQ ID NO: 81143

SEQ ID NO: 532043 - RNA, 64 nt, Homo Sapiens; identical to SEQ ID NO: 81144

SEQ ID NO: 532044 - RNA, 64 nt, Homo Sapiens; identical to SEQ ID NO: 81145

SEQ ID NO: 532045 - RNA, 64 nt, Homo Sapiens; identical to SEQ ID NO: 81146

SEQ ID NO: 532046 - RNA, 64 nt, Homo Sapiens; identical to SEQ ID NO: 81147

SEQ ID NO: 532047 - RNA, 64 nt, Homo Sapiens; identical to SEQ ID NO: 81148

SEQ ID NO: 532048 - RNA, 64 nt, Homo Sapiens; identical to SEQ ID NO: 81149

SEQ ID NO: 532049 - RNA, 64 nt, Homo Sapiens; identical to SEQ ID NO: 81150

SEQ ID NO: 532050 - RNA, 64 nt, Homo Sapiens; identical to SEQ ID NO: 81151

SEQ ID NO: 532051 - RNA, 64 nt, Homo Sapiens; identical to SEQ ID NO: 81152

SEQ ID NO: 532052 - RNA, 64 nt, Homo Sapiens; identical to SEQ ID NO: 81153

SEQ ID NO: 532053 - RNA, 64 nt, Homo Sapiens; identical to SEQ ID NO: 81154

SEQ ID NO: 532054 - RNA, 64 nt, Homo Sapiens; identical to SEQ ID NO: 81155

SEQ ID NO: 532055 - RNA, 64 nt, Homo Sapiens; identical to SEQ ID NO: 81156

SEQ ID NO: 532056 - RNA, 64 nt, Homo Sapiens; identical to SEQ ID NO: 81157

SEQ ID NO: 532057 - RNA, 64 nt, Homo Sapiens; identical to SEQ ID NO: 81158

SEQ ID NO: 532058 - RNA, 64 nt, Homo Sapiens; identical to SEQ ID NO: 81159

SEQ ID NO: 532059 - RNA, 64 nt, Homo Sapiens; identical to SEQ ID NO: 81160

SEQ ID NO: 532060 - RNA, 64 nt, Homo Sapiens; identical to SEQ ID NO: 81161

SEQ ID NO: 532061 - RNA, 64 nt, Homo Sapiens; identical to SEQ ID NO: 81162

SEQ ID NO: 532062 - RNA, 64 nt, Homo Sapiens; identical to SEQ ID NO: 81163

SEQ ID NO: 532063 - RNA, 64 nt, Homo Sapiens; identical to SEQ ID NO: 81164

SEQ ID NO: 532064 - RNA, 64 nt, Homo Sapiens; identical to SEQ ID NO: 81165

SEQ ID NO: 532065 - RNA, 64 nt, Homo Sapiens; identical to SEQ ID NO: 81166

SEQ ID NO: 532066 - RNA, 64 nt, Homo Sapiens; identical to SEQ ID NO: 81167

SEQ ID NO: 532067 - RNA, 64 nt, Homo Sapiens; identical to SEQ ID NO: 81168

SEQ ID NO: 532068 - RNA, 64 nt, Homo Sapiens; identical to SEQ ID NO: 81169

SEQ ID NO: 532069 - RNA, 64 nt, Homo Sapiens; identical to SEQ ID NO: 81170

SEQ ID NO: 532070 - RNA, 64 nt, Homo Sapiens; identical to SEQ ID NO: 81171

SEQ ID NO: 532071 - RNA, 64 nt, Homo Sapiens; identical to SEQ ID NO: 81172

SEQ ID NO: 532072 - RNA, 64 nt, Homo Sapiens; identical to SEQ ID NO: 81173

SEQ ID NO: 532073 - RNA, 64 nt, Homo Sapiens
cugaaucuagccuaauucgcagugagguuccuucccugcaaauguggugaaaagcuuuucacua

SEQ ID NO: 532074 - RNA, 64 nt, Homo Sapiens
agacagguccuccaguacccagggaccaccucacccugcaaaagccccuccaucaagaucuuug

SEQ ID NO: 532075 - RNA, 64 nt, Homo Sapiens
acagauucauucguaaauauagggacaauagaaaccugcaaaacugaucuucacuccagucacu

SEQ ID NO: 532076 - RNA, 64 nt, Homo Sapiens
ggaaaacagcaucuccucacggaacugacagcaaccugcaaagagaaaagcagucaaguuccaa

SEQ ID NO: 532077 - RNA, 64 nt, Homo Sapiens
uuuccuuuaauaaaauuugccugcaaaccuuaaaccugcaaaauuuucaccuacaaaauuucac

SEQ ID NO: 532078 - RNA, 64 nt, Homo Sapiens
uuaaaccugcaaaauuuuccccuacaaaauuucaccugcaaaccgugaaaaguaaaccuuuuca

SEQ ID NO: 532079 - RNA, 64 nt, Homo Sapiens
cugccugcccacacagguucugcccguaaacacgccugcaaacgacacgccugcaaacgcugcc

SEQ ID NO: 532080 - RNA, 64 nt, Homo Sapiens
cugccugcccguaaacacgcugccgguaaacacgccugcaaacgacacgccugcaaacgcugcc

SEQ ID NO: 532081 - RNA, 64 nt, Homo Sapiens
cugccugccgguaaacacgcugcauguaaacacgccugcaaacggucucacauggugcuacgcc

SEQ ID NO: 532082 - RNA, 64 nt, Homo Sapiens
gaagcgcggacccuucuggguccagggaggggucccugcaaaacuccaggcaggacuucucacc

SEQ ID NO: 532083 - RNA, 64 nt, Homo Sapiens
accagaaagcuucauccacagccuugcagcggcuccugcaaaaggaggugaaaucccugccuca

SEQ ID NO: 532084 - RNA, 64 nt, Homo Sapiens
acacguggaggaaugcucccccauccuccccuucccugcaaacaugggguuggcugggcccaga

SEQ ID NO: 532085 - RNA, 64 nt, Homo Sapiens
ugaccuguggggauuucucccagcucuagacaacccugcaaaggacuguuuuuuccugagcuug

SEQ ID NO: 532086 - RNA, 64 nt, Homo Sapiens
gagcaagaaugccagaaauagccuucauuucuacccugcaaaauaauccagaucugcuuucuaa

SEQ ID NO: 532087 - RNA, 64 nt, Homo Sapiens
aaaauccuagaguugauucauuguuuuccuccauccugcaaaagaagaucccuuuguuaagcag

SEQ ID NO: 532088 - RNA, 64 nt, Homo Sapiens
ccauuuauggcuuguggugggggugcugcugaugccugcaaaaguggcaggggcaggcaacuuu

SEQ ID NO: 532089 - RNA, 64 nt, Homo Sapiens
cagugcucagccuucaguucaauauauuuucauuccugcaaacauuuugucuguucccuaagaa

SEQ ID NO: 532090 - RNA, 64 nt, Homo Sapiens; identical to SEQ ID NO: 413193

SEQ ID NO: 532091 - RNA, 64 nt, Homo Sapiens; identical to SEQ ID NO: 413194

SEQ ID NO: 532092 - RNA, 64 nt, Homo Sapiens; identical to SEQ ID NO: 413195

SEQ ID NO: 532093 - RNA, 64 nt, Homo Sapiens; identical to SEQ ID NO: 413196

SEQ ID NO: 532094 - RNA, 64 nt, Homo Sapiens; identical to SEQ ID NO: 413197

SEQ ID NO: 532095 - RNA, 64 nt, Homo Sapiens; identical to SEQ ID NO: 413198

SEQ ID NO: 532096 - RNA, 64 nt, Homo Sapiens; identical to SEQ ID NO: 413199

SEQ ID NO: 532097 - RNA, 64 nt, Homo Sapiens; identical to SEQ ID NO: 413200

SEQ ID NO: 532098 - RNA, 64 nt, Homo Sapiens; identical to SEQ ID NO: 413201

SEQ ID NO: 532099 - RNA, 64 nt, Homo Sapiens; identical to SEQ ID NO: 413202

SEQ ID NO: 532100 - RNA, 64 nt, Homo Sapiens; identical to SEQ ID NO: 413203

SEQ ID NO: 532101 - RNA, 64 nt, Homo Sapiens; identical to SEQ ID NO: 413204

SEQ ID NO: 532102 - RNA, 64 nt, Homo Sapiens; identical to SEQ ID NO: 413205

SEQ ID NO: 532103 - RNA, 64 nt, Homo Sapiens; identical to SEQ ID NO: 413206

SEQ ID NO: 532104 - RNA, 64 nt, Homo Sapiens; identical to SEQ ID NO: 413207

SEQ ID NO: 532105 - RNA, 64 nt, Homo Sapiens; identical to SEQ ID NO: 413208

SEQ ID NO: 532106 - RNA, 64 nt, Homo Sapiens; identical to SEQ ID NO: 413209

SEQ ID NO: 532107 - RNA, 64 nt, Homo Sapiens; identical to SEQ ID NO: 413210

SEQ ID NO: 532108 - RNA, 64 nt, Homo Sapiens; identical to SEQ ID NO: 413211

SEQ ID NO: 532109 - RNA, 64 nt, Homo Sapiens; identical to SEQ ID NO: 413212

SEQ ID NO: 532110 - RNA, 64 nt, Homo Sapiens; identical to SEQ ID NO: 413213

SEQ ID NO: 532111 - RNA, 64 nt, Homo Sapiens; identical to SEQ ID NO: 413214

SEQ ID NO: 532112 - RNA, 64 nt, Homo Sapiens; identical to SEQ ID NO: 413215

SEQ ID NO: 532113 - RNA, 64 nt, Homo Sapiens; identical to SEQ ID NO: 413216

SEQ ID NO: 532114 - RNA, 64 nt, Homo Sapiens
cucuacuaaaaauacaaaaaauuagccaggcauggugccgcauaacuauaaucccagcuacuug

SEQ ID NO: 532115 - RNA, 64 nt, Homo Sapiens
gcuuacauacagaggcccuucaggagggccuccugugccgcagggagggugcguggggaagaug

SEQ ID NO: 532116 - RNA, 64 nt, Homo Sapiens
acggagucucacucugucaccaggcuggagugcagugccgcaaucucggcucacugcaaccucc

SEQ ID NO: 532117 - RNA, 64 nt, Homo Sapiens
cgugucguguccuuuucucucuggcuaggcaggugugccgcaaauauuugacgaauagauggau

SEQ ID NO: 532118 - RNA, 64 nt, Homo Sapiens
cuugauucugacauuuggcccagccuguacuggugugccgcaaugagagucaaucucuauugac

SEQ ID NO: 532119 - RNA, 64 nt, Homo Sapiens
auugaacuguaccaugugcuugccucaggccucugugccgcaccgagggcagcgggagccuccc

SEQ ID NO: 532120 - RNA, 64 nt, Homo Sapiens
uagcuucugaucccuggguucugggagacugcaggugccgcacauugucaaguuagaaauacuc

SEQ ID NO: 532121 - RNA, 64 nt, Homo Sapiens
uggaucccaguguugccuuaacagggugucugucgugccgcaguagagcacugcugcuuccucc

SEQ ID NO: 532122 - RNA, 64 nt, Homo Sapiens
gugcccacgugcccacgccccgcggcuucccgccgugccgcagccuuggcgucugcccugcccu

SEQ ID NO: 532123 - RNA, 64 nt, Homo Sapiens
aaacauacgugugcauguguugcuauugugaauagugccgcaauuuggguugguuccaagucuu

SEQ ID NO: 532124 - RNA, 64 nt, Homo Sapiens
gauccacucuguccguggaggucgcugcguugcugugccgcagaagcugagggaccaggcuggg

SEQ ID NO: 532125 - RNA, 64 nt, Homo Sapiens
gaaucaaaugggcaauauuuguccugggagaccugugccgcacccagguccccguguuaacgug

SEQ ID NO: 532126 - RNA, 64 nt, Homo Sapiens
aggaacagcgggcccugagcagccccggaagcaagugccgcauucuucaggaaggaagagaccu

SEQ ID NO: 532127 - RNA, 64 nt, Homo Sapiens
agcccaggcagggugagcagucccagugguccuagugccgcaucagauccaggugggugagggc

SEQ ID NO: 532128 - RNA, 64 nt, Homo Sapiens
caguguaauuaucucugaaagagcaagucagcuugugccgcauccccaaccaauccacagccug

SEQ ID NO: 532129 - RNA, 64 nt, Homo Sapiens
agugggcggcgugugcuagcaaggccugccgggugugccgcagucaccacaggguucugagaac

SEQ ID NO: 532130 - RNA, 64 nt, Homo Sapiens
ggcccaucuuuuaugggaaguccucuaugccuuggugccgcaguccuguguaacuuguagcucu

SEQ ID NO: 532131 - RNA, 64 nt, Homo Sapiens
uacacauccuggccgugcacagacaugugugcucgugccgcacagucugguguuggcguguggg

SEQ ID NO: 532132 - RNA, 64 nt, Homo Sapiens
cuucuaccucccagcgagaccuggcccagaaagggugccgcagcaaggagugauaugguuuguc

SEQ ID NO: 532133 - RNA, 64 nt, Homo Sapiens
gaggccacguccacaaggagcuuuucaugccccugugccgcauagccucaccucuuuccuccag

SEQ ID NO: 532134 - RNA, 64 nt, Homo Sapiens
ucuagcauguuggucuccuugucuugaggcccuggugccgcacuucuucauguuccgaagugua

SEQ ID NO: 532135 - RNA, 64 nt, Homo Sapiens
cucaacauaggccaugugggccacgguguggacagugccgcaccccucgugccucugucccuca

SEQ ID NO: 532136 - RNA, 64 nt, Homo Sapiens
ucgaggccgauugugugccauuuggacgggugcugugccgcaugcgaaugaggcucaugggagg

SEQ ID NO: 532137 - RNA, 64 nt, Homo Sapiens
cacuaacgguaugugcucucccugguagggaggggugccgcagcgugcugaggcugcaucagac

SEQ ID NO: 532138 - RNA, 64 nt, Homo Sapiens
ucuauauucugcuucaaaucgccccuggucucccgugccgcaguccaggagagccccauuccca

SEQ ID NO: 532139 - RNA, 64 nt, Homo Sapiens
aacagacacaguauuuaauuuuuguuugagguucgugccgcagucccagaacacuuguauauug

SEQ ID NO: 532140 - RNA, 64 nt, Homo Sapiens
gugcauaggcugaaaugucuaguuaucaguacaagugccgcauauuaauaaaauugugauaauc

SEQ ID NO: 532141 - RNA, 64 nt, Homo Sapiens
guuauauaauuguugaacagguguuuuuccacaagugccgcaaauuguaccuuuuuuguuuuuu

SEQ ID NO: 532142 - RNA, 64 nt, Homo Sapiens
cacauuugugugggucucucauugucccuuaacagugccgcaucucagccuggaagucagcuuu

SEQ ID NO: 532143 - RNA, 64 nt, Homo Sapiens
ugucacgacuggaagggcgugaggccucccagcagugccgcagcguuucgaggggcgugugcug

SEQ ID NO: 532144 - RNA, 64 nt, Homo Sapiens
ccuguugacguaacuaagccuuacagcaaggcaugugccgcacgugcuccgugguacuuagagc

SEQ ID NO: 532145 - RNA, 64 nt, Homo Sapiens
cacugucucaccaucccgcaacgacccccacgaugugccgcaaguccccagccacaggccugcu

SEQ ID NO: 532146 - RNA, 64 nt, Homo Sapiens
ccuggaucagaccccaggaucugccuaggacccagugccgcaggcgucucaccaggcagacagu

SEQ ID NO: 532147 - RNA, 64 nt, Homo Sapiens
uuuuaucuuauaugccagaggcaccaggccagaugugccgcacagucauguaauucaaucaugu

SEQ ID NO: 532148 - RNA, 64 nt, Homo Sapiens
ucacccauggugucccugucgcucccuucccugggugccgcacguccagccuguguccaggccu

SEQ ID NO: 532149 - RNA, 64 nt, Homo Sapiens
gcaaggaugguggggcccccagcacccucuguuagugccgcaauaaaugcucaaucaugugcca

SEQ ID NO: 532150 - RNA, 64 nt, Homo Sapiens
ccuuagccucccaaguagcugggauuacaggugugugccgcaaugcccagcuaauuuuuguguu

SEQ ID NO: 532151 - RNA, 64 nt, Homo Sapiens
uucccucagagcauacucucacuccccucugcaagugccgcagcgcuccauuugguuccagccc

SEQ ID NO: 532152 - RNA, 64 nt, Homo Sapiens
acgcaaaauuuagaauucuaaggccacugguucugugccgcagccgggugguggcagagugaga

SEQ ID NO: 532153 - RNA, 64 nt, Homo Sapiens
ggggucaagcugagcuggcuguugaggugggguagugccgcaguaacuucuguaaggggcagca

SEQ ID NO: 532154 - RNA, 64 nt, Homo Sapiens
gcugggcgggagagacuguucgugucaaucccuugugccgcaggaacaucggauuuggggaacg

SEQ ID NO: 532155 - RNA, 64 nt, Homo Sapiens
gguugugaccccaacccaaggucaccccccaggggugccgcauacaggaggugcuuaauaaacg

SEQ ID NO: 532156 - RNA, 64 nt, Homo Sapiens
gaccccgacucacugccagccggggcggggcagggugccgcaggcugggcuugcuaauaaagac

SEQ ID NO: 532157 - RNA, 64 nt, Homo Sapiens
cacuuucucgcaguguuuuauuaaaauuccaggugugccgcaccuguuuuuauuucugacuuuu

SEQ ID NO: 532158 - RNA, 64 nt, Homo Sapiens
gauuuuguuuaugggcaguuacgagcaugucacagugccgcagagcaugggugucauagccauc

SEQ ID NO: 532159 - RNA, 64 nt, Homo Sapiens
ucacagcuaugcaaaaagcuggcugggaaaucgagugccgcauccaaugguaguuucugugguu

SEQ ID NO: 532160 - RNA, 64 nt, Homo Sapiens
ccaccagccugagcaagacgcccucucggggccugugccgcacuagccucccucuccucugucc

SEQ ID NO: 532161 - RNA, 64 nt, Homo Sapiens
cuggcgguggccacagcgugauucccccugcccugugccgcacucugcuagcaggcccccuagg

SEQ ID NO: 532162 - RNA, 64 nt, Homo Sapiens
cucuggggucuucuguccaggggcucucacccaggugccgcacccugccuuggugugcagucca

SEQ ID NO: 532163 - RNA, 64 nt, Homo Sapiens
uuacccugagcaugacugggacacagccgcgcccgugccgcagaaggauuuagaaaucuucaag

SEQ ID NO: 532164 - RNA, 51 nt, Homo Sapiens
caagaacuagaaauaaauaaggauggugauagagagguauaccuucauauu

SEQ ID NO: 532165 - RNA, 64 nt, Homo Sapiens
gcagaaaagaucucaagaaccagaaauaaauaaggauggugauagagagguauaccuuuauauu

SEQ ID NO: 532166 - RNA, 64 nt, Homo Sapiens
aauuuagaguugaccuccaguggaugguuucaaggauggugaggccuagggaagcccauccauc

SEQ ID NO: 532167 - RNA, 64 nt, Homo Sapiens
aguucucugggcagguggccgaagcuuaagagcagauggugacagcaggcagggcagggucugu

SEQ ID NO: 532168 - RNA, 64 nt, Homo Sapiens
aggaaacaauagauuauuuuauauuauuauuucugauggugacaaguuugucuugaggucacau

SEQ ID NO: 532169 - RNA, 64 nt, Homo Sapiens
gcauacugaaaaaggaaugccaccugccacaguugauggugaggaagcuccuuugacguggugc

SEQ ID NO: 532170 - RNA, 64 nt, Homo Sapiens
cauucuuuauggccagcagcccuugguuggugcagauggugauaggaccagugggucccacagc

SEQ ID NO: 532171 - RNA, 64 nt, Homo Sapiens
accacuggcacuuucagcaccagggggucugaaggauggugacugcgccauggccuggaucugc

SEQ ID NO: 532172 - RNA, 64 nt, Homo Sapiens
acaagguaagucauaaagaaggagauuuuauggagauggugagcacacauuuagaguaguccuu

SEQ ID NO: 532173 - RNA, 64 nt, Homo Sapiens
gccaucuuaaaacuuacuggcaacuuuucacaaagauggugaguuagacuucguuaguaauguu

SEQ ID NO: 532174 - RNA, 64 nt, Homo Sapiens
cccagcccagauucaucugugccuuggacauggugauggugauggguugccauccaagugaaag

SEQ ID NO: 532175 - RNA, 64 nt, Homo Sapiens
ggacggguauuucauggcuuggugcuguuuucuugauggugaauuauugcaagauacggucauu

SEQ ID NO: 532176 - RNA, 64 nt, Homo Sapiens
aacagacaagaaggagcgaaaguauauuuuauuugauggugauguggaugcucuauggguggaa

SEQ ID NO: 532177 - RNA, 64 nt, Homo Sapiens
cccuuccauucugcagauuccagacgguggcccagauggugagagucuggaggaaugagugucu

SEQ ID NO: 532178 - RNA, 64 nt, Homo Sapiens
aggggagaggagggagaccuaggagacgcguagggauggugaggagucacgcguagggauggug

SEQ ID NO: 532179 - RNA, 64 nt, Homo Sapiens
agacgcguagggauggugagcagucacgcguagggauggugaggcccauuuuuaucaggaaagu

SEQ ID NO: 532180 - RNA, 64 nt, Homo Sapiens
cugcaggagacucugaaguggaagaggucugcuugauggugacuuggcgacacggccucccgag

SEQ ID NO: 532181 - RNA, 64 nt, Homo Sapiens
ccagaagucaaggguuggggcccaggugacaggagauggugauaccaucggacagagacuggag

SEQ ID NO: 532182 - RNA, 64 nt, Homo Sapiens; identical to SEQ ID NO: 132737

SEQ ID NO: 532183 - RNA, 64 nt, Homo Sapiens; identical to SEQ ID NO: 132738

SEQ ID NO: 532184 - RNA, 64 nt, Homo Sapiens; identical to SEQ ID NO: 132739

SEQ ID NO: 532185 - RNA, 64 nt, Homo Sapiens; identical to SEQ ID NO: 132740

SEQ ID NO: 532186 - RNA, 64 nt, Homo Sapiens; identical to SEQ ID NO: 132741

SEQ ID NO: 532187 - RNA, 64 nt, Homo Sapiens; identical to SEQ ID NO: 132742

SEQ ID NO: 532188 - RNA, 64 nt, Homo Sapiens; identical to SEQ ID NO: 132743

SEQ ID NO: 532189 - RNA, 64 nt, Homo Sapiens; identical to SEQ ID NO: 132744

SEQ ID NO: 532190 - RNA, 64 nt, Homo Sapiens; identical to SEQ ID NO: 132745

SEQ ID NO: 532191 - RNA, 64 nt, Homo Sapiens; identical to SEQ ID NO: 132746

SEQ ID NO: 532192 - RNA, 64 nt, Homo Sapiens; identical to SEQ ID NO: 132747

SEQ ID NO: 532193 - RNA, 64 nt, Homo Sapiens; identical to SEQ ID NO: 132748

SEQ ID NO: 532194 - RNA, 64 nt, Homo Sapiens; identical to SEQ ID NO: 132749

SEQ ID NO: 532195 - RNA, 64 nt, Homo Sapiens; identical to SEQ ID NO: 132750

SEQ ID NO: 532196 - RNA, 64 nt, Homo Sapiens; identical to SEQ ID NO: 132751

SEQ ID NO: 532197 - RNA, 64 nt, Homo Sapiens; identical to SEQ ID NO: 132752

SEQ ID NO: 532198 - RNA, 64 nt, Homo Sapiens; identical to SEQ ID NO: 132753

SEQ ID NO: 532199 - RNA, 64 nt, Homo Sapiens; identical to SEQ ID NO: 132754

SEQ ID NO: 532200 - RNA, 64 nt, Homo Sapiens; identical to SEQ ID NO: 132755

SEQ ID NO: 532201 - RNA, 64 nt, Homo Sapiens; identical to SEQ ID NO: 132756

SEQ ID NO: 532202 - RNA, 64 nt, Homo Sapiens; identical to SEQ ID NO: 132757

SEQ ID NO: 532203 - RNA, 64 nt, Homo Sapiens; identical to SEQ ID NO: 132758

SEQ ID NO: 532204 - RNA, 64 nt, Homo Sapiens; identical to SEQ ID NO: 132759

SEQ ID NO: 532205 - RNA, 64 nt, Homo Sapiens; identical to SEQ ID NO: 132760

SEQ ID NO: 532206 - RNA, 64 nt, Homo Sapiens; identical to SEQ ID NO: 132761

SEQ ID NO: 532207 - RNA, 64 nt, Homo Sapiens; identical to SEQ ID NO: 132762

SEQ ID NO: 532208 - RNA, 64 nt, Homo Sapiens; identical to SEQ ID NO: 240322

SEQ ID NO: 532209 - RNA, 64 nt, Homo Sapiens; identical to SEQ ID NO: 240323

SEQ ID NO: 532210 - RNA, 64 nt, Homo Sapiens; identical to SEQ ID NO: 240324

SEQ ID NO: 532211 - RNA, 64 nt, Homo Sapiens; identical to SEQ ID NO: 240325

SEQ ID NO: 532212 - RNA, 64 nt, Homo Sapiens; identical to SEQ ID NO: 240326

SEQ ID NO: 532213 - RNA, 64 nt, Homo Sapiens; identical to SEQ ID NO: 240327

SEQ ID NO: 532214 - RNA, 64 nt, Homo Sapiens; identical to SEQ ID NO: 240328

SEQ ID NO: 532215 - RNA, 64 nt, Homo Sapiens; identical to SEQ ID NO: 240329

SEQ ID NO: 532216 - RNA, 64 nt, Homo Sapiens; identical to SEQ ID NO: 240330

SEQ ID NO: 532217 - RNA, 64 nt, Homo Sapiens; identical to SEQ ID NO: 240331

SEQ ID NO: 532218 - RNA, 64 nt, Homo Sapiens; identical to SEQ ID NO: 240332

SEQ ID NO: 532219 - RNA, 64 nt, Homo Sapiens; identical to SEQ ID NO: 240333

SEQ ID NO: 532220 - RNA, 64 nt, Homo Sapiens; identical to SEQ ID NO: 240334

SEQ ID NO: 532221 - RNA, 62 nt, Homo Sapiens
acuuaggaagcuuugccagugacuucacagagcugucagaaggcauuggaaaaagccacuug

SEQ ID NO: 532222 - RNA, 62 nt, Homo Sapiens
acuugggaagguuugccagcgacuuuacagagcugucagaagucucuggagauagcuaccug

SEQ ID NO: 532223 - RNA, 62 nt, Homo Sapiens
gugggagugauuuugcaacuguggauugagugcugucagaaaggauugagugcugucagaaa

SEQ ID NO: 532224 - RNA, 62 nt, Homo Sapiens
guggauugagugcugucagacuggauugagugcugucagaaacaagugagcaaggguuucuu

SEQ ID NO: 532225 - RNA, 62 nt, Homo Sapiens
ucuugcagauacuguguucagaggguggauggcugucagagcuguaaagugaaguaagauug

SEQ ID NO: 532226 - RNA, 62 nt, Homo Sapiens
agccccggggggcagcagguugcccugucaggcugucagacaacgggggcagcgugcagccc

SEQ ID NO: 532227 - RNA, 62 nt, Homo Sapiens
acugcccuucucucugccugccucaccuccagcugucagagggugagcagggcccuggaggc

SEQ ID NO: 532228 - RNA, 62 nt, Homo Sapiens
cccagcccagccugcucugcggcccccugcggcugucagagagcggugagaccuggagcgag

SEQ ID NO: 532229 - RNA, 62 nt, Homo Sapiens
augggacguuuuauuugugugcucucccuugacugucagauugaaguaagagcaguucucuc

SEQ ID NO: 532230 - RNA, 62 nt, Homo Sapiens
cagagcuuccauuaguguagaccuguagccaccugucagaagguggguggcauauuggggac

SEQ ID NO: 532231 - RNA, 62 nt, Homo Sapiens
gaggauuccuucaccacaguuucaccuuuacgcugucagacaacuuccugccacagaagaag

SEQ ID NO: 532232 - RNA, 62 nt, Homo Sapiens
ucuuccguguucucagagguucuuuucagugucugucagaacuuggcauacuuucuccauag

SEQ ID NO: 532233 - RNA, 62 nt, Homo Sapiens
uguuugauuuuagcguuucccgggucccggaacugucagacauggcccgaggggcuguggaa

SEQ ID NO: 532234 - RNA, 62 nt, Homo Sapiens
uggugacaagugccaaaggcggagcucagggccugucagacccaaaggucuugguucuccca

SEQ ID NO: 532235 - RNA, 64 nt, Homo Sapiens
ggcugccuuggaggguacaagauccacugaggguggccaccacagccuuggcuccaugguggcg

SEQ ID NO: 532236 - RNA, 64 nt, Homo Sapiens
gaagaauggagggaggagcaggcuaggaagacggggccaccacccucuccuugcuuucagcccu

SEQ ID NO: 532237 - RNA, 64 nt, Homo Sapiens
ugaccuggggcgcugcucccgggccuuccccagcggccaccaacagccugcucaccccacucca

SEQ ID NO: 532238 - RNA, 63 nt, Homo Sapiens
acugcugccacuucuuccagcagccucagccggggccaccagcagcgcuaccugcggaaauaa

SEQ ID NO: 532239 - RNA, 50 nt, Homo Sapiens
gccgcgaaggcuuccucuagggccaccaggcugaggacucgcccaggaca

SEQ ID NO: 532240 - RNA, 64 nt, Homo Sapiens
cgcccaggacauggacuggucucucagaccccugggccaccauguaggccaccacuccaggccg

SEQ ID NO: 532241 - RNA, 64 nt, Homo Sapiens
ggacuggucucucagaccccugggccaccauguaggccaccacuccaggccguggacuuccccc

SEQ ID NO: 532242 - RNA, 61 nt, Homo Sapiens
ucggggaggggugcuccugaaggccaggcauggccaccacgugacgcuguucuuaguucac

SEQ ID NO: 532243 - RNA, 64 nt, Homo Sapiens
cagcguuuaccacugcugucaagccacagcccuuggccaccauacgggccauccucagugaggc

SEQ ID NO: 532244 - RNA, 64 nt, Homo Sapiens
uuguaggaguguggguauuccagagcaagacuguggccaccaucuuccccucuugguguuuucc

SEQ ID NO: 532245 - RNA, 64 nt, Homo Sapiens
uuucuagggugagaguucccaauuuggauagaacggccaccauauugguuacugaaucucucuc

SEQ ID NO: 532246 - RNA, 64 nt, Homo Sapiens
ggauguuauuggcuaauccacugcaugguuugauggccaccaucucgguuggcccuuugggugu

SEQ ID NO: 532247 - RNA, 64 nt, Homo Sapiens
uuuuugguguacuuggcacaguaggugccaaguuggccaccauucuguguaacaccuuuuuugg

SEQ ID NO: 532248 - RNA, 64 nt, Homo Sapiens
uggacaucauacuggguaggugacaacgucagugggccaccaugugccaugauggcugcugcag

SEQ ID NO: 532249 - RNA, 64 nt, Homo Sapiens
cugcgugaauauccugaaauugaguccccuccccggccaccaucacugauucccucccgggugc

SEQ ID NO: 532250 - RNA, 64 nt, Homo Sapiens
ggggccgggggccacgggcugcccguccagcgugggccaccacugguccugggaauggcggcgg

SEQ ID NO: 532251 - RNA, 64 nt, Homo Sapiens
uucccucccuugacucugggcccccagccaacugggccaccagcugaggugacccugggccuug

SEQ ID NO: 532252 - RNA, 64 nt, Homo Sapiens
ccacaccuugcgguuugaaagcccggccuguccgggccaccauuccagcucugauuccuucaag

SEQ ID NO: 532253 - RNA, 64 nt, Homo Sapiens
ggauguagugcuuuuuagaggagccacugggcaaggccaccaagaacaaaugcaugacauuuua

SEQ ID NO: 532254 - RNA, 64 nt, Homo Sapiens
guuuggcauuuggggugacagggagugacccagaggccaccacugcuuuucaugcaggaguuac

SEQ ID NO: 532255 - RNA, 64 nt, Homo Sapiens
agcccaagauauccuuccugagaggcucccaaagggccaccaugccagcaucagcccuggggag

SEQ ID NO: 532256 - RNA, 64 nt, Homo Sapiens
gggcuccuacucccacccccgggcccuggaucccggccaccaggccagcagcaggcgcggcugg

SEQ ID NO: 532257 - RNA, 64 nt, Homo Sapiens; identical to SEQ ID NO: 385392

SEQ ID NO: 532258 - RNA, 64 nt, Homo Sapiens; identical to SEQ ID NO: 385393

SEQ ID NO: 532259 - RNA, 64 nt, Homo Sapiens; identical to SEQ ID NO: 385394

SEQ ID NO: 532260 - RNA, 64 nt, Homo Sapiens; identical to SEQ ID NO: 385395

SEQ ID NO: 532261 - RNA, 64 nt, Homo Sapiens; identical to SEQ ID NO: 385396

SEQ ID NO: 532262 - RNA, 64 nt, Homo Sapiens; identical to SEQ ID NO: 385397

SEQ ID NO: 532263 - RNA, 64 nt, Homo Sapiens; identical to SEQ ID NO: 385398

SEQ ID NO: 532264 - RNA, 64 nt, Homo Sapiens; identical to SEQ ID NO: 385399

SEQ ID NO: 532265 - RNA, 64 nt, Homo Sapiens; identical to SEQ ID NO: 385400

SEQ ID NO: 532266 - RNA, 64 nt, Homo Sapiens; identical to SEQ ID NO: 385401

SEQ ID NO: 532267 - RNA, 64 nt, Homo Sapiens; identical to SEQ ID NO: 385402

SEQ ID NO: 532268 - RNA, 64 nt, Homo Sapiens; identical to SEQ ID NO: 385403

SEQ ID NO: 532269 - RNA, 64 nt, Homo Sapiens; identical to SEQ ID NO: 385404

SEQ ID NO: 532270 - RNA, 64 nt, Homo Sapiens; identical to SEQ ID NO: 385405

SEQ ID NO: 532271 - RNA, 64 nt, Homo Sapiens; identical to SEQ ID NO: 385406

SEQ ID NO: 532272 - RNA, 64 nt, Homo Sapiens; identical to SEQ ID NO: 385407

SEQ ID NO: 532273 - RNA, 64 nt, Homo Sapiens; identical to SEQ ID NO: 385408

SEQ ID NO: 532274 - RNA, 64 nt, Homo Sapiens; identical to SEQ ID NO: 385409

SEQ ID NO: 532275 - RNA, 64 nt, Homo Sapiens; identical to SEQ ID NO: 385410

SEQ ID NO: 532276 - RNA, 64 nt, Homo Sapiens; identical to SEQ ID NO: 385411

SEQ ID NO: 532277 - RNA, 64 nt, Homo Sapiens; identical to SEQ ID NO: 385412

SEQ ID NO: 532278 - RNA, 64 nt, Homo Sapiens; identical to SEQ ID NO: 385413

SEQ ID NO: 532279 - RNA, 62 nt, Homo Sapiens; identical to SEQ ID NO: 385414

SEQ ID NO: 532280 - RNA, 64 nt, Homo Sapiens; identical to SEQ ID NO: 385415

SEQ ID NO: 532281 - RNA, 64 nt, Homo Sapiens; identical to SEQ ID NO: 385416

SEQ ID NO: 532282 - RNA, 64 nt, Homo Sapiens; identical to SEQ ID NO: 385417

SEQ ID NO: 532283 - RNA, 64 nt, Homo Sapiens; identical to SEQ ID NO: 385418

SEQ ID NO: 532284 - RNA, 64 nt, Homo Sapiens; identical to SEQ ID NO: 385419

SEQ ID NO: 532285 - RNA, 64 nt, Homo Sapiens; identical to SEQ ID NO: 385420

SEQ ID NO: 532286 - RNA, 64 nt, Homo Sapiens; identical to SEQ ID NO: 385421

SEQ ID NO: 532287 - RNA, 64 nt, Homo Sapiens; identical to SEQ ID NO: 385422

SEQ ID NO: 532288 - RNA, 64 nt, Homo Sapiens; identical to SEQ ID NO: 385423

SEQ ID NO: 532289 - RNA, 64 nt, Homo Sapiens; identical to SEQ ID NO: 385424

SEQ ID NO: 532290 - RNA, 64 nt, Homo Sapiens; identical to SEQ ID NO: 385425

SEQ ID NO: 532291 - RNA, 64 nt, Homo Sapiens; identical to SEQ ID NO: 120595

SEQ ID NO: 532292 - RNA, 64 nt, Homo Sapiens; identical to SEQ ID NO: 120596

SEQ ID NO: 532293 - RNA, 64 nt, Homo Sapiens; identical to SEQ ID NO: 120626

SEQ ID NO: 532294 - RNA, 64 nt, Homo Sapiens; identical to SEQ ID NO: 120627

SEQ ID NO: 532295 - RNA, 64 nt, Homo Sapiens; identical to SEQ ID NO: 120650

SEQ ID NO: 532296 - RNA, 64 nt, Homo Sapiens; identical to SEQ ID NO: 120651

SEQ ID NO: 532297 - RNA, 64 nt, Homo Sapiens; identical to SEQ ID NO: 120660

SEQ ID NO: 532298 - RNA, 64 nt, Homo Sapiens; identical to SEQ ID NO: 120661

SEQ ID NO: 532299 - RNA, 64 nt, Homo Sapiens; identical to SEQ ID NO: 120680

SEQ ID NO: 532300 - RNA, 64 nt, Homo Sapiens; identical to SEQ ID NO: 120681

SEQ ID NO: 532301 - RNA, 64 nt, Homo Sapiens; identical to SEQ ID NO: 120750

SEQ ID NO: 532302 - RNA, 64 nt, Homo Sapiens; identical to SEQ ID NO: 120751

SEQ ID NO: 532303 - RNA, 64 nt, Homo Sapiens; identical to SEQ ID NO: 120802

SEQ ID NO: 532304 - RNA, 64 nt, Homo Sapiens; identical to SEQ ID NO: 120803

SEQ ID NO: 532305 - RNA, 64 nt, Homo Sapiens
augucccagguccaggaaauccaauguuggugaaggcagccacucucuugcuuguccccaaauc

SEQ ID NO: 532306 - RNA, 64 nt, Homo Sapiens
gugguggggugggcucucccuuaggcuugggcaaggcagccaccugcccuugcucucccuuagu

SEQ ID NO: 532307 - RNA, 64 nt, Homo Sapiens
aagcaggcugaaaggcagaggguggggggugccuggcagccaugcaugccaguaccugccuggg

SEQ ID NO: 532308 - RNA, 64 nt, Homo Sapiens
ccaguaccugccugggggugcagucccucaggcuggcagccaugucugccaacuguggaaacuu

SEQ ID NO: 532309 - RNA, 64 nt, Homo Sapiens
aggccuggauggaggccuaguggguuacuucaagggcagccagccagggcuccccaaccugagu

SEQ ID NO: 532310 - RNA, 57 nt, Homo Sapiens; identical to SEQ ID NO: 83127

SEQ ID NO: 532311 - RNA, 64 nt, Homo Sapiens
gcagaauuguuugugggcaauuugggauuaauugggcagccaucugaaaggaggaucagaaugc

SEQ ID NO: 532312 - RNA, 64 nt, Homo Sapiens
cugcagcuucaaacgcucacuucgccgacacgauggcagccaaauggugccugaauucuuucuu

SEQ ID NO: 532313 - RNA, 64 nt, Homo Sapiens
cacuauggccccagugccuugaggcccaggccagggcagccaguggcucuagcucagggaaagc

SEQ ID NO: 532314 - RNA, 64 nt, Homo Sapiens
gaagccaugaggaccuggccuucugcccgacccaggcagccauucaaguugagcaauggccacu

SEQ ID NO: 532315 - RNA, 64 nt, Homo Sapiens
ggggaggcggccucuccccuuggcuguggacacuggcagccaauccgcccccucuccccuuccc

SEQ ID NO: 532316 - RNA, 64 nt, Homo Sapiens
ggccaggccguuguauccaugcagaugcuuccugggcagccacugaacuagagccccaaccaca

SEQ ID NO: 532317 - RNA, 64 nt, Homo Sapiens
gaagacugugcucgcuggguagguuucagacacuggcagccaaucuggccuaggcgaggguucc

SEQ ID NO: 532318 - RNA, 64 nt, Homo Sapiens
gcuuccuggaggcgaugcaggggcagccccucccggcagccagggcuguccucccaucuccugu

SEQ ID NO: 532319 - RNA, 59 nt, Homo Sapiens; identical to SEQ ID NO: 83136

SEQ ID NO: 532320 - RNA, 64 nt, Homo Sapiens
gcccucgaggcucgaugccugugccaaggccaggggcagccagagggcagcuggauggccacgu

SEQ ID NO: 532321 - RNA, 64 nt, Homo Sapiens
cggggagggcuaccuccucccagaugcaguauucggcagccagccacgugggugucacgugucc

SEQ ID NO: 532322 - RNA, 64 nt, Homo Sapiens
ggggcgugaugcagugugcaaagaggcagagggaggcagccagcugagugugcgucuguacggg

SEQ ID NO: 532323 - RNA, 64 nt, Homo Sapiens
ggacaggaagagucugugaucacaagccucagaaggcagccagacauucuucaucauggaaagc

SEQ ID NO: 532324 - RNA, 64 nt, Homo Sapiens
ggcauucaguuugugggcaucagccugucacaguggcagccacaucuguucguaggaugaugug

SEQ ID NO: 532325 - RNA, 64 nt, Homo Sapiens
aucugggccuuggccuggagucaucuggggagcaggcagccagcgagaggcagcccaggaaguc

SEQ ID NO: 532326 - RNA, 64 nt, Homo Sapiens
gcccugagccagggucuccaaccccccuuucacaggcagccaguuugugggccugggcuccugg

SEQ ID NO: 532327 - RNA, 64 nt, Homo Sapiens
aacccacaccaugaagacagcugacaguucuguuggcagccaagcccuuccuucuuaauaaagg

SEQ ID NO: 532328 - RNA, 64 nt, Homo Sapiens
caccuggucccuugugcugauauuuucucucucaggcagccagcaaacucuuuccacugugacu

SEQ ID NO: 532329 - RNA, 64 nt, Homo Sapiens
ggugggcccugagcccucagcagcacuucccccaggcagccagucccuuuccacaccagacugg

SEQ ID NO: 532330 - RNA, 64 nt, Homo Sapiens
guccccagagcugcuuguggccuggaguguguugggcagccagugaacugaugaagucaccugg

SEQ ID NO: 532331 - RNA, 64 nt, Homo Sapiens
uguggcguugugaggccaccagggccucucauguggcagccacacauacagacuggcacugggc

SEQ ID NO: 532332 - RNA, 64 nt, Homo Sapiens
gcacuuuaaccccugcauagcuuguuugcccucaggcagccaaaaggggaaaaaccccugcuca

SEQ ID NO: 532333 - RNA, 64 nt, Homo Sapiens
cucuggcucaggaggguugggucccugggaggccggcagccaggccacagaauccacacgugga

SEQ ID NO: 532334 - RNA, 64 nt, Homo Sapiens
ccacacguggaccauugugggucccugggaggccggcagccaggccacggaauccacacgugga

SEQ ID NO: 532335 - RNA, 64 nt, Homo Sapiens
cugcauucccacccagcgcgguguggcugugccgggcagccaucaauggccgccuggggagccu

SEQ ID NO: 532336 - RNA, 64 nt, Homo Sapiens
cagaggaggggcucuaccagcccucccacagccuggcagccauccagggucucgugcugcccuu

SEQ ID NO: 532337 - RNA, 64 nt, Homo Sapiens
augugcuugggcccaccaggugcccccacuccagggcagccauguucuguagcagccacccccc

SEQ ID NO: 532338 - RNA, 64 nt, Homo Sapiens
ccaaagacacuggugugcaucauaggugcccaacggcagccaaacccggggugggaccagaggu

SEQ ID NO: 532339 - RNA, 64 nt, Homo Sapiens; identical to SEQ ID NO: 497550

SEQ ID NO: 532340 - RNA, 64 nt, Homo Sapiens; identical to SEQ ID NO: 497551

SEQ ID NO: 532341 - RNA, 64 nt, Homo Sapiens; identical to SEQ ID NO: 497552

SEQ ID NO: 532342 - RNA, 64 nt, Homo Sapiens; identical to SEQ ID NO: 497553

SEQ ID NO: 532343 - RNA, 64 nt, Homo Sapiens; identical to SEQ ID NO: 497554

SEQ ID NO: 532344 - RNA, 64 nt, Homo Sapiens; identical to SEQ ID NO: 497555

SEQ ID NO: 532345 - RNA, 64 nt, Homo Sapiens; identical to SEQ ID NO: 497556

SEQ ID NO: 532346 - RNA, 64 nt, Homo Sapiens; identical to SEQ ID NO: 497557

SEQ ID NO: 532347 - RNA, 64 nt, Homo Sapiens; identical to SEQ ID NO: 497558

SEQ ID NO: 532348 - RNA, 64 nt, Homo Sapiens; identical to SEQ ID NO: 497559

SEQ ID NO: 532349 - RNA, 64 nt, Homo Sapiens; identical to SEQ ID NO: 497560

SEQ ID NO: 532350 - RNA, 64 nt, Homo Sapiens; identical to SEQ ID NO: 497561

SEQ ID NO: 532351 - RNA, 64 nt, Homo Sapiens; identical to SEQ ID NO: 497562

SEQ ID NO: 532352 - RNA, 64 nt, Homo Sapiens; identical to SEQ ID NO: 497563

SEQ ID NO: 532353 - RNA, 64 nt, Homo Sapiens; identical to SEQ ID NO: 497564

SEQ ID NO: 532354 - RNA, 64 nt, Homo Sapiens; identical to SEQ ID NO: 497565

SEQ ID NO: 532355 - RNA, 64 nt, Homo Sapiens; identical to SEQ ID NO: 497566

SEQ ID NO: 532356 - RNA, 64 nt, Homo Sapiens; identical to SEQ ID NO: 497567

SEQ ID NO: 532357 - RNA, 64 nt, Homo Sapiens; identical to SEQ ID NO: 497568

SEQ ID NO: 532358 - RNA, 64 nt, Homo Sapiens; identical to SEQ ID NO: 497569

SEQ ID NO: 532359 - RNA, 64 nt, Homo Sapiens; identical to SEQ ID NO: 497570

SEQ ID NO: 532360 - RNA, 64 nt, Homo Sapiens; identical to SEQ ID NO: 497571

SEQ ID NO: 532361 - RNA, 64 nt, Homo Sapiens; identical to SEQ ID NO: 497572

SEQ ID NO: 532362 - RNA, 64 nt, Homo Sapiens; identical to SEQ ID NO: 497573

SEQ ID NO: 532363 - RNA, 64 nt, Homo Sapiens; identical to SEQ ID NO: 497574

SEQ ID NO: 532364 - RNA, 64 nt, Homo Sapiens
agccaacauggggacccagcugcucagaaucugguauguggaaguaagagaauuauuaguaauu

SEQ ID NO: 532365 - RNA, 64 nt, Homo Sapiens
uuuugcauauaauauaaaugcacaaaugguaaauuauguggaucuguucgaauagugaaacaua

SEQ ID NO: 532366 - RNA, 64 nt, Homo Sapiens
uggauauucauggcaguuuuucuuuuuuguacauuauguggauauuuggaauaauaucagucuu

SEQ ID NO: 532367 - RNA, 64 nt, Homo Sapiens
auuaauacuguguuauaauacauauggccuuacuuauguggaaggguguucucuuucuuguuug

SEQ ID NO: 532368 - RNA, 64 nt, Homo Sapiens
acaaagauagauagauagcacugugagaauuuuauauguggauacuuuuaaguugccuugcugg

SEQ ID NO: 532369 - RNA, 64 nt, Homo Sapiens
auauuagaaacuacagaguuauauuagaaacuucuauguggaaacuguugguacuauguggaaa

SEQ ID NO: 532370 - RNA, 64 nt, Homo Sapiens
auauuagaaacuucuauguggcagcuguugguacuauguggaaaaucuuucauaucuuggauuu

SEQ ID NO: 532371 - RNA, 64 nt, Homo Sapiens
accaauuuaaaaauauauguuuuuguguauaucuuauguggauuacaauguagucacuugaagg

SEQ ID NO: 532372 - RNA, 64 nt, Homo Sapiens
aauuaaauauaaaggaauugcccuucaaagaugauauguggaggcuugugauuuauuagucagg

SEQ ID NO: 532373 - RNA, 64 nt, Homo Sapiens
gauuuguguguauguguaugucaauucaugacauuauguggaauccuaaaccuuugguggcugg

SEQ ID NO: 532374 - RNA, 64 nt, Homo Sapiens
caauuauauuauguuuaauuauuuaagauuucuuuauguggaacaucuauagagauaaauagaa

SEQ ID NO: 532375 - RNA, 64 nt, Homo Sapiens
uggcaucaauuuuauacagggauauaaaaaaguauauguggauaaauuuuuuguaaucuuuagg

SEQ ID NO: 532376 - RNA, 64 nt, Homo Sapiens
aauuuuuuguaaucuuuagggauauaaaaaaguguauguggauaaauuuuuuguaaucuuuauu

SEQ ID NO: 532377 - RNA, 64 nt, Homo Sapiens
acccucacuuucucuucacgaagaaaucccggauuauguggaaagaaagucuuugggcauugcc

SEQ ID NO: 532378 - RNA, 64 nt, Homo Sapiens
agaguucuuuguauaacaucuugccacggaauccuauguggagcaaagcagcaaaauaguacuc

SEQ ID NO: 532379 - RNA, 64 nt, Homo Sapiens
auauuccacauguguauauaauuccacauguguguauguggaauuauguggaauauauacauau

SEQ ID NO: 532380 - RNA, 64 nt, Homo Sapiens
auauacauauauuccacaugauuccacauguguguauguggaauaguuccauauauauacauau

SEQ ID NO: 532381 - RNA, 64 nt, Homo Sapiens; identical to SEQ ID NO: 312464

SEQ ID NO: 532382 - RNA, 64 nt, Homo Sapiens; identical to SEQ ID NO: 312465

SEQ ID NO: 532383 - RNA, 64 nt, Homo Sapiens; identical to SEQ ID NO: 312466

SEQ ID NO: 532384 - RNA, 64 nt, Homo Sapiens; identical to SEQ ID NO: 312467

SEQ ID NO: 532385 - RNA, 64 nt, Homo Sapiens; identical to SEQ ID NO: 312468

SEQ ID NO: 532386 - RNA, 64 nt, Homo Sapiens; identical to SEQ ID NO: 312469

SEQ ID NO: 532387 - RNA, 64 nt, Homo Sapiens; identical to SEQ ID NO: 312470

SEQ ID NO: 532388 - RNA, 64 nt, Homo Sapiens; identical to SEQ ID NO: 312471

SEQ ID NO: 532389 - RNA, 64 nt, Homo Sapiens; identical to SEQ ID NO: 312472

SEQ ID NO: 532390 - RNA, 64 nt, Homo Sapiens; identical to SEQ ID NO: 312473

SEQ ID NO: 532391 - RNA, 64 nt, Homo Sapiens; identical to SEQ ID NO: 312474

SEQ ID NO: 532392 - RNA, 64 nt, Homo Sapiens; identical to SEQ ID NO: 312475

SEQ ID NO: 532393 - RNA, 64 nt, Homo Sapiens; identical to SEQ ID NO: 312476

SEQ ID NO: 532394 - RNA, 64 nt, Homo Sapiens; identical to SEQ ID NO: 312477

SEQ ID NO: 532395 - RNA, 64 nt, Homo Sapiens; identical to SEQ ID NO: 312478

SEQ ID NO: 532396 - RNA, 64 nt, Homo Sapiens; identical to SEQ ID NO: 312479

SEQ ID NO: 532397 - RNA, 64 nt, Homo Sapiens; identical to SEQ ID NO: 312480

SEQ ID NO: 532398 - RNA, 64 nt, Homo Sapiens; identical to SEQ ID NO: 312481

SEQ ID NO: 532399 - RNA, 64 nt, Homo Sapiens; identical to SEQ ID NO: 312482

SEQ ID NO: 532400 - RNA, 64 nt, Homo Sapiens; identical to SEQ ID NO: 312483

SEQ ID NO: 532401 - RNA, 64 nt, Homo Sapiens; identical to SEQ ID NO: 312484

SEQ ID NO: 532402 - RNA, 64 nt, Homo Sapiens; identical to SEQ ID NO: 312485

SEQ ID NO: 532403 - RNA, 64 nt, Homo Sapiens; identical to SEQ ID NO: 312486

SEQ ID NO: 532404 - RNA, 64 nt, Homo Sapiens; identical to SEQ ID NO: 312487

SEQ ID NO: 532405 - RNA, 64 nt, Homo Sapiens; identical to SEQ ID NO: 312488

SEQ ID NO: 532406 - RNA, 64 nt, Homo Sapiens; identical to SEQ ID NO: 312489

SEQ ID NO: 532407 - RNA, 64 nt, Homo Sapiens; identical to SEQ ID NO: 312490

SEQ ID NO: 532408 - RNA, 64 nt, Homo Sapiens; identical to SEQ ID NO: 312491

SEQ ID NO: 532409 - RNA, 64 nt, Homo Sapiens; identical to SEQ ID NO: 312492

SEQ ID NO: 532410 - RNA, 64 nt, Homo Sapiens; identical to SEQ ID NO: 312493

SEQ ID NO: 532411 - RNA, 64 nt, Homo Sapiens; identical to SEQ ID NO: 312494

SEQ ID NO: 532412 - RNA, 64 nt, Homo Sapiens; identical to SEQ ID NO: 312495

SEQ ID NO: 532413 - RNA, 64 nt, Homo Sapiens; identical to SEQ ID NO: 312496

SEQ ID NO: 532414 - RNA, 64 nt, Homo Sapiens; identical to SEQ ID NO: 312497

SEQ ID NO: 532415 - RNA, 64 nt, Homo Sapiens; identical to SEQ ID NO: 312498

SEQ ID NO: 532416 - RNA, 64 nt, Homo Sapiens; identical to SEQ ID NO: 312499

SEQ ID NO: 532417 - RNA, 64 nt, Homo Sapiens; identical to SEQ ID NO: 312500

SEQ ID NO: 532418 - RNA, 64 nt, Homo Sapiens; identical to SEQ ID NO: 312501

SEQ ID NO: 532419 - RNA, 64 nt, Homo Sapiens; identical to SEQ ID NO: 312502

SEQ ID NO: 532420 - RNA, 64 nt, Homo Sapiens; identical to SEQ ID NO: 312503

SEQ ID NO: 532421 - RNA, 64 nt, Homo Sapiens; identical to SEQ ID NO: 312504

SEQ ID NO: 532422 - RNA, 64 nt, Homo Sapiens; identical to SEQ ID NO: 312505

SEQ ID NO: 532423 - RNA, 64 nt, Homo Sapiens; identical to SEQ ID NO: 312506

SEQ ID NO: 532424 - RNA, 64 nt, Homo Sapiens; identical to SEQ ID NO: 312507

SEQ ID NO: 532425 - RNA, 64 nt, Homo Sapiens; identical to SEQ ID NO: 312508

SEQ ID NO: 532426 - RNA, 64 nt, Homo Sapiens; identical to SEQ ID NO: 312509

SEQ ID NO: 532427 - RNA, 64 nt, Homo Sapiens; identical to SEQ ID NO: 312510

SEQ ID NO: 532428 - RNA, 64 nt, Homo Sapiens; identical to SEQ ID NO: 312511

SEQ ID NO: 532429 - RNA, 64 nt, Homo Sapiens; identical to SEQ ID NO: 312512

SEQ ID NO: 532430 - RNA, 64 nt, Homo Sapiens
cuuggugacagggacgcauucugauaaaugugucauuaggcaauugcauuguagugugauuauc

SEQ ID NO: 532431 - RNA, 64 nt, Homo Sapiens
aaaugcauauuaaaacauuuucuuccuucaguauauuaggcaauaggaauuuuucaaguccacu

SEQ ID NO: 532432 - RNA, 64 nt, Homo Sapiens
ccggaaagcuuucuguuuuugacacgauggccagaucauggacuguacccuuagugguagccau

SEQ ID NO: 532433 - RNA, 64 nt, Homo Sapiens
ucuggagaguuucuguggauagugcuuccuugagaucauggaaucccuuccugcucuaacgucc

SEQ ID NO: 532434 - RNA, 64 nt, Homo Sapiens
ggggugggcuaugaaagccgucaccugccuccucaucauggaaggugguggcuguuccucccug

SEQ ID NO: 532435 - RNA, 64 nt, Homo Sapiens
caauucagaaguaaagaagauacuaacguauuucaucauggaagguccuguggugaugguuuuc

SEQ ID NO: 532436 - RNA, 64 nt, Homo Sapiens
guaugaagauauguguaaaauguuuuuacuauggaucauggauuuaagaaacuugaaaagcugg

SEQ ID NO: 532437 - RNA, 64 nt, Homo Sapiens
uuaaaaauauuuuacugcagaaacucauucagaaaucauggauuaaaguuauaaauaaagagaa

SEQ ID NO: 532438 - RNA, 64 nt, Homo Sapiens
acucacugcugagauaguaaauccuucuucauaaaucauggaaaaucccagauguguucugaau

SEQ ID NO: 532439 - RNA, 64 nt, Homo Sapiens
acucccuuccccucucugguccucagcuuccuccaucauggaggagaugggaucauggauuuuc

SEQ ID NO: 532440 - RNA, 64 nt, Homo Sapiens
gguccucagcuuccuccaucauggaggagaugggaucauggauuuucugggcauaaguggcugu

SEQ ID NO: 532441 - RNA, 64 nt, Homo Sapiens
uaauguacuguaacuuuaucuaauguaaccuauuaucauggaucguagggcucugcaaauaaaa

SEQ ID NO: 532442 - RNA, 64 nt, Homo Sapiens
auuguuauuagcuuuguggcaaguagguuaagugaucauggaucaaaaccaaacacucauuuaa

SEQ ID NO: 532443 - RNA, 64 nt, Homo Sapiens
gugacuuccuuucccacccaugccgcuuagacuuagcugucaguacucacccaacucuaaauug

SEQ ID NO: 532444 - RNA, 64 nt, Homo Sapiens
ucagcaaauauguagucaaggaaagugaucaccgagcugucacagcucagagucuuguucaaga

SEQ ID NO: 532445 - RNA, 64 nt, Homo Sapiens
uuggagauugguaauggcuugguuucaggaucaaagcugucauguguucucaguaucagcccau

SEQ ID NO: 532446 - RNA, 64 nt, Homo Sapiens
uauuuuguaaauuuuuaccuuaucaaaaauaaaaagcugucacagccuguauaugauguaacug

SEQ ID NO: 532447 - RNA, 64 nt, Homo Sapiens
agacuuaggaagcuuugccacuuggacuucacagagcugucagagccagcauuggaaaaagcca

SEQ ID NO: 532448 - RNA, 64 nt, Homo Sapiens
agacuugggaagguuugccaccuggacuuuacagagcugucagacuacucucuggagauagcua

SEQ ID NO: 532449 - RNA, 64 nt, Homo Sapiens
cccacauacagaaucauuucagcacuuucucaagagcugucaguuucuauaaccuuguuuguau

SEQ ID NO: 532450 - RNA, 64 nt, Homo Sapiens
guauguuacaagguuuucaguaagaaacccauccagcugucaugaauuacauugugcaaugcau

SEQ ID NO: 532451 - RNA, 64 nt, Homo Sapiens
ccugucagucucaugacaguucuagaaaucuuucagcugucaggaaaaaagucaugggaccacu

SEQ ID NO: 532452 - RNA, 64 nt, Homo Sapiens
ucccccaggagaucaggauucaaguuguuucuccagcugucaccggcccagagaugcuuaaauc

SEQ ID NO: 532453 - RNA, 64 nt, Homo Sapiens
caguuacucuuaauucuuuauacaugagaaauucagcugucauuccuaggaggcagucaauaaa

SEQ ID NO: 532454 - RNA, 64 nt, Homo Sapiens
gggcaauuucuuuauuuauaugcuuccaaacuguagcugucacagcugaaaagagaaaugauaa

SEQ ID NO: 532455 - RNA, 64 nt, Homo Sapiens
ccaccaggccacggccgccugcuguacauagugaagcugucacucgccggggcacggggcgucg

SEQ ID NO: 532456 - RNA, 64 nt, Homo Sapiens
ucucuggacuccaguuuuggccccucucacacagagcugucagcaggggccgcuguggcggugc

SEQ ID NO: 532457 - RNA, 64 nt, Homo Sapiens
ccgcugcaggguaaaugggauuccuugccacccaagcugucagaacugccacugagcuaaagau

SEQ ID NO: 532458 - RNA, 64 nt, Homo Sapiens
ucaaacaccaagcacucucagccuccccgccuucagcugucagcuuucuggggcuaacuucucu

SEQ ID NO: 532459 - RNA, 64 nt, Homo Sapiens
uucucuuauuuauuccccagcccugggaaauaggagcugucauuauccuucucuuucugcacaa

SEQ ID NO: 532460 - RNA, 64 nt, Homo Sapiens
auuuuagaugagcccagguaagaccucucugaagagcugucaugaaggagggagggagcacauu

SEQ ID NO: 532461 - RNA, 64 nt, Homo Sapiens
gcccagcccaucucagccaacccuccuuagacugagcugucagagcaagcaauuaggggccagc

SEQ ID NO: 532462 - RNA, 64 nt, Homo Sapiens
aauccuuagagucugaauuccuuuagcugggaacagcugucauggucaccccuggauaacauuu

SEQ ID NO: 532463 - RNA, 64 nt, Homo Sapiens
uuccucuuugguuucuucagagcuuucccaagagagcugucaguuuucagcugucaguaacaca

SEQ ID NO: 532464 - RNA, 64 nt, Homo Sapiens
cuucagagcuuucccaagagagcugucaguuuucagcugucaguaacacaaaugaguuuauggu

SEQ ID NO: 532465 - RNA, 63 nt, Homo Sapiens
uggcaaaaaaaaaaacccacuguuaccaguguaggaaguuacaagaaggcacauacugaaugc

SEQ ID NO: 532466 - RNA, 63 nt, Homo Sapiens
uauaugagccaaaccacauaccuuaaugauuugggaaguuaggcaaauaugagauauguagac

SEQ ID NO: 532467 - RNA, 63 nt, Homo Sapiens
ugaauuuauuuuuaagaaagaaauacuguauugggaaguuacuguuacuugauaacaauguuu

SEQ ID NO: 532468 - RNA, 63 nt, Homo Sapiens
acaauaaagcaauaagaacaaauacaauacauaggaaguuaaaagcacaaaggaaugaacuua

SEQ ID NO: 532469 - RNA, 63 nt, Homo Sapiens
uuccccagacagcuaaugccaaaacccacuguaggaaguuagccaguggugauuaacucaacu

SEQ ID NO: 532470 - RNA, 63 nt, Homo Sapiens
aucagaaagaagaagcaagcccgucuccugagaggaaguuaggcucugagggugcaggcuaga

SEQ ID NO: 532471 - RNA, 63 nt, Homo Sapiens
uuagagauaacauacauucccuuugguaucacaggaaguuacuggggauuacucgaccucauu

SEQ ID NO: 532472 - RNA, 63 nt, Homo Sapiens
uuagagcuguauaacuauaguuugaacuagcaaggaaguuauuguuuugacaaccagaaauua

SEQ ID NO: 532473 - RNA, 63 nt, Homo Sapiens
ggagcuuccccauccucccugccuuccccagugggaaguuagggaagcucaggagccugggac

SEQ ID NO: 532474 - RNA, 63 nt, Homo Sapiens
caccugagaaaguugucauuugaggucgcacuuggaaguuacaucugugaaguuucugucauu

SEQ ID NO: 532475 - RNA, 63 nt, Homo Sapiens
auuuucuuuaugaaaauaaaccaguucuuccaaggaaguuaaaaggcuugguauggauguugg

SEQ ID NO: 532476 - RNA, 63 nt, Homo Sapiens
uucuacuucuggauccaaauguuaccucuuaggggaaguuaugcccccucaacuauugucuua

SEQ ID NO: 532477 - RNA, 64 nt, Homo Sapiens
cagcuuucuuucccaggggugaaggauggcgcucgggggugacuccuaagcucagcguggaagc

SEQ ID NO: 532478 - RNA, 64 nt, Homo Sapiens
guuuuuaacuuguuccucugucuacuguguguuugggggugacaucuaaauuccauuucuucuu

SEQ ID NO: 532479 - RNA, 64 nt, Homo Sapiens
aaacccuugcauuccaaaggaauuauauaugucugggggugaaauguuuuuuguuuuuuaacag

SEQ ID NO: 532480 - RNA, 64 nt, Homo Sapiens
ugggcccuaggcagacugcaggcacgggaguggggggggugacagccaucucgcccuugcuggg

SEQ ID NO: 532481 - RNA, 64 nt, Homo Sapiens
gaacgccagagcccuggcuggugaugugcuggcugggggugaaucccaaugagggucccucuca

SEQ ID NO: 532482 - RNA, 64 nt, Homo Sapiens
gaacgccagagcccuggauggugaugcgcuggcugggggugaaucccaaugagggucccucuca

SEQ ID NO: 532483 - RNA, 64 nt, Homo Sapiens
gaacgccagagcccuggcuggugacaugcuggcugggggugaauccgaaugacagugcagacgu

SEQ ID NO: 532484 - RNA, 64 nt, Homo Sapiens
ccaggacacaggaauagguuggacagguucuguugggggugacaggggugacaccaggagagag

SEQ ID NO: 532485 - RNA, 64 nt, Homo Sapiens
ccaggagagagggacagguuggacagguucugucgggggugacaggggugacaagaggagacag

SEQ ID NO: 532486 - RNA, 64 nt, Homo Sapiens
agaggagacagggacagguuggacagguucuguugggggugacaugggugacaccaggagagag

SEQ ID NO: 532487 - RNA, 64 nt, Homo Sapiens
ccaggacacagggacagguuggacagguucugucgggggugacaggggugacaccaggacacag

SEQ ID NO: 532488 - RNA, 64 nt, Homo Sapiens
ccgggcugucucgugguggcagucugcuuucugugggggugagggucuuuuuuuuuuuuuuugg

SEQ ID NO: 532489 - RNA, 64 nt, Homo Sapiens
gugugugacagucuacuggaguuucucuaaguuggggggugagcagaccaugguguuucucuau

SEQ ID NO: 532490 - RNA, 64 nt, Homo Sapiens
guaggugcuuuuuucuuauguacggggugggggcgggggugagguugacugcauuaacuuaacu

SEQ ID NO: 532491 - RNA, 64 nt, Homo Sapiens
uuuggcagcccgagacccagugucggggcuuggugggggugacugccggacguccuacucaggc

SEQ ID NO: 532492 - RNA, 64 nt, Homo Sapiens
gggugcacaccugcccaggucaccauaauccagugggggugacuacacccucucaugcuaccag

SEQ ID NO: 532493 - RNA, 64 nt, Homo Sapiens
ccugcugugagaguucaggcaagcauacaggcuugggggugagcguccaaagagagucagagcu

SEQ ID NO: 532494 - RNA, 64 nt, Homo Sapiens
cuucuuccuccccucaacagugaguuagacucaagggggugacagaaccgagaagggggugaca

SEQ ID NO: 532495 - RNA, 64 nt, Homo Sapiens
ugaguuagacucaagggggugacagaaccgagaagggggugacaguccuccauccacguggccu

SEQ ID NO: 532496 - RNA, 64 nt, Homo Sapiens
ucuggugcucacagccgagggcugaggugccccggggggugaucgugcucaugcagacucuggg

SEQ ID NO: 532497 - RNA, 64 nt, Homo Sapiens
uggcccccgaagaauggaacugugggggcauuuggggggugaaggugaggagaggacccaggag

SEQ ID NO: 532498 - RNA, 64 nt, Homo Sapiens
agcccuuuagauguuuauauucaccacgagaagccagucauaaagauaaaggaaauuugugcau

SEQ ID NO: 532499 - RNA, 64 nt, Homo Sapiens
uauguaauugaagauuacuauuuuaagaagucaucagucauaucacucacacagaauuuuauuu

SEQ ID NO: 532500 - RNA, 64 nt, Homo Sapiens
aaucguaugaauguaaugaguaugagggcaguuucagucauagcucagaucuuauccugcaaca

SEQ ID NO: 532501 - RNA, 64 nt, Homo Sapiens
gaaaucauguauguacugcaugugguaaagccuucagucauagcucagccauugcucagcauca

SEQ ID NO: 532502 - RNA, 64 nt, Homo Sapiens
aaauguaauaagcauguaugugugugaggagauucagucauaacccaacgcucauucaacauca

SEQ ID NO: 532503 - RNA, 64 nt, Homo Sapiens
agaaauacuucacagaauuauaucuauuucaccaucuacagaagcuugggaaagucacuccuag

SEQ ID NO: 532504 - RNA, 64 nt, Homo Sapiens
aauuaguaauacccaaguaaagauuuuaucuuugucuacagaacuguauuugcuaaugaucuuc

SEQ ID NO: 532505 - RNA, 64 nt, Homo Sapiens
uuugauuauaaauauguuccaauuuugccauuuaucuacagaaauuucaagcuaguucucugaa

SEQ ID NO: 532506 - RNA, 64 nt, Homo Sapiens
caagagcaaucuggaaggaauuagcauauaauugucuacagaagacuguuauguugaauaauaa

SEQ ID NO: 532507 - RNA, 64 nt, Homo Sapiens
gauagccuuccguaacccaaugagcacucccaagucuacagaguguucuuacgauggcacccag

SEQ ID NO: 532508 - RNA, 64 nt, Homo Sapiens
accuggaguuccugaaccugcccaaagccuugugucuacagagagcuccuucucugaagggaau

SEQ ID NO: 532509 - RNA, 64 nt, Homo Sapiens
cccuuucugccccuccaccaccuuggugggacauucuacagaacuccuuaugaucaugcucagc

SEQ ID NO: 532510 - RNA, 64 nt, Homo Sapiens
aacgccggaaguuguuugagaccgcaauaaacuuucuacagaggaaagaaaguacgaauuaaag

SEQ ID NO: 532511 - RNA, 64 nt, Homo Sapiens
caauuccucaaguggacuugagucuacagauaaaucuacagagacauaaaacuccuuauuagag

SEQ ID NO: 532512 - RNA, 54 nt, Homo Sapiens
aaucuacagagacaauuccuagagucuacagauagccauaaaacuccuuauuag

SEQ ID NO: 532513 - RNA, 61 nt, Homo Sapiens
uuccugugcuuuuucucagaaacugggcgaaucuacagaacaaagaacggcaugugaauuc

SEQ ID NO: 532514 - RNA, 64 nt, Homo Sapiens
uagguuugaguucaaauuuugcauugugugagcuucuacagauuuuagacaaggaccguuuuua

SEQ ID NO: 532515 - RNA, 64 nt, Homo Sapiens
auacaaacauaaguuuauuuuauaugcccagaugucuacagagacccuuuuuguaaaugucaag

SEQ ID NO: 532516 - RNA, 64 nt, Homo Sapiens
guauaaccauguagccaauuguggcccacuaaaaucuacagaaguuaaugugggucaccauuuu

SEQ ID NO: 532517 - RNA, 64 nt, Homo Sapiens
aauaggaaaucugaagaaccugcuguguuuagaugucucugaaaacagguuggaaagacuuccu

SEQ ID NO: 532518 - RNA, 64 nt, Homo Sapiens
ucgcuguggugcacuggagaacuugguaaaugaugucucugaugaagccuggaacgagcgugcu

SEQ ID NO: 532519 - RNA, 64 nt, Homo Sapiens
cccagcccugucugucuccaccccauccccucuugucucugagaaccauucucccaccccaagu

SEQ ID NO: 532520 - RNA, 64 nt, Homo Sapiens
aaguuccaccuucuauguuucuacucccucccuggucucugaaugccuucgccuguauaaagag

SEQ ID NO: 532521 - RNA, 64 nt, Homo Sapiens
ggauaaauuuuguagcugguacacucuggccugggucucugaauucagccugucaccgauggcu

SEQ ID NO: 532522 - RNA, 64 nt, Homo Sapiens
uagguccuugaucuuuucuuuagauugaaagucugucucugaacacaauuauuuguaaaaguua

SEQ ID NO: 532523 - RNA, 64 nt, Homo Sapiens
ggggugcucucucugagggggugggggugccgcugucucugaggggugggggugccgcugucuc

SEQ ID NO: 532524 - RNA, 64 nt, Homo Sapiens
ggugccgcugucucugaggggugggggugccgcugucucugaggggugggggugccgcucucuc

SEQ ID NO: 532525 - RNA, 64 nt, Homo Sapiens
gggugcugcucucuccgagggguggaaugccgcugucucugaggggugggggugccgcucuaaa

SEQ ID NO: 532526 - RNA, 64 nt, Homo Sapiens
aaaauuuguguaaauuuguauccacacaaauucagucucugaauacacaguauucagagucucu

SEQ ID NO: 532527 - RNA, 64 nt, Homo Sapiens
cacaaauucagucucugaauacacaguauucagagucucugauacacaguaauugugacaauag

SEQ ID NO: 532528 - RNA, 64 nt, Homo Sapiens
gaacuacugcuuuagaaugaagucguauaauaaagucucugaaaaggccuuauucagaauaagc

SEQ ID NO: 532529 - RNA, 64 nt, Homo Sapiens
ucauauaucucuccagagaacucaccugacaaaugucucugagcacaggcugacaccaaagugg

SEQ ID NO: 532530 - RNA, 64 nt, Homo Sapiens; identical to SEQ ID NO: 167088

SEQ ID NO: 532531 - RNA, 64 nt, Homo Sapiens; identical to SEQ ID NO: 167089

SEQ ID NO: 532532 - RNA, 64 nt, Homo Sapiens; identical to SEQ ID NO: 167090

SEQ ID NO: 532533 - RNA, 64 nt, Homo Sapiens; identical to SEQ ID NO: 167091

SEQ ID NO: 532534 - RNA, 64 nt, Homo Sapiens; identical to SEQ ID NO: 167092

SEQ ID NO: 532535 - RNA, 64 nt, Homo Sapiens; identical to SEQ ID NO: 167093

SEQ ID NO: 532536 - RNA, 64 nt, Homo Sapiens; identical to SEQ ID NO: 167094

SEQ ID NO: 532537 - RNA, 64 nt, Homo Sapiens; identical to SEQ ID NO: 167095

SEQ ID NO: 532538 - RNA, 64 nt, Homo Sapiens; identical to SEQ ID NO: 167096

SEQ ID NO: 532539 - RNA, 64 nt, Homo Sapiens; identical to SEQ ID NO: 167097

SEQ ID NO: 532540 - RNA, 64 nt, Homo Sapiens; identical to SEQ ID NO: 167098

SEQ ID NO: 532541 - RNA, 64 nt, Homo Sapiens; identical to SEQ ID NO: 167099

SEQ ID NO: 532542 - RNA, 64 nt, Homo Sapiens; identical to SEQ ID NO: 167100

SEQ ID NO: 532543 - RNA, 64 nt, Homo Sapiens; identical to SEQ ID NO: 167101

SEQ ID NO: 532544 - RNA, 64 nt, Homo Sapiens; identical to SEQ ID NO: 167102

SEQ ID NO: 532545 - RNA, 64 nt, Homo Sapiens; identical to SEQ ID NO: 167103

SEQ ID NO: 532546 - RNA, 64 nt, Homo Sapiens; identical to SEQ ID NO: 167104

SEQ ID NO: 532547 - RNA, 64 nt, Homo Sapiens; identical to SEQ ID NO: 167105

SEQ ID NO: 532548 - RNA, 64 nt, Homo Sapiens; identical to SEQ ID NO: 167106

SEQ ID NO: 532549 - RNA, 64 nt, Homo Sapiens; identical to SEQ ID NO: 167107

SEQ ID NO: 532550 - RNA, 64 nt, Homo Sapiens; identical to SEQ ID NO: 167108

SEQ ID NO: 532551 - RNA, 64 nt, Homo Sapiens; identical to SEQ ID NO: 167109

SEQ ID NO: 532552 - RNA, 64 nt, Homo Sapiens; identical to SEQ ID NO: 167110

SEQ ID NO: 532553 - RNA, 64 nt, Homo Sapiens; identical to SEQ ID NO: 167111

SEQ ID NO: 532554 - RNA, 64 nt, Homo Sapiens; identical to SEQ ID NO: 167112

SEQ ID NO: 532555 - RNA, 64 nt, Homo Sapiens; identical to SEQ ID NO: 167113

SEQ ID NO: 532556 - RNA, 64 nt, Homo Sapiens; identical to SEQ ID NO: 167114

SEQ ID NO: 532557 - RNA, 64 nt, Homo Sapiens; identical to SEQ ID NO: 167115

SEQ ID NO: 532558 - RNA, 64 nt, Homo Sapiens; identical to SEQ ID NO: 167116

SEQ ID NO: 532559 - RNA, 64 nt, Homo Sapiens; identical to SEQ ID NO: 167117

SEQ ID NO: 532560 - RNA, 64 nt, Homo Sapiens; identical to SEQ ID NO: 167118

SEQ ID NO: 532561 - RNA, 64 nt, Homo Sapiens; identical to SEQ ID NO: 167119

SEQ ID NO: 532562 - RNA, 64 nt, Homo Sapiens; identical to SEQ ID NO: 167120

SEQ ID NO: 532563 - RNA, 64 nt, Homo Sapiens; identical to SEQ ID NO: 167121

SEQ ID NO: 532564 - RNA, 64 nt, Homo Sapiens; identical to SEQ ID NO: 167122

SEQ ID NO: 532565 - RNA, 64 nt, Homo Sapiens; identical to SEQ ID NO: 167123

SEQ ID NO: 532566 - RNA, 64 nt, Homo Sapiens; identical to SEQ ID NO: 167124

SEQ ID NO: 532567 - RNA, 64 nt, Homo Sapiens; identical to SEQ ID NO: 167125

SEQ ID NO: 532568 - RNA, 64 nt, Homo Sapiens; identical to SEQ ID NO: 167126

SEQ ID NO: 532569 - RNA, 64 nt, Homo Sapiens; identical to SEQ ID NO: 167127

SEQ ID NO: 532570 - RNA, 64 nt, Homo Sapiens; identical to SEQ ID NO: 167128

SEQ ID NO: 532571 - RNA, 64 nt, Homo Sapiens; identical to SEQ ID NO: 167129

SEQ ID NO: 532572 - RNA, 64 nt, Homo Sapiens; identical to SEQ ID NO: 167130

SEQ ID NO: 532573 - RNA, 64 nt, Homo Sapiens; identical to SEQ ID NO: 167131

SEQ ID NO: 532574 - RNA, 64 nt, Homo Sapiens; identical to SEQ ID NO: 167132

SEQ ID NO: 532575 - RNA, 64 nt, Homo Sapiens; identical to SEQ ID NO: 167133

SEQ ID NO: 532576 - RNA, 64 nt, Homo Sapiens; identical to SEQ ID NO: 167134

SEQ ID NO: 532577 - RNA, 64 nt, Homo Sapiens; identical to SEQ ID NO: 167135

SEQ ID NO: 532578 - RNA, 64 nt, Homo Sapiens; identical to SEQ ID NO: 167136

SEQ ID NO: 532579 - RNA, 64 nt, Homo Sapiens; identical to SEQ ID NO: 167137

SEQ ID NO: 532580 - RNA, 64 nt, Homo Sapiens; identical to SEQ ID NO: 167138

SEQ ID NO: 532581 - RNA, 64 nt, Homo Sapiens; identical to SEQ ID NO: 167139

SEQ ID NO: 532582 - RNA, 64 nt, Homo Sapiens; identical to SEQ ID NO: 167140

SEQ ID NO: 532583 - RNA, 64 nt, Homo Sapiens; identical to SEQ ID NO: 167141

SEQ ID NO: 532584 - RNA, 64 nt, Homo Sapiens; identical to SEQ ID NO: 167142

SEQ ID NO: 532585 - RNA, 64 nt, Homo Sapiens; identical to SEQ ID NO: 167143

SEQ ID NO: 532586 - RNA, 64 nt, Homo Sapiens; identical to SEQ ID NO: 167144

SEQ ID NO: 532587 - RNA, 64 nt, Homo Sapiens; identical to SEQ ID NO: 167145

SEQ ID NO: 532588 - RNA, 64 nt, Homo Sapiens; identical to SEQ ID NO: 167146

SEQ ID NO: 532589 - RNA, 64 nt, Homo Sapiens; identical to SEQ ID NO: 167147

SEQ ID NO: 532590 - RNA, 64 nt, Homo Sapiens; identical to SEQ ID NO: 167148

SEQ ID NO: 532591 - RNA, 64 nt, Homo Sapiens; identical to SEQ ID NO: 167149

SEQ ID NO: 532592 - RNA, 64 nt, Homo Sapiens; identical to SEQ ID NO: 167150

SEQ ID NO: 532593 - RNA, 64 nt, Homo Sapiens; identical to SEQ ID NO: 167151

SEQ ID NO: 532594 - RNA, 64 nt, Homo Sapiens; identical to SEQ ID NO: 167152

SEQ ID NO: 532595 - RNA, 64 nt, Homo Sapiens; identical to SEQ ID NO: 167153

SEQ ID NO: 532596 - RNA, 64 nt, Homo Sapiens; identical to SEQ ID NO: 167154

SEQ ID NO: 532597 - RNA, 64 nt, Homo Sapiens; identical to SEQ ID NO: 167155

SEQ ID NO: 532598 - RNA, 64 nt, Homo Sapiens; identical to SEQ ID NO: 167156

SEQ ID NO: 532599 - RNA, 64 nt, Homo Sapiens; identical to SEQ ID NO: 167157

SEQ ID NO: 532600 - RNA, 64 nt, Homo Sapiens; identical to SEQ ID NO: 167158

SEQ ID NO: 532601 - RNA, 64 nt, Homo Sapiens; identical to SEQ ID NO: 167159

SEQ ID NO: 532602 - RNA, 64 nt, Homo Sapiens; identical to SEQ ID NO: 167160

SEQ ID NO: 532603 - RNA, 64 nt, Homo Sapiens; identical to SEQ ID NO: 167161

SEQ ID NO: 532604 - RNA, 64 nt, Homo Sapiens; identical to SEQ ID NO: 167162

SEQ ID NO: 532605 - RNA, 64 nt, Homo Sapiens; identical to SEQ ID NO: 167163

SEQ ID NO: 532606 - RNA, 64 nt, Homo Sapiens; identical to SEQ ID NO: 167164

SEQ ID NO: 532607 - RNA, 64 nt, Homo Sapiens; identical to SEQ ID NO: 167165

SEQ ID NO: 532608 - RNA, 64 nt, Homo Sapiens; identical to SEQ ID NO: 167166

SEQ ID NO: 532609 - RNA, 64 nt, Homo Sapiens; identical to SEQ ID NO: 167167

SEQ ID NO: 532610 - RNA, 64 nt, Homo Sapiens; identical to SEQ ID NO: 167168

SEQ ID NO: 532611 - RNA, 64 nt, Homo Sapiens; identical to SEQ ID NO: 473932

SEQ ID NO: 532612 - RNA, 64 nt, Homo Sapiens; identical to SEQ ID NO: 473933

SEQ ID NO: 532613 - RNA, 64 nt, Homo Sapiens; identical to SEQ ID NO: 473934

SEQ ID NO: 532614 - RNA, 64 nt, Homo Sapiens; identical to SEQ ID NO: 473935

SEQ ID NO: 532615 - RNA, 64 nt, Homo Sapiens; identical to SEQ ID NO: 473936

SEQ ID NO: 532616 - RNA, 64 nt, Homo Sapiens; identical to SEQ ID NO: 473937

SEQ ID NO: 532617 - RNA, 64 nt, Homo Sapiens; identical to SEQ ID NO: 473938

SEQ ID NO: 532618 - RNA, 64 nt, Homo Sapiens; identical to SEQ ID NO: 473939

SEQ ID NO: 532619 - RNA, 64 nt, Homo Sapiens; identical to SEQ ID NO: 473940

SEQ ID NO: 532620 - RNA, 64 nt, Homo Sapiens; identical to SEQ ID NO: 473941

SEQ ID NO: 532621 - RNA, 64 nt, Homo Sapiens; identical to SEQ ID NO: 473942

SEQ ID NO: 532622 - RNA, 64 nt, Homo Sapiens; identical to SEQ ID NO: 473943

SEQ ID NO: 532623 - RNA, 64 nt, Homo Sapiens; identical to SEQ ID NO: 473944

SEQ ID NO: 532624 - RNA, 64 nt, Homo Sapiens; identical to SEQ ID NO: 473945

SEQ ID NO: 532625 - RNA, 64 nt, Homo Sapiens; identical to SEQ ID NO: 473946

SEQ ID NO: 532626 - RNA, 64 nt, Homo Sapiens; identical to SEQ ID NO: 473947

SEQ ID NO: 532627 - RNA, 64 nt, Homo Sapiens; identical to SEQ ID NO: 473948

SEQ ID NO: 532628 - RNA, 64 nt, Homo Sapiens; identical to SEQ ID NO: 473949

SEQ ID NO: 532629 - RNA, 64 nt, Homo Sapiens; identical to SEQ ID NO: 473950

SEQ ID NO: 532630 - RNA, 64 nt, Homo Sapiens; identical to SEQ ID NO: 473951

SEQ ID NO: 532631 - RNA, 64 nt, Homo Sapiens; identical to SEQ ID NO: 473952

SEQ ID NO: 532632 - RNA, 64 nt, Homo Sapiens; identical to SEQ ID NO: 473953

SEQ ID NO: 532633 - RNA, 64 nt, Homo Sapiens; identical to SEQ ID NO: 473954

SEQ ID NO: 532634 - RNA, 64 nt, Homo Sapiens; identical to SEQ ID NO: 473955

SEQ ID NO: 532635 - RNA, 64 nt, Homo Sapiens; identical to SEQ ID NO: 473956

SEQ ID NO: 532636 - RNA, 64 nt, Homo Sapiens; identical to SEQ ID NO: 473957

SEQ ID NO: 532637 - RNA, 64 nt, Homo Sapiens; identical to SEQ ID NO: 473958

SEQ ID NO: 532638 - RNA, 64 nt, Homo Sapiens; identical to SEQ ID NO: 473959

SEQ ID NO: 532639 - RNA, 64 nt, Homo Sapiens; identical to SEQ ID NO: 473960

SEQ ID NO: 532640 - RNA, 64 nt, Homo Sapiens; identical to SEQ ID NO: 473961

SEQ ID NO: 532641 - RNA, 64 nt, Homo Sapiens; identical to SEQ ID NO: 473962

SEQ ID NO: 532642 - RNA, 64 nt, Homo Sapiens; identical to SEQ ID NO: 473963

SEQ ID NO: 532643 - RNA, 64 nt, Homo Sapiens; identical to SEQ ID NO: 473964

SEQ ID NO: 532644 - RNA, 64 nt, Homo Sapiens; identical to SEQ ID NO: 473965

SEQ ID NO: 532645 - RNA, 64 nt, Homo Sapiens; identical to SEQ ID NO: 473966

SEQ ID NO: 532646 - RNA, 64 nt, Homo Sapiens; identical to SEQ ID NO: 473967

SEQ ID NO: 532647 - RNA, 64 nt, Homo Sapiens; identical to SEQ ID NO: 473968

SEQ ID NO: 532648 - RNA, 64 nt, Homo Sapiens; identical to SEQ ID NO: 473969

SEQ ID NO: 532649 - RNA, 64 nt, Homo Sapiens; identical to SEQ ID NO: 473970

SEQ ID NO: 532650 - RNA, 64 nt, Homo Sapiens; identical to SEQ ID NO: 473971

SEQ ID NO: 532651 - RNA, 64 nt, Homo Sapiens; identical to SEQ ID NO: 473972

SEQ ID NO: 532652 - RNA, 64 nt, Homo Sapiens; identical to SEQ ID NO: 473973

SEQ ID NO: 532653 - RNA, 64 nt, Homo Sapiens; identical to SEQ ID NO: 473974

SEQ ID NO: 532654 - RNA, 64 nt, Homo Sapiens; identical to SEQ ID NO: 473975

SEQ ID NO: 532655 - RNA, 64 nt, Homo Sapiens; identical to SEQ ID NO: 473976

SEQ ID NO: 532656 - RNA, 64 nt, Homo Sapiens; identical to SEQ ID NO: 473977

SEQ ID NO: 532657 - RNA, 64 nt, Homo Sapiens; identical to SEQ ID NO: 473978

SEQ ID NO: 532658 - RNA, 64 nt, Homo Sapiens; identical to SEQ ID NO: 473979

SEQ ID NO: 532659 - RNA, 64 nt, Homo Sapiens; identical to SEQ ID NO: 473980

SEQ ID NO: 532660 - RNA, 64 nt, Homo Sapiens; identical to SEQ ID NO: 473981

SEQ ID NO: 532661 - RNA, 64 nt, Homo Sapiens; identical to SEQ ID NO: 473982

SEQ ID NO: 532662 - RNA, 64 nt, Homo Sapiens; identical to SEQ ID NO: 473983

SEQ ID NO: 532663 - RNA, 64 nt, Homo Sapiens; identical to SEQ ID NO: 473984

SEQ ID NO: 532664 - RNA, 64 nt, Homo Sapiens; identical to SEQ ID NO: 473985

SEQ ID NO: 532665 - RNA, 64 nt, Homo Sapiens; identical to SEQ ID NO: 473986

SEQ ID NO: 532666 - RNA, 64 nt, Homo Sapiens; identical to SEQ ID NO: 473987

SEQ ID NO: 532667 - RNA, 64 nt, Homo Sapiens; identical to SEQ ID NO: 473988

SEQ ID NO: 532668 - RNA, 64 nt, Homo Sapiens; identical to SEQ ID NO: 473989

SEQ ID NO: 532669 - RNA, 64 nt, Homo Sapiens; identical to SEQ ID NO: 473990

SEQ ID NO: 532670 - RNA, 64 nt, Homo Sapiens; identical to SEQ ID NO: 473991

SEQ ID NO: 532671 - RNA, 64 nt, Homo Sapiens; identical to SEQ ID NO: 473992

SEQ ID NO: 532672 - RNA, 64 nt, Homo Sapiens; identical to SEQ ID NO: 473993

SEQ ID NO: 532673 - RNA, 64 nt, Homo Sapiens; identical to SEQ ID NO: 473994

SEQ ID NO: 532674 - RNA, 64 nt, Homo Sapiens; identical to SEQ ID NO: 473995

SEQ ID NO: 532675 - RNA, 64 nt, Homo Sapiens; identical to SEQ ID NO: 473996

SEQ ID NO: 532676 - RNA, 64 nt, Homo Sapiens; identical to SEQ ID NO: 473997

SEQ ID NO: 532677 - RNA, 64 nt, Homo Sapiens; identical to SEQ ID NO: 473998

SEQ ID NO: 532678 - RNA, 64 nt, Homo Sapiens; identical to SEQ ID NO: 473999

SEQ ID NO: 532679 - RNA, 64 nt, Homo Sapiens; identical to SEQ ID NO: 474000

SEQ ID NO: 532680 - RNA, 64 nt, Homo Sapiens; identical to SEQ ID NO: 474001

SEQ ID NO: 532681 - RNA, 64 nt, Homo Sapiens; identical to SEQ ID NO: 474002

SEQ ID NO: 532682 - RNA, 64 nt, Homo Sapiens; identical to SEQ ID NO: 474003

SEQ ID NO: 532683 - RNA, 64 nt, Homo Sapiens; identical to SEQ ID NO: 474004

SEQ ID NO: 532684 - RNA, 64 nt, Homo Sapiens; identical to SEQ ID NO: 474005

SEQ ID NO: 532685 - RNA, 64 nt, Homo Sapiens; identical to SEQ ID NO: 474006

SEQ ID NO: 532686 - RNA, 64 nt, Homo Sapiens; identical to SEQ ID NO: 474007

SEQ ID NO: 532687 - RNA, 64 nt, Homo Sapiens; identical to SEQ ID NO: 474008

SEQ ID NO: 532688 - RNA, 64 nt, Homo Sapiens; identical to SEQ ID NO: 474009

SEQ ID NO: 532689 - RNA, 64 nt, Homo Sapiens; identical to SEQ ID NO: 474010

SEQ ID NO: 532690 - RNA, 64 nt, Homo Sapiens; identical to SEQ ID NO: 474011

SEQ ID NO: 532691 - RNA, 64 nt, Homo Sapiens; identical to SEQ ID NO: 474012

SEQ ID NO: 532692 - RNA, 64 nt, Homo Sapiens; identical to SEQ ID NO: 474013

SEQ ID NO: 532693 - RNA, 64 nt, Homo Sapiens; identical to SEQ ID NO: 474014

SEQ ID NO: 532694 - RNA, 64 nt, Homo Sapiens; identical to SEQ ID NO: 474015

SEQ ID NO: 532695 - RNA, 64 nt, Homo Sapiens; identical to SEQ ID NO: 474016

SEQ ID NO: 532696 - RNA, 64 nt, Homo Sapiens; identical to SEQ ID NO: 474017

SEQ ID NO: 532697 - RNA, 64 nt, Homo Sapiens; identical to SEQ ID NO: 474018

SEQ ID NO: 532698 - RNA, 64 nt, Homo Sapiens; identical to SEQ ID NO: 474019

SEQ ID NO: 532699 - RNA, 64 nt, Homo Sapiens; identical to SEQ ID NO: 474020

SEQ ID NO: 532700 - RNA, 64 nt, Homo Sapiens; identical to SEQ ID NO: 474021

SEQ ID NO: 532701 - RNA, 64 nt, Homo Sapiens; identical to SEQ ID NO: 474022

SEQ ID NO: 532702 - RNA, 64 nt, Homo Sapiens; identical to SEQ ID NO: 474023

SEQ ID NO: 532703 - RNA, 64 nt, Homo Sapiens; identical to SEQ ID NO: 474024

SEQ ID NO: 532704 - RNA, 64 nt, Homo Sapiens; identical to SEQ ID NO: 474025

SEQ ID NO: 532705 - RNA, 64 nt, Homo Sapiens; identical to SEQ ID NO: 474026

SEQ ID NO: 532706 - RNA, 64 nt, Homo Sapiens; identical to SEQ ID NO: 474027

SEQ ID NO: 532707 - RNA, 64 nt, Homo Sapiens; identical to SEQ ID NO: 474028

SEQ ID NO: 532708 - RNA, 64 nt, Homo Sapiens; identical to SEQ ID NO: 474029

SEQ ID NO: 532709 - RNA, 64 nt, Homo Sapiens; identical to SEQ ID NO: 474030

SEQ ID NO: 532710 - RNA, 64 nt, Homo Sapiens; identical to SEQ ID NO: 474031

SEQ ID NO: 532711 - RNA, 64 nt, Homo Sapiens; identical to SEQ ID NO: 474032

SEQ ID NO: 532712 - RNA, 64 nt, Homo Sapiens; identical to SEQ ID NO: 474033

SEQ ID NO: 532713 - RNA, 65 nt, Homo Sapiens
gcaccugguaucucgagugccugcaguugcaaguauguuuacaccugguguccaauuuuguauuu

SEQ ID NO: 532714 - RNA, 65 nt, Homo Sapiens
aaggcagaguaacauuacuuaaaaaaaaaaggauauguuuacauuuaauuuuggcuaccaggagu

SEQ ID NO: 532715 - RNA, 65 nt, Homo Sapiens
gugaagagcuuuugcucuugcauuagauuugaagauguuuacauuguuguuauuguuauguauca

SEQ ID NO: 532716 - RNA, 65 nt, Homo Sapiens
gcaccuaacgggaaagaaccgacauggcugccuuuuguuuacacugguuauuuauuuaugacuug

SEQ ID NO: 532717 - RNA, 65 nt, Homo Sapiens
cagacuuccucuaggaguggugcugcuaccuuguauguuuacauaaugcuuuagcccaaggacac

SEQ ID NO: 532718 - RNA, 65 nt, Homo Sapiens
ccuuccaugccaaagguuggagucugcuggugcgguguuuacacaccaggcagggcugucugcca

SEQ ID NO: 532719 - RNA, 65 nt, Homo Sapiens
cugccgcugagaaggguugauccugcaucuggguuuguuuacagcaauuccuggacucgggggua

SEQ ID NO: 532720 - RNA, 65 nt, Homo Sapiens
uuucuuugaaaauucuggcagaccaagguucuuuuuguuuacauaauacuugaaaaauaaaaaug

SEQ ID NO: 532721 - RNA, 65 nt, Homo Sapiens
auguauuggucuuucuccguguucuuuggggguuuuguuuacaaacuucuuuuuguauugagaga

SEQ ID NO: 532722 - RNA, 65 nt, Homo Sapiens
uagaagacuuuuuuuauuuuaaccaaaguuacuguuguuuacagugaguuuggggaaaaaaaaua

SEQ ID NO: 532723 - RNA, 65 nt, Homo Sapiens
aauuuuuuuuaaaauuaugaaucauaucaaguaguuguuuacauuucuugaaaaaauaggaacuc

SEQ ID NO: 532724 - RNA, 65 nt, Homo Sapiens; identical to SEQ ID NO: 420659

SEQ ID NO: 532725 - RNA, 65 nt, Homo Sapiens; identical to SEQ ID NO: 420660

SEQ ID NO: 532726 - RNA, 65 nt, Homo Sapiens
acaggcuggggaauuuugcugcucccuauugcuucuguuuacaaaaaugaauuuuuccugguuuc

SEQ ID NO: 532727 - RNA, 65 nt, Homo Sapiens
guaaaacauaccauccuuuucuauuuucuugaugcuguuuacaacauaguuuggugauauccaga

SEQ ID NO: 532728 - RNA, 65 nt, Homo Sapiens
ucuacuacagcacugugaugcuuuaugcaacuaacuguuuacauaucuguccccugcuacuagau

SEQ ID NO: 532729 - RNA, 65 nt, Homo Sapiens
caccagacugaagcacauguaauauagaccguguauguuuacaauguuguguauaaaugggacaa

SEQ ID NO: 532730 - RNA, 65 nt, Homo Sapiens
uccuuucucuuuugugaaucuuuccccccauuuccuguuuacauguaacccaacaaaaugcaauu

SEQ ID NO: 532731 - RNA, 65 nt, Homo Sapiens
acagcuuuuuuuauuuugcauuuguuuuuucaauguguuuacauuguaugaauugagcuuuuugc

SEQ ID NO: 532732 - RNA, 65 nt, Homo Sapiens; identical to SEQ ID NO: 420661

SEQ ID NO: 532733 - RNA, 65 nt, Homo Sapiens; identical to SEQ ID NO: 420662

SEQ ID NO: 532734 - RNA, 65 nt, Homo Sapiens
uuucuuuucuccuuaucugugcagaacagguugcuuguuuacaacugaagaucaugcuauauuuu

SEQ ID NO: 532735 - RNA, 65 nt, Homo Sapiens
aaauuguuuguaacuuggaugcugccgcuacugaauguuuacaaauugcuugccugcuaaaguaa

SEQ ID NO: 532736 - RNA, 65 nt, Homo Sapiens
acaaaguuucuggauguuuuauuaaauauuguacguguuuacaguugggaauuuaaaauaauaca

SEQ ID NO: 532737 - RNA, 65 nt, Homo Sapiens; identical to SEQ ID NO: 420663

SEQ ID NO: 532738 - RNA, 65 nt, Homo Sapiens; identical to SEQ ID NO: 420664

SEQ ID NO: 532739 - RNA, 65 nt, Homo Sapiens
ugucauguugggguuuuuaaugugauuguguauucuguuuacauuaaaaagaagcaaaaauaauu

SEQ ID NO: 532740 - RNA, 65 nt, Homo Sapiens
gauaugacaacugguaaugguggauucauuuacauuguuuacacuucuaugaccaggccuuaagg

SEQ ID NO: 532741 - RNA, 65 nt, Homo Sapiens
agccucgaaauuccuguaaauuguuuacuuuaugauguuuacauacacguuucacuuugaaaaaa

SEQ ID NO: 532742 - RNA, 65 nt, Homo Sapiens
aagcaguuccagaaggaccauucucaccuguguuuuguuuacauggaccacuacagaaauuaguu

SEQ ID NO: 532743 - RNA, 65 nt, Homo Sapiens
ucaaugcaggacucaucacaucuauucggauauucuguuuacacacccaugucaucccagagagg

SEQ ID NO: 532744 - RNA, 65 nt, Homo Sapiens
acagcauguccucuaccugugacuucucauuuuccuguuuacacuggggauuuggagggggcagg

SEQ ID NO: 532745 - RNA, 65 nt, Homo Sapiens
ggcaaggggcagcacugccugcugcuuccuuccccuguuuacagcaauaagcacguccuccuccc

SEQ ID NO: 532746 - RNA, 65 nt, Homo Sapiens; identical to SEQ ID NO: 420665

SEQ ID NO: 532747 - RNA, 65 nt, Homo Sapiens; identical to SEQ ID NO: 420666

SEQ ID NO: 532748 - RNA, 65 nt, Homo Sapiens
auguuuuaagaaacaaaacauaguaucuuauggauuguuuacaaucacaaggacauagauaccua

SEQ ID NO: 532749 - RNA, 65 nt, Homo Sapiens
aaaacagauuugauaaucuuauucacaguuguuauuguuuacagaccauuuaauuaauauuuccu

SEQ ID NO: 532750 - RNA, 65 nt, Homo Sapiens
guggauuuuguauuaaaauauauagaagcaauuucuguuuacauguccuugcuacuuuuaaaaac

SEQ ID NO: 532751 - RNA, 65 nt, Homo Sapiens
cuguacuuucuguaguuucuguguaaacugccauauguuuacauggaaacuacaggaaaaaauug

SEQ ID NO: 532752 - RNA, 65 nt, Homo Sapiens
aaaguauuaauacuuuaaagucaaauaagauauaguguuuacauucuuuagguccugaggggcag

SEQ ID NO: 532753 - RNA, 65 nt, Homo Sapiens
ugaagccucggcuuucccucuggagccugggacccuguuuacaguugcacaucugggccccucac

SEQ ID NO: 532754 - RNA, 65 nt, Homo Sapiens
gauaaugaugaguaacuuaaccagcacauuucuccuguuuacacucgggggauuuuuuuguuuuc

SEQ ID NO: 532755 - RNA, 65 nt, Homo Sapiens
guuaucccgcaagguuuaguugagaagauacaaaauguuuacaguguuggcacuuagaguuuuua

SEQ ID NO: 532756 - RNA, 65 nt, Homo Sapiens
gggugggccggggagggguccuuugcggugagcuauguuuacaugacacagugugccaaagugac

SEQ ID NO: 532757 - RNA, 65 nt, Homo Sapiens
uugauaacuucgcuacauaacaaggaaaauauaaauguuuacaaacagcuuaaagauuugcaugu

SEQ ID NO: 532758 - RNA, 65 nt, Homo Sapiens; identical to SEQ ID NO: 420667

SEQ ID NO: 532759 - RNA, 65 nt, Homo Sapiens; identical to SEQ ID NO: 420668

SEQ ID NO: 532760 - RNA, 65 nt, Homo Sapiens
caucaugagacaugcuucuuugguuuauaaugagauguuuacaguuaaauacagauggcaguuga

SEQ ID NO: 532761 - RNA, 65 nt, Homo Sapiens
cagaaugaaacacauuccuucagcauuuacaaauguguuuacagucauaagucgggguuuggucu

SEQ ID NO: 532762 - RNA, 65 nt, Homo Sapiens
uauguucugcaagacgcuguucgucugccauucaauguuuacauuagauuucaaggggaagggag

SEQ ID NO: 532763 - RNA, 65 nt, Homo Sapiens
uuaaacugcugaauauuauuaacaguuaaacaagcuguuuacagucauuacugcaauguucucuu

SEQ ID NO: 532764 - RNA, 65 nt, Homo Sapiens
ugagauuuauagucgugggaaguaauaguaaaucauguuuacauagacggaacaaguuuaguagc

SEQ ID NO: 532765 - RNA, 65 nt, Homo Sapiens
gauacuauuaagaaaaugaacgccaaaauucgcuauguuuacaguuuuucagagcaaucuaaaag

SEQ ID NO: 532766 - RNA, 65 nt, Homo Sapiens
gcccuuucacgugcacagcauggucagcacuuaacuguuuacaaaguauaauaauuugccuugug

SEQ ID NO: 532767 - RNA, 65 nt, Homo Sapiens; identical to SEQ ID NO: 420669

SEQ ID NO: 532768 - RNA, 65 nt, Homo Sapiens; identical to SEQ ID NO: 420670

SEQ ID NO: 532769 - RNA, 65 nt, Homo Sapiens
augcaagaggggaaaccugucuuagggguggcuuuuguuuacaaguugugugugaagauuccuga

SEQ ID NO: 532770 - RNA, 65 nt, Homo Sapiens
uuucuacacauuucauccuuuaaagcagguuguguuguuuacaugucuaauaacauguauagauc

SEQ ID NO: 532771 - RNA, 65 nt, Homo Sapiens
gagaauauauucaaguuuuuuaauguuaaaguuuuuguuuacauuggggacuuuugccuuguuug

SEQ ID NO: 532772 - RNA, 65 nt, Homo Sapiens
aauuuuaccgagugggacuuuauuaaauaugugaauguuuacacuaaugcuuauuuuaaagguac

SEQ ID NO: 532773 - RNA, 65 nt, Homo Sapiens
uguauuaggaccauugaugcuuuuuagugguauucuguuuacagauauuucaugccaguaaaauu

SEQ ID NO: 532774 - RNA, 65 nt, Homo Sapiens
ugaugcaugucuuuuaaaauauggcuguaaucauuuguuuacauuagaauaugacuuuuuauaaa

SEQ ID NO: 532775 - RNA, 65 nt, Homo Sapiens
auuugauucuaaguugaauuugugcuacuaacucuuguuuacaaauugacaaucuacugugccac

SEQ ID NO: 532776 - RNA, 65 nt, Homo Sapiens
uuaaauuuuagaacuuguuuuucuacauaugagaauguuuacaauuaauacaccaauuaaaauau

SEQ ID NO: 532777 - RNA, 65 nt, Homo Sapiens
auggccagaaggcuugcaaacaguuaauuuuuaaauguuuacauauuauuuuucaauuggcaauu

SEQ ID NO: 532778 - RNA, 65 nt, Homo Sapiens
cugagacuguucuacaguuuggucagugauuuuauuguuuacaucauccagggauauaacuccuu

SEQ ID NO: 532779 - RNA, 65 nt, Homo Sapiens
aacagaucaagggcuauaauugaagaagcuggcauuguuuacagaaaggguaguugccaauaacc

SEQ ID NO: 532780 - RNA, 65 nt, Homo Sapiens
uuuuccuguggaauaauuauuuauuuauagucaaguguuuacacuuuuggauacucugugccaau

SEQ ID NO: 532781 - RNA, 65 nt, Homo Sapiens
cucugcugguucccucugugcugaaccccuaaaaauguuuacagucacgaggaaaagaccuuccc

SEQ ID NO: 532782 - RNA, 65 nt, Homo Sapiens
ccauucugauggguucuuugccuuuaagucuuaccuguuuacagcaagucuuuuucuuuaauaug

SEQ ID NO: 532783 - RNA, 65 nt, Homo Sapiens
gggagaguuggcugcuccagagugugccugguguguguuuacaaauaggggcaucucugugucug

SEQ ID NO: 532784 - RNA, 65 nt, Homo Sapiens
aggaaacaagauggaauaaacauauugugcucuucuguuuacaagcggcuccuuugaaaacaggu

SEQ ID NO: 532785 - RNA, 65 nt, Homo Sapiens
ggcaguacaacugaauguuagaugugaauuggcccuguuuacagaacauggccacgcuguggaau

SEQ ID NO: 532786 - RNA, 65 nt, Homo Sapiens
uagacuaucugaguaaauggggcagcuuauuuauuuguuuacaguaaauugcugagguuuccuua

SEQ ID NO: 532787 - RNA, 65 nt, Homo Sapiens
ccgcucuaauguuugauauaggugauugacauccauguuuacacucaaauuuaugaaacuaaaag

SEQ ID NO: 532788 - RNA, 65 nt, Homo Sapiens
ccuaauugcuuuaagcacuuuuucuauuucaguuuuguuuacacuaaaauagcaguuuuaaaagu

SEQ ID NO: 532789 - RNA, 65 nt, Homo Sapiens
uccccaagccuggcaagggaguugauuaauggaaauguuuacagacucgggauuaguacacacuu

SEQ ID NO: 532790 - RNA, 65 nt, Homo Sapiens
uauaggaccacauaucccugcucauagugccaguguguuuacauuagaaacagagcuaucuguuc

SEQ ID NO: 532791 - RNA, 65 nt, Homo Sapiens
cacucgugcuuuuccuuauccucaguccaacacuguguuuacauaguguucuuuacaaaggcuag

SEQ ID NO: 532792 - RNA, 65 nt, Homo Sapiens
uuugguuacagugugcuacguagaaacuccacagcuguuuacaaaaacaucacuaaaugugggca

SEQ ID NO: 532793 - RNA, 65 nt, Homo Sapiens
guggcccggagcgucuuggcugggauaaccucggcuguuuacaguguuuguguuccagcuguguc

SEQ ID NO: 532794 - RNA, 65 nt, Homo Sapiens
uuugaauuaggcuaaaagguaaaaaagacugaacauguuuacaggaaauauuaaagauucucuuu

SEQ ID NO: 532795 - RNA, 65 nt, Homo Sapiens
acuacuuuuguaacuuccagauuuaauucauaugguguuuacagucuugugcauuuguuauggaa

SEQ ID NO: 532796 - RNA, 65 nt, Homo Sapiens
guuugguucaauuauaaacaacauucuuguuuaaguguuuacacauacuagaaucuacucugcuu

SEQ ID NO: 532797 - RNA, 65 nt, Homo Sapiens
auaaacugacaaaugacaaaauggugagcuuaugauguuuacauaaaaguucuauaagcugugua

SEQ ID NO: 532798 - RNA, 65 nt, Homo Sapiens
uuuagaugaggaugauugaguccauauacuauguauguuuacauauacuauacaugcacauuagg

SEQ ID NO: 532799 - RNA, 65 nt, Homo Sapiens
gaauauuaugcagaugccguuaauuuuuuacccuauguuuacaucuugaggcagcagagucuguc

SEQ ID NO: 532800 - RNA, 65 nt, Homo Sapiens; identical to SEQ ID NO: 420671

SEQ ID NO: 532801 - RNA, 65 nt, Homo Sapiens; identical to SEQ ID NO: 420672

SEQ ID NO: 532802 - RNA, 65 nt, Homo Sapiens
auagauauuugcccuuaguuuacugguuaaaaguuuguuuacagaacuuuucucuggugcuuaaa

SEQ ID NO: 532803 - RNA, 65 nt, Homo Sapiens
gauucuucuaaugauggucaacugcaaggagaaacuguuuacauccuucccacuacacaguugcu

SEQ ID NO: 532804 - RNA, 65 nt, Homo Sapiens
cucuauguguauagguaucuguauaucuuuccuuuuguuuacaacuguuaaaaaaccucaaaaua

SEQ ID NO: 532805 - RNA, 65 nt, Homo Sapiens
gcugacuuggcuggugugguacagagaagccagcuuguuuacaugcuuauuccaugacugcuugc

SEQ ID NO: 532806 - RNA, 65 nt, Homo Sapiens
cuugugaggguacucugucuaauguauauuucuaguguuuacagacaguaaauguguauauguag

SEQ ID NO: 532807 - RNA, 65 nt, Homo Sapiens
acucuuuucucaugcacauguuacguuggagaaaauguuuacaaaaaugguuuuguuacacuaau

SEQ ID NO: 532808 - RNA, 65 nt, Homo Sapiens
gaagagacuuugaagucaccugacucagccccuuguguuuacagacaaggacauguaguccaagg

SEQ ID NO: 532809 - RNA, 65 nt, Homo Sapiens
uuuguuaacccuuauccauuuguugacauguagacuguuuacaaaaaaaaaacacaugguuaaau

SEQ ID NO: 532810 - RNA, 65 nt, Homo Sapiens
augguuuuuuggagcaggauuuuguguaagaaugguguuuacaugcaguguguuuucccccucac

SEQ ID NO: 532811 - RNA, 65 nt, Homo Sapiens
cuaauacagcugcuaaaaugaucccugucuccucguguuuacauucuguguguguccccucccac

SEQ ID NO: 532812 - RNA, 65 nt, Homo Sapiens
ucaaugauaaagggauaaaacaguauacugacaacuguuuacaagaaaguggagaaaaauguaca

SEQ ID NO: 532813 - RNA, 65 nt, Homo Sapiens
gcugaugcaagccuuuuucaguucaagagaauaaauguuuacaaauauaggcucacuuugucuuu

SEQ ID NO: 532814 - RNA, 65 nt, Homo Sapiens
uccugcaucacuuguuuuaacuauuuauuuugccauguuuacauuuuguaucuuguaaaaauaaa

SEQ ID NO: 532815 - RNA, 65 nt, Homo Sapiens
auccaacacuagaaagcaaugacuaacauuuaauuuguuuacaaaaauguuuauugucuucagua

SEQ ID NO: 532816 - RNA, 65 nt, Homo Sapiens
aaaauucuguauaaaacuguaauccuuuguauucauguuuacagugcuauuacuauaauucaaaa

SEQ ID NO: 532817 - RNA, 65 nt, Homo Sapiens
aaaagaaaccaagaauuuuccauuuugugaucaauuguuuacagcccgugauggugauguguuug

SEQ ID NO: 532818 - RNA, 65 nt, Homo Sapiens
ggcuucaagaaauccuuuggaaauaaaaaguuaaauguuuacauuucaugugguauuucaggucu

SEQ ID NO: 532819 - RNA, 65 nt, Homo Sapiens
uuguacuuuggaauucuuagucacaaaauauauuuuguuuacaaaaauuucuguaaaacagguua

SEQ ID NO: 532820 - RNA, 65 nt, Homo Sapiens
ucuguaauuucugaauguauauagaauaauauuuauguuuacaauguaacuuuucaaaauuuaca

SEQ ID NO: 532821 - RNA, 65 nt, Homo Sapiens
agaucuauugaauuucagagaagagccuucuaacuuguuuacacaaaaacgaguaugauuuagca

SEQ ID NO: 532822 - RNA, 65 nt, Homo Sapiens
agacucagguuguaguaaagaaauuuaaaagacacuguuuacaagaaaaaaugaauuuuguuugg

SEQ ID NO: 532823 - RNA, 65 nt, Homo Sapiens
gacuguaggaagucaaaaacuuguacuguaucuuguguuuacaguucugauuuauuccuuugaaa

SEQ ID NO: 532824 - RNA, 65 nt, Homo Sapiens
uaauuuguauuacuagucauaugcauguagcuuucuguuuacauccuaugccacauggucuucau

SEQ ID NO: 532825 - RNA, 65 nt, Homo Sapiens
cuucucuuguggcacuuaucacacuguauuuuacuuguuuacauguuugucuccccuucuagacu

SEQ ID NO: 532826 - RNA, 65 nt, Homo Sapiens
caaaaguuggggguggguaagagggauaguuaaaauguuuacaaaacuuuaggcucccucggaac

SEQ ID NO: 532827 - RNA, 65 nt, Homo Sapiens
uaaaauuaauauguugucagugauuagaacaacacuguuuacauaaaaaccauuuuucuaauucu

SEQ ID NO: 532828 - RNA, 65 nt, Homo Sapiens
uuauauauauaugauagauagccgcuguuaccucuuguuuacaguaagaaaaucaguuucuagaa

SEQ ID NO: 532829 - RNA, 65 nt, Homo Sapiens
auuauaagggauuugugaugagggaaaaguuauuuuguuuacauuagcucucaaguucacccuuu

SEQ ID NO: 532830 - RNA, 65 nt, Homo Sapiens
ggauaaaggauuaggcaaaagucagcuuaaaaauauguuuacauucuaggcacagaaaaaaauag

SEQ ID NO: 532831 - RNA, 65 nt, Homo Sapiens
uagccuucccaguaaaaaaacagugagaauguuuauguuuacaacguuuuggggggccaguaguu

SEQ ID NO: 532832 - RNA, 65 nt, Homo Sapiens
auuugcauaauuuuaaaagauuaaaauguaccucuuguuuacauaaguuuugcauguagaucaau

SEQ ID NO: 532833 - RNA, 65 nt, Homo Sapiens
augcuagcuggaaagucugucuuacagacacaggcuguuuacaaagaauguuuuuaauuugcuga

SEQ ID NO: 532834 - RNA, 65 nt, Homo Sapiens
uguuuaauaaagaacuguauauuuuuacagugaaguguuuacaguuuguuuauaaaguuuuaugg

SEQ ID NO: 532835 - RNA, 65 nt, Homo Sapiens
ccacuucacuggaagacgucgacagaaggaacguauguuuacaaagaguuugcacuccaguagaa

SEQ ID NO: 532836 - RNA, 65 nt, Homo Sapiens
aaugguucguguguguuaccuaaccaaauagaaucuguuuacaaagauggaaggaauacuucuau

SEQ ID NO: 532837 - RNA, 65 nt, Homo Sapiens
cuuuguaagaguggaaccaaguaauucuaaaugaauguuuacacucugagcauguacugagccuu

SEQ ID NO: 532838 - RNA, 65 nt, Homo Sapiens
uggggacaagugcuaaguaugcacgccaugggaaguguuuacacuuaaccugggagacggaagaa

SEQ ID NO: 532839 - RNA, 65 nt, Homo Sapiens
aauaaaccauguaaaugaacgaaagacaauuuuaauguuuacaaccugauaaauucuuucuuuga

SEQ ID NO: 532840 - RNA, 65 nt, Homo Sapiens
acuccaauuugaauucaggaauacuauuauuuaguuguuuacaaguuauauuuccauaguaucac

SEQ ID NO: 532841 - RNA, 65 nt, Homo Sapiens
gaugccgaacauuaggaauuuuacacaugugcugauguuuacaauaugucagacuuugcugcauu

SEQ ID NO: 532842 - RNA, 65 nt, Homo Sapiens
gaugugcuauaaaagcaccaaaagccaaguuaaacuguuuacacuaauguuuuaaaauauaaaac

SEQ ID NO: 532843 - RNA, 65 nt, Homo Sapiens
uagcgauaaaauuauuuuucugaaguaccccaaccuguuuacauuuauuuucuucuuauuuugga

SEQ ID NO: 532844 - RNA, 65 nt, Homo Sapiens
uucugguacucugugaaagaguucaagcuaaauauuguuuacauuaaaaagaugaggacucagaa

SEQ ID NO: 532845 - RNA, 65 nt, Homo Sapiens
cuaugaagguaaaguauaugaucuuugugaucaauuguuuacagcguaaaaagaaacaaagaauu

SEQ ID NO: 532846 - RNA, 65 nt, Homo Sapiens
augaugaaaauaauuuuccaauguaggggaagagauguuuacagugacuauuucaaaauguccag

SEQ ID NO: 532847 - RNA, 65 nt, Homo Sapiens
cugugaaagugauuuauuugucauuuuugauauauuguuuacagcggaaagcaaaaaauagagcu

SEQ ID NO: 532848 - RNA, 65 nt, Homo Sapiens
acgauuacucgaagaugacuuucauuccauucuauuguuuacacaugcauacaauuuaauguaau

SEQ ID NO: 532849 - RNA, 65 nt, Homo Sapiens
auuuuacugggacuuuuaaauuucuuauaugauuuuguuuacaaagggaagagccagccuugccu

SEQ ID NO: 532850 - RNA, 65 nt, Homo Sapiens
aagcgguaugaaaguuguuaaaaugucuauuuagguguuuacauugagauauuuacaacugggag

SEQ ID NO: 532851 - RNA, 65 nt, Homo Sapiens
aggcagcccuuuggguacuauuacagugacugucguguuuacaaagggaaacgaacccacugugc

SEQ ID NO: 532852 - RNA, 65 nt, Homo Sapiens
uaugaucuucuaugaaauggcaucauccuucugcuuguuuacaacuuuaauuaugucagagauug

SEQ ID NO: 532853 - RNA, 65 nt, Homo Sapiens
ugacauuaaauuauuuuuccuaguugaaaguguuguguuuacaucuaccccagcugccacuccuc

SEQ ID NO: 532854 - RNA, 65 nt, Homo Sapiens
aaagcuucuucacagaauuuuucuaauugcaaagauguuuacaucccccuauuuuuggcuuuaau

SEQ ID NO: 532855 - RNA, 65 nt, Homo Sapiens
guauguguaugucacuuucggagcagugggcacaauguuuacaaugggccaaaugaacguuugca

SEQ ID NO: 532856 - RNA, 65 nt, Homo Sapiens
acacacacacacacacacacgauuugguucaaagauguuuacagguuguuaauuuauuuuauagu

SEQ ID NO: 532857 - RNA, 65 nt, Homo Sapiens; identical to SEQ ID NO: 420673

SEQ ID NO: 532858 - RNA, 65 nt, Homo Sapiens; identical to SEQ ID NO: 420674

SEQ ID NO: 532859 - RNA, 65 nt, Homo Sapiens
uuaagauacucauuuucaguggaaagcaguuuuaauguuuacaguauuauuuaauuccuuaauuu

SEQ ID NO: 532860 - RNA, 65 nt, Homo Sapiens
uaguuuaagacuauuuaaauucuggcugccuuacuuguuuacagauucccagaucauuugaaauu

SEQ ID NO: 532861 - RNA, 65 nt, Homo Sapiens; identical to SEQ ID NO: 420675

SEQ ID NO: 532862 - RNA, 65 nt, Homo Sapiens; identical to SEQ ID NO: 420676

SEQ ID NO: 532863 - RNA, 65 nt, Homo Sapiens
aaaguuuuuuugcuuaauuaugaaguagacaugcauguuuacauuuauguaaaauauuugcugug

SEQ ID NO: 532864 - RNA, 65 nt, Homo Sapiens
cuaggggaaucucuauuacucuguacuuauacuaauguuuacaagaaugcaauauacugugaugc

SEQ ID NO: 532865 - RNA, 65 nt, Homo Sapiens
ccaacuuuguaccuugauugccuuacaaaguuauuuguuuacaaacagcgaccauauaaaagccu

SEQ ID NO: 532866 - RNA, 65 nt, Homo Sapiens
aaacuccauuauaaucuauauacauuuaaagaccguguuuacauaaucucuucuggguagaaaau

SEQ ID NO: 532867 - RNA, 65 nt, Homo Sapiens
cucccacagcuuuaaauacugaggaaaauguggccuguuuacaaaacauucagcacguugaagaa

SEQ ID NO: 532868 - RNA, 65 nt, Homo Sapiens
uguuuauacuccaguguacauaguguaauguagcguguuuacauguguagccuauguuguggucc

SEQ ID NO: 532869 - RNA, 65 nt, Homo Sapiens; identical to SEQ ID NO: 420677

SEQ ID NO: 532870 - RNA, 65 nt, Homo Sapiens; identical to SEQ ID NO: 420678

SEQ ID NO: 532871 - RNA, 65 nt, Homo Sapiens
caagaccagggaggaaaguggcaagcuguagaaaauguuuacacgcauggaggggcauugcucua

SEQ ID NO: 532872 - RNA, 57 nt, Homo Sapiens
gugcuccgaagaucggcugaagcuuccuguuuacacuuggagggaaaaguucuuuuu

SEQ ID NO: 532873 - RNA, 65 nt, Homo Sapiens
ugauagaagagugggcuuuaacuggcaggccuguauguuuacagacuaccauacuguaaauauga

SEQ ID NO: 532874 - RNA, 65 nt, Homo Sapiens
uggcugugucuaggcgcaagcacuuuagcaguaucuguuuacaugcgcaaggaucaagccgacua

SEQ ID NO: 532875 - RNA, 65 nt, Homo Sapiens
gcuuauucuuuuuguucacuggagagagagagaacuguuuacaguuaaucugugucuaauuaucu

SEQ ID NO: 532876 - RNA, 65 nt, Homo Sapiens
cuugguguauguaagcacauuuguuccuuuauaucuguuuacaaaacugugaaucaaaaagacaa

SEQ ID NO: 532877 - RNA, 65 nt, Homo Sapiens
auguuaaugaaaucaaguuccaguaacccaaaucuuguuuacaaaauauucgugguaucugugaa

SEQ ID NO: 532878 - RNA, 65 nt, Homo Sapiens
aagaauugagaaaacucugagcauuuuuaaaaguuuguuuacaauuccacaagcaaaagcucuaa

SEQ ID NO: 532879 - RNA, 65 nt, Homo Sapiens; identical to SEQ ID NO: 420679

SEQ ID NO: 532880 - RNA, 65 nt, Homo Sapiens; identical to SEQ ID NO: 420680

SEQ ID NO: 532881 - RNA, 65 nt, Homo Sapiens; identical to SEQ ID NO: 420681

SEQ ID NO: 532882 - RNA, 65 nt, Homo Sapiens
cuugcuuauuacauuuaaauccuuguguaacugaauguuuacaugucaagaggaaaagcuguaag

SEQ ID NO: 532883 - RNA, 65 nt, Homo Sapiens
ugggggguggggggagaugaaagagagucgcguuuuguuuacaguuaaagacauccaauaucuua

SEQ ID NO: 532884 - RNA, 65 nt, Homo Sapiens
ccuguagauaacgucuuuggaagaagaauguaauuuguuuacaaauuaacuuauuuauguccuaa

SEQ ID NO: 532885 - RNA, 65 nt, Homo Sapiens
gucuguaguaaauccugauguuauuuauagauaucuguuuacaaauuuucuccacccuaguuuau

SEQ ID NO: 532886 - RNA, 65 nt, Homo Sapiens
uuuauaaucucaguugauaaaacauggaaaaauuguguuuacaauaaugaaagcuaguagaugua

SEQ ID NO: 532887 - RNA, 65 nt, Homo Sapiens
acacuuaccaagaaagcacucgagacggccauucuuguuuacaaagucauguacacaaagaccau

SEQ ID NO: 532888 - RNA, 65 nt, Homo Sapiens
cccaaagaggacacugaauugcagaaguuuggggcuguuuacaaagaguacauuaagaaguacau

SEQ ID NO: 532889 - RNA, 65 nt, Homo Sapiens
uggcaaacagacuggcuggcgcagccugggcagucuguuuacagcguucuuuuggucccagagag

SEQ ID NO: 532890 - RNA, 65 nt, Homo Sapiens; identical to SEQ ID NO: 420682

SEQ ID NO: 532891 - RNA, 65 nt, Homo Sapiens; identical to SEQ ID NO: 420683

SEQ ID NO: 532892 - RNA, 65 nt, Homo Sapiens; identical to SEQ ID NO: 420684

SEQ ID NO: 532893 - RNA, 65 nt, Homo Sapiens; identical to SEQ ID NO: 420685

SEQ ID NO: 532894 - RNA, 65 nt, Homo Sapiens; identical to SEQ ID NO: 420686

SEQ ID NO: 532895 - RNA, 65 nt, Homo Sapiens
gguauaagucaguaauagcaggcuuuuguauacuguguuuacacaaagugaauuauuuugaugua

SEQ ID NO: 532896 - RNA, 65 nt, Homo Sapiens
caauauggagcaccauucuuauguccaugucuauauguuuacaagucauauccacugauuuccug

SEQ ID NO: 532897 - RNA, 65 nt, Homo Sapiens
ucugugugacugucugcuugaacucacagaacauuuguuuacaaugugacaucucuuguacacug

SEQ ID NO: 532898 - RNA, 65 nt, Homo Sapiens
uuggcaaaguugcaguuuguugaaaugcuuuaccuuguuuacaguucccuugaacuuugaaccug

SEQ ID NO: 532899 - RNA, 65 nt, Homo Sapiens
auuuuaaccuauaugauuuuaggcucuaggccagauguuuacauaguuaugugaguugaaucaag

SEQ ID NO: 532900 - RNA, 65 nt, Homo Sapiens; identical to SEQ ID NO: 420687

SEQ ID NO: 532901 - RNA, 65 nt, Homo Sapiens; identical to SEQ ID NO: 420688

SEQ ID NO: 532902 - RNA, 65 nt, Homo Sapiens
aaguguguuuuucuuugguuagcauaguguucuguuguuuacauguuuauuguagaacuaaacuu

SEQ ID NO: 532903 - RNA, 65 nt, Homo Sapiens
uacuuuuuuuuaauagcaauaggguuuuuuuuuucuguuuacauaaguuuuucuguugaaacuag

SEQ ID NO: 532904 - RNA, 65 nt, Homo Sapiens
uagaauaauguuuuuuucuuagaguugagugaaucuguuuacauuaaguuuucuacaacaaaaaa

SEQ ID NO: 532905 - RNA, 65 nt, Homo Sapiens
gcaaaaagaaaaaagaggaauugguucaugugcauuguuuacaaauuuaaagcugaaaaauacau

SEQ ID NO: 532906 - RNA, 65 nt, Homo Sapiens
cagugccagcacaagguagugaggcuggggcagaauguuuacagcacugaguuagggugcaggca

SEQ ID NO: 532907 - RNA, 65 nt, Homo Sapiens
aaaauaaaguauucacuacccccucaaaacuaacuuguuuacaacaggaggaccacgaggaaaua

SEQ ID NO: 532908 - RNA, 65 nt, Homo Sapiens
cagaugaaauaaauuuauucaacuauuaaacaccuuguuuacagaugcauuuaaaaaaaugccau

SEQ ID NO: 532909 - RNA, 65 nt, Homo Sapiens
uuacguacuaaggauacagggacccuucgugacaauguuuacaaaugcauauauuaaagcaucag

SEQ ID NO: 532910 - RNA, 65 nt, Homo Sapiens
uguuugaauuugugaucugaugaacagaagcuuaauguuuacaaggaauccucuucccaggggau

SEQ ID NO: 532911 - RNA, 65 nt, Homo Sapiens
ucuaaauaaugaaauguguucuacuuuuaaauaaauguuuacauuauucauuuuuaacuugcuac

SEQ ID NO: 532912 - RNA, 65 nt, Homo Sapiens
cugaauucuguaauaugaacuuggguacacugaaauguuuacauagauaaauucauaaugcuuuu

SEQ ID NO: 532913 - RNA, 65 nt, Homo Sapiens
uccuugacagucccacgcccuucaguuuuccucucuguuuacagcagcuggagugggguacagag

SEQ ID NO: 532914 - RNA, 65 nt, Homo Sapiens; identical to SEQ ID NO: 420689

SEQ ID NO: 532915 - RNA, 65 nt, Homo Sapiens; identical to SEQ ID NO: 420690

SEQ ID NO: 532916 - RNA, 65 nt, Homo Sapiens
auguauuuuaauuggcaaauaauacuuguauauauuguuuacaacuuguuuuaaaguaugaauac

SEQ ID NO: 532917 - RNA, 65 nt, Homo Sapiens
gcaguaucacaggccagauguuguuccuggcuagauguuuacauuuguaagaaauaacacuguga

SEQ ID NO: 532918 - RNA, 65 nt, Homo Sapiens
aagccgagguggggggauauggggauucaggcaauuguuuacacacuuugaauaacugcaaagga

SEQ ID NO: 532919 - RNA, 65 nt, Homo Sapiens
gguuaucagcucuuuaagagcucuauuaauugccauguuuacaaacaaacacaaagagagaaguu

SEQ ID NO: 532920 - RNA, 65 nt, Homo Sapiens
guguuuuuugcaaauuagagcaggacaaacuuuuauguuuacagggcacgucuguuguaaugcaa

SEQ ID NO: 532921 - RNA, 65 nt, Homo Sapiens
uauauuuuugacacaauuaaauauuacauagaguauguuuacaacaaauauccugucagccaaau

SEQ ID NO: 532922 - RNA, 65 nt, Homo Sapiens
guauguucaacucucauccaaauggcauaugacccuguuuacacagccuaaagcuaaaaauauua

SEQ ID NO: 532923 - RNA, 65 nt, Homo Sapiens
cuacaaaaaaacuuuuaaaacuuugccauuucaucuguuuacacucuuugccacugauuagcagu

SEQ ID NO: 532924 - RNA, 65 nt, Homo Sapiens
ucuuuauuaugaaacuuuaucacauucgaaauguuuguuuacagugggauuuuaggggggauugu

SEQ ID NO: 532925 - RNA, 65 nt, Homo Sapiens
guguaguaaugaaaauaccaaguugcaacauuacauguuuacaaaaaaaaaucuguguuuguagu

SEQ ID NO: 532926 - RNA, 65 nt, Homo Sapiens
ggcaacagauuuugccuccccgaucagugugugccuguuuacagcacuaucuaucuuucucucuc

SEQ ID NO: 532927 - RNA, 65 nt, Homo Sapiens
auucuauuuaagaaagcuaguggacaaucaguguauguuuacaauuguuuauacacuguucucca

SEQ ID NO: 532928 - RNA, 65 nt, Homo Sapiens
aagucaacuaagcuacuuuuagauuuggaaauugcuguuuacagucuaacaacauuaaaaugaga

SEQ ID NO: 532929 - RNA, 65 nt, Homo Sapiens
ggcccacagugacuuuugcugggcauuuucccagauguuuacagacugugaguacagcagaaaau

SEQ ID NO: 532930 - RNA, 65 nt, Homo Sapiens
uuguuaaugcauuuuugaugggaagaaaagguacauguuuacaaagagguuuuaugaaaagaaua

SEQ ID NO: 532931 - RNA, 65 nt, Homo Sapiens; identical to SEQ ID NO: 420691

SEQ ID NO: 532932 - RNA, 65 nt, Homo Sapiens; identical to SEQ ID NO: 420692

SEQ ID NO: 532933 - RNA, 65 nt, Homo Sapiens
cuagugcguugacggcaccgacuguugccugucaguguuuacaaauuuuuuuuuaauguaucuua

SEQ ID NO: 532934 - RNA, 65 nt, Homo Sapiens
caccauagggauucaaaagaugagcauuuaaaaacuguuuacagcacucacauuccuugaagcua

SEQ ID NO: 532935 - RNA, 65 nt, Homo Sapiens
caaauaauuuugggagcugccucauggggagaaaauguuuacagagaucauguuccuaaaagaug

SEQ ID NO: 532936 - RNA, 65 nt, Homo Sapiens
aaaaauucuguaaauuguuucuaguaaugagcuucuguuuacaauguugauucaguuuguaauaa

SEQ ID NO: 532937 - RNA, 65 nt, Homo Sapiens
acaguaguguucuguucacuuccuguuuuuccuuuuguuuacaacaccaugugcaaacugaucca

SEQ ID NO: 532938 - RNA, 65 nt, Homo Sapiens
caaacaaaguaggauuuacaacaaauguuggagcauguuuacauauccaucugggaaugauuaac

SEQ ID NO: 532939 - RNA, 65 nt, Homo Sapiens
uaguaaauuuauuuucagcuuuuuuuuuuuguguguguuuacaagaagauacaaaaaaucuugua

SEQ ID NO: 532940 - RNA, 65 nt, Homo Sapiens
acagaaaaggcuaagcagaaaaauaaauguacaauuguuuacauauccugaaguuuuagaauggc

SEQ ID NO: 532941 - RNA, 65 nt, Homo Sapiens
guagaaugauuaaaucaaugugauguuuugauauauguuuacaguuauauauauggaguacaaug

SEQ ID NO: 532942 - RNA, 65 nt, Homo Sapiens
aaaaaguccagacacacuguuaaaucaagcauguuuguuuacauuguccuugcucugaaaauugg

SEQ ID NO: 532943 - RNA, 65 nt, Homo Sapiens
aaauuggacagggaugcagaaauuucuacaaauguuguuuacaucuaaacuuucuuaacaaaccc

SEQ ID NO: 532944 - RNA, 65 nt, Homo Sapiens
ucaacuacggggauguuccauuccuuccuauacauuguuuacacuaugcaucaucuuaucauaua

SEQ ID NO: 532945 - RNA, 65 nt, Homo Sapiens
auugauuuaauaugagaggacaagcaauugucuuuuguuuacaaguaaaacuuaacaggccauca

SEQ ID NO: 532946 - RNA, 65 nt, Homo Sapiens
uuaggaguacugauagggguaccuuaguuccuuacuguuuacaguccuaauguguuucuuuugac

SEQ ID NO: 532947 - RNA, 65 nt, Homo Sapiens
aauagugguguuuuuaccuauagaguccucaauuguguuuacauugaaaaacaaagugacaauug

SEQ ID NO: 532948 - RNA, 65 nt, Homo Sapiens
gcuuaacuaauuuauuugcuacuaaaauggacaauuguuuacaaguuuuuuuuuuaagauauaug

SEQ ID NO: 532949 - RNA, 65 nt, Homo Sapiens
uauacauuuugaagaugaaaccuugucaagggcucuguuuacaucagcaguucuacauuaaauca

SEQ ID NO: 532950 - RNA, 65 nt, Homo Sapiens
uuucaucaggaaaucccaaaguuuccaaagcuuuuuguuuacagaauaaaacuucaaauaaaacc

SEQ ID NO: 532951 - RNA, 65 nt, Homo Sapiens
aacauuuguguuucaacaagggacaguaaacuguguguuuacagccaaaagaaaugccucauagu

SEQ ID NO: 532952 - RNA, 65 nt, Homo Sapiens
aguuuuccuuagaaaaagcuuuugcuaucuuauccuguuuacauuauuucuuuauuuuaauucug

SEQ ID NO: 532953 - RNA, 65 nt, Homo Sapiens
cccauuauuauccacccugagccaccauaauaugcuguuuacauuuauuuucuucagccugugca

SEQ ID NO: 532954 - RNA, 65 nt, Homo Sapiens
uagccacuagaaagagaaauaaacccaauggcauguguuuacaggaagaaagauuaccuucagau

SEQ ID NO: 532955 - RNA, 65 nt, Homo Sapiens
gcaugucacuagguaacacagauccauccagaugguguuuacauuugauuuauuugggaucuuau

SEQ ID NO: 532956 - RNA, 65 nt, Homo Sapiens
uaaaccccuuugauuuaaaaauguauuuuuaaaaauguuuacauugaugaugaguaauauugcau

SEQ ID NO: 532957 - RNA, 65 nt, Homo Sapiens
aagacuguauuuagaucucauaaugcuuuguuaaauguuuacaaguaaauaguuugaauucagua

SEQ ID NO: 532958 - RNA, 65 nt, Homo Sapiens
caacauuuuacuuuuuaucauugauguguucaaacuguuuacaaggagaugcuuauagaugauag

SEQ ID NO: 532959 - RNA, 65 nt, Homo Sapiens
ucuuaagaccacucagcaugacgacugaguagacuuguuuacaucugaucaaagcacugggcuug

SEQ ID NO: 532960 - RNA, 65 nt, Homo Sapiens
uuucaaccuuuuagggugauaaauacauguauaauuguuuacauacuuaaaaggaaaaaguugag

SEQ ID NO: 532961 - RNA, 65 nt, Homo Sapiens
auuggcgcugagauccaggcuggauccauugcuuuuguuuacaauaggcacucucucuaccccac

SEQ ID NO: 532962 - RNA, 65 nt, Homo Sapiens
guacugccaggcaugugggugugggugcauguggguguuuacacacaugccuacagguaugcgug

SEQ ID NO: 532963 - RNA, 65 nt, Homo Sapiens
ggaaucccuugggggagauauuaggagugcucuguuguuuacaaacucagguacccgcagggccu

SEQ ID NO: 532964 - RNA, 65 nt, Homo Sapiens; identical to SEQ ID NO: 420693

SEQ ID NO: 532965 - RNA, 65 nt, Homo Sapiens; identical to SEQ ID NO: 420694

SEQ ID NO: 532966 - RNA, 65 nt, Homo Sapiens
ucuacuaauauuuacuugugauugugugacaaguguguuuacagauuauugguuacacuucaauu

SEQ ID NO: 532967 - RNA, 65 nt, Homo Sapiens
ccacuucauuugaaaauaaugaaaccauguaccacuguuuacaucaucuguagugauuucauaga

SEQ ID NO: 532968 - RNA, 65 nt, Homo Sapiens
agcugcugcucucguacuaacugugccagugcccauguuuacagaagucaggggaaggaaggagc

SEQ ID NO: 532969 - RNA, 65 nt, Homo Sapiens
acuuuuguuauacacauuugcuuuguguaaauaaauguuuacaauuuuauaugaaagauggaaua

SEQ ID NO: 532970 - RNA, 65 nt, Homo Sapiens; identical to SEQ ID NO: 420695

SEQ ID NO: 532971 - RNA, 65 nt, Homo Sapiens; identical to SEQ ID NO: 420696

SEQ ID NO: 532972 - RNA, 65 nt, Homo Sapiens
aguuccuauaccuuacugaccauuccagaacaaauuguuuacauaaaccauuuaaagaaagaaug

SEQ ID NO: 532973 - RNA, 65 nt, Homo Sapiens
uagugcaauggcgcaauccuugccauugccuuucuuguuuacagaauguaugguuagaguccaau

SEQ ID NO: 532974 - RNA, 65 nt, Homo Sapiens
uaauuuuauaucaugucuuuuuuaaauguauuguuuguuuacauuuauuuuucuaauuauugcuu

SEQ ID NO: 532975 - RNA, 65 nt, Homo Sapiens
cauguauuuauugcaauguaacagucuuguuugucuguuuacaaccaaaugaccuuaccuguaau

SEQ ID NO: 532976 - RNA, 65 nt, Homo Sapiens
agaaaaaaagucaaaauuaugaaaaaugguuaacauguuuacacaguguacuuuuucaugaaaag

SEQ ID NO: 532977 - RNA, 65 nt, Homo Sapiens
augauauuauaaauaaauaaagugcacagugugauuguuuacaaauucuuauuguugaauaaaaa

SEQ ID NO: 532978 - RNA, 65 nt, Homo Sapiens
aagaaucaaauaccacuaugagcacugccuacaccuguuuacaaaaggcgcuagaucaaggucac

SEQ ID NO: 532979 - RNA, 65 nt, Homo Sapiens
ucuguuuugaaauguuugccaaaagggaagcauuauguuuacaaauuucaaagugcugccaguug

SEQ ID NO: 532980 - RNA, 65 nt, Homo Sapiens
uuuccuguuguacauuuagguagaguuccacgguuuguuuacacauacuaugcaauaauauaacu

SEQ ID NO: 532981 - RNA, 65 nt, Homo Sapiens
guacacugcgaccaccuugcauuuccaaagcuacuuguuuacauuaacacucaaggacuuuguuc

SEQ ID NO: 532982 - RNA, 65 nt, Homo Sapiens
auccaacagugcacucaucaauguauaaucaguaguguuuacaagccacuaagaauacaguuuga

SEQ ID NO: 532983 - RNA, 65 nt, Homo Sapiens
aguagcaaaaauauauuuaugaaaaucacacauuauguuuacauagugcccaacuuucagaagag

SEQ ID NO: 532984 - RNA, 65 nt, Homo Sapiens
ugucagaaauaagcauuucuuguucauugaaauucuguuuacacuagaaagaaaauuagaaaauc

SEQ ID NO: 532985 - RNA, 65 nt, Homo Sapiens
uaucucuauguuuaccuuuuuuccuuuuuuuuuaauguuuacauuaaaguuaauauacuaaaggg

SEQ ID NO: 532986 - RNA, 65 nt, Homo Sapiens
uauccaguuuuagaagagaguuuuuuuuuuuuuaauguuuacaauacuugaauaguucuacaguc

SEQ ID NO: 532987 - RNA, 65 nt, Homo Sapiens
uuuguuuuuauggcauuucuaaaguucugauaccuuguuuacauggugagauguuucagugaacc

SEQ ID NO: 532988 - RNA, 65 nt, Homo Sapiens
ggauauacauaguugaaaucaggauuaaucugguguguuuacauacugcauauauaugaaugacu

SEQ ID NO: 532989 - RNA, 65 nt, Homo Sapiens
gucccuguguauguuggacuuccggcccgcgccccuguuuacagccccacuuugcacacccgcuc

SEQ ID NO: 532990 - RNA, 65 nt, Homo Sapiens
auguguagugguaugccccugcuguuuaaagcagcuguuuacaggccuuuggucaaucauaacau

SEQ ID NO: 532991 - RNA, 65 nt, Homo Sapiens
aauaugugaaaaaagauuuaauguacuaaauccuauguuuacauuaacugucauuguacuaauua

SEQ ID NO: 532992 - RNA, 65 nt, Homo Sapiens
gugauauuuucuauuaaaucauggaucaauggauuuguuuacaaucgucauucuguuuuaagcuc

SEQ ID NO: 532993 - RNA, 65 nt, Homo Sapiens
agugagagggagaucaaaagcaaagauggcaaaauuguuuacaccgacaagugcuucuaaaccuu

SEQ ID NO: 532994 - RNA, 65 nt, Homo Sapiens
uucauuaaaaacuaaaaacuaaaugggagcuuuuuuguuuacaaggggauuuuguuuuuauuuug

SEQ ID NO: 532995 - RNA, 65 nt, Homo Sapiens
uuugcauagacuacacacaugagaauagcuucauauguuuacacggaggaaaugggcauagagua

SEQ ID NO: 532996 - RNA, 65 nt, Homo Sapiens
acuggggaggcuccacccaggucccugaacugagcuguuuacagggguggccagcuuguacacca

SEQ ID NO: 532997 - RNA, 65 nt, Homo Sapiens
auuuguacaucuaugcaaaauguccaccuauuaauuguuuacaauaaacagaucuucuucucucu

SEQ ID NO: 532998 - RNA, 65 nt, Homo Sapiens
auuaaaauugcaguguuccuuggaggcuuauuccauguuuacacagugaaaauggaguucugggu

SEQ ID NO: 532999 - RNA, 65 nt, Homo Sapiens
uggggaucagagcagacuucggagaagggaaucauuguuuacacauguguccugaagucgccaga

SEQ ID NO: 533000 - RNA, 65 nt, Homo Sapiens
cauugaugaucacugugaaaauugaccaagugauguguuuacauuuacugaaaugcgcucuuuaa

SEQ ID NO: 533001 - RNA, 65 nt, Homo Sapiens
uucucauguagaacaagaaaucuuucuggaauugauguuuacaugucuguuguuggucaucucuc

SEQ ID NO: 533002 - RNA, 65 nt, Homo Sapiens
cacacaguuuaaaaaaucagccccuaauuucuccauguuuacacuucaaucugcaggcuucuuaa

SEQ ID NO: 533003 - RNA, 65 nt, Homo Sapiens
cagaauguguaauagcucacaauaaguagguauuauguuuacauauuauguuuguauuuaugcua

SEQ ID NO: 533004 - RNA, 65 nt, Homo Sapiens
ugaugucugggccuucggugugcugaugugggaaguguuuacacauggagagaugccccauggug

SEQ ID NO: 533005 - RNA, 65 nt, Homo Sapiens
uugcccuuccccucccucgggaagccaccuaagaauguuuacaugccaaacagaauguaacaccc

SEQ ID NO: 533006 - RNA, 65 nt, Homo Sapiens
auccaggccgggccuauacagaggugcuggcugcuuguuuacauucuccucuggggcucuaccuc

SEQ ID NO: 533007 - RNA, 65 nt, Homo Sapiens
guuaacagcucauaucaggagcugugauaaguaaguguuuacauacacugucuagugcauaaaaa

SEQ ID NO: 533008 - RNA, 65 nt, Homo Sapiens
guagggccuacaugguuauuugccugcucacuuuauguuuacaucucccacauucauaccaauau

SEQ ID NO: 533009 - RNA, 65 nt, Homo Sapiens
ccuugaagguauaucuagguuuaugacaguaauuguguuuacauuuuauggugccuaguauugac

SEQ ID NO: 533010 - RNA, 65 nt, Homo Sapiens; identical to SEQ ID NO: 420697

SEQ ID NO: 533011 - RNA, 65 nt, Homo Sapiens; identical to SEQ ID NO: 420698

SEQ ID NO: 533012 - RNA, 65 nt, Homo Sapiens
uagucacaauuggguagaugugacauccauauacuuguuuacauuuuaucuguucucaugucaaa

SEQ ID NO: 533013 - RNA, 65 nt, Homo Sapiens
ggcuuuuuacuuugcuagaacaacaaacuaucuuauguuuacauacugguuuacaauguuauuua

SEQ ID NO: 533014 - RNA, 65 nt, Homo Sapiens
aaagucaaauguguauguucuaccuccaacggaaauguuuacaaggucaagacuuaauucaauuc

SEQ ID NO: 533015 - RNA, 65 nt, Homo Sapiens
uuucucauggauuuuuguggugugggccaauaugguguuuacauuauauaauuccugcuguggca

SEQ ID NO: 533016 - RNA, 65 nt, Homo Sapiens
gaguggcaucagucucacucaucuuggugccccgguguuuacaagagccagauggugucagagga

SEQ ID NO: 533017 - RNA, 65 nt, Homo Sapiens
aguggaaguuuucccuaugagccuacagucuguauuguuuacauuaagaaacucucuauuauugu

SEQ ID NO: 533018 - RNA, 65 nt, Homo Sapiens
ggcuuuugucauuguugccaucauauggaagauaauguuuacauccuuuuaaacauuuuuauaug

SEQ ID NO: 533019 - RNA, 65 nt, Homo Sapiens
agggugaaggaggucaggccccacuccuuccugauuguuuacagucauuggaauaaggcauggcu

SEQ ID NO: 533020 - RNA, 65 nt, Homo Sapiens
augauacuuucuaaauaaacgugguacaauuuguuuguuuacacuuguauuccaagaaaaucaaa

SEQ ID NO: 533021 - RNA, 65 nt, Homo Sapiens
aaaauguuaauuauauucuauuguucagauuaaaauguuuacaacgucuccaaauaaaaaggguu

SEQ ID NO: 533022 - RNA, 65 nt, Homo Sapiens
uggauuuuccuguaauaaacucuuuuacuguacauuguuuacaucaauuuuuaguuguauucuau

SEQ ID NO: 533023 - RNA, 65 nt, Homo Sapiens
ggggaggggagggguucguagaucucgcagcacuguguuuacaggaggaagccuucucugccagc

SEQ ID NO: 533024 - RNA, 65 nt, Homo Sapiens
acugguggacaaguguaaauggaaaccaggggcaauguuuacaagagaagaaccuggaggacgga

SEQ ID NO: 533025 - RNA, 65 nt, Homo Sapiens
cagggacaguuucgucucccgaguuuccauggugauguuuacauccucacuggcaaguguuugug

SEQ ID NO: 533026 - RNA, 65 nt, Homo Sapiens
gaaccucagcucccgucugcgaacccugagagugcuguuuacagaggcucuugguggaggcaggg

SEQ ID NO: 533027 - RNA, 65 nt, Homo Sapiens
ccuuauuggcaugucaacucagcucuuuuguuuacuguuuacaccguuugaaaugcagcgugagu

SEQ ID NO: 533028 - RNA, 65 nt, Homo Sapiens
acacccagaacagugguaaaggaccacaugugagauguuuacaaggagccuggaaaaaaaaauua

SEQ ID NO: 533029 - RNA, 65 nt, Homo Sapiens
aaauaaagaaauauuuaguaaaacccaguagucauuguuuacagccauguauacaucauaguuca

SEQ ID NO: 533030 - RNA, 65 nt, Homo Sapiens
aguuucaaaaaugacaaaguuuccauugagaggaauguuuacagcuauuuguugggcagaggcug

SEQ ID NO: 533031 - RNA, 65 nt, Homo Sapiens
uaccuuaucaaaccuagaauaggagucauggcaucuguuuacauuuguggguuuucuguuugaaa

SEQ ID NO: 533032 - RNA, 65 nt, Homo Sapiens
uuuuuguaugguauuuuaagucuaaaccauccuuuuguuuacacaauuuuauaaugcccugcaac

SEQ ID NO: 533033 - RNA, 65 nt, Homo Sapiens
gcagccuacuggauugucucgauuuauaaucauaauguuuacaauuaauaauggcaguacuaaga

SEQ ID NO: 533034 - RNA, 65 nt, Homo Sapiens; identical to SEQ ID NO: 420699

SEQ ID NO: 533035 - RNA, 65 nt, Homo Sapiens; identical to SEQ ID NO: 420700

SEQ ID NO: 533036 - RNA, 65 nt, Homo Sapiens
gauauuggcugcuuuuuuuacaucucacaauguacuguuuacauggagcuaucaaucaaauuuua

SEQ ID NO: 533037 - RNA, 65 nt, Homo Sapiens
uauguuucuguuuauaaccaugcuuauaauacuaauguuuacagaaaccaccuuuaauauuacac

SEQ ID NO: 533038 - RNA, 65 nt, Homo Sapiens
cugucuauugguaugcaaucaacgaaaauuuccuauguuuacagucaguaaacccaucuuuccuu

SEQ ID NO: 533039 - RNA, 65 nt, Homo Sapiens
uaaaauguuucugccacaaaggcagagagccuugcuguuuacaauccuguucaucugggcugccu

SEQ ID NO: 533040 - RNA, 65 nt, Homo Sapiens
ccugcuuuuugcuuauaauucuaugacaaaauugauguuuacagguuuccuuucucuguuucagc

SEQ ID NO: 533041 - RNA, 65 nt, Homo Sapiens
cggaccuguucucuuccgacacagagcauucugaguguuuacaggguucuagucccacuugucaa

SEQ ID NO: 533042 - RNA, 65 nt, Homo Sapiens
cacaagcuuugcguucugacaaauguuucucuugauguuuacauguguaaacugucagggugaua

SEQ ID NO: 533043 - RNA, 65 nt, Homo Sapiens
ucauuuuuauguuccugcuucuggcucagcaguuauguuuacacacugacucagcacuuuguuca

SEQ ID NO: 533044 - RNA, 65 nt, Homo Sapiens
uguuguaaaagccauauuucuaauggaaaaucagguguuuacaggaaagaucucagaggcuauga

SEQ ID NO: 533045 - RNA, 65 nt, Homo Sapiens
uuuuguccuauggaaaauacuguaauucaggauuauguuuacaauugauccagguguuuguuucu

SEQ ID NO: 533046 - RNA, 65 nt, Homo Sapiens; identical to SEQ ID NO: 420701

SEQ ID NO: 533047 - RNA, 65 nt, Homo Sapiens; identical to SEQ ID NO: 420702

SEQ ID NO: 533048 - RNA, 65 nt, Homo Sapiens
uagacauuguucaacuguauguuauuggcacguguuguuuacauuuugcugugacauuuaaaaau

SEQ ID NO: 533049 - RNA, 65 nt, Homo Sapiens
aaguuauuuauaacagagaccucuagugcugcacuuguuuacacaccuuugaaaaucuggaaaug

SEQ ID NO: 533050 - RNA, 65 nt, Homo Sapiens
aaauguaucuuaugaauagagacauauuaaaauaauguuuacaucuuagaaaaaacauagauagu

SEQ ID NO: 533051 - RNA, 65 nt, Homo Sapiens
uuuacuguuguacaaucauguucuggugguuugauuguuuacaggauauuccaaaauaaaaggac

SEQ ID NO: 533052 - RNA, 65 nt, Homo Sapiens
uuaauuaauaggcuuuauuuguaagagcaguuuuauguuuacagaaaaauuaggcacaaagggau

SEQ ID NO: 533053 - RNA, 65 nt, Homo Sapiens
gguuuugaugugucugauuuugacuacucaagcucuguuuacagaagaaaauugaauggcgaggg

SEQ ID NO: 533054 - RNA, 65 nt, Homo Sapiens
auauucuagaauagauacuguauuaaauauugccauguuuacaauauguaauauguuuuuagccg

SEQ ID NO: 533055 - RNA, 65 nt, Homo Sapiens
aagcuaugcacccaguuggccuuagaaaaccacaauguuuacagcccugucuuagggccgcggcu

SEQ ID NO: 533056 - RNA, 65 nt, Homo Sapiens
ucuuugcuucaggagucucagcuagggaguugaaguguuuacaucagacugucuugugcaauucu

SEQ ID NO: 533057 - RNA, 65 nt, Homo Sapiens
uauuaacaauucccccagaacauggaaauaaccauuguuuacagagcugagcauuggugacaggg

SEQ ID NO: 533058 - RNA, 65 nt, Homo Sapiens
auguauggaaauucuuaggauuuuuuuaccagcuuuguuuacagacccaaauguaaauauuaaaa

SEQ ID NO: 533059 - RNA, 57 nt, Homo Sapiens
uaugggagacauccauuuaagaucaacuguuuacaugugauacaucgaaaacuguuu

SEQ ID NO: 533060 - RNA, 56 nt, Homo Sapiens
agauauguucccaguuguagaauuacuguuuacacacauuuuuguucaauauugau

SEQ ID NO: 533061 - RNA, 65 nt, Homo Sapiens
gcacuuauuuuuuaagagggaaaggacuuuggucauguuuacauuggccuuugguuuuuuuuuuu

SEQ ID NO: 533062 - RNA, 65 nt, Homo Sapiens
cggguucaguaccauggacagcgcccucgacccgcuguuuacaaccaugaccccuuggacacugg

SEQ ID NO: 533063 - RNA, 65 nt, Homo Sapiens
guuuuguauuuucuauacugguguuagaaaacauauguuuacauuugauuaacuguguugccuau

SEQ ID NO: 533064 - RNA, 65 nt, Homo Sapiens
aauuauuaccaugaguauaauuuuaagaaugaaaauguuuacaguauuuucaguuuuauuauaaa

SEQ ID NO: 533065 - RNA, 65 nt, Homo Sapiens
augcgaacagguaccuaucuguuucuaaauaaaacuguuuacauucauuaugggguauguaugac

SEQ ID NO: 533066 - RNA, 65 nt, Homo Sapiens
uauugccaaaaucaaauaaauggcuucucagcugcuguuuacaacaaacuucccuaaccaaaaca

SEQ ID NO: 533067 - RNA, 65 nt, Homo Sapiens
gcuucacggucacgcucguccguccugcaguggcguguuuacauggucacacguguguguaucac

SEQ ID NO: 533068 - RNA, 65 nt, Homo Sapiens
ugcuauagagaacauucuuccaagauaaauauguguguuuacacauaugucugcaugcaugugaa

SEQ ID NO: 533069 - RNA, 65 nt, Homo Sapiens
acgccauggggccgcugcugcuuaugugguuggauuguuuacaagccucauuauuaaaacugaag

SEQ ID NO: 533070 - RNA, 65 nt, Homo Sapiens
uugggaaaaaaauuaguuuauuagucuggucauuuuguuuacacaugaaauggccaggcacaaau

SEQ ID NO: 533071 - RNA, 65 nt, Homo Sapiens
guggauuuugacauaaaugauucauucauuagcccuguuuacaauucaaaaagcaugaacucguu

SEQ ID NO: 533072 - RNA, 65 nt, Homo Sapiens
auuaauucaucccuuaauuuaagagaugcacuauauguuuacacagaguccaggagcucaggaag

SEQ ID NO: 533073 - RNA, 65 nt, Homo Sapiens
guuccgugguuaaacucgcuuuuaaaggcccuaucuguuuacagugaaaagagaugaugaaaaua

SEQ ID NO: 533074 - RNA, 65 nt, Homo Sapiens
aucagaugauccacagaauuguaucuuuuugaaaauguuuacaucguuauuuuccaaaggauuuu

SEQ ID NO: 533075 - RNA, 65 nt, Homo Sapiens
guugcuaaucauuacaaaacggaaaaaccuggugguguuuacaauaaagacuagcaguuaguguu

SEQ ID NO: 533076 - RNA, 65 nt, Homo Sapiens
agagaaagaggccagacauguagagaaaagauguuuguuuacauaagacagugcccugagaccuc

SEQ ID NO: 533077 - RNA, 65 nt, Homo Sapiens
ggugggaaauucagcugaguauggcauuauguggauguuuacaauaauauacaugaacuuuuuuc

SEQ ID NO: 533078 - RNA, 65 nt, Homo Sapiens
cauggaaaacagaguauuucguauuguucuauuuuuguuuacaaauccaaucacaguguuaugua

SEQ ID NO: 533079 - RNA, 65 nt, Homo Sapiens
uuaagccuuaacauguaucuguuugccuuccaaaguguuuacaccauaauuuuuuucacuaagcu

SEQ ID NO: 533080 - RNA, 65 nt, Homo Sapiens
uccggccaggaccccggccccaagugucagucgaguguuuacagacuuccgcccggaggaaugaa

SEQ ID NO: 533081 - RNA, 65 nt, Homo Sapiens
auauuuaagucuugugaaacuagucuccucccuguuguuuacagcaccagaggugugacaggcuc

SEQ ID NO: 533082 - RNA, 65 nt, Homo Sapiens
gaguuuaguuuuuaagacaugaugaagauacuguuuguuuacaaaauguaauuuuaugcuucaga

SEQ ID NO: 533083 - RNA, 65 nt, Homo Sapiens
uuuucagccagacagaggcauaauaaagugacugauguuuacagaacccaaaugaugucuuccuc

SEQ ID NO: 533084 - RNA, 65 nt, Homo Sapiens
uaauuuauaauuagggauuguucaaacuucagaucuguuuacagguuguaaaaauaaacuucggu

SEQ ID NO: 533085 - RNA, 65 nt, Homo Sapiens
aaauugugagguuaauguuuaaaaagcuuuacaccuguuuacaauuuggggacaaaaaggcaggc

SEQ ID NO: 533086 - RNA, 65 nt, Homo Sapiens
uccuugcugacuuguguugcauuguauuccaaacguguuuacagguucucuuaagcaauguugua

SEQ ID NO: 533087 - RNA, 65 nt, Homo Sapiens
ccccacacccuuauuuucagauucuggaucauucuuguuuacaacugaaauauauauaaccucag

SEQ ID NO: 533088 - RNA, 65 nt, Homo Sapiens
aagcuuuguauuauucuuccacauaugcuggcugcuguuuacacacccugccaaugccuuagcac

SEQ ID NO: 533089 - RNA, 65 nt, Homo Sapiens
ugaacuuucaaagcuugcuauuaaaucauuuagaauguuuacauuuacuaaggugugcuggguca

SEQ ID NO: 533090 - RNA, 65 nt, Homo Sapiens
cuuguguguuacauguaacagacaugguaaauauuuguuuacagucuuuguuuaacaaaccaugc

SEQ ID NO: 533091 - RNA, 65 nt, Homo Sapiens
ucuauucucuccaaaaaugcacccaacuagcucuauguuuacaaauggacauaggacucaaaguu

SEQ ID NO: 533092 - RNA, 65 nt, Homo Sapiens
aaguguuuaaaacuuuugacaagugguaguccuacuguuuacacucacaguuaauguucauaccu

SEQ ID NO: 533093 - RNA, 65 nt, Homo Sapiens
uuugaauaccuugauguuuugcauuacuucauuuauguuuacaucauguuuagaaauguuuucau

SEQ ID NO: 533094 - RNA, 65 nt, Homo Sapiens
gaaauuggaaggauucauugagcagcauagaaguuuguuuacauguuacuuugagaugcuaggua

SEQ ID NO: 533095 - RNA, 65 nt, Homo Sapiens
uaguuuaucaaaccaaauacugugaacguaccagguguuuacagauuuaaaugcauguuaccaua

SEQ ID NO: 533096 - RNA, 65 nt, Homo Sapiens; identical to SEQ ID NO: 420703

SEQ ID NO: 533097 - RNA, 65 nt, Homo Sapiens; identical to SEQ ID NO: 420704

SEQ ID NO: 533098 - RNA, 65 nt, Homo Sapiens
uauguauacaucugaaugaaaagcaaagcuaaauauguuuacagaccaaagugugauuucacacu

SEQ ID NO: 533099 - RNA, 65 nt, Homo Sapiens
acacugagaccuguuguuuuuggagguuuugaugguguuuacaacagauuauaagccuaauggug

SEQ ID NO: 533100 - RNA, 65 nt, Homo Sapiens; identical to SEQ ID NO: 420705

SEQ ID NO: 533101 - RNA, 65 nt, Homo Sapiens; identical to SEQ ID NO: 420706

SEQ ID NO: 533102 - RNA, 65 nt, Homo Sapiens; identical to SEQ ID NO: 420707

SEQ ID NO: 533103 - RNA, 65 nt, Homo Sapiens; identical to SEQ ID NO: 420708

SEQ ID NO: 533104 - RNA, 65 nt, Homo Sapiens
auggcgaccaccaaagucaaucauuucugccaugauguuuacaagaaaaagagcuggugguuuga

SEQ ID NO: 533105 - RNA, 65 nt, Homo Sapiens
ggaccuauggaaacaaaggcaaaggaaaaugucaguguuuacaugaaacagaagagcagggacau

SEQ ID NO: 533106 - RNA, 65 nt, Homo Sapiens
uuuucuagagcagcugugcgagcacagugccguguuguuuacagcacaggcgguuugugcaggaa

SEQ ID NO: 533107 - RNA, 65 nt, Homo Sapiens
auacaacuguguuacuguauuuuuacuggacaugauguuuacaagcauuucuauuuguuacuccu

SEQ ID NO: 533108 - RNA, 65 nt, Homo Sapiens; identical to SEQ ID NO: 420709

SEQ ID NO: 533109 - RNA, 65 nt, Homo Sapiens; identical to SEQ ID NO: 420710

SEQ ID NO: 533110 - RNA, 65 nt, Homo Sapiens
aucuccaaguuaauuaagggaccuacauguauagcuguuuacaaaauauccccacaauuuccgga

SEQ ID NO: 533111 - RNA, 65 nt, Homo Sapiens; identical to SEQ ID NO: 420711

SEQ ID NO: 533112 - RNA, 65 nt, Homo Sapiens; identical to SEQ ID NO: 420712

SEQ ID NO: 533113 - RNA, 65 nt, Homo Sapiens
ccuucucuguuguaucaguacaugcaaacuguuccuguuuacauacuauacauuuuuccaauccc

SEQ ID NO: 533114 - RNA, 65 nt, Homo Sapiens
cugcugcugauagguucaagcagcauucuugugaauguuuacaucucaugucuuuuccagaguga

SEQ ID NO: 533115 - RNA, 53 nt, Homo Sapiens
ugaauucaugacaccuuugagguuguuuacagguagcugauguucaggcauaa

SEQ ID NO: 533116 - RNA, 65 nt, Homo Sapiens
uguuuucucuuuuuuacaguaaaaaauuaagaguguguuuacaacuauuaucuugcagauaaaga

SEQ ID NO: 533117 - RNA, 65 nt, Homo Sapiens
aaagaauucccuuugguauauuguacuuuauaucuuguuuacaauuuugcacaauauuucuuuug

SEQ ID NO: 533118 - RNA, 65 nt, Homo Sapiens
ugcaaauguagcaaacaaggcuggcucugccuagcuguuuacauuaucaugcauuagagucaguu

SEQ ID NO: 533119 - RNA, 65 nt, Homo Sapiens
auuuccagguccagagagguaaggugggccccguguguuuacagcgaacuaaggagcaguggcag

SEQ ID NO: 533120 - RNA, 65 nt, Homo Sapiens; identical to SEQ ID NO: 420713

SEQ ID NO: 533121 - RNA, 65 nt, Homo Sapiens; identical to SEQ ID NO: 420714

SEQ ID NO: 533122 - RNA, 65 nt, Homo Sapiens
uuuggaaucaaguaugaaaaucugcacaaaugcaauguuuacaagaacugguugauucugggagg

SEQ ID NO: 533123 - RNA, 65 nt, Homo Sapiens
caucaucugagaccagccaguagucacagaacugcuguuuacacaguucucaggaggcugugguu

SEQ ID NO: 533124 - RNA, 65 nt, Homo Sapiens
uuuugaaguauuuaagguucccguugcauuuguuuuguuuacagauaauuaccuacucuggcuag

SEQ ID NO: 533125 - RNA, 65 nt, Homo Sapiens
acauguuaagaccauaauguaguuauaaauggaaauguuuacaccugaagugaguauuuucaaau

SEQ ID NO: 533126 - RNA, 51 nt, Homo Sapiens
auuuuuuauuuuaguguuaaauguuuacaaaagacagugaaggauucuuau

SEQ ID NO: 533127 - RNA, 65 nt, Homo Sapiens
guuaauauuauuguauuaacauuuuaaguauaugguguuuacauucuuauuucuuuugacauuuu

SEQ ID NO: 533128 - RNA, 65 nt, Homo Sapiens
acagcaaaugaccaagcaugaacuaaagguaaagauguuuacagauuacuuuucuuacaaaaaaa

SEQ ID NO: 533129 - RNA, 65 nt, Homo Sapiens
gagaagcuguacaaguauaggcagaguuauuuuccuguuuacauuuuuuuuuuguuuuggggaaa

SEQ ID NO: 533130 - RNA, 65 nt, Homo Sapiens
auaccuggaauaucauguauguuucauuuacuggauguuuacauuuuaggaaggaaaauaguuuu

SEQ ID NO: 533131 - RNA, 65 nt, Homo Sapiens
aaggagccugcacauuugggugagcagacccaagcuguuuacagcucuuucuuguccugccaucc

SEQ ID NO: 533132 - RNA, 65 nt, Homo Sapiens
aaucuguccucuguaguauuuuuuaaauaaaucaguguuuacauuagaauucuuggcagauugcu

SEQ ID NO: 533133 - RNA, 65 nt, Homo Sapiens
cugcccagauccccggcacacacucccccaccugcuguuuacaugacccagggggugcacacuac

SEQ ID NO: 533134 - RNA, 65 nt, Homo Sapiens
augugacugaggcccaggagggaccugugagggucuguuuacagaggcugggcaggggccgcuug

SEQ ID NO: 533135 - RNA, 65 nt, Homo Sapiens
acuccagaggccugaggcuccagggcuggcucugguguuuacaagcuggacucagggauccuccu

SEQ ID NO: 533136 - RNA, 65 nt, Homo Sapiens
uuguauacccugaagaacucaaaucccagggcaaauguuuacauuuggacugugccaucuguggg

SEQ ID NO: 533137 - RNA, 65 nt, Homo Sapiens
uguugccugagcugguuaacuuguuuuguuuccgauguuuacacauucuccaaaccuuuuuuguu

SEQ ID NO: 533138 - RNA, 65 nt, Homo Sapiens
auaauaaauauuauugcuauugggauacagaccuauguuuacaauuuuuccuagauuuaugcuuu

SEQ ID NO: 533139 - RNA, 65 nt, Homo Sapiens
gcagaaggcggcucagcaguagugccuguguggucuguuuacagugugggugucccugguaggga

SEQ ID NO: 533140 - RNA, 65 nt, Homo Sapiens
cagggacauacaccaugcagacuugcuggagcccauguuuacagagggcaggcccgcacauaucc

SEQ ID NO: 533141 - RNA, 65 nt, Homo Sapiens
uaauugaucacaaccuguuaaauaaagccgccugguguuuacaacccccagauugcaaugcuacc

SEQ ID NO: 533142 - RNA, 65 nt, Homo Sapiens
ugaagugaguauuuucaaauaguuauaaauggaaauguuuacaccacauguuaagaccauaaugu

SEQ ID NO: 533143 - RNA, 65 nt, Homo Sapiens
uuuuuuuucuucagaaguaaugaucaugggggaaauguuuacauucaaaugaggggagucagcag

SEQ ID NO: 533144 - RNA, 65 nt, Homo Sapiens
aagaaauuuaaacucuacgugcacuaggauuaauuuguuuacaagaaaauguguagcacagaacu

SEQ ID NO: 533145 - RNA, 65 nt, Homo Sapiens
ugaaaguguaguagggauuaaguauacuacaguuauguuuacaucgagguacuuugggccaguag

SEQ ID NO: 533146 - RNA, 65 nt, Homo Sapiens
gugcccuucacgggauacuuggagcugggugugaguguuuacacugcccuaaugggaaaugaagg

SEQ ID NO: 533147 - RNA, 65 nt, Homo Sapiens
acccuugaaauguuuucaguacagcuuuauucuuguguuuacauucaucacuaaguaauagaccc

SEQ ID NO: 533148 - RNA, 65 nt, Homo Sapiens
agaaauaauaaacuggagguuguaacuaucuuacauguuuacauaacuugcccuuuuuccuggga

SEQ ID NO: 533149 - RNA, 65 nt, Homo Sapiens
acuaaggcccacuucccugccaagugucuaaacauuguuuacaaguguaacugcaguauuuugua

SEQ ID NO: 533150 - RNA, 65 nt, Homo Sapiens
cagaguucugugacacaugcagauguuuguguaucuguuuacaucgaaaaauguauccagucuga

SEQ ID NO: 533151 - RNA, 65 nt, Homo Sapiens
aaagugguugucgcacuggguuagcaucugacagguguuuacaaauaguguguaaggccguauuu

SEQ ID NO: 533152 - RNA, 65 nt, Homo Sapiens
gacaacuucacucuuucauaauauauaggauaaauuguuuacaugauuggacccucagauucugu

SEQ ID NO: 533153 - RNA, 65 nt, Homo Sapiens
ucuuuguguguuagaguauuuguuuuaguaagaaauguuuacacagcuuguggaauuauuucgug

SEQ ID NO: 533154 - RNA, 65 nt, Homo Sapiens
uauaaucaagguaucuugaugguuauaugugguauuguuuacacuguuaauauccacauguaagg

SEQ ID NO: 533155 - RNA, 65 nt, Homo Sapiens
uuuuugugcuuuuaauaguccgagcagucuuaccuuguuuacacauguauugacaccauuugcuu

SEQ ID NO: 533156 - RNA, 65 nt, Homo Sapiens
auauuuuguacagaaaauaucaaccucuucccuuuuguuuacaagauguuuuguauaagccuaug

SEQ ID NO: 533157 - RNA, 65 nt, Homo Sapiens
uggccugggucaagaugagggucuuucaguguuccuguuuacaacaugucaaagccauugguuca

SEQ ID NO: 533158 - RNA, 65 nt, Homo Sapiens
cgggaggagugccaucugggucuuccaucuagaacuguuuacaugaagauaagauacucacuguu

SEQ ID NO: 533159 - RNA, 65 nt, Homo Sapiens
gcaaacaucuucuggcauauggcuuguuaauguuguguuuacacuaacugccaaaaugugccugu

SEQ ID NO: 533160 - RNA, 65 nt, Homo Sapiens
acaaaucuauuuagagaaacagcuggcccugcaaauguuuacagaaaugaaauucuuccuacuua

SEQ ID NO: 533161 - RNA, 65 nt, Homo Sapiens
gaaacuuccaauuaugucuauaauuuauauucuuuuguuuacaugaugaaacuuuuuguuguugc

SEQ ID NO: 533162 - RNA, 65 nt, Homo Sapiens
gaucuugagcaaguauuggucaugauacaguaauuuguuuacagaauccaaaaauacaauagaga

SEQ ID NO: 533163 - RNA, 65 nt, Homo Sapiens
uuauucauguguacagaaacaacugccaaauaaaauguuuacauuuucuuucauaucccagaggu

SEQ ID NO: 533164 - RNA, 65 nt, Homo Sapiens
cuaugggagagugucaaccagacagagggucacaguguuuacacuuuggaccuuacgaucaggca

SEQ ID NO: 533165 - RNA, 65 nt, Homo Sapiens
cuuauuuugagauuugagauuuaaauuuuauguauuguuuacagucagaguaaaucacuggauuu

SEQ ID NO: 533166 - RNA, 65 nt, Homo Sapiens
acugccaaagucaggggaggagggcagagacuuuguguuuacaucugcauuucuacauguuuuag

SEQ ID NO: 533167 - RNA, 65 nt, Homo Sapiens
auucuuuggauuucuggaagguuaugacacuuuacuguuuacagcuaaugcauaguuacuugcau

SEQ ID NO: 533168 - RNA, 65 nt, Homo Sapiens
auuuucuuuuguuacguaguggaaacauuuugcauuguuuacauaguucucauggaacauggaaa

SEQ ID NO: 533169 - RNA, 65 nt, Homo Sapiens; identical to SEQ ID NO: 420715

SEQ ID NO: 533170 - RNA, 65 nt, Homo Sapiens; identical to SEQ ID NO: 420716

SEQ ID NO: 533171 - RNA, 65 nt, Homo Sapiens
auggcaauggaaacacaauuccagcucuaucuuuguguuuacaucauauguaauaaugacuccau

SEQ ID NO: 533172 - RNA, 65 nt, Homo Sapiens
uggacacacaaggugcaaauccugcacuaauuugauguuuacagggaaugauacccugaauuugg

SEQ ID NO: 533173 - RNA, 65 nt, Homo Sapiens
cuugcaguguagcccaguuuaugucuucuuguuauuguuuacacauauggcaaaaugaauccuuc

SEQ ID NO: 533174 - RNA, 65 nt, Homo Sapiens
uucaggccaagaugacugauggaagcaaaccuccuuguuuacaucagugaaguacucaucuugca

SEQ ID NO: 533175 - RNA, 65 nt, Homo Sapiens
aucaccagugccacgucauggccccuguuuucugcuguuuacaaccauaauuuggucauuuggca

SEQ ID NO: 533176 - RNA, 65 nt, Homo Sapiens
auggaaauugacaaacuauauggacuuagugggaguguuuacaccucagugcugucuugguagcu

SEQ ID NO: 533177 - RNA, 65 nt, Homo Sapiens
guucauaugaauaauaaucuucaaauagaugauucuguuuacauuaaaauauauuugauguuaaa

SEQ ID NO: 533178 - RNA, 65 nt, Homo Sapiens; identical to SEQ ID NO: 420717

SEQ ID NO: 533179 - RNA, 65 nt, Homo Sapiens; identical to SEQ ID NO: 420718

SEQ ID NO: 533180 - RNA, 65 nt, Homo Sapiens; identical to SEQ ID NO: 420719

SEQ ID NO: 533181 - RNA, 65 nt, Homo Sapiens; identical to SEQ ID NO: 420720

SEQ ID NO: 533182 - RNA, 65 nt, Homo Sapiens
gcagaaaauaucaucaccaugggucaccaacaggcuguuuacaaauaaugauucuugggugcugu

SEQ ID NO: 533183 - RNA, 65 nt, Homo Sapiens
gucuggauccaucagcccucuuacaccuagcugaauguuuacaagcuucagccuuucugguuaug

SEQ ID NO: 533184 - RNA, 65 nt, Homo Sapiens; identical to SEQ ID NO: 420721

SEQ ID NO: 533185 - RNA, 65 nt, Homo Sapiens; identical to SEQ ID NO: 420722

SEQ ID NO: 533186 - RNA, 65 nt, Homo Sapiens
cgucccccggggaaauguauagaucuguugaauaauguuuacauuagcuguguuuuccuaagcug

SEQ ID NO: 533187 - RNA, 65 nt, Homo Sapiens
accuaagcuuagccuccagggccuugcuacacuaauguuuacagcgagggagcuugcugccuccu

SEQ ID NO: 533188 - RNA, 65 nt, Homo Sapiens
gugacauccagccccaaggauuuauuguguggucauguuuacauuccuccucacugccauuauag

SEQ ID NO: 533189 - RNA, 65 nt, Homo Sapiens
uucauugcuguggucaggccaaaaauauuacucuguguuuacagaaagugacucuuuacuguagg

SEQ ID NO: 533190 - RNA, 65 nt, Homo Sapiens
gaaaaccggauuuucaguagcuaaaauucugauacuguuuacaaauggagggucauaggacuucg

SEQ ID NO: 533191 - RNA, 65 nt, Homo Sapiens
ccuggggaaucuuuuacaucugauacaagcaaguuuguuuacaucuccugcccaucagagaggcc

SEQ ID NO: 533192 - RNA, 65 nt, Homo Sapiens
ugauuuuauuugacaaaauuuguugaaauuauguauguuuacauaucaccucauggccuauuaua

SEQ ID NO: 533193 - RNA, 65 nt, Homo Sapiens; identical to SEQ ID NO: 420723

SEQ ID NO: 533194 - RNA, 65 nt, Homo Sapiens; identical to SEQ ID NO: 420724

SEQ ID NO: 533195 - RNA, 65 nt, Homo Sapiens
gccuggggguggggggcgggacucucacggugacauguuuacagcugggugugacucaguaaagu

SEQ ID NO: 533196 - RNA, 65 nt, Homo Sapiens
ggugccccugccgagguggccugcagugcuguacauguuuacagaagcugcugggcuuggcucag

SEQ ID NO: 533197 - RNA, 65 nt, Homo Sapiens
uagcacacaguaauguuaucuggaagcucuguuuuuguuuacauuucuguaucccuggguugacu

SEQ ID NO: 533198 - RNA, 65 nt, Homo Sapiens
gccaugugccuacaaaugucaguugugauuuccacuguuuacaagugaguggagcuggagcuggg

SEQ ID NO: 533199 - RNA, 65 nt, Homo Sapiens
ugcugucugccgaggagcgccaagaagaugucacuuguuuacacacgaacugccacauccccaag

SEQ ID NO: 533200 - RNA, 65 nt, Homo Sapiens; identical to SEQ ID NO: 420725

SEQ ID NO: 533201 - RNA, 65 nt, Homo Sapiens; identical to SEQ ID NO: 420726

SEQ ID NO: 533202 - RNA, 65 nt, Homo Sapiens
gcaaccuuuuucccucuucccagaaaaccagucuguguuuacagacagaagagaaggaagccaua

SEQ ID NO: 533203 - RNA, 65 nt, Homo Sapiens; identical to SEQ ID NO: 420727

SEQ ID NO: 533204 - RNA, 65 nt, Homo Sapiens; identical to SEQ ID NO: 420728

SEQ ID NO: 533205 - RNA, 65 nt, Homo Sapiens
ccuguuaaauuaagucauuggauuuuacucuguucuguuuacaguuuacuauuuaagguuuuaua

SEQ ID NO: 533206 - RNA, 65 nt, Homo Sapiens
ucuuucuauacauucagucaggcacugggaucaucuguuuacaggcauuauauuuauuuggcacu

SEQ ID NO: 533207 - RNA, 65 nt, Homo Sapiens
caugccacuugaagauuucucugagaucaugaguuuguuuacacuugucucaagccuaucuauag

SEQ ID NO: 533208 - RNA, 65 nt, Homo Sapiens
gcacccauggcccccacccacggaaggacuugaguuguuuacaagcccugcacugaggcagauug

SEQ ID NO: 533209 - RNA, 65 nt, Homo Sapiens
cagggccaccccgucacauaugacugguagggcuguguuuacaguucucaggccaugagcugcag

SEQ ID NO: 533210 - RNA, 65 nt, Homo Sapiens
cacccuuggguccuaaauuaccagcgcuccuaucauguuuacaguucugccucagugacaauguc

SEQ ID NO: 533211 - RNA, 65 nt, Homo Sapiens
agcuucugauuugcauugaaaauccugccugauuguguuuacagauuaccgcucauugccucucu

SEQ ID NO: 533212 - RNA, 65 nt, Homo Sapiens
uaaaauggauauuauagcaucuggcucaaguacuuuguuuacaauugcucaaguacuuaaguagu

SEQ ID NO: 533213 - RNA, 65 nt, Homo Sapiens
caccacauuuacacauccacugcggacggugacaauguuuacaagacauggauguugggucucug

SEQ ID NO: 533214 - RNA, 65 nt, Homo Sapiens
acuguuguuuacuuguugcuacacagacccacacauguuuacagagugcauccacgcacacaugg

SEQ ID NO: 533215 - RNA, 65 nt, Homo Sapiens
uaaaacucagccagucucauuccuuugauuucuacuguuuacaaacacuuuacuggcaagagacu

SEQ ID NO: 533216 - RNA, 65 nt, Homo Sapiens
ccuuuguggagccuacaucuuccacaucucguugcuguuuacauuauggaaaagccugcuguugu

SEQ ID NO: 533217 - RNA, 65 nt, Homo Sapiens
uuguuuauggcgacugccauacagccaugcucauuuguuuacaugcaauaaagucucauuggaac

SEQ ID NO: 533218 - RNA, 65 nt, Homo Sapiens
auuaaaauguauguuagcaaugcagauucuauuuuuguuuacaaucauucuuguugcauugucuc

SEQ ID NO: 533219 - RNA, 65 nt, Homo Sapiens
cuuuugaaaauauuuagucuucaccaucaucacaguguuuacaaaauguucuuucuaugcuuucc

SEQ ID NO: 533220 - RNA, 65 nt, Homo Sapiens
uacuugaauuuuuaaauuauuaacaaauuagaauuuguuuacaacaggggaauauaugaauuguu

SEQ ID NO: 533221 - RNA, 65 nt, Homo Sapiens
uuuauugguuuacauauuuucagccucugcaaaacuguuuacauaagacuugcuaaaauauaaau

SEQ ID NO: 533222 - RNA, 65 nt, Homo Sapiens
guacuguauguaugggagaggcgcucagccugauguguuuacaugaccugcccuaccaccaccac

SEQ ID NO: 533223 - RNA, 65 nt, Homo Sapiens
acucugcuaacuucucacuucccugaacuguucuuuguuuacaggaccugggagcgcagguuggc

SEQ ID NO: 533224 - RNA, 65 nt, Homo Sapiens
auuuugcuuucccagcgggaggggaggaagaagaguguuuacaaaguccuguagcccccucaccu

SEQ ID NO: 533225 - RNA, 65 nt, Homo Sapiens
uuuugcaugcuuucuuaauaaaaaaaaaaaaagaauguuuacaguuuuaucuuacugguaguggu

SEQ ID NO: 533226 - RNA, 65 nt, Homo Sapiens; identical to SEQ ID NO: 420729

SEQ ID NO: 533227 - RNA, 65 nt, Homo Sapiens; identical to SEQ ID NO: 420730

SEQ ID NO: 533228 - RNA, 65 nt, Homo Sapiens; identical to SEQ ID NO: 420731

SEQ ID NO: 533229 - RNA, 65 nt, Homo Sapiens; identical to SEQ ID NO: 420732

SEQ ID NO: 533230 - RNA, 65 nt, Homo Sapiens
uuuaaaggcuuaauuugggaggggggacuuauuucuguuuacaguguauuaccuuccuucccucc

SEQ ID NO: 533231 - RNA, 65 nt, Homo Sapiens
aauuuuuggguuugacaaccacuuauuuuuuccuuuguuuacaaucuacucaccaggcucauacc

SEQ ID NO: 533232 - RNA, 65 nt, Homo Sapiens
guauuauacagaucuaaaacucgcaagugaaagauuguuuacaaacuuccugaauauuaucaaug

SEQ ID NO: 533233 - RNA, 65 nt, Homo Sapiens
gacagacugucacugaucacuuccauuccuguugcuguuuacacagaauggacuuuaaaaaaauu

SEQ ID NO: 533234 - RNA, 65 nt, Homo Sapiens
acuuuucaaaucucuuauuauauguuuccuuuuuuuguuuacauagggaacaauguuuauagucg

SEQ ID NO: 533235 - RNA, 65 nt, Homo Sapiens
uggggcugauguguaaagcuguucaaguuauuugauguuuacaccucagggaaagucuuguguuc

SEQ ID NO: 533236 - RNA, 65 nt, Homo Sapiens
caugguggacuacuagucacugcuuccauaaauauuguuuacagggugagauuugguuuauucau

SEQ ID NO: 533237 - RNA, 65 nt, Homo Sapiens
cacuagcuaauucucauauccaugccuuuuuguccuguuuacagucuuaaaagagguaaaacagc

SEQ ID NO: 533238 - RNA, 65 nt, Homo Sapiens
cuaauuccaugucaccaacaacacagacaagacccuguuuacaacuuuuucuuuccuuuuuuuua

SEQ ID NO: 533239 - RNA, 65 nt, Homo Sapiens
gucauuuauguuauuuaaaugauguacuguacugcuguuuacauggacguuuugugcgggugcuu

SEQ ID NO: 533240 - RNA, 65 nt, Homo Sapiens
uugugcccagcaacaugcuguaggaauuuaacucuuguuuacauccauuagccucaugguuuugc

SEQ ID NO: 533241 - RNA, 65 nt, Homo Sapiens
cuuggcuucuucuuuaggauugugaugguucguucuguuuacaucaguuuuaacgagagguaugc

SEQ ID NO: 533242 - RNA, 65 nt, Homo Sapiens
ugucuuaugaugugugccucucccucccccaaaccuguuuacagucaauuauaaccugacaaacg

SEQ ID NO: 533243 - RNA, 65 nt, Homo Sapiens
guagguuucaucuauccaccuggcuuucuccuuauuguuuacagauguaguucuuguuagaggau

SEQ ID NO: 533244 - RNA, 65 nt, Homo Sapiens
cuauaacucgaguuuauaggggaagaaaaagcuauuguuuacaauuauaucaccauuaaggcaac

SEQ ID NO: 533245 - RNA, 65 nt, Homo Sapiens
uuacuacuuuuuaaauuucacagucucuguaucaauguuuacaugcugcuauguguauaggaaag

SEQ ID NO: 533246 - RNA, 65 nt, Homo Sapiens
uauuuaaagaguuuuauguucagauuuugcauuuuuguuuacaacauaaaauauuuuuaugacua

SEQ ID NO: 533247 - RNA, 65 nt, Homo Sapiens
aggacuucugaaauuaauccuauucaugccugauuuguuuacaugaaaguucauuauaagggcuu

SEQ ID NO: 533248 - RNA, 65 nt, Homo Sapiens
gucagauuaacauuugaaagugagaacucaacugcuguuuacagugcuuucuuugcccauguaaa

SEQ ID NO: 533249 - RNA, 65 nt, Homo Sapiens
uaaucagacuauaauauuuaauuugggguuuuguuuguuuacaaauuuaaaauagaauuuagagu

SEQ ID NO: 533250 - RNA, 65 nt, Homo Sapiens
caacaaaugguuagcuagggcaacguagaauuacuuguuuacaucacugucaucucauucuugua

SEQ ID NO: 533251 - RNA, 65 nt, Homo Sapiens
ggggcaaggaccucucaugguggccuggaugucaauguuuacaaaacacuuuccccaggcuccag

SEQ ID NO: 533252 - RNA, 65 nt, Homo Sapiens; identical to SEQ ID NO: 420733

SEQ ID NO: 533253 - RNA, 65 nt, Homo Sapiens; identical to SEQ ID NO: 420734

SEQ ID NO: 533254 - RNA, 65 nt, Homo Sapiens
gauaauuuuuauugacauaauugccauuaaaauuuuguuuacaaacuauaugaugaaauguuauu

SEQ ID NO: 533255 - RNA, 65 nt, Homo Sapiens; identical to SEQ ID NO: 420735

SEQ ID NO: 533256 - RNA, 65 nt, Homo Sapiens; identical to SEQ ID NO: 420736

SEQ ID NO: 533257 - RNA, 65 nt, Homo Sapiens
uuuugcacuugggaggagggcuguuccguuuacucuguuuacacaaccacuuagacugcacuuuu

SEQ ID NO: 533258 - RNA, 65 nt, Homo Sapiens
uacccucuucauggauggggacugugaaggacccuuguuuacacagggaucccucccccccaugc

SEQ ID NO: 533259 - RNA, 65 nt, Homo Sapiens
aguucaaauacuuuugggauaauauacauagucuuuguuuacaugaguacauuuucucccuuagg

SEQ ID NO: 533260 - RNA, 65 nt, Homo Sapiens
uccagcauauaaggaaagugaugacugagaaaacuuguuuacagcgcugagaagauuuuuuuuua

SEQ ID NO: 533261 - RNA, 65 nt, Homo Sapiens
guuuguagauacuuuuuuuguaaaugauacagaucuguuuacaagauuuggauuauuuauguuua

SEQ ID NO: 533262 - RNA, 65 nt, Homo Sapiens
guucaucgugccuguuaaugggugcccauuaacaguguuuacacuuugucugcccuguuaaacuu

SEQ ID NO: 533263 - RNA, 65 nt, Homo Sapiens
gaauaauuuuaaaaccacaaggaaagaauauaggauguuuacaguuccagcucugaaauuaauua

SEQ ID NO: 533264 - RNA, 65 nt, Homo Sapiens
uuccaaauagccauuuugcacugaaucaagcuuaauguuuacaguacauggaaauuuagggguuu

SEQ ID NO: 533265 - RNA, 65 nt, Homo Sapiens
cugaaaaauuauugcuuuuuaaaaaucacgacuacuguuuacagauauuuaaaaaaggaaaggag

SEQ ID NO: 533266 - RNA, 65 nt, Homo Sapiens
gcugcaucagacaaugccaucugcagggcuucucuuguuuacacaggcagcagugcuuagagcuu

SEQ ID NO: 533267 - RNA, 65 nt, Homo Sapiens
gagagagcugcauauugcauaacaagcuaacuguguguuuacauaacauugggaacauauuucuu

SEQ ID NO: 533268 - RNA, 65 nt, Homo Sapiens
aaaaauuuccagagaagcauucuucaaauauuucauguuuacauucuugagacuuuuuaaucggu

SEQ ID NO: 533269 - RNA, 65 nt, Homo Sapiens
auaguuguuccagaaaucuucauuuuaaauagaaguguuuacaaugccuuuuuucccccaguauu

SEQ ID NO: 533270 - RNA, 65 nt, Homo Sapiens
cgucauaggcuucugcacguuggaucaacuaauguuguuuacaauauagaugacauuuuaaaaau

SEQ ID NO: 533271 - RNA, 65 nt, Homo Sapiens
gugguaagaaugaccugucacuauaauauacuguauguuuacauuuuauuuaaauuuaaucucuu

SEQ ID NO: 533272 - RNA, 65 nt, Homo Sapiens; identical to SEQ ID NO: 420737

SEQ ID NO: 533273 - RNA, 65 nt, Homo Sapiens; identical to SEQ ID NO: 420738

SEQ ID NO: 533274 - RNA, 65 nt, Homo Sapiens
auaagucaugacacaguauucgcucuuuuucugaauguuuacauagagauucaucacugcagauu

SEQ ID NO: 533275 - RNA, 65 nt, Homo Sapiens
aacucccuucccucugggcagaggcccaucugcucuguuuacacaccuggaccuggugugaaggg

SEQ ID NO: 533276 - RNA, 65 nt, Homo Sapiens
cagaauuuuuuuuuuuuuuuuuuuuuuuuggcaaauguuuacauucaauuaaggggaaaaaguag

SEQ ID NO: 533277 - RNA, 65 nt, Homo Sapiens
uacaggcagcguuuggaaaccuuuuauuauauaguuguuuacauacuuauaagucuaucauuuaa

SEQ ID NO: 533278 - RNA, 65 nt, Homo Sapiens
cuuccuguuugaugaagauauuuuuuaacaucuuauguuuacagguuacaucuuuauuuaaauuu

SEQ ID NO: 533279 - RNA, 65 nt, Homo Sapiens
uuggcuauggcugcugucuaauagcuguacccauuuguuuacauaaaauaacguuuuauuggagc

SEQ ID NO: 533280 - RNA, 65 nt, Homo Sapiens
uaugggauguaguauuucuagaagcuccuggugaauguuuacaaucuguuacuuacuguacuaug

SEQ ID NO: 533281 - RNA, 65 nt, Homo Sapiens
uuuuuaaauuuaaauucagauauauuguaaauagcuguuuacaggaacuaauuuauaacuuguuc

SEQ ID NO: 533282 - RNA, 65 nt, Homo Sapiens
ugccaguuccaggugauuaguacaaaaugcuacaguguuuacaaaugauugucaggggaaaaacu

SEQ ID NO: 533283 - RNA, 65 nt, Homo Sapiens
cuauaaauggcagcucuccuguuguauucagguguuguuuacagacuaacaaauguguuggcaaa

SEQ ID NO: 533284 - RNA, 65 nt, Homo Sapiens
uguuuguggcuggagguggauuucaugcccugugguguuuacaguguauauaaugguuguguuuu

SEQ ID NO: 533285 - RNA, 65 nt, Homo Sapiens
gcacaaaauuaugcaaauauuuuaauguuuauuaauguuuacaguggaauugugaauaaguuuuc

SEQ ID NO: 533286 - RNA, 65 nt, Homo Sapiens
ugcuguuaaguuuguuauuuggguauaaaaccagauguuuacaccuguaaaucuugugcugguua

SEQ ID NO: 533287 - RNA, 65 nt, Homo Sapiens
uccacagagccugggcugggcccgguggaggcuccuguuuacagcccucucuucuuuguacaguu

SEQ ID NO: 533288 - RNA, 65 nt, Homo Sapiens
gcgcgggcgcccuuccaaagcacauacucaccgaauguuuacagacuggcuguccuggcagggcu

SEQ ID NO: 533289 - RNA, 65 nt, Homo Sapiens
ugucaaagagaauuaaaaaaaaaaacuucagauuuuguuuacauauuuuacuacauuuuugcugg

SEQ ID NO: 533290 - RNA, 65 nt, Homo Sapiens
gucucucacauuauauaguagauguuuguuuauaauguuuacaaaacauuuuggugaauuuccuc

SEQ ID NO: 533291 - RNA, 65 nt, Homo Sapiens
cuuuauuuccuagagaauuuauuuuauaaauacuuuguuuacauuuuagauuguacuugucuuua

SEQ ID NO: 533292 - RNA, 65 nt, Homo Sapiens
ugaaauuaccaggcacagauuuagucuugucauuuuguuuacacauuggggaaaacaauucaguu

SEQ ID NO: 533293 - RNA, 65 nt, Homo Sapiens
ggagaaggggagaaauguacuuggaaauuaauguauguuuacaucucuuugcaaauuccuguaca

SEQ ID NO: 533294 - RNA, 65 nt, Homo Sapiens
uauccauuucgauugugugacagauugaaauuuauuguuuacauuggggaauguaucucaaauuu

SEQ ID NO: 533295 - RNA, 65 nt, Homo Sapiens
aggcccugucagcuggaacuggacagaccuugguuuguuuacauguccgaugggggcaggagcuc

SEQ ID NO: 533296 - RNA, 65 nt, Homo Sapiens
guuguaagcuuggauuuuuaggucuagcaauacacuguuuacaagagcaucaccuaaaaugugac

SEQ ID NO: 533297 - RNA, 65 nt, Homo Sapiens
ggggccaaggaggccucugucauuuuaaagacucguguuuacaguuuuguauccaaggccgcacu

SEQ ID NO: 533298 - RNA, 65 nt, Homo Sapiens
ugaagggcuuuucucucucacuucuuucucuagauuguuuacauaucccuuccccaucccaaccc

SEQ ID NO: 533299 - RNA, 65 nt, Homo Sapiens
uuccugaacccuccugagcgacuaucuuuuuaguuuguuuacauuuugcgugguuggauuuuucc

SEQ ID NO: 533300 - RNA, 65 nt, Homo Sapiens
gauaaagccagauauguuuuuacuuguagcaaauauguuuacauuucacuuuuaccuuuaaaguu

SEQ ID NO: 533301 - RNA, 65 nt, Homo Sapiens
uguauaaggauuucauauauauaauuuauuaagaauguuuacaccuuuuuuuuauuuuauugcuu

SEQ ID NO: 533302 - RNA, 65 nt, Homo Sapiens
ucaucugcagcuguuuuuugcauaccaugcucauuuguuuacauauucauaaaguuugauuggaa

SEQ ID NO: 533303 - RNA, 65 nt, Homo Sapiens
auaaagauuauuucaaaccauauuuuaaacacagauguuuacaaaaauugugagcaggguucauc

SEQ ID NO: 533304 - RNA, 65 nt, Homo Sapiens
ccauagguguucuggucugguuugccaucucacccuguuuacaugggaccuaugaauuuguacuu

SEQ ID NO: 533305 - RNA, 65 nt, Homo Sapiens
gcuucuggugauaucuuuucuacccuuagcugaaauguuuacauaaacacccuuaacuuucucuu

SEQ ID NO: 533306 - RNA, 65 nt, Homo Sapiens
gagcuaucgguuuagccuuuuucucccauaggcuguguuuacauguucuuagucccuaaucaugu

SEQ ID NO: 533307 - RNA, 65 nt, Homo Sapiens
cugaugagcagaucccagacaggagaagaaucauuuguuuacaaagcagagaacagaauguguca

SEQ ID NO: 533308 - RNA, 65 nt, Homo Sapiens
aucuuccuuuuauuccucacccagagguugugcacuguuuacagaccaaaucguagcguuuguua

SEQ ID NO: 533309 - RNA, 65 nt, Homo Sapiens; identical to SEQ ID NO: 420739

SEQ ID NO: 533310 - RNA, 65 nt, Homo Sapiens; identical to SEQ ID NO: 420740

SEQ ID NO: 533311 - RNA, 65 nt, Homo Sapiens
uguguugauccugguuucccagaucuguauuucaguguuuacaagggaggaaggaccuuuccuca

SEQ ID NO: 533312 - RNA, 65 nt, Homo Sapiens
cugcucagccccgcggcuggaccuuccuucugcauuguuuacauugcauccuggaugggacguuu

SEQ ID NO: 533313 - RNA, 65 nt, Homo Sapiens
uuaggugcccauugcaucuuuuugugcuauggaguuguuuacauuaagcaugaccgaacgagaga

SEQ ID NO: 533314 - RNA, 65 nt, Homo Sapiens
uguuuguaacugugauuaugauagaggccuaucucuguuuacaugcauagcuuugaguuaggcua

SEQ ID NO: 533315 - RNA, 65 nt, Homo Sapiens
uggguuauauaccauauguuaaauaugcaauaaaguguuuacaggaugcccuucugaaggguagu

SEQ ID NO: 533316 - RNA, 65 nt, Homo Sapiens
gaggaaagggaaaggguaggccuguagacuaacgcuguuuacacccuuguucugucaaagcaauu

SEQ ID NO: 533317 - RNA, 65 nt, Homo Sapiens
ugguucauuuuuguuuguuuuguuuuguuuuguuuuguuuacagaugaggucuuccuguguugcc

SEQ ID NO: 533318 - RNA, 65 nt, Homo Sapiens
cucucgcccugaguacucuucuugggaguugcugcuguuuacagccacagucucaucuaucacua

SEQ ID NO: 533319 - RNA, 65 nt, Homo Sapiens
cauaggaaagguacaguaaaaguggugaguauuuguguuuacaaaaccgcaggcaauuguaacac

SEQ ID NO: 533320 - RNA, 65 nt, Homo Sapiens; identical to SEQ ID NO: 420741

SEQ ID NO: 533321 - RNA, 65 nt, Homo Sapiens; identical to SEQ ID NO: 420742

SEQ ID NO: 533322 - RNA, 65 nt, Homo Sapiens
cuguggugcaaucuacuguuuuaugcaacuuaaaauguuuacacauuugaaaaucaaggagaagu

SEQ ID NO: 533323 - RNA, 65 nt, Homo Sapiens
cgugcaauuuguuugugcuuaaucauuguacaguuuguuuacacaaccuucccucaucuuucauc

SEQ ID NO: 533324 - RNA, 65 nt, Homo Sapiens
ugugcaaauuauuuagagcauggucaucuaagauuuguuuacaaaugauagauacacugcaucuu

SEQ ID NO: 533325 - RNA, 65 nt, Homo Sapiens
augagaugugacucuacagaauguuucccaaacacuguuuacagagccauaauuuucagaugaag

SEQ ID NO: 533326 - RNA, 64 nt, Homo Sapiens
auguuuagugaguuuaaucaaugaaauaaauuuauuguuuacagucauuaaaucuuuaaaagaa

SEQ ID NO: 533327 - RNA, 65 nt, Homo Sapiens; identical to SEQ ID NO: 420743

SEQ ID NO: 533328 - RNA, 65 nt, Homo Sapiens; identical to SEQ ID NO: 420744

SEQ ID NO: 533329 - RNA, 65 nt, Homo Sapiens
ugugaaaacuuuguggguuuaaacauuuggcacauuguuuacaggacuugcauaugagagaaaua

SEQ ID NO: 533330 - RNA, 65 nt, Homo Sapiens
gaaggugucauucacaaaaagacucuccuucccauuguuuacagugcccauagggcugccugguu

SEQ ID NO: 533331 - RNA, 65 nt, Homo Sapiens
cucuccuggcagagguuggcaagcugucagugguguguuuacaaucauuuaaaaacaaagugucc

SEQ ID NO: 533332 - RNA, 65 nt, Homo Sapiens
aaggccacggugcucuuagcucuagcaccuaguguuguuuacaagcugaaauuccagcugguuuc

SEQ ID NO: 533333 - RNA, 65 nt, Homo Sapiens
guauaaaagagaagaagccagacaaauaaaugugguguuuacaauccagagguuugcaagccuca

SEQ ID NO: 533334 - RNA, 65 nt, Homo Sapiens
uauuuuaauuuaaguucaguuucauauugcaaagauguuuacaaguuugacuugaaaaauuauau

SEQ ID NO: 533335 - RNA, 65 nt, Homo Sapiens
uucccugggacagauccagggauuuuucccagauuuguuuacaugaggaaaacuugcagaaaugu

SEQ ID NO: 533336 - RNA, 65 nt, Homo Sapiens
agcugugggguguuacgcauugcacuccccgcuuguguuuacacacaccugcaggcacgugugua

SEQ ID NO: 533337 - RNA, 65 nt, Homo Sapiens
uagagagaaccccuuguagguauuucauccagauuuguuuacaucaugguauacuuggauuaaaa

SEQ ID NO: 533338 - RNA, 65 nt, Homo Sapiens
aucgucaaaaggaagggauugguuuggcaagaacuuguuuacaacauuuuugcaaaucuaaaguu

SEQ ID NO: 533339 - RNA, 65 nt, Homo Sapiens
aaucaauuugauaggauuaaucuccagugaagcuguguuuacagggcauuccaagugauucuuau

SEQ ID NO: 533340 - RNA, 65 nt, Homo Sapiens
ccuagaccaauucuguguggauauuuaagugaacauguuuacaauuuuuguauauaucacucucu

SEQ ID NO: 533341 - RNA, 65 nt, Homo Sapiens
gagcugaaggucugcgucacggugaaaauucgggauguuuacagagcaucacaaaugccucucuc

SEQ ID NO: 533342 - RNA, 65 nt, Homo Sapiens; identical to SEQ ID NO: 420745

SEQ ID NO: 533343 - RNA, 65 nt, Homo Sapiens; identical to SEQ ID NO: 420746

SEQ ID NO: 533344 - RNA, 65 nt, Homo Sapiens
ugucuguacuucuguuugaacuuuccacguuguccuguuuacaaguuaacuuaaguugggguauc

SEQ ID NO: 533345 - RNA, 65 nt, Homo Sapiens
cuuaaaugcaucuaacccuuuaacaaauguguacauguuuacaaguaauggaaaugcgucuauaa

SEQ ID NO: 533346 - RNA, 65 nt, Homo Sapiens
cauuuuguuuuggagguucucacuuugaaccuucuuguuuacagauuuuuuuguuuguuuuuuga

SEQ ID NO: 533347 - RNA, 65 nt, Homo Sapiens
agccuuuggucuccuggaugggccuuugagccugauguuuacagugucugugugugugugugcau

SEQ ID NO: 533348 - RNA, 65 nt, Homo Sapiens
aaaaaaacaaaaaaauuuaaaaagauggaauguaguguuuacauuaaagccgccguuuucaugac

SEQ ID NO: 533349 - RNA, 65 nt, Homo Sapiens
ccuggcuccuguguucccucuauccagccaaugccuguuuacacagacaccuggccucacugcca

SEQ ID NO: 533350 - RNA, 65 nt, Homo Sapiens
ugaauuugguugguuuugguguuguacagcucacauguuuacacacucagugcccuaauuucccc

SEQ ID NO: 533351 - RNA, 65 nt, Homo Sapiens
aggcugcauccucuucugucccuggcaccaggcuuuguuuacacuuggagccaccuugguguggg

SEQ ID NO: 533352 - RNA, 65 nt, Homo Sapiens
uuuaguugaacugugcggaauugugguguugguuuuguuuacacagccagauuuuuccuucuuuu

SEQ ID NO: 533353 - RNA, 65 nt, Homo Sapiens; identical to SEQ ID NO: 420747

SEQ ID NO: 533354 - RNA, 65 nt, Homo Sapiens; identical to SEQ ID NO: 420748

SEQ ID NO: 533355 - RNA, 65 nt, Homo Sapiens
gaacaugaguuauaaguuauuacuuuuccuuuacauguuuacacuuuuauaaaaaucagauuuuu

SEQ ID NO: 533356 - RNA, 65 nt, Homo Sapiens
ccuguuuugucauccugcugggggggaugagaucauguuuacagaagcuccuuggaagaagggau

SEQ ID NO: 533357 - RNA, 65 nt, Homo Sapiens
aacccagccagaguuugccuugcagcugcgauggauguuuacaggggccuuggcuucugauuauu

SEQ ID NO: 533358 - RNA, 65 nt, Homo Sapiens
uacccaguaucuuugcacaaccuccuaccucuucauguuuacauaagccaggaccugaacucgca

SEQ ID NO: 533359 - RNA, 65 nt, Homo Sapiens; identical to SEQ ID NO: 420749

SEQ ID NO: 533360 - RNA, 65 nt, Homo Sapiens; identical to SEQ ID NO: 420750

SEQ ID NO: 533361 - RNA, 65 nt, Homo Sapiens
uagccagaaacuauacaaguacuucuagaacaucuuguuuacaguaaaaaaaaaagauaacuaga

SEQ ID NO: 533362 - RNA, 65 nt, Homo Sapiens
cucuucugucucugcccccaggggguggaacccaauguuuacauugggucuucccuugagcucca

SEQ ID NO: 533363 - RNA, 65 nt, Homo Sapiens
cggugccagcccggcucugacaucaccaggucuaauguuuacaaaucuccuccuccauccccaga

SEQ ID NO: 533364 - RNA, 65 nt, Homo Sapiens
cagauuuuuguaauaaaggcagugcgguagcuauuuguuuacauggcccuggagggaggcucuuc

SEQ ID NO: 533365 - RNA, 65 nt, Homo Sapiens
gugagcuuuuugugcgucugagagcagcuuaauccuguuuacaauugauguuacgggcuaaauca

SEQ ID NO: 533366 - RNA, 65 nt, Homo Sapiens
uuugcaaugaaauauucauagauauugaaagcuuguguuuacaugaaauauguuuauuaucaaga

SEQ ID NO: 533367 - RNA, 65 nt, Homo Sapiens
ugugcauccuuugauuacucucaugcugcauuuacuguuuacauuuguuuuauuguacauagguu

SEQ ID NO: 533368 - RNA, 65 nt, Homo Sapiens
uuuuauuaaaggcaugcagggauuaacaggacuucuguuuacaauggaaaucugaaauggaagaa

SEQ ID NO: 533369 - RNA, 65 nt, Homo Sapiens
auaauuguuaucuccuuuuggcuuaugugauuuucuguuuacaaguagaauagccaauuauuuaa

SEQ ID NO: 533370 - RNA, 65 nt, Homo Sapiens
ccacuggcuggaggaaguggggucuggccuguugauguuuacauggcgcccugccuccuggagga

SEQ ID NO: 533371 - RNA, 65 nt, Homo Sapiens
aguuuuaauggauuauuuuuaaugaaauguuuuauuguuuacaaacgguauguugcuguguaccu

SEQ ID NO: 533372 - RNA, 65 nt, Homo Sapiens
agccugugccacgauugcaggagucccugccaucauguuuacagaggacaguauuuguggggagg

SEQ ID NO: 533373 - RNA, 65 nt, Homo Sapiens
gggggccagcggcagcgggucagucuggcucgagcuguuuacagugaugccgauauuuucuugcu

SEQ ID NO: 533374 - RNA, 65 nt, Homo Sapiens
gugggcagaugaaaaugaugcauggccaaguucaguguuuacagauaaaacugcugugguucaag

SEQ ID NO: 533375 - RNA, 65 nt, Homo Sapiens
ccuuuuucuuucucuuuuuuuuuuuuguauauuauuguuuacaauaaauauacauugcauuaaaa

SEQ ID NO: 533376 - RNA, 65 nt, Homo Sapiens
auuuauucucuguauaggcauuaccuacguuccuguguuuacauacacaaguagcaaauucgagu

SEQ ID NO: 533377 - RNA, 65 nt, Homo Sapiens
gaaucaccuccugccuuggcgaggcggcagcucauuguuuacaggcaagcccugcuccugggagg

SEQ ID NO: 533378 - RNA, 65 nt, Homo Sapiens
augcauauguaccuguccgucaguguguggauguauguuuacaguucuacauaaaugggaucauu

SEQ ID NO: 533379 - RNA, 65 nt, Homo Sapiens
augaagauuagaugaaauuggaaauaaaccaacauuguuuacauuccaggagacuuguagcucag

SEQ ID NO: 533380 - RNA, 65 nt, Homo Sapiens
gaggacucggccacuguguccccagagguggcccuuguuuacaguccagggucccacccccaacc

SEQ ID NO: 533381 - RNA, 65 nt, Homo Sapiens
ugagugaaacugcacaaaggcauagccaagugacuuguuuacaugcgggggggcgugggucaaau

SEQ ID NO: 533382 - RNA, 65 nt, Homo Sapiens
acuagaaaauuauuaguuuugauacaaaaugguauuguuuacauucacacagugagagucuuaaa

SEQ ID NO: 533383 - RNA, 65 nt, Homo Sapiens
ugugcccugcauuuagucuguucaaauguauaauauguuuacagacuuugacugauauuguaauu

SEQ ID NO: 533384 - RNA, 65 nt, Homo Sapiens
uugaauauuaaaaugugcauuauuuguggauacuuuguuuacauuauucuuuggcuuuuuuggac

SEQ ID NO: 533385 - RNA, 65 nt, Homo Sapiens
gucaaacaucuggaaaauaauauguauuuuauguauguuuacacuauaaagcaucuaaacuuuaa

SEQ ID NO: 533386 - RNA, 65 nt, Homo Sapiens
agagagggguaaaccuaugauuuaguggaagcccuuguuuacagaacucccagugaugaccaggc

SEQ ID NO: 533387 - RNA, 65 nt, Homo Sapiens
uugcauuuugaaugauuagucuuuugcuguugucguguuuacaguuuacucacucaauuguuacc

SEQ ID NO: 533388 - RNA, 65 nt, Homo Sapiens
accaaaaaagaaaaaauccaauauuaaacaguacauguuuacaauuuuuaaauuaaauucgggua

SEQ ID NO: 533389 - RNA, 65 nt, Homo Sapiens
gguggggagauggagcagggcucagcccaaaacucuguuuacaugcagagaggcagcuuaucaaa

SEQ ID NO: 533390 - RNA, 65 nt, Homo Sapiens
uuuauuauccuaugggggccagggccccaccaaucuguuuacauacuuucucuccuucuaucucc

SEQ ID NO: 533391 - RNA, 65 nt, Homo Sapiens
ccagacuuuuauauuuuaaugacuuggccaacugauguuuacaaaaucaugaaggacucugaaua

SEQ ID NO: 533392 - RNA, 65 nt, Homo Sapiens
cucccccuggggcgagggucgcugcuggguuugcauguuuacagaaagacauuuccgaaccaaag

SEQ ID NO: 533393 - RNA, 65 nt, Homo Sapiens
agcaaagacuuggaaccaacuguuuauugcagcacuguuuacaauuaaagacacaugcacacgua

SEQ ID NO: 533394 - RNA, 65 nt, Homo Sapiens
cugccucaaucacucugucucuuguuuuuuaauaauguuuacaaucucuauuuuuuuguuuguuu

SEQ ID NO: 533395 - RNA, 65 nt, Homo Sapiens
accuauuugugugguuauauugggucccgugucacuguuuacaugggguccagugugcccugcga

SEQ ID NO: 533396 - RNA, 65 nt, Homo Sapiens
cugacugacuccugaauuggaagaggaagaacuucuguuuacagaaaacuguauuguuauauaug

SEQ ID NO: 533397 - RNA, 65 nt, Homo Sapiens
aacucuuuccacaguguucagauuuguccuguguguguuuacaguauucaauuuauugcaguuau

SEQ ID NO: 533398 - RNA, 65 nt, Homo Sapiens
aaacuuagugauugccacaagaguaggguaccgucuguuuacacguccaguuaggcuacaguucu

SEQ ID NO: 533399 - RNA, 65 nt, Homo Sapiens
guaacacuuccaaauaugggaggaaaggacagauguguuuacaagggaggauuuuacaacauacu

SEQ ID NO: 533400 - RNA, 65 nt, Homo Sapiens
gugaaacugcauaguaaugagacugugcacacugauguuuacaagauugaaagagucuuucuccg

SEQ ID NO: 533401 - RNA, 65 nt, Homo Sapiens
ugcugcccaacuccugugagagaaaaaccaaucaauguuuacaaaauggaaaaggacacagcaug

SEQ ID NO: 533402 - RNA, 65 nt, Homo Sapiens
uguuuuuguuuuuaccuuggcuuuuguuuuucucauguuuacagugcacggaguguggaaggggg

SEQ ID NO: 533403 - RNA, 65 nt, Homo Sapiens
aauuaccuaaaauauuguuuaccaaaaagauucuguguuuacauguucuuuucuucuggugauug

SEQ ID NO: 533404 - RNA, 65 nt, Homo Sapiens
aaauguaguuuucaugacaauuuuauauugauguguguuuacaaugagaaaauggcaugaaaaua

SEQ ID NO: 533405 - RNA, 65 nt, Homo Sapiens
auuuuaaagacuccuguuuauauugauuacuuaaguguuuacauugugggccaccagagaacccu

SEQ ID NO: 533406 - RNA, 65 nt, Homo Sapiens
cagcagauaauuguucauagauaguuauuuagacauguuuacaugaugauugauguauuuuaucu

SEQ ID NO: 533407 - RNA, 65 nt, Homo Sapiens
gugggacuauauacagucacgccagcaguccacaguguuuacagaugcccuuuucucugagaaga

SEQ ID NO: 533408 - RNA, 65 nt, Homo Sapiens
uuuuugcggagacgguauugcuauguugccaagguuguuuacaugccaguacaauuuauaauaaa

SEQ ID NO: 533409 - RNA, 65 nt, Homo Sapiens
cuagucugcagauugaguugguaggaggugugauuuguuuacaugcaccuuuguuccugcuggua

SEQ ID NO: 533410 - RNA, 65 nt, Homo Sapiens
auagucugcucuccccgggaaucucuaacaugcucuguuuacaucgauaaaugcacuuaaggaaa

SEQ ID NO: 533411 - RNA, 65 nt, Homo Sapiens
ggggucccggaagccccuucuggcugcaccugccauguuuacagagggccccugggcugcgcggc

SEQ ID NO: 533412 - RNA, 65 nt, Homo Sapiens
guuuuuuuucucacaaaguaaauggugggcauccauguuuacauugcaccuucccgugcuguaau

SEQ ID NO: 533413 - RNA, 65 nt, Homo Sapiens
aucuuuugccgugguucugagcauucaccucaccauguuuacaaagaacuguuuuguauauagac

SEQ ID NO: 533414 - RNA, 65 nt, Homo Sapiens
aauuuauccauucugcuguugauggacuuuuacauuguuuacagcuuagggucauaauaaaucau

SEQ ID NO: 533415 - RNA, 65 nt, Homo Sapiens
uggagacccuguuuuuuuaaaaaaagaaguggagguguuuacaccagcaaaauacucauuuuuua

SEQ ID NO: 533416 - RNA, 65 nt, Homo Sapiens
ggccuuuuguauuuuuauuuuuguucaucugcugcuguuuacauucugggggguuagggggaguc

SEQ ID NO: 533417 - RNA, 65 nt, Homo Sapiens
aagaagcuauuugcagacuacagaaugggagaaaauguuuacaaacugcaucugacaaagaucua

SEQ ID NO: 533418 - RNA, 65 nt, Homo Sapiens
acuucgagugaguuuccuaaggccgacugaagcucuguuuacacauaagaguguuccccaaagug

SEQ ID NO: 533419 - RNA, 65 nt, Homo Sapiens
ccugugagccuuuucauuuuguuaauuuuucccaguguuuacaaccaggaaauagcuugucaucu

SEQ ID NO: 533420 - RNA, 65 nt, Homo Sapiens
accgugcugucucugccccacauuguccuuauguauguuuacauggaugucuccccagcagcuug

SEQ ID NO: 533421 - RNA, 65 nt, Homo Sapiens
uuacaaccaacuucuaugaacuuaauuuaaaaacauguuuacaaguacuacacuuuaucuuaauu

SEQ ID NO: 533422 - RNA, 65 nt, Homo Sapiens
agcgcugacucccaacggugguggguggggaugccuguuuacacugggugggggggcuuaucugg

SEQ ID NO: 533423 - RNA, 65 nt, Homo Sapiens
caccggcccccaugacucugccaucaauaaaacucuguuuacaacugccucccccagcccccucc

SEQ ID NO: 533424 - RNA, 65 nt, Homo Sapiens
uccaaucucucuauuucuggcagaacuggauacgguguuuacaaugcccuggcuuucaggguggu

SEQ ID NO: 533425 - RNA, 65 nt, Homo Sapiens
gaugucccugaauaucagcccauaucccacuucuuuguuuacaccaaaaaaucagggauauaguu

SEQ ID NO: 533426 - RNA, 65 nt, Homo Sapiens
aacuuuccacuuuugccaaagagccaugggguugguguuuacaagcuguggagaaaaacuauuuu

SEQ ID NO: 533427 - RNA, 65 nt, Homo Sapiens
uuguuuauugaggagguguuugaagcaguuguuucuguuuacaugaaugagauuuuuguagagac

SEQ ID NO: 533428 - RNA, 65 nt, Homo Sapiens
cugauuuguauacuauuuuagcuauaaauuucaucuguuuacaucauccauauuaaauuuauaug

SEQ ID NO: 533429 - RNA, 65 nt, Homo Sapiens
agcuuuugauguuuguauuacauccuggcauguuuuguuuacaauaguuuuuuucaugaguuucu

SEQ ID NO: 533430 - RNA, 65 nt, Homo Sapiens
uagaaagcugcacuggugcuucaugcugguggcauuguuuacagccccuacagggacacuaucac

SEQ ID NO: 533431 - RNA, 65 nt, Homo Sapiens
caccgucagcggggcgcgcacgcccccaaaccagcuguuuacauacaggaaucagguauuggggc

SEQ ID NO: 533432 - RNA, 65 nt, Homo Sapiens
agggaguauacuaaauguuuacuuaagaaacacccuguuuacagccagaggagaaacacccaaca

SEQ ID NO: 533433 - RNA, 65 nt, Homo Sapiens
gacugucucaacugugcaaaaaacaaaagauggaguguuuacaaguagacauucgucaucaguug

SEQ ID NO: 533434 - RNA, 65 nt, Homo Sapiens
aauuuaguuaugacagugucacuguauccuaguuauguuuacagcacaaauaaauaaugacuguc

SEQ ID NO: 533435 - RNA, 65 nt, Homo Sapiens
aagaguuuaauuuuugaaaacuggcuacugcucuguguuuacagacgugugcaguuguaggcaug

SEQ ID NO: 533436 - RNA, 65 nt, Homo Sapiens
uuacucguucuaucugaugagaacucacacuagcuuguuuacaagaugacgacaguccaagggca

SEQ ID NO: 533437 - RNA, 65 nt, Homo Sapiens
ccugagguguugagggugucacgagcccauucucauguuuacagggguugugggggcagaggggg

SEQ ID NO: 533438 - RNA, 65 nt, Homo Sapiens
agacggcugcugcccuucucugggcauguucugaauguuuacacugguaccuucugguaucuucu

SEQ ID NO: 533439 - RNA, 65 nt, Homo Sapiens
uucugggggcccgacaggugggccugggaggaagauguuuacauuuuuaaagguacacugguauu

SEQ ID NO: 533440 - RNA, 65 nt, Homo Sapiens; identical to SEQ ID NO: 420751

SEQ ID NO: 533441 - RNA, 65 nt, Homo Sapiens; identical to SEQ ID NO: 420752

SEQ ID NO: 533442 - RNA, 65 nt, Homo Sapiens
cacacaaaaugucucucuagaguugacuuuaaaguuguuuacagaaauuuaaacucaauuccaga

SEQ ID NO: 533443 - RNA, 65 nt, Homo Sapiens
guacaacuccacgaggugaaaaauauucaguaacuuguuuacauagcauuuguguaaagacuaug

SEQ ID NO: 533444 - RNA, 65 nt, Homo Sapiens
ucuuuaaaacagugguucuuuauuaaccuguauucuguuuacaugaagauaaugaucucauuguu

SEQ ID NO: 533445 - RNA, 65 nt, Homo Sapiens
uaaaaccuaaaguugcaggaaaugugugcuuuaacuguuuacaagugguuaaaucaucuuuacaa

SEQ ID NO: 533446 - RNA, 65 nt, Homo Sapiens
gaauuucauauucugcaaaaaaacccaaacacugauguuuacacaugaaucagaacuuuuauaua

SEQ ID NO: 533447 - RNA, 65 nt, Homo Sapiens
auguuugcgcagcuucgcuucugaacucuacgccguguuuacagauucugaaccuugggagaggg

SEQ ID NO: 533448 - RNA, 65 nt, Homo Sapiens; identical to SEQ ID NO: 420753

SEQ ID NO: 533449 - RNA, 65 nt, Homo Sapiens; identical to SEQ ID NO: 420754

SEQ ID NO: 533450 - RNA, 65 nt, Homo Sapiens; identical to SEQ ID NO: 420755

SEQ ID NO: 533451 - RNA, 65 nt, Homo Sapiens; identical to SEQ ID NO: 420756

SEQ ID NO: 533452 - RNA, 65 nt, Homo Sapiens
cucccucuccugcacaauucaugucuguagucaguuguuuacaaauuaaagaugacccaauguga

SEQ ID NO: 533453 - RNA, 65 nt, Homo Sapiens
agagaaacaaacaagccccaaaaaaacaauauccuuguuuacagaugacucuacuccuaaaaggg

SEQ ID NO: 533454 - RNA, 65 nt, Homo Sapiens
ugguuuauuugugcauauuuaagacuuaaaaauuguguuuacagagaaaugcaugcaauacuuau

SEQ ID NO: 533455 - RNA, 65 nt, Homo Sapiens
uuguagcaguugggggaaaaugcucaccgucaauauguuuacaagaacuugaauuccgucaucaa

SEQ ID NO: 533456 - RNA, 65 nt, Homo Sapiens
uugggccuugaucaggagccguugcuuauuaauacuguuuacacaggaaauauauuuuuccaucu

SEQ ID NO: 533457 - RNA, 65 nt, Homo Sapiens
ucccaguauggggaccauaguaucauucagugcauuguuuacauauucaaaguggugcacuuuga

SEQ ID NO: 533458 - RNA, 65 nt, Homo Sapiens
gaauguauagaagucucccugcaauuaauuuccaauguuuacauuuuuuaacuagacuguggaau

SEQ ID NO: 533459 - RNA, 65 nt, Homo Sapiens
ucauaucaucugaaaugguauggcugaaguucauuuguuuacagggucgggaaugucuucaguuc

SEQ ID NO: 533460 - RNA, 65 nt, Homo Sapiens
accaaauuugaugcgaucuguaguaagaauucugguguuuacacauauaggcacauuaccauuca

SEQ ID NO: 533461 - RNA, 65 nt, Homo Sapiens
aagcaauaaagugaaagaacuugcuauggccaaaguguuuacaaugguuauuuaaaaacuaacau

SEQ ID NO: 533462 - RNA, 65 nt, Homo Sapiens
aaacucccuuucauguuaauguuauccagaaguauuguuuacauuaugaguaaugugaucgcuug

SEQ ID NO: 533463 - RNA, 65 nt, Homo Sapiens
augaaguuauuaguucuuagacucuguaugcuuaauguuuacaauuaauguggccuugaauuuua

SEQ ID NO: 533464 - RNA, 65 nt, Homo Sapiens; identical to SEQ ID NO: 420757

SEQ ID NO: 533465 - RNA, 65 nt, Homo Sapiens; identical to SEQ ID NO: 420758

SEQ ID NO: 533466 - RNA, 65 nt, Homo Sapiens
gugucccuggcgcugugcuagcuuuccuuuacagcuguuuacagacaaggcaggccugaggcaga

SEQ ID NO: 533467 - RNA, 65 nt, Homo Sapiens
ggcucagaaaaaagaugcuaauauauuuaucucauuguuuacauaagcuuuuacaguuucagacc

SEQ ID NO: 533468 - RNA, 65 nt, Homo Sapiens
agaaggaauguauuuguugcuaaauuucguagcacuguuuacaguuuuccuccauguuauuuaug

SEQ ID NO: 533469 - RNA, 65 nt, Homo Sapiens
uuuagccuuagggaagggaaaacacuaagugaaacuguuuacaauaaccucauacaaccuucugu

SEQ ID NO: 533470 - RNA, 65 nt, Homo Sapiens
agugagccucaugguuuucagagaagucauuguucuguuuacauuuucauaaaaccuguuuaaaa

SEQ ID NO: 533471 - RNA, 65 nt, Homo Sapiens
ccaugcacaaucugugcuucaacagcgggggaaaauguuuacacucucaugcucucagagcaggg

SEQ ID NO: 533472 - RNA, 65 nt, Homo Sapiens
aucagguaacuaacugcauaaggucagccacuguuuguuuacaaaugaaggugauuuaagggccc

SEQ ID NO: 533473 - RNA, 65 nt, Homo Sapiens
guucggcggcagcguuuguuaucuccaccccaucauguuuacagggccugccgcccgccaccccc

SEQ ID NO: 533474 - RNA, 65 nt, Homo Sapiens
uauauugaauaugucaagauaaugucacuuuguuuuguuuacaaaccucuauauauuuuuaaggc

SEQ ID NO: 533475 - RNA, 65 nt, Homo Sapiens
gaugagaacaagaguuaaugucaauauuaauauuguguuuacauuuuacccauuuucuuuaaucu

SEQ ID NO: 533476 - RNA, 65 nt, Homo Sapiens
gaggggcuuucuguaacuuguaacuuguaaucuuuuguuuacaaucuguguguacuuugauuuua

SEQ ID NO: 533477 - RNA, 65 nt, Homo Sapiens
cccggcccucgacaguauuggggccgccccggccauguuuacagcccgaccacuaggggugggca

SEQ ID NO: 533478 - RNA, 65 nt, Homo Sapiens
ugcuuguuuguugcaggcuguaaggcauggcugcuuguuuacaaagcaucucauucauauuaccu

SEQ ID NO: 533479 - RNA, 65 nt, Homo Sapiens
caagaaauggccuguggaauguuauuguucaacguuguuuacagcucuuaaaacauggugaggaa

SEQ ID NO: 533480 - RNA, 65 nt, Homo Sapiens; identical to SEQ ID NO: 420759

SEQ ID NO: 533481 - RNA, 65 nt, Homo Sapiens; identical to SEQ ID NO: 420760

SEQ ID NO: 533482 - RNA, 65 nt, Homo Sapiens
ugacugacaagcauaaaaggcuaacuuguggauaguguuuacaaaaguacaaaaguacuacuucc

SEQ ID NO: 533483 - RNA, 65 nt, Homo Sapiens
ucguauggcuagugagguuucagauuuauuccccauguuuacagauaccgcuaauaaauugcagu

SEQ ID NO: 533484 - RNA, 65 nt, Homo Sapiens
gaugauccucauauggcccagugucaaguugugcuuguuuacagcacuacucugugccagccaca

SEQ ID NO: 533485 - RNA, 65 nt, Homo Sapiens
uauauaugaaauuaauuaggcucuaguccaacaguuguuuacauuuuaaauaguccauauugaau

SEQ ID NO: 533486 - RNA, 65 nt, Homo Sapiens
aagguacaaaaauggcuuuuauacuuaaauauuuuuguuuacauuuccagaauaguggggggaaa

SEQ ID NO: 533487 - RNA, 65 nt, Homo Sapiens
caauaaugugauccuaaaacuggcuuauccuugaguguuuacaacucaaacaacuuuuugaaugc

SEQ ID NO: 533488 - RNA, 65 nt, Homo Sapiens
gagucuucuuuuuuacaauaauguaaaaauuaaacuguuuacauuuuuuuaaagcauuguaguuu

SEQ ID NO: 533489 - RNA, 65 nt, Homo Sapiens
guuguacuaaauaaugaugaccucugcuggauuucuguuuacauccagaaaacaauguuaaggau

SEQ ID NO: 533490 - RNA, 65 nt, Homo Sapiens
ccuccugguuuucuuuuguuacaaccacccuugccuguuuacauuaauugcaaggagcauaacgu

SEQ ID NO: 533491 - RNA, 65 nt, Homo Sapiens
agcacuuuuuaugcucccacugugguugagcuuuauguuuacagucucagcaacaacacuuaugc

SEQ ID NO: 533492 - RNA, 65 nt, Homo Sapiens
augccaggggcuucauucagagacacuuucuuuuguguuuacaucaggagggcucagccuugcug

SEQ ID NO: 533493 - RNA, 65 nt, Homo Sapiens
uuuucuuuaggggaacuacauagacacucaccagauguuuacaagaguuuuuaauguaacaccau

SEQ ID NO: 533494 - RNA, 65 nt, Homo Sapiens
aauacuauguuuuacaguuuugaacaguccucagguguuuacauaaugaagaugcuguacccacu

SEQ ID NO: 533495 - RNA, 65 nt, Homo Sapiens
acagauaaaacuuugugccagugauaaauucaugauguuuacagcuuuuuuuuccuuccaauuuu

SEQ ID NO: 533496 - RNA, 65 nt, Homo Sapiens
guaccugcucgggccagguagauauaacuuuguuuuguuuacagaauucggggaaggcacuuggu

SEQ ID NO: 533497 - RNA, 65 nt, Homo Sapiens
uacagcacuuaaaauguuugccuucuguagagggcuguuuacauaaauuuugcccauacagucuu

SEQ ID NO: 533498 - RNA, 65 nt, Homo Sapiens
ugaagugccuguguaauugaaguuguacuguagauuguuuacaugguuggugccaaaauauuuuc

SEQ ID NO: 533499 - RNA, 65 nt, Homo Sapiens
aagcaaguauccaguaugacaaguacaucuagauguguuuacagaaucuguuucagaauuguaaa

SEQ ID NO: 533500 - RNA, 65 nt, Homo Sapiens
auagucuauuggguugauucguuaccuuacuauuuuguuuacaaguguucaucuguuuuugaagu

SEQ ID NO: 533501 - RNA, 65 nt, Homo Sapiens
auguauugaauaauguuguuugguuguauguggccuguuuacaugguggcuugacagcaucuucc

SEQ ID NO: 533502 - RNA, 65 nt, Homo Sapiens
acucuauaaauggguuccugucgccauaguuguguuguuuacaauauguuaaucugagagcagug

SEQ ID NO: 533503 - RNA, 65 nt, Homo Sapiens
gaugucucuuauaucuaaauguauauccuuuucuguguuuacagaugcauaucuucaucauauug

SEQ ID NO: 533504 - RNA, 65 nt, Homo Sapiens
caccgaggcacccccccgucccccagaaucuuggcuguuuacaaaucacguguccaucgagcacg

SEQ ID NO: 533505 - RNA, 65 nt, Homo Sapiens
agacaaaauguacuucccuuaacuuucauuaauaguguuuacaucuuuugucagcacagcaaacu

SEQ ID NO: 533506 - RNA, 65 nt, Homo Sapiens
ugcuggguucuaauaagcccuacuuccaccuaaucuguuuacagucuuuugguauguuucaguua

SEQ ID NO: 533507 - RNA, 65 nt, Homo Sapiens
cucgugcaagcagggaccucagaucacugaauucauguuuacauugugugacuucugcgaggucc

SEQ ID NO: 533508 - RNA, 64 nt, Homo Sapiens; identical to SEQ ID NO: 109461

SEQ ID NO: 533509 - RNA, 64 nt, Homo Sapiens; identical to SEQ ID NO: 109462

SEQ ID NO: 533510 - RNA, 64 nt, Homo Sapiens; identical to SEQ ID NO: 109463

SEQ ID NO: 533511 - RNA, 64 nt, Homo Sapiens; identical to SEQ ID NO: 109464

SEQ ID NO: 533512 - RNA, 64 nt, Homo Sapiens; identical to SEQ ID NO: 109465

SEQ ID NO: 533513 - RNA, 64 nt, Homo Sapiens; identical to SEQ ID NO: 109466

SEQ ID NO: 533514 - RNA, 64 nt, Homo Sapiens; identical to SEQ ID NO: 109467

SEQ ID NO: 533515 - RNA, 64 nt, Homo Sapiens; identical to SEQ ID NO: 109468

SEQ ID NO: 533516 - RNA, 64 nt, Homo Sapiens; identical to SEQ ID NO: 109469

SEQ ID NO: 533517 - RNA, 64 nt, Homo Sapiens; identical to SEQ ID NO: 109470

SEQ ID NO: 533518 - RNA, 64 nt, Homo Sapiens
cggcuaagggcacgaagacgauaucugguagagagggccagagaugcccgcgugguagggcugc

SEQ ID NO: 533519 - RNA, 64 nt, Homo Sapiens
gaccaggguuucucaaacucguacuugacauuuggggccagauaauucuuuguuguggggcugu

SEQ ID NO: 533520 - RNA, 64 nt, Homo Sapiens
cucucucugcuccuccauucgcaagugucuuccugggccagacuccccuccaccucauguacuu

SEQ ID NO: 533521 - RNA, 64 nt, Homo Sapiens
uccccacaaagccguucgcagcuuccgggagaaggggccagagcccgguggggccaguuucuca

SEQ ID NO: 533522 - RNA, 64 nt, Homo Sapiens
aagggagggaggguggggggacugcaucucacuggggccagaggcguggacauagcccugugau

SEQ ID NO: 533523 - RNA, 64 nt, Homo Sapiens
ggguaguggggaaugaagggaaccacuggacagagggccagaguucaaggucuccgccuuguaa

SEQ ID NO: 533524 - RNA, 64 nt, Homo Sapiens
ugcugggggaccgaguuuguacuguccguucucggggccagagcgggaaggcgccgggcccggg

SEQ ID NO: 533525 - RNA, 64 nt, Homo Sapiens
cgcccggcccagcccuggagcucucccggcagaggggccagaaucaggccgaacuccgcacucg

SEQ ID NO: 533526 - RNA, 64 nt, Homo Sapiens
cugaaaggucccucugacccaggucaccaaauuugggccagaacuggcacuuccgagugcccac

SEQ ID NO: 533527 - RNA, 64 nt, Homo Sapiens
gcgccggacggcgcagcuggccaagaggcgggcggggccagaaauaccucaugccccugcacca

SEQ ID NO: 533528 - RNA, 64 nt, Homo Sapiens
cucccacaggugggugaguggaagugcacagccugggccagauaagcacgaacugcccgucaga

SEQ ID NO: 533529 - RNA, 51 nt, Homo Sapiens
ugguccuuacucccugccauggggccagagcggggugccggccagagcuga

SEQ ID NO: 533530 - RNA, 64 nt, Homo Sapiens
ucuggcucaucucuggcauuccauggagagccuggggccagauauuccacacccuccucgguau

SEQ ID NO: 533531 - RNA, 64 nt, Homo Sapiens
gugggcagagugcaucucggcucuggagcugaaggggccagagaggggauucaguaguccagau

SEQ ID NO: 533532 - RNA, 64 nt, Homo Sapiens
aagugucaagugggaggauacugcccccuugugggggccagacgggucggacacggcugugccc

SEQ ID NO: 533533 - RNA, 64 nt, Homo Sapiens
gagaacagccaguagccuugguaauaugaagggugggccagaagaugauuucacuugcaaaaac

SEQ ID NO: 533534 - RNA, 64 nt, Homo Sapiens
agccuaccccaggacaggagcaucccccagccuggggccagaacaccccugucagucugcuccc

SEQ ID NO: 533535 - RNA, 64 nt, Homo Sapiens
uggcagcacugaaugugggcucuggcugggaggugggccagaccggggugauuggacaagaggg

SEQ ID NO: 533536 - RNA, 64 nt, Homo Sapiens
gacucucguucuuucuagaugagcuggugccuucgggccagaaauccucauugugccuucauca

SEQ ID NO: 533537 - RNA, 64 nt, Homo Sapiens
gugcugggaaggcaguuguuagaaaugcggugaagggccagacggaugugugugugacguguuu

SEQ ID NO: 533538 - RNA, 64 nt, Homo Sapiens
uccccguuacucuuagagaaaggaguuggggugagggccagagcuggcaguggaaacuuguucu

SEQ ID NO: 533539 - RNA, 64 nt, Homo Sapiens
cguaggaaaaaggaauagcaaucauuaaaaucuugggccagagaacacuauuuuuacauaacag

SEQ ID NO: 533540 - RNA, 64 nt, Homo Sapiens
cagccuggggucuggaguugucagaacucaaauggggccagaucgagcccagcuccaaggggaa

SEQ ID NO: 533541 - RNA, 64 nt, Homo Sapiens
ugccacaaggacuuccugucauucacaguucuuugggccagacagaaagauaacuaggaaaucc

SEQ ID NO: 533542 - RNA, 64 nt, Homo Sapiens
caggggggugaggagcuggggagacauacuugaagggccagagcaagcuccucuccccagccca

SEQ ID NO: 533543 - RNA, 64 nt, Homo Sapiens
uacacuuuggccuuccuuuccccagcgccccugagggccagaggcagaugugggcugcaggcug

SEQ ID NO: 533544 - RNA, 64 nt, Homo Sapiens
cuacgccccaugucaucacagggccuucaugacagggccagagccagccagcuuugaagacgcg

SEQ ID NO: 533545 - RNA, 64 nt, Homo Sapiens
ucauguggccaagcacaucuuugaccacgucaucgggccagaaggcgugcuggcaggcaaggug

SEQ ID NO: 533546 - RNA, 64 nt, Homo Sapiens
uccagugcucagagggcggggagaaucucagcgugggccagaggcagcucgugugccuggcccg

SEQ ID NO: 533547 - RNA, 64 nt, Homo Sapiens
cgcucucugcagcguggauuuccuuugcccauuugggccagaaggucaccaggaguucaucacu

SEQ ID NO: 533548 - RNA, 64 nt, Homo Sapiens
agaauagccagcggagcauggacuguuccagcacgggccagauggccagcugucgagagcagcc

SEQ ID NO: 533549 - RNA, 64 nt, Homo Sapiens
ggcacaaggcacucgugcccaaggggcugugcuggggccagacuauaccaggagucacuggaga

SEQ ID NO: 533550 - RNA, 64 nt, Homo Sapiens
cuguugaccauaccaggagucggggcccaggccugggccagaaggcagaggacuccagccuucu

SEQ ID NO: 533551 - RNA, 64 nt, Homo Sapiens
ccaggaaggugggguagacucggggggccuggcugggccagaccccggacacccauagacggug

SEQ ID NO: 533552 - RNA, 64 nt, Homo Sapiens
ggcuaggaucccaaaggacuguugggacuuaggugggccagagggugccuuugcugccccuuag

SEQ ID NO: 533553 - RNA, 64 nt, Homo Sapiens
caggguccccaaaguccuggaguaacaaguggcagggccagaaccauguggaauaaaguaauag

SEQ ID NO: 533554 - RNA, 64 nt, Homo Sapiens
ggcgggucuauguucacgucugaugcccagagcggggccagagcgagagagcggaaggagcagc

SEQ ID NO: 533555 - RNA, 64 nt, Homo Sapiens
accacacauuucacugucugucgaugcagacagggggccagaacuggcaauguuuugcuuuugc

SEQ ID NO: 533556 - RNA, 64 nt, Homo Sapiens
uagcuuugcacuuuucuaaaugaagaccuaaccagggccagaagaccgacaagcacagucaggu

SEQ ID NO: 533557 - RNA, 64 nt, Homo Sapiens; identical to SEQ ID NO: 97587

SEQ ID NO: 533558 - RNA, 64 nt, Homo Sapiens; identical to SEQ ID NO: 97588

SEQ ID NO: 533559 - RNA, 64 nt, Homo Sapiens; identical to SEQ ID NO: 97589

SEQ ID NO: 533560 - RNA, 64 nt, Homo Sapiens; identical to SEQ ID NO: 97590

SEQ ID NO: 533561 - RNA, 64 nt, Homo Sapiens; identical to SEQ ID NO: 97591

SEQ ID NO: 533562 - RNA, 64 nt, Homo Sapiens; identical to SEQ ID NO: 97592

SEQ ID NO: 533563 - RNA, 64 nt, Homo Sapiens; identical to SEQ ID NO: 97593

SEQ ID NO: 533564 - RNA, 61 nt, Homo Sapiens; identical to SEQ ID NO: 97594

SEQ ID NO: 533565 - RNA, 64 nt, Homo Sapiens; identical to SEQ ID NO: 97595

SEQ ID NO: 533566 - RNA, 64 nt, Homo Sapiens; identical to SEQ ID NO: 97596

SEQ ID NO: 533567 - RNA, 64 nt, Homo Sapiens; identical to SEQ ID NO: 97597

SEQ ID NO: 533568 - RNA, 64 nt, Homo Sapiens; identical to SEQ ID NO: 97598

SEQ ID NO: 533569 - RNA, 64 nt, Homo Sapiens; identical to SEQ ID NO: 97599

SEQ ID NO: 533570 - RNA, 64 nt, Homo Sapiens; identical to SEQ ID NO: 97600

SEQ ID NO: 533571 - RNA, 64 nt, Homo Sapiens; identical to SEQ ID NO: 97601

SEQ ID NO: 533572 - RNA, 64 nt, Homo Sapiens; identical to SEQ ID NO: 97602

SEQ ID NO: 533573 - RNA, 64 nt, Homo Sapiens; identical to SEQ ID NO: 97603

SEQ ID NO: 533574 - RNA, 64 nt, Homo Sapiens; identical to SEQ ID NO: 97604

SEQ ID NO: 533575 - RNA, 64 nt, Homo Sapiens; identical to SEQ ID NO: 97605

SEQ ID NO: 533576 - RNA, 64 nt, Homo Sapiens; identical to SEQ ID NO: 97606

SEQ ID NO: 533577 - RNA, 64 nt, Homo Sapiens; identical to SEQ ID NO: 97607

SEQ ID NO: 533578 - RNA, 64 nt, Homo Sapiens; identical to SEQ ID NO: 97608

SEQ ID NO: 533579 - RNA, 64 nt, Homo Sapiens; identical to SEQ ID NO: 97609

SEQ ID NO: 533580 - RNA, 64 nt, Homo Sapiens; identical to SEQ ID NO: 97610

SEQ ID NO: 533581 - RNA, 64 nt, Homo Sapiens; identical to SEQ ID NO: 97611

SEQ ID NO: 533582 - RNA, 64 nt, Homo Sapiens; identical to SEQ ID NO: 97612

SEQ ID NO: 533583 - RNA, 64 nt, Homo Sapiens; identical to SEQ ID NO: 97613

SEQ ID NO: 533584 - RNA, 64 nt, Homo Sapiens; identical to SEQ ID NO: 97614

SEQ ID NO: 533585 - RNA, 64 nt, Homo Sapiens; identical to SEQ ID NO: 97615

SEQ ID NO: 533586 - RNA, 64 nt, Homo Sapiens; identical to SEQ ID NO: 97616

SEQ ID NO: 533587 - RNA, 64 nt, Homo Sapiens; identical to SEQ ID NO: 97617

SEQ ID NO: 533588 - RNA, 64 nt, Homo Sapiens; identical to SEQ ID NO: 97618

SEQ ID NO: 533589 - RNA, 64 nt, Homo Sapiens; identical to SEQ ID NO: 97619

SEQ ID NO: 533590 - RNA, 64 nt, Homo Sapiens; identical to SEQ ID NO: 97620

SEQ ID NO: 533591 - RNA, 64 nt, Homo Sapiens; identical to SEQ ID NO: 97621

SEQ ID NO: 533592 - RNA, 64 nt, Homo Sapiens; identical to SEQ ID NO: 97622

SEQ ID NO: 533593 - RNA, 64 nt, Homo Sapiens; identical to SEQ ID NO: 97623

SEQ ID NO: 533594 - RNA, 64 nt, Homo Sapiens; identical to SEQ ID NO: 97624

SEQ ID NO: 533595 - RNA, 64 nt, Homo Sapiens; identical to SEQ ID NO: 97625

SEQ ID NO: 533596 - RNA, 64 nt, Homo Sapiens; identical to SEQ ID NO: 97626

SEQ ID NO: 533597 - RNA, 64 nt, Homo Sapiens; identical to SEQ ID NO: 97627

SEQ ID NO: 533598 - RNA, 64 nt, Homo Sapiens; identical to SEQ ID NO: 97628

SEQ ID NO: 533599 - RNA, 64 nt, Homo Sapiens; identical to SEQ ID NO: 97629

SEQ ID NO: 533600 - RNA, 64 nt, Homo Sapiens; identical to SEQ ID NO: 97630

SEQ ID NO: 533601 - RNA, 64 nt, Homo Sapiens; identical to SEQ ID NO: 97631

SEQ ID NO: 533602 - RNA, 64 nt, Homo Sapiens; identical to SEQ ID NO: 97632

SEQ ID NO: 533603 - RNA, 64 nt, Homo Sapiens; identical to SEQ ID NO: 97633

SEQ ID NO: 533604 - RNA, 64 nt, Homo Sapiens; identical to SEQ ID NO: 97634

SEQ ID NO: 533605 - RNA, 64 nt, Homo Sapiens; identical to SEQ ID NO: 97635

SEQ ID NO: 533606 - RNA, 64 nt, Homo Sapiens; identical to SEQ ID NO: 97636

SEQ ID NO: 533607 - RNA, 64 nt, Homo Sapiens; identical to SEQ ID NO: 97637

SEQ ID NO: 533608 - RNA, 64 nt, Homo Sapiens; identical to SEQ ID NO: 97638

SEQ ID NO: 533609 - RNA, 64 nt, Homo Sapiens; identical to SEQ ID NO: 97639

SEQ ID NO: 533610 - RNA, 64 nt, Homo Sapiens; identical to SEQ ID NO: 97640

SEQ ID NO: 533611 - RNA, 64 nt, Homo Sapiens; identical to SEQ ID NO: 97641

SEQ ID NO: 533612 - RNA, 64 nt, Homo Sapiens; identical to SEQ ID NO: 97642

SEQ ID NO: 533613 - RNA, 64 nt, Homo Sapiens; identical to SEQ ID NO: 97643

SEQ ID NO: 533614 - RNA, 64 nt, Homo Sapiens; identical to SEQ ID NO: 97644

SEQ ID NO: 533615 - RNA, 64 nt, Homo Sapiens; identical to SEQ ID NO: 97645

SEQ ID NO: 533616 - RNA, 64 nt, Homo Sapiens; identical to SEQ ID NO: 97646

SEQ ID NO: 533617 - RNA, 64 nt, Homo Sapiens; identical to SEQ ID NO: 97647

SEQ ID NO: 533618 - RNA, 64 nt, Homo Sapiens; identical to SEQ ID NO: 97648

SEQ ID NO: 533619 - RNA, 64 nt, Homo Sapiens; identical to SEQ ID NO: 97649

SEQ ID NO: 533620 - RNA, 64 nt, Homo Sapiens; identical to SEQ ID NO: 97650

SEQ ID NO: 533621 - RNA, 64 nt, Homo Sapiens; identical to SEQ ID NO: 97651

SEQ ID NO: 533622 - RNA, 64 nt, Homo Sapiens; identical to SEQ ID NO: 97652

SEQ ID NO: 533623 - RNA, 64 nt, Homo Sapiens; identical to SEQ ID NO: 97653

SEQ ID NO: 533624 - RNA, 64 nt, Homo Sapiens; identical to SEQ ID NO: 97654

SEQ ID NO: 533625 - RNA, 64 nt, Homo Sapiens; identical to SEQ ID NO: 97655

SEQ ID NO: 533626 - RNA, 64 nt, Homo Sapiens; identical to SEQ ID NO: 97656

SEQ ID NO: 533627 - RNA, 64 nt, Homo Sapiens; identical to SEQ ID NO: 97657

SEQ ID NO: 533628 - RNA, 64 nt, Homo Sapiens; identical to SEQ ID NO: 97658

SEQ ID NO: 533629 - RNA, 64 nt, Homo Sapiens; identical to SEQ ID NO: 97659

SEQ ID NO: 533630 - RNA, 58 nt, Homo Sapiens; identical to SEQ ID NO: 97660

SEQ ID NO: 533631 - RNA, 64 nt, Homo Sapiens; identical to SEQ ID NO: 97661

SEQ ID NO: 533632 - RNA, 64 nt, Homo Sapiens; identical to SEQ ID NO: 97662

SEQ ID NO: 533633 - RNA, 64 nt, Homo Sapiens; identical to SEQ ID NO: 97663

SEQ ID NO: 533634 - RNA, 64 nt, Homo Sapiens; identical to SEQ ID NO: 97664

SEQ ID NO: 533635 - RNA, 64 nt, Homo Sapiens; identical to SEQ ID NO: 97665

SEQ ID NO: 533636 - RNA, 64 nt, Homo Sapiens; identical to SEQ ID NO: 97666

SEQ ID NO: 533637 - RNA, 64 nt, Homo Sapiens; identical to SEQ ID NO: 97667

SEQ ID NO: 533638 - RNA, 64 nt, Homo Sapiens; identical to SEQ ID NO: 97668

SEQ ID NO: 533639 - RNA, 64 nt, Homo Sapiens; identical to SEQ ID NO: 97669

SEQ ID NO: 533640 - RNA, 64 nt, Homo Sapiens; identical to SEQ ID NO: 97670

SEQ ID NO: 533641 - RNA, 64 nt, Homo Sapiens
uuuaucuuaguguuuuuaaacuugguuuugguuacuugaggaguuuuuuaauaauauugugugc

SEQ ID NO: 533642 - RNA, 64 nt, Homo Sapiens
cuuuucccaccucuugauaucugugauacugaaacuugaggauguugaaauguauuacauuuug

SEQ ID NO: 533643 - RNA, 64 nt, Homo Sapiens
caacugaauacccagaguaguggaaauuuuaggacuugaggacgugaacaacuugaaagagaaa

SEQ ID NO: 533644 - RNA, 64 nt, Homo Sapiens
gacgugaacaacuugaaagagaaaauugauuccccuugaggaaagaauggcucaacguggauuu

SEQ ID NO: 533645 - RNA, 64 nt, Homo Sapiens
aaaauacauguauauuuuugcucugaugccugaacuugaggaggaauacaagucacuaaucaua

SEQ ID NO: 533646 - RNA, 64 nt, Homo Sapiens
uggugaaaaggcagauucuugaucgccugcaucacuugaggagcuguuucucaaaaucuccaua

SEQ ID NO: 533647 - RNA, 64 nt, Homo Sapiens
agugagaacgugcagggccugccuagcuugcgugcuugaggaagguggcauuccgugcuugccu

SEQ ID NO: 533648 - RNA, 64 nt, Homo Sapiens
gugcuugaggaagguggcauuccgugcuugccuccuugaggaggguggcauucugugucuucug

SEQ ID NO: 533649 - RNA, 64 nt, Homo Sapiens
gagggcuugagguuggugagucuuugcauggagacuugaggaggcuccacucugacuggcacag

SEQ ID NO: 533650 - RNA, 64 nt, Homo Sapiens
ucaccaauuaaccagaaaucggcuugccacagcucuugaggaugccaucacgcggccgagacau

SEQ ID NO: 533651 - RNA, 64 nt, Homo Sapiens
cuuugguguguggugggaagugguggcagcuguccuugaggaacacauguucuugcagcagcuc

SEQ ID NO: 533652 - RNA, 64 nt, Homo Sapiens
ugacugugaagcgacgcccaauuuuagucuucugcuugaggaacaucuucuaaaaagaaauaau

SEQ ID NO: 533653 - RNA, 62 nt, Homo Sapiens; identical to SEQ ID NO: 172166

SEQ ID NO: 533654 - RNA, 62 nt, Homo Sapiens; identical to SEQ ID NO: 172167

SEQ ID NO: 533655 - RNA, 62 nt, Homo Sapiens; identical to SEQ ID NO: 172168

SEQ ID NO: 533656 - RNA, 62 nt, Homo Sapiens; identical to SEQ ID NO: 172169

SEQ ID NO: 533657 - RNA, 62 nt, Homo Sapiens; identical to SEQ ID NO: 172170

SEQ ID NO: 533658 - RNA, 62 nt, Homo Sapiens; identical to SEQ ID NO: 172171

SEQ ID NO: 533659 - RNA, 62 nt, Homo Sapiens; identical to SEQ ID NO: 172172

SEQ ID NO: 533660 - RNA, 62 nt, Homo Sapiens; identical to SEQ ID NO: 172173

SEQ ID NO: 533661 - RNA, 62 nt, Homo Sapiens; identical to SEQ ID NO: 172174

SEQ ID NO: 533662 - RNA, 62 nt, Homo Sapiens; identical to SEQ ID NO: 172175

SEQ ID NO: 533663 - RNA, 62 nt, Homo Sapiens; identical to SEQ ID NO: 172176

SEQ ID NO: 533664 - RNA, 62 nt, Homo Sapiens; identical to SEQ ID NO: 172177

SEQ ID NO: 533665 - RNA, 62 nt, Homo Sapiens; identical to SEQ ID NO: 172178

SEQ ID NO: 533666 - RNA, 62 nt, Homo Sapiens; identical to SEQ ID NO: 172179

SEQ ID NO: 533667 - RNA, 62 nt, Homo Sapiens; identical to SEQ ID NO: 172180

SEQ ID NO: 533668 - RNA, 62 nt, Homo Sapiens; identical to SEQ ID NO: 172181

SEQ ID NO: 533669 - RNA, 62 nt, Homo Sapiens; identical to SEQ ID NO: 172182

SEQ ID NO: 533670 - RNA, 62 nt, Homo Sapiens; identical to SEQ ID NO: 172183

SEQ ID NO: 533671 - RNA, 64 nt, Homo Sapiens
ccuggguaacuagggaagauaauauuaaggaagacaaugugaaaagaaaaaugagccuggcaag

SEQ ID NO: 533672 - RNA, 64 nt, Homo Sapiens
ucacuugaguccagaaguuugagaucagccugggcaaugugauaaaaccccaucucuacaaaaa

SEQ ID NO: 533673 - RNA, 64 nt, Homo Sapiens
uaauaguauuauaauugguuuauguaaaguuguucaaugugacauaguauuucaaagaagcaau

SEQ ID NO: 533674 - RNA, 64 nt, Homo Sapiens
acggguucuguaguauuuguaacacucaaccaaacaaugugaaaauacagaauugaaaaagaua

SEQ ID NO: 533675 - RNA, 64 nt, Homo Sapiens
cccccaagcguuuuauauuuauguauuuuguauucaaugugaggcuuauuaaaaauagugauuc

SEQ ID NO: 533676 - RNA, 64 nt, Homo Sapiens
cagauauuuguggauuacaauccucauuuacuuccaaugugacuaaaaagagaaaaaaaaucac

SEQ ID NO: 533677 - RNA, 64 nt, Homo Sapiens
aacuuuaaugaaagguggaaaauaauuuaacuuacaaugugaaaauacaaugugaaauguacaa

SEQ ID NO: 533678 - RNA, 64 nt, Homo Sapiens
gguggaaaauaauuuaacuuacaaugugaaaauacaaugugaaauguacaauaaaucauauuua

SEQ ID NO: 533679 - RNA, 64 nt, Homo Sapiens
auaauuugccagacagagaucagaauugaaccgucaaugugaaauaaagaguucuccuuguacu

SEQ ID NO: 533680 - RNA, 64 nt, Homo Sapiens
guuauguaaacaucauaaauaguaaauaaugauucaaugugaauuuuaaaaugcaaauauugcu

SEQ ID NO: 533681 - RNA, 64 nt, Homo Sapiens
auuucauaugcauuuugccuuauugcuaccaaaucaaugugacuuucugaaaauuaaagaccau

SEQ ID NO: 533682 - RNA, 64 nt, Homo Sapiens
gauuuuugcagauucaaaauaucugucccaacagcaaugugacgaaaauuuuagccuuaucuua

SEQ ID NO: 533683 - RNA, 64 nt, Homo Sapiens
ccuaaaggggucucacuuuaccaauuguuacuuucaaugugaggaaugaaugauaaauuaagag

SEQ ID NO: 533684 - RNA, 64 nt, Homo Sapiens
uugauaagcauaggagguucuguuauuaaagaaacaaugugaaauaauguggaaauuaauacug

SEQ ID NO: 533685 - RNA, 64 nt, Homo Sapiens
cuuucuggcaaacguuucucaaaucugcuucauccaaugugaaguucaucuugcagcauuuacu

SEQ ID NO: 533686 - RNA, 64 nt, Homo Sapiens
ugacauucggggugauccuguucugcgcuguguacaaugugagaucggugcguucuccugaugu

SEQ ID NO: 533687 - RNA, 64 nt, Homo Sapiens
uagacuaagugaaaaucugagaaagaguuaauugcaaugugauaguggguagaaaggagagaaa

SEQ ID NO: 533688 - RNA, 64 nt, Homo Sapiens
uuauaauaauuauaaaugguauaaaugcauucuacaaugugauuauuuucuguauuuuaguaua

SEQ ID NO: 533689 - RNA, 64 nt, Homo Sapiens
uggggcagauaaaaugccagcuggucagcugccccaaugugaccgugaggagucuggguccauc

SEQ ID NO: 533690 - RNA, 64 nt, Homo Sapiens
aauggcacugaccggugcuuauguuuuauccuuacaaugugaaucggcgccuuuuuggccugug

SEQ ID NO: 533691 - RNA, 64 nt, Homo Sapiens
gggcagguccccuauuuuaaucauaauuuguucuuaaguauacugauuccaaucccgauccaaa

SEQ ID NO: 533692 - RNA, 64 nt, Homo Sapiens
uuguguguguuguuugucuuugcacaugcaggccuaaguauauguauuucucacagaugugcag

SEQ ID NO: 533693 - RNA, 64 nt, Homo Sapiens
uucuaauagaaagaugugcuacacuguauuguaauaaguauacucuguuauagucaacaaaguu

SEQ ID NO: 533694 - RNA, 64 nt, Homo Sapiens
acaguaguuaaauaggaaauaaacuaguuccauauaaguauacaccuagaguuuuaauuaccuu

SEQ ID NO: 533695 - RNA, 64 nt, Homo Sapiens
aucuguuguaaaaucagacuuugcuaaaaauaaauaaguauaaucucuuuauauaaauacccau

SEQ ID NO: 533696 - RNA, 64 nt, Homo Sapiens
aacacaaaugcauaucauugcuugcuacaaugguuaaguauacaauauacggcacuucacuggg

SEQ ID NO: 533697 - RNA, 64 nt, Homo Sapiens
caccacauuuucuuuauccaucuggauauguauauaaguauauauacaccacauuauccaguca

SEQ ID NO: 533698 - RNA, 64 nt, Homo Sapiens
caccacauuauccagucaucuauguguauguauauaaguauauauguguguaugcauauaugug

SEQ ID NO: 533699 - RNA, 64 nt, Homo Sapiens
uuuuaaagauaugggacuuuaaauacucgauauauaaguauagauuaaguaauauaugaagugu

SEQ ID NO: 533700 - RNA, 64 nt, Homo Sapiens
cauuuuuucugauuguugugaaguuaaguuauuuuaaguauauguuauaugaauauuauuauuu

SEQ ID NO: 533701 - RNA, 64 nt, Homo Sapiens
aaaaaagucguaucuuaacaaugcaaauggccacuaaguauauggaaaaaucacagaagagaga

SEQ ID NO: 533702 - RNA, 64 nt, Homo Sapiens
cuaugauuuuauuuauaaauaugaagaaaugcuauaaguauaaauugaaaaaaaaacacuaaaa

SEQ ID NO: 533703 - RNA, 64 nt, Homo Sapiens
uugcgggugcuucaggacuuuuugcuucuauauuuaaguauauuguuuuuauagcaagaacaua

SEQ ID NO: 533704 - RNA, 64 nt, Homo Sapiens
ggcaacuucgcauauuuucauugacaccaguguauaaguauaaauuuaaaugaacuaauuacuu

SEQ ID NO: 533705 - RNA, 64 nt, Homo Sapiens
auuucagcuuccuugauuuagaccagaguauauuuaaguauauauugugguucauguauauuuu

SEQ ID NO: 533706 - RNA, 64 nt, Homo Sapiens
agauuuuacugauauguaaauguauacauaguuuuaaguauaacguuuuuugccagaaauguac

SEQ ID NO: 533707 - RNA, 64 nt, Homo Sapiens
gaaaauaauguaccuugauuaaauucgagcuacauaaguauaugggacauuuagauacauaaua

SEQ ID NO: 533708 - RNA, 64 nt, Homo Sapiens
uuagagcugaaucaguaagaaagccuugacaaaguaaguauauuuuauuucaacacauucuaag

SEQ ID NO: 533709 - RNA, 64 nt, Homo Sapiens
cauguaagaauuauaaauuuuuguacuucuggcuuaaguauaacgaaguuacuuauuucuaguc

SEQ ID NO: 533710 - RNA, 64 nt, Homo Sapiens
uuacuuauuuuaauuuucuggguuuuaaguauuuuaaguauauaugaaaauggauauagauaca

SEQ ID NO: 533711 - RNA, 64 nt, Homo Sapiens
aggcacauuugugguaauuuauaugucuauagaguaaguauaagagauaauucauuaguaauag

SEQ ID NO: 533712 - RNA, 64 nt, Homo Sapiens
uccuuaagauccuaaacaaaucaucuuugucaguuaaguauaguugcgcaaaaauuguuaaauc

SEQ ID NO: 533713 - RNA, 64 nt, Homo Sapiens
ucauaggauuugagaaucuuaacacauguauaaauaaguauauauaaacuccaauuuuaaaucu

SEQ ID NO: 533714 - RNA, 64 nt, Homo Sapiens
uuucauauaauuuuauuuauuaagaauuccaaucuaaguauaaagguacaagguagugagaagg

SEQ ID NO: 533715 - RNA, 64 nt, Homo Sapiens
caguucuauuugcuaucugaacuaauucauuuauuaaguauauuuguaaaagcuaaggcucgag

SEQ ID NO: 533716 - RNA, 64 nt, Homo Sapiens
aucucaaauacaguaguauaauguaugaauuuuguaaguauaagaaauuuuauuagacauucuc

SEQ ID NO: 533717 - RNA, 64 nt, Homo Sapiens
uuucugcuuuuacagcagcuucucucccacaccacaacuuuauuaagguauaguggauaauuua

SEQ ID NO: 533718 - RNA, 64 nt, Homo Sapiens
uccccaacuuguaaugauucaauuuaggguuuuucaacuuuacugucgguuuauugggguauua

SEQ ID NO: 533719 - RNA, 64 nt, Homo Sapiens
uaaguuaugcuacaucuugacccacuagaauuagcaacuuuauuauagauuuaaacuuucuuca

SEQ ID NO: 533720 - RNA, 64 nt, Homo Sapiens
cuuuacaguugacaggaaccuggaccccuuaccccaacuuuaugaguaaugcuuggaauaaaaa

SEQ ID NO: 533721 - RNA, 64 nt, Homo Sapiens
ugcaaugggauuuuuccuagucuucucccacccccaacuuuauuuugaaagcuuuaaaggagau

SEQ ID NO: 533722 - RNA, 64 nt, Homo Sapiens
auuugaaagcuuuaaaggaguguguaaacaggaacaacuuuaugccuuuaaguaugcuccucaa

SEQ ID NO: 533723 - RNA, 64 nt, Homo Sapiens
ccaagcaaaggggcugaaaaacugaauaaggaaacaacuuuauaagagaaacaguggucuucaa

SEQ ID NO: 533724 - RNA, 64 nt, Homo Sapiens
cagcauaaugacuguguguucugagaaaugcaaacaacuuuaugaaaguguggucaucuugacc

SEQ ID NO: 533725 - RNA, 64 nt, Homo Sapiens
gauagguugacuaucuaaauugucauuuaguguccaacuuuacgucaacuuuaaauguucacua

SEQ ID NO: 533726 - RNA, 64 nt, Homo Sapiens
uguucacuaugucauuuaguuagacaaagaguuucaacuuuaaaaguuuuaggaaaauauuugg

SEQ ID NO: 533727 - RNA, 64 nt, Homo Sapiens
uagaaugacaugggguggguacuuuagugcuucccaacuuuauuguggcaaagacaccagcuca

SEQ ID NO: 533728 - RNA, 64 nt, Homo Sapiens
gcuucccaacuuuauuuagacaaagacaccagcucaacuuuagugagucuggggacauccgugg

SEQ ID NO: 533729 - RNA, 64 nt, Homo Sapiens
uuaaaacuagaaaccauuguucuaacaaagcaggcaacuuuauucuauaaacacaacuuuauua

SEQ ID NO: 533730 - RNA, 64 nt, Homo Sapiens
uucuaacaaagcaggcaacuuuauucuauaaacacaacuuuauuaagcagaauacacuguagau

SEQ ID NO: 533731 - RNA, 64 nt, Homo Sapiens
gacugaaagaaacuaugcuagggucuugagcuugcuggcauaugacugaaaaauggcucuucuu

SEQ ID NO: 533732 - RNA, 64 nt, Homo Sapiens
auccagugcacucccuaggauguggguaaucaaacuggcauaaagaaugaaugaggaagaaaac

SEQ ID NO: 533733 - RNA, 64 nt, Homo Sapiens
aucugugucaaguucaaugugagcccuggcaaggcuggcauauuaacaccugccuucuggcuuc

SEQ ID NO: 533734 - RNA, 64 nt, Homo Sapiens
guuugucacaugugaugaagacaaauauguauaccuggcauagagaaaaauauauaccugguac

SEQ ID NO: 533735 - RNA, 64 nt, Homo Sapiens
gaguccucacuccuggccuuggauaccauggguccuggcauagagcagcucacucccagggauu

SEQ ID NO: 533736 - RNA, 64 nt, Homo Sapiens
cuuaucccccucaucucuggggcccccuguggaucuggcauacccaaguucaguaaaugucuau

SEQ ID NO: 533737 - RNA, 64 nt, Homo Sapiens
gagugggucucuguggcuuucacugauguucacucuggcauacuuucgcaauuuucuuuuucaa

SEQ ID NO: 533738 - RNA, 64 nt, Homo Sapiens
guguucaucaggugccuauggauuaaaucacauacuggcauauuuaagcugaaugucaaucugg

SEQ ID NO: 533739 - RNA, 64 nt, Homo Sapiens
guguuaucugugaaugcacaacaguuuagaaucuuaugcuuacaagaggaauguuaaauaucua

SEQ ID NO: 533740 - RNA, 64 nt, Homo Sapiens
gcgcuguggacaaucugauuuugauauaauguguuaugcuuaugaguugaaauguccccuuaac

SEQ ID NO: 533741 - RNA, 64 nt, Homo Sapiens
uuuguuugaaauuuguuuuuuauuuccauuugguuaugcuuauuuugacauuuauuuauucuuu

SEQ ID NO: 533742 - RNA, 64 nt, Homo Sapiens
uucuuagcaguugauaaaauuaaaggaaagagguuaugcuuauccacuugagggugauauguuu

SEQ ID NO: 533743 - RNA, 64 nt, Homo Sapiens
auaaaugugucacuucuaaauuugcucacgcauguaugcuuaguuguauucugugcuuauuuuu

SEQ ID NO: 533744 - RNA, 64 nt, Homo Sapiens
guaaauauuuccuagcuuguccagaauuucacaauaugcuuacaaaguauugauaguaugucuu

SEQ ID NO: 533745 - RNA, 64 nt, Homo Sapiens
acuuuccuuuuauuaauugucaauuuagagaaacuaugcuuaagcuggucuuuugcauugcuaa

SEQ ID NO: 533746 - RNA, 64 nt, Homo Sapiens
auuuauaauugaugucaauauuaguaguccacuuuaugcuuaaaauaaaaucauaaaaaaucaa

SEQ ID NO: 533747 - RNA, 64 nt, Homo Sapiens
aagucuccagucaccuacaacuuccuucucucaauaugcuuacaauuuauuacuaaccuucugg

SEQ ID NO: 533748 - RNA, 64 nt, Homo Sapiens
auauccuuuguggcaccuuuuugucaugaauucuuaugcuuauacugugucugaagugguuguu

SEQ ID NO: 533749 - RNA, 64 nt, Homo Sapiens
agagccaaguagucaguggaagggcaagaauucuuaugcuuauguuauggaguuugugggaaau

SEQ ID NO: 533750 - RNA, 64 nt, Homo Sapiens
aaaaaaaaauuuuuuuuuaaaaucaacuggagucuaugcuuaaaggaaacagcuuguuguaccg

SEQ ID NO: 533751 - RNA, 64 nt, Homo Sapiens
gauuugauaaaucuuauacuuauggauuuaguaguaugcuuauguuuuaucuuaguaguaugcu

SEQ ID NO: 533752 - RNA, 64 nt, Homo Sapiens
gauuuaguaguaugcuuauguuuuaucuuaguaguaugcuuaugcaucuuuuacucugacuugc

SEQ ID NO: 533753 - RNA, 64 nt, Homo Sapiens
ugguauuugugcaaaagagaugaagacuucucaauaugcuuauuuugcuuugcauaauuggcuc

SEQ ID NO: 533754 - RNA, 64 nt, Homo Sapiens
agguaauauuuguacuuuaacauguugcauaauauaugcuuauguagcuuuccaggacuaacag

SEQ ID NO: 533755 - RNA, 64 nt, Homo Sapiens
cucuacuauuauaaccaaaaaauauuucuuguaugucccauaaaaauauuuguguaauucuuau

SEQ ID NO: 533756 - RNA, 64 nt, Homo Sapiens
agacuacugggauccuucagaaaagaaacacugggucccauagcuaaauucucaaccgccaggc

SEQ ID NO: 533757 - RNA, 64 nt, Homo Sapiens
uuacaauuacugaccauccccaguagacuccccagucccauaauuguguaucuuccagccagga

SEQ ID NO: 533758 - RNA, 64 nt, Homo Sapiens
caaauuucuugugguuuguauuaucagcaagauggucccauaagucuacauuucuagaaaguuc

SEQ ID NO: 533759 - RNA, 64 nt, Homo Sapiens
guuaucuccccugcccuggugaggccagggaauggucccauacaggagagugcuggggcaggug

SEQ ID NO: 533760 - RNA, 64 nt, Homo Sapiens
agggauagcacugagcaaagcauugagcaaaggggucccauagaggugagggaagccugaaaaa

SEQ ID NO: 533761 - RNA, 64 nt, Homo Sapiens
agguccguggccauucacuucaauuuugaccucugucccauagugaagaacauuuaaaguaaua

SEQ ID NO: 533762 - RNA, 64 nt, Homo Sapiens
ucuugugaaaaggcuuuuucgcaagauccagguggucccauaggacacagaggaccucuuuggg

SEQ ID NO: 533763 - RNA, 64 nt, Homo Sapiens
gaaaugcuguauugccauagauacaaaguagccagucccauaauuauguuucacauauaguuuu

SEQ ID NO: 533764 - RNA, 64 nt, Homo Sapiens
augcuuuuuacucccugauccauguaucuguuuugucccauaaugcagacaguguuuugcacau

SEQ ID NO: 533765 - RNA, 64 nt, Homo Sapiens
auuauaauggagcagaaaaucauauacaauaguggucccauaaaaguuauguacugcauaauga

SEQ ID NO: 533766 - RNA, 64 nt, Homo Sapiens
agacucacggucuccauuauggucuacuugucuagucccauaccugguuucuggguucuccauu

SEQ ID NO: 533767 - RNA, 64 nt, Homo Sapiens
agggaacauuuugguuauuuaaauuguucauaaugucccauauuucaccuguucaguguauacu

SEQ ID NO: 533768 - RNA, 64 nt, Homo Sapiens
aaaaagaaaugacaauauggaacaucccaaggcugucccauaggguuggaaguuguguagcauu

SEQ ID NO: 533769 - RNA, 64 nt, Homo Sapiens
uguaaucauaucuacaugcauguucaaaauaauagucccauaucgaaaucaccaacaaagaaga

SEQ ID NO: 533770 - RNA, 64 nt, Homo Sapiens
aagcucuguguguaccuggucccuucuagguguggucccauaggagcagccuuagcauccccug

SEQ ID NO: 533771 - RNA, 64 nt, Homo Sapiens
aucccaacuagauaggcuuuaugcucacaucauugucccauacccaccccuuucucauccccau

SEQ ID NO: 533772 - RNA, 64 nt, Homo Sapiens
agcuauaugaagcacuuugcagugaauggcaggugucccauaucugguuauguuaaccuagaaa

SEQ ID NO: 533773 - RNA, 64 nt, Homo Sapiens
ucaagaagccucuccacacucuguggcacuuccagucccauaaauccuguuucuuauccacuuu

SEQ ID NO: 533774 - RNA, 64 nt, Homo Sapiens
ucuagguucaaaagaaguuguaguguuaucaggcgucccauaccuuguuuuuaaucuccuguuu

SEQ ID NO: 533775 - RNA, 64 nt, Homo Sapiens
auguccagucauacuucuucgugguguuuucccagucccauauucugcagcaaccuggcucugu

SEQ ID NO: 533776 - RNA, 64 nt, Homo Sapiens
uuccuccugacaguuugauguugcaggugccagugucccauaugcucugcuuuuaaaaaaacca

SEQ ID NO: 533777 - RNA, 64 nt, Homo Sapiens
auguguaaaaacaauugaccagcuaggcuauuuagucccauaguaguucagaucugcuuagaug

SEQ ID NO: 533778 - RNA, 64 nt, Homo Sapiens
cccccuuacuuuaauucuugggccuccaauaagugucccauaggugucuggccaggcccaccug

SEQ ID NO: 533779 - RNA, 64 nt, Homo Sapiens
ggaaaagguguucagggcacuucuuguccucucugucccauaaccuaccuccacccucccccua

SEQ ID NO: 533780 - RNA, 64 nt, Homo Sapiens
caucaggcuggagucuucuccaguguggacucaggucccauagacccacagcuugugcccucca

SEQ ID NO: 533781 - RNA, 64 nt, Homo Sapiens
ugggaacaaauacagcuuucuuccugaucucuuagucccauaaacgcaaaacacauccuuauug

SEQ ID NO: 533782 - RNA, 64 nt, Homo Sapiens
gguagcccccucaucugcaggggcggccucccaggucccauaaggugacauccgucccacauca

SEQ ID NO: 533783 - RNA, 64 nt, Homo Sapiens
aagcaaagucauuggaugggaggaggaagaaaaagucccauaaaggaacuuuuguagucuuauc

SEQ ID NO: 533784 - RNA, 54 nt, Homo Sapiens
ucaaagcuuccuucaaauaagauggucccauagucuguauccaaauaaugaauc

SEQ ID NO: 533785 - RNA, 64 nt, Homo Sapiens
uacuaaaaaaaaauuuuauacuuuccuugcuaaggucccauauauugauuuguacagauccacu

SEQ ID NO: 533786 - RNA, 64 nt, Homo Sapiens
auucugauuuuaggauguccagauucugaccacugucccauaggcugaggaaaguccugugggg

SEQ ID NO: 533787 - RNA, 64 nt, Homo Sapiens
uucaagagaugaaccuaaaugagauaggaagccugucccauagcagccuuccucucacuacuuu

SEQ ID NO: 533788 - RNA, 64 nt, Homo Sapiens
guguuuuuuacaugguagauuacuaccuuguagugucccauacuucauuuaaaaaauauauaaa

SEQ ID NO: 533789 - RNA, 64 nt, Homo Sapiens
gaagcacaggggacucacccaucaaccagcauuggucccauagggccgcuccuucuuucagccc

SEQ ID NO: 533790 - RNA, 64 nt, Homo Sapiens
ccccugagcaaugucugugcuagggaaacuucccgucccauauccugccucagcccgccaaggu

SEQ ID NO: 533791 - RNA, 64 nt, Homo Sapiens
ugugcucaguuuggcagcuauagaaggaaaugcugucccauaaaaugccauuccuauuuucuaa

SEQ ID NO: 533792 - RNA, 64 nt, Homo Sapiens
gaggaauuuaaaugagcuguggauuauucauuuugucccauaagaagauaauuaaaaaaugaca

SEQ ID NO: 533793 - RNA, 64 nt, Homo Sapiens
gaaacaaauaucaaggaugagaauggcacuggcugucccauaugguauccaggagccaccaaug

SEQ ID NO: 533794 - RNA, 64 nt, Homo Sapiens
augauaacacaaauucacauauaauuggggguuagucccauacucuauaacagacuuaguccug

SEQ ID NO: 533795 - RNA, 64 nt, Homo Sapiens
aaauuggguguguauacuugcuguggcaaagcgugucccauagaagagcuuggcccucuuuccu

SEQ ID NO: 533796 - RNA, 64 nt, Homo Sapiens
ucauggaugccaccagcuuggugaaauuuuuccagucccauagcuuagaaaaauuggccucagu

SEQ ID NO: 533797 - RNA, 64 nt, Homo Sapiens
ucaaaagauuguuuuauauguaguacuaacuaaggucccauaauaaaaagauaguaucuuuuaa

SEQ ID NO: 533798 - RNA, 64 nt, Homo Sapiens
gucccuaagcuggggacagagaagguucugagcugucccauacucccacuuugugccaaaugac

SEQ ID NO: 533799 - RNA, 64 nt, Homo Sapiens
uucuuuuaagggauaguuuguaauaguaagaacugucccauauguuaguaaauuacauauguac

SEQ ID NO: 533800 - RNA, 64 nt, Homo Sapiens
ggaccccagcaagugguccuagaggcccuuugcugucccauagucccugccacgaauuucugug

SEQ ID NO: 533801 - RNA, 64 nt, Homo Sapiens
accacacaaaagcaugaugaaaaggcuucuuguagucccauaauuucuugugaacuaauguugu

SEQ ID NO: 533802 - RNA, 64 nt, Homo Sapiens
ccugagugcagggguaguccuggggagccaagaggucccauauucucuaggggcuaggggggag

SEQ ID NO: 533803 - RNA, 64 nt, Homo Sapiens
agucauucacacaugugaaguaaccauauguucugucccauagcguugcugucgcuccuguuuu

SEQ ID NO: 533804 - RNA, 64 nt, Homo Sapiens
ucccagcucucuaaaguguuaagacgggaaugaugucccauacuaaucaguuacugagugaaga

SEQ ID NO: 533805 - RNA, 64 nt, Homo Sapiens
aauuuuaaucuaacccuuauguguauaaauuggugucccauaccagcuuuuaaugguggaccua

SEQ ID NO: 533806 - RNA, 64 nt, Homo Sapiens
ugagaaagcuuaaauacaccgucuauuauuuguugucccauaauuuuuaguaugaagcaaugaa

SEQ ID NO: 533807 - RNA, 64 nt, Homo Sapiens
acagaaaugggaugcuagcgcaucgggcuuugcagucccauagauauaguggaaugagugugag

SEQ ID NO: 533808 - RNA, 64 nt, Homo Sapiens
ugcaaggggaggggauuugggacucucccuacuugucccauauuuuguccuggugccuccauca

SEQ ID NO: 533809 - RNA, 64 nt, Homo Sapiens
uugucaguagaugccuuuuuugcauaacagacaagucccauauuauuuuauagcccacuuacca

SEQ ID NO: 533810 - RNA, 64 nt, Homo Sapiens
ggggcucagcuauuuuucugccccuucacuuccagucccauagcgggccaggagguucuggagg

SEQ ID NO: 533811 - RNA, 64 nt, Homo Sapiens
cuguauucgggauccaucuguauaagaacucaaggucccauacugugaaaaaaaaaaaaaaaga

SEQ ID NO: 533812 - RNA, 64 nt, Homo Sapiens
ccccgguugguugccagugacuugccauuaagaagucccauaaccuuucaaaacacccaccccu

SEQ ID NO: 533813 - RNA, 64 nt, Homo Sapiens
ugugaaaaguuguguuuguguguuuucuucuccugucccauauuuggguuaugaugacucaagu

SEQ ID NO: 533814 - RNA, 64 nt, Homo Sapiens
cccaaauagguauauauagacugcagaagcuucagucccauauauaaacguucaugucauuuua

SEQ ID NO: 533815 - RNA, 64 nt, Homo Sapiens
gcagucacguggaggagcagugcaggcacaguaugucccauaggcccagugagaugcauucuug

SEQ ID NO: 533816 - RNA, 64 nt, Homo Sapiens
uuuaagaaauuauaucauaccagcuguugacaaugucccauauauauauuuuucauaugaauca

SEQ ID NO: 533817 - RNA, 64 nt, Homo Sapiens
aggagcccugagcuuguuuuccugcaauuagacggucccauaugggagugaugggagacaguga

SEQ ID NO: 533818 - RNA, 64 nt, Homo Sapiens
uaguuguuugguuuucuuuucuuuccccccuccggucccauacuucacagcacucuggugcggg

SEQ ID NO: 533819 - RNA, 60 nt, Homo Sapiens
gcaccaaccccuuccucugagccccgccccgucccauaccggccugcgccugcgccggac

SEQ ID NO: 533820 - RNA, 64 nt, Homo Sapiens
cucgcagcccagguccagagcccccggcgagccggucccauaaccggcccccugccccugcccc

SEQ ID NO: 533821 - RNA, 64 nt, Homo Sapiens
uuggcagcuggagccgaagacuaguaggucuacagucccauaugagaagucauaauaucuggca

SEQ ID NO: 533822 - RNA, 64 nt, Homo Sapiens
caaaccucauccuuagaaaugagaauugaucugggucccauaagcaaacaugcggacuguucaa

SEQ ID NO: 533823 - RNA, 64 nt, Homo Sapiens
ccuggcccucuuuggggaaaagccacugagcccagucccauaaacugcagggcccaugcaccag

SEQ ID NO: 533824 - RNA, 64 nt, Homo Sapiens
cucauugggcucccagacgugggaaaugcacacugucccauagcugacuuuccggaggccuuga

SEQ ID NO: 533825 - RNA, 64 nt, Homo Sapiens
ucaugaagucacacuauuggcaccgguuccuuuugucccauacgcagcucccuccaggccugag

SEQ ID NO: 533826 - RNA, 64 nt, Homo Sapiens
gauugcagcagcccuggacuauuuauuucuggaugucccauacaugaaaaauaugcacuucuua

SEQ ID NO: 533827 - RNA, 64 nt, Homo Sapiens
cgucaucauuggguucuguuuugacagcucugcugucccauagggacugcgacugggaccaggu

SEQ ID NO: 533828 - RNA, 64 nt, Homo Sapiens
cacugcuucuguuuauucauuuauaugcuuuugugucccauaaauuauuucagaaaaugcugau

SEQ ID NO: 533829 - RNA, 64 nt, Homo Sapiens
auagugaaauggugccuguaccguacccagccuggucccauaucaggauuacaggcgugagcca

SEQ ID NO: 533830 - RNA, 64 nt, Homo Sapiens
uaacugccuccuggauugucaucuucccagaugugucccauaguguccaggugucacagagacg

SEQ ID NO: 533831 - RNA, 64 nt, Homo Sapiens
gugccuucugaauacuguuaucacugucaccugugucccauaggggccaucuagccucguaacu

SEQ ID NO: 533832 - RNA, 64 nt, Homo Sapiens
cuuuagaguuacaagccccuggaaaagggagcaggucccauacaaucagccuuucuccucuucu

SEQ ID NO: 533833 - RNA, 64 nt, Homo Sapiens
caguagacucccacagaaaauaaauuuuuuuuuagucccauaagucuuuuaagucagucuguua

SEQ ID NO: 533834 - RNA, 64 nt, Homo Sapiens
ugaguuugaggcacauucccagugaauaagcugagucccauaccacacucaaaagguuuuaaua

SEQ ID NO: 533835 - RNA, 64 nt, Homo Sapiens
cuuuccucccagaacuauaucugacucucagucugucccauaaauuaauucagaaaccaucuuc

SEQ ID NO: 533836 - RNA, 64 nt, Homo Sapiens
gggucaagcugcuuaccugcuccccuagccuagggucccauauuauuuuaguaaagggacccuu

SEQ ID NO: 533837 - RNA, 64 nt, Homo Sapiens
uacaugguacagggcuguugcugagagucucaaggucccauagcagcccuuuuuauuuuuggua

SEQ ID NO: 533838 - RNA, 64 nt, Homo Sapiens
ggugauguagagauuuaccuuucuuugcauuucugucccauaugggggcucgaggaacguagug

SEQ ID NO: 533839 - RNA, 64 nt, Homo Sapiens
guuuagccuagucaugugccuugaacauauaugugucccauaaucuggcucaugguaccuguuc

SEQ ID NO: 533840 - RNA, 64 nt, Homo Sapiens; identical to SEQ ID NO: 518339

SEQ ID NO: 533841 - RNA, 64 nt, Homo Sapiens; identical to SEQ ID NO: 518340

SEQ ID NO: 533842 - RNA, 64 nt, Homo Sapiens; identical to SEQ ID NO: 518341

SEQ ID NO: 533843 - RNA, 64 nt, Homo Sapiens; identical to SEQ ID NO: 518342

SEQ ID NO: 533844 - RNA, 64 nt, Homo Sapiens; identical to SEQ ID NO: 518343

SEQ ID NO: 533845 - RNA, 64 nt, Homo Sapiens; identical to SEQ ID NO: 518344

SEQ ID NO: 533846 - RNA, 64 nt, Homo Sapiens; identical to SEQ ID NO: 518345

SEQ ID NO: 533847 - RNA, 64 nt, Homo Sapiens; identical to SEQ ID NO: 518346

SEQ ID NO: 533848 - RNA, 64 nt, Homo Sapiens; identical to SEQ ID NO: 518347

SEQ ID NO: 533849 - RNA, 64 nt, Homo Sapiens; identical to SEQ ID NO: 518348

SEQ ID NO: 533850 - RNA, 64 nt, Homo Sapiens; identical to SEQ ID NO: 518349

SEQ ID NO: 533851 - RNA, 64 nt, Homo Sapiens; identical to SEQ ID NO: 518350

SEQ ID NO: 533852 - RNA, 64 nt, Homo Sapiens; identical to SEQ ID NO: 518351

SEQ ID NO: 533853 - RNA, 64 nt, Homo Sapiens; identical to SEQ ID NO: 518352

SEQ ID NO: 533854 - RNA, 64 nt, Homo Sapiens; identical to SEQ ID NO: 518353

SEQ ID NO: 533855 - RNA, 64 nt, Homo Sapiens; identical to SEQ ID NO: 518354

SEQ ID NO: 533856 - RNA, 64 nt, Homo Sapiens; identical to SEQ ID NO: 518355

SEQ ID NO: 533857 - RNA, 64 nt, Homo Sapiens; identical to SEQ ID NO: 518356

SEQ ID NO: 533858 - RNA, 64 nt, Homo Sapiens; identical to SEQ ID NO: 518357

SEQ ID NO: 533859 - RNA, 64 nt, Homo Sapiens; identical to SEQ ID NO: 518358

SEQ ID NO: 533860 - RNA, 64 nt, Homo Sapiens; identical to SEQ ID NO: 518359

SEQ ID NO: 533861 - RNA, 64 nt, Homo Sapiens; identical to SEQ ID NO: 518360

SEQ ID NO: 533862 - RNA, 64 nt, Homo Sapiens; identical to SEQ ID NO: 518361

SEQ ID NO: 533863 - RNA, 64 nt, Homo Sapiens; identical to SEQ ID NO: 518362

SEQ ID NO: 533864 - RNA, 64 nt, Homo Sapiens; identical to SEQ ID NO: 518363

SEQ ID NO: 533865 - RNA, 64 nt, Homo Sapiens; identical to SEQ ID NO: 518364

SEQ ID NO: 533866 - RNA, 64 nt, Homo Sapiens; identical to SEQ ID NO: 518365

SEQ ID NO: 533867 - RNA, 64 nt, Homo Sapiens; identical to SEQ ID NO: 518366

SEQ ID NO: 533868 - RNA, 64 nt, Homo Sapiens; identical to SEQ ID NO: 518367

SEQ ID NO: 533869 - RNA, 64 nt, Homo Sapiens; identical to SEQ ID NO: 518368

SEQ ID NO: 533870 - RNA, 64 nt, Homo Sapiens; identical to SEQ ID NO: 518369

SEQ ID NO: 533871 - RNA, 64 nt, Homo Sapiens; identical to SEQ ID NO: 518370

SEQ ID NO: 533872 - RNA, 64 nt, Homo Sapiens; identical to SEQ ID NO: 518371

SEQ ID NO: 533873 - RNA, 64 nt, Homo Sapiens; identical to SEQ ID NO: 518372

SEQ ID NO: 533874 - RNA, 64 nt, Homo Sapiens; identical to SEQ ID NO: 518373

SEQ ID NO: 533875 - RNA, 64 nt, Homo Sapiens; identical to SEQ ID NO: 518374

SEQ ID NO: 533876 - RNA, 64 nt, Homo Sapiens; identical to SEQ ID NO: 518375

SEQ ID NO: 533877 - RNA, 64 nt, Homo Sapiens; identical to SEQ ID NO: 518376

SEQ ID NO: 533878 - RNA, 64 nt, Homo Sapiens; identical to SEQ ID NO: 518377

SEQ ID NO: 533879 - RNA, 64 nt, Homo Sapiens; identical to SEQ ID NO: 518378

SEQ ID NO: 533880 - RNA, 64 nt, Homo Sapiens; identical to SEQ ID NO: 518379

SEQ ID NO: 533881 - RNA, 64 nt, Homo Sapiens; identical to SEQ ID NO: 518380

SEQ ID NO: 533882 - RNA, 64 nt, Homo Sapiens; identical to SEQ ID NO: 518381

SEQ ID NO: 533883 - RNA, 64 nt, Homo Sapiens; identical to SEQ ID NO: 518382

SEQ ID NO: 533884 - RNA, 64 nt, Homo Sapiens; identical to SEQ ID NO: 518383

SEQ ID NO: 533885 - RNA, 64 nt, Homo Sapiens; identical to SEQ ID NO: 518384

SEQ ID NO: 533886 - RNA, 64 nt, Homo Sapiens; identical to SEQ ID NO: 518385

SEQ ID NO: 533887 - RNA, 64 nt, Homo Sapiens; identical to SEQ ID NO: 518386

SEQ ID NO: 533888 - RNA, 64 nt, Homo Sapiens; identical to SEQ ID NO: 518387

SEQ ID NO: 533889 - RNA, 64 nt, Homo Sapiens; identical to SEQ ID NO: 518388

SEQ ID NO: 533890 - RNA, 64 nt, Homo Sapiens; identical to SEQ ID NO: 518389

SEQ ID NO: 533891 - RNA, 64 nt, Homo Sapiens; identical to SEQ ID NO: 518390

SEQ ID NO: 533892 - RNA, 64 nt, Homo Sapiens; identical to SEQ ID NO: 518391

SEQ ID NO: 533893 - RNA, 64 nt, Homo Sapiens; identical to SEQ ID NO: 518392

SEQ ID NO: 533894 - RNA, 64 nt, Homo Sapiens; identical to SEQ ID NO: 518393

SEQ ID NO: 533895 - RNA, 64 nt, Homo Sapiens; identical to SEQ ID NO: 518394

SEQ ID NO: 533896 - RNA, 64 nt, Homo Sapiens; identical to SEQ ID NO: 518395

SEQ ID NO: 533897 - RNA, 64 nt, Homo Sapiens; identical to SEQ ID NO: 518396

SEQ ID NO: 533898 - RNA, 64 nt, Homo Sapiens; identical to SEQ ID NO: 518397

SEQ ID NO: 533899 - RNA, 64 nt, Homo Sapiens; identical to SEQ ID NO: 518398

SEQ ID NO: 533900 - RNA, 64 nt, Homo Sapiens; identical to SEQ ID NO: 518399

SEQ ID NO: 533901 - RNA, 64 nt, Homo Sapiens; identical to SEQ ID NO: 518400

SEQ ID NO: 533902 - RNA, 64 nt, Homo Sapiens; identical to SEQ ID NO: 518401

SEQ ID NO: 533903 - RNA, 64 nt, Homo Sapiens; identical to SEQ ID NO: 518402

SEQ ID NO: 533904 - RNA, 60 nt, Homo Sapiens; identical to SEQ ID NO: 518403

SEQ ID NO: 533905 - RNA, 64 nt, Homo Sapiens; identical to SEQ ID NO: 518404

SEQ ID NO: 533906 - RNA, 64 nt, Homo Sapiens; identical to SEQ ID NO: 518405

SEQ ID NO: 533907 - RNA, 64 nt, Homo Sapiens; identical to SEQ ID NO: 518406

SEQ ID NO: 533908 - RNA, 64 nt, Homo Sapiens; identical to SEQ ID NO: 518407

SEQ ID NO: 533909 - RNA, 64 nt, Homo Sapiens; identical to SEQ ID NO: 518408

SEQ ID NO: 533910 - RNA, 64 nt, Homo Sapiens; identical to SEQ ID NO: 518409

SEQ ID NO: 533911 - RNA, 64 nt, Homo Sapiens; identical to SEQ ID NO: 518410

SEQ ID NO: 533912 - RNA, 64 nt, Homo Sapiens; identical to SEQ ID NO: 518411

SEQ ID NO: 533913 - RNA, 64 nt, Homo Sapiens; identical to SEQ ID NO: 518412

SEQ ID NO: 533914 - RNA, 64 nt, Homo Sapiens; identical to SEQ ID NO: 518413

SEQ ID NO: 533915 - RNA, 64 nt, Homo Sapiens; identical to SEQ ID NO: 518414

SEQ ID NO: 533916 - RNA, 64 nt, Homo Sapiens; identical to SEQ ID NO: 518415

SEQ ID NO: 533917 - RNA, 64 nt, Homo Sapiens; identical to SEQ ID NO: 518416

SEQ ID NO: 533918 - RNA, 64 nt, Homo Sapiens; identical to SEQ ID NO: 518417

SEQ ID NO: 533919 - RNA, 64 nt, Homo Sapiens; identical to SEQ ID NO: 518418

SEQ ID NO: 533920 - RNA, 64 nt, Homo Sapiens; identical to SEQ ID NO: 518419

SEQ ID NO: 533921 - RNA, 64 nt, Homo Sapiens; identical to SEQ ID NO: 518420

SEQ ID NO: 533922 - RNA, 64 nt, Homo Sapiens; identical to SEQ ID NO: 518421

SEQ ID NO: 533923 - RNA, 64 nt, Homo Sapiens; identical to SEQ ID NO: 518422

SEQ ID NO: 533924 - RNA, 64 nt, Homo Sapiens; identical to SEQ ID NO: 518423

SEQ ID NO: 533925 - RNA, 64 nt, Homo Sapiens; identical to SEQ ID NO: 518424

SEQ ID NO: 533926 - RNA, 64 nt, Homo Sapiens; identical to SEQ ID NO: 518425

SEQ ID NO: 533927 - RNA, 64 nt, Homo Sapiens; identical to SEQ ID NO: 518426

SEQ ID NO: 533928 - RNA, 64 nt, Homo Sapiens; identical to SEQ ID NO: 518427

SEQ ID NO: 533929 - RNA, 64 nt, Homo Sapiens; identical to SEQ ID NO: 518428

SEQ ID NO: 533930 - RNA, 64 nt, Homo Sapiens; identical to SEQ ID NO: 518429

SEQ ID NO: 533931 - RNA, 64 nt, Homo Sapiens; identical to SEQ ID NO: 518430

SEQ ID NO: 533932 - RNA, 64 nt, Homo Sapiens; identical to SEQ ID NO: 518431

SEQ ID NO: 533933 - RNA, 64 nt, Homo Sapiens; identical to SEQ ID NO: 518432

SEQ ID NO: 533934 - RNA, 64 nt, Homo Sapiens; identical to SEQ ID NO: 518433

SEQ ID NO: 533935 - RNA, 64 nt, Homo Sapiens; identical to SEQ ID NO: 518434

SEQ ID NO: 533936 - RNA, 64 nt, Homo Sapiens; identical to SEQ ID NO: 518435

SEQ ID NO: 533937 - RNA, 64 nt, Homo Sapiens; identical to SEQ ID NO: 518436

SEQ ID NO: 533938 - RNA, 64 nt, Homo Sapiens; identical to SEQ ID NO: 518437

SEQ ID NO: 533939 - RNA, 64 nt, Homo Sapiens; identical to SEQ ID NO: 518438

SEQ ID NO: 533940 - RNA, 64 nt, Homo Sapiens; identical to SEQ ID NO: 518439

SEQ ID NO: 533941 - RNA, 64 nt, Homo Sapiens; identical to SEQ ID NO: 518440

SEQ ID NO: 533942 - RNA, 64 nt, Homo Sapiens; identical to SEQ ID NO: 518441

SEQ ID NO: 533943 - RNA, 64 nt, Homo Sapiens; identical to SEQ ID NO: 518442

SEQ ID NO: 533944 - RNA, 64 nt, Homo Sapiens; identical to SEQ ID NO: 518443

SEQ ID NO: 533945 - RNA, 64 nt, Homo Sapiens; identical to SEQ ID NO: 518444

SEQ ID NO: 533946 - RNA, 64 nt, Homo Sapiens; identical to SEQ ID NO: 518445

SEQ ID NO: 533947 - RNA, 64 nt, Homo Sapiens; identical to SEQ ID NO: 518446

SEQ ID NO: 533948 - RNA, 64 nt, Homo Sapiens; identical to SEQ ID NO: 518447

SEQ ID NO: 533949 - RNA, 64 nt, Homo Sapiens; identical to SEQ ID NO: 518448

SEQ ID NO: 533950 - RNA, 64 nt, Homo Sapiens; identical to SEQ ID NO: 518449

SEQ ID NO: 533951 - RNA, 64 nt, Homo Sapiens; identical to SEQ ID NO: 518450

SEQ ID NO: 533952 - RNA, 64 nt, Homo Sapiens; identical to SEQ ID NO: 518451

SEQ ID NO: 533953 - RNA, 64 nt, Homo Sapiens; identical to SEQ ID NO: 518452

SEQ ID NO: 533954 - RNA, 64 nt, Homo Sapiens; identical to SEQ ID NO: 518453

SEQ ID NO: 533955 - RNA, 64 nt, Homo Sapiens; identical to SEQ ID NO: 518454

SEQ ID NO: 533956 - RNA, 64 nt, Homo Sapiens; identical to SEQ ID NO: 518455

SEQ ID NO: 533957 - RNA, 64 nt, Homo Sapiens; identical to SEQ ID NO: 518456

SEQ ID NO: 533958 - RNA, 64 nt, Homo Sapiens; identical to SEQ ID NO: 518457

SEQ ID NO: 533959 - RNA, 64 nt, Homo Sapiens; identical to SEQ ID NO: 518458

SEQ ID NO: 533960 - RNA, 64 nt, Homo Sapiens; identical to SEQ ID NO: 518459

SEQ ID NO: 533961 - RNA, 64 nt, Homo Sapiens; identical to SEQ ID NO: 518460

SEQ ID NO: 533962 - RNA, 64 nt, Homo Sapiens; identical to SEQ ID NO: 518461

SEQ ID NO: 533963 - RNA, 64 nt, Homo Sapiens; identical to SEQ ID NO: 518462

SEQ ID NO: 533964 - RNA, 64 nt, Homo Sapiens; identical to SEQ ID NO: 518463

SEQ ID NO: 533965 - RNA, 64 nt, Homo Sapiens; identical to SEQ ID NO: 518464

SEQ ID NO: 533966 - RNA, 64 nt, Homo Sapiens; identical to SEQ ID NO: 518465

SEQ ID NO: 533967 - RNA, 64 nt, Homo Sapiens; identical to SEQ ID NO: 518466

SEQ ID NO: 533968 - RNA, 64 nt, Homo Sapiens; identical to SEQ ID NO: 518467

SEQ ID NO: 533969 - RNA, 64 nt, Homo Sapiens; identical to SEQ ID NO: 518468

SEQ ID NO: 533970 - RNA, 64 nt, Homo Sapiens; identical to SEQ ID NO: 518469

SEQ ID NO: 533971 - RNA, 64 nt, Homo Sapiens; identical to SEQ ID NO: 518470

SEQ ID NO: 533972 - RNA, 64 nt, Homo Sapiens; identical to SEQ ID NO: 518471

SEQ ID NO: 533973 - RNA, 64 nt, Homo Sapiens; identical to SEQ ID NO: 518472

SEQ ID NO: 533974 - RNA, 64 nt, Homo Sapiens; identical to SEQ ID NO: 518473

SEQ ID NO: 533975 - RNA, 64 nt, Homo Sapiens; identical to SEQ ID NO: 518474

SEQ ID NO: 533976 - RNA, 64 nt, Homo Sapiens; identical to SEQ ID NO: 518475

SEQ ID NO: 533977 - RNA, 64 nt, Homo Sapiens; identical to SEQ ID NO: 518476

SEQ ID NO: 533978 - RNA, 64 nt, Homo Sapiens; identical to SEQ ID NO: 518477

SEQ ID NO: 533979 - RNA, 64 nt, Homo Sapiens; identical to SEQ ID NO: 518478

SEQ ID NO: 533980 - RNA, 64 nt, Homo Sapiens; identical to SEQ ID NO: 518479

SEQ ID NO: 533981 - RNA, 64 nt, Homo Sapiens; identical to SEQ ID NO: 518480

SEQ ID NO: 533982 - RNA, 64 nt, Homo Sapiens; identical to SEQ ID NO: 518481

SEQ ID NO: 533983 - RNA, 64 nt, Homo Sapiens; identical to SEQ ID NO: 518482

SEQ ID NO: 533984 - RNA, 64 nt, Homo Sapiens; identical to SEQ ID NO: 518483

SEQ ID NO: 533985 - RNA, 64 nt, Homo Sapiens; identical to SEQ ID NO: 518484

SEQ ID NO: 533986 - RNA, 64 nt, Homo Sapiens; identical to SEQ ID NO: 518485

SEQ ID NO: 533987 - RNA, 64 nt, Homo Sapiens; identical to SEQ ID NO: 518486

SEQ ID NO: 533988 - RNA, 64 nt, Homo Sapiens; identical to SEQ ID NO: 518487

SEQ ID NO: 533989 - RNA, 64 nt, Homo Sapiens; identical to SEQ ID NO: 518488

SEQ ID NO: 533990 - RNA, 64 nt, Homo Sapiens; identical to SEQ ID NO: 518489

SEQ ID NO: 533991 - RNA, 64 nt, Homo Sapiens; identical to SEQ ID NO: 518490

SEQ ID NO: 533992 - RNA, 64 nt, Homo Sapiens; identical to SEQ ID NO: 518491

SEQ ID NO: 533993 - RNA, 64 nt, Homo Sapiens; identical to SEQ ID NO: 518492

SEQ ID NO: 533994 - RNA, 64 nt, Homo Sapiens; identical to SEQ ID NO: 518493

SEQ ID NO: 533995 - RNA, 64 nt, Homo Sapiens; identical to SEQ ID NO: 518494

SEQ ID NO: 533996 - RNA, 64 nt, Homo Sapiens; identical to SEQ ID NO: 518495

SEQ ID NO: 533997 - RNA, 64 nt, Homo Sapiens; identical to SEQ ID NO: 518496

SEQ ID NO: 533998 - RNA, 64 nt, Homo Sapiens; identical to SEQ ID NO: 518497

SEQ ID NO: 533999 - RNA, 64 nt, Homo Sapiens; identical to SEQ ID NO: 518498

SEQ ID NO: 534000 - RNA, 64 nt, Homo Sapiens; identical to SEQ ID NO: 518499

SEQ ID NO: 534001 - RNA, 64 nt, Homo Sapiens; identical to SEQ ID NO: 518500

SEQ ID NO: 534002 - RNA, 64 nt, Homo Sapiens
cccucugaugggacgguacugagauaucucggcuuccgcucagcccgguuuugacugguugaaa

SEQ ID NO: 534003 - RNA, 64 nt, Homo Sapiens
ucugucacccaggcuggaaugcaguggcgagaucuccgcucacuguagccuccucccccugggu

SEQ ID NO: 534004 - RNA, 64 nt, Homo Sapiens
gcaagcucugccuccugggcgcaguggcgcgaucuccgcucacuucuguuacccaggcuagagu

SEQ ID NO: 534005 - RNA, 64 nt, Homo Sapiens
gucucauuuccccaggccaacucaagggcugugguccgcucaggaugggcugcuccucccaggg

SEQ ID NO: 534006 - RNA, 64 nt, Homo Sapiens
ccugucgcccaggcuggagugcaaugccgugaucuccgcucacugccaccuccgccucucuagu

SEQ ID NO: 534007 - RNA, 64 nt, Homo Sapiens
guuuuuucuuucuucaagucguaaccacaaagcuuccgcucaggcuuuuaauuuaaaggaagca

SEQ ID NO: 534008 - RNA, 64 nt, Homo Sapiens
gaucgcuguuccuugagcaaggcgcuuacucuccuccgcucaggcccccaaggccgcccuuucc

SEQ ID NO: 534009 - RNA, 64 nt, Homo Sapiens
gggagugagaugaggugggcuugaaaguaccuuguccgcucagaaggaccauucaagguucacu

SEQ ID NO: 534010 - RNA, 64 nt, Homo Sapiens
gccccggucaccuccgagucgcccuggccauggcuccgcucaggaugaugaaggugaaacguca

SEQ ID NO: 534011 - RNA, 64 nt, Homo Sapiens
cuuucaucuuccuugggugguccucaugucgcuguccgcucauguuccugguguucuggcauca

SEQ ID NO: 534012 - RNA, 64 nt, Homo Sapiens
uggugaccuggccaaggggauacagacccugcaguccgcucagggugggauggcagacauggca

SEQ ID NO: 534013 - RNA, 64 nt, Homo Sapiens
gaaggcuggaucugggccccgaggugcccagugcuccgcucaagugcuguggauguaaggauag

SEQ ID NO: 534014 - RNA, 64 nt, Homo Sapiens
uccuuuaagauuuggaaagccaggauccuucugcuccgcucaggacccccggagccccgcgaaa

SEQ ID NO: 534015 - RNA, 64 nt, Homo Sapiens
ggaagcacacugcagggcugcuguggcccagucguccgcucagccaaggagucagauggcaaug

SEQ ID NO: 534016 - RNA, 64 nt, Homo Sapiens
uuuaaaauuuaauuuuuaagggaaagcuguaguauccgcucauucugagauccgagaggagcuu

SEQ ID NO: 534017 - RNA, 64 nt, Homo Sapiens
accugucucaccuacccuccaguccccucccagcuccgcucacagggcucucauuucguccauc

SEQ ID NO: 534018 - RNA, 64 nt, Homo Sapiens
ucgcccccuccagugcaugaggaacccucuuuccuccgcucagagaugcugcuucauuuaccca

SEQ ID NO: 534019 - RNA, 64 nt, Homo Sapiens
uguggugugcggguuuccuugcugccgucaccucuccgcucauacaggaaugaagccuuagcca

SEQ ID NO: 534020 - RNA, 64 nt, Homo Sapiens
aguggggaaugaggcugguccugcagccucucccuccgcucagggcuugaaggucgguggcgga

SEQ ID NO: 534021 - RNA, 64 nt, Homo Sapiens
ucugucgcccaggcugaggugcaguagugcaaucuccgcucacuacaaccuccacucccugggg

SEQ ID NO: 534022 - RNA, 64 nt, Homo Sapiens
uucccugagcacagauaaugguaggcacauuagcuccgcucauguaaauggauucgagccacuu

SEQ ID NO: 534023 - RNA, 64 nt, Homo Sapiens
gagcucuucuucauucucacccagcugcugucauuccgcucacuccucuccccacaccacccac

SEQ ID NO: 534024 - RNA, 64 nt, Homo Sapiens
gacacucuguaaaggccaauggcugugaaugugauccgcucacuagcaggaggugacacuagau

SEQ ID NO: 534025 - RNA, 64 nt, Homo Sapiens
uuuuguuguuuuugugaccaaccugcagacugcauccgcucauuccgguaaggacagggacagg

SEQ ID NO: 534026 - RNA, 64 nt, Homo Sapiens
ccccacggccagcgugggcacagggcaaggagacuccgcucacucaggcagagcccccaccagg

SEQ ID NO: 534027 - RNA, 64 nt, Homo Sapiens
acguuacccugucgcucgaacggagaucaaaacguccgcucaaaugggaggugagacguugucc

SEQ ID NO: 534028 - RNA, 64 nt, Homo Sapiens
acacgccuuguuacgagcaaccccucacaggacguccgcucagcagacgucccgccacccacca

SEQ ID NO: 534029 - RNA, 64 nt, Homo Sapiens
cccggcggggaggagcggguagcccucagggagcuccgcucagcagcucccagcccuucccccc

SEQ ID NO: 534030 - RNA, 64 nt, Homo Sapiens
ggcccugcagcuccagggcuggugcucuagcagauccgcucaggcacgguugggugaccguggg

SEQ ID NO: 534031 - RNA, 64 nt, Homo Sapiens
cucuccucugcugacucugccguuucuccaggccuccgcucagugaugagaccaagagaucgga

SEQ ID NO: 534032 - RNA, 64 nt, Homo Sapiens
gggcugagggugcccuuuuccagccucagccuacuccgcucacugaacuccuuccccacuucug

SEQ ID NO: 534033 - RNA, 64 nt, Homo Sapiens
aacugucaucucccgacuccucccugagccagccuccgcucaguguggcuccucagcccacaga

SEQ ID NO: 534034 - RNA, 64 nt, Homo Sapiens
ucuuagaaaccaccugcuucuguccaccuguagcuccgcucauuagaggggcgaacuaaagacc

SEQ ID NO: 534035 - RNA, 64 nt, Homo Sapiens
cgccccgugugcucccgcccagccugcugaggccuccgcucaggucagaagcccagcugcugau

SEQ ID NO: 534036 - RNA, 64 nt, Homo Sapiens
aagcucagagauuugcaccaggugccuuguugccuccgcucaggaugaaagaggagcugagaga

SEQ ID NO: 534037 - RNA, 64 nt, Homo Sapiens
auucacauucaucugacuguaaaucccaagggccuccgcucaugcuaaauugagaaucuuaggg

SEQ ID NO: 534038 - RNA, 64 nt, Homo Sapiens
cugcccccuugggcucuugcugauguaggggucguccgcucaggccccacaucuaaccaggccc

SEQ ID NO: 534039 - RNA, 64 nt, Homo Sapiens
ugaacacagugaaagcugcaaguaugccaguggguccgcucacgaccguccuguuucuugcucc

SEQ ID NO: 534040 - RNA, 64 nt, Homo Sapiens
cauucccugccuucucuaggccugacugcuccuuuccgcucaccugcuacucauucugaagggc

SEQ ID NO: 534041 - RNA, 64 nt, Homo Sapiens
cacuccagccugggcgacugagcgagacucuaucucaaaacaaucaaaacaaaaaagaccugug

SEQ ID NO: 534042 - RNA, 64 nt, Homo Sapiens
cugggcgacugagcgagacucuaucucaaaacaaucaaaacaaaaaagaccuguggacucuagu

SEQ ID NO: 534043 - RNA, 64 nt, Homo Sapiens
ucuuuucuucugguuuaauuuuaauuuucuauuuucaaaacaaauauuuacuucauuugccaau

SEQ ID NO: 534044 - RNA, 64 nt, Homo Sapiens
auaaguggaagggcagcuauuaccauucgcuuagucaaaacauucgguuacugcccuuuaauac

SEQ ID NO: 534045 - RNA, 64 nt, Homo Sapiens
accuauuucaaauucaauugacuaaaaaaucuauucaaaacauuucauguaagauuucaauaaa

SEQ ID NO: 534046 - RNA, 64 nt, Homo Sapiens
cugggcacacuguuaaaucagcuucauuuuagcuucaaaacaagcaaugcuuuuaucguuucag

SEQ ID NO: 534047 - RNA, 64 nt, Homo Sapiens
agaguggcugaaagucacacuggcagguccugaaucaaaacaacaccauagccagcaaaagacc

SEQ ID NO: 534048 - RNA, 64 nt, Homo Sapiens
augccccccgcccaucccaugguacggucagcuuucaaaacaauagaagagaugaagaggggga

SEQ ID NO: 534049 - RNA, 64 nt, Homo Sapiens
cacaaauacaguauccaaacagcaagacucugucucaaaacaaacacuccagccugggcgacag

SEQ ID NO: 534050 - RNA, 64 nt, Homo Sapiens
accuccaggcugacgaggcagcugcuuugcucuuucaaaacagaaacccauucaauuucagucu

SEQ ID NO: 534051 - RNA, 64 nt, Homo Sapiens
acauuuaaauuuaguuuaaauagcuuuuugaugcucaaaacaucagacuaauccuuuuagauag

SEQ ID NO: 534052 - RNA, 64 nt, Homo Sapiens
agaaggcuacauuugugggaccuuauugcucuuaucaaaacagaugucccauuucauucagagc

SEQ ID NO: 534053 - RNA, 64 nt, Homo Sapiens
auaaguuuacuccuccaucuugcacuaacaaagcucaaaacacggugaccaccaaauuguuauu

SEQ ID NO: 534054 - RNA, 64 nt, Homo Sapiens
cuccuuugcaguuccucuucauuugucuucuccuucaaaacauuagcuacuuuugccaaauucu

SEQ ID NO: 534055 - RNA, 64 nt, Homo Sapiens
cuccaguuacuguauucuacaaauauuuuuauguucaaaacacacaguacagacagcauggaua

SEQ ID NO: 534056 - RNA, 64 nt, Homo Sapiens
agugugcuuuauugaguguggauuuugcauacauucaaaacauuaaccacaaaauacagcaagu

SEQ ID NO: 534057 - RNA, 64 nt, Homo Sapiens
acaugaacucacagggauccagagaugguaaaauucaaaacagccugucaaguucaaaacagag

SEQ ID NO: 534058 - RNA, 64 nt, Homo Sapiens
cagagaugguaaaauucaaaacagccugucaaguucaaaacagagaggugaaagcagaagagac

SEQ ID NO: 534059 - RNA, 64 nt, Homo Sapiens
caucacccucagacuuuaagacaagaagccaccaucaaaacaaaggaugggauacguauagaau

SEQ ID NO: 534060 - RNA, 64 nt, Homo Sapiens
uguuugaguuccaaucuuacauuuuauaccaaguucaaaacacuuucagauagaagucuuucua

SEQ ID NO: 534061 - RNA, 64 nt, Homo Sapiens
uuguuugcaaaggggaggcaagaaugacaguccgucaaaacagauauggaaauucugcucagau

SEQ ID NO: 534062 - RNA, 64 nt, Homo Sapiens
gugccaugucaaacaaauaggauucccacccaauucaaaacauuuuuuucuaacugggggaaaa

SEQ ID NO: 534063 - RNA, 64 nt, Homo Sapiens
acaaaugcuguucagggaaaaguguagguggguaucaaaacaagugcaguacguuucuaauaua

SEQ ID NO: 534064 - RNA, 64 nt, Homo Sapiens
uuagucauacgaccauaaauggauaggcuuauauucaaaacaucgaaauuuauaucuggcauac

SEQ ID NO: 534065 - RNA, 64 nt, Homo Sapiens
guagguagcuucaggaaauggcucagguuaauucucaaaacacaaauuguugcuggccaggcau

SEQ ID NO: 534066 - RNA, 64 nt, Homo Sapiens
uugaagccccagucuuugauuuuacagguaacuuucaaaacaucaugaugcugccaaauguacu

SEQ ID NO: 534067 - RNA, 64 nt, Homo Sapiens
aaauuucuugauggaauguaaaauugucauaacaucaaaacaagaaauguguuuuuuacuugcu

SEQ ID NO: 534068 - RNA, 64 nt, Homo Sapiens
cagauaauucacacaagaggacugaauuaauccuucaaaacaauugaguugggaaauucucuug

SEQ ID NO: 534069 - RNA, 64 nt, Homo Sapiens
uaaacgguggaacuacgacuaggucugugucuugucaaaacaagagggcaauagagguucugaa

SEQ ID NO: 534070 - RNA, 64 nt, Homo Sapiens
uuuuaaaaagaaagaaagaaagcaaaacuuugccucaaaacaaaacacuccagccuggggacgg

SEQ ID NO: 534071 - RNA, 64 nt, Homo Sapiens
uacuccagcuugggcaacagagugagacuccaucucaaaacaaaacaaaacaaaacaaaacaaa

SEQ ID NO: 534072 - RNA, 64 nt, Homo Sapiens
aacaggaaguugacuguaugucugcuaguuagauucaaaacaucauaaagaugauagcauguca

SEQ ID NO: 534073 - RNA, 64 nt, Homo Sapiens
acguaacuuuguuguuguuucaauaaacuuucuuucaaaacaauccucaaaacuuuacuagggc

SEQ ID NO: 534074 - RNA, 64 nt, Homo Sapiens
gggggguggggcuuuaagagugaacugaaaucugucaaaacaaaaaagagacuaggacucaguc

SEQ ID NO: 534075 - RNA, 64 nt, Homo Sapiens
cuugacuguccccugguacauagaaacaguacacucaaaacaucuuguuuuuaguuuuuguugg

SEQ ID NO: 534076 - RNA, 64 nt, Homo Sapiens
gaaagacugaugaaaaguaaucaaaaaaacuuguucaaaacaggaaaacuaaaacuaagaauuc

SEQ ID NO: 534077 - RNA, 64 nt, Homo Sapiens
uaguucugaguaacauuuucucugcuaugugucaucaaaacaucaccaucuugaaccacagauu

SEQ ID NO: 534078 - RNA, 64 nt, Homo Sapiens
aggcagaauagaaugcugaguugauucugugcaaucaaaacaaaccauaugaaucagaauuaua

SEQ ID NO: 534079 - RNA, 64 nt, Homo Sapiens
ugaauggcugcagugacccagauauugcacuaggucaaaacauucagguauagcugacaucucc

SEQ ID NO: 534080 - RNA, 64 nt, Homo Sapiens
gcuacuaauuauauaguauaccauacauuaucauucaaaacaaccauccugcucauaacaucuu

SEQ ID NO: 534081 - RNA, 64 nt, Homo Sapiens
gcagcuuuaaaaaaauaauucuauuucacaugagucaaaacaaauauaagaauguaggccuuaa

SEQ ID NO: 534082 - RNA, 64 nt, Homo Sapiens
acaaaacaaaacaaacaaacaacgaaacuccaucucaaaacaaaacuccagccugggcgacaaa

SEQ ID NO: 534083 - RNA, 64 nt, Homo Sapiens; identical to SEQ ID NO: 495467

SEQ ID NO: 534084 - RNA, 64 nt, Homo Sapiens; identical to SEQ ID NO: 495468

SEQ ID NO: 534085 - RNA, 64 nt, Homo Sapiens; identical to SEQ ID NO: 495469

SEQ ID NO: 534086 - RNA, 64 nt, Homo Sapiens; identical to SEQ ID NO: 495470

SEQ ID NO: 534087 - RNA, 64 nt, Homo Sapiens; identical to SEQ ID NO: 495471

SEQ ID NO: 534088 - RNA, 64 nt, Homo Sapiens; identical to SEQ ID NO: 495472

SEQ ID NO: 534089 - RNA, 64 nt, Homo Sapiens; identical to SEQ ID NO: 495473

SEQ ID NO: 534090 - RNA, 64 nt, Homo Sapiens; identical to SEQ ID NO: 495474

SEQ ID NO: 534091 - RNA, 64 nt, Homo Sapiens; identical to SEQ ID NO: 495475

SEQ ID NO: 534092 - RNA, 64 nt, Homo Sapiens; identical to SEQ ID NO: 495476

SEQ ID NO: 534093 - RNA, 64 nt, Homo Sapiens; identical to SEQ ID NO: 495477

SEQ ID NO: 534094 - RNA, 64 nt, Homo Sapiens; identical to SEQ ID NO: 495478

SEQ ID NO: 534095 - RNA, 64 nt, Homo Sapiens; identical to SEQ ID NO: 495479

SEQ ID NO: 534096 - RNA, 64 nt, Homo Sapiens; identical to SEQ ID NO: 495480

SEQ ID NO: 534097 - RNA, 64 nt, Homo Sapiens; identical to SEQ ID NO: 495481

SEQ ID NO: 534098 - RNA, 64 nt, Homo Sapiens; identical to SEQ ID NO: 495482

SEQ ID NO: 534099 - RNA, 64 nt, Homo Sapiens; identical to SEQ ID NO: 495483

SEQ ID NO: 534100 - RNA, 64 nt, Homo Sapiens; identical to SEQ ID NO: 495484

SEQ ID NO: 534101 - RNA, 64 nt, Homo Sapiens; identical to SEQ ID NO: 495485

SEQ ID NO: 534102 - RNA, 64 nt, Homo Sapiens; identical to SEQ ID NO: 495486

SEQ ID NO: 534103 - RNA, 64 nt, Homo Sapiens; identical to SEQ ID NO: 495487

SEQ ID NO: 534104 - RNA, 64 nt, Homo Sapiens; identical to SEQ ID NO: 495488

SEQ ID NO: 534105 - RNA, 64 nt, Homo Sapiens; identical to SEQ ID NO: 495489

SEQ ID NO: 534106 - RNA, 64 nt, Homo Sapiens; identical to SEQ ID NO: 495490

SEQ ID NO: 534107 - RNA, 64 nt, Homo Sapiens; identical to SEQ ID NO: 495491

SEQ ID NO: 534108 - RNA, 64 nt, Homo Sapiens; identical to SEQ ID NO: 495492

SEQ ID NO: 534109 - RNA, 64 nt, Homo Sapiens; identical to SEQ ID NO: 495493

SEQ ID NO: 534110 - RNA, 64 nt, Homo Sapiens; identical to SEQ ID NO: 495494

SEQ ID NO: 534111 - RNA, 64 nt, Homo Sapiens; identical to SEQ ID NO: 495495

SEQ ID NO: 534112 - RNA, 64 nt, Homo Sapiens; identical to SEQ ID NO: 495496

SEQ ID NO: 534113 - RNA, 64 nt, Homo Sapiens; identical to SEQ ID NO: 495497

SEQ ID NO: 534114 - RNA, 64 nt, Homo Sapiens; identical to SEQ ID NO: 495498

SEQ ID NO: 534115 - RNA, 64 nt, Homo Sapiens; identical to SEQ ID NO: 495499

SEQ ID NO: 534116 - RNA, 64 nt, Homo Sapiens; identical to SEQ ID NO: 170352

SEQ ID NO: 534117 - RNA, 64 nt, Homo Sapiens; identical to SEQ ID NO: 170353

SEQ ID NO: 534118 - RNA, 64 nt, Homo Sapiens; identical to SEQ ID NO: 170354

SEQ ID NO: 534119 - RNA, 64 nt, Homo Sapiens; identical to SEQ ID NO: 170355

SEQ ID NO: 534120 - RNA, 64 nt, Homo Sapiens; identical to SEQ ID NO: 170356

SEQ ID NO: 534121 - RNA, 64 nt, Homo Sapiens; identical to SEQ ID NO: 170357

SEQ ID NO: 534122 - RNA, 64 nt, Homo Sapiens; identical to SEQ ID NO: 170358

SEQ ID NO: 534123 - RNA, 64 nt, Homo Sapiens; identical to SEQ ID NO: 170359

SEQ ID NO: 534124 - RNA, 64 nt, Homo Sapiens; identical to SEQ ID NO: 170360

SEQ ID NO: 534125 - RNA, 64 nt, Homo Sapiens; identical to SEQ ID NO: 170361

SEQ ID NO: 534126 - RNA, 64 nt, Homo Sapiens; identical to SEQ ID NO: 170362

SEQ ID NO: 534127 - RNA, 64 nt, Homo Sapiens; identical to SEQ ID NO: 170363

SEQ ID NO: 534128 - RNA, 64 nt, Homo Sapiens; identical to SEQ ID NO: 170364

SEQ ID NO: 534129 - RNA, 64 nt, Homo Sapiens; identical to SEQ ID NO: 170365

SEQ ID NO: 534130 - RNA, 64 nt, Homo Sapiens; identical to SEQ ID NO: 170366

SEQ ID NO: 534131 - RNA, 64 nt, Homo Sapiens; identical to SEQ ID NO: 170367

SEQ ID NO: 534132 - RNA, 64 nt, Homo Sapiens; identical to SEQ ID NO: 170368

SEQ ID NO: 534133 - RNA, 64 nt, Homo Sapiens; identical to SEQ ID NO: 170369

SEQ ID NO: 534134 - RNA, 64 nt, Homo Sapiens; identical to SEQ ID NO: 170370

SEQ ID NO: 534135 - RNA, 64 nt, Homo Sapiens; identical to SEQ ID NO: 170371

SEQ ID NO: 534136 - RNA, 64 nt, Homo Sapiens; identical to SEQ ID NO: 170372

SEQ ID NO: 534137 - RNA, 64 nt, Homo Sapiens; identical to SEQ ID NO: 170373

SEQ ID NO: 534138 - RNA, 64 nt, Homo Sapiens; identical to SEQ ID NO: 170374

SEQ ID NO: 534139 - RNA, 64 nt, Homo Sapiens; identical to SEQ ID NO: 170375

SEQ ID NO: 534140 - RNA, 64 nt, Homo Sapiens; identical to SEQ ID NO: 170376

SEQ ID NO: 534141 - RNA, 64 nt, Homo Sapiens; identical to SEQ ID NO: 170377

SEQ ID NO: 534142 - RNA, 64 nt, Homo Sapiens; identical to SEQ ID NO: 170378

SEQ ID NO: 534143 - RNA, 64 nt, Homo Sapiens; identical to SEQ ID NO: 170379

SEQ ID NO: 534144 - RNA, 64 nt, Homo Sapiens; identical to SEQ ID NO: 114692

SEQ ID NO: 534145 - RNA, 64 nt, Homo Sapiens; identical to SEQ ID NO: 114693

SEQ ID NO: 534146 - RNA, 64 nt, Homo Sapiens; identical to SEQ ID NO: 114694

SEQ ID NO: 534147 - RNA, 64 nt, Homo Sapiens; identical to SEQ ID NO: 114695

SEQ ID NO: 534148 - RNA, 64 nt, Homo Sapiens; identical to SEQ ID NO: 114696

SEQ ID NO: 534149 - RNA, 64 nt, Homo Sapiens; identical to SEQ ID NO: 114697

SEQ ID NO: 534150 - RNA, 64 nt, Homo Sapiens; identical to SEQ ID NO: 114698

SEQ ID NO: 534151 - RNA, 64 nt, Homo Sapiens; identical to SEQ ID NO: 114699

SEQ ID NO: 534152 - RNA, 64 nt, Homo Sapiens
agaagcaagagaccuuaaaggcuuccuaucccaccaauuacagggaaaaaacgugugaugaucc

SEQ ID NO: 534153 - RNA, 64 nt, Homo Sapiens
uuuacaacuucaaagcuguuuuauacauagaaaucaauuacaguuuuaauugaaaacuauaacc

SEQ ID NO: 534154 - RNA, 64 nt, Homo Sapiens
guuuuaaaacauaaggcauuugucugccauuuuucaauuacaugcugacuucccuuacaauuga

SEQ ID NO: 534155 - RNA, 64 nt, Homo Sapiens
uuauauauauuuggcuuggaaauguguuuuucuucaauuacaucuacaaguaaguacagcugaa

SEQ ID NO: 534156 - RNA, 64 nt, Homo Sapiens
ucccaaagucaguuauucauaaacaaaauuucuacaauuacaguuuacuuucuuguuuuuggaa

SEQ ID NO: 534157 - RNA, 64 nt, Homo Sapiens
ucccaaagacacaguuguucaaagaaaauuucuacaauuacaguuuacuuucuuguucuuggau

SEQ ID NO: 534158 - RNA, 64 nt, Homo Sapiens; identical to SEQ ID NO: 42310

SEQ ID NO: 534159 - RNA, 64 nt, Homo Sapiens; identical to SEQ ID NO: 42311

SEQ ID NO: 534160 - RNA, 64 nt, Homo Sapiens; identical to SEQ ID NO: 42312

SEQ ID NO: 534161 - RNA, 64 nt, Homo Sapiens; identical to SEQ ID NO: 42313

SEQ ID NO: 534162 - RNA, 64 nt, Homo Sapiens; identical to SEQ ID NO: 42314

SEQ ID NO: 534163 - RNA, 64 nt, Homo Sapiens; identical to SEQ ID NO: 42315

SEQ ID NO: 534164 - RNA, 64 nt, Homo Sapiens; identical to SEQ ID NO: 42316

SEQ ID NO: 534165 - RNA, 64 nt, Homo Sapiens; identical to SEQ ID NO: 298158

SEQ ID NO: 534166 - RNA, 64 nt, Homo Sapiens; identical to SEQ ID NO: 298159

SEQ ID NO: 534167 - RNA, 64 nt, Homo Sapiens; identical to SEQ ID NO: 298160

SEQ ID NO: 534168 - RNA, 64 nt, Homo Sapiens; identical to SEQ ID NO: 298161

SEQ ID NO: 534169 - RNA, 64 nt, Homo Sapiens; identical to SEQ ID NO: 298162

SEQ ID NO: 534170 - RNA, 64 nt, Homo Sapiens; identical to SEQ ID NO: 298163

SEQ ID NO: 534171 - RNA, 64 nt, Homo Sapiens; identical to SEQ ID NO: 298164

SEQ ID NO: 534172 - RNA, 64 nt, Homo Sapiens; identical to SEQ ID NO: 298165

SEQ ID NO: 534173 - RNA, 64 nt, Homo Sapiens; identical to SEQ ID NO: 298166

SEQ ID NO: 534174 - RNA, 64 nt, Homo Sapiens; identical to SEQ ID NO: 298167

SEQ ID NO: 534175 - RNA, 64 nt, Homo Sapiens; identical to SEQ ID NO: 298168

SEQ ID NO: 534176 - RNA, 64 nt, Homo Sapiens; identical to SEQ ID NO: 298169

SEQ ID NO: 534177 - RNA, 64 nt, Homo Sapiens; identical to SEQ ID NO: 298170

SEQ ID NO: 534178 - RNA, 64 nt, Homo Sapiens; identical to SEQ ID NO: 298171

SEQ ID NO: 534179 - RNA, 64 nt, Homo Sapiens; identical to SEQ ID NO: 298172

SEQ ID NO: 534180 - RNA, 64 nt, Homo Sapiens; identical to SEQ ID NO: 298173

SEQ ID NO: 534181 - RNA, 64 nt, Homo Sapiens; identical to SEQ ID NO: 298174

SEQ ID NO: 534182 - RNA, 64 nt, Homo Sapiens; identical to SEQ ID NO: 298175

SEQ ID NO: 534183 - RNA, 64 nt, Homo Sapiens; identical to SEQ ID NO: 298176

SEQ ID NO: 534184 - RNA, 64 nt, Homo Sapiens; identical to SEQ ID NO: 298177

SEQ ID NO: 534185 - RNA, 64 nt, Homo Sapiens; identical to SEQ ID NO: 298178

SEQ ID NO: 534186 - RNA, 64 nt, Homo Sapiens; identical to SEQ ID NO: 298179

SEQ ID NO: 534187 - RNA, 64 nt, Homo Sapiens; identical to SEQ ID NO: 298180

SEQ ID NO: 534188 - RNA, 64 nt, Homo Sapiens; identical to SEQ ID NO: 298181

SEQ ID NO: 534189 - RNA, 64 nt, Homo Sapiens; identical to SEQ ID NO: 298182

SEQ ID NO: 534190 - RNA, 64 nt, Homo Sapiens; identical to SEQ ID NO: 298183

SEQ ID NO: 534191 - RNA, 64 nt, Homo Sapiens; identical to SEQ ID NO: 298184

SEQ ID NO: 534192 - RNA, 64 nt, Homo Sapiens; identical to SEQ ID NO: 298185

SEQ ID NO: 534193 - RNA, 64 nt, Homo Sapiens; identical to SEQ ID NO: 298186

SEQ ID NO: 534194 - RNA, 64 nt, Homo Sapiens; identical to SEQ ID NO: 298187

SEQ ID NO: 534195 - RNA, 64 nt, Homo Sapiens; identical to SEQ ID NO: 298188

SEQ ID NO: 534196 - RNA, 64 nt, Homo Sapiens; identical to SEQ ID NO: 298189

SEQ ID NO: 534197 - RNA, 64 nt, Homo Sapiens; identical to SEQ ID NO: 298190

SEQ ID NO: 534198 - RNA, 64 nt, Homo Sapiens; identical to SEQ ID NO: 298191

SEQ ID NO: 534199 - RNA, 64 nt, Homo Sapiens; identical to SEQ ID NO: 298192

SEQ ID NO: 534200 - RNA, 64 nt, Homo Sapiens; identical to SEQ ID NO: 298193

SEQ ID NO: 534201 - RNA, 64 nt, Homo Sapiens; identical to SEQ ID NO: 298194

SEQ ID NO: 534202 - RNA, 64 nt, Homo Sapiens; identical to SEQ ID NO: 298195

SEQ ID NO: 534203 - RNA, 64 nt, Homo Sapiens; identical to SEQ ID NO: 298196

SEQ ID NO: 534204 - RNA, 64 nt, Homo Sapiens; identical to SEQ ID NO: 298197

SEQ ID NO: 534205 - RNA, 64 nt, Homo Sapiens; identical to SEQ ID NO: 298198

SEQ ID NO: 534206 - RNA, 64 nt, Homo Sapiens; identical to SEQ ID NO: 298199

SEQ ID NO: 534207 - RNA, 64 nt, Homo Sapiens; identical to SEQ ID NO: 298200

SEQ ID NO: 534208 - RNA, 64 nt, Homo Sapiens; identical to SEQ ID NO: 298201

SEQ ID NO: 534209 - RNA, 64 nt, Homo Sapiens; identical to SEQ ID NO: 298202

SEQ ID NO: 534210 - RNA, 64 nt, Homo Sapiens; identical to SEQ ID NO: 298203

SEQ ID NO: 534211 - RNA, 64 nt, Homo Sapiens; identical to SEQ ID NO: 298204

SEQ ID NO: 534212 - RNA, 64 nt, Homo Sapiens; identical to SEQ ID NO: 298205

SEQ ID NO: 534213 - RNA, 64 nt, Homo Sapiens; identical to SEQ ID NO: 298206

SEQ ID NO: 534214 - RNA, 64 nt, Homo Sapiens; identical to SEQ ID NO: 298207

SEQ ID NO: 534215 - RNA, 64 nt, Homo Sapiens; identical to SEQ ID NO: 298208

SEQ ID NO: 534216 - RNA, 64 nt, Homo Sapiens; identical to SEQ ID NO: 298209

SEQ ID NO: 534217 - RNA, 64 nt, Homo Sapiens; identical to SEQ ID NO: 298210

SEQ ID NO: 534218 - RNA, 64 nt, Homo Sapiens; identical to SEQ ID NO: 298211

SEQ ID NO: 534219 - RNA, 64 nt, Homo Sapiens; identical to SEQ ID NO: 298212

SEQ ID NO: 534220 - RNA, 64 nt, Homo Sapiens; identical to SEQ ID NO: 298213

SEQ ID NO: 534221 - RNA, 64 nt, Homo Sapiens; identical to SEQ ID NO: 298214

SEQ ID NO: 534222 - RNA, 64 nt, Homo Sapiens; identical to SEQ ID NO: 298215

SEQ ID NO: 534223 - RNA, 64 nt, Homo Sapiens; identical to SEQ ID NO: 298216

SEQ ID NO: 534224 - RNA, 64 nt, Homo Sapiens; identical to SEQ ID NO: 298217

SEQ ID NO: 534225 - RNA, 64 nt, Homo Sapiens; identical to SEQ ID NO: 298218

SEQ ID NO: 534226 - RNA, 64 nt, Homo Sapiens; identical to SEQ ID NO: 298219

SEQ ID NO: 534227 - RNA, 64 nt, Homo Sapiens; identical to SEQ ID NO: 298220

SEQ ID NO: 534228 - RNA, 64 nt, Homo Sapiens; identical to SEQ ID NO: 298221

SEQ ID NO: 534229 - RNA, 64 nt, Homo Sapiens; identical to SEQ ID NO: 298222

SEQ ID NO: 534230 - RNA, 64 nt, Homo Sapiens; identical to SEQ ID NO: 298223

SEQ ID NO: 534231 - RNA, 64 nt, Homo Sapiens; identical to SEQ ID NO: 298224

SEQ ID NO: 534232 - RNA, 64 nt, Homo Sapiens; identical to SEQ ID NO: 298225

SEQ ID NO: 534233 - RNA, 64 nt, Homo Sapiens; identical to SEQ ID NO: 298226

SEQ ID NO: 534234 - RNA, 64 nt, Homo Sapiens; identical to SEQ ID NO: 298227

SEQ ID NO: 534235 - RNA, 64 nt, Homo Sapiens; identical to SEQ ID NO: 298228

SEQ ID NO: 534236 - RNA, 64 nt, Homo Sapiens; identical to SEQ ID NO: 298229

SEQ ID NO: 534237 - RNA, 56 nt, Homo Sapiens; identical to SEQ ID NO: 298230

SEQ ID NO: 534238 - RNA, 64 nt, Homo Sapiens; identical to SEQ ID NO: 298231

SEQ ID NO: 534239 - RNA, 64 nt, Homo Sapiens; identical to SEQ ID NO: 298232

SEQ ID NO: 534240 - RNA, 64 nt, Homo Sapiens; identical to SEQ ID NO: 298233

SEQ ID NO: 534241 - RNA, 64 nt, Homo Sapiens; identical to SEQ ID NO: 298234

SEQ ID NO: 534242 - RNA, 64 nt, Homo Sapiens; identical to SEQ ID NO: 298235

SEQ ID NO: 534243 - RNA, 64 nt, Homo Sapiens; identical to SEQ ID NO: 298236

SEQ ID NO: 534244 - RNA, 64 nt, Homo Sapiens; identical to SEQ ID NO: 298237

SEQ ID NO: 534245 - RNA, 64 nt, Homo Sapiens; identical to SEQ ID NO: 298238

SEQ ID NO: 534246 - RNA, 63 nt, Homo Sapiens; identical to SEQ ID NO: 298239

SEQ ID NO: 534247 - RNA, 64 nt, Homo Sapiens; identical to SEQ ID NO: 298240

SEQ ID NO: 534248 - RNA, 64 nt, Homo Sapiens; identical to SEQ ID NO: 298241

SEQ ID NO: 534249 - RNA, 64 nt, Homo Sapiens; identical to SEQ ID NO: 298242

SEQ ID NO: 534250 - RNA, 64 nt, Homo Sapiens; identical to SEQ ID NO: 298243

SEQ ID NO: 534251 - RNA, 64 nt, Homo Sapiens; identical to SEQ ID NO: 298244

SEQ ID NO: 534252 - RNA, 64 nt, Homo Sapiens; identical to SEQ ID NO: 298245

SEQ ID NO: 534253 - RNA, 64 nt, Homo Sapiens; identical to SEQ ID NO: 298246

SEQ ID NO: 534254 - RNA, 64 nt, Homo Sapiens; identical to SEQ ID NO: 298247

SEQ ID NO: 534255 - RNA, 64 nt, Homo Sapiens; identical to SEQ ID NO: 298248

SEQ ID NO: 534256 - RNA, 64 nt, Homo Sapiens; identical to SEQ ID NO: 298249

SEQ ID NO: 534257 - RNA, 64 nt, Homo Sapiens; identical to SEQ ID NO: 287439

SEQ ID NO: 534258 - RNA, 64 nt, Homo Sapiens; identical to SEQ ID NO: 287440

SEQ ID NO: 534259 - RNA, 64 nt, Homo Sapiens; identical to SEQ ID NO: 287441

SEQ ID NO: 534260 - RNA, 64 nt, Homo Sapiens; identical to SEQ ID NO: 287442

SEQ ID NO: 534261 - RNA, 64 nt, Homo Sapiens; identical to SEQ ID NO: 287443

SEQ ID NO: 534262 - RNA, 64 nt, Homo Sapiens; identical to SEQ ID NO: 287444

SEQ ID NO: 534263 - RNA, 64 nt, Homo Sapiens; identical to SEQ ID NO: 287445

SEQ ID NO: 534264 - RNA, 64 nt, Homo Sapiens; identical to SEQ ID NO: 287446

SEQ ID NO: 534265 - RNA, 64 nt, Homo Sapiens; identical to SEQ ID NO: 287447

SEQ ID NO: 534266 - RNA, 64 nt, Homo Sapiens; identical to SEQ ID NO: 287448

SEQ ID NO: 534267 - RNA, 64 nt, Homo Sapiens; identical to SEQ ID NO: 287449

SEQ ID NO: 534268 - RNA, 64 nt, Homo Sapiens; identical to SEQ ID NO: 287450

SEQ ID NO: 534269 - RNA, 64 nt, Homo Sapiens; identical to SEQ ID NO: 287451

SEQ ID NO: 534270 - RNA, 64 nt, Homo Sapiens; identical to SEQ ID NO: 287452

SEQ ID NO: 534271 - RNA, 64 nt, Homo Sapiens; identical to SEQ ID NO: 287453

SEQ ID NO: 534272 - RNA, 64 nt, Homo Sapiens; identical to SEQ ID NO: 287454

SEQ ID NO: 534273 - RNA, 64 nt, Homo Sapiens; identical to SEQ ID NO: 287455

SEQ ID NO: 534274 - RNA, 64 nt, Homo Sapiens; identical to SEQ ID NO: 287456

SEQ ID NO: 534275 - RNA, 64 nt, Homo Sapiens; identical to SEQ ID NO: 287457

SEQ ID NO: 534276 - RNA, 64 nt, Homo Sapiens; identical to SEQ ID NO: 287458

SEQ ID NO: 534277 - RNA, 64 nt, Homo Sapiens; identical to SEQ ID NO: 287459

SEQ ID NO: 534278 - RNA, 64 nt, Homo Sapiens; identical to SEQ ID NO: 287460

SEQ ID NO: 534279 - RNA, 64 nt, Homo Sapiens; identical to SEQ ID NO: 287461

SEQ ID NO: 534280 - RNA, 64 nt, Homo Sapiens; identical to SEQ ID NO: 287462

SEQ ID NO: 534281 - RNA, 64 nt, Homo Sapiens; identical to SEQ ID NO: 287463

SEQ ID NO: 534282 - RNA, 64 nt, Homo Sapiens; identical to SEQ ID NO: 287464

SEQ ID NO: 534283 - RNA, 64 nt, Homo Sapiens; identical to SEQ ID NO: 287465

SEQ ID NO: 534284 - RNA, 64 nt, Homo Sapiens; identical to SEQ ID NO: 287466

SEQ ID NO: 534285 - RNA, 64 nt, Homo Sapiens; identical to SEQ ID NO: 287467

SEQ ID NO: 534286 - RNA, 64 nt, Homo Sapiens; identical to SEQ ID NO: 287468

SEQ ID NO: 534287 - RNA, 64 nt, Homo Sapiens; identical to SEQ ID NO: 287469

SEQ ID NO: 534288 - RNA, 64 nt, Homo Sapiens; identical to SEQ ID NO: 287470

SEQ ID NO: 534289 - RNA, 64 nt, Homo Sapiens; identical to SEQ ID NO: 287471

SEQ ID NO: 534290 - RNA, 64 nt, Homo Sapiens; identical to SEQ ID NO: 287472

SEQ ID NO: 534291 - RNA, 64 nt, Homo Sapiens; identical to SEQ ID NO: 287473

SEQ ID NO: 534292 - RNA, 64 nt, Homo Sapiens; identical to SEQ ID NO: 287474

SEQ ID NO: 534293 - RNA, 64 nt, Homo Sapiens; identical to SEQ ID NO: 287475

SEQ ID NO: 534294 - RNA, 64 nt, Homo Sapiens; identical to SEQ ID NO: 287476

SEQ ID NO: 534295 - RNA, 64 nt, Homo Sapiens; identical to SEQ ID NO: 287477

SEQ ID NO: 534296 - RNA, 64 nt, Homo Sapiens; identical to SEQ ID NO: 287478

SEQ ID NO: 534297 - RNA, 64 nt, Homo Sapiens; identical to SEQ ID NO: 287479

SEQ ID NO: 534298 - RNA, 64 nt, Homo Sapiens; identical to SEQ ID NO: 287480

SEQ ID NO: 534299 - RNA, 64 nt, Homo Sapiens; identical to SEQ ID NO: 287481

SEQ ID NO: 534300 - RNA, 64 nt, Homo Sapiens; identical to SEQ ID NO: 287482

SEQ ID NO: 534301 - RNA, 64 nt, Homo Sapiens; identical to SEQ ID NO: 287483

SEQ ID NO: 534302 - RNA, 64 nt, Homo Sapiens; identical to SEQ ID NO: 287484

SEQ ID NO: 534303 - RNA, 64 nt, Homo Sapiens; identical to SEQ ID NO: 287485

SEQ ID NO: 534304 - RNA, 64 nt, Homo Sapiens; identical to SEQ ID NO: 287486

SEQ ID NO: 534305 - RNA, 64 nt, Homo Sapiens; identical to SEQ ID NO: 287487

SEQ ID NO: 534306 - RNA, 64 nt, Homo Sapiens
cuccugggccaacucugcacgugcaggccgccugccccgccacgcugcugggcgagcagggcag

SEQ ID NO: 534307 - RNA, 64 nt, Homo Sapiens
cuggagcccggagggucugcagguggacgcugggccccgccagggaucugaccugggcccacca

SEQ ID NO: 534308 - RNA, 64 nt, Homo Sapiens
gcuggggacagagggugucauguguggcagggggccccgccaggcuuuguggagagaaugugug

SEQ ID NO: 534309 - RNA, 64 nt, Homo Sapiens
gccuucggacagacauauggcccuggagcaggagccccgccacagcaccgccacgucccagcau

SEQ ID NO: 534310 - RNA, 64 nt, Homo Sapiens
ucuggcuguuuagcuugaggcucucccgggcugcccccgccagccucuucacguucaucccugu

SEQ ID NO: 534311 - RNA, 64 nt, Homo Sapiens
uggggagacagcccuucccaagcucaacuccccaccccgccacgcccugaaggagcugagaggg

SEQ ID NO: 534312 - RNA, 64 nt, Homo Sapiens
ggagaccaggcuggcuggauggcccaugagugacccccgccagggugucuguguguugaugggu

SEQ ID NO: 534313 - RNA, 64 nt, Homo Sapiens
uggggugcccaggggcaggguaccaaagacugacccccgccagcacaccaaaguguccacauug

SEQ ID NO: 534314 - RNA, 64 nt, Homo Sapiens
acccaccccgcuuucguaguagggccacaacugcccccgccacaucagucaccgaagguccuac

SEQ ID NO: 534315 - RNA, 64 nt, Homo Sapiens
cucacccgacccgugcacgacccaacugcgccgaccccgccacuugcugcuccacggcgcggag

SEQ ID NO: 534316 - RNA, 64 nt, Homo Sapiens
ggggacgacagggaucuucauccacaaugggcucccccgccaacaguguggcaguccccacagc

SEQ ID NO: 534317 - RNA, 64 nt, Homo Sapiens
ccuuagagcagagcagccccccaccaccccccccccccgccacgugagguccccuaaucugugg

SEQ ID NO: 534318 - RNA, 64 nt, Homo Sapiens
gagacacaccauuacauacacacacgcagccccuccccgccacagacacacacagacacacaau

SEQ ID NO: 534319 - RNA, 64 nt, Homo Sapiens
gagacacaccauuacauacacacacacacacccuccccgccacagaaagacacagacacaaaau

SEQ ID NO: 534320 - RNA, 64 nt, Homo Sapiens
gagacaccauuacauacacacacacacacacccuccccgccacagacacacacagacacaaaau

SEQ ID NO: 534321 - RNA, 64 nt, Homo Sapiens
uugucccagccacucuagcucaacagugcuuggcccccgccagcgucaccagacccuauugcuu

SEQ ID NO: 534322 - RNA, 64 nt, Homo Sapiens
cagcuccugcugccaucccccaauuccaugcuucccccgccaacaaggggcugcagcccuguug

SEQ ID NO: 534323 - RNA, 64 nt, Homo Sapiens
gucuuccuuccacccugcagcccguguccaggagccccgccaggugcccgcgccaggcccucag

SEQ ID NO: 534324 - RNA, 64 nt, Homo Sapiens
gaccagcuggcggguguggagaccaggcuccugaccccgccaugcaugcagcgccaccuggaag

SEQ ID NO: 534325 - RNA, 64 nt, Homo Sapiens
aggacagagagauggacaugcguccccucccuccccccgccaagugcucacacacaaccucacg

SEQ ID NO: 534326 - RNA, 64 nt, Homo Sapiens
acacacgcagauggaggcgccucacugggaggugccccgccagcccugggcagugucaggcagg

SEQ ID NO: 534327 - RNA, 64 nt, Homo Sapiens
gcagcgagauugcucugcagccagugagggagguccccgccaugccggcuggaagaagaaccuc

SEQ ID NO: 534328 - RNA, 64 nt, Homo Sapiens
ucuguucagaugacagcgaccgccuuuucauuccccccgccaccuguacucacccucacgcucu

SEQ ID NO: 534329 - RNA, 64 nt, Homo Sapiens
augugcuuuuccaguucuucuggaauugggggacccccgccaaagacugagcccccugucuccu

SEQ ID NO: 534330 - RNA, 64 nt, Homo Sapiens
ccauguggauuuuggggggucccuuuugugucucccccgccauucaaggacuccucucuuucuu

SEQ ID NO: 534331 - RNA, 64 nt, Homo Sapiens
acguccagagcaacuuacccccaccaggacugcuccccgccagcgaagugcccccgccaucccg

SEQ ID NO: 534332 - RNA, 64 nt, Homo Sapiens
ccgccaccaggacugcucccggacccagaagugcccccgccauccccggaucccgugcacccug

SEQ ID NO: 534333 - RNA, 64 nt, Homo Sapiens
cccuuacaccuaccccaccucauauugcaugcccccccgccauugggcacugcccucccucacc

SEQ ID NO: 534334 - RNA, 64 nt, Homo Sapiens
cuaccucccaccccagcagcaggaccgggcccugccccgccacccugcaugcccaguauugcca

SEQ ID NO: 534335 - RNA, 64 nt, Homo Sapiens; identical to SEQ ID NO: 138011

SEQ ID NO: 534336 - RNA, 64 nt, Homo Sapiens; identical to SEQ ID NO: 138012

SEQ ID NO: 534337 - RNA, 64 nt, Homo Sapiens; identical to SEQ ID NO: 138013

SEQ ID NO: 534338 - RNA, 64 nt, Homo Sapiens; identical to SEQ ID NO: 138014

SEQ ID NO: 534339 - RNA, 64 nt, Homo Sapiens; identical to SEQ ID NO: 138015

SEQ ID NO: 534340 - RNA, 59 nt, Homo Sapiens; identical to SEQ ID NO: 138016

SEQ ID NO: 534341 - RNA, 64 nt, Homo Sapiens; identical to SEQ ID NO: 138017

SEQ ID NO: 534342 - RNA, 64 nt, Homo Sapiens; identical to SEQ ID NO: 138018

SEQ ID NO: 534343 - RNA, 64 nt, Homo Sapiens; identical to SEQ ID NO: 138019

SEQ ID NO: 534344 - RNA, 64 nt, Homo Sapiens; identical to SEQ ID NO: 138020

SEQ ID NO: 534345 - RNA, 64 nt, Homo Sapiens; identical to SEQ ID NO: 138021

SEQ ID NO: 534346 - RNA, 64 nt, Homo Sapiens; identical to SEQ ID NO: 138022

SEQ ID NO: 534347 - RNA, 64 nt, Homo Sapiens; identical to SEQ ID NO: 138023

SEQ ID NO: 534348 - RNA, 64 nt, Homo Sapiens; identical to SEQ ID NO: 138024

SEQ ID NO: 534349 - RNA, 64 nt, Homo Sapiens; identical to SEQ ID NO: 138025

SEQ ID NO: 534350 - RNA, 64 nt, Homo Sapiens; identical to SEQ ID NO: 138026

SEQ ID NO: 534351 - RNA, 64 nt, Homo Sapiens; identical to SEQ ID NO: 138027

SEQ ID NO: 534352 - RNA, 64 nt, Homo Sapiens; identical to SEQ ID NO: 138028

SEQ ID NO: 534353 - RNA, 64 nt, Homo Sapiens; identical to SEQ ID NO: 138029

SEQ ID NO: 534354 - RNA, 64 nt, Homo Sapiens; identical to SEQ ID NO: 138030

SEQ ID NO: 534355 - RNA, 64 nt, Homo Sapiens; identical to SEQ ID NO: 138031

SEQ ID NO: 534356 - RNA, 64 nt, Homo Sapiens; identical to SEQ ID NO: 138032

SEQ ID NO: 534357 - RNA, 64 nt, Homo Sapiens; identical to SEQ ID NO: 138033

SEQ ID NO: 534358 - RNA, 64 nt, Homo Sapiens; identical to SEQ ID NO: 138034

SEQ ID NO: 534359 - RNA, 64 nt, Homo Sapiens; identical to SEQ ID NO: 138035

SEQ ID NO: 534360 - RNA, 64 nt, Homo Sapiens; identical to SEQ ID NO: 138036

SEQ ID NO: 534361 - RNA, 64 nt, Homo Sapiens; identical to SEQ ID NO: 138037

SEQ ID NO: 534362 - RNA, 64 nt, Homo Sapiens; identical to SEQ ID NO: 138038

SEQ ID NO: 534363 - RNA, 64 nt, Homo Sapiens; identical to SEQ ID NO: 138039

SEQ ID NO: 534364 - RNA, 64 nt, Homo Sapiens; identical to SEQ ID NO: 138040

SEQ ID NO: 534365 - RNA, 64 nt, Homo Sapiens; identical to SEQ ID NO: 138041

SEQ ID NO: 534366 - RNA, 64 nt, Homo Sapiens; identical to SEQ ID NO: 138042

SEQ ID NO: 534367 - RNA, 64 nt, Homo Sapiens; identical to SEQ ID NO: 138043

SEQ ID NO: 534368 - RNA, 64 nt, Homo Sapiens; identical to SEQ ID NO: 138044

SEQ ID NO: 534369 - RNA, 64 nt, Homo Sapiens; identical to SEQ ID NO: 138045

SEQ ID NO: 534370 - RNA, 64 nt, Homo Sapiens; identical to SEQ ID NO: 138046

SEQ ID NO: 534371 - RNA, 64 nt, Homo Sapiens; identical to SEQ ID NO: 138047

SEQ ID NO: 534372 - RNA, 64 nt, Homo Sapiens; identical to SEQ ID NO: 138048

SEQ ID NO: 534373 - RNA, 64 nt, Homo Sapiens; identical to SEQ ID NO: 138049

SEQ ID NO: 534374 - RNA, 64 nt, Homo Sapiens; identical to SEQ ID NO: 138050

SEQ ID NO: 534375 - RNA, 64 nt, Homo Sapiens; identical to SEQ ID NO: 138051

SEQ ID NO: 534376 - RNA, 64 nt, Homo Sapiens; identical to SEQ ID NO: 138052

SEQ ID NO: 534377 - RNA, 64 nt, Homo Sapiens; identical to SEQ ID NO: 138053

SEQ ID NO: 534378 - RNA, 64 nt, Homo Sapiens; identical to SEQ ID NO: 138054

SEQ ID NO: 534379 - RNA, 64 nt, Homo Sapiens; identical to SEQ ID NO: 138055

SEQ ID NO: 534380 - RNA, 64 nt, Homo Sapiens; identical to SEQ ID NO: 138056

SEQ ID NO: 534381 - RNA, 64 nt, Homo Sapiens; identical to SEQ ID NO: 138057

SEQ ID NO: 534382 - RNA, 64 nt, Homo Sapiens; identical to SEQ ID NO: 138058

SEQ ID NO: 534383 - RNA, 64 nt, Homo Sapiens; identical to SEQ ID NO: 138059

SEQ ID NO: 534384 - RNA, 64 nt, Homo Sapiens; identical to SEQ ID NO: 138060

SEQ ID NO: 534385 - RNA, 64 nt, Homo Sapiens; identical to SEQ ID NO: 138061

SEQ ID NO: 534386 - RNA, 64 nt, Homo Sapiens; identical to SEQ ID NO: 138062

SEQ ID NO: 534387 - RNA, 64 nt, Homo Sapiens; identical to SEQ ID NO: 138063

SEQ ID NO: 534388 - RNA, 64 nt, Homo Sapiens; identical to SEQ ID NO: 138064

SEQ ID NO: 534389 - RNA, 64 nt, Homo Sapiens; identical to SEQ ID NO: 138065

SEQ ID NO: 534390 - RNA, 64 nt, Homo Sapiens; identical to SEQ ID NO: 138066

SEQ ID NO: 534391 - RNA, 64 nt, Homo Sapiens; identical to SEQ ID NO: 369644

SEQ ID NO: 534392 - RNA, 64 nt, Homo Sapiens; identical to SEQ ID NO: 369645

SEQ ID NO: 534393 - RNA, 64 nt, Homo Sapiens; identical to SEQ ID NO: 369646

SEQ ID NO: 534394 - RNA, 64 nt, Homo Sapiens; identical to SEQ ID NO: 369647

SEQ ID NO: 534395 - RNA, 64 nt, Homo Sapiens; identical to SEQ ID NO: 369648

SEQ ID NO: 534396 - RNA, 64 nt, Homo Sapiens; identical to SEQ ID NO: 369649

SEQ ID NO: 534397 - RNA, 64 nt, Homo Sapiens; identical to SEQ ID NO: 369650

SEQ ID NO: 534398 - RNA, 64 nt, Homo Sapiens; identical to SEQ ID NO: 369651

SEQ ID NO: 534399 - RNA, 64 nt, Homo Sapiens; identical to SEQ ID NO: 390131

SEQ ID NO: 534400 - RNA, 64 nt, Homo Sapiens; identical to SEQ ID NO: 390132

SEQ ID NO: 534401 - RNA, 64 nt, Homo Sapiens; identical to SEQ ID NO: 390133

SEQ ID NO: 534402 - RNA, 64 nt, Homo Sapiens; identical to SEQ ID NO: 390134

SEQ ID NO: 534403 - RNA, 64 nt, Homo Sapiens; identical to SEQ ID NO: 390135

SEQ ID NO: 534404 - RNA, 64 nt, Homo Sapiens; identical to SEQ ID NO: 390136

SEQ ID NO: 534405 - RNA, 64 nt, Homo Sapiens; identical to SEQ ID NO: 390137

SEQ ID NO: 534406 - RNA, 64 nt, Homo Sapiens; identical to SEQ ID NO: 390138

SEQ ID NO: 534407 - RNA, 64 nt, Homo Sapiens; identical to SEQ ID NO: 390139

SEQ ID NO: 534408 - RNA, 64 nt, Homo Sapiens; identical to SEQ ID NO: 390140

SEQ ID NO: 534409 - RNA, 64 nt, Homo Sapiens; identical to SEQ ID NO: 390141

SEQ ID NO: 534410 - RNA, 64 nt, Homo Sapiens; identical to SEQ ID NO: 390142

SEQ ID NO: 534411 - RNA, 64 nt, Homo Sapiens; identical to SEQ ID NO: 390143

SEQ ID NO: 534412 - RNA, 57 nt, Homo Sapiens; identical to SEQ ID NO: 390144

SEQ ID NO: 534413 - RNA, 64 nt, Homo Sapiens; identical to SEQ ID NO: 390145

SEQ ID NO: 534414 - RNA, 64 nt, Homo Sapiens; identical to SEQ ID NO: 390146

SEQ ID NO: 534415 - RNA, 64 nt, Homo Sapiens; identical to SEQ ID NO: 390147

SEQ ID NO: 534416 - RNA, 64 nt, Homo Sapiens; identical to SEQ ID NO: 390148

SEQ ID NO: 534417 - RNA, 64 nt, Homo Sapiens; identical to SEQ ID NO: 390149

SEQ ID NO: 534418 - RNA, 64 nt, Homo Sapiens; identical to SEQ ID NO: 390150

SEQ ID NO: 534419 - RNA, 64 nt, Homo Sapiens; identical to SEQ ID NO: 390151

SEQ ID NO: 534420 - RNA, 64 nt, Homo Sapiens; identical to SEQ ID NO: 390152

SEQ ID NO: 534421 - RNA, 64 nt, Homo Sapiens; identical to SEQ ID NO: 390153

SEQ ID NO: 534422 - RNA, 64 nt, Homo Sapiens; identical to SEQ ID NO: 390154

SEQ ID NO: 534423 - RNA, 64 nt, Homo Sapiens; identical to SEQ ID NO: 390155

SEQ ID NO: 534424 - RNA, 64 nt, Homo Sapiens; identical to SEQ ID NO: 390156

SEQ ID NO: 534425 - RNA, 64 nt, Homo Sapiens; identical to SEQ ID NO: 390157

SEQ ID NO: 534426 - RNA, 64 nt, Homo Sapiens; identical to SEQ ID NO: 390158

SEQ ID NO: 534427 - RNA, 64 nt, Homo Sapiens; identical to SEQ ID NO: 390159

SEQ ID NO: 534428 - RNA, 64 nt, Homo Sapiens; identical to SEQ ID NO: 390160

SEQ ID NO: 534429 - RNA, 64 nt, Homo Sapiens; identical to SEQ ID NO: 390161

SEQ ID NO: 534430 - RNA, 64 nt, Homo Sapiens; identical to SEQ ID NO: 390162

SEQ ID NO: 534431 - RNA, 64 nt, Homo Sapiens; identical to SEQ ID NO: 390163

SEQ ID NO: 534432 - RNA, 64 nt, Homo Sapiens; identical to SEQ ID NO: 390164

SEQ ID NO: 534433 - RNA, 64 nt, Homo Sapiens; identical to SEQ ID NO: 390165

SEQ ID NO: 534434 - RNA, 64 nt, Homo Sapiens; identical to SEQ ID NO: 390166

SEQ ID NO: 534435 - RNA, 64 nt, Homo Sapiens; identical to SEQ ID NO: 390167

SEQ ID NO: 534436 - RNA, 64 nt, Homo Sapiens; identical to SEQ ID NO: 390168

SEQ ID NO: 534437 - RNA, 64 nt, Homo Sapiens; identical to SEQ ID NO: 390169

SEQ ID NO: 534438 - RNA, 64 nt, Homo Sapiens; identical to SEQ ID NO: 390170

SEQ ID NO: 534439 - RNA, 64 nt, Homo Sapiens; identical to SEQ ID NO: 390171

SEQ ID NO: 534440 - RNA, 64 nt, Homo Sapiens; identical to SEQ ID NO: 390172

SEQ ID NO: 534441 - RNA, 64 nt, Homo Sapiens; identical to SEQ ID NO: 390173

SEQ ID NO: 534442 - RNA, 64 nt, Homo Sapiens; identical to SEQ ID NO: 390174

SEQ ID NO: 534443 - RNA, 64 nt, Homo Sapiens; identical to SEQ ID NO: 390175

SEQ ID NO: 534444 - RNA, 64 nt, Homo Sapiens; identical to SEQ ID NO: 390176

SEQ ID NO: 534445 - RNA, 64 nt, Homo Sapiens; identical to SEQ ID NO: 390177

SEQ ID NO: 534446 - RNA, 64 nt, Homo Sapiens; identical to SEQ ID NO: 390178

SEQ ID NO: 534447 - RNA, 64 nt, Homo Sapiens; identical to SEQ ID NO: 390179

SEQ ID NO: 534448 - RNA, 64 nt, Homo Sapiens; identical to SEQ ID NO: 390180

SEQ ID NO: 534449 - RNA, 64 nt, Homo Sapiens; identical to SEQ ID NO: 390181

SEQ ID NO: 534450 - RNA, 64 nt, Homo Sapiens; identical to SEQ ID NO: 390182

SEQ ID NO: 534451 - RNA, 64 nt, Homo Sapiens; identical to SEQ ID NO: 390183

SEQ ID NO: 534452 - RNA, 64 nt, Homo Sapiens; identical to SEQ ID NO: 390184

SEQ ID NO: 534453 - RNA, 64 nt, Homo Sapiens; identical to SEQ ID NO: 390185

SEQ ID NO: 534454 - RNA, 64 nt, Homo Sapiens; identical to SEQ ID NO: 390186

SEQ ID NO: 534455 - RNA, 64 nt, Homo Sapiens; identical to SEQ ID NO: 390187

SEQ ID NO: 534456 - RNA, 64 nt, Homo Sapiens; identical to SEQ ID NO: 390188

SEQ ID NO: 534457 - RNA, 64 nt, Homo Sapiens; identical to SEQ ID NO: 390189

SEQ ID NO: 534458 - RNA, 64 nt, Homo Sapiens; identical to SEQ ID NO: 390190

SEQ ID NO: 534459 - RNA, 64 nt, Homo Sapiens; identical to SEQ ID NO: 390191

SEQ ID NO: 534460 - RNA, 64 nt, Homo Sapiens; identical to SEQ ID NO: 390192

SEQ ID NO: 534461 - RNA, 64 nt, Homo Sapiens; identical to SEQ ID NO: 390193

SEQ ID NO: 534462 - RNA, 64 nt, Homo Sapiens; identical to SEQ ID NO: 390194

SEQ ID NO: 534463 - RNA, 64 nt, Homo Sapiens; identical to SEQ ID NO: 390195

SEQ ID NO: 534464 - RNA, 64 nt, Homo Sapiens; identical to SEQ ID NO: 390196

SEQ ID NO: 534465 - RNA, 64 nt, Homo Sapiens; identical to SEQ ID NO: 390197

SEQ ID NO: 534466 - RNA, 64 nt, Homo Sapiens; identical to SEQ ID NO: 390198

SEQ ID NO: 534467 - RNA, 64 nt, Homo Sapiens; identical to SEQ ID NO: 390199

SEQ ID NO: 534468 - RNA, 64 nt, Homo Sapiens; identical to SEQ ID NO: 390200

SEQ ID NO: 534469 - RNA, 64 nt, Homo Sapiens; identical to SEQ ID NO: 390201

SEQ ID NO: 534470 - RNA, 64 nt, Homo Sapiens; identical to SEQ ID NO: 390202

SEQ ID NO: 534471 - RNA, 64 nt, Homo Sapiens; identical to SEQ ID NO: 390203

SEQ ID NO: 534472 - RNA, 64 nt, Homo Sapiens; identical to SEQ ID NO: 390204

SEQ ID NO: 534473 - RNA, 60 nt, Homo Sapiens; identical to SEQ ID NO: 390205

SEQ ID NO: 534474 - RNA, 64 nt, Homo Sapiens; identical to SEQ ID NO: 390206

SEQ ID NO: 534475 - RNA, 64 nt, Homo Sapiens; identical to SEQ ID NO: 390207

SEQ ID NO: 534476 - RNA, 64 nt, Homo Sapiens; identical to SEQ ID NO: 390208

SEQ ID NO: 534477 - RNA, 64 nt, Homo Sapiens; identical to SEQ ID NO: 390209

SEQ ID NO: 534478 - RNA, 64 nt, Homo Sapiens; identical to SEQ ID NO: 390210

SEQ ID NO: 534479 - RNA, 64 nt, Homo Sapiens; identical to SEQ ID NO: 390211

SEQ ID NO: 534480 - RNA, 64 nt, Homo Sapiens; identical to SEQ ID NO: 390212

SEQ ID NO: 534481 - RNA, 64 nt, Homo Sapiens; identical to SEQ ID NO: 390213

SEQ ID NO: 534482 - RNA, 64 nt, Homo Sapiens; identical to SEQ ID NO: 390214

SEQ ID NO: 534483 - RNA, 64 nt, Homo Sapiens; identical to SEQ ID NO: 390215

SEQ ID NO: 534484 - RNA, 64 nt, Homo Sapiens; identical to SEQ ID NO: 390216

SEQ ID NO: 534485 - RNA, 64 nt, Homo Sapiens; identical to SEQ ID NO: 390217

SEQ ID NO: 534486 - RNA, 64 nt, Homo Sapiens; identical to SEQ ID NO: 390218

SEQ ID NO: 534487 - RNA, 64 nt, Homo Sapiens; identical to SEQ ID NO: 390219

SEQ ID NO: 534488 - RNA, 64 nt, Homo Sapiens; identical to SEQ ID NO: 390220

SEQ ID NO: 534489 - RNA, 64 nt, Homo Sapiens; identical to SEQ ID NO: 390221

SEQ ID NO: 534490 - RNA, 64 nt, Homo Sapiens; identical to SEQ ID NO: 390222

SEQ ID NO: 534491 - RNA, 64 nt, Homo Sapiens; identical to SEQ ID NO: 390223

SEQ ID NO: 534492 - RNA, 64 nt, Homo Sapiens; identical to SEQ ID NO: 390224

SEQ ID NO: 534493 - RNA, 64 nt, Homo Sapiens; identical to SEQ ID NO: 390225

SEQ ID NO: 534494 - RNA, 64 nt, Homo Sapiens; identical to SEQ ID NO: 390226

SEQ ID NO: 534495 - RNA, 64 nt, Homo Sapiens; identical to SEQ ID NO: 390227

SEQ ID NO: 534496 - RNA, 64 nt, Homo Sapiens; identical to SEQ ID NO: 390228

SEQ ID NO: 534497 - RNA, 64 nt, Homo Sapiens; identical to SEQ ID NO: 390229

SEQ ID NO: 534498 - RNA, 64 nt, Homo Sapiens; identical to SEQ ID NO: 390230

SEQ ID NO: 534499 - RNA, 64 nt, Homo Sapiens; identical to SEQ ID NO: 390231

SEQ ID NO: 534500 - RNA, 64 nt, Homo Sapiens; identical to SEQ ID NO: 390232

SEQ ID NO: 534501 - RNA, 64 nt, Homo Sapiens; identical to SEQ ID NO: 390233

SEQ ID NO: 534502 - RNA, 64 nt, Homo Sapiens; identical to SEQ ID NO: 390234

SEQ ID NO: 534503 - RNA, 64 nt, Homo Sapiens; identical to SEQ ID NO: 390235

SEQ ID NO: 534504 - RNA, 64 nt, Homo Sapiens; identical to SEQ ID NO: 390236

SEQ ID NO: 534505 - RNA, 64 nt, Homo Sapiens; identical to SEQ ID NO: 390237

SEQ ID NO: 534506 - RNA, 64 nt, Homo Sapiens; identical to SEQ ID NO: 390238

SEQ ID NO: 534507 - RNA, 64 nt, Homo Sapiens; identical to SEQ ID NO: 390239

SEQ ID NO: 534508 - RNA, 64 nt, Homo Sapiens; identical to SEQ ID NO: 390240

SEQ ID NO: 534509 - RNA, 64 nt, Homo Sapiens; identical to SEQ ID NO: 390241

SEQ ID NO: 534510 - RNA, 64 nt, Homo Sapiens; identical to SEQ ID NO: 390242

SEQ ID NO: 534511 - RNA, 64 nt, Homo Sapiens; identical to SEQ ID NO: 390243

SEQ ID NO: 534512 - RNA, 64 nt, Homo Sapiens; identical to SEQ ID NO: 390244

SEQ ID NO: 534513 - RNA, 64 nt, Homo Sapiens; identical to SEQ ID NO: 390245

SEQ ID NO: 534514 - RNA, 64 nt, Homo Sapiens; identical to SEQ ID NO: 390246

SEQ ID NO: 534515 - RNA, 64 nt, Homo Sapiens; identical to SEQ ID NO: 390247

SEQ ID NO: 534516 - RNA, 64 nt, Homo Sapiens; identical to SEQ ID NO: 390248

SEQ ID NO: 534517 - RNA, 64 nt, Homo Sapiens; identical to SEQ ID NO: 390249

SEQ ID NO: 534518 - RNA, 64 nt, Homo Sapiens; identical to SEQ ID NO: 390250

SEQ ID NO: 534519 - RNA, 64 nt, Homo Sapiens; identical to SEQ ID NO: 390251

SEQ ID NO: 534520 - RNA, 64 nt, Homo Sapiens; identical to SEQ ID NO: 390252

SEQ ID NO: 534521 - RNA, 64 nt, Homo Sapiens; identical to SEQ ID NO: 390253

SEQ ID NO: 534522 - RNA, 64 nt, Homo Sapiens; identical to SEQ ID NO: 390254

SEQ ID NO: 534523 - RNA, 64 nt, Homo Sapiens; identical to SEQ ID NO: 390255

SEQ ID NO: 534524 - RNA, 64 nt, Homo Sapiens; identical to SEQ ID NO: 390256

SEQ ID NO: 534525 - RNA, 64 nt, Homo Sapiens; identical to SEQ ID NO: 390257

SEQ ID NO: 534526 - RNA, 64 nt, Homo Sapiens; identical to SEQ ID NO: 390258

SEQ ID NO: 534527 - RNA, 64 nt, Homo Sapiens; identical to SEQ ID NO: 390259

SEQ ID NO: 534528 - RNA, 64 nt, Homo Sapiens; identical to SEQ ID NO: 163578

SEQ ID NO: 534529 - RNA, 64 nt, Homo Sapiens; identical to SEQ ID NO: 163579

SEQ ID NO: 534530 - RNA, 64 nt, Homo Sapiens; identical to SEQ ID NO: 163580

SEQ ID NO: 534531 - RNA, 64 nt, Homo Sapiens; identical to SEQ ID NO: 163581

SEQ ID NO: 534532 - RNA, 64 nt, Homo Sapiens; identical to SEQ ID NO: 163582

SEQ ID NO: 534533 - RNA, 64 nt, Homo Sapiens; identical to SEQ ID NO: 163583

SEQ ID NO: 534534 - RNA, 64 nt, Homo Sapiens; identical to SEQ ID NO: 163584

SEQ ID NO: 534535 - RNA, 64 nt, Homo Sapiens; identical to SEQ ID NO: 163585

SEQ ID NO: 534536 - RNA, 64 nt, Homo Sapiens; identical to SEQ ID NO: 163586

SEQ ID NO: 534537 - RNA, 64 nt, Homo Sapiens; identical to SEQ ID NO: 163587

SEQ ID NO: 534538 - RNA, 64 nt, Homo Sapiens; identical to SEQ ID NO: 163588

SEQ ID NO: 534539 - RNA, 64 nt, Homo Sapiens; identical to SEQ ID NO: 163589

SEQ ID NO: 534540 - RNA, 64 nt, Homo Sapiens; identical to SEQ ID NO: 163590

SEQ ID NO: 534541 - RNA, 64 nt, Homo Sapiens; identical to SEQ ID NO: 163591

SEQ ID NO: 534542 - RNA, 64 nt, Homo Sapiens; identical to SEQ ID NO: 163592

SEQ ID NO: 534543 - RNA, 64 nt, Homo Sapiens; identical to SEQ ID NO: 163593

SEQ ID NO: 534544 - RNA, 64 nt, Homo Sapiens; identical to SEQ ID NO: 163594

SEQ ID NO: 534545 - RNA, 64 nt, Homo Sapiens; identical to SEQ ID NO: 163595

SEQ ID NO: 534546 - RNA, 64 nt, Homo Sapiens; identical to SEQ ID NO: 163596

SEQ ID NO: 534547 - RNA, 64 nt, Homo Sapiens; identical to SEQ ID NO: 163597

SEQ ID NO: 534548 - RNA, 64 nt, Homo Sapiens; identical to SEQ ID NO: 163598

SEQ ID NO: 534549 - RNA, 64 nt, Homo Sapiens; identical to SEQ ID NO: 163599

SEQ ID NO: 534550 - RNA, 64 nt, Homo Sapiens; identical to SEQ ID NO: 163600

SEQ ID NO: 534551 - RNA, 64 nt, Homo Sapiens; identical to SEQ ID NO: 163601

SEQ ID NO: 534552 - RNA, 54 nt, Homo Sapiens; identical to SEQ ID NO: 163602

SEQ ID NO: 534553 - RNA, 64 nt, Homo Sapiens; identical to SEQ ID NO: 163603

SEQ ID NO: 534554 - RNA, 64 nt, Homo Sapiens; identical to SEQ ID NO: 163604

SEQ ID NO: 534555 - RNA, 64 nt, Homo Sapiens; identical to SEQ ID NO: 163605

SEQ ID NO: 534556 - RNA, 64 nt, Homo Sapiens; identical to SEQ ID NO: 163606

SEQ ID NO: 534557 - RNA, 64 nt, Homo Sapiens; identical to SEQ ID NO: 163607

SEQ ID NO: 534558 - RNA, 64 nt, Homo Sapiens; identical to SEQ ID NO: 163608

SEQ ID NO: 534559 - RNA, 64 nt, Homo Sapiens; identical to SEQ ID NO: 163609

SEQ ID NO: 534560 - RNA, 64 nt, Homo Sapiens; identical to SEQ ID NO: 163610

SEQ ID NO: 534561 - RNA, 64 nt, Homo Sapiens; identical to SEQ ID NO: 163611

SEQ ID NO: 534562 - RNA, 63 nt, Homo Sapiens; identical to SEQ ID NO: 163612

SEQ ID NO: 534563 - RNA, 64 nt, Homo Sapiens; identical to SEQ ID NO: 163613

SEQ ID NO: 534564 - RNA, 64 nt, Homo Sapiens; identical to SEQ ID NO: 163614

SEQ ID NO: 534565 - RNA, 64 nt, Homo Sapiens; identical to SEQ ID NO: 163615

SEQ ID NO: 534566 - RNA, 64 nt, Homo Sapiens; identical to SEQ ID NO: 163616

SEQ ID NO: 534567 - RNA, 64 nt, Homo Sapiens; identical to SEQ ID NO: 163617

SEQ ID NO: 534568 - RNA, 64 nt, Homo Sapiens; identical to SEQ ID NO: 163618

SEQ ID NO: 534569 - RNA, 64 nt, Homo Sapiens; identical to SEQ ID NO: 163619

SEQ ID NO: 534570 - RNA, 64 nt, Homo Sapiens; identical to SEQ ID NO: 163620

SEQ ID NO: 534571 - RNA, 64 nt, Homo Sapiens; identical to SEQ ID NO: 163621

SEQ ID NO: 534572 - RNA, 64 nt, Homo Sapiens; identical to SEQ ID NO: 474151

SEQ ID NO: 534573 - RNA, 64 nt, Homo Sapiens; identical to SEQ ID NO: 474152

SEQ ID NO: 534574 - RNA, 64 nt, Homo Sapiens; identical to SEQ ID NO: 474153

SEQ ID NO: 534575 - RNA, 64 nt, Homo Sapiens; identical to SEQ ID NO: 474154

SEQ ID NO: 534576 - RNA, 64 nt, Homo Sapiens; identical to SEQ ID NO: 474155

SEQ ID NO: 534577 - RNA, 64 nt, Homo Sapiens; identical to SEQ ID NO: 474156

SEQ ID NO: 534578 - RNA, 64 nt, Homo Sapiens; identical to SEQ ID NO: 474157

SEQ ID NO: 534579 - RNA, 64 nt, Homo Sapiens; identical to SEQ ID NO: 474158

SEQ ID NO: 534580 - RNA, 64 nt, Homo Sapiens; identical to SEQ ID NO: 474159

SEQ ID NO: 534581 - RNA, 64 nt, Homo Sapiens; identical to SEQ ID NO: 474160

SEQ ID NO: 534582 - RNA, 64 nt, Homo Sapiens
ugacuccacggggaucuggagucugcccaggaaagaacuucagcggagaauuucaggucuccac

SEQ ID NO: 534583 - RNA, 64 nt, Homo Sapiens
aucucacuuacagcaggcgagucagcuggcagcugaacuucagaaauucuccaucaacaucaca

SEQ ID NO: 534584 - RNA, 64 nt, Homo Sapiens
cacuguagucuaagaccugagauggcuguaaugagaacuucaauaugauuauguguccuuucuu

SEQ ID NO: 534585 - RNA, 64 nt, Homo Sapiens
auguucguauucuauucaaaacgcuuaaaaccuagaacuucaaaggcagcaguuccaugaagac

SEQ ID NO: 534586 - RNA, 64 nt, Homo Sapiens
ucauaauguuccagggauucagaagcaacgcuaugaacuucagcugacuuguuacuuaaaaauu

SEQ ID NO: 534587 - RNA, 64 nt, Homo Sapiens
augguaauaggaaaacaaaacccaaagcuuuucagaacuucagugugagguuuccuauuuugac

SEQ ID NO: 534588 - RNA, 64 nt, Homo Sapiens
gauacccacuuuucaggaugggacaguaucagaugaacuucaacccauggagaacaagccucaa

SEQ ID NO: 534589 - RNA, 64 nt, Homo Sapiens
agacaggaaacgaauauggacguaauugcagaaggaacuucaaggagaugaaugaaugcuaaaa

SEQ ID NO: 534590 - RNA, 64 nt, Homo Sapiens
ugaaucauagcuggaaacagaaauggucuacagagaacuucaguuacuuguucuagguccaucu

SEQ ID NO: 534591 - RNA, 64 nt, Homo Sapiens
ucuuaauuuccaaguuauacucaacuucuuuucugaacuucaaaccaaaccuaagauuuuagcc

SEQ ID NO: 534592 - RNA, 64 nt, Homo Sapiens
ugaccuuuacuuuucucuaguuucaguccagaaagaacuucauauuuagagcuaaggccacuga

SEQ ID NO: 534593 - RNA, 64 nt, Homo Sapiens
ucagagcagaucucccuuacugucaggggauauggaacuucaaaggcccacauggcaagccagg

SEQ ID NO: 534594 - RNA, 64 nt, Homo Sapiens
cuaccaugcccuugauauaucuuuugcaccugcugaacuucauuucuguaucaccugaccucug

SEQ ID NO: 534595 - RNA, 64 nt, Homo Sapiens
ugccaaacacuguugugccauguggaacugagaagaacuucacaaauggaaugguuaaugguca

SEQ ID NO: 534596 - RNA, 64 nt, Homo Sapiens
caagugguacuguuauaaugacagcagcugugaggaacuucacccugaugaaauugacaccgac

SEQ ID NO: 534597 - RNA, 64 nt, Homo Sapiens
uauauauagugagaacuaaagagguagcagcaaucccuaauauagcccucaccauuugccuaag

SEQ ID NO: 534598 - RNA, 64 nt, Homo Sapiens
ugaugcagauaauagccuacaguugugcuagcaacccuaauagguugccaagcaauuagccuua

SEQ ID NO: 534599 - RNA, 64 nt, Homo Sapiens
acaccuauuucacuaacuugcaaauggaaagauccccuaauaauuucauuugaaaucuaggagu

SEQ ID NO: 534600 - RNA, 64 nt, Homo Sapiens
caaugcaguuaacaaguauacauuuuaaauguugcccuaauaauucggcugcagccaucccccu

SEQ ID NO: 534601 - RNA, 64 nt, Homo Sapiens
ggugauuucccgugugacauauuuucuucauagucccuaauauagucauccucuacagaguugg

SEQ ID NO: 534602 - RNA, 64 nt, Homo Sapiens
uagacagcucuccccuacuagguugggucauuuccccuaauaacuauagagagacuguguuuca

SEQ ID NO: 534603 - RNA, 64 nt, Homo Sapiens; identical to SEQ ID NO: 21758

SEQ ID NO: 534604 - RNA, 64 nt, Homo Sapiens; identical to SEQ ID NO: 21759

SEQ ID NO: 534605 - RNA, 64 nt, Homo Sapiens; identical to SEQ ID NO: 21760

SEQ ID NO: 534606 - RNA, 64 nt, Homo Sapiens; identical to SEQ ID NO: 21761

SEQ ID NO: 534607 - RNA, 64 nt, Homo Sapiens; identical to SEQ ID NO: 21762

SEQ ID NO: 534608 - RNA, 64 nt, Homo Sapiens; identical to SEQ ID NO: 21763

SEQ ID NO: 534609 - RNA, 64 nt, Homo Sapiens; identical to SEQ ID NO: 21764

SEQ ID NO: 534610 - RNA, 64 nt, Homo Sapiens; identical to SEQ ID NO: 21765

SEQ ID NO: 534611 - RNA, 64 nt, Homo Sapiens; identical to SEQ ID NO: 21766

SEQ ID NO: 534612 - RNA, 64 nt, Homo Sapiens; identical to SEQ ID NO: 21767

SEQ ID NO: 534613 - RNA, 64 nt, Homo Sapiens; identical to SEQ ID NO: 21768

SEQ ID NO: 534614 - RNA, 64 nt, Homo Sapiens; identical to SEQ ID NO: 21769

SEQ ID NO: 534615 - RNA, 64 nt, Homo Sapiens; identical to SEQ ID NO: 21770

SEQ ID NO: 534616 - RNA, 64 nt, Homo Sapiens; identical to SEQ ID NO: 21771

SEQ ID NO: 534617 - RNA, 64 nt, Homo Sapiens; identical to SEQ ID NO: 21772

SEQ ID NO: 534618 - RNA, 64 nt, Homo Sapiens; identical to SEQ ID NO: 21773

SEQ ID NO: 534619 - RNA, 64 nt, Homo Sapiens; identical to SEQ ID NO: 21774

SEQ ID NO: 534620 - RNA, 64 nt, Homo Sapiens; identical to SEQ ID NO: 21775

SEQ ID NO: 534621 - RNA, 64 nt, Homo Sapiens; identical to SEQ ID NO: 21776

SEQ ID NO: 534622 - RNA, 64 nt, Homo Sapiens; identical to SEQ ID NO: 21777

SEQ ID NO: 534623 - RNA, 64 nt, Homo Sapiens; identical to SEQ ID NO: 21778

SEQ ID NO: 534624 - RNA, 64 nt, Homo Sapiens; identical to SEQ ID NO: 21779

SEQ ID NO: 534625 - RNA, 64 nt, Homo Sapiens; identical to SEQ ID NO: 21780

SEQ ID NO: 534626 - RNA, 64 nt, Homo Sapiens; identical to SEQ ID NO: 21781

SEQ ID NO: 534627 - RNA, 64 nt, Homo Sapiens
cuaccaucagggacaggaugaccuggauaacuuagguggcaagcugugacuucuccaggucuca

SEQ ID NO: 534628 - RNA, 64 nt, Homo Sapiens
cuucuccaggucucacgggcaugggcacucccuugguggcaagagcccccuugacaccggggug

SEQ ID NO: 534629 - RNA, 64 nt, Homo Sapiens
ucuuguaauuuuuauuuaggaaguguugaagggagguggcaagaguguggaggcugacguguga

SEQ ID NO: 534630 - RNA, 64 nt, Homo Sapiens
ccuggauguuguguguaucgagaggccaaaggcugguggcaagugcacggggcacagcggaguc

SEQ ID NO: 534631 - RNA, 64 nt, Homo Sapiens
aagcaaaauaucacaucucuagaaguguugggaaaaauauaauuucuuucuuuacuuauauuca

SEQ ID NO: 534632 - RNA, 64 nt, Homo Sapiens
uaaaguaguggauuuuucugaguaaauuugcugaaaauauaagagagaagcuaucuaauaccuu

SEQ ID NO: 534633 - RNA, 64 nt, Homo Sapiens
caaaucuuaauuuggauuuaaggaagaaaucaauaaauauaaaauauaagcacauauuuauuau

SEQ ID NO: 534634 - RNA, 64 nt, Homo Sapiens
uaauuuggauuuaaggaagaaaucaauaaauauaaaauauaagcacauauuuauuauauaucua

SEQ ID NO: 534635 - RNA, 64 nt, Homo Sapiens
uuacaaaaugaacucauuuuauuuucccaccuucaaauauaaguauuaucaucuaucuguuuau

SEQ ID NO: 534636 - RNA, 64 nt, Homo Sapiens
uauggacuuucucagauuaggaaauaccaauuaaaaauauaauaaauagcuacauugauuucug

SEQ ID NO: 534637 - RNA, 64 nt, Homo Sapiens
aaagauuguccauuacucccagagaucagcaaauaaauauaaccauuuccucuguaauuucaac

SEQ ID NO: 534638 - RNA, 64 nt, Homo Sapiens
cuauauaauaauuauaauccaaugaacacuuuucaaauauaaaauuaaauguuuauguuuuaag

SEQ ID NO: 534639 - RNA, 64 nt, Homo Sapiens
ucaauaauaguccuuguagcugcacaugaaaauaaaauauaaagcuuuuuaaaauaauuauacu

SEQ ID NO: 534640 - RNA, 64 nt, Homo Sapiens
ugaccauugaugauauccagugaguuauaaauuuaaauauaaauaaugcaaaucaugcagaauu

SEQ ID NO: 534641 - RNA, 64 nt, Homo Sapiens
cagcauaacguguaaagcucgggaaauguuugggaaauauaagcaauaugccugcaucguguug

SEQ ID NO: 534642 - RNA, 64 nt, Homo Sapiens
caucuuccuuugucugcuuaugacagugauuuuuaaauauaaugauucuaaauccuaguaaaau

SEQ ID NO: 534643 - RNA, 64 nt, Homo Sapiens
uuuuuucaaauuuggaguuuauauuauaaacucaaaauauaaauauuuucuucguuuuaauaga

SEQ ID NO: 534644 - RNA, 64 nt, Homo Sapiens
accagugcugugaaaugcaguuuauaaggaaaacaaauauaauaaauuuauaaaguaaaaagau

SEQ ID NO: 534645 - RNA, 64 nt, Homo Sapiens
uauuauacucuugauuuuucuaaauuugugugugaaauauaacauugauugaauugcaguuaca

SEQ ID NO: 534646 - RNA, 64 nt, Homo Sapiens
gauugacuuugggaauuugaauuuucaucagugcaaauauaaauuucucuauccugcucugagg

SEQ ID NO: 534647 - RNA, 64 nt, Homo Sapiens
cacaauaagcuggaaguuuguuguaguaugccucaaauauaacugacuguauacuauaguggua

SEQ ID NO: 534648 - RNA, 64 nt, Homo Sapiens
uuacuuugguuccuguugugcucuuguaaaagaaaaauauaauuuccugaagaauaaaauagau

SEQ ID NO: 534649 - RNA, 64 nt, Homo Sapiens
cugugaacauaaguguuuauuaaaaauggcaauuaaauauaaauuacuuuugugggggaaugcc

SEQ ID NO: 534650 - RNA, 64 nt, Homo Sapiens
ccuagcaauaaaaucuaauuuuuaaaaaguauauaaauauaaaauguauaaaugauggauagau

SEQ ID NO: 534651 - RNA, 64 nt, Homo Sapiens
guauccaaacucugucuuaacauucaagauugaaaaauauaaagcaugcuguauuauuacuucu

SEQ ID NO: 534652 - RNA, 64 nt, Homo Sapiens
auaauauauuugugcuucgaugagagcugagccgaaauauaagagagguagcugcucuccccac

SEQ ID NO: 534653 - RNA, 64 nt, Homo Sapiens
gaaaguuggccgacugcacuguagaacauagcaaaaauauaaccgcaauaguuauauuuaggug

SEQ ID NO: 534654 - RNA, 64 nt, Homo Sapiens
auuacuuuuguauguuccaauguauaaauguauaaaauauaaggcagugauaucuuuuauaugc

SEQ ID NO: 534655 - RNA, 64 nt, Homo Sapiens
uggacuuuguucuuuuuagcacuaaagcuauuacaaauauaacaauuuuuuuaauuccugcugc

SEQ ID NO: 534656 - RNA, 64 nt, Homo Sapiens
aacuuuauuugucagcauuuuauaaauaauguaaaaauauaaucaugucuaaaacuuguuuaaa

SEQ ID NO: 534657 - RNA, 64 nt, Homo Sapiens
aauguaaaaauauaaucaacucuaaaacuuguuuaaauauaaaucauauuuugcuaaaaauaug

SEQ ID NO: 534658 - RNA, 64 nt, Homo Sapiens
uagcauguaaacucauuucguuaaagggaaaaguaaauauaacuauaagauagcacauugacuu

SEQ ID NO: 534659 - RNA, 64 nt, Homo Sapiens
uuaacacaguggaaggacaaaggaaauaaaauauaaauauaagaaccugcucucucuauagaga

SEQ ID NO: 534660 - RNA, 64 nt, Homo Sapiens
auaagauuaacacaguggaauagagaaggaaauaaaauauaaauguuuuuaccugcucucucua

SEQ ID NO: 534661 - RNA, 64 nt, Homo Sapiens
auuagccaggcauggugguggccaucuccacuaaaaauauaaaaccugaccaacauggugaaau

SEQ ID NO: 534662 - RNA, 64 nt, Homo Sapiens
cuuuaaagucccaguagaaauaagaaauaugauaaaauauaauacccagguacuauugaaguaa

SEQ ID NO: 534663 - RNA, 64 nt, Homo Sapiens
cauagagagguaagcauuaguggcacagcugagaaaauauaaaagguaguucugucucuauccu

SEQ ID NO: 534664 - RNA, 64 nt, Homo Sapiens
cuauuucuuguuguaaaacagauguuuguuucuaaaauauaaugaauuaaugauuaucaaagua

SEQ ID NO: 534665 - RNA, 64 nt, Homo Sapiens
gagccuuggauguuccuguggaccugacaguuaaaaauauaaagaaccuaggauucaauuccaa

SEQ ID NO: 534666 - RNA, 64 nt, Homo Sapiens
aaugacaggagucaaucagccuuuacagcuaucaaaauauaaugagaucccaaugaugauucuu

SEQ ID NO: 534667 - RNA, 64 nt, Homo Sapiens
auguggaacaccaaacaggaaagaacuaugucugaaauauaaaaaauaaaaauaaaaaaacaac

SEQ ID NO: 534668 - RNA, 64 nt, Homo Sapiens
auguucuuuucaaucccaucuagauaauuuauagaaauauaacccuaauuggacaugugguaca

SEQ ID NO: 534669 - RNA, 64 nt, Homo Sapiens
ucucuaagguuuacaauaggaguggugauuugaaaaauauaaaauuaugagauugguuuuccug

SEQ ID NO: 534670 - RNA, 64 nt, Homo Sapiens
aaacauguuaaugacaauauuccagaucuuucagaaauauaacacauuuuuuugcaugcaugca

SEQ ID NO: 534671 - RNA, 64 nt, Homo Sapiens
auaucucauugcagccagugauauauauaaauauaaauauaaauuaacauauauauauauauac

SEQ ID NO: 534672 - RNA, 64 nt, Homo Sapiens
auaaauauaucucauugcagauauacauauauauaaauauaaauuguacauaacauauauauau

SEQ ID NO: 534673 - RNA, 64 nt, Homo Sapiens
gaaguguuaacuauuguauuuucugguaaauaauaaauauaacauuugcuuuauuauuguuuuc

SEQ ID NO: 534674 - RNA, 64 nt, Homo Sapiens
uuuagaggcaauauuuucuagguggaaggagauaaaauauaauaaaguaggggcugaagaggaa

SEQ ID NO: 534675 - RNA, 64 nt, Homo Sapiens
uugaaaguauguagucagcuuauccuuugucaggaaauauaaacuacaggauggaaaaagguca

SEQ ID NO: 534676 - RNA, 64 nt, Homo Sapiens
gaauuggagguuuuugcuaauauguggaggaauuaaauauaaaggucaggcccuucaaagauga

SEQ ID NO: 534677 - RNA, 64 nt, Homo Sapiens
auaaaauguugaaaagucaaaaauauagcuguacaaauauaagaaacugcauuaccgcguugua

SEQ ID NO: 534678 - RNA, 64 nt, Homo Sapiens
cugcguuaaaggcucgauuuaaaagauauauuaaaaauauaaaaauaaauauauauaaaccuaa

SEQ ID NO: 534679 - RNA, 64 nt, Homo Sapiens
uggcaaagcauuuaauugguccucaaugcuuaauaaauauaauucaugcuggagagaaacuuca

SEQ ID NO: 534680 - RNA, 64 nt, Homo Sapiens
gugacaaagcuugcaaccacacucaaucuauucuaaauauaagagaaaugauauuggugagaag

SEQ ID NO: 534681 - RNA, 64 nt, Homo Sapiens
acaugauauccuuuauauucgagaaaaguuauagaaauauaaaaaauauagaaaagucauaucu

SEQ ID NO: 534682 - RNA, 64 nt, Homo Sapiens
uccauuuucaaggugcagaacaaggagugaaagaaaauauaagaagaaaaaaauccccuacauu

SEQ ID NO: 534683 - RNA, 64 nt, Homo Sapiens
acauuguuacugaggaugucaacauauaacaauaaaauauaaaucacccauuugcuugacauua

SEQ ID NO: 534684 - RNA, 64 nt, Homo Sapiens
uugguucccaugaaaguuaguaagaugcccuuuuaaauauaaggaucagugcuuuguucugcag

SEQ ID NO: 534685 - RNA, 64 nt, Homo Sapiens
ugguuuucuuauccuuugauaaaagcaucccauaaaauauaaaguaguaaguuaacauaguauu

SEQ ID NO: 534686 - RNA, 64 nt, Homo Sapiens
uauuugaaucuacaaaaaacaacaaauaauuuuuaaauauaaggauuuuccuagauauugcacg

SEQ ID NO: 534687 - RNA, 64 nt, Homo Sapiens
cuccaaauuuuuuuuacuguuucugauuguauggaaauauaaaaguaaauaugaaacauuuaaa

SEQ ID NO: 534688 - RNA, 64 nt, Homo Sapiens
guauggaaauauaaaaguaaauaugaaacauuuaaaauauaauuuguugucaaaguaaucaagu

SEQ ID NO: 534689 - RNA, 64 nt, Homo Sapiens
cuuacuucuucucauacuauuuaagagaacaagcaaauauaaacagcaacuuguguuccuaaca

SEQ ID NO: 534690 - RNA, 64 nt, Homo Sapiens
ucaaaguuaagaaucuuuauaguucuacuccauuaaauauaaagcaagauaauaaaaauuguug

SEQ ID NO: 534691 - RNA, 64 nt, Homo Sapiens
guggcugggauaugauggguuagaagcaaggagaaaauauaaggacuuuuugauggaauuaaau

SEQ ID NO: 534692 - RNA, 64 nt, Homo Sapiens
uaauuaaaugaacuuauguacagaaaacauguauaaauauaagucuauacuaaugcuuacaacu

SEQ ID NO: 534693 - RNA, 64 nt, Homo Sapiens
acacaaacuaauauaaaguuauaguuauaucuuaaaauauaauugaagaagcauaugacauaua

SEQ ID NO: 534694 - RNA, 64 nt, Homo Sapiens
guuaaguagaaaaauuuuaaaaauuugcuuaugaaaauauaacccccagaaaguaacaaugaca

SEQ ID NO: 534695 - RNA, 64 nt, Homo Sapiens
uacucuugugacauuuuuuugguuaucaacaacuaaauauaaauuacuuuggaaaaaguaaggc

SEQ ID NO: 534696 - RNA, 64 nt, Homo Sapiens
aaaauaaaaguugaacuugaguuacauuuaauuuaaauauaaaugcauuuugagaaauguuaag

SEQ ID NO: 534697 - RNA, 64 nt, Homo Sapiens
uuucuuagagaacaccucuugaggaaagauuauaaaauauaaaacaugucuuucucauauuuca

SEQ ID NO: 534698 - RNA, 64 nt, Homo Sapiens
cacaaauauacuugaauauucuaaaguaauguaaaaauauaaaguugaaagcuaaaaauagguu

SEQ ID NO: 534699 - RNA, 64 nt, Homo Sapiens
uuugaaacuaugagaacauaaucaaaagaaaauaaaauauaaauaccuuaauuuguuuuccaga

SEQ ID NO: 534700 - RNA, 64 nt, Homo Sapiens
gucuuuauuaauauuuuauuuuuauuauauauaaaaauauaaauauuguugguaaacuaaucau

SEQ ID NO: 534701 - RNA, 64 nt, Homo Sapiens
cagagaugguaaucuacagcucaccucugaaggcaaauauaagcugggaaaaaaguuuugauga

SEQ ID NO: 534702 - RNA, 64 nt, Homo Sapiens
ccgcaggcuauuuguucagagaggccuuuuguuuaaauauaaauguuuaaauauaaauguuugu

SEQ ID NO: 534703 - RNA, 64 nt, Homo Sapiens
uucagagaggccuuuuguuuaaauauaaauguuuaaauauaaauguuugucuggauuggcuaua

SEQ ID NO: 534704 - RNA, 64 nt, Homo Sapiens
ugaugaggcauuucuuacuagaaucccauaagugaaauauaauauuuuucaaaguugauaucau

SEQ ID NO: 534705 - RNA, 64 nt, Homo Sapiens
uucuaguuucccggcauugauaguucccuauuugaaauauaauguuucucuuguaagugauaug

SEQ ID NO: 534706 - RNA, 64 nt, Homo Sapiens
uaagagcaaaacuccaucaaaauaaaauaaaauaaaauauaaaauaacuuaaaaagaacuuuga

SEQ ID NO: 534707 - RNA, 64 nt, Homo Sapiens
ggagacuuaaaauauuuuauauuugaugcaauuuaaauauaacauuauaauuaacauaauuuaa

SEQ ID NO: 534708 - RNA, 64 nt, Homo Sapiens
auacuuuaacuaagccagugccuuggaaacuaucaaauauaaauuuuccccaaugguaaccuua

SEQ ID NO: 534709 - RNA, 64 nt, Homo Sapiens
uuaauuuucaggaauccaguucuauuccuugugaaaauauaaaugcauugcuagucuagaauag

SEQ ID NO: 534710 - RNA, 64 nt, Homo Sapiens
aauaguguaugcaaguuaaugucgaaagcacacaaaauauaaauagacaacauuauaacuaaaa

SEQ ID NO: 534711 - RNA, 64 nt, Homo Sapiens
uucagagugcuucaguaaaauauugcaaagcuuuaaauauaaauaaguacagugaauuuugcuu

SEQ ID NO: 534712 - RNA, 64 nt, Homo Sapiens
acauguacagaagaaauagaauacauguucaugcaaauauaaauuauguauucuaauauaggug

SEQ ID NO: 534713 - RNA, 64 nt, Homo Sapiens
aguaauuauuuaccaaacuuaaaaacauuucuauaaauauaaagcuuuucuuuauauuuaagac

SEQ ID NO: 534714 - RNA, 64 nt, Homo Sapiens
uauaaauauaaagcuuuucuuuauauuuaagacaaaauauaaaggcuagaauuugguuccuucu

SEQ ID NO: 534715 - RNA, 64 nt, Homo Sapiens
aagagagccuaaauaaaauuaucaucaagguauuaaauauaagacguuaaauauaauaaagugg

SEQ ID NO: 534716 - RNA, 64 nt, Homo Sapiens
aaaauuaucaucaagguauuaaauauaagacguuaaauauaauaaaguggggauauauagaaaa

SEQ ID NO: 534717 - RNA, 64 nt, Homo Sapiens
gggauggauuaugaugaaaucauuuucaaucuuaaaauauaauacaacaaucuugcaaaauuau

SEQ ID NO: 534718 - RNA, 64 nt, Homo Sapiens
cccagccccauucauaaugaauaagucacccuuuaaauauaagacacaaauucuacaguauuga

SEQ ID NO: 534719 - RNA, 64 nt, Homo Sapiens
ugucuagagggaaaaucuggcugauuugggaauaaaauauaaucgaauauucaacaccaugaag

SEQ ID NO: 534720 - RNA, 64 nt, Homo Sapiens
uccuguucacugaauauuccggguaauugaaagaaaauauaauggaugggcuccauuaaaacca

SEQ ID NO: 534721 - RNA, 64 nt, Homo Sapiens
gaacacuauuuuaagcaucaaaugcaaucaucuaaaauauaaaggucaaucauuuauaauagaa

SEQ ID NO: 534722 - RNA, 64 nt, Homo Sapiens
gcugccauguguguacuguauuauuuucagaaaaaaauauaauagucugaguccaaguuaucuu

SEQ ID NO: 534723 - RNA, 64 nt, Homo Sapiens
uacuuagagcuggauucaugcaucaggucuuauaaaauauaaugauaauuuaaucuguuuaaau

SEQ ID NO: 534724 - RNA, 64 nt, Homo Sapiens
cacacagaaaaacuggcauuaugcaaugcauauuaaauauaauaaauuaaaaaaauauuucaaa

SEQ ID NO: 534725 - RNA, 64 nt, Homo Sapiens
aaguucauuguuuuaggguuucaaaaauagucacaaauauaacaaguuuagguccccauaaucc

SEQ ID NO: 534726 - RNA, 64 nt, Homo Sapiens
uguaaggggauuucgucaguugcuggcagaacugaaauauaaacuccuuguauauaaugacuuu

SEQ ID NO: 534727 - RNA, 64 nt, Homo Sapiens
gaugcuuuguauaauucauuaaagccaaauauaaaaauauaaauuccauauugccuuauguccc

SEQ ID NO: 534728 - RNA, 64 nt, Homo Sapiens
auauaaaugaugcuuuguauuaugucccaaagccaaauauaaaaauaaguucuccauauugccu

SEQ ID NO: 534729 - RNA, 64 nt, Homo Sapiens
uauaaaugcaauuuuugucaagagaucuuucagaaaauauaagccuuuaaagugaagaagagga

SEQ ID NO: 534730 - RNA, 64 nt, Homo Sapiens
gccucauacuaaaauauauuuuugcaagugaaguaaauauaaaaauaauuuaauccaaaauuaa

SEQ ID NO: 534731 - RNA, 64 nt, Homo Sapiens
auaauaccuuuaacugcaaagaaaaggcaguuucaaauauaagaaauuuauuucagguaagggu

SEQ ID NO: 534732 - RNA, 64 nt, Homo Sapiens
gauauuagacaguuuuuuuaguccaugggauuguaaauauaaacauuaacuuuccuauaagaau

SEQ ID NO: 534733 - RNA, 64 nt, Homo Sapiens
uauauugcaaagucuguauuccagcucuuaagaaaaauauaagcauguuaaauaccauauuuac

SEQ ID NO: 534734 - RNA, 64 nt, Homo Sapiens
acaugaaaucaucuuccuugucucaugaaaaccuaaauauaaaaaaaaggaaaauacuggaguu

SEQ ID NO: 534735 - RNA, 64 nt, Homo Sapiens
cauuuuauugaaaaaaaaaccuuuuuuuuugccuaaauauaaguuugguagcuugguuucuuuu

SEQ ID NO: 534736 - RNA, 64 nt, Homo Sapiens
uagcuugguuucuuuuuuuuauuaaauagugugaaaauauaaugggcauuuugaaaacuuuuag

SEQ ID NO: 534737 - RNA, 64 nt, Homo Sapiens
uagcuguauuuguagcaauuaucagguuugcuagaaauauaacuuuuaauacaguagccuguaa

SEQ ID NO: 534738 - RNA, 64 nt, Homo Sapiens
uucaaaugguuuuuauccaaggaauugcaaaaauaaauauaaauauugccauuaauuuguguuu

SEQ ID NO: 534739 - RNA, 64 nt, Homo Sapiens
gaaaccagccugggcaaaacccugucucuacuaaaaauauaaaaauuagccaggcaugauggca

SEQ ID NO: 534740 - RNA, 64 nt, Homo Sapiens
ccuggccaacauggcaaaaccccgucucuaugaaaaauauaaaaauuagcugggcaugguggca

SEQ ID NO: 534741 - RNA, 64 nt, Homo Sapiens
guacagagaggaaaguugagaugugagaggaguuaaauauaaauuauuuucuuugccuaaauac

SEQ ID NO: 534742 - RNA, 64 nt, Homo Sapiens
cuucuaagaaggaacaguaguaaaaugugaucgaaaauauaauguugcaauguuagugauguuu

SEQ ID NO: 534743 - RNA, 64 nt, Homo Sapiens
gagcucacgacgugugaccauuucgucauauuuaaaauauaacuucaagaaaagaguaaacauc

SEQ ID NO: 534744 - RNA, 64 nt, Homo Sapiens
caagcacuuaauggaaagguaaauggucagauaaaaauauaauuaccuguaagguuaucugguu

SEQ ID NO: 534745 - RNA, 64 nt, Homo Sapiens
uuggcucuauugauuuguccauuauguguuaggcaaauauaacuuaaguggagggggaaguuua

SEQ ID NO: 534746 - RNA, 64 nt, Homo Sapiens
cugaacccugcuuuagagcuguguguugagcuaaaaauauaauuuuuuaaaaauugacuagcaa

SEQ ID NO: 534747 - RNA, 64 nt, Homo Sapiens
augaauugauuaguucucuccaagccauugcuuaaaauauaacauguuuuggauccaauacaca

SEQ ID NO: 534748 - RNA, 64 nt, Homo Sapiens
aaaguguguugaugccagaauguucagcuucaguaaauauaauaagcucuugugccuuguaugc

SEQ ID NO: 534749 - RNA, 64 nt, Homo Sapiens
gccucuaucacacaucuguuuuucucgaagaaaaaaauauaauuaauaaaaauguuuuacucuu

SEQ ID NO: 534750 - RNA, 64 nt, Homo Sapiens
ugguuuggguuuuuguuuuguuauuuuccauuagaaauauaaagaugucaagaagcuuuuaaag

SEQ ID NO: 534751 - RNA, 64 nt, Homo Sapiens
uacugguuuaaauaaguuuaccuuuuccuccaggaaauauaaugauuucugggaacaugggcau

SEQ ID NO: 534752 - RNA, 64 nt, Homo Sapiens
ucccaccuuuccaugcuuaagacaaaaaugucuuaaauauaaagcugugauuauaucaaaaauc

SEQ ID NO: 534753 - RNA, 64 nt, Homo Sapiens
uacaaguuuauuuauaauuuaacaacucagcugaaaauauaacggguauauuuguuauucuaac

SEQ ID NO: 534754 - RNA, 64 nt, Homo Sapiens
aaaaauaaaauuuuaacccaaaugaauaacuaagaaauauaaaacaagcacaaaaucuuaggga

SEQ ID NO: 534755 - RNA, 64 nt, Homo Sapiens
aaaggaagauugaacuaauaaaauuuuauuucuuaaauauaaauuugaccuaaaauauuuucuc

SEQ ID NO: 534756 - RNA, 64 nt, Homo Sapiens
ucuuauaugcuguugcagauauauguauaugcuaaaauauaacuugcaaagauguucuaaauac

SEQ ID NO: 534757 - RNA, 64 nt, Homo Sapiens
aaguaugaauuuaauucauauauaagaucuauuuaaauauaagaguagcaauacugcaccuggu

SEQ ID NO: 534758 - RNA, 64 nt, Homo Sapiens
cuaaagugcuguuccgaagaauaggcugaaacaaaaauauaagaauuauuagcuacuuuguugg

SEQ ID NO: 534759 - RNA, 64 nt, Homo Sapiens
aauuagcuuuaaacacuaaaaucagauuucuucaaaauauaaauuuguuuugauucuuuauauu

SEQ ID NO: 534760 - RNA, 64 nt, Homo Sapiens
ugcauuacuuugaguuaaauuugaauagaguauuaaauauaaaguuguagauucuuauguguuu

SEQ ID NO: 534761 - RNA, 64 nt, Homo Sapiens
agaaagaacccuguuagaucuugguuugugauaaaaauauaaagacagaagacaugaggaaaaa

SEQ ID NO: 534762 - RNA, 64 nt, Homo Sapiens
ucucuacuaugcaaaaauuaauuuauuccucaauaaauauaauuauaauacaacuuguuauaaa

SEQ ID NO: 534763 - RNA, 64 nt, Homo Sapiens
cacaucccacucaagacacagguaaaugugaguuaaauauaacuagacagauaauuuauagaca

SEQ ID NO: 534764 - RNA, 64 nt, Homo Sapiens
acaaauuaauguuuuauagaacaaaaaaauaguaaaauauaaaaugauuuaaaaacaaaaaaac

SEQ ID NO: 534765 - RNA, 64 nt, Homo Sapiens
uaaauaaaaaaaggaaaggaaaaaaaacauugcaaaauauaaaaaaaaacuuaaauauuaugga

SEQ ID NO: 534766 - RNA, 64 nt, Homo Sapiens
caguuuucauguagacuuaggacucaugugcaguaaauauaaauaaguguagcaucagaagcag

SEQ ID NO: 534767 - RNA, 64 nt, Homo Sapiens
cccauuggcaacugcagcugagaucuuagagaggaaauauaaccggugugagaucuagcaaugc

SEQ ID NO: 534768 - RNA, 64 nt, Homo Sapiens
aaugaaggcauauuuccaauucaauauugauuuuaaauauaagugauuguuuuagaaguuaaag

SEQ ID NO: 534769 - RNA, 64 nt, Homo Sapiens
acaacaaauacuuccauaugucacuagucaagaaaaauauaaaacaaauuuuucaucucuucaa

SEQ ID NO: 534770 - RNA, 64 nt, Homo Sapiens
uaugaagacauaaacccaguuuuuuaauuuacaaaaauauaaaagcuauuuaaaacuuguaauu

SEQ ID NO: 534771 - RNA, 63 nt, Homo Sapiens
agccauuggcuauuuaaaacucauguuuucugaaaauauaaccccauuaaugaauuagucuaa

SEQ ID NO: 534772 - RNA, 64 nt, Homo Sapiens
caaacuucagcuguacuucgucuucuaauuucaaaaauauaacuuaaaaauguaaauauucuau

SEQ ID NO: 534773 - RNA, 64 nt, Homo Sapiens
auaacuuaaaaauguaaauauucuauaugaauuuaaauauaauucuguaaauguguguaggucu

SEQ ID NO: 534774 - RNA, 64 nt, Homo Sapiens
cuugugauaagcugcugcuccuauauuuuuuaagaaauauaauaaagcacuuagggcaggggaa

SEQ ID NO: 534775 - RNA, 64 nt, Homo Sapiens
ccuuauuaagaacacuacuacaguucugaaggggaaauauaacaucuaugguuauauauuuuaa

SEQ ID NO: 534776 - RNA, 64 nt, Homo Sapiens
uguuucugauuugaagaaacugacauuccuuuaaaaauauaaauauaaauacauacauacauag

SEQ ID NO: 534777 - RNA, 64 nt, Homo Sapiens
ugauuugaagaaacugacauuccuuuaaaaauauaaauauaaauacauacauacauagauauau

SEQ ID NO: 534778 - RNA, 64 nt, Homo Sapiens
uucuuguuuuaagauacaaguaaaauuaaucuuuaaauauaaauguaaauuaguacacaaaacu

SEQ ID NO: 534779 - RNA, 64 nt, Homo Sapiens
accccuuauccuuaacauauauaguauauuuaaaaaauauaaaauuguauuguacuaaugugau

SEQ ID NO: 534780 - RNA, 64 nt, Homo Sapiens
uuucauguagcguaucacauaacuuuuuugcaaaaaauauaaaaagaaauaaacuucaauguau

SEQ ID NO: 534781 - RNA, 64 nt, Homo Sapiens
guacugugcuagugacuggaggcccugcuacugcaaauauaaaacauaaaguuuguuuaaaaaa

SEQ ID NO: 534782 - RNA, 64 nt, Homo Sapiens
aaguuaacaaagggguacacaguauggucuuuggaaauauaauaaaacaucaacuaacuuggac

SEQ ID NO: 534783 - RNA, 64 nt, Homo Sapiens
ggaaugccaucagggaauucaccuuuuauuaggaaaauauaaaauauguauguaugugcagaua

SEQ ID NO: 534784 - RNA, 64 nt, Homo Sapiens
cuccagagcacacaagaguaaaagaccuuucaugaaauauaagucauaaauguaauuacuauug

SEQ ID NO: 534785 - RNA, 63 nt, Homo Sapiens
auaggcaaagccguuaguaugaaaaaaauaaacaaauauaaaaaugaaagcauucauacuuga

SEQ ID NO: 534786 - RNA, 64 nt, Homo Sapiens
uaucacccccauuuccauuugauuuguaaauuacaaauauaaauuaaguguaugauagauguuu

SEQ ID NO: 534787 - RNA, 64 nt, Homo Sapiens
aauuuggcauauugacccuagaugauggauugaaaaauauaaguuuaagugacaaauguuagaa

SEQ ID NO: 534788 - RNA, 64 nt, Homo Sapiens
auauaaaaauuucuuuugguuuuuuaugaugagcaaauauaaguuaaugccaaacguuauguua

SEQ ID NO: 534789 - RNA, 64 nt, Homo Sapiens
gguaaaaaguaguauuuuguauauuuuuguaacaaaauauaaaugaagauauuuuaccaugaag

SEQ ID NO: 534790 - RNA, 64 nt, Homo Sapiens
augaagagauugcacuuauccuugagaacagucuaaauauaaaugaagauauuuuaccaugaag

SEQ ID NO: 534791 - RNA, 64 nt, Homo Sapiens
gauauuucucucuuuuuaaagugaauauguggguaaauauaaaaggaaugaaguucugaaaaug

SEQ ID NO: 534792 - RNA, 64 nt, Homo Sapiens
uagaggaaaacauaagauugaaaagagcuauuguaaauauaaagaauuaguagacaaggauauu

SEQ ID NO: 534793 - RNA, 64 nt, Homo Sapiens
gaacugguacaauguggucccucucaauauuuaaaaauauaauuuguaacagugcuuaccauuc

SEQ ID NO: 534794 - RNA, 64 nt, Homo Sapiens
gaaucugugggaaauaggcagauauagcuuuuuaaaauauaaaguacuugggauuuugcauuau

SEQ ID NO: 534795 - RNA, 64 nt, Homo Sapiens
gcaaaaauaucccuuccggagucuuugaagcugaaaauauaaaacaaauaaaaaauaaaaaaau

SEQ ID NO: 534796 - RNA, 64 nt, Homo Sapiens
auuucuugugauguuuugagaguaaugcauacagaaauauaauaaaauguguugaaacugcaug

SEQ ID NO: 534797 - RNA, 64 nt, Homo Sapiens
uaaaauaaaauguuaagauaguauuauuuuuauuaaauauaauggaguuacuggguaguuguaa

SEQ ID NO: 534798 - RNA, 64 nt, Homo Sapiens
guguuugcuacucagaugagacaaguaauuucaaaaauauaaagaaguaguaccaggaaguagg

SEQ ID NO: 534799 - RNA, 64 nt, Homo Sapiens
gugacaaguggacauuauuuugauuguuuaaaagaaauauaaaucuaauucauuaaauacuaau

SEQ ID NO: 534800 - RNA, 64 nt, Homo Sapiens
cuuuuaaaaagaaaauuauugccagcugaauuuaaaauauaauauguaacagacuggcacaugu

SEQ ID NO: 534801 - RNA, 64 nt, Homo Sapiens
gugaucucaagaccuccagccagaagucccuuccaaauauaagaguacucauguuuauuuauuu

SEQ ID NO: 534802 - RNA, 64 nt, Homo Sapiens
ccaguuaauuugaaaaggccccagaugaaucaauaaauauaauuuuauaguauuuugcagagga

SEQ ID NO: 534803 - RNA, 64 nt, Homo Sapiens
cugccagaaaaacuuacauguaucagauuuuuaaaaauauaaauagagaacauuuugcaaaugc

SEQ ID NO: 534804 - RNA, 64 nt, Homo Sapiens
auggaaaaccagauaaaacaauguuacaaaaggcaaauauaaagaguauguuuucuuuuuagug

SEQ ID NO: 534805 - RNA, 64 nt, Homo Sapiens
gauuuaaaauguuuugaauuacaucccuuugaaaaaauauaacacuaugaaggcuuucauuugu

SEQ ID NO: 534806 - RNA, 64 nt, Homo Sapiens
gcauauggaacauaauguauaucugauuccucccaaauauaaaguguaaaggcuacaaaucaca

SEQ ID NO: 534807 - RNA, 64 nt, Homo Sapiens
cuccugaaugccugaggcacucaaauauaaauuaaaauauaacauuuuucaucagucaucacuc

SEQ ID NO: 534808 - RNA, 64 nt, Homo Sapiens
uaaaauauaacacuccugaacagucaucacucucaaauauaaauuucaugcaaauauuuuucau

SEQ ID NO: 534809 - RNA, 64 nt, Homo Sapiens
ugucucaguauuuuagggucaaugagagccauaaaaauauaacauaaucacaaguaaaggagau

SEQ ID NO: 534810 - RNA, 64 nt, Homo Sapiens
gaaaucuuucaacuuauuucugaaaaagagaaaaaaauauaaaauuucuggugcacagguuugu

SEQ ID NO: 534811 - RNA, 64 nt, Homo Sapiens
cugaaauaaaccugcacugaacuugccuggaauaaaauauaaaaauacuauccauguaauaagc

SEQ ID NO: 534812 - RNA, 64 nt, Homo Sapiens
uguagcgaccccagacuguagucucuguuuccugaaauauaaacagugaggacucggccacugu

SEQ ID NO: 534813 - RNA, 64 nt, Homo Sapiens
agauccaggggacauaaaugcccuucuucuaacuaaauauaaaauuaagaccuaauccccaccu

SEQ ID NO: 534814 - RNA, 64 nt, Homo Sapiens
aauuacuauuuuguacuguguuuuuuuuuuuugaaaauauaaaugagaacuuccaaauguuaau

SEQ ID NO: 534815 - RNA, 64 nt, Homo Sapiens
auuuguccagugucuuacuuaccuucauauaugcaaauauaauuuuaaaaaauuuuuuaauuaa

SEQ ID NO: 534816 - RNA, 64 nt, Homo Sapiens
ugucaguuaaggacauagcuauuccaaauaaacuaaauauaauauugagcugcauuucucaaag

SEQ ID NO: 534817 - RNA, 64 nt, Homo Sapiens
ugguauuauggaaggcuuauugggggaacaagaaaaauauaaaaagugaucucugcccacggaa

SEQ ID NO: 534818 - RNA, 64 nt, Homo Sapiens
augggccucuguguggcugaacaguauauuuuguaaauauaaguacuaguccuaauugcagaaa

SEQ ID NO: 534819 - RNA, 64 nt, Homo Sapiens
uauaaaagcugcuuuuuugcagaacauuccuugaaaauauaagguuuugaaaagacauaauuuu

SEQ ID NO: 534820 - RNA, 64 nt, Homo Sapiens
aauuagccggacaugguggcccccacucuacuaaaaauauaagacuagaauguauaugagaaac

SEQ ID NO: 534821 - RNA, 64 nt, Homo Sapiens
acuuuagcaaaaacauucacuacuaacauuuuaaaaauauaaauguuugcucaacaugguuuac

SEQ ID NO: 534822 - RNA, 64 nt, Homo Sapiens
ucacauaagaaccauggccugucaaaauuuuguaaaauauaacccccccuaagguuacauguga

SEQ ID NO: 534823 - RNA, 64 nt, Homo Sapiens
uuucuccccccuaagguuacgaacacuguggcugaaauauaauuuuaucaaagggcugaguuga

SEQ ID NO: 534824 - RNA, 64 nt, Homo Sapiens
gcuagaauacaaagcuaauagugaaauaaaacaaaaauauaaugauaaaagugauggaauuaau

SEQ ID NO: 534825 - RNA, 64 nt, Homo Sapiens
guuuuuauguuccacugaauaggacuccacuuauaaauauaacugaagcaagugguaugugaca

SEQ ID NO: 534826 - RNA, 64 nt, Homo Sapiens
auaauuggcuuuuuaaauuuaaaagugaaguaacaaauauaauggacuuauuaauuuugcugac

SEQ ID NO: 534827 - RNA, 64 nt, Homo Sapiens
aauaagucuuugaacaaucuaguuuuuuacuuagaaauauaagggacuuuaaaagccuccuuga

SEQ ID NO: 534828 - RNA, 64 nt, Homo Sapiens
gugggccccuugcuaauuaacuuccauuuuguaaaaauauaaacacauggggcuaugacuuucc

SEQ ID NO: 534829 - RNA, 64 nt, Homo Sapiens
ccuggccaacauggugaaauccccucucuacuaaaaauauaaaaauuagccaaguuugguggca

SEQ ID NO: 534830 - RNA, 64 nt, Homo Sapiens
cuaggaaagcauuuauacuugagauaaauuauacaaauauaaagacugugaaaaagccaucauu

SEQ ID NO: 534831 - RNA, 64 nt, Homo Sapiens
uauaagugcaauuacugucaaaagaucuuucagaaaauauaagcuuuuuuagugaagaguauuu

SEQ ID NO: 534832 - RNA, 64 nt, Homo Sapiens
agugaagaguauuuauuuugaaguugaacaucacaaauauaaaaaggguuguagugccuuuacu

SEQ ID NO: 534833 - RNA, 64 nt, Homo Sapiens
ucaacaucagggaauuuauauugaaaaauugugcaaauauaauaaauuuggaaaaacaauuuuu

SEQ ID NO: 534834 - RNA, 64 nt, Homo Sapiens
uuucaucaguuugugagauuucucuauuuuuuuuaaauauaauuuuauuucuuucaacaaauau

SEQ ID NO: 534835 - RNA, 64 nt, Homo Sapiens
uauuuuuuuuaaauauaauuuuauuucuuucaacaaauauaaaauaaaaaacaacuuuggaaca

SEQ ID NO: 534836 - RNA, 64 nt, Homo Sapiens
uuuuaaagugaagaguauuuaaauaucuuuaagaaaauauaagccauaagugcaacuacuguca

SEQ ID NO: 534837 - RNA, 64 nt, Homo Sapiens
acugugaaaaagccauuaaugagaaauauuguacaaauauaaagacaggaaagcauuuauacuu

SEQ ID NO: 534838 - RNA, 64 nt, Homo Sapiens
caugaauuaugcuuuccuucgcagugauuuugaaaaauauaauauaccagauauguuugugcau

SEQ ID NO: 534839 - RNA, 64 nt, Homo Sapiens
aaaauuuaccaacuacaguuuuugccuuaaauggaaauauaaacguguguguauaaaauauaua

SEQ ID NO: 534840 - RNA, 64 nt, Homo Sapiens
ugcauguuuuaugugcacucauaugaguaucuuuaaauauaaucccuuuacaucuguguucuau

SEQ ID NO: 534841 - RNA, 64 nt, Homo Sapiens
gcuuucguagccccugcuaaguguugacuuuuuaaaauauaaguuuauuguaaaagugacauga

SEQ ID NO: 534842 - RNA, 64 nt, Homo Sapiens
gccaagauaauucacucuacucagccggcguggcaaauauaaaacuuacagagcguggcugugc

SEQ ID NO: 534843 - RNA, 64 nt, Homo Sapiens
cuguauaaacauuaaaugucuuauauagcagcaaaaauauaaaauaguuguccauauuuucaca

SEQ ID NO: 534844 - RNA, 64 nt, Homo Sapiens
uguacugugggacauguuaauaagugcuauaaagaaauauaaaggguuugggagcaaaaagagg

SEQ ID NO: 534845 - RNA, 64 nt, Homo Sapiens
caaacacuuaaaacuuuuuguuauggaagaauucaaauauaaauaaaaaauugugaguaauaaa

SEQ ID NO: 534846 - RNA, 64 nt, Homo Sapiens
agaaccuuggaguucauauuucacaaauauuaauaaauauaaguccaagagcugucagccuaau

SEQ ID NO: 534847 - RNA, 64 nt, Homo Sapiens
gugagauuuguuauguucuggcuuuuaaaagguaaaauauaaauaaauuucauaacuuaaucua

SEQ ID NO: 534848 - RNA, 64 nt, Homo Sapiens
ucucuaggaaacagucuggcuuaacuauuuuugaaaauauaacuguuuccccucucugcugcuu

SEQ ID NO: 534849 - RNA, 64 nt, Homo Sapiens
caguuaucagaaagguaguuuuuuucuucuauuaaaauauaacauugugaaagaaaauaaaauu

SEQ ID NO: 534850 - RNA, 64 nt, Homo Sapiens
gagggaagaaaacaaacuuucaggaaaugugggaaaauauaaacggaacaaagaagcaaaacaa

SEQ ID NO: 534851 - RNA, 64 nt, Homo Sapiens
ggaacaaagaagcaaaacaauaaaaaaaagaacaaaauauaagaaaaacauaacaaguaaauuu

SEQ ID NO: 534852 - RNA, 64 nt, Homo Sapiens
ugagccauauauuagugaaauguuuuauuuuguaaaauauaaauggauuauuugccaucauuag

SEQ ID NO: 534853 - RNA, 64 nt, Homo Sapiens
auaaauuuauaacuuuguuauuacauuguguaacaaauauaagguuuacgagcuaugagaauug

SEQ ID NO: 534854 - RNA, 64 nt, Homo Sapiens
cugccaaacaucagucaauugcuugagcaugcccaaauauaacaugaaagucaagucuaccugc

SEQ ID NO: 534855 - RNA, 64 nt, Homo Sapiens
ggcaagcucauagcacauguuuuacaaagaaacaaaauauaaaucacagauuuccaaaaguacu

SEQ ID NO: 534856 - RNA, 64 nt, Homo Sapiens
aucugauuuuaucucugcguuucagugaccuaccuuaaaacaacacacgagaagaguuaaacug

SEQ ID NO: 534857 - RNA, 64 nt, Homo Sapiens
uguguaacaaaggcauaucgucauguuaauaaauuuaaaacaucauucguauaaaauauuuuaa

SEQ ID NO: 534858 - RNA, 64 nt, Homo Sapiens
auuaacuagauacagaauaauggagaacaaguuguuaaaacauuuaauauuauauaggauauug

SEQ ID NO: 534859 - RNA, 64 nt, Homo Sapiens
uguaucacaccuaaucuucccaauguuugggauauuaaaacacaaaguccuuaacaugccaggc

SEQ ID NO: 534860 - RNA, 64 nt, Homo Sapiens
ucuucacagaaaauaaaagguguuaauuugcuuuuuaaaacaaauuuaauuaucacauuuuaaa

SEQ ID NO: 534861 - RNA, 64 nt, Homo Sapiens
uugcaaauucaucuguuacacagaaaauuuugacuuaaaacaucugcugaauuccaaauuucug

SEQ ID NO: 534862 - RNA, 64 nt, Homo Sapiens
uuugaaaucuaugauuuacugcaguaguaugugcuuaaaacaacuguugaggucuuuuaagcag

SEQ ID NO: 534863 - RNA, 64 nt, Homo Sapiens
auuugauggacuugguucaacaacaagaacuuacuuaaaacaauguacuguggugaugaguccc

SEQ ID NO: 534864 - RNA, 64 nt, Homo Sapiens
aauuugauccaaauuugaacuggccaaccagucuuuaaaacacuggacuagaagagauaaugau

SEQ ID NO: 534865 - RNA, 64 nt, Homo Sapiens
gugccuugaguaccauuaugugcaagcuacauaauuaaaacauuuuucuuaguuucccugggaa

SEQ ID NO: 534866 - RNA, 64 nt, Homo Sapiens
guagaucaugcccugaccuccaauaaaaaccucuuuaaaacaaugcugauuuuugaauucauga

SEQ ID NO: 534867 - RNA, 64 nt, Homo Sapiens
uccuuuaaucgaugaauugauuaaauuuagacaauuaaaacauuucuaaagugagacugaaaau

SEQ ID NO: 534868 - RNA, 64 nt, Homo Sapiens
uuccucuuuuguuaguuacagcaaacggguucauuuaaaacaggucauuuuuagugauugacaa

SEQ ID NO: 534869 - RNA, 64 nt, Homo Sapiens
aacacauugcuuaaaaugauaguugauaggauguuuaaaacaucuaaguuuacuuucuucaaag

SEQ ID NO: 534870 - RNA, 64 nt, Homo Sapiens
guucuucagguuucugcuugaaaugacucucaucuuaaaacaagagaaaaugccugccaaguau

SEQ ID NO: 534871 - RNA, 64 nt, Homo Sapiens
cuauaugcccagggccuaacucacccgaggaauuuuaaaacagccaaacugguacacauuagac

SEQ ID NO: 534872 - RNA, 64 nt, Homo Sapiens
uuguauguuucuucuuaucuuuguugugcaucauuuaaaacauuuucuuuuauacugcuggauu

SEQ ID NO: 534873 - RNA, 64 nt, Homo Sapiens
uuaguagccuucaguuuuguacaaaguauuuauauuaaaacaguauaaauaugauaaugagaag

SEQ ID NO: 534874 - RNA, 64 nt, Homo Sapiens
uauaauaauagcauuuaauuuuuaauucccaguuuuaaaacagaucugcaaaguauuucuaacc

SEQ ID NO: 534875 - RNA, 64 nt, Homo Sapiens
aucacuuuuacacagguguauuuuuagcccauaauuaaaacaugcaagcuuacuguauuaguca

SEQ ID NO: 534876 - RNA, 64 nt, Homo Sapiens
cuauuaagcaaccuuucugaugcucuccaaauccuuaaaacauggggggaaaaaaugggagccu

SEQ ID NO: 534877 - RNA, 64 nt, Homo Sapiens
guuagcuuuauuuuaguauuuaugacccagaaucuuaaaacagaauuuuguuuagaaugggcua

SEQ ID NO: 534878 - RNA, 64 nt, Homo Sapiens
gggaguagaaaacaacaaagaauggaauggacucuuaaaacaaugaaagagcauuuaucguuug

SEQ ID NO: 534879 - RNA, 64 nt, Homo Sapiens
ccaagacauuagucuuacauuuaaacuuuuuucuuuaaaacaugguuuuggugguuaacuuuua

SEQ ID NO: 534880 - RNA, 64 nt, Homo Sapiens
uuaauggaauauuuuuaaaucccacauucagaguuuaaaacacugguuuucaauguguuuuuua

SEQ ID NO: 534881 - RNA, 64 nt, Homo Sapiens
uauuuuucuucugucaguacccuuaggauacacuuuaaaacaccuuaaggucugauguuauggc

SEQ ID NO: 534882 - RNA, 64 nt, Homo Sapiens
acuuauaaauaacauauuucuucagacuaacaucuuaaaacacugaccucuaugagguauuuac

SEQ ID NO: 534883 - RNA, 64 nt, Homo Sapiens
ucacacaaaggcugauuucuaaaauauauauauauuaaaacaauaaaguauuuauuuugccuaa

SEQ ID NO: 534884 - RNA, 64 nt, Homo Sapiens
cugauaaucaguuuggaccaguuucuuaaggucauuaaaacagaagcaaauuaagacagguuug

SEQ ID NO: 534885 - RNA, 64 nt, Homo Sapiens
uaacugaauaguuuacuauuucauucaagcauguuuaaaacaaauaauuuccuuucaccaguuu

SEQ ID NO: 534886 - RNA, 64 nt, Homo Sapiens
uagaaaacaccccaggguagaauucugcaauacuuuaaaacauuuuuuguguggagauauucau

SEQ ID NO: 534887 - RNA, 64 nt, Homo Sapiens
gucucugacuuauaaagcgauguuuauuacuacauuaaaacaaaacucccugauggcaggucug

SEQ ID NO: 534888 - RNA, 64 nt, Homo Sapiens
ucaggucagcaaaauuagaauguaaauacgaauguuaaaacauuuugcauaguauuuugcauuc

SEQ ID NO: 534889 - RNA, 64 nt, Homo Sapiens
ucugaauugcaguugaauggugcuucuaaauacauuaaaacauugagcacagguuugauauuua

SEQ ID NO: 534890 - RNA, 64 nt, Homo Sapiens
uauuuaaaauguaaaaaggaauaugaaagucuuauuaaaacacuucauugaaaauauacagucu

SEQ ID NO: 534891 - RNA, 64 nt, Homo Sapiens
auaaugagaaauguuggugugcuuuucuaagcauuuaaaacauaauugccaauugaaacccuaa

SEQ ID NO: 534892 - RNA, 64 nt, Homo Sapiens
gacauuuggguucaguugcuuguagucuguaaauuuaaaacagcuuaauuugguacagguuaca

SEQ ID NO: 534893 - RNA, 64 nt, Homo Sapiens
auguaaagucccucuaagacuacauacuuuuuguuuaaaacaaaauuggaauuuguuuucccuu

SEQ ID NO: 534894 - RNA, 64 nt, Homo Sapiens
uuuaaacugugaagaacuuuaucauacaggaaacuuaaaacaagaggugucaaaagacccaaau

SEQ ID NO: 534895 - RNA, 64 nt, Homo Sapiens
gccuuuugcauaagccucuuuauaacauguaucuuuaaaacaauuaagucuuuaggaaugugua

SEQ ID NO: 534896 - RNA, 64 nt, Homo Sapiens
ggacaaacagaaccauuuucuuccucuuuaccucuuaaaacagcagaaguacaagaauacagcu

SEQ ID NO: 534897 - RNA, 64 nt, Homo Sapiens
gaagcaccuaaaaacacugcuugauauuauaaauuuaaaacacaagugaaaguuuagccauggu

SEQ ID NO: 534898 - RNA, 64 nt, Homo Sapiens
uaggcaccagaagaacaguaggugacacuauaguuuaaaacacauugccuaacuacuaguuuuu

SEQ ID NO: 534899 - RNA, 64 nt, Homo Sapiens
auaaaaagccacuagacucuucacuguuagcuuuuuaaaacauuaggcucccaucccuauggag

SEQ ID NO: 534900 - RNA, 64 nt, Homo Sapiens
cucauaaguaaguuuggcaauuacaaaguuguuuuuaaaacacauugcuucuuugcccagacau

SEQ ID NO: 534901 - RNA, 64 nt, Homo Sapiens
gaagcuagaaauuuagcaguacuccugagcauauuuaaaacaaauugcugcagaauuuggguug

SEQ ID NO: 534902 - RNA, 64 nt, Homo Sapiens
auaacauaguaccugcuucgugguuuccugaaccuuaaaacaggugcuuacauucucuaagccu

SEQ ID NO: 534903 - RNA, 64 nt, Homo Sapiens
ggcuggcgaguugacaacugaugagaggcagugguuaaaacagguuaauugaaugucugugcuu

SEQ ID NO: 534904 - RNA, 64 nt, Homo Sapiens
aauaaacagccacacacacauuuuuuuuuuuccuuuaaaacaguaacuuggaaauaugaaaagg

SEQ ID NO: 534905 - RNA, 64 nt, Homo Sapiens
aauuccaucugagugauugucaguguaaggccuuuuaaaacaaaagcaaguucuuuguuaggaa

SEQ ID NO: 534906 - RNA, 64 nt, Homo Sapiens
uuuuucccaaaagguaaaaauauagauugaaaaguuaaaacauuuugcauggcugcaguuccuu

SEQ ID NO: 534907 - RNA, 64 nt, Homo Sapiens
gcuauggaaagaugcauagaaagaguauaauguuuuaaaacauaaggcauuugucugccauuuu

SEQ ID NO: 534908 - RNA, 64 nt, Homo Sapiens
cagauccauguuaggacauuaaaaagcacaauuauuaaaacaaacuaguagaugauaagccuaa

SEQ ID NO: 534909 - RNA, 64 nt, Homo Sapiens
aacacauaaggaaucugaagccugcaaauugucuuuaaaacaacuucaguccuucucccaaccc

SEQ ID NO: 534910 - RNA, 64 nt, Homo Sapiens
auauauauuuaaaauaaauaaauuauuacacaauuuaaaacaacuggguugaagcuuuucugau

SEQ ID NO: 534911 - RNA, 64 nt, Homo Sapiens
aagggaaauguccuagguuuuagaauuucccaguuuaaaacaaaauugucuuccuccaaggagu

SEQ ID NO: 534912 - RNA, 64 nt, Homo Sapiens
ggccuuagacuaauuuucgauagcuuaagcugauuuaaaacaaaauacauauauauauaucaua

SEQ ID NO: 534913 - RNA, 64 nt, Homo Sapiens
uuuaaugcauauacaaaaacagucaaagaagacuuuaaaacauucaagggaagucaucaagaaa

SEQ ID NO: 534914 - RNA, 64 nt, Homo Sapiens
cagauucaaguugguuaauuauuuauagucugauuuaaaacaauuuuauuuuuuuguuuguuuu

SEQ ID NO: 534915 - RNA, 64 nt, Homo Sapiens
uuccuuggaacagagcuauuuaucugggcaaaaauuaaaacacagugcaaagcuuauuuucuuu

SEQ ID NO: 534916 - RNA, 64 nt, Homo Sapiens
uuguaaaaacacuuuuuugguuuaauauauauuuuuaaaacauuucacuagugauugaauucua

SEQ ID NO: 534917 - RNA, 64 nt, Homo Sapiens
uucuacuuuugccaucugaauugacuugaaugucuuaaaacagguaaauacuguaaagugugua

SEQ ID NO: 534918 - RNA, 64 nt, Homo Sapiens
uuauuuuuauauggaauugcauaaugugugccuuuuaaaacaauaacaaaaaccagagaugugc

SEQ ID NO: 534919 - RNA, 64 nt, Homo Sapiens
acuugacauuaaccucaucaaaagugugugaauuuuaaaacaaauucuaaaaaaacuauagugc

SEQ ID NO: 534920 - RNA, 64 nt, Homo Sapiens
aaaguuguacugcaucuuaguuuacuggauaaauuuaaaacacaguauuguagaaagcuaauac

SEQ ID NO: 534921 - RNA, 64 nt, Homo Sapiens
uucuguugaaccaccuguguagucucucuaguaguuaaaacagcuauuuuaguaaccccaagag

SEQ ID NO: 534922 - RNA, 64 nt, Homo Sapiens
acuucgaguucuuuugaaauucagagucuguaacuuaaaacauuacccuuaugaauuuagauga

SEQ ID NO: 534923 - RNA, 64 nt, Homo Sapiens
caaaaauaacuaugaaaaugccaguaacguuuauuuaaaacaaaauauuuuaauuuuuaaauuu

SEQ ID NO: 534924 - RNA, 64 nt, Homo Sapiens
uuaaaacaaaauauuuuaauuuuuaaauuuucccuuaaaacacacuuuuggaauaugcuacaau

SEQ ID NO: 534925 - RNA, 64 nt, Homo Sapiens
caaaaaauuauuuuaggcaaaguccauacuccuuuuaaaacaauauuuauguccuauguuugug

SEQ ID NO: 534926 - RNA, 64 nt, Homo Sapiens
uacauuguaguuaaacaaagcaauuucuccagacuuaaaacaugaugaguugagcucuaucuuc

SEQ ID NO: 534927 - RNA, 64 nt, Homo Sapiens
uuuuuauuuuguuuuucuauuaaauacuuugccuuuaaaacacuuaagcaagaaaaauaucuuu

SEQ ID NO: 534928 - RNA, 64 nt, Homo Sapiens
gaagacuucucuauaauuucgacaaaaucuuuaauuaaaacaguuagugauauucucaugccug

SEQ ID NO: 534929 - RNA, 64 nt, Homo Sapiens
gguuacuaaggugccugcuagccauuguauaaaauuaaaacaugaagaauauuuuuuuuuugag

SEQ ID NO: 534930 - RNA, 64 nt, Homo Sapiens
aagaauauuuuuuuuuugagcauggcuaguggauuuaaaacaacacauaccugucacugcugga

SEQ ID NO: 534931 - RNA, 64 nt, Homo Sapiens
ugaugccacaaugacuauuggggcgcuaaagggauuaaaacaacuagaguguuuuugcacauuu

SEQ ID NO: 534932 - RNA, 64 nt, Homo Sapiens
uuuucauggucugaauuguauuaaguaaauguauuuaaaacaaauauuuuuagagguacauguu

SEQ ID NO: 534933 - RNA, 64 nt, Homo Sapiens
caacucacugugaucuauggcauuguaaauuacguuaaaacacauuaccucagugguaucagca

SEQ ID NO: 534934 - RNA, 64 nt, Homo Sapiens
gcagcuucccaaguauucgauuucauucaugugauuaaaacaaguugccauauuucaaagccuu

SEQ ID NO: 534935 - RNA, 64 nt, Homo Sapiens
cagaaguuauuagaugaaagcagcgagugaaucuuuaaaacagacuugaucacgcacacacaau

SEQ ID NO: 534936 - RNA, 64 nt, Homo Sapiens
ggaagacucauguuaaacucuauuacaguucuuuuuaaaacacuaaaauauuuugcuuuaugua

SEQ ID NO: 534937 - RNA, 64 nt, Homo Sapiens
uaacaaacuuuuuucuuuuuacuacucauauugauuaaaacaguuccaauuagggauguuuguu

SEQ ID NO: 534938 - RNA, 64 nt, Homo Sapiens
gaaccuuuugcugauguguuaagucuacauuuguuuaaaacacuacuuuguacaguacaaaaua

SEQ ID NO: 534939 - RNA, 64 nt, Homo Sapiens
agcaguaaaacgcuguaaaccugcucaugcugacuuaaaacacugcuacauaaguacuuugaua

SEQ ID NO: 534940 - RNA, 64 nt, Homo Sapiens
gaauauuuuugcuucaaguguacgugacagaauauuaaaacauguuacauuuuuaaaaaaucug

SEQ ID NO: 534941 - RNA, 64 nt, Homo Sapiens
auuuaaaaaacauuucuauuaaaagacgauagaguuaaaacaaucgaaagaaguaagagauuug

SEQ ID NO: 534942 - RNA, 64 nt, Homo Sapiens
gacuuuuauuauuuuucacgcaaaacucagugguuuaaaacaagcacugcauaacaaaccacac

SEQ ID NO: 534943 - RNA, 64 nt, Homo Sapiens
cuagaaucucauguuuuauaaguauacuuauuuuuuaaaacagggagugaagauaguacuagca

SEQ ID NO: 534944 - RNA, 64 nt, Homo Sapiens
uuuaauuuauuuggucauucaugaacucagggcuuuaaaacauuaaaucuccuaaaaccagucu

SEQ ID NO: 534945 - RNA, 64 nt, Homo Sapiens
gucccguguguccuaaaaaucuauaagcugcuuauuaaaacagagaaauaugguuugcuaaaau

SEQ ID NO: 534946 - RNA, 64 nt, Homo Sapiens
auuuguuucaaauugcaguuuuuauaaaacauuuuuaaaacacaaauggcauguaugcuaauga

SEQ ID NO: 534947 - RNA, 64 nt, Homo Sapiens
uaguuuugaacuaauguaacaugauuuuucuuuuuuaaaacagccugaaaauguacuaguguuu

SEQ ID NO: 534948 - RNA, 64 nt, Homo Sapiens
ugucccgauuguuaaaaaguuggcucaauuauuuuuaaaacauuuuguaagccaacaaaagucu

SEQ ID NO: 534949 - RNA, 64 nt, Homo Sapiens
aaagucugugggcugccaguuuauuacuuuugucuuaaaacaugaucauuguucucucacggua

SEQ ID NO: 534950 - RNA, 64 nt, Homo Sapiens
ucuuaaaugauggaaguauaggacguugcuuauuuuaaaacaagggaaggacacaaaauggaau

SEQ ID NO: 534951 - RNA, 64 nt, Homo Sapiens
auggaaugacugcuuaguccuuucucagauacucuuaaaacaauuuuuuauuguuaaauuugug

SEQ ID NO: 534952 - RNA, 64 nt, Homo Sapiens
ccauaggcugguuucaguuuucuaauaaaugaucuuaaaacaguaauggcuucugaaugacugu

SEQ ID NO: 534953 - RNA, 64 nt, Homo Sapiens
uguuagagcaaaauuaaaagcgaugucugaaccuuuaaaacaucguuauccucaaaaacaucag

SEQ ID NO: 534954 - RNA, 64 nt, Homo Sapiens
acuguaauguuaauuuccuguuacauguguaaaauuaaaacacugcuuucauuucuuccauuaa

SEQ ID NO: 534955 - RNA, 64 nt, Homo Sapiens
aauuuguuaauuucuuauaaaguguuguuuauuauuaaaacaaugcaggcagaauuuaugaaua

SEQ ID NO: 534956 - RNA, 64 nt, Homo Sapiens
gcucauuuaggguagauuuauuuaucucauuaacuuaaaacagcuauguguaugaaauagguca

SEQ ID NO: 534957 - RNA, 63 nt, Homo Sapiens
uuuuuacaauuugauuuuaacuuuuaaaauaaauuuaaaacauaauugucacuucuuaguuuu

SEQ ID NO: 534958 - RNA, 64 nt, Homo Sapiens
cacacagcuguuagcauaaacuuuaauuuuuugauuaaaacauauuuuaggguuuuuuuuucuu

SEQ ID NO: 534959 - RNA, 64 nt, Homo Sapiens
gccauauguugaauuuuuaaugaaagcacaaaaauuaaaacauucuaucgauuuaguuaccucu

SEQ ID NO: 534960 - RNA, 64 nt, Homo Sapiens
aaaccucacacauaccuaaacaagacccugucucuuaaaacaaacuccagccuaggcaacagag

SEQ ID NO: 534961 - RNA, 64 nt, Homo Sapiens
aaguagaccaggugcaguaguucaguguauuuauuuaaaacauaaguucccccaaaugugaugu

SEQ ID NO: 534962 - RNA, 64 nt, Homo Sapiens
caaccccccaucacaaacuuuuugagggacaaauuuaaaacaaaucaacuuuaugcagcuuccu

SEQ ID NO: 534963 - RNA, 64 nt, Homo Sapiens
gucaaggugcuguugucauuugauagcguuggaauuaaaacaauguuuuacugcuuuuaacuuc

SEQ ID NO: 534964 - RNA, 64 nt, Homo Sapiens
uuggacuuuuagcuguuaaaugguaucucauuuuuuaaaacacauuucacauuuaaagucauac

SEQ ID NO: 534965 - RNA, 64 nt, Homo Sapiens
aacaguaauaacuauaaaucucacuuuaaauaauuuaaaacaaauuaaagugauauaugaguua

SEQ ID NO: 534966 - RNA, 64 nt, Homo Sapiens
agauacuuaccacucucucuucucuuucccaugguuaaaacaggaguuguguucucugucgcug

SEQ ID NO: 534967 - RNA, 64 nt, Homo Sapiens
gucacuuuugaagcauguuaauaaaugucacugauuaaaacagcuggagcauuuccuucccuuu

SEQ ID NO: 534968 - RNA, 64 nt, Homo Sapiens
aaugucucugguguuuagagcuuuauuuuuuucuuuaaaacauuaaaacagcugagaaucaguu

SEQ ID NO: 534969 - RNA, 64 nt, Homo Sapiens
ugguguuuagagcuuuauuuuuuucuuuaaaacauuaaaacagcugagaaucaguuaaauggaa

SEQ ID NO: 534970 - RNA, 64 nt, Homo Sapiens
aauuuuuuugucuuauucugccagauauguuccuuuaaaacauguucaauggaauaccagcuaa

SEQ ID NO: 534971 - RNA, 64 nt, Homo Sapiens
uauauaccucauucuuuaguguaaaagucugugauuaaaacauuaauacaauuaauugcauaca

SEQ ID NO: 534972 - RNA, 64 nt, Homo Sapiens
aaugggaauuauugcacagaaaguaugaaucuaauuaaaacagaaaacuuauccagggccauag

SEQ ID NO: 534973 - RNA, 64 nt, Homo Sapiens
aaauauagagaggggcuuuaucuauauuuaaauguuaaaacacuuuuuuguaaauguuaaaaca

SEQ ID NO: 534974 - RNA, 64 nt, Homo Sapiens
uauauuuaaauguuaaaacagauuuuuguaaauguuaaaacaucugugacuucuauauucaaua

SEQ ID NO: 534975 - RNA, 64 nt, Homo Sapiens
uguuaaacuaaaaaccacacuuuuaacaauaaaauuaaaacaaccaacuacauccuuaugaugu

SEQ ID NO: 534976 - RNA, 64 nt, Homo Sapiens
aaaguugaauaaaaugcauguggauugccaauuuuuaaaacacuuugguccauugaaaguuaca

SEQ ID NO: 534977 - RNA, 64 nt, Homo Sapiens
gccaacucaaaauaacauuaccuuaugaaaaguguuaaaacauuaaucuuuuauguuucauuua

SEQ ID NO: 534978 - RNA, 64 nt, Homo Sapiens
uugggaaaacugagcaugugcuaaugaaaacacuuuaaaacagaagcacuuacagaagaguauc

SEQ ID NO: 534979 - RNA, 64 nt, Homo Sapiens
uuuucaauuaauauuaucacaauuuuaaaauccuuuaaaacaacgcuuaaauuacucaauuuaa

SEQ ID NO: 534980 - RNA, 64 nt, Homo Sapiens
augaaacauuugccaaaacauuggaccgaagucauuaaaacaaauguauuucauuuucuuuaua

SEQ ID NO: 534981 - RNA, 64 nt, Homo Sapiens
ucauguuucugcuucauauuuugaaaaauaacaauuaaaacagacagcuguacugagguaagau

SEQ ID NO: 534982 - RNA, 64 nt, Homo Sapiens
cucaauaucaacuccaguuuaaaaaguguuauuuuuaaaacauuugaaaccaaguacuguuuaa

SEQ ID NO: 534983 - RNA, 64 nt, Homo Sapiens
ucuuucuuuucccuaauuugcuuuggugggguccuuaaaacauuucccaacuaaagaauagaau

SEQ ID NO: 534984 - RNA, 64 nt, Homo Sapiens
ucaucauaccaaaaaguguaagugaaaacccccuuuaaaacaaaacaaaaaaaugaaauaaaau

SEQ ID NO: 534985 - RNA, 64 nt, Homo Sapiens
guuguuuaagcauguuuaaauuuaaaacagaauguuaaaacacuauagguauuuuaaaacauug

SEQ ID NO: 534986 - RNA, 64 nt, Homo Sapiens
auguuaaaacacuguuguuuuuuuaaaacauuguuuaaaacagauguaagauaauaaauaggua

SEQ ID NO: 534987 - RNA, 64 nt, Homo Sapiens
guuuaaaacagaauguuaaaaauaaauagguauuuuaaaacauuaucucauauugcuguaagau

SEQ ID NO: 534988 - RNA, 64 nt, Homo Sapiens
agucuuucaacuguuucagaaaacauaauauagcuuaaaacacuucuaauucugugauuaaaau

SEQ ID NO: 534989 - RNA, 64 nt, Homo Sapiens
gcugaauuuacaguaguuaaccuuuuacaagugguuaaaacauagcuuucuucccguaaaaacu

SEQ ID NO: 534990 - RNA, 64 nt, Homo Sapiens
ucaucuucauaaagcaagacaacauuaugacacuuuaaaacaguagcaaagaagucuauuuauu

SEQ ID NO: 534991 - RNA, 64 nt, Homo Sapiens
agaaauuuucuaaauuuuaguaagagagaagcuuuuaaaacaguacauuccugaauaaaacaac

SEQ ID NO: 534992 - RNA, 64 nt, Homo Sapiens
uuuuucuuuaucaagagaacaaaaugccagaauguuaaaacaguuaacucaaaaucuagucauc

SEQ ID NO: 534993 - RNA, 64 nt, Homo Sapiens
uugucugaugugacguagcaacacccaggucuucuuaaaacaaagucaucagcuuugccagguu

SEQ ID NO: 534994 - RNA, 64 nt, Homo Sapiens
aauggaacacaauuuuuuucuguacucuaauuuuuuaaaacaguuugauauagaccaaagaugg

SEQ ID NO: 534995 - RNA, 64 nt, Homo Sapiens
acuuuaaaaggaaaagccuguacacugaccagcuuuaaaacaguugcacagaccugaggaacuu

SEQ ID NO: 534996 - RNA, 64 nt, Homo Sapiens
gguacggaccaugugcuauauguugucguuguuuuuaaaacaaaguguauuccuaacagucuuu

SEQ ID NO: 534997 - RNA, 64 nt, Homo Sapiens
acaacucugagaugaacaaucaucuaccacggcuuuaaaacaaaaaugcacauuuaaagagaag

SEQ ID NO: 534998 - RNA, 64 nt, Homo Sapiens
uuuugcugggacaaaauguuugaacuauaaaauguuaaaacauuuuauguauuuuuugaaguua

SEQ ID NO: 534999 - RNA, 64 nt, Homo Sapiens
uuccuccccucuggccagugcccuucuguaaauuuuaaaacauuugcuuuuuuccucugcucuu

SEQ ID NO: 535000 - RNA, 64 nt, Homo Sapiens
auuuggaaaauauagacauauuucuuuugcuuucuuaaaacagcuuaaaaugaugaacuuuuau

SEQ ID NO: 535001 - RNA, 64 nt, Homo Sapiens
ggccucuuaaucccuuaccugagaaugaagggauuuaaaacacugauuuaacauugaaaggccu

SEQ ID NO: 535002 - RNA, 64 nt, Homo Sapiens
uuuagucugaugcuguuguauuuuuucauuuuauuuaaaacacuacuuacuucuuauucucuua

SEQ ID NO: 535003 - RNA, 64 nt, Homo Sapiens
agaauuaauguuuucaaaugugcaacucuaguuuuuaaaacaaaauuugguucuuuacauucau

SEQ ID NO: 535004 - RNA, 64 nt, Homo Sapiens
uuugcugccuugcuccuagcagacagaaacuggauuaaaacaauuuuuuuuuuccucuucagaa

SEQ ID NO: 535005 - RNA, 64 nt, Homo Sapiens
uuuccuucauucauagggaaagguuuuguauuuuuuaaaacacuaaaagcagcgucacucuacc

SEQ ID NO: 535006 - RNA, 64 nt, Homo Sapiens
uccuucaccucgucguauauauccucgauaaguauuaaaacaguauuugaguuuaaaagaguuu

SEQ ID NO: 535007 - RNA, 64 nt, Homo Sapiens
uuuggguuagaauuuuucuuuuuguacuguuucuuuaaaacagaguucuuaguaacaggggcag

SEQ ID NO: 535008 - RNA, 64 nt, Homo Sapiens
ugaguauauagaaagaaaagucauuucuuuuuccuuaaaacauaauauccagugcaaucaacug

SEQ ID NO: 535009 - RNA, 64 nt, Homo Sapiens
auauauuaugucacuauucauuuuaucugaaagauuaaaacaaacgucauuucuguguccucaa

SEQ ID NO: 535010 - RNA, 64 nt, Homo Sapiens
uaauccaaaauaagucuauggaugcaguauauauuuaaaacauuuacugagauauauuuuugca

SEQ ID NO: 535011 - RNA, 64 nt, Homo Sapiens
agauaauucauacuggagagauuuucaacuuuuauuaaaacacaugugucaaauccuuuagugu

SEQ ID NO: 535012 - RNA, 64 nt, Homo Sapiens
aaugaaauuuaccacauuaaguuguaacaauuuguuaaaacaacgguugcuaaauauugaagug

SEQ ID NO: 535013 - RNA, 64 nt, Homo Sapiens
ugaugcuggcuggguggggucacauacuuuaauuuuaaaacacuguuaugucuaggaaacaagg

SEQ ID NO: 535014 - RNA, 64 nt, Homo Sapiens
uguucagaugcaucuggcaccaauuagguauuucuuaaaacaggacucaucugucagagugcac

SEQ ID NO: 535015 - RNA, 64 nt, Homo Sapiens
gguagugacugagauguaaaaauagauuuuagaauuaaaacaaaauccaaguccucacaccccu

SEQ ID NO: 535016 - RNA, 64 nt, Homo Sapiens
uuuuaaggacugacugaggcuucuauagcaucacuuaaaacacgcgucagauguuuaaaacacc

SEQ ID NO: 535017 - RNA, 64 nt, Homo Sapiens
uucuauagcaucacuuaaaaacgacgucagauguuuaaaacaccuacugauggaauuuuuuugu

SEQ ID NO: 535018 - RNA, 64 nt, Homo Sapiens
aggaugggcuucugugcccagaaaauaguuuauuuuaaaacaauaagccaaaauuaagguguuu

SEQ ID NO: 535019 - RNA, 64 nt, Homo Sapiens
auuccuuuuuauuuauauguaauaaucaagagccuuaaaacaucuauauuugauuuauuaacuu

SEQ ID NO: 535020 - RNA, 64 nt, Homo Sapiens
guauuugacuacuaaaaagcaaaauaauuaagauuuaaaacaauaagcauguauuuuauaauca

SEQ ID NO: 535021 - RNA, 64 nt, Homo Sapiens
agcuaggcaugguggugcacaucucuacaaaauauuaaaacauugggcaacacagcaagacccc

SEQ ID NO: 535022 - RNA, 64 nt, Homo Sapiens
aagaaaaccuugaauuucucuauauaggaucagcuuaaaacauaaauuuaucucaaaaucucca

SEQ ID NO: 535023 - RNA, 64 nt, Homo Sapiens
aauuucaaucaaauacuuuucaaugaaauugcuguuaaaacacaaucuaaaaaaaaauucuuag

SEQ ID NO: 535024 - RNA, 64 nt, Homo Sapiens
uuguuuuugaguuuucuuauacagcuggacuuauuuaaaacaacuuuggcugcaggcagcaaaa

SEQ ID NO: 535025 - RNA, 64 nt, Homo Sapiens
gaaggucaaucuaguuccagaucuaacuuccuccuuaaaacagaaggcucaacaagggucucau

SEQ ID NO: 535026 - RNA, 64 nt, Homo Sapiens
gcaagcagaugacaaaaaggugcagaaggcaaucuuaaaacagaaaggugcaggagguaccuua

SEQ ID NO: 535027 - RNA, 64 nt, Homo Sapiens
uuauuggaaggcaagucauuauuacugguauuaguuaaaacacauaucaaaugcuugcucuuca

SEQ ID NO: 535028 - RNA, 64 nt, Homo Sapiens
gaguauuuuuggaaaaaaaaauaauauuuuuauguuaaaacaauuuuaaaaucuuaaaauggcc

SEQ ID NO: 535029 - RNA, 64 nt, Homo Sapiens
guggaauguuauuguucaacguuguuuacagcucuuaaaacauggugaggaaugccuaagucuu

SEQ ID NO: 535030 - RNA, 64 nt, Homo Sapiens
gauauguugaugaaauucuggaucaggagggguguuaaaacaucaaaaugauggcgacuuguau

SEQ ID NO: 535031 - RNA, 64 nt, Homo Sapiens
gauugucaaauacagcauuucuuuggaaaccaccuuaaaacauuagugcuaugguuaugagugu

SEQ ID NO: 535032 - RNA, 64 nt, Homo Sapiens
acgcuuuuuagcuaaauauauacucuucucuaguuuaaaacauuugaacuugccuaguuagugu

SEQ ID NO: 535033 - RNA, 64 nt, Homo Sapiens
uaaauauccaaagaugccuuuugaauuucaaagauuaaaacacagcuagaguaguaguauugua

SEQ ID NO: 535034 - RNA, 64 nt, Homo Sapiens
acuucauuuuauguccuuucacaaauaaauuaguuuaaaacagaaaguggcuacuugccauuuu

SEQ ID NO: 535035 - RNA, 64 nt, Homo Sapiens
cucauuuugcgaggcuuaggcagcuagacaucguuuaaaacaaaauauuaacuuauauuacaug

SEQ ID NO: 535036 - RNA, 64 nt, Homo Sapiens
aguauaguguuguguagcuucugugguaaaugauuuaaaacacuauguuuucaagaaauguaca

SEQ ID NO: 535037 - RNA, 64 nt, Homo Sapiens
uguuucaaaaauauaagaaaucuuguaguguuaguuaaaacauaagccuuguguucuguauuuu

SEQ ID NO: 535038 - RNA, 64 nt, Homo Sapiens
uuuugauaaguaauuacacuagagaugcuguagcuuaaaacauguucacauuucuaaauuuaac

SEQ ID NO: 535039 - RNA, 64 nt, Homo Sapiens
cucuacaugccuaauguuuuucauuuuccuauuuuuaaaacaugccugguaauacagcucagug

SEQ ID NO: 535040 - RNA, 64 nt, Homo Sapiens
gugucuucucaagcuuucuuuacugaggaauucagcuugugacacagauacaucccacuagcuu

SEQ ID NO: 535041 - RNA, 64 nt, Homo Sapiens
ggaauucagcuugugacacagauacaucccacuagcuugugagguggaacuaguaauaaagacc

SEQ ID NO: 535042 - RNA, 64 nt, Homo Sapiens
ucaagcuuuacugugaaucagaaacauccaguaagcuugugacaaaugcagacuccuagggaaa

SEQ ID NO: 535043 - RNA, 64 nt, Homo Sapiens
ucugacauuauuaguggaauuccacaccaacagggcuugugagcuuccauuucaucuuacugua

SEQ ID NO: 535044 - RNA, 64 nt, Homo Sapiens
uauuuuauuuuauucuuuuucaucacucaggauggcuugugauuagcaggagaucaugagauuu

SEQ ID NO: 535045 - RNA, 64 nt, Homo Sapiens
auuagaguaauuuacaugacgcuaauugaauuaggcuugugacauauuuuaggaauuaugacaa

SEQ ID NO: 535046 - RNA, 64 nt, Homo Sapiens
acuagugagccacacgccacagucagcgucugcugcuugugaagaaauagccuaccagguacag

SEQ ID NO: 535047 - RNA, 64 nt, Homo Sapiens
uuuuuaagaaaaagaaaagccuuauuugacuuaugcuugugauacuggacuucuuaccaauccg

SEQ ID NO: 535048 - RNA, 64 nt, Homo Sapiens
aggcagaacaguaucaaaagaagaaucggaagaugcuugugauuuuaauauuauuugucaucau

SEQ ID NO: 535049 - RNA, 64 nt, Homo Sapiens
uucguuuugggggugguggugcuggcugggccaugcuugugaagugaugugugucucugauuua

SEQ ID NO: 535050 - RNA, 64 nt, Homo Sapiens; identical to SEQ ID NO: 476364

SEQ ID NO: 535051 - RNA, 64 nt, Homo Sapiens; identical to SEQ ID NO: 476365

SEQ ID NO: 535052 - RNA, 64 nt, Homo Sapiens; identical to SEQ ID NO: 476366

SEQ ID NO: 535053 - RNA, 64 nt, Homo Sapiens; identical to SEQ ID NO: 476367

SEQ ID NO: 535054 - RNA, 64 nt, Homo Sapiens; identical to SEQ ID NO: 476368

SEQ ID NO: 535055 - RNA, 64 nt, Homo Sapiens; identical to SEQ ID NO: 476369

SEQ ID NO: 535056 - RNA, 64 nt, Homo Sapiens; identical to SEQ ID NO: 476370

SEQ ID NO: 535057 - RNA, 64 nt, Homo Sapiens; identical to SEQ ID NO: 476371

SEQ ID NO: 535058 - RNA, 64 nt, Homo Sapiens; identical to SEQ ID NO: 476372

SEQ ID NO: 535059 - RNA, 64 nt, Homo Sapiens; identical to SEQ ID NO: 476373

SEQ ID NO: 535060 - RNA, 64 nt, Homo Sapiens; identical to SEQ ID NO: 476374

SEQ ID NO: 535061 - RNA, 64 nt, Homo Sapiens; identical to SEQ ID NO: 476375

SEQ ID NO: 535062 - RNA, 64 nt, Homo Sapiens; identical to SEQ ID NO: 476376

SEQ ID NO: 535063 - RNA, 64 nt, Homo Sapiens; identical to SEQ ID NO: 476377

SEQ ID NO: 535064 - RNA, 64 nt, Homo Sapiens; identical to SEQ ID NO: 476378

SEQ ID NO: 535065 - RNA, 64 nt, Homo Sapiens; identical to SEQ ID NO: 476379

SEQ ID NO: 535066 - RNA, 64 nt, Homo Sapiens; identical to SEQ ID NO: 476380

SEQ ID NO: 535067 - RNA, 64 nt, Homo Sapiens; identical to SEQ ID NO: 476381

SEQ ID NO: 535068 - RNA, 64 nt, Homo Sapiens; identical to SEQ ID NO: 476382

SEQ ID NO: 535069 - RNA, 64 nt, Homo Sapiens; identical to SEQ ID NO: 476383

SEQ ID NO: 535070 - RNA, 64 nt, Homo Sapiens
gcagcagcauggaggagggugcugaaccucgggaacgagcuauccuagcuucugaauccagguu

SEQ ID NO: 535071 - RNA, 64 nt, Homo Sapiens
uaaacagugccauuguuuuggaugaaugguuaacacgagcuaguugaugauucuacuugcugua

SEQ ID NO: 535072 - RNA, 64 nt, Homo Sapiens
uucugcaauguuuaucuagacuccaggggaucacacgagcuagcaugaugacuacgucccgugu

SEQ ID NO: 535073 - RNA, 64 nt, Homo Sapiens
auuuaccaacccauuuaucacaaauaagagcaccacgagcuaaaugaauuagaagccccuauua

SEQ ID NO: 535074 - RNA, 64 nt, Homo Sapiens
uaacuuauauuuuuuaaugguaaguugauuauauacgagcuaugccucauagugcaguaauaag

SEQ ID NO: 535075 - RNA, 64 nt, Homo Sapiens
agccaauugcucuucaucacacucuuggugaggcacgagcuaccucacugauuaacguugcuaa

SEQ ID NO: 535076 - RNA, 64 nt, Homo Sapiens
ggucauacaugaaugucuagauauauucuugcagacgagcuauaucgaaguggagaaaaugagg

SEQ ID NO: 535077 - RNA, 64 nt, Homo Sapiens
augguacggaacuuuuuuuaaauugugauuuuaaacgagcuauuuucugaauuauuuuaucuua

SEQ ID NO: 535078 - RNA, 64 nt, Homo Sapiens
accuugaaguagcacagcccguccuugcaugugcacgagcuaucauuugaguaaaaguauacau

SEQ ID NO: 535079 - RNA, 64 nt, Homo Sapiens
uaucuauauauuucucucacacaggaacgcguccacgagcuauaauauauacauauauagacag

SEQ ID NO: 535080 - RNA, 64 nt, Homo Sapiens
uagaaaacuuuuaaaaaaauuaauauggcagaauacgagcuauuaauaguaucagauacagaac

SEQ ID NO: 535081 - RNA, 64 nt, Homo Sapiens
ccgaacugacuucagcagcuguacuggcagugggacgagcuagcucccauauccagggcuccgg

SEQ ID NO: 535082 - RNA, 64 nt, Homo Sapiens
guaagaaaaugaaaauuuaauuuuuuuuucuaggacgagcuauagaaaagcuauugagaguauc

SEQ ID NO: 535083 - RNA, 64 nt, Homo Sapiens
gcugaugacgaacuaucucuaacuggucuugaccacgagcuaguucugaauugcaggggccuca

SEQ ID NO: 535084 - RNA, 64 nt, Homo Sapiens
auaacuguuugguauuugaugcagaugagagagcacgagcuaaaguaaaauaucuaacagguga

SEQ ID NO: 535085 - RNA, 64 nt, Homo Sapiens
caaucuuuuuccaaaacccaaggucaggguuuuaacgagcuaugagagcggaaaaaaaaaaaag

SEQ ID NO: 535086 - RNA, 64 nt, Homo Sapiens
uauaaauauauauauacauagauauauucuauauacgagcuauaacacaucuaccauauauaca

SEQ ID NO: 535087 - RNA, 51 nt, Homo Sapiens
augguggcccaugccuguaguacgagcuacucaggagguugaggcagggga

SEQ ID NO: 535088 - RNA, 64 nt, Homo Sapiens
aauuguguucuuuuggaaucaucccaauuauaacacgagcuauugcauaauacaaauaacccuc

SEQ ID NO: 535089 - RNA, 64 nt, Homo Sapiens
gcuaccgugccugacagcaggaugguccucgcgaacgagcuacaguaaggauggcuugcaugga

SEQ ID NO: 535090 - RNA, 64 nt, Homo Sapiens
ccacguugacagcuuaagaccucgagcagaugacacgagcuagucaagaacagcgacagcccuu

SEQ ID NO: 535091 - RNA, 64 nt, Homo Sapiens
uuuauuucuccgaauaaacguccaaccccuuuccacgagcuauaagguguaccucccccugccu

SEQ ID NO: 535092 - RNA, 64 nt, Homo Sapiens
gcaucugaugcuggggccagggacucucccacgcacgagcuagugaguggcacaccagagccau

SEQ ID NO: 535093 - RNA, 64 nt, Homo Sapiens
cucaaaucuuguuuccugcuggccuggucugcccacgagcuagagcggggaaauguugagcuca

SEQ ID NO: 535094 - RNA, 64 nt, Homo Sapiens
uuuguuauuacauuguguaacaaauauaagguuuacgagcuaugagaauuggugcuaucaccau

SEQ ID NO: 535095 - RNA, 63 nt, Homo Sapiens; identical to SEQ ID NO: 252244

SEQ ID NO: 535096 - RNA, 63 nt, Homo Sapiens; identical to SEQ ID NO: 252245

SEQ ID NO: 535097 - RNA, 63 nt, Homo Sapiens; identical to SEQ ID NO: 252246

SEQ ID NO: 535098 - RNA, 63 nt, Homo Sapiens; identical to SEQ ID NO: 252247

SEQ ID NO: 535099 - RNA, 63 nt, Homo Sapiens; identical to SEQ ID NO: 252248

SEQ ID NO: 535100 - RNA, 63 nt, Homo Sapiens; identical to SEQ ID NO: 252249

SEQ ID NO: 535101 - RNA, 63 nt, Homo Sapiens; identical to SEQ ID NO: 252250

SEQ ID NO: 535102 - RNA, 63 nt, Homo Sapiens; identical to SEQ ID NO: 252251

SEQ ID NO: 535103 - RNA, 63 nt, Homo Sapiens; identical to SEQ ID NO: 252252

SEQ ID NO: 535104 - RNA, 63 nt, Homo Sapiens; identical to SEQ ID NO: 252253

SEQ ID NO: 535105 - RNA, 63 nt, Homo Sapiens; identical to SEQ ID NO: 252254

SEQ ID NO: 535106 - RNA, 63 nt, Homo Sapiens; identical to SEQ ID NO: 252255

SEQ ID NO: 535107 - RNA, 63 nt, Homo Sapiens; identical to SEQ ID NO: 252256

SEQ ID NO: 535108 - RNA, 63 nt, Homo Sapiens; identical to SEQ ID NO: 252257

SEQ ID NO: 535109 - RNA, 63 nt, Homo Sapiens; identical to SEQ ID NO: 252258

SEQ ID NO: 535110 - RNA, 63 nt, Homo Sapiens; identical to SEQ ID NO: 252259

SEQ ID NO: 535111 - RNA, 63 nt, Homo Sapiens; identical to SEQ ID NO: 252260

SEQ ID NO: 535112 - RNA, 63 nt, Homo Sapiens; identical to SEQ ID NO: 252261

SEQ ID NO: 535113 - RNA, 63 nt, Homo Sapiens; identical to SEQ ID NO: 252262

SEQ ID NO: 535114 - RNA, 63 nt, Homo Sapiens; identical to SEQ ID NO: 252263

SEQ ID NO: 535115 - RNA, 63 nt, Homo Sapiens; identical to SEQ ID NO: 252264

SEQ ID NO: 535116 - RNA, 65 nt, Homo Sapiens; identical to SEQ ID NO: 252265

SEQ ID NO: 535117 - RNA, 65 nt, Homo Sapiens; identical to SEQ ID NO: 252266

SEQ ID NO: 535118 - RNA, 65 nt, Homo Sapiens; identical to SEQ ID NO: 252267

SEQ ID NO: 535119 - RNA, 65 nt, Homo Sapiens; identical to SEQ ID NO: 252268

SEQ ID NO: 535120 - RNA, 65 nt, Homo Sapiens; identical to SEQ ID NO: 252269

SEQ ID NO: 535121 - RNA, 65 nt, Homo Sapiens; identical to SEQ ID NO: 252270

SEQ ID NO: 535122 - RNA, 65 nt, Homo Sapiens; identical to SEQ ID NO: 252271

SEQ ID NO: 535123 - RNA, 65 nt, Homo Sapiens; identical to SEQ ID NO: 252272

SEQ ID NO: 535124 - RNA, 65 nt, Homo Sapiens; identical to SEQ ID NO: 252273

SEQ ID NO: 535125 - RNA, 65 nt, Homo Sapiens; identical to SEQ ID NO: 252274

SEQ ID NO: 535126 - RNA, 65 nt, Homo Sapiens; identical to SEQ ID NO: 252275

SEQ ID NO: 535127 - RNA, 65 nt, Homo Sapiens; identical to SEQ ID NO: 252276

SEQ ID NO: 535128 - RNA, 65 nt, Homo Sapiens; identical to SEQ ID NO: 252277

SEQ ID NO: 535129 - RNA, 65 nt, Homo Sapiens; identical to SEQ ID NO: 252278

SEQ ID NO: 535130 - RNA, 65 nt, Homo Sapiens; identical to SEQ ID NO: 252279

SEQ ID NO: 535131 - RNA, 65 nt, Homo Sapiens; identical to SEQ ID NO: 252280

SEQ ID NO: 535132 - RNA, 65 nt, Homo Sapiens; identical to SEQ ID NO: 252281

SEQ ID NO: 535133 - RNA, 65 nt, Homo Sapiens; identical to SEQ ID NO: 252282

SEQ ID NO: 535134 - RNA, 65 nt, Homo Sapiens; identical to SEQ ID NO: 252283

SEQ ID NO: 535135 - RNA, 65 nt, Homo Sapiens; identical to SEQ ID NO: 252284

SEQ ID NO: 535136 - RNA, 65 nt, Homo Sapiens; identical to SEQ ID NO: 252285

SEQ ID NO: 535137 - RNA, 65 nt, Homo Sapiens; identical to SEQ ID NO: 252286

SEQ ID NO: 535138 - RNA, 65 nt, Homo Sapiens; identical to SEQ ID NO: 252287

SEQ ID NO: 535139 - RNA, 65 nt, Homo Sapiens; identical to SEQ ID NO: 252288

SEQ ID NO: 535140 - RNA, 65 nt, Homo Sapiens; identical to SEQ ID NO: 252289

SEQ ID NO: 535141 - RNA, 65 nt, Homo Sapiens; identical to SEQ ID NO: 252290

SEQ ID NO: 535142 - RNA, 65 nt, Homo Sapiens; identical to SEQ ID NO: 252291

SEQ ID NO: 535143 - RNA, 65 nt, Homo Sapiens; identical to SEQ ID NO: 252292

SEQ ID NO: 535144 - RNA, 65 nt, Homo Sapiens; identical to SEQ ID NO: 252293

SEQ ID NO: 535145 - RNA, 65 nt, Homo Sapiens; identical to SEQ ID NO: 252294

SEQ ID NO: 535146 - RNA, 65 nt, Homo Sapiens; identical to SEQ ID NO: 252295

SEQ ID NO: 535147 - RNA, 65 nt, Homo Sapiens; identical to SEQ ID NO: 252296

SEQ ID NO: 535148 - RNA, 65 nt, Homo Sapiens; identical to SEQ ID NO: 252297

SEQ ID NO: 535149 - RNA, 65 nt, Homo Sapiens; identical to SEQ ID NO: 252298

SEQ ID NO: 535150 - RNA, 59 nt, Homo Sapiens
ccaagccuguggcuggagcugguguguguuuaucuaauaaagucccacaggugccucac

SEQ ID NO: 535151 - RNA, 59 nt, Homo Sapiens
uaauaugguuguugaaaaugugaucaccuuuaucuaaagugggagaagauacauacaca

SEQ ID NO: 535152 - RNA, 59 nt, Homo Sapiens
cauccagaaguuccucaagggccaggacuuuaucuaauaccucugugugcuccuccuug

SEQ ID NO: 535153 - RNA, 59 nt, Homo Sapiens
ggguuuaauauuacccuuuccuauguguuuuaucuaauuauuuugguuguuaauauggu

SEQ ID NO: 535154 - RNA, 59 nt, Homo Sapiens
aagccgaaaucugcauaaggaagcccacuuuaucuaaaugauauuagccaggauccuug

SEQ ID NO: 535155 - RNA, 59 nt, Homo Sapiens
guccaugcacaucccugacaccucacaccuuaucuaagucugaagcuggggagaaaggg

SEQ ID NO: 535156 - RNA, 59 nt, Homo Sapiens
aaguuucucugguuaccccucuucccuuguuaucuaagcuuuccucaguugucaucucu

SEQ ID NO: 535157 - RNA, 59 nt, Homo Sapiens
aggcagcuuucaucacacccuuuuaacauuuaucuaaaagaauuuaaauucuuuuucaa

SEQ ID NO: 535158 - RNA, 59 nt, Homo Sapiens
agccaguccacagguuugcauccuggacuuuaucuaaauagugccaagacacaucacua

SEQ ID NO: 535159 - RNA, 59 nt, Homo Sapiens
ugcuggugaaccaauaccauaagcauguauuaucuaagcacuugaucaagaaauauaca

SEQ ID NO: 535160 - RNA, 59 nt, Homo Sapiens
auaugguuggcauuaaauuuagcauuucauuaucuaacaaaauuaauauaaauuccagg

SEQ ID NO: 535161 - RNA, 59 nt, Homo Sapiens
uaaacauccugaaucgggaacaaaggguuuuaucuaauaaagugucucuuccauucacg

SEQ ID NO: 535162 - RNA, 59 nt, Homo Sapiens
aucugcuuuugguuauaauguguuuuuaauuaucuaaaguaugaagcauuuucuggggu

SEQ ID NO: 535163 - RNA, 59 nt, Homo Sapiens
uugucaugacauuuccaacacugugugaauuaucuaaaugcgucuaccauuuugcacua

SEQ ID NO: 535164 - RNA, 59 nt, Homo Sapiens
uauuucauaaaauaagaauuuguucuguguuaucuaaagauguaucaguauauugucac

SEQ ID NO: 535165 - RNA, 59 nt, Homo Sapiens
gaacuuauaguaaggaaacucacuugauuuuaucuaaccucaaacuuuccaaguuuaau

SEQ ID NO: 535166 - RNA, 59 nt, Homo Sapiens
auuagaaacaugacauuuaacuuucaagauuaucuaaacaggggaagugaggagaauuu

SEQ ID NO: 535167 - RNA, 59 nt, Homo Sapiens
uccagaugcuuuuguagauguggcuaaaauuaucuaauuaaguuuuaugucccugacuc

SEQ ID NO: 535168 - RNA, 59 nt, Homo Sapiens
ucuucuagaauuuauuuuucuuacagauauuaucuaaauucagggucaaaucauguaca

SEQ ID NO: 535169 - RNA, 59 nt, Homo Sapiens
ggucuuugcauauagaugaaggcuuuuauuuaucuaagagcuaagacuuuuuuuccugu

SEQ ID NO: 535170 - RNA, 59 nt, Homo Sapiens
aaucagaaauacuaguuuaagugcaauuuuuaucuaaccuacaggaucuuucagaucau

SEQ ID NO: 535171 - RNA, 59 nt, Homo Sapiens
cagauggaucuuccuuacaacucauauuuuuaucuaauuaaauaaccaauacuccacug

SEQ ID NO: 535172 - RNA, 59 nt, Homo Sapiens
ccuggaggguggacucugucaucccagcguuaucuaacuuuggccuggcccagcccaag

SEQ ID NO: 535173 - RNA, 59 nt, Homo Sapiens
aaucagauuucacagucucacauuuacacuuaucuaauaauuauacggcuacauuuaca

SEQ ID NO: 535174 - RNA, 59 nt, Homo Sapiens
agaaagaaacagagauaauaaugaaagguuuaucuaagagaaauuaggauaugacauau

SEQ ID NO: 535175 - RNA, 59 nt, Homo Sapiens
cuuuaaaccuaucuuccaggcacaaguuguuaucuaaaccuucaauuuggagugacuaa

SEQ ID NO: 535176 - RNA, 59 nt, Homo Sapiens
cuccacuucuucuugugauguguucuggauuaucuaaugagauuggauagcaaggcugc

SEQ ID NO: 535177 - RNA, 59 nt, Homo Sapiens
uuugugauagggaaacaaauuuggugguguuaucuaauucuccauggacauugcugcuc

SEQ ID NO: 535178 - RNA, 59 nt, Homo Sapiens
agguuauuucaaaguuugcaugcucacaguuaucuaaugaccagguauggaagccuacg

SEQ ID NO: 535179 - RNA, 59 nt, Homo Sapiens
ugaauugagaaaaaauuacaagguacaauuuaucuaaacugggauaauuuuucuauauu

SEQ ID NO: 535180 - RNA, 59 nt, Homo Sapiens
agaaaauaugcagaauaacuuuucaucauuuaucuaaagaucuuuuuuuaaaaaccgaa

SEQ ID NO: 535181 - RNA, 59 nt, Homo Sapiens
uuaacacccuuuugugaagaucacagcauuuaucuaagaaacugugaggcuuucugguu

SEQ ID NO: 535182 - RNA, 59 nt, Homo Sapiens
uuuauauauguauugauuggcaaccagauuuaucuaaguagaacugaauuggcuaggaa

SEQ ID NO: 535183 - RNA, 59 nt, Homo Sapiens
aguaacuugugaauguuaaguaucaucucuuaucuaaauauuaaaagauaagucaaaca

SEQ ID NO: 535184 - RNA, 59 nt, Homo Sapiens
cacaaugucaguauuucaguguaguuaauuuaucuaaauuaaagccuuuaguaucagug

SEQ ID NO: 535185 - RNA, 59 nt, Homo Sapiens
uuauuuuguauaauuuuuaugcucuuugauuaucuaauaaggccaguauuucaaaagcu

SEQ ID NO: 535186 - RNA, 59 nt, Homo Sapiens
cccauuauuaaaucaaccugagccacauguuaucuaaaggaacugauucacaacuuucu

SEQ ID NO: 535187 - RNA, 59 nt, Homo Sapiens
ucuaguguacaucuagcuaaaagugugguuuaucuaaaccguuuuaauaagcaagauga

SEQ ID NO: 535188 - RNA, 59 nt, Homo Sapiens
ucacuugcacaucauggaggguuuagugcuuaucuaauuugugccucacuggacuuguc

SEQ ID NO: 535189 - RNA, 59 nt, Homo Sapiens
guaaguguuuuccggcugauuauuuuuauuuaucuaaaaaguuuagaaauauccuaauc

SEQ ID NO: 535190 - RNA, 59 nt, Homo Sapiens
ugcacugaugaacuagauuaauggcuuucuuaucuaaaccaguaugcccauuuguuuuu

SEQ ID NO: 535191 - RNA, 59 nt, Homo Sapiens
ucugcuagggaauaucaauauuccuuaaauuaucuaaaaccugcuucugauaugcaguu

SEQ ID NO: 535192 - RNA, 59 nt, Homo Sapiens
auuaucuacguuucucucuauauugaggauuaucuaauuaccuuccaagugaauaugau

SEQ ID NO: 535193 - RNA, 59 nt, Homo Sapiens
uuauugugacaacucuagaccugccugcuuuaucuaauguaaucaugcucaaugucuac

SEQ ID NO: 535194 - RNA, 59 nt, Homo Sapiens
aaagaaguaugucaguuauaauaaccugguuaucuaaccuguuccauuccauggaacca

SEQ ID NO: 535195 - RNA, 59 nt, Homo Sapiens
accagcacuagcuuguuccaagcuggaauuuaucuaaucuauuuuuguguuuaaaaaag

SEQ ID NO: 535196 - RNA, 59 nt, Homo Sapiens
uucaggggcuagagugauuuuuuuccagauuaucuaaaguuggaugcccacacuaugaa

SEQ ID NO: 535197 - RNA, 59 nt, Homo Sapiens
ggcuagcaaucugccuguaucucucacuauuaucuaaaagaaaccuuccaaugcuucug

SEQ ID NO: 535198 - RNA, 59 nt, Homo Sapiens
uguuaaaaggcauuuauaauuauuuuuaauuaucuaaguuuuaauacaagaacgauuuc

SEQ ID NO: 535199 - RNA, 59 nt, Homo Sapiens
uguccuuguuaagaauuucuugaagugauuuaucuaaaauaaagguuggcaaacuuuuu

SEQ ID NO: 535200 - RNA, 59 nt, Homo Sapiens
cauuuauuguuuaggaguauaauuuuauuuuaucuaaaauaauagucuauuuuuucuuu

SEQ ID NO: 535201 - RNA, 59 nt, Homo Sapiens
augaaaagggacuuaaaaaguaaacaugauuaucuaaauuacuuaaaauuuuuuaaucu

SEQ ID NO: 535202 - RNA, 59 nt, Homo Sapiens
uuucaauaugcaaguuaggcuuaauuuuuuuaucuaaugaucaucaugaaaugaauaag

SEQ ID NO: 535203 - RNA, 59 nt, Homo Sapiens
aauugguuauauucuaagaugagauaaaguuaucuaacagcuuguaaacagaugugaua

SEQ ID NO: 535204 - RNA, 59 nt, Homo Sapiens
ccagcaaaacagauucaaaggaagucuucuuaucuaaacaauauauaguuagcuuuauu

SEQ ID NO: 535205 - RNA, 59 nt, Homo Sapiens
uguugaauccauucugguuuacucuguguuuaucuaaaauucaagcaaaagaauuauua

SEQ ID NO: 535206 - RNA, 59 nt, Homo Sapiens
uaacugagaaagaaagccuucuuuaagacuuaucuaauuuguuuuuaguaguuucccaa

SEQ ID NO: 535207 - RNA, 59 nt, Homo Sapiens
ucuuuuauuucuuguuuucuuuacaaagguuaucuaaugcuuuuuaauuuuaguaauuu

SEQ ID NO: 535208 - RNA, 59 nt, Homo Sapiens
ccauaaaagugggaauuucaguuguccccuuaucuaacuggagugaugaaucaucaccg

SEQ ID NO: 535209 - RNA, 59 nt, Homo Sapiens
gugcaguuucauuuagauaaccucaagauuuaucuaacauacaggauuuuggcucgaua

SEQ ID NO: 535210 - RNA, 59 nt, Homo Sapiens
augaauguggccacaaagcuaguccgagcuuaucuaaauucuccagaagaggggagcag

SEQ ID NO: 535211 - RNA, 59 nt, Homo Sapiens
cuuccuuuucuuucagaaaucuaauccaauuaucuaaauauuuacaauuuauguauucc

SEQ ID NO: 535212 - RNA, 59 nt, Homo Sapiens
uaaugagaaacucagaaaaaaaacacagcuuaucuaaucgagcuaagacaaacaaaaca

SEQ ID NO: 535213 - RNA, 59 nt, Homo Sapiens
ugcaauaagagagccucucucauuugggcuuaucuaauuuaaaugugaauaugcuuuua

SEQ ID NO: 535214 - RNA, 59 nt, Homo Sapiens
ggaaacugagggcagagagguuaacagauuuaucuaagguccccagcagaauugacagu

SEQ ID NO: 535215 - RNA, 59 nt, Homo Sapiens
ucguguucuguguauaccaaaugauucuguuaucuaaagaagcuuuuugcugggaaaac

SEQ ID NO: 535216 - RNA, 59 nt, Homo Sapiens
accuggcucucucucuguccugccucccauuaucuaacacauuuuuuacauguacauuu

SEQ ID NO: 535217 - RNA, 59 nt, Homo Sapiens
gauuugaucuuuuuucaguuucacauaccuuaucuaagguuucccaggauuuaaacaga

SEQ ID NO: 535218 - RNA, 59 nt, Homo Sapiens
auaauuuuaaaaaaucccuuguaggauuauuaucuaaauuuauaugucuaacuucuacu

SEQ ID NO: 535219 - RNA, 59 nt, Homo Sapiens
uuuggucuuggcuuguucucauaagucauuuaucuaaguuuguguuucugugugugugu

SEQ ID NO: 535220 - RNA, 59 nt, Homo Sapiens
guccccaucugucaaaugagaagauuggauuaucuaaucuuuuagauccuuaacaacuc

SEQ ID NO: 535221 - RNA, 59 nt, Homo Sapiens
gcuggugcuaaauaacagucuuuauuauauuaucuaauuuugacuaaagaaauacuuuu

SEQ ID NO: 535222 - RNA, 59 nt, Homo Sapiens
uucauuugugaguuuggauauagagcacauuaucuaaaccauuuuguaguuccaaaaac

SEQ ID NO: 535223 - RNA, 59 nt, Homo Sapiens
gaaaaaaugaaagcuauuucaugcaaacauuaucuaauuuagcuuaaaagugaaagugg

SEQ ID NO: 535224 - RNA, 59 nt, Homo Sapiens
aagcuugugaauauguaaauuuuaaacuauuaucuaacuaaguguacugaauugucguu

SEQ ID NO: 535225 - RNA, 59 nt, Homo Sapiens
cuuucuauuacuuuuuaggcuuuaguauauuaucuaaaguuuggcuuuugauguggaug

SEQ ID NO: 535226 - RNA, 59 nt, Homo Sapiens
augaaacucccuaguuccuuccgaacgucuuaucuaauccuguccgguggagaucccac

SEQ ID NO: 535227 - RNA, 59 nt, Homo Sapiens
uuuuguuuuguuuuauuauuguuuuacuuuuaucuaaaguacugcuuagcauuuugcau

SEQ ID NO: 535228 - RNA, 59 nt, Homo Sapiens
uacuaaguugguacccuaccauacaaugguuaucuaacauuucauuucugguuuuuacu

SEQ ID NO: 535229 - RNA, 59 nt, Homo Sapiens
guauuaauuguuugguugcuacuauuucauuaucuaaguauuuuguacugagaucauac

SEQ ID NO: 535230 - RNA, 59 nt, Homo Sapiens
auuuuguauucaauguguaaauacuuuuauuaucuaauacuaucuuacgucuaauuagu

SEQ ID NO: 535231 - RNA, 59 nt, Homo Sapiens
gaguauuuauugucaguuuuguucacuuguuaucuaauacaaaauuauaaagccuucag

SEQ ID NO: 535232 - RNA, 59 nt, Homo Sapiens
ggauucauaaggagcuuaucugaacagauuuaucuaagaaaaaaaaaaaacgacauaaa

SEQ ID NO: 535233 - RNA, 59 nt, Homo Sapiens
ugaaaguauucuaagccaaguuuuaaauauuaucuaacagacaagagugguauauacaa

SEQ ID NO: 535234 - RNA, 59 nt, Homo Sapiens
uuuuccugcggcaucagaugaauuguuaauuaucuaauuucugaaaugugcagcuccca

SEQ ID NO: 535235 - RNA, 59 nt, Homo Sapiens
uagacuaauauggguaauuacccuuugguuuaucuaaaguguguucaugaugacugagg

SEQ ID NO: 535236 - RNA, 59 nt, Homo Sapiens
caaugccuuuauuuaaaaaaauugucuacuuaucuaaauauucauaccacaauuucaaa

SEQ ID NO: 535237 - RNA, 59 nt, Homo Sapiens
uaagugauaugagaaaucuuuaaccagccuuaucuaaaaauaaaaagagaagccauugu

SEQ ID NO: 535238 - RNA, 59 nt, Homo Sapiens
ccugccaauguuuaacuuuuaaaagcaucuuaucuaaaagaaaggcuauccaguagagc

SEQ ID NO: 535239 - RNA, 59 nt, Homo Sapiens
aaaaaaacagaaaauuauuugauaaaaaauuaucuaagggagguugauaaaguauuacu

SEQ ID NO: 535240 - RNA, 59 nt, Homo Sapiens
uaaauauacacaaauaugaaaaguuucaguuaucuaaaaauuugcuguuaaauucugug

SEQ ID NO: 535241 - RNA, 59 nt, Homo Sapiens
uuuuuuuuuuuuugguauacuguuuuauuuuaucuaauuucaagaccuauuggggguuu

SEQ ID NO: 535242 - RNA, 59 nt, Homo Sapiens
gcucuaaacucauuaaaaaaacucagugguuaucuaauauguguacauaguuaccuuua

SEQ ID NO: 535243 - RNA, 59 nt, Homo Sapiens
acaaauugucagauuucuuaaaaugucuguuaucuaacucaauuaugaaagugaaaugc

SEQ ID NO: 535244 - RNA, 59 nt, Homo Sapiens
gaaugagccaaaaugacuuuuggucaguauuaucuaaauuuugaaauuguagugcaaaa

SEQ ID NO: 535245 - RNA, 59 nt, Homo Sapiens
aacucaauauuaagauguuauucuugucuuuaucuaauaauuuccccaagccccauuuu

SEQ ID NO: 535246 - RNA, 59 nt, Homo Sapiens
cucagguaugaggcuuuaguuuugucuguuuaucuaauucugaacugcuagcccucccu

SEQ ID NO: 535247 - RNA, 59 nt, Homo Sapiens
gaagaaucuguacuuuguauguauagaauuuaucuaauaaaucauucauagaucauuuu

SEQ ID NO: 535248 - RNA, 59 nt, Homo Sapiens
ugugguccauuuuauuuucuaauauugguuuaucuaauguuuucugcguggugcugucu

SEQ ID NO: 535249 - RNA, 59 nt, Homo Sapiens
ggcaugagcccuugaauuucaggcaccuuuuaucuaaugagaguuuuuacagcucauca

SEQ ID NO: 535250 - RNA, 59 nt, Homo Sapiens
guagcguaauuaaccucucacaaagaugcuuaucuaaccuccccagcagucauggguuu

SEQ ID NO: 535251 - RNA, 59 nt, Homo Sapiens
cacucagcuaccuaauuccucaaugaccuuuaucuaaaaucuccauggaagcaauaaau

SEQ ID NO: 535252 - RNA, 59 nt, Homo Sapiens
gagcugucauuguccuuuauucaacuaguuuaucuaaauuugugauugcuuaggguuuu

SEQ ID NO: 535253 - RNA, 59 nt, Homo Sapiens
acuuauuucagguaauagcuuggggauauuuaucuaaagguacccccaacaaaucuucu

SEQ ID NO: 535254 - RNA, 59 nt, Homo Sapiens
guguguccaguagugcaggaaaugaugucuuaucuaaugauuugcuucucuagaggaga

SEQ ID NO: 535255 - RNA, 59 nt, Homo Sapiens
uauuugccuuaauauaagcuuuuaagcaguuaucuaacuaguguccacaacccuguaac

SEQ ID NO: 535256 - RNA, 59 nt, Homo Sapiens
acguggaauuguacuuguauaugauuaccuuaucuaaaaugaauaagaggugauggacc

SEQ ID NO: 535257 - RNA, 59 nt, Homo Sapiens
gcugcuaugcuauagucuccuuaggcaaguuaucuaaaucauuugugagcugugggacu

SEQ ID NO: 535258 - RNA, 59 nt, Homo Sapiens
aaauauugagaugugcuuuucuacacccuuuaucuaaauuauuucccagcagugacaau

SEQ ID NO: 535259 - RNA, 59 nt, Homo Sapiens
caucagaacauguguuuucacucaacucguuaucuaaagauucauuucuguauuauauu

SEQ ID NO: 535260 - RNA, 59 nt, Homo Sapiens
auuaaucugagcacaucaaguauccaguguuaucuaaaacaagucucugaaagcagaac

SEQ ID NO: 535261 - RNA, 59 nt, Homo Sapiens
uaauuuaaaguuguuugugcuauguacaguuaucuaaguuguguguguauauauauaua

SEQ ID NO: 535262 - RNA, 59 nt, Homo Sapiens
uuuuaaaagaaaauauaccuauuugcuaguuaucuaaugaacugcuccugguauuauau

SEQ ID NO: 535263 - RNA, 59 nt, Homo Sapiens
auaaaaagcucuauaaggaggaaaggccuuuaucuaauucuuaucuacagacacuuacu

SEQ ID NO: 535264 - RNA, 59 nt, Homo Sapiens
uguagccuaaguacguaaacaaauuaauguuaucuaaguuuuucauauuucauggacaa

SEQ ID NO: 535265 - RNA, 59 nt, Homo Sapiens
gcaugauuuuuauauaacuaguuucaguuuuaucuaauaacuuacuuuuuaaaucaaua

SEQ ID NO: 535266 - RNA, 59 nt, Homo Sapiens
ccccugagagaugcucaccaagcuucuauuuaucuaauuuaaaacuugaaaguaaagcc

SEQ ID NO: 535267 - RNA, 59 nt, Homo Sapiens
cucacccaucuaaguugauaucuaaaauuuuaucuaaguugguaucuaaaauuuuucau

SEQ ID NO: 535268 - RNA, 59 nt, Homo Sapiens
uaaaagaccucaggcaccacacuaagaaguuaucuaauggguggagaaccugacagagg

SEQ ID NO: 535269 - RNA, 59 nt, Homo Sapiens
auauguacagcucuccccucucucaucuuuuaucuaacuaaacaugccagaaggaaucu

SEQ ID NO: 535270 - RNA, 59 nt, Homo Sapiens
uuguuagcccuguguauguagaaucuggauuaucuaacaguguaaucaugagaguauaa

SEQ ID NO: 535271 - RNA, 59 nt, Homo Sapiens
gggcaauuaauuccuucagcagguauucguuaucuaauaaucacucuguucauuccucc

SEQ ID NO: 535272 - RNA, 59 nt, Homo Sapiens
uaaaggaaauguuaucaaaacugaaaucauuaucuaaaagcaauaaagucuccuuggua

SEQ ID NO: 535273 - RNA, 59 nt, Homo Sapiens
ucauaauagcaauuauugccauccuguguuuaucuaacuauuuguaaaccaagaaauua

SEQ ID NO: 535274 - RNA, 59 nt, Homo Sapiens
ucuuagaucagugguccccaccugcucaguuaucuaauggaguuaaaguuuuauauuuu

SEQ ID NO: 535275 - RNA, 59 nt, Homo Sapiens
aaagggaauuuuaacuuuucauaaucaguuuaucuaagaacguuaauuuucaguuuuaa

SEQ ID NO: 535276 - RNA, 59 nt, Homo Sapiens
gauuuuguauguuagacuuuuuacauuguuuaucuaauauuauuuaugacaguaauuuu

SEQ ID NO: 535277 - RNA, 59 nt, Homo Sapiens
guaauucuaggagacacguguugaucuaguuaucuaacauuguuguuauaagaaaauga

SEQ ID NO: 535278 - RNA, 59 nt, Homo Sapiens
caacauuuguuuagcuugcuuggcuuuaauuaucuaaagccaaugaaagacuucuuugu

SEQ ID NO: 535279 - RNA, 59 nt, Homo Sapiens
aauagccccaaacugcaauuccauaugacuuaucuaacaucuuggggggaaagaauauu

SEQ ID NO: 535280 - RNA, 59 nt, Homo Sapiens
gacgccauuuucuguuauaaucauuuuuguuaucuaauuuggggaaacuauucaucugu

SEQ ID NO: 535281 - RNA, 59 nt, Homo Sapiens
uggcuagcuauugggcaccaguuuuucuguuaucuaaaauuucacacaacuucauuguu

SEQ ID NO: 535282 - RNA, 59 nt, Homo Sapiens
uuaugguuccaagugcaaaacagguguucuuaucuaaaacgucaauuagaaaauuaucu

SEQ ID NO: 535283 - RNA, 59 nt, Homo Sapiens
uuauauuuuuaucauuccuuuuucuucauuuaucuaaccccaaagcccugauaugccac

SEQ ID NO: 535284 - RNA, 59 nt, Homo Sapiens
augauccgugcuuaaugaucaaguguuacuuaucuaauaauccucuagaaagaacccug

SEQ ID NO: 535285 - RNA, 59 nt, Homo Sapiens
agcuuuuaauuaucuacagcuaacuugauuuaucuaauuuaaucugaaggaugauacug

SEQ ID NO: 535286 - RNA, 59 nt, Homo Sapiens
uguacauaauuuugagguaguugaccagcuuaucuaaaagguguguauucaaauaauac

SEQ ID NO: 535287 - RNA, 59 nt, Homo Sapiens
uauaugauaugcagccgcugauaagucauuuaucuaaucuaaaccuugugauucugcuu

SEQ ID NO: 535288 - RNA, 59 nt, Homo Sapiens
uaaaguugauauuauuuuuguaauaaaauuuaucuaauuuaaaaugauuacuuuaaaaa

SEQ ID NO: 535289 - RNA, 59 nt, Homo Sapiens
uucucagaacacucuccuaaaccaaagcuuuaucuaagcgacucucccagcauguuucu

SEQ ID NO: 535290 - RNA, 59 nt, Homo Sapiens
uugaugaucguagagaaagacuugguaauuuaucuaaguaucuuuaauaaaucuuucag

SEQ ID NO: 535291 - RNA, 59 nt, Homo Sapiens
aggauugaaaaauguauaucacucaauuuuuaucuaagaaggauagguuauaaagggag

SEQ ID NO: 535292 - RNA, 59 nt, Homo Sapiens
aaucuagcuuuuuuguacagacuuagaaauuaucuaaagauuucaucuuuuuaccucau

SEQ ID NO: 535293 - RNA, 59 nt, Homo Sapiens
uuuaguucuaacauugaguuuggacaauuuuaucuaauuguaauucucuagggugccag

SEQ ID NO: 535294 - RNA, 59 nt, Homo Sapiens
gaagauggucacuuuaaccuuguaaauauuuaucuaaaaugauauuuacaaaacuguaa

SEQ ID NO: 535295 - RNA, 59 nt, Homo Sapiens
aaaacaaaggcaaacuuuguacuauccaguuaucuaaggaacaauaaaaacauuaggag

SEQ ID NO: 535296 - RNA, 59 nt, Homo Sapiens
cuguaaguaguugucauauuaaaguuguuuuaucuaauacagguguuuaaaaagaaaga

SEQ ID NO: 535297 - RNA, 59 nt, Homo Sapiens
auuaacauucuaagucuaccauauuuucuuuaucuaaaucugguaaugucuucaguaaa

SEQ ID NO: 535298 - RNA, 59 nt, Homo Sapiens
ggacacuuuuacuguuuucuaaaagauacuuaucuaacuauucuacucucagaggugca

SEQ ID NO: 535299 - RNA, 59 nt, Homo Sapiens
gccugcuucagggcugggcgcaugcaaucuuaucuaaaaucccucaaaauuuucaugga

SEQ ID NO: 535300 - RNA, 59 nt, Homo Sapiens
uuauuguuuguuguggugucaauuuuaaauuaucuaaaucucuugccuuuuuuuuuuua

SEQ ID NO: 535301 - RNA, 59 nt, Homo Sapiens
uaaauuggcccaggguuggcuuugagcauuuaucuaaauuuuccuguggccguuugaac

SEQ ID NO: 535302 - RNA, 59 nt, Homo Sapiens
uuugcauggaaauuaaguaggcuguuuauuuaucuaaaggaaucaaguccacucuucug

SEQ ID NO: 535303 - RNA, 59 nt, Homo Sapiens
aaaccagcagguugcuaaaagaaggcauuuuaucuaaaguuauuuuaauaggugguaua

SEQ ID NO: 535304 - RNA, 59 nt, Homo Sapiens
auuuaaaagguauaaaucaaaauaacaaauuaucuaaaaaaaaucuauccuguacaugu

SEQ ID NO: 535305 - RNA, 59 nt, Homo Sapiens
uaguuagaugaugugacaaccucuaauauuuaucuaauaaauauguauucagaugaaac

SEQ ID NO: 535306 - RNA, 59 nt, Homo Sapiens
uaucacccucauugauauuaucauuggaauuaucuaaggugagccccaguuuccagggc

SEQ ID NO: 535307 - RNA, 59 nt, Homo Sapiens
uaugccaaauuuuauaugaauuuuucagauuaucuaagcuuccagguuuuauaauuaga

SEQ ID NO: 535308 - RNA, 59 nt, Homo Sapiens
gaguuuacaauacugcaaacuguguuauuuuaucuaauccauugcuuaaugaguguguu

SEQ ID NO: 535309 - RNA, 59 nt, Homo Sapiens
auccuauuuagagggugguuuuuuuuaauuuaucuaauggcuacgauauagccagauuc

SEQ ID NO: 535310 - RNA, 59 nt, Homo Sapiens
cugagaacugucacucuaaccucuccagcuuaucuaacaugucauaaacauaauaaauc

SEQ ID NO: 535311 - RNA, 52 nt, Homo Sapiens; identical to SEQ ID NO: 252460

SEQ ID NO: 535312 - RNA, 59 nt, Homo Sapiens
uugcauugacugucacauaaugcucauacuuaucuaauguugaguuauuaauauguuau

SEQ ID NO: 535313 - RNA, 59 nt, Homo Sapiens
acugcaguccuggagcaaucacagaugaguuaucuaagaauacagcuuucugaccuuca

SEQ ID NO: 535314 - RNA, 59 nt, Homo Sapiens
uaagcuaccuuuuguaagugccauguuuauuaucuaaucauuccaaguuuugcauugau

SEQ ID NO: 535315 - RNA, 59 nt, Homo Sapiens
uuaaguaguuuaaguauguuagagugauguuaucuaaguacauuuugguaguauacuuc

SEQ ID NO: 535316 - RNA, 59 nt, Homo Sapiens
cauuucucgaucacugguuuuuuugugccuuaucuaaaauguuaacauucuugguaucu

SEQ ID NO: 535317 - RNA, 59 nt, Homo Sapiens
augauucuagguguugcugguccaaauuguuaucuaaagacuuucuccauggccuauga

SEQ ID NO: 535318 - RNA, 59 nt, Homo Sapiens
acacaugguaauggugaugcugugccuuguuaucuaagaacaugauuguauaauuuguu

SEQ ID NO: 535319 - RNA, 59 nt, Homo Sapiens
guggucccucaaggucuucgaauagauguuuaucuaaccugacaguugcaguuuucacc

SEQ ID NO: 535320 - RNA, 59 nt, Homo Sapiens
auuuuuuaaaaaauaauacuguguuguguuuaucuaaauacguaaacucaagcuaccaa

SEQ ID NO: 535321 - RNA, 59 nt, Homo Sapiens
guaguacagauaaccccucauaaagaugcuuaucuaaccuccccaguguucagguguuu

SEQ ID NO: 535322 - RNA, 59 nt, Homo Sapiens
cacuuauuaccuguaugaacaugggcaaauuaucuaaucucucugaucuauuuuuccuc

SEQ ID NO: 535323 - RNA, 59 nt, Homo Sapiens
gaugggaguggguaaagaguuugggaagguuaucuaacugaaucacuacugaguugaau

SEQ ID NO: 535324 - RNA, 59 nt, Homo Sapiens
aucguaacuugaauaccuugauguagagauuaucuaaaauuuauaauuugaugucucaa

SEQ ID NO: 535325 - RNA, 59 nt, Homo Sapiens
aaauucauuuuuauaucgaagauugauuuuuaucuaaaauaagacaaggucacugugcu

SEQ ID NO: 535326 - RNA, 59 nt, Homo Sapiens
gugcucaagagguucucgacgugccuacauuaucuaacugcuuggaccucgugcuuuaa

SEQ ID NO: 535327 - RNA, 59 nt, Homo Sapiens
ggaggcagaccugaagauggaguguggauuuaucuaaauaagcagcccaacacaaaacg

SEQ ID NO: 535328 - RNA, 59 nt, Homo Sapiens
uaaagcuuccuguuuauacauaaucuuauuuaucuaaacuauaaaauuuuuguaaugga

SEQ ID NO: 535329 - RNA, 59 nt, Homo Sapiens
agaauacauuuaaccugucauaauaaccuuuaucuaaauauggauccaggguauaccuc

SEQ ID NO: 535330 - RNA, 59 nt, Homo Sapiens
aacuacagcuaucuuaauuuaagcaacauuuaucuaauggugaacaacgugaugacaac

SEQ ID NO: 535331 - RNA, 59 nt, Homo Sapiens
auauuacacuuauccaucagucuuccucuuuaucuaacuugauaacugggaaauguuuu

SEQ ID NO: 535332 - RNA, 59 nt, Homo Sapiens
acaugaguaguuggcucugaguggccuucuuaucuaagcauuagaugacguauuuauug

SEQ ID NO: 535333 - RNA, 59 nt, Homo Sapiens
ugcuuugaguuuguauaauaacugaugcuuuaucuaaaaaucaaucuauaauauauuag

SEQ ID NO: 535334 - RNA, 59 nt, Homo Sapiens
ccauuaggguucacgucuuuuguuaauuauuaucuaauuuguacauaugcccccaucca

SEQ ID NO: 535335 - RNA, 59 nt, Homo Sapiens
uaaccuauuuuuguucugguuugguucgguuaucuaauggaaagguaacuggcaaugca

SEQ ID NO: 535336 - RNA, 59 nt, Homo Sapiens
gcccuacaaggauauguuuuccugugaaauuaucuaagagguagguuuagacaucugcu

SEQ ID NO: 535337 - RNA, 59 nt, Homo Sapiens
cuuauguguaucugcaacacccugaaaaauuaucuaauaaaaaggcacaaagaaaaagc

SEQ ID NO: 535338 - RNA, 59 nt, Homo Sapiens
aguugaauuucuuuaaaaaguuuucuauuuuaucuaaaaucuuuccauuauaucuaaau

SEQ ID NO: 535339 - RNA, 59 nt, Homo Sapiens
gcuuuaaaaagucccacugucagauuauauuaucuaacaauugaauauuguaaauauac

SEQ ID NO: 535340 - RNA, 59 nt, Homo Sapiens
uuuuaaauauuuguugaguacuuacguguuuaucuaacaguucacuuccauuuuucuag

SEQ ID NO: 535341 - RNA, 59 nt, Homo Sapiens
uuuuucaucuguuguacauaguuguauuuuuaucuaaugccauuuuagaauuuucuaag

SEQ ID NO: 535342 - RNA, 59 nt, Homo Sapiens
cuucuugcuuuaaguccucacccuuuacauuaucuaauucuucaguuuugaugcugaua

SEQ ID NO: 535343 - RNA, 59 nt, Homo Sapiens
gggguggguaggcacccuccuuccuguuuuuaucuaauaaaaugcuaaccugcccugag

SEQ ID NO: 535344 - RNA, 59 nt, Homo Sapiens
ccuuugacccugcuuauuugucucacugguuaucuaaugaggaacaaacacuaaccuaa

SEQ ID NO: 535345 - RNA, 59 nt, Homo Sapiens
uuaaagaauggccaauuagcugagaagaauuaucuaaucaauuagugaugucugccaug

SEQ ID NO: 535346 - RNA, 59 nt, Homo Sapiens
acucuaggaaucuuaggcagaaagggauuuuaucuaaaucacuggaaaggcuggaggag

SEQ ID NO: 535347 - RNA, 59 nt, Homo Sapiens
uguguuguugcuuuaggcucgagcgauuauuaucuaaagcugggagaggauuuuuuucu

SEQ ID NO: 535348 - RNA, 59 nt, Homo Sapiens
gcuauuaaaacaaccuacugaaaccaguuuuaucuaacaaaacuaccuguuguaaccua

SEQ ID NO: 535349 - RNA, 59 nt, Homo Sapiens
ucaucuagguuuucuuuaaauuuucugaauuaucuaauaguuucuguuugaagugagga

SEQ ID NO: 535350 - RNA, 59 nt, Homo Sapiens
aaagucaaaucuugacagaacuuugugguuuaucuaaggcugugaguuaaaauuguauc

SEQ ID NO: 535351 - RNA, 59 nt, Homo Sapiens
uccuccuaagaguuuuacuaaagugagcuuuaucuaauaggggaaaaagggcuauugcu

SEQ ID NO: 535352 - RNA, 59 nt, Homo Sapiens
uuuuauaugcugcuaaauauccuucccuuuuaucuaauuuuuauuuaauaguaguauuu

SEQ ID NO: 535353 - RNA, 59 nt, Homo Sapiens
uaauauaugcaccuuucagauaaaccuuauuaucuaagguagugugaagcacucauuuc

SEQ ID NO: 535354 - RNA, 59 nt, Homo Sapiens
ccauuucaaaacaaaacuguucccuuauuuuaucuaacacuuacccauucucuauuuau

SEQ ID NO: 535355 - RNA, 59 nt, Homo Sapiens
aacugcgcuguaacaaacuuauuuauauuuuaucuaaauacuuuauauuaugcauaaau

SEQ ID NO: 535356 - RNA, 59 nt, Homo Sapiens
uaagcgcucauucuauuuuaaccucuugauuaucuaaacagaugauaccugaagcuguc

SEQ ID NO: 535357 - RNA, 59 nt, Homo Sapiens
uaucucuucuggacccaugugcaugggucuuaucuaacuacauauagaaauguuugaau

SEQ ID NO: 535358 - RNA, 59 nt, Homo Sapiens
aagacaccucauucaaacaaggcauguaguuaucuaaucaaguacuguucuccuucagu

SEQ ID NO: 535359 - RNA, 59 nt, Homo Sapiens
accauaguacuuaaauugaauuuucucgauuaucuaaaaauguuaagguacaacugugu

SEQ ID NO: 535360 - RNA, 59 nt, Homo Sapiens
ugauuggugaaaugcaggguauguggaaguuaucuaauuaaccucaguuguauaugaau

SEQ ID NO: 535361 - RNA, 59 nt, Homo Sapiens
aaauguauacauuucggaacaacuccauuuuaucuaaaaaaguucuugugauugccagu

SEQ ID NO: 535362 - RNA, 59 nt, Homo Sapiens
uggcagugacaaagugcuagcauuuauuguuaucuaauaaagaccuuggagcauaugug

SEQ ID NO: 535363 - RNA, 59 nt, Homo Sapiens
cauguaauacacagugagacacaguaauuuuaucuaaauuacagugcaguuuaguuaau

SEQ ID NO: 535364 - RNA, 59 nt, Homo Sapiens
uccccagcaauuaagauuucgagcagaauuuaucuaaauguguuucaaggaaacacaau

SEQ ID NO: 535365 - RNA, 59 nt, Homo Sapiens
aaguucaugauagugcuuuuuggaaaguauuaucuaauuccuucugauuuaaguacagc

SEQ ID NO: 535366 - RNA, 59 nt, Homo Sapiens
gugagagcugcauagauccaauagcucacuuaucuaaagaagaucccucugccaaaaau

SEQ ID NO: 535367 - RNA, 59 nt, Homo Sapiens
auggacugcucaggaaacgauuuucccauuuaucuaaauaaaugcuggcuauagauguc

SEQ ID NO: 535368 - RNA, 59 nt, Homo Sapiens
guuucagaauucaaucgugauucucuuuguuaucuaaauagggaggaaaacucaacugu

SEQ ID NO: 535369 - RNA, 59 nt, Homo Sapiens
cucagaucagguuuugaaaggacauauucuuaucuaauuacaggcuugucuuucuaagu

SEQ ID NO: 535370 - RNA, 59 nt, Homo Sapiens
ucaugaaccagaaugaaucauaaacaccauuaucuaacuucagugaacuuucaaaacca

SEQ ID NO: 535371 - RNA, 59 nt, Homo Sapiens
aaucuaauucuguugauuuuggcugaucauuaucuaaagggaauguuguuuucugacua

SEQ ID NO: 535372 - RNA, 59 nt, Homo Sapiens
auuccugucaccacaagaggaacaaauuuuuaucuaaaagaguaagguaagaaaaaugg

SEQ ID NO: 535373 - RNA, 59 nt, Homo Sapiens
uacuuuuacauauuuguaaaucauuaguauuaucuaauggcuagaacucuaccuguguu

SEQ ID NO: 535374 - RNA, 59 nt, Homo Sapiens
aaagcacugcaagaaaauagcaauaguuuuuaucuaauacuaaaaagucaaaacguuaa

SEQ ID NO: 535375 - RNA, 59 nt, Homo Sapiens
uaauacauuccgaggggcucaguucugccuuaucuaaaucaccagagaccaaacaagga

SEQ ID NO: 535376 - RNA, 59 nt, Homo Sapiens
auuaaacauucauaaucaugauuuaaguguuaucuaaauuuaccuuauuaguguuacca

SEQ ID NO: 535377 - RNA, 59 nt, Homo Sapiens
uugauuauauuuuaaagauaaccaggauauuaucuaauggugaauuguagaauuuugau

SEQ ID NO: 535378 - RNA, 59 nt, Homo Sapiens
acaagugugguaaaugccauguuuguacuuuaucuaacaucuucucuuucaguagucuu

SEQ ID NO: 535379 - RNA, 59 nt, Homo Sapiens
cuaauguguguggaaagagguguuccucauuaucuaauauuucaauguguuaagaguuu

SEQ ID NO: 535380 - RNA, 59 nt, Homo Sapiens
uccugacuguaacauauucuguaugaacuuuaucuaaagaaaaauaaaucuguucuggg

SEQ ID NO: 535381 - RNA, 59 nt, Homo Sapiens
aggcauagguacuguuguaccaaggucacuuaucuaacaaaauaacccuucauguauuu

SEQ ID NO: 535382 - RNA, 59 nt, Homo Sapiens
aauuuauuugacaagucugcagacaauccuuaucuaaccagcuauuuucuuaauugcua

SEQ ID NO: 535383 - RNA, 59 nt, Homo Sapiens
ccaucucuauguuucuguucaaaaacagauuaucuaaagggaacauugguuugugaagg

SEQ ID NO: 535384 - RNA, 59 nt, Homo Sapiens
uauaacauacaauuauuuuacauucccuguuaucuaaauugaacuaaggcuaccaaaua

SEQ ID NO: 535385 - RNA, 59 nt, Homo Sapiens
aguaaauguauuugccuuugacuuugguuuuaucuaaaauaaaaguuaauugauauuau

SEQ ID NO: 535386 - RNA, 59 nt, Homo Sapiens
aguugcuggaaaaucauauucaaauuucauuaucuaaugccacccacaaagaaacaaag

SEQ ID NO: 535387 - RNA, 59 nt, Homo Sapiens
ucgugcggaaucagcuucuacaagauaguuuaucuaacuuuguaaugauugauuaaaug

SEQ ID NO: 535388 - RNA, 59 nt, Homo Sapiens
uuauauguucaccaaugggaggucaauauuuaucuaauuuaaaagguaugcuaaccacu

SEQ ID NO: 535389 - RNA, 59 nt, Homo Sapiens
gcaaggcaaaaauguaugccacaucucaguuaucuaaacuagauuagauccaagccaag

SEQ ID NO: 535390 - RNA, 59 nt, Homo Sapiens
uaacaauucacaaggcacuuucacacccauuaucuaauuuaauccucauaaugacuaug

SEQ ID NO: 535391 - RNA, 59 nt, Homo Sapiens
uuguccaagagcacacugaaaguugaauguuaucuaaugcauuccucuaccuuucagaa

SEQ ID NO: 535392 - RNA, 59 nt, Homo Sapiens
agguugguggaaugaaugcgagcugaguauuaucuaaacuagaauuugaauaugaccca

SEQ ID NO: 535393 - RNA, 59 nt, Homo Sapiens
uauuuuucaaaaauuuuuugcguuuuuaauuaucuaauuuccagcuuugcuggaaaaga

SEQ ID NO: 535394 - RNA, 59 nt, Homo Sapiens
uuaccauuuugggguacccacugcucugguuaucuaauauguaacaagccaccccaaau

SEQ ID NO: 535395 - RNA, 59 nt, Homo Sapiens
aacuuaugaccucuuccuuuaggagggaguuaucuaaaagaaaugucuauuaaggugau

SEQ ID NO: 535396 - RNA, 59 nt, Homo Sapiens
aaaaaacacuauuuuacuuaaacuguuucuuaucuaaauucuugcagagugucaauguu

SEQ ID NO: 535397 - RNA, 59 nt, Homo Sapiens
uuugagaccagaauaagccuaagauaaucuuaucuaauugucaauauucauuucaguag

SEQ ID NO: 535398 - RNA, 59 nt, Homo Sapiens
auauguauaugcugugucauuuuuauauauuaucuaaauuuccugcgguuuauucuaug

SEQ ID NO: 535399 - RNA, 59 nt, Homo Sapiens
aguacaguuucauauuugaguuugcagaauuaucuaauagucuuuuuuuggcuaauauu

SEQ ID NO: 535400 - RNA, 59 nt, Homo Sapiens
guauucagggaaccugucuuaaauugugcuuaucuaaaucuuggaacuuugagcuaggg

SEQ ID NO: 535401 - RNA, 59 nt, Homo Sapiens
uacuuuuagaguugaaacagaguaauaacuuaucuaacccucuuuuccuacaaaggaga

SEQ ID NO: 535402 - RNA, 59 nt, Homo Sapiens
accacucuuauacaggaaaacuguccaaauuaucuaaagauccuccugagaagcuuaaa

SEQ ID NO: 535403 - RNA, 59 nt, Homo Sapiens
aucaggugcagugucaguuucaaaucaaauuaucuaagaaaacaagaaaacaaaggcag

SEQ ID NO: 535404 - RNA, 59 nt, Homo Sapiens
ggucaugacaaggaaaaaaaacaccacauuuaucuaagaagugauuuuggcugcaggac

SEQ ID NO: 535405 - RNA, 59 nt, Homo Sapiens
auuagcuuuguccuaccaacuucuggaauuuaucuaauuauuguuuuucaaaguuucuu

SEQ ID NO: 535406 - RNA, 59 nt, Homo Sapiens
ucagguguacagguuauucuggguuaauuuuaucuaaugaagcccauuccuuuuuguac

SEQ ID NO: 535407 - RNA, 59 nt, Homo Sapiens
uauaaaaagguguuuugaugcagguagaauuaucuaauucuuaaacccauauuguaaaa

SEQ ID NO: 535408 - RNA, 51 nt, Homo Sapiens; identical to SEQ ID NO: 252557

SEQ ID NO: 535409 - RNA, 59 nt, Homo Sapiens
uaauaaagucagacaaaauguggccuaaauuaucuaauguaauugcaaauagguaggag

SEQ ID NO: 535410 - RNA, 59 nt, Homo Sapiens
uuugacaugguagaccuugcuuguucugauuaucuaaaaugguauuuaaucccaaagug

SEQ ID NO: 535411 - RNA, 59 nt, Homo Sapiens
aaaucuuaaauaaauuuucaaacaaauauuuaucuaaauuauggagcuauuccauuuua

SEQ ID NO: 535412 - RNA, 59 nt, Homo Sapiens
gcaaauaaggauguguucucgaucugcuuuuaucuaaauagaaaugagugaaugugggu

SEQ ID NO: 535413 - RNA, 59 nt, Homo Sapiens
caccauucuguagccacccauccuuugccuuaucuaacaaacauuuuuccaggaaggug

SEQ ID NO: 535414 - RNA, 59 nt, Homo Sapiens
aaugcuacaauaguuuuuuaucuauaaaauuaucuaaagaaucauugucuuucagagac

SEQ ID NO: 535415 - RNA, 59 nt, Homo Sapiens
gcuacugaaacacccacuguaagccaguuuuaucuaacgaaauuuccugcuguauccag

SEQ ID NO: 535416 - RNA, 59 nt, Homo Sapiens
uaaaauucuagacugcuuucuguaugauuuuaucuaaaggcaaaaauaauacauggaau

SEQ ID NO: 535417 - RNA, 59 nt, Homo Sapiens
ugugaauucucugaauacugucaacacucuuaucuaaguuugccuuuaugaugcagugg

SEQ ID NO: 535418 - RNA, 59 nt, Homo Sapiens
uccuucaggggagccucaguuuugcccauuuaucuaauugaaucaguuuuuuacccaau

SEQ ID NO: 535419 - RNA, 59 nt, Homo Sapiens
aaucccccgauuuuguaggauaaucucccuuaucuaaagucaacugauuauggacuuua

SEQ ID NO: 535420 - RNA, 59 nt, Homo Sapiens
ugaauuggagguuuauuuuuuaauauauauuaucuaagaagagaucugugugugugaug

SEQ ID NO: 535421 - RNA, 59 nt, Homo Sapiens
ucuuugggacaaaacagaaguccauggaguuaucuaagcucuuguaagugaguuaauuu

SEQ ID NO: 535422 - RNA, 59 nt, Homo Sapiens
caugaaagaacacguacugguuacaguucuuaucuaagauguucuaaagccuuucauuu

SEQ ID NO: 535423 - RNA, 59 nt, Homo Sapiens
ucaccaaauucacauugcaguaacaauccuuaucuaacauugaauagcgucuuuuuauu

SEQ ID NO: 535424 - RNA, 59 nt, Homo Sapiens
ugacccugcaauuuacaugaauacuguuuuuaucuaauggucaguuuauagacugaaca

SEQ ID NO: 535425 - RNA, 59 nt, Homo Sapiens
uaucaccuuuguauucaccuauaaugaauuuaucuaaucaaaccaucaucagagucaca

SEQ ID NO: 535426 - RNA, 59 nt, Homo Sapiens
gacuuuggcuuuuguaaaucccuggccuuuuaucuaaagguaucuauguugguacgacu

SEQ ID NO: 535427 - RNA, 59 nt, Homo Sapiens
caagcuugagaaugaauguacuggauagauuaucuaaguuauagaaaucuuggucaggg

SEQ ID NO: 535428 - RNA, 59 nt, Homo Sapiens
auuauucucuguauauaacucaccauacuuuaucuaauugugugaaaucuaguuuuuau

SEQ ID NO: 535429 - RNA, 59 nt, Homo Sapiens
aaaaugauaauuaaaaugcuguaaccaacuuaucuaauaaaauuggcaaccagccacua

SEQ ID NO: 535430 - RNA, 59 nt, Homo Sapiens
gaguaacuguaauuggauguuuauuguuuuuaucuaaaguaagguguauguguuugaga

SEQ ID NO: 535431 - RNA, 59 nt, Homo Sapiens
uuagccagcucuuccugucagggcacagauuaucuaaaagauuagacacuucaguguca

SEQ ID NO: 535432 - RNA, 59 nt, Homo Sapiens
cacagccauucuguucucacguaguuuuauuaucuaaggaggguuaacucuuuauuuuu

SEQ ID NO: 535433 - RNA, 59 nt, Homo Sapiens
ucguucaacagugugagcauuugucucuguuaucuaaugauguucucugacccagcaga

SEQ ID NO: 535434 - RNA, 59 nt, Homo Sapiens
cuugguuauaauuuauaacuuacuuauuuuuaucuaauaauuguagauucaguguauuu

SEQ ID NO: 535435 - RNA, 59 nt, Homo Sapiens
uagaauuaauuuaaagccuuaaacaaaauuuaucuaaagaaauaacuucuauuacuguc

SEQ ID NO: 535436 - RNA, 59 nt, Homo Sapiens
uuacuuuuuauucaucuuuguguuuuuauuuaucuaaaauggguauugauuuuuaggac

SEQ ID NO: 535437 - RNA, 59 nt, Homo Sapiens
augucaaucgauaaacccuacuuuccaaauuaucuaaaagauuaccauuuggggcccuu

SEQ ID NO: 535438 - RNA, 59 nt, Homo Sapiens
gauuaccauuuggggcccuuguuuucaaguuaucuaacugaaauauuauuaauuuuuuu

SEQ ID NO: 535439 - RNA, 59 nt, Homo Sapiens
auauaccuauauauguuuguaucuaugacuuaucuaaucugccuaucaaucuaucuagu

SEQ ID NO: 535440 - RNA, 59 nt, Homo Sapiens
uuucuaaaacaacuugaaguauaguuuuguuaucuaagcaauuuuuguuuuaaguaagu

SEQ ID NO: 535441 - RNA, 59 nt, Homo Sapiens
cuaaugaaauuccuuuuauaauucucagcuuaucuaaacagccuggaaaacuuuugugu

SEQ ID NO: 535442 - RNA, 59 nt, Homo Sapiens
cuuaguuuccuggaauaauaauuuuuuucuuaucuaaauuaaauuaggguugguauuuc

SEQ ID NO: 535443 - RNA, 59 nt, Homo Sapiens
guccugaaauccacuugucagagugugguuuaucuaaaucuaagaguacaaagccaaga

SEQ ID NO: 535444 - RNA, 59 nt, Homo Sapiens
uauuugacuuaaaaauaucgaaacuguuuuuaucuaagaagacaagcugaaacaacaca

SEQ ID NO: 535445 - RNA, 59 nt, Homo Sapiens
cauguuaguuuggugcuacauguugucaauuaucuaaagauucuucaaaauauguaagc

SEQ ID NO: 535446 - RNA, 59 nt, Homo Sapiens
ucagacaucuaguggggcaggacucugaguuaucuaauggagacuuguuggagaggcgg

SEQ ID NO: 535447 - RNA, 59 nt, Homo Sapiens
cuucugccugaaaugugcuuagagcucaguuaucuaaggauucucugacacuagugcau

SEQ ID NO: 535448 - RNA, 64 nt, Homo Sapiens; identical to SEQ ID NO: 478274

SEQ ID NO: 535449 - RNA, 64 nt, Homo Sapiens; identical to SEQ ID NO: 478275

SEQ ID NO: 535450 - RNA, 64 nt, Homo Sapiens; identical to SEQ ID NO: 478276

SEQ ID NO: 535451 - RNA, 64 nt, Homo Sapiens; identical to SEQ ID NO: 478277

SEQ ID NO: 535452 - RNA, 64 nt, Homo Sapiens; identical to SEQ ID NO: 478278

SEQ ID NO: 535453 - RNA, 64 nt, Homo Sapiens; identical to SEQ ID NO: 478279

SEQ ID NO: 535454 - RNA, 64 nt, Homo Sapiens; identical to SEQ ID NO: 478280

SEQ ID NO: 535455 - RNA, 64 nt, Homo Sapiens; identical to SEQ ID NO: 478281

SEQ ID NO: 535456 - RNA, 64 nt, Homo Sapiens; identical to SEQ ID NO: 478282

SEQ ID NO: 535457 - RNA, 64 nt, Homo Sapiens; identical to SEQ ID NO: 478283

SEQ ID NO: 535458 - RNA, 64 nt, Homo Sapiens; identical to SEQ ID NO: 478284

SEQ ID NO: 535459 - RNA, 64 nt, Homo Sapiens; identical to SEQ ID NO: 478285

SEQ ID NO: 535460 - RNA, 64 nt, Homo Sapiens; identical to SEQ ID NO: 478286

SEQ ID NO: 535461 - RNA, 64 nt, Homo Sapiens; identical to SEQ ID NO: 478287

SEQ ID NO: 535462 - RNA, 64 nt, Homo Sapiens; identical to SEQ ID NO: 478288

SEQ ID NO: 535463 - RNA, 64 nt, Homo Sapiens; identical to SEQ ID NO: 478289

SEQ ID NO: 535464 - RNA, 64 nt, Homo Sapiens; identical to SEQ ID NO: 478290

SEQ ID NO: 535465 - RNA, 64 nt, Homo Sapiens; identical to SEQ ID NO: 478291

SEQ ID NO: 535466 - RNA, 64 nt, Homo Sapiens; identical to SEQ ID NO: 478292

SEQ ID NO: 535467 - RNA, 64 nt, Homo Sapiens; identical to SEQ ID NO: 478293

SEQ ID NO: 535468 - RNA, 64 nt, Homo Sapiens; identical to SEQ ID NO: 478294

SEQ ID NO: 535469 - RNA, 64 nt, Homo Sapiens; identical to SEQ ID NO: 478295

SEQ ID NO: 535470 - RNA, 64 nt, Homo Sapiens; identical to SEQ ID NO: 478296

SEQ ID NO: 535471 - RNA, 64 nt, Homo Sapiens; identical to SEQ ID NO: 478297

SEQ ID NO: 535472 - RNA, 64 nt, Homo Sapiens
cuguguaagucuuugcauuuaagacauccaaucaauaaugaaggaaauuuuuuucugaauguag

SEQ ID NO: 535473 - RNA, 64 nt, Homo Sapiens
uuuauuguuggggauauuaacaaaugugauuuguauaaugaaaugcauuucauuuggaagaauu

SEQ ID NO: 535474 - RNA, 64 nt, Homo Sapiens
uaacuuaaacagaaauauccacuugccucuauuuauaaugaagauucauaugauugugcagaaa

SEQ ID NO: 535475 - RNA, 64 nt, Homo Sapiens
gagcuuucucuauagccauaguuaaacaauuguaauaaugaaauauaacccauguuacaaggaa

SEQ ID NO: 535476 - RNA, 64 nt, Homo Sapiens
uuuccuauucuaaaauaucaaauuuaaaauaaagauaaugaaagaaaacauaagagaacuauug

SEQ ID NO: 535477 - RNA, 64 nt, Homo Sapiens
ugagcauaaucauuccuuggaguuauacuaacuaauaaugaauauuaaaugauuuuucuucagu

SEQ ID NO: 535478 - RNA, 64 nt, Homo Sapiens
uauuuuaagucuacaaaaagguauaaauaauaauauaaugaauuccuauauaccuaauacccag

SEQ ID NO: 535479 - RNA, 64 nt, Homo Sapiens
aaaucucuuuuuaagauagacuuauucuuuuauaauaaugaaugugcacucauacauauguaga

SEQ ID NO: 535480 - RNA, 55 nt, Homo Sapiens
caucuuugaaaaauguaugaaaggaauaaugaaaaggguaaaaagaacaaggggu

SEQ ID NO: 535481 - RNA, 64 nt, Homo Sapiens
gaaaagauaaucaaggccuacauuuuagcugaggauaaugaacuuuuuuccucauucggcugua

SEQ ID NO: 535482 - RNA, 64 nt, Homo Sapiens
ccuauuaguggaggagggagaaccauauuuauuuauaaugaagacaucuaagaucccuaugaug

SEQ ID NO: 535483 - RNA, 64 nt, Homo Sapiens
uucugugaauuauugaauuuaagagcccugcuaaauaaugaaaaaacacuuuacuaaaauuuau

SEQ ID NO: 535484 - RNA, 64 nt, Homo Sapiens
gacuaauauucagauuccauuuucaauaagguaaauaaugaaagaucucacaaaggaaucauug

SEQ ID NO: 535485 - RNA, 64 nt, Homo Sapiens
aguuaaaaugcuuuuuacucugguguauuauagaauaaugaacacauuuuuauauauguuaaag

SEQ ID NO: 535486 - RNA, 64 nt, Homo Sapiens
auucuuuuucuuuuaaauuuguugcuaaucucugauaaugaagauucuuacucugauucucagc

SEQ ID NO: 535487 - RNA, 64 nt, Homo Sapiens
aaugaauugcucugugcugaaauuugaagaccagauaaugaaacugaaaagcaaacaauuuuac

SEQ ID NO: 535488 - RNA, 64 nt, Homo Sapiens
aguuauugacuuuauauucaauuauuuacaucaaauaaugaaauaacugaaauguacaaauguc

SEQ ID NO: 535489 - RNA, 64 nt, Homo Sapiens
gaauauuguauguugcauuccacuucauuugaaaauaaugaaaccauguaccacuguuuacauc

SEQ ID NO: 535490 - RNA, 64 nt, Homo Sapiens
uuuccaaaaugacuucuuaaacaaaacaaauauuauaaugaauugucuggagaggaccucuuca

SEQ ID NO: 535491 - RNA, 64 nt, Homo Sapiens
ucccagacuucacaggaagauagauauucuugagauaaugaaaagugauaucuucgcauacgaa

SEQ ID NO: 535492 - RNA, 64 nt, Homo Sapiens
caccaugaauauacuuuuuucugugauuuucauaauaaugaagauuuccugaugagucauauua

SEQ ID NO: 535493 - RNA, 64 nt, Homo Sapiens
uagaaaucuaucuccauaaaucuaauaaucccgaauaaugaacguguucaaacugaaggaaauu

SEQ ID NO: 535494 - RNA, 64 nt, Homo Sapiens
gugagagauuuuuaaauaaaaucuuguaacuuugauaaugaacaagucugucuauugguaugca

SEQ ID NO: 535495 - RNA, 64 nt, Homo Sapiens
ugaaaccuuuggccuaagaagucuucuguaaaauauaaugaagcgacuuaccggaccacugaag

SEQ ID NO: 535496 - RNA, 64 nt, Homo Sapiens
gggguguugguuuaugcgugcugcagcagugggcauaaugaauauaauuuacccaguggacaaa

SEQ ID NO: 535497 - RNA, 64 nt, Homo Sapiens
uuuuuaaaaaagaaaaacaaacuauugauuguagauaaugaaaagcuaggguuugcccucuuca

SEQ ID NO: 535498 - RNA, 64 nt, Homo Sapiens
cauauguaugugugguuacuuuuuauaaugugaaauaaugaauaaugaauuuacucaaaauaaa

SEQ ID NO: 535499 - RNA, 64 nt, Homo Sapiens
augugugguuacuuuuuauaaugugaaauaaugaauaaugaauuuacucaaaauaaaacauagg

SEQ ID NO: 535500 - RNA, 64 nt, Homo Sapiens
ugccauuuggcugcuccuuacugcgaucuuagaaauaaugaaggaugaaaauuaaguacagagg

SEQ ID NO: 535501 - RNA, 64 nt, Homo Sapiens
aggauaaugcaaaaauuauguuucauuuagauguauaaugaaaauacuuuuaucaguagaauga

SEQ ID NO: 535502 - RNA, 64 nt, Homo Sapiens
uauggcuucacauucauugcgguauuuguucaaaauaaugaaguuuuuucuuacacacuaaaug

SEQ ID NO: 535503 - RNA, 64 nt, Homo Sapiens
uaacuagaaagugaguuaaugaguuugacuuagaauaaugaaggcacuucaguccuuuucugaa

SEQ ID NO: 535504 - RNA, 64 nt, Homo Sapiens
uagaaauuauaacacuaggguaaacaguuguaaaauaaugaaggaaagcauacagucuaaauaa

SEQ ID NO: 535505 - RNA, 64 nt, Homo Sapiens
accugauucauugucccuuuuauuacuucuccaaauaaugaacucaugugauguuuauagucug

SEQ ID NO: 535506 - RNA, 64 nt, Homo Sapiens
cuuggcuuuaguuuuauaucauauuuagaaaauaauaaugaaaagcauccccaaaauuucaaug

SEQ ID NO: 535507 - RNA, 64 nt, Homo Sapiens
ugucuaccaagaacaauugaguuuucuaaaaguaauaaugaagauuaugcaauucuaacuguag

SEQ ID NO: 535508 - RNA, 64 nt, Homo Sapiens
agagaauuugcaugagaggagaguacuuaugaguauaaugaauauugagaaaucuuuuaucaac

SEQ ID NO: 535509 - RNA, 64 nt, Homo Sapiens
uccaagaugacuugguuggggggcacuguaugccauaaugaaugugagaaagcugucauuuaaa

SEQ ID NO: 535510 - RNA, 64 nt, Homo Sapiens
auuccagagcaaaacacauuguggcuuuauauugauaaugaaauggggguggggcugggaccgg

SEQ ID NO: 535511 - RNA, 64 nt, Homo Sapiens
uacaaauccauccuuauuuccugaaaaagaacuuauaaugaagcuuagguaggggagaacauuu

SEQ ID NO: 535512 - RNA, 64 nt, Homo Sapiens
cuaggaaaugagaguuggcauuaaacagugugauguguguuaucgacuauucuuucccccacuc

SEQ ID NO: 535513 - RNA, 64 nt, Homo Sapiens
uugagucaugaauguacaagauuuggguuugaggguguguuauuguugaaauggcuuuagaauc

SEQ ID NO: 535514 - RNA, 64 nt, Homo Sapiens
gaccaaaauucuuggcauaacugaugaauaaaaaguguguuaaaaggauaucccucaccuguuc

SEQ ID NO: 535515 - RNA, 64 nt, Homo Sapiens
uaaacagcacuaguacuguacaauguauaaucugguguguuauuguguaguuuuaauuaugcug

SEQ ID NO: 535516 - RNA, 64 nt, Homo Sapiens
cuccaguuuucgggggaagcugguauuugacauaguguguuaaacagcuccugagaaccuuugg

SEQ ID NO: 535517 - RNA, 64 nt, Homo Sapiens
ucauuuagucguguacguaaaaacucuccuuuuaguguguuauuuucuuggccuucccuuuuaa

SEQ ID NO: 535518 - RNA, 64 nt, Homo Sapiens
acuuacaagagucuugaaaaggcugcuuauggcuguguguuacuaaagggaccauaagcauuuu

SEQ ID NO: 535519 - RNA, 64 nt, Homo Sapiens
ccaaaugaacgguucuagccuuaacaccagauuaguguguuacccaagaacacaugaaauucuu

SEQ ID NO: 535520 - RNA, 64 nt, Homo Sapiens
guagcaauaacaaaaaguagguuugcacacacgcguguguuauuuguguguguguguuaugugu

SEQ ID NO: 535521 - RNA, 64 nt, Homo Sapiens
uguguuugcacacacgcgugcuuuaaguguguguguguguuauguguggaggagugaaauggag

SEQ ID NO: 535522 - RNA, 64 nt, Homo Sapiens; identical to SEQ ID NO: 115405

SEQ ID NO: 535523 - RNA, 64 nt, Homo Sapiens; identical to SEQ ID NO: 115406

SEQ ID NO: 535524 - RNA, 64 nt, Homo Sapiens; identical to SEQ ID NO: 115407

SEQ ID NO: 535525 - RNA, 64 nt, Homo Sapiens; identical to SEQ ID NO: 115408

SEQ ID NO: 535526 - RNA, 64 nt, Homo Sapiens; identical to SEQ ID NO: 115409

SEQ ID NO: 535527 - RNA, 64 nt, Homo Sapiens; identical to SEQ ID NO: 115410

SEQ ID NO: 535528 - RNA, 64 nt, Homo Sapiens; identical to SEQ ID NO: 115411

SEQ ID NO: 535529 - RNA, 64 nt, Homo Sapiens; identical to SEQ ID NO: 115412

SEQ ID NO: 535530 - RNA, 64 nt, Homo Sapiens; identical to SEQ ID NO: 115413

SEQ ID NO: 535531 - RNA, 64 nt, Homo Sapiens; identical to SEQ ID NO: 115414

SEQ ID NO: 535532 - RNA, 64 nt, Homo Sapiens; identical to SEQ ID NO: 115415

SEQ ID NO: 535533 - RNA, 64 nt, Homo Sapiens; identical to SEQ ID NO: 115416

SEQ ID NO: 535534 - RNA, 64 nt, Homo Sapiens; identical to SEQ ID NO: 115417

SEQ ID NO: 535535 - RNA, 64 nt, Homo Sapiens; identical to SEQ ID NO: 115418

SEQ ID NO: 535536 - RNA, 64 nt, Homo Sapiens; identical to SEQ ID NO: 115419

SEQ ID NO: 535537 - RNA, 64 nt, Homo Sapiens; identical to SEQ ID NO: 115420

SEQ ID NO: 535538 - RNA, 64 nt, Homo Sapiens; identical to SEQ ID NO: 115421

SEQ ID NO: 535539 - RNA, 64 nt, Homo Sapiens; identical to SEQ ID NO: 115422

SEQ ID NO: 535540 - RNA, 64 nt, Homo Sapiens; identical to SEQ ID NO: 115423

SEQ ID NO: 535541 - RNA, 64 nt, Homo Sapiens; identical to SEQ ID NO: 115424

SEQ ID NO: 535542 - RNA, 64 nt, Homo Sapiens; identical to SEQ ID NO: 115425

SEQ ID NO: 535543 - RNA, 64 nt, Homo Sapiens; identical to SEQ ID NO: 115426

SEQ ID NO: 535544 - RNA, 64 nt, Homo Sapiens; identical to SEQ ID NO: 115427

SEQ ID NO: 535545 - RNA, 64 nt, Homo Sapiens; identical to SEQ ID NO: 115428

SEQ ID NO: 535546 - RNA, 64 nt, Homo Sapiens; identical to SEQ ID NO: 115429

SEQ ID NO: 535547 - RNA, 64 nt, Homo Sapiens; identical to SEQ ID NO: 115430

SEQ ID NO: 535548 - RNA, 64 nt, Homo Sapiens; identical to SEQ ID NO: 115431

SEQ ID NO: 535549 - RNA, 64 nt, Homo Sapiens; identical to SEQ ID NO: 115432

SEQ ID NO: 535550 - RNA, 64 nt, Homo Sapiens; identical to SEQ ID NO: 115433

SEQ ID NO: 535551 - RNA, 64 nt, Homo Sapiens; identical to SEQ ID NO: 115434

SEQ ID NO: 535552 - RNA, 64 nt, Homo Sapiens; identical to SEQ ID NO: 115435

SEQ ID NO: 535553 - RNA, 64 nt, Homo Sapiens; identical to SEQ ID NO: 115436

SEQ ID NO: 535554 - RNA, 64 nt, Homo Sapiens; identical to SEQ ID NO: 115437

SEQ ID NO: 535555 - RNA, 64 nt, Homo Sapiens; identical to SEQ ID NO: 115438

SEQ ID NO: 535556 - RNA, 64 nt, Homo Sapiens; identical to SEQ ID NO: 115439

SEQ ID NO: 535557 - RNA, 64 nt, Homo Sapiens; identical to SEQ ID NO: 115440

SEQ ID NO: 535558 - RNA, 55 nt, Homo Sapiens; identical to SEQ ID NO: 115441

SEQ ID NO: 535559 - RNA, 64 nt, Homo Sapiens; identical to SEQ ID NO: 115442

SEQ ID NO: 535560 - RNA, 64 nt, Homo Sapiens; identical to SEQ ID NO: 115443

SEQ ID NO: 535561 - RNA, 64 nt, Homo Sapiens; identical to SEQ ID NO: 115444

SEQ ID NO: 535562 - RNA, 64 nt, Homo Sapiens; identical to SEQ ID NO: 115445

SEQ ID NO: 535563 - RNA, 64 nt, Homo Sapiens; identical to SEQ ID NO: 115446

SEQ ID NO: 535564 - RNA, 64 nt, Homo Sapiens; identical to SEQ ID NO: 115447

SEQ ID NO: 535565 - RNA, 64 nt, Homo Sapiens; identical to SEQ ID NO: 115448

SEQ ID NO: 535566 - RNA, 64 nt, Homo Sapiens; identical to SEQ ID NO: 115449

SEQ ID NO: 535567 - RNA, 64 nt, Homo Sapiens; identical to SEQ ID NO: 115450

SEQ ID NO: 535568 - RNA, 64 nt, Homo Sapiens; identical to SEQ ID NO: 115451

SEQ ID NO: 535569 - RNA, 64 nt, Homo Sapiens; identical to SEQ ID NO: 115452

SEQ ID NO: 535570 - RNA, 64 nt, Homo Sapiens; identical to SEQ ID NO: 115453

SEQ ID NO: 535571 - RNA, 64 nt, Homo Sapiens; identical to SEQ ID NO: 115454

SEQ ID NO: 535572 - RNA, 64 nt, Homo Sapiens; identical to SEQ ID NO: 115455

SEQ ID NO: 535573 - RNA, 64 nt, Homo Sapiens; identical to SEQ ID NO: 115456

SEQ ID NO: 535574 - RNA, 64 nt, Homo Sapiens; identical to SEQ ID NO: 115457

SEQ ID NO: 535575 - RNA, 64 nt, Homo Sapiens; identical to SEQ ID NO: 115458

SEQ ID NO: 535576 - RNA, 57 nt, Homo Sapiens; identical to SEQ ID NO: 115459

SEQ ID NO: 535577 - RNA, 64 nt, Homo Sapiens; identical to SEQ ID NO: 115460

SEQ ID NO: 535578 - RNA, 64 nt, Homo Sapiens; identical to SEQ ID NO: 115461

SEQ ID NO: 535579 - RNA, 64 nt, Homo Sapiens; identical to SEQ ID NO: 115462

SEQ ID NO: 535580 - RNA, 64 nt, Homo Sapiens; identical to SEQ ID NO: 115463

SEQ ID NO: 535581 - RNA, 64 nt, Homo Sapiens; identical to SEQ ID NO: 115464

SEQ ID NO: 535582 - RNA, 64 nt, Homo Sapiens; identical to SEQ ID NO: 115465

SEQ ID NO: 535583 - RNA, 64 nt, Homo Sapiens; identical to SEQ ID NO: 115466

SEQ ID NO: 535584 - RNA, 64 nt, Homo Sapiens; identical to SEQ ID NO: 115467

SEQ ID NO: 535585 - RNA, 64 nt, Homo Sapiens; identical to SEQ ID NO: 115468

SEQ ID NO: 535586 - RNA, 64 nt, Homo Sapiens; identical to SEQ ID NO: 115469

SEQ ID NO: 535587 - RNA, 64 nt, Homo Sapiens; identical to SEQ ID NO: 115470

SEQ ID NO: 535588 - RNA, 64 nt, Homo Sapiens; identical to SEQ ID NO: 115471

SEQ ID NO: 535589 - RNA, 64 nt, Homo Sapiens; identical to SEQ ID NO: 115472

SEQ ID NO: 535590 - RNA, 64 nt, Homo Sapiens; identical to SEQ ID NO: 115473

SEQ ID NO: 535591 - RNA, 64 nt, Homo Sapiens; identical to SEQ ID NO: 115474

SEQ ID NO: 535592 - RNA, 64 nt, Homo Sapiens; identical to SEQ ID NO: 115475

SEQ ID NO: 535593 - RNA, 59 nt, Homo Sapiens; identical to SEQ ID NO: 115476

SEQ ID NO: 535594 - RNA, 64 nt, Homo Sapiens; identical to SEQ ID NO: 115477

SEQ ID NO: 535595 - RNA, 64 nt, Homo Sapiens; identical to SEQ ID NO: 115478

SEQ ID NO: 535596 - RNA, 64 nt, Homo Sapiens; identical to SEQ ID NO: 115479

SEQ ID NO: 535597 - RNA, 64 nt, Homo Sapiens; identical to SEQ ID NO: 115480

SEQ ID NO: 535598 - RNA, 64 nt, Homo Sapiens; identical to SEQ ID NO: 115481

SEQ ID NO: 535599 - RNA, 64 nt, Homo Sapiens; identical to SEQ ID NO: 115482

SEQ ID NO: 535600 - RNA, 64 nt, Homo Sapiens; identical to SEQ ID NO: 115483

SEQ ID NO: 535601 - RNA, 64 nt, Homo Sapiens; identical to SEQ ID NO: 115484

SEQ ID NO: 535602 - RNA, 64 nt, Homo Sapiens; identical to SEQ ID NO: 115485

SEQ ID NO: 535603 - RNA, 64 nt, Homo Sapiens; identical to SEQ ID NO: 115486

SEQ ID NO: 535604 - RNA, 64 nt, Homo Sapiens; identical to SEQ ID NO: 115487

SEQ ID NO: 535605 - RNA, 64 nt, Homo Sapiens; identical to SEQ ID NO: 115488

SEQ ID NO: 535606 - RNA, 64 nt, Homo Sapiens; identical to SEQ ID NO: 115489

SEQ ID NO: 535607 - RNA, 62 nt, Homo Sapiens; identical to SEQ ID NO: 115490

SEQ ID NO: 535608 - RNA, 64 nt, Homo Sapiens; identical to SEQ ID NO: 115491

SEQ ID NO: 535609 - RNA, 64 nt, Homo Sapiens; identical to SEQ ID NO: 115492

SEQ ID NO: 535610 - RNA, 64 nt, Homo Sapiens; identical to SEQ ID NO: 115493

SEQ ID NO: 535611 - RNA, 64 nt, Homo Sapiens; identical to SEQ ID NO: 115494

SEQ ID NO: 535612 - RNA, 64 nt, Homo Sapiens; identical to SEQ ID NO: 115495

SEQ ID NO: 535613 - RNA, 64 nt, Homo Sapiens; identical to SEQ ID NO: 115496

SEQ ID NO: 535614 - RNA, 64 nt, Homo Sapiens; identical to SEQ ID NO: 115497

SEQ ID NO: 535615 - RNA, 64 nt, Homo Sapiens; identical to SEQ ID NO: 115498

SEQ ID NO: 535616 - RNA, 64 nt, Homo Sapiens; identical to SEQ ID NO: 115499

SEQ ID NO: 535617 - RNA, 64 nt, Homo Sapiens; identical to SEQ ID NO: 115500

SEQ ID NO: 535618 - RNA, 64 nt, Homo Sapiens; identical to SEQ ID NO: 115501

SEQ ID NO: 535619 - RNA, 64 nt, Homo Sapiens; identical to SEQ ID NO: 115502

SEQ ID NO: 535620 - RNA, 64 nt, Homo Sapiens; identical to SEQ ID NO: 115503

SEQ ID NO: 535621 - RNA, 64 nt, Homo Sapiens; identical to SEQ ID NO: 115504

SEQ ID NO: 535622 - RNA, 64 nt, Homo Sapiens; identical to SEQ ID NO: 115505

SEQ ID NO: 535623 - RNA, 64 nt, Homo Sapiens; identical to SEQ ID NO: 115506

SEQ ID NO: 535624 - RNA, 64 nt, Homo Sapiens; identical to SEQ ID NO: 115507

SEQ ID NO: 535625 - RNA, 64 nt, Homo Sapiens; identical to SEQ ID NO: 115508

SEQ ID NO: 535626 - RNA, 64 nt, Homo Sapiens; identical to SEQ ID NO: 115509

SEQ ID NO: 535627 - RNA, 64 nt, Homo Sapiens; identical to SEQ ID NO: 115510

SEQ ID NO: 535628 - RNA, 64 nt, Homo Sapiens; identical to SEQ ID NO: 115511

SEQ ID NO: 535629 - RNA, 64 nt, Homo Sapiens; identical to SEQ ID NO: 115512

SEQ ID NO: 535630 - RNA, 64 nt, Homo Sapiens; identical to SEQ ID NO: 115513

SEQ ID NO: 535631 - RNA, 64 nt, Homo Sapiens; identical to SEQ ID NO: 115514

SEQ ID NO: 535632 - RNA, 52 nt, Homo Sapiens; identical to SEQ ID NO: 115515

SEQ ID NO: 535633 - RNA, 64 nt, Homo Sapiens; identical to SEQ ID NO: 115516

SEQ ID NO: 535634 - RNA, 64 nt, Homo Sapiens; identical to SEQ ID NO: 115517

SEQ ID NO: 535635 - RNA, 64 nt, Homo Sapiens; identical to SEQ ID NO: 115518

SEQ ID NO: 535636 - RNA, 64 nt, Homo Sapiens; identical to SEQ ID NO: 115519

SEQ ID NO: 535637 - RNA, 64 nt, Homo Sapiens; identical to SEQ ID NO: 115520

SEQ ID NO: 535638 - RNA, 64 nt, Homo Sapiens; identical to SEQ ID NO: 115521

SEQ ID NO: 535639 - RNA, 64 nt, Homo Sapiens; identical to SEQ ID NO: 115522

SEQ ID NO: 535640 - RNA, 64 nt, Homo Sapiens; identical to SEQ ID NO: 115523

SEQ ID NO: 535641 - RNA, 64 nt, Homo Sapiens; identical to SEQ ID NO: 115524

SEQ ID NO: 535642 - RNA, 64 nt, Homo Sapiens; identical to SEQ ID NO: 115525

SEQ ID NO: 535643 - RNA, 64 nt, Homo Sapiens; identical to SEQ ID NO: 115526

SEQ ID NO: 535644 - RNA, 64 nt, Homo Sapiens; identical to SEQ ID NO: 115527

SEQ ID NO: 535645 - RNA, 64 nt, Homo Sapiens; identical to SEQ ID NO: 115528

SEQ ID NO: 535646 - RNA, 64 nt, Homo Sapiens; identical to SEQ ID NO: 115529

SEQ ID NO: 535647 - RNA, 64 nt, Homo Sapiens; identical to SEQ ID NO: 115530

SEQ ID NO: 535648 - RNA, 64 nt, Homo Sapiens; identical to SEQ ID NO: 115531

SEQ ID NO: 535649 - RNA, 64 nt, Homo Sapiens; identical to SEQ ID NO: 115532

SEQ ID NO: 535650 - RNA, 64 nt, Homo Sapiens; identical to SEQ ID NO: 115533

SEQ ID NO: 535651 - RNA, 64 nt, Homo Sapiens; identical to SEQ ID NO: 115534

SEQ ID NO: 535652 - RNA, 64 nt, Homo Sapiens; identical to SEQ ID NO: 115535

SEQ ID NO: 535653 - RNA, 64 nt, Homo Sapiens; identical to SEQ ID NO: 115536

SEQ ID NO: 535654 - RNA, 64 nt, Homo Sapiens; identical to SEQ ID NO: 115537

SEQ ID NO: 535655 - RNA, 64 nt, Homo Sapiens; identical to SEQ ID NO: 115538

SEQ ID NO: 535656 - RNA, 64 nt, Homo Sapiens; identical to SEQ ID NO: 115539

SEQ ID NO: 535657 - RNA, 64 nt, Homo Sapiens; identical to SEQ ID NO: 115540

SEQ ID NO: 535658 - RNA, 64 nt, Homo Sapiens; identical to SEQ ID NO: 115541

SEQ ID NO: 535659 - RNA, 64 nt, Homo Sapiens; identical to SEQ ID NO: 115542

SEQ ID NO: 535660 - RNA, 64 nt, Homo Sapiens; identical to SEQ ID NO: 115543

SEQ ID NO: 535661 - RNA, 64 nt, Homo Sapiens; identical to SEQ ID NO: 115544

SEQ ID NO: 535662 - RNA, 64 nt, Homo Sapiens; identical to SEQ ID NO: 115545

SEQ ID NO: 535663 - RNA, 64 nt, Homo Sapiens; identical to SEQ ID NO: 115546

SEQ ID NO: 535664 - RNA, 64 nt, Homo Sapiens; identical to SEQ ID NO: 115547

SEQ ID NO: 535665 - RNA, 64 nt, Homo Sapiens; identical to SEQ ID NO: 115548

SEQ ID NO: 535666 - RNA, 64 nt, Homo Sapiens; identical to SEQ ID NO: 115549

SEQ ID NO: 535667 - RNA, 64 nt, Homo Sapiens; identical to SEQ ID NO: 115550

SEQ ID NO: 535668 - RNA, 64 nt, Homo Sapiens; identical to SEQ ID NO: 115551

SEQ ID NO: 535669 - RNA, 64 nt, Homo Sapiens; identical to SEQ ID NO: 115552

SEQ ID NO: 535670 - RNA, 64 nt, Homo Sapiens; identical to SEQ ID NO: 115553

SEQ ID NO: 535671 - RNA, 64 nt, Homo Sapiens; identical to SEQ ID NO: 115554

SEQ ID NO: 535672 - RNA, 64 nt, Homo Sapiens; identical to SEQ ID NO: 115555

SEQ ID NO: 535673 - RNA, 64 nt, Homo Sapiens; identical to SEQ ID NO: 115556

SEQ ID NO: 535674 - RNA, 64 nt, Homo Sapiens; identical to SEQ ID NO: 115557

SEQ ID NO: 535675 - RNA, 64 nt, Homo Sapiens; identical to SEQ ID NO: 115558

SEQ ID NO: 535676 - RNA, 64 nt, Homo Sapiens; identical to SEQ ID NO: 115559

SEQ ID NO: 535677 - RNA, 64 nt, Homo Sapiens; identical to SEQ ID NO: 115560

SEQ ID NO: 535678 - RNA, 64 nt, Homo Sapiens; identical to SEQ ID NO: 115561

SEQ ID NO: 535679 - RNA, 64 nt, Homo Sapiens; identical to SEQ ID NO: 115562

SEQ ID NO: 535680 - RNA, 64 nt, Homo Sapiens; identical to SEQ ID NO: 115563

SEQ ID NO: 535681 - RNA, 64 nt, Homo Sapiens; identical to SEQ ID NO: 115564

SEQ ID NO: 535682 - RNA, 64 nt, Homo Sapiens; identical to SEQ ID NO: 115565

SEQ ID NO: 535683 - RNA, 64 nt, Homo Sapiens; identical to SEQ ID NO: 115566

SEQ ID NO: 535684 - RNA, 64 nt, Homo Sapiens; identical to SEQ ID NO: 115567

SEQ ID NO: 535685 - RNA, 64 nt, Homo Sapiens; identical to SEQ ID NO: 115568

SEQ ID NO: 535686 - RNA, 64 nt, Homo Sapiens; identical to SEQ ID NO: 115569

SEQ ID NO: 535687 - RNA, 64 nt, Homo Sapiens; identical to SEQ ID NO: 115570

SEQ ID NO: 535688 - RNA, 64 nt, Homo Sapiens; identical to SEQ ID NO: 115571

SEQ ID NO: 535689 - RNA, 64 nt, Homo Sapiens; identical to SEQ ID NO: 115572

SEQ ID NO: 535690 - RNA, 64 nt, Homo Sapiens; identical to SEQ ID NO: 115573

SEQ ID NO: 535691 - RNA, 64 nt, Homo Sapiens; identical to SEQ ID NO: 115574

SEQ ID NO: 535692 - RNA, 64 nt, Homo Sapiens; identical to SEQ ID NO: 115575

SEQ ID NO: 535693 - RNA, 66 nt, Homo Sapiens
auugcucccccuucauucugaugccucccuggggaacaaggauaaugacuuugcaucugcaccugg

SEQ ID NO: 535694 - RNA, 66 nt, Homo Sapiens
auuuugcacgaacaugcaguuauugaagauuaggaucaaggauagacaagguauaguaguuaucuu

SEQ ID NO: 535695 - RNA, 66 nt, Homo Sapiens
uugggcaugugguauacugaagcaauacccguuagacaaggauauuuuacuucuuccagacaccag

SEQ ID NO: 535696 - RNA, 66 nt, Homo Sapiens
uccacugccaaguagaagugacucaaaacccucugacaaggauauucccuuggcuaugguccugcc

SEQ ID NO: 535697 - RNA, 66 nt, Homo Sapiens
gccauccagcaguuccuuaaauaaggucaccaaggacaaggauaucaaauaacuacuguucaaucu

SEQ ID NO: 535698 - RNA, 66 nt, Homo Sapiens
ucccaaauggugcuuaucuugauugaacauucagaacaaggauauuauuuucagugauuuugugag

SEQ ID NO: 535699 - RNA, 66 nt, Homo Sapiens
cugccuaguaggcugaagcuucaggacucugcaggucaaggauaugugaugagcaccggccuaagu

SEQ ID NO: 535700 - RNA, 66 nt, Homo Sapiens
ccaaccaaaaggcuuucagaggugugaauggaucuccaaggauaaguguaacaguuggcaacaucc

SEQ ID NO: 535701 - RNA, 66 nt, Homo Sapiens
uucuuccucugacauggggaguccacacuucaaggccaaggauaguccguccucaugcuccucagu

SEQ ID NO: 535702 - RNA, 66 nt, Homo Sapiens
cugacccauauaguuuacucaagucuacuuuuuguucaaggauauguuuaaaugaauacuuuuaca

SEQ ID NO: 535703 - RNA, 66 nt, Homo Sapiens
agccuguuuuuucccuuuuuuuauucuacccccuaccaaggauaucaaauccuaaguguaaaucag

SEQ ID NO: 535704 - RNA, 66 nt, Homo Sapiens
uuuaguuugaguggaauuuggucuuuuugaauguaucaaggauauacuuauuaaaauuuacaaaau

SEQ ID NO: 535705 - RNA, 66 nt, Homo Sapiens
cauugauucuuugcuucguaaauacuauaguugaaccaaggauauguuauuucauguaguauggcu

SEQ ID NO: 535706 - RNA, 66 nt, Homo Sapiens
ugagcucugaguuucucagugaaauuaauggaggcucaaggauagauuagccauugcccuggagau

SEQ ID NO: 535707 - RNA, 66 nt, Homo Sapiens
gaggaggagggaagaacaaaccagccaaaaacuggacaaggauagaacuauuuucuccuuaaagcu

SEQ ID NO: 535708 - RNA, 66 nt, Homo Sapiens
gcuggcugcuuccaggagggucuaaaauuaaaaugccaaggauaaagcauggaaguuuaaauuuuc

SEQ ID NO: 535709 - RNA, 66 nt, Homo Sapiens
guguauaauacgguauuauacccgcaugugcucuagcaaggauaccaaggcaagcauacauguagc

SEQ ID NO: 535710 - RNA, 66 nt, Homo Sapiens
aaaucaaaugagccaucagugaggcagcaguuacuucaaggauaugauauguuaaugaauccaaag

SEQ ID NO: 535711 - RNA, 66 nt, Homo Sapiens
aagcuacaaguuagcucaagcaaugugacauuauuucaaggauaugugccagggaauucaggaacc

SEQ ID NO: 535712 - RNA, 66 nt, Homo Sapiens
uaaagagaaaaaauauguguauaucauggaaaaagacaaggauauuuuaauaaaacauuacuuauu

SEQ ID NO: 535713 - RNA, 66 nt, Homo Sapiens
acgaagaaagaauaaauuucggcuguuuuaagccaccaaggauaauugguuacagcagcucuagga

SEQ ID NO: 535714 - RNA, 66 nt, Homo Sapiens
ggguucuucagugaaaagcaggagaagagcccacugcaaggauagcucauuaggcacaugaccgau

SEQ ID NO: 535715 - RNA, 66 nt, Homo Sapiens
aguagauacaggcacugcucugaaaaccuggcuagccaaggauauucucagaauguuaucaccugu

SEQ ID NO: 535716 - RNA, 66 nt, Homo Sapiens
aaccccagaauauuuccucuugacuucuuuuuguaacaaggauaauuuagggauuuauaaaguugu

SEQ ID NO: 535717 - RNA, 66 nt, Homo Sapiens
uggcugagaaaauucuggaacuauggaucuugaccccaaggauauauuauuuuauuccaagaaaga

SEQ ID NO: 535718 - RNA, 66 nt, Homo Sapiens
aaugccaucaggaaauagcuccaguggcuuugggggcaaggauagaccagcagacugguggcaugc

SEQ ID NO: 535719 - RNA, 66 nt, Homo Sapiens
uucuuauuuaaucuuuucuuguagacauuuauaacucaaggauaccugauuaaaagguauacuuua

SEQ ID NO: 535720 - RNA, 66 nt, Homo Sapiens
aucucaucuagaaaaugcaauaguaacaaaauuauacaaggauagagaauuuuuugauguuuauau

SEQ ID NO: 535721 - RNA, 66 nt, Homo Sapiens
uuggaauaaagcacuauguuuugaaggaaguucauucaaggauaaguuuuuuuaaaugguugaaac

SEQ ID NO: 535722 - RNA, 66 nt, Homo Sapiens
aaugucuggauuggccuccauuaaagagaguggcaccaaggauagcugccuuuguggcuucgcuga

SEQ ID NO: 535723 - RNA, 66 nt, Homo Sapiens
ugaaaucacuacuguguuuuuccuguuggucaugaucaaggauauucaaacuugacuuugaaauau

SEQ ID NO: 535724 - RNA, 66 nt, Homo Sapiens
ggcaaaaucaauuuuguaauuuuucuguguuacacucaaggauaaacuaggucuacagguuuacau

SEQ ID NO: 535725 - RNA, 66 nt, Homo Sapiens
guuaggauuaauuacuuaauagaaaucaaaucagcccaaggauauaucagucugucgggugggggc

SEQ ID NO: 535726 - RNA, 66 nt, Homo Sapiens
aggacaguuagaccccugggugggcccugccgugggcaaggauacccgguggcuucuggcaccugg

SEQ ID NO: 535727 - RNA, 66 nt, Homo Sapiens
agccuuuccaauagccccaugaaaagaagcaucacccaaggauauuguaaaaaggauguaacaagg

SEQ ID NO: 535728 - RNA, 66 nt, Homo Sapiens
cucugaaguuauguaaaauaaaagcaucugauccuucaaggauaaaguugaggaucacaugguacg

SEQ ID NO: 535729 - RNA, 55 nt, Homo Sapiens; identical to SEQ ID NO: 115441

SEQ ID NO: 535730 - RNA, 66 nt, Homo Sapiens
gcggagacucuggccaagcuugagugcuuggcuuuccaaggauacuccagagcaaucuagaaucuu

SEQ ID NO: 535731 - RNA, 66 nt, Homo Sapiens
gugaucaauuuuacccuguauauuauuuuuugaaaacaaggauauuuaaaaacaagguauauacuu

SEQ ID NO: 535732 - RNA, 66 nt, Homo Sapiens
uggagugaaaugcuggccaggagcugaggucucauacaaggauauucugguugcauggcccacuug

SEQ ID NO: 535733 - RNA, 66 nt, Homo Sapiens
cauuuaucaaagaaguuaaaggaaaggucuaaaucacaaggauagagauaccuucuuuacaggaga

SEQ ID NO: 535734 - RNA, 66 nt, Homo Sapiens
cuuuucacuuuuguuauauagguuuaauccccaagccaaggauaguacuuaguauuucacuacacu

SEQ ID NO: 535735 - RNA, 66 nt, Homo Sapiens
gacuggaaacaguuugaacagaauucaaaguaugagcaaggauaccaaaaaucacauccuacuaua

SEQ ID NO: 535736 - RNA, 66 nt, Homo Sapiens
aaagagaaguuuccagcaaaacccucaucagcauuacaaggauauuugaacuccaugcuugauggu

SEQ ID NO: 535737 - RNA, 66 nt, Homo Sapiens
uaagagacuugccccuuuuguaccuauucauuaacacaaggauacauuuccuagaggagagauuag

SEQ ID NO: 535738 - RNA, 66 nt, Homo Sapiens
ucagucaugaaccuguuuucucucuauaaucaaggacaaggauaauuuaugugugucauucaugaa

SEQ ID NO: 535739 - RNA, 66 nt, Homo Sapiens
ggguuuuaucaaaacaaaauauuuuacauuugaauacaaggauaauacuggauuauauugcagcau

SEQ ID NO: 535740 - RNA, 66 nt, Homo Sapiens
aaaaaauggaagauuaaaaagaucaucacaucaguccaaggauauagcccuggaucauauuccggg

SEQ ID NO: 535741 - RNA, 66 nt, Homo Sapiens
ucuccauaucuugauggcuuuugggagcauuucacacaaggauauaaaaugcgguuuucuuaaaug

SEQ ID NO: 535742 - RNA, 66 nt, Homo Sapiens
agucaguuuguaucaguuaauaggauguucauauuccaaggauauuaguuguuuuuuuaaucaucc

SEQ ID NO: 535743 - RNA, 66 nt, Homo Sapiens
ugcacuggagccguaggaggcucuucaguugggccccaaggauaaggcuacugauuugauacuaaa

SEQ ID NO: 535744 - RNA, 66 nt, Homo Sapiens
gugucgcauaaccacuucuucuauccccuguacuuucaaggauaauuuaggcuacaugagauuuug

SEQ ID NO: 535745 - RNA, 66 nt, Homo Sapiens
ugacguuaaaaaacaacaacagaucuagagauaccucaaggauaucauuuuugauuuuguguuaca

SEQ ID NO: 535746 - RNA, 66 nt, Homo Sapiens
ggaaccacaggacuauuuggaaaaauucuuaucauucaaggauauuguuuucuuuuuucacacagu

SEQ ID NO: 535747 - RNA, 57 nt, Homo Sapiens; identical to SEQ ID NO: 115459

SEQ ID NO: 535748 - RNA, 66 nt, Homo Sapiens
cuuuggcaggggugugugugcacaacuggcagaaaacaaggauauguugagaucgcugauugguga

SEQ ID NO: 535749 - RNA, 66 nt, Homo Sapiens
cuuguauauuugaaaaauaaaauugucugccaauaccaaggauauuugggcugaaggacaaauuga

SEQ ID NO: 535750 - RNA, 66 nt, Homo Sapiens
uaucugggacauuauuggcaagggaugagauacagacaaggauagcgccugacaaugguaccuauu

SEQ ID NO: 535751 - RNA, 66 nt, Homo Sapiens
agagcugggaaauucaugugguuuccugauaacaagcaaggauaucgguggagagcacuagaagug

SEQ ID NO: 535752 - RNA, 66 nt, Homo Sapiens
cucacuuugcaugaggagcucccagggcuggagccacaaggauacccaaaggugaccgcagggggc

SEQ ID NO: 535753 - RNA, 66 nt, Homo Sapiens
uuuuaaggcauuggcuuuuaaauuaauacauauauccaaggauauguuauagcugcaguguuugaa

SEQ ID NO: 535754 - RNA, 66 nt, Homo Sapiens
accacuucaaaacugguagaauauuuauucauaugacaaggauaccugaguaaaacuauccuuuuu

SEQ ID NO: 535755 - RNA, 66 nt, Homo Sapiens
aucugcgugacagaaacaccagcauauuugcaacgccaaggauauuggucuuaagugcaagagcac

SEQ ID NO: 535756 - RNA, 66 nt, Homo Sapiens
gauagaaaaagugauuucuuauucaaaucaugcugacaaggauacuaguagguacucuugagagca

SEQ ID NO: 535757 - RNA, 66 nt, Homo Sapiens
gucccuuauuugaaggcaucuguacuguauugucaucaaggauacucuuggagaauugugaaugua

SEQ ID NO: 535758 - RNA, 66 nt, Homo Sapiens
acagaccaacuaggcuacauugacaccguugucauccaaggauaauguacccuagauagugucaca

SEQ ID NO: 535759 - RNA, 66 nt, Homo Sapiens
cugcagcuuuacugccuuccccacuuugacacgcuucaaggauauacucuccuuuuccuuaccaua

SEQ ID NO: 535760 - RNA, 66 nt, Homo Sapiens
ugccccaacgaaugcugcugaaaauaaguaaaauuccaaggauauagcaagacucccguuucucuu

SEQ ID NO: 535761 - RNA, 66 nt, Homo Sapiens
auagugaacauuucuccuaagauuauaaaaauaagacaaggauaucugcugucaaugauuuuauuc

SEQ ID NO: 535762 - RNA, 66 nt, Homo Sapiens
acaaaucuuuugguacuaccauuuggggaagccaagcaaggauaguaaauugaccagaacacaguu

SEQ ID NO: 535763 - RNA, 66 nt, Homo Sapiens
aggaauaaaaccuugucuuccauuacaauuaacagucaaggauaaaacaagcacgcgcacaaucaa

SEQ ID NO: 535764 - RNA, 59 nt, Homo Sapiens; identical to SEQ ID NO: 115476

SEQ ID NO: 535765 - RNA, 66 nt, Homo Sapiens
aaauuugacauuauuucuuuaacuuucaacuacuaucaaggauaauaccuuuuccauauuacugug

SEQ ID NO: 535766 - RNA, 66 nt, Homo Sapiens
uuucaugucccaccauuuucgagagaaagcaguuuccaaggauauggagagagaaagacgaaggga

SEQ ID NO: 535767 - RNA, 66 nt, Homo Sapiens
guauuuuaaaaugggaguugcuuguaauguauuuuacaaggauaauguauuuuaaaauacauuauc

SEQ ID NO: 535768 - RNA, 66 nt, Homo Sapiens
auccacauuuggguuaacuccucagauuuggaguggcaaggauaaaagugagggcagaaguagcug

SEQ ID NO: 535769 - RNA, 66 nt, Homo Sapiens
acaagucguccaguagaaaugcaucuaugaggucagcaaggauaugaugagauuuugcucacaguc

SEQ ID NO: 535770 - RNA, 66 nt, Homo Sapiens
ggaauaugauuuuccagagccuacuuuucucugggacaaggauaaagcaaaccuucuaccuccuac

SEQ ID NO: 535771 - RNA, 66 nt, Homo Sapiens
caauacugcguuccuuauaggucuuacaugcauaugcaaggauauuuuaucuuauucauucauuuc

SEQ ID NO: 535772 - RNA, 66 nt, Homo Sapiens
uucauucagaccuguugcuaacaaauuuauauuugccaaggauauuaggcaaaagaggcuacuuga

SEQ ID NO: 535773 - RNA, 66 nt, Homo Sapiens
gguucgcaccaacucaaugaacaagcugaagaaauccaaggauacagucucagaggacaccauuag

SEQ ID NO: 535774 - RNA, 66 nt, Homo Sapiens
acugaacuguaaggguuaguuucuucaucuguaaaacaaggauaauauauaacuucucuuuggcuu

SEQ ID NO: 535775 - RNA, 66 nt, Homo Sapiens
auuaaaacuagaaaugacugguuccccacucuauaccaaggauauucaaaaaguauuucucuguca

SEQ ID NO: 535776 - RNA, 66 nt, Homo Sapiens
uauuuuauagaugggcaacuagaauccaauacugcccaaggauaggccaccucaaaaaaaaaaaaa

SEQ ID NO: 535777 - RNA, 66 nt, Homo Sapiens
ugugcacuuugcucaaaauuuuaaaaauaccaaucacaaggauaauagaguagccuaaaauuacua

SEQ ID NO: 535778 - RNA, 62 nt, Homo Sapiens; identical to SEQ ID NO: 115490

SEQ ID NO: 535779 - RNA, 66 nt, Homo Sapiens
guauaugcaaauugcaagauuuaaaccauucugaugcaaggauaaaccuuuacuuugacuaccagc

SEQ ID NO: 535780 - RNA, 66 nt, Homo Sapiens
ugaagaaaaggaaauaaaaauucuucucagcaacaucaaggauauagcuguugugcaaaguucagu

SEQ ID NO: 535781 - RNA, 66 nt, Homo Sapiens
uuuaaaugcuuucaaaucugaguaguacggcuguugcaaggauauuuaaaaauagauaaaguauaa

SEQ ID NO: 535782 - RNA, 66 nt, Homo Sapiens
ugaaacugggucucccugggugccucucagcaucaucaaggauaacaacauguucguggugcugaa

SEQ ID NO: 535783 - RNA, 66 nt, Homo Sapiens
cuuuuaacuucuucccuucaccuucuugaauggcuccaaggauacccacacacacacacacacacc

SEQ ID NO: 535784 - RNA, 66 nt, Homo Sapiens
acaucuuccuaaucuguuaauggucagugguguccccaaggauagugcuggcuuccauggaaaccc

SEQ ID NO: 535785 - RNA, 66 nt, Homo Sapiens
cuuuauucugcaagcaauaccaugauucagagcuuucaaggauaggauaccacugagcucacugcc

SEQ ID NO: 535786 - RNA, 66 nt, Homo Sapiens
cuuuauucugcaagcaaucacaugaugcagagcuuucaaggauaggauaccacugagcucacugcc

SEQ ID NO: 535787 - RNA, 66 nt, Homo Sapiens
gagaaacuaugugacucauuauuuaaaauaccugcacaaggauagagggaacuguuuugaauaagg

SEQ ID NO: 535788 - RNA, 66 nt, Homo Sapiens
ccaaagcccuuaagaccucagcccagcgcucgugaccaaggauacacucaggaacucugcuuccug

SEQ ID NO: 535789 - RNA, 66 nt, Homo Sapiens
aaaauaguucuggccagaaucaaagauucagcccuacaaggauauguuuuccugugaaauuaucua

SEQ ID NO: 535790 - RNA, 66 nt, Homo Sapiens
ggccucuacuagguggcugugauuaaaugucccaagcaaggauagggaaggggaaugguugagccu

SEQ ID NO: 535791 - RNA, 66 nt, Homo Sapiens
ucaaaacugaagcuuuuuauuuaggcuuuuccaaaucaaggauaaauaucuuacgcacgauaucua

SEQ ID NO: 535792 - RNA, 66 nt, Homo Sapiens
gucuaacagacggucacaaccagugccauggaaaaccaaggauauuagcaaaagcagaaguugcua

SEQ ID NO: 535793 - RNA, 66 nt, Homo Sapiens
caggggagcacacagggcccggcagcccccaggaaucaaggauagggcuaagguuuucaccuuaac

SEQ ID NO: 535794 - RNA, 66 nt, Homo Sapiens
aaaccaaacacugcauauucucugagcaaacuaucgcaaggauagaaugaagcuggaaaccaucau

SEQ ID NO: 535795 - RNA, 66 nt, Homo Sapiens
gguuuuucucauguaucuuuuuuaaguauuaacuuacaaggauauaauaaaugguuucugaaaaug

SEQ ID NO: 535796 - RNA, 66 nt, Homo Sapiens
caugauucuuaaccaggcuauuauccuucggagagacaaggauaugugcccaagggccagcucagu

SEQ ID NO: 535797 - RNA, 66 nt, Homo Sapiens
ugcuggcccagggcccagagcaggacagaugccacacaaggauagaauggugccccaggaccagcu

SEQ ID NO: 535798 - RNA, 66 nt, Homo Sapiens
ggaaggguaugccuuuggguguuguaaggccuaugccaaggauaaaaaccauggccuuuccucagu

SEQ ID NO: 535799 - RNA, 66 nt, Homo Sapiens
caugauucagggaaugaagaugaguccuauaaaaagcaaggauauguugcuaaugguuguuuucug

SEQ ID NO: 535800 - RNA, 66 nt, Homo Sapiens
ucuucugaagaucaaggcaaucaacccagggacacccaaggauauggaaccccucaauggacucuc

SEQ ID NO: 535801 - RNA, 66 nt, Homo Sapiens
uauaagaccacugcuuaucucgaagggaaaaagcugcaaggauauauguaacaaaauauguauguc

SEQ ID NO: 535802 - RNA, 66 nt, Homo Sapiens
uuucaaauguaugcuuaagcaggauaagaaacagaccaaggauaacaggauuagauguggaaggga

SEQ ID NO: 535803 - RNA, 52 nt, Homo Sapiens; identical to SEQ ID NO: 115515

SEQ ID NO: 535804 - RNA, 66 nt, Homo Sapiens
aaaagagcuauuguaaauauugauggaauuaguagacaaggauauuaaacccagaaaagacagagg

SEQ ID NO: 535805 - RNA, 66 nt, Homo Sapiens
cgugggauagauaacugagaggcucagaaucuuuaccaaggauauuuuuuaggauaagguagcugc

SEQ ID NO: 535806 - RNA, 66 nt, Homo Sapiens
uguagucucuuguuuaaaaaaucuggagcgggaaugcaaggauacaaaacuuuagcaugcuuugag

SEQ ID NO: 535807 - RNA, 66 nt, Homo Sapiens
uugguuucagucaucaacuacccaugaauuccugcccaaggauacuuaaucaggauuaaauuuucu

SEQ ID NO: 535808 - RNA, 66 nt, Homo Sapiens
guacuaguuguuaaaauggaaggcuuuuccuaaggccaaggauaauggaacacauagaacugaugg

SEQ ID NO: 535809 - RNA, 66 nt, Homo Sapiens
agcugcagugguauuaauuucgcuuuugccauuagccaaggauagauauuuuccagguacccuucu

SEQ ID NO: 535810 - RNA, 66 nt, Homo Sapiens
aucauugccuuguguuacagugcaauuccuuuuuagcaaggauaaagagaaggcauuaaaaagaag

SEQ ID NO: 535811 - RNA, 66 nt, Homo Sapiens
ugacucuccaauagguucuuuccucucuuggagagccaaggauaagagcccgacauggugcuaguu

SEQ ID NO: 535812 - RNA, 66 nt, Homo Sapiens
aaaacguuuugauuuauaguaccaagugcuuaaacacaaggauaguguuagauuuucgagugacuu

SEQ ID NO: 535813 - RNA, 66 nt, Homo Sapiens
uuuuuucuuuucuuaguucauauuugcauuuucguucaaggauaugcuuagcaauaaaauguucuu

SEQ ID NO: 535814 - RNA, 66 nt, Homo Sapiens
uccccagcaaauccuagaaguggagucuggauacuucaaggauagaaguguuggcacgcacagcca

SEQ ID NO: 535815 - RNA, 66 nt, Homo Sapiens
accuuucacgcaagugccauuacuugccuucccgggcaaggauagggaaagaguuggauuggaccc

SEQ ID NO: 535816 - RNA, 66 nt, Homo Sapiens
ccuuuguggucuucugugauuauuuaugcugccucccaaggauagaauugaaauaaaauguuuuca

SEQ ID NO: 535817 - RNA, 66 nt, Homo Sapiens
aagaaaauagaagguaaagacugaaaaaaaagaaagcaaggauacugaaaagaucgucugagaaau

SEQ ID NO: 535818 - RNA, 66 nt, Homo Sapiens
ucccuaaccucacucagucaaguuguucagaauccccaaggauauuuuuuaaguuucuaagggucu

SEQ ID NO: 535819 - RNA, 66 nt, Homo Sapiens
uuuuacaagugguuuucuuauuuugaaguccguauacaaggauauaaaauuuuuuguaugaucagu

SEQ ID NO: 535820 - RNA, 66 nt, Homo Sapiens
acugcagagcccagagcccuucaucucucugagggucaaggauaccaggggucccaagucacagau

SEQ ID NO: 535821 - RNA, 66 nt, Homo Sapiens
gggccuggccuguccucuaagucaaguuuaggaaaacaaggauaagauucugucauaggcauagag

SEQ ID NO: 535822 - RNA, 66 nt, Homo Sapiens
auugagaauguaaauaaaugugucuucuuuauggaccaaggauaugaaaucauuuuucuuuuguag

SEQ ID NO: 535823 - RNA, 66 nt, Homo Sapiens
cucagaggaguuuaacgcgaucuucacauuuuacgacaaggauagaagcggcuacauugacgagca

SEQ ID NO: 535824 - RNA, 66 nt, Homo Sapiens
aaaaaaacuacauaaaaggccuaaaaguaagacccacaaggauauuccuuugcccuucuuguacuu

SEQ ID NO: 535825 - RNA, 66 nt, Homo Sapiens
ucuuuaucuuuucuuugaauaagaaaaaguaucuagcaaggauauuacuugugccuugaggcuagc

SEQ ID NO: 535826 - RNA, 66 nt, Homo Sapiens
uguccccuuguucucucugcccucagaaccccacggcaaggauauaaagauuuggcccucauuuuc

SEQ ID NO: 535827 - RNA, 66 nt, Homo Sapiens
aaauacuucacugccgggcauuugucuaacacauuucaaggauagagugggguuuccccucaggaa

SEQ ID NO: 535828 - RNA, 66 nt, Homo Sapiens
gggagccggcggccucucgaggacguggacaugccucaaggauacauguuccaaccuccugcucug

SEQ ID NO: 535829 - RNA, 66 nt, Homo Sapiens
ggacacaccucugcuccaaauugcuagcuagccagccaaggauaccaagcauacuugugaacuacc

SEQ ID NO: 535830 - RNA, 66 nt, Homo Sapiens
ugggaaaaaacccaaagaaccaaaaacaaaccaccccaaggauaauaauagcuacacugcuagcuu

SEQ ID NO: 535831 - RNA, 66 nt, Homo Sapiens
caaacaggcacuguuagaugaaguaaaugauuucaacaaggauauuuguaucaggguucuacuuca

SEQ ID NO: 535832 - RNA, 66 nt, Homo Sapiens
gacguugcugaacaagcgugugaaaucauuucagaucaaggauaagccaguguguacauauguuca

SEQ ID NO: 535833 - RNA, 66 nt, Homo Sapiens
uguuauugggcauuugaugagguuuggcauggacuucaaggauaaaugaaugaaaacuuugcacca

SEQ ID NO: 535834 - RNA, 66 nt, Homo Sapiens
ucucuuguguggucccagaaggagaagugaguuugccaaggauauggggcaggaggcucccucugc

SEQ ID NO: 535835 - RNA, 66 nt, Homo Sapiens
cguaugauguaugggguaucuuccucuauauagaaucaaggauauccuuucagauugccaugggga

SEQ ID NO: 535836 - RNA, 66 nt, Homo Sapiens
uugauaaaaccuuuuuaauaagugaugcagagcagccaaggauauguugacccagaugucaaccag

SEQ ID NO: 535837 - RNA, 66 nt, Homo Sapiens
acagaagaagcuugugguaucuaucuauucuuaauucaaggauaaaaauaucaggggcauaaaagg

SEQ ID NO: 535838 - RNA, 66 nt, Homo Sapiens
cacugucaacauuagaucaaugagacagaaaguuaacaaggauauccaggaauugaacacagcucu

SEQ ID NO: 535839 - RNA, 66 nt, Homo Sapiens
auuugcaacagcuacagucuaaaauugcuucuuuaccaaggauauuuacagaaaagacucugacca

SEQ ID NO: 535840 - RNA, 66 nt, Homo Sapiens
gguuuuuuguuauccuuugauuuuguuuaugaaaagcaaggauagcuuaauuuucaaaaacucaau

SEQ ID NO: 535841 - RNA, 66 nt, Homo Sapiens
guuuuacuuauuugcuccuuguagagcugccuuuuccaaggauaccauaaacuccugagagcaggg

SEQ ID NO: 535842 - RNA, 66 nt, Homo Sapiens
uaaggcacuguggugguuauaagacacgaaagcaagcaaggauauaccuugauccuggcauucugg

SEQ ID NO: 535843 - RNA, 66 nt, Homo Sapiens
ccagcauuugcgugaguaucuagcuauggaggacuacaaggauaacaggccccgaguuagaaaaag

SEQ ID NO: 535844 - RNA, 66 nt, Homo Sapiens
auucaaaggagcucacauuugcacagauccccccagcaaggauaacgacagcccccaggccugggg

SEQ ID NO: 535845 - RNA, 66 nt, Homo Sapiens
ccuuggccccgauuccggaucuccuugucgugcggucaaggauacaggguucagguccgcccauua

SEQ ID NO: 535846 - RNA, 66 nt, Homo Sapiens
caaauuccccuaaagguuccugcagacugacaguuucaaggauaccccucucagggguagugaagc

SEQ ID NO: 535847 - RNA, 66 nt, Homo Sapiens
ucaaacggcagucauuuguucuccucggcucuguggcaaggauagcccuuuggagggggacucuug

SEQ ID NO: 535848 - RNA, 66 nt, Homo Sapiens
ugucaccagccuguuguuuuaagagagaaaaaaaaucaaggauaucugauuggagcaaaccacuuc

SEQ ID NO: 535849 - RNA, 66 nt, Homo Sapiens
uauguaauaagaaacuuugcauauuuugcuuuuuaacaaggauauugguuauauuguacaggauca

SEQ ID NO: 535850 - RNA, 66 nt, Homo Sapiens
ugcugaguuuugaugucaaaacguguauauauagaccaaggauauguauuguuuuaugaaacuuuc

SEQ ID NO: 535851 - RNA, 66 nt, Homo Sapiens
uuucuucgguaucuuuuaauuuuauaauucaaagaacaaggauagcaucauugcaaccucugugcu

SEQ ID NO: 535852 - RNA, 66 nt, Homo Sapiens
ugggcuguuuucugucuuauuucucaguugagugagcaaggauacgaaaacaguguguuugaaaac

SEQ ID NO: 535853 - RNA, 66 nt, Homo Sapiens
agaaguuuuuuuuuauuuaagcacucuauucaagugcaaggauaucuuugauuuuggaauucaggu

SEQ ID NO: 535854 - RNA, 66 nt, Homo Sapiens
gaggggcacggggccuccgagcuccagcuccguucccaaggauacucgugaagaccccaucugugu

SEQ ID NO: 535855 - RNA, 66 nt, Homo Sapiens
auucacucagcaaccaugcccuuagucugaagauaacaaggauacuuuaauauccagugccgguuc

SEQ ID NO: 535856 - RNA, 66 nt, Homo Sapiens
gccaaauuagaaaauccuauguccuaguuuccuuaccaaggauaauuaaauauaucacuaagagcu

SEQ ID NO: 535857 - RNA, 66 nt, Homo Sapiens
ucacaugguuagaaauuuaaagcaagaucauuuacccaaggauagguguuugguaauguugaagga

SEQ ID NO: 535858 - RNA, 66 nt, Homo Sapiens
ucauuggagcaaguguuggauuucugaaguugaaaacaaggauauaaaauguaaaugucuguugaa

SEQ ID NO: 535859 - RNA, 66 nt, Homo Sapiens
uguggagaaaaugaugagaaaugaacaaaaaagcugcaaggauaaaaaguuaacaggaauaaauau

SEQ ID NO: 535860 - RNA, 66 nt, Homo Sapiens
aggaauauaaaaauucucaaacuugugcaaguacuucaaggauagccucuuuuucuccuaggagca

SEQ ID NO: 535861 - RNA, 66 nt, Homo Sapiens
ugcauuuagccuggagccccuggggaaaacauuaaucaaggauacugggagggugauucccagugg

SEQ ID NO: 535862 - RNA, 66 nt, Homo Sapiens
uuauagagcaguuggaggaauaaagggggcuggagacaaggauaaguacacagaaucuccugauag

SEQ ID NO: 535863 - RNA, 66 nt, Homo Sapiens
gugugaagaaauaggaaagaagaaguuaccauuaaccaaggauaugagagaacaaggaguuaaaag

SEQ ID NO: 535864 - RNA, 64 nt, Homo Sapiens
aguccuuccuuccuaaucucuaauccccugaagccuaacacaguuccuaauguguuuugccuua

SEQ ID NO: 535865 - RNA, 64 nt, Homo Sapiens
ggcugugguuuacuccugucuaaaccccugaagccuaacacaguuccuggcacacaacaggugu

SEQ ID NO: 535866 - RNA, 64 nt, Homo Sapiens
uggccuuguuggagggggccaggcucuagaacgucuaacacaguggagaaccgaaacccccccc

SEQ ID NO: 535867 - RNA, 64 nt, Homo Sapiens
ucccucccccagucucucuucucaaucccccuuucuaacacacacacacacacacacacacaca

SEQ ID NO: 535868 - RNA, 64 nt, Homo Sapiens
auuccuggauggaauggaucguccuuuccguugcuauggugaaacacaagcagugacaccucgg

SEQ ID NO: 535869 - RNA, 64 nt, Homo Sapiens
acacaggccccgccccuucccuugcucuagugucuauggugagaacuguuccuucuauggggcu

SEQ ID NO: 535870 - RNA, 64 nt, Homo Sapiens
ccccaucucuacuaaaaauaaccagccugaccaauauggugaaaccuggggucaggaguucgag

SEQ ID NO: 535871 - RNA, 64 nt, Homo Sapiens
cccugucucuccuaaaaauaccagcaauggccaguauggugaaaaugaagucaagaguucgaga

SEQ ID NO: 535872 - RNA, 64 nt, Homo Sapiens
auucaaaaugaauacaaaauuaaaauuugaacauuauggugauuauggugaggagaaugggaua

SEQ ID NO: 535873 - RNA, 64 nt, Homo Sapiens
gaauacaaaauuaaaauuugaacauuauggugauuauggugaggagaaugggauauuaacauaa

SEQ ID NO: 535874 - RNA, 64 nt, Homo Sapiens; identical to SEQ ID NO: 294005

SEQ ID NO: 535875 - RNA, 64 nt, Homo Sapiens; identical to SEQ ID NO: 294006

SEQ ID NO: 535876 - RNA, 64 nt, Homo Sapiens; identical to SEQ ID NO: 294007

SEQ ID NO: 535877 - RNA, 64 nt, Homo Sapiens; identical to SEQ ID NO: 294008

SEQ ID NO: 535878 - RNA, 64 nt, Homo Sapiens; identical to SEQ ID NO: 294009

SEQ ID NO: 535879 - RNA, 64 nt, Homo Sapiens; identical to SEQ ID NO: 294010

SEQ ID NO: 535880 - RNA, 64 nt, Homo Sapiens; identical to SEQ ID NO: 294011

SEQ ID NO: 535881 - RNA, 64 nt, Homo Sapiens; identical to SEQ ID NO: 294012

SEQ ID NO: 535882 - RNA, 64 nt, Homo Sapiens; identical to SEQ ID NO: 294013

SEQ ID NO: 535883 - RNA, 64 nt, Homo Sapiens; identical to SEQ ID NO: 294014

SEQ ID NO: 535884 - RNA, 64 nt, Homo Sapiens; identical to SEQ ID NO: 294015

SEQ ID NO: 535885 - RNA, 64 nt, Homo Sapiens; identical to SEQ ID NO: 294016

SEQ ID NO: 535886 - RNA, 64 nt, Homo Sapiens; identical to SEQ ID NO: 294017

SEQ ID NO: 535887 - RNA, 64 nt, Homo Sapiens; identical to SEQ ID NO: 294018

SEQ ID NO: 535888 - RNA, 64 nt, Homo Sapiens; identical to SEQ ID NO: 294019

SEQ ID NO: 535889 - RNA, 64 nt, Homo Sapiens; identical to SEQ ID NO: 294020

SEQ ID NO: 535890 - RNA, 64 nt, Homo Sapiens; identical to SEQ ID NO: 294021

SEQ ID NO: 535891 - RNA, 64 nt, Homo Sapiens; identical to SEQ ID NO: 294022

SEQ ID NO: 535892 - RNA, 64 nt, Homo Sapiens; identical to SEQ ID NO: 294023

SEQ ID NO: 535893 - RNA, 64 nt, Homo Sapiens; identical to SEQ ID NO: 294024

SEQ ID NO: 535894 - RNA, 64 nt, Homo Sapiens
uuuuuucuaaauguacauaaugcuguuuaacacaguguuguauuuguuccauugcuagcugucc

SEQ ID NO: 535895 - RNA, 64 nt, Homo Sapiens
uuccauugcuagcuguccuggguuuuucagcauaguguuguaugccgcuuaaccaagcuguugu

SEQ ID NO: 535896 - RNA, 64 nt, Homo Sapiens
ucuagucccagcuacuugggaguagcugggcacgguguuguaccucuccugccucagccuccug

SEQ ID NO: 535897 - RNA, 64 nt, Homo Sapiens
auaaauacuuugauguuucacucuuccuuauuuaguguuguaucuuacugaauuuaguucugug

SEQ ID NO: 535898 - RNA, 64 nt, Homo Sapiens
aaguacuuucagugcucaaaaaaaugcaaucacuguguuguauauaauaguucauagguugauc

SEQ ID NO: 535899 - RNA, 64 nt, Homo Sapiens
accccucaacuuuaauuugcccaguuauaccucaguguuguagcaguacugugauaccuggcac

SEQ ID NO: 535900 - RNA, 64 nt, Homo Sapiens
auuaaguuacaauuacaucuauuagcauaauuuuguguuguacaaaucccaguaggcuuuuacc

SEQ ID NO: 535901 - RNA, 64 nt, Homo Sapiens
gcugagcaagagagagagagaucauccuggagggguguuguaugaagcuccucacugguauacu

SEQ ID NO: 535902 - RNA, 64 nt, Homo Sapiens
aucguuuuggaauuugugccauugugcccuuuaaguguuguaaauacauucuauuccuguaauu

SEQ ID NO: 535903 - RNA, 64 nt, Homo Sapiens
cuucauccaaaagucagcuuuacucccugacacuguguuguaccuauagggaaaagaaaucacc

SEQ ID NO: 535904 - RNA, 64 nt, Homo Sapiens
uuacauuuucauuaugccccccuuuucuuucuuaguguuguaagcacuguguuccuauaaaggc

SEQ ID NO: 535905 - RNA, 64 nt, Homo Sapiens
uguaacacuggcacugaaauuaacuggaacauuuguguuguauccauuccguuugaauuccuuc

SEQ ID NO: 535906 - RNA, 64 nt, Homo Sapiens; identical to SEQ ID NO: 145890

SEQ ID NO: 535907 - RNA, 64 nt, Homo Sapiens; identical to SEQ ID NO: 145891

SEQ ID NO: 535908 - RNA, 64 nt, Homo Sapiens; identical to SEQ ID NO: 145892

SEQ ID NO: 535909 - RNA, 64 nt, Homo Sapiens; identical to SEQ ID NO: 145893

SEQ ID NO: 535910 - RNA, 64 nt, Homo Sapiens; identical to SEQ ID NO: 145894

SEQ ID NO: 535911 - RNA, 64 nt, Homo Sapiens; identical to SEQ ID NO: 145895

SEQ ID NO: 535912 - RNA, 64 nt, Homo Sapiens; identical to SEQ ID NO: 145896

SEQ ID NO: 535913 - RNA, 64 nt, Homo Sapiens; identical to SEQ ID NO: 145897

SEQ ID NO: 535914 - RNA, 64 nt, Homo Sapiens; identical to SEQ ID NO: 145898

SEQ ID NO: 535915 - RNA, 64 nt, Homo Sapiens; identical to SEQ ID NO: 145899

SEQ ID NO: 535916 - RNA, 64 nt, Homo Sapiens; identical to SEQ ID NO: 145900

SEQ ID NO: 535917 - RNA, 64 nt, Homo Sapiens; identical to SEQ ID NO: 145901

SEQ ID NO: 535918 - RNA, 64 nt, Homo Sapiens; identical to SEQ ID NO: 145902

SEQ ID NO: 535919 - RNA, 64 nt, Homo Sapiens; identical to SEQ ID NO: 145903

SEQ ID NO: 535920 - RNA, 64 nt, Homo Sapiens; identical to SEQ ID NO: 145904

SEQ ID NO: 535921 - RNA, 64 nt, Homo Sapiens; identical to SEQ ID NO: 145905

SEQ ID NO: 535922 - RNA, 64 nt, Homo Sapiens; identical to SEQ ID NO: 145906

SEQ ID NO: 535923 - RNA, 64 nt, Homo Sapiens; identical to SEQ ID NO: 145907

SEQ ID NO: 535924 - RNA, 62 nt, Homo Sapiens; identical to SEQ ID NO: 145908

SEQ ID NO: 535925 - RNA, 64 nt, Homo Sapiens; identical to SEQ ID NO: 145909

SEQ ID NO: 535926 - RNA, 64 nt, Homo Sapiens; identical to SEQ ID NO: 145910

SEQ ID NO: 535927 - RNA, 64 nt, Homo Sapiens; identical to SEQ ID NO: 145911

SEQ ID NO: 535928 - RNA, 64 nt, Homo Sapiens; identical to SEQ ID NO: 145912

SEQ ID NO: 535929 - RNA, 64 nt, Homo Sapiens; identical to SEQ ID NO: 145913

SEQ ID NO: 535930 - RNA, 64 nt, Homo Sapiens; identical to SEQ ID NO: 145914

SEQ ID NO: 535931 - RNA, 64 nt, Homo Sapiens; identical to SEQ ID NO: 145915

SEQ ID NO: 535932 - RNA, 64 nt, Homo Sapiens; identical to SEQ ID NO: 145916

SEQ ID NO: 535933 - RNA, 64 nt, Homo Sapiens; identical to SEQ ID NO: 145917

SEQ ID NO: 535934 - RNA, 64 nt, Homo Sapiens; identical to SEQ ID NO: 145918

SEQ ID NO: 535935 - RNA, 64 nt, Homo Sapiens; identical to SEQ ID NO: 145919

SEQ ID NO: 535936 - RNA, 64 nt, Homo Sapiens; identical to SEQ ID NO: 145920

SEQ ID NO: 535937 - RNA, 64 nt, Homo Sapiens; identical to SEQ ID NO: 145921

SEQ ID NO: 535938 - RNA, 64 nt, Homo Sapiens; identical to SEQ ID NO: 145922

SEQ ID NO: 535939 - RNA, 64 nt, Homo Sapiens; identical to SEQ ID NO: 145923

SEQ ID NO: 535940 - RNA, 64 nt, Homo Sapiens; identical to SEQ ID NO: 145924

SEQ ID NO: 535941 - RNA, 64 nt, Homo Sapiens; identical to SEQ ID NO: 145925

SEQ ID NO: 535942 - RNA, 64 nt, Homo Sapiens; identical to SEQ ID NO: 145926

SEQ ID NO: 535943 - RNA, 64 nt, Homo Sapiens; identical to SEQ ID NO: 145927

SEQ ID NO: 535944 - RNA, 64 nt, Homo Sapiens; identical to SEQ ID NO: 145928

SEQ ID NO: 535945 - RNA, 64 nt, Homo Sapiens; identical to SEQ ID NO: 145929

SEQ ID NO: 535946 - RNA, 64 nt, Homo Sapiens; identical to SEQ ID NO: 145930

SEQ ID NO: 535947 - RNA, 64 nt, Homo Sapiens; identical to SEQ ID NO: 145931

SEQ ID NO: 535948 - RNA, 64 nt, Homo Sapiens; identical to SEQ ID NO: 145932

SEQ ID NO: 535949 - RNA, 64 nt, Homo Sapiens; identical to SEQ ID NO: 145933

SEQ ID NO: 535950 - RNA, 64 nt, Homo Sapiens; identical to SEQ ID NO: 145934

SEQ ID NO: 535951 - RNA, 64 nt, Homo Sapiens; identical to SEQ ID NO: 145935

SEQ ID NO: 535952 - RNA, 64 nt, Homo Sapiens; identical to SEQ ID NO: 145936

SEQ ID NO: 535953 - RNA, 64 nt, Homo Sapiens; identical to SEQ ID NO: 145937

SEQ ID NO: 535954 - RNA, 64 nt, Homo Sapiens; identical to SEQ ID NO: 145938

SEQ ID NO: 535955 - RNA, 64 nt, Homo Sapiens; identical to SEQ ID NO: 145939

SEQ ID NO: 535956 - RNA, 64 nt, Homo Sapiens; identical to SEQ ID NO: 145940

SEQ ID NO: 535957 - RNA, 64 nt, Homo Sapiens; identical to SEQ ID NO: 145941

SEQ ID NO: 535958 - RNA, 64 nt, Homo Sapiens; identical to SEQ ID NO: 145942

SEQ ID NO: 535959 - RNA, 64 nt, Homo Sapiens; identical to SEQ ID NO: 145943

SEQ ID NO: 535960 - RNA, 64 nt, Homo Sapiens; identical to SEQ ID NO: 145944

SEQ ID NO: 535961 - RNA, 64 nt, Homo Sapiens; identical to SEQ ID NO: 145945

SEQ ID NO: 535962 - RNA, 64 nt, Homo Sapiens; identical to SEQ ID NO: 145946

SEQ ID NO: 535963 - RNA, 64 nt, Homo Sapiens; identical to SEQ ID NO: 145947

SEQ ID NO: 535964 - RNA, 64 nt, Homo Sapiens; identical to SEQ ID NO: 145948

SEQ ID NO: 535965 - RNA, 64 nt, Homo Sapiens; identical to SEQ ID NO: 145949

SEQ ID NO: 535966 - RNA, 64 nt, Homo Sapiens; identical to SEQ ID NO: 145950

SEQ ID NO: 535967 - RNA, 64 nt, Homo Sapiens; identical to SEQ ID NO: 145951

SEQ ID NO: 535968 - RNA, 64 nt, Homo Sapiens; identical to SEQ ID NO: 145952

SEQ ID NO: 535969 - RNA, 64 nt, Homo Sapiens; identical to SEQ ID NO: 145953

SEQ ID NO: 535970 - RNA, 64 nt, Homo Sapiens; identical to SEQ ID NO: 145954

SEQ ID NO: 535971 - RNA, 64 nt, Homo Sapiens; identical to SEQ ID NO: 145955

SEQ ID NO: 535972 - RNA, 64 nt, Homo Sapiens; identical to SEQ ID NO: 145956

SEQ ID NO: 535973 - RNA, 64 nt, Homo Sapiens; identical to SEQ ID NO: 145957

SEQ ID NO: 535974 - RNA, 64 nt, Homo Sapiens; identical to SEQ ID NO: 145958

SEQ ID NO: 535975 - RNA, 64 nt, Homo Sapiens; identical to SEQ ID NO: 145959

SEQ ID NO: 535976 - RNA, 64 nt, Homo Sapiens; identical to SEQ ID NO: 145960

SEQ ID NO: 535977 - RNA, 64 nt, Homo Sapiens; identical to SEQ ID NO: 145961

SEQ ID NO: 535978 - RNA, 64 nt, Homo Sapiens; identical to SEQ ID NO: 145962

SEQ ID NO: 535979 - RNA, 64 nt, Homo Sapiens; identical to SEQ ID NO: 145963

SEQ ID NO: 535980 - RNA, 64 nt, Homo Sapiens; identical to SEQ ID NO: 145964

SEQ ID NO: 535981 - RNA, 64 nt, Homo Sapiens; identical to SEQ ID NO: 145965

SEQ ID NO: 535982 - RNA, 64 nt, Homo Sapiens; identical to SEQ ID NO: 145966

SEQ ID NO: 535983 - RNA, 64 nt, Homo Sapiens; identical to SEQ ID NO: 145967

SEQ ID NO: 535984 - RNA, 64 nt, Homo Sapiens; identical to SEQ ID NO: 145968

SEQ ID NO: 535985 - RNA, 64 nt, Homo Sapiens; identical to SEQ ID NO: 145969

SEQ ID NO: 535986 - RNA, 64 nt, Homo Sapiens; identical to SEQ ID NO: 145970

SEQ ID NO: 535987 - RNA, 64 nt, Homo Sapiens; identical to SEQ ID NO: 145971

SEQ ID NO: 535988 - RNA, 64 nt, Homo Sapiens; identical to SEQ ID NO: 145972

SEQ ID NO: 535989 - RNA, 64 nt, Homo Sapiens; identical to SEQ ID NO: 145973

SEQ ID NO: 535990 - RNA, 64 nt, Homo Sapiens; identical to SEQ ID NO: 145974

SEQ ID NO: 535991 - RNA, 64 nt, Homo Sapiens; identical to SEQ ID NO: 145975

SEQ ID NO: 535992 - RNA, 64 nt, Homo Sapiens; identical to SEQ ID NO: 145976

SEQ ID NO: 535993 - RNA, 64 nt, Homo Sapiens; identical to SEQ ID NO: 145977

SEQ ID NO: 535994 - RNA, 64 nt, Homo Sapiens; identical to SEQ ID NO: 145978

SEQ ID NO: 535995 - RNA, 64 nt, Homo Sapiens; identical to SEQ ID NO: 145979

SEQ ID NO: 535996 - RNA, 64 nt, Homo Sapiens; identical to SEQ ID NO: 145980

SEQ ID NO: 535997 - RNA, 64 nt, Homo Sapiens; identical to SEQ ID NO: 145981

SEQ ID NO: 535998 - RNA, 64 nt, Homo Sapiens; identical to SEQ ID NO: 145982

SEQ ID NO: 535999 - RNA, 64 nt, Homo Sapiens; identical to SEQ ID NO: 145983

SEQ ID NO: 536000 - RNA, 64 nt, Homo Sapiens; identical to SEQ ID NO: 145984

SEQ ID NO: 536001 - RNA, 64 nt, Homo Sapiens; identical to SEQ ID NO: 145985

SEQ ID NO: 536002 - RNA, 64 nt, Homo Sapiens; identical to SEQ ID NO: 145986

SEQ ID NO: 536003 - RNA, 64 nt, Homo Sapiens; identical to SEQ ID NO: 145987

SEQ ID NO: 536004 - RNA, 64 nt, Homo Sapiens; identical to SEQ ID NO: 145988

SEQ ID NO: 536005 - RNA, 64 nt, Homo Sapiens; identical to SEQ ID NO: 145989

SEQ ID NO: 536006 - RNA, 64 nt, Homo Sapiens; identical to SEQ ID NO: 145990

SEQ ID NO: 536007 - RNA, 64 nt, Homo Sapiens; identical to SEQ ID NO: 145991

SEQ ID NO: 536008 - RNA, 64 nt, Homo Sapiens; identical to SEQ ID NO: 145992

SEQ ID NO: 536009 - RNA, 64 nt, Homo Sapiens; identical to SEQ ID NO: 145993

SEQ ID NO: 536010 - RNA, 64 nt, Homo Sapiens; identical to SEQ ID NO: 145994

SEQ ID NO: 536011 - RNA, 64 nt, Homo Sapiens; identical to SEQ ID NO: 145995

SEQ ID NO: 536012 - RNA, 64 nt, Homo Sapiens; identical to SEQ ID NO: 145996

SEQ ID NO: 536013 - RNA, 64 nt, Homo Sapiens; identical to SEQ ID NO: 145997

SEQ ID NO: 536014 - RNA, 64 nt, Homo Sapiens; identical to SEQ ID NO: 145998

SEQ ID NO: 536015 - RNA, 64 nt, Homo Sapiens
acugaaaauauuggccauuuuacucaaguuguacuacccacauauuuugucauguaaaaaaggu

SEQ ID NO: 536016 - RNA, 64 nt, Homo Sapiens
auacauacauacauauauauuuuuuaagacuauguacccacacccaaaucacauuacuggguaa

SEQ ID NO: 536017 - RNA, 64 nt, Homo Sapiens
agcaaaugacaacgugucuguacgcccauuuuccuacccacagcuguaucuguuucuccuccuu

SEQ ID NO: 536018 - RNA, 64 nt, Homo Sapiens
ggugguuauuacagcaugguagacccuuuuugauuacccacacuccaacccucuuaaaugucaa

SEQ ID NO: 536019 - RNA, 64 nt, Homo Sapiens
gcccccagacagaaucuagccccaccuuuccagauacccacaaagauccccaaagaagcugcgc

SEQ ID NO: 536020 - RNA, 64 nt, Homo Sapiens
cagccaucuggagucauggacggugagguuuugauacccacaccggggaggggacugggacugg

SEQ ID NO: 536021 - RNA, 64 nt, Homo Sapiens
ucuccccucacauccuccugcccagcuccucacauacccacacauuccagggcuggggugagcc

SEQ ID NO: 536022 - RNA, 64 nt, Homo Sapiens
ccugccauuggccucuugucccuuggcacacuuguacccacaggugaggggcaggaccugaagg

SEQ ID NO: 536023 - RNA, 64 nt, Homo Sapiens; identical to SEQ ID NO: 210736

SEQ ID NO: 536024 - RNA, 64 nt, Homo Sapiens; identical to SEQ ID NO: 210737

SEQ ID NO: 536025 - RNA, 64 nt, Homo Sapiens; identical to SEQ ID NO: 210738

SEQ ID NO: 536026 - RNA, 64 nt, Homo Sapiens; identical to SEQ ID NO: 210739

SEQ ID NO: 536027 - RNA, 64 nt, Homo Sapiens; identical to SEQ ID NO: 210740

SEQ ID NO: 536028 - RNA, 64 nt, Homo Sapiens; identical to SEQ ID NO: 210741

SEQ ID NO: 536029 - RNA, 64 nt, Homo Sapiens; identical to SEQ ID NO: 210742

SEQ ID NO: 536030 - RNA, 64 nt, Homo Sapiens; identical to SEQ ID NO: 210743

SEQ ID NO: 536031 - RNA, 64 nt, Homo Sapiens; identical to SEQ ID NO: 210744

SEQ ID NO: 536032 - RNA, 64 nt, Homo Sapiens; identical to SEQ ID NO: 210745

SEQ ID NO: 536033 - RNA, 64 nt, Homo Sapiens; identical to SEQ ID NO: 210746

SEQ ID NO: 536034 - RNA, 64 nt, Homo Sapiens; identical to SEQ ID NO: 210747

SEQ ID NO: 536035 - RNA, 64 nt, Homo Sapiens; identical to SEQ ID NO: 210748

SEQ ID NO: 536036 - RNA, 64 nt, Homo Sapiens; identical to SEQ ID NO: 210749

SEQ ID NO: 536037 - RNA, 64 nt, Homo Sapiens; identical to SEQ ID NO: 210750

SEQ ID NO: 536038 - RNA, 64 nt, Homo Sapiens; identical to SEQ ID NO: 210751

SEQ ID NO: 536039 - RNA, 64 nt, Homo Sapiens; identical to SEQ ID NO: 210752

SEQ ID NO: 536040 - RNA, 64 nt, Homo Sapiens; identical to SEQ ID NO: 210753

SEQ ID NO: 536041 - RNA, 64 nt, Homo Sapiens; identical to SEQ ID NO: 210754

SEQ ID NO: 536042 - RNA, 64 nt, Homo Sapiens; identical to SEQ ID NO: 210755

SEQ ID NO: 536043 - RNA, 64 nt, Homo Sapiens; identical to SEQ ID NO: 210756

SEQ ID NO: 536044 - RNA, 64 nt, Homo Sapiens; identical to SEQ ID NO: 210757

SEQ ID NO: 536045 - RNA, 64 nt, Homo Sapiens; identical to SEQ ID NO: 210758

SEQ ID NO: 536046 - RNA, 64 nt, Homo Sapiens; identical to SEQ ID NO: 210759

SEQ ID NO: 536047 - RNA, 64 nt, Homo Sapiens; identical to SEQ ID NO: 210760

SEQ ID NO: 536048 - RNA, 64 nt, Homo Sapiens; identical to SEQ ID NO: 210761

SEQ ID NO: 536049 - RNA, 64 nt, Homo Sapiens; identical to SEQ ID NO: 210762

SEQ ID NO: 536050 - RNA, 64 nt, Homo Sapiens; identical to SEQ ID NO: 210763

SEQ ID NO: 536051 - RNA, 64 nt, Homo Sapiens; identical to SEQ ID NO: 210764

SEQ ID NO: 536052 - RNA, 64 nt, Homo Sapiens; identical to SEQ ID NO: 210765

SEQ ID NO: 536053 - RNA, 64 nt, Homo Sapiens; identical to SEQ ID NO: 210766

SEQ ID NO: 536054 - RNA, 64 nt, Homo Sapiens; identical to SEQ ID NO: 210767

SEQ ID NO: 536055 - RNA, 64 nt, Homo Sapiens; identical to SEQ ID NO: 210768

SEQ ID NO: 536056 - RNA, 64 nt, Homo Sapiens; identical to SEQ ID NO: 210769

SEQ ID NO: 536057 - RNA, 64 nt, Homo Sapiens; identical to SEQ ID NO: 210770

SEQ ID NO: 536058 - RNA, 64 nt, Homo Sapiens; identical to SEQ ID NO: 210771

SEQ ID NO: 536059 - RNA, 64 nt, Homo Sapiens; identical to SEQ ID NO: 210772

SEQ ID NO: 536060 - RNA, 64 nt, Homo Sapiens; identical to SEQ ID NO: 210773

SEQ ID NO: 536061 - RNA, 64 nt, Homo Sapiens; identical to SEQ ID NO: 210774

SEQ ID NO: 536062 - RNA, 64 nt, Homo Sapiens; identical to SEQ ID NO: 210775

SEQ ID NO: 536063 - RNA, 64 nt, Homo Sapiens; identical to SEQ ID NO: 210776

SEQ ID NO: 536064 - RNA, 64 nt, Homo Sapiens; identical to SEQ ID NO: 210777

SEQ ID NO: 536065 - RNA, 64 nt, Homo Sapiens; identical to SEQ ID NO: 210778

SEQ ID NO: 536066 - RNA, 64 nt, Homo Sapiens; identical to SEQ ID NO: 210779

SEQ ID NO: 536067 - RNA, 64 nt, Homo Sapiens; identical to SEQ ID NO: 210780

SEQ ID NO: 536068 - RNA, 64 nt, Homo Sapiens; identical to SEQ ID NO: 210781

SEQ ID NO: 536069 - RNA, 64 nt, Homo Sapiens; identical to SEQ ID NO: 210782

SEQ ID NO: 536070 - RNA, 64 nt, Homo Sapiens; identical to SEQ ID NO: 210783

SEQ ID NO: 536071 - RNA, 64 nt, Homo Sapiens; identical to SEQ ID NO: 210784

SEQ ID NO: 536072 - RNA, 64 nt, Homo Sapiens; identical to SEQ ID NO: 210785

SEQ ID NO: 536073 - RNA, 64 nt, Homo Sapiens; identical to SEQ ID NO: 210786

SEQ ID NO: 536074 - RNA, 64 nt, Homo Sapiens; identical to SEQ ID NO: 210787

SEQ ID NO: 536075 - RNA, 64 nt, Homo Sapiens; identical to SEQ ID NO: 210788

SEQ ID NO: 536076 - RNA, 64 nt, Homo Sapiens; identical to SEQ ID NO: 210789

SEQ ID NO: 536077 - RNA, 64 nt, Homo Sapiens; identical to SEQ ID NO: 210790

SEQ ID NO: 536078 - RNA, 64 nt, Homo Sapiens; identical to SEQ ID NO: 210791

SEQ ID NO: 536079 - RNA, 64 nt, Homo Sapiens; identical to SEQ ID NO: 210792

SEQ ID NO: 536080 - RNA, 64 nt, Homo Sapiens; identical to SEQ ID NO: 210793

SEQ ID NO: 536081 - RNA, 64 nt, Homo Sapiens; identical to SEQ ID NO: 210794

SEQ ID NO: 536082 - RNA, 64 nt, Homo Sapiens; identical to SEQ ID NO: 210795

SEQ ID NO: 536083 - RNA, 64 nt, Homo Sapiens; identical to SEQ ID NO: 210796

SEQ ID NO: 536084 - RNA, 64 nt, Homo Sapiens; identical to SEQ ID NO: 210797

SEQ ID NO: 536085 - RNA, 64 nt, Homo Sapiens; identical to SEQ ID NO: 210798

SEQ ID NO: 536086 - RNA, 64 nt, Homo Sapiens; identical to SEQ ID NO: 210799

SEQ ID NO: 536087 - RNA, 64 nt, Homo Sapiens; identical to SEQ ID NO: 210800

SEQ ID NO: 536088 - RNA, 64 nt, Homo Sapiens; identical to SEQ ID NO: 210801

SEQ ID NO: 536089 - RNA, 64 nt, Homo Sapiens; identical to SEQ ID NO: 210802

SEQ ID NO: 536090 - RNA, 64 nt, Homo Sapiens; identical to SEQ ID NO: 210803

SEQ ID NO: 536091 - RNA, 64 nt, Homo Sapiens; identical to SEQ ID NO: 210804

SEQ ID NO: 536092 - RNA, 64 nt, Homo Sapiens; identical to SEQ ID NO: 210805

SEQ ID NO: 536093 - RNA, 64 nt, Homo Sapiens; identical to SEQ ID NO: 210806

SEQ ID NO: 536094 - RNA, 64 nt, Homo Sapiens; identical to SEQ ID NO: 210807

SEQ ID NO: 536095 - RNA, 64 nt, Homo Sapiens; identical to SEQ ID NO: 210808

SEQ ID NO: 536096 - RNA, 64 nt, Homo Sapiens; identical to SEQ ID NO: 210809

SEQ ID NO: 536097 - RNA, 64 nt, Homo Sapiens; identical to SEQ ID NO: 271003

SEQ ID NO: 536098 - RNA, 64 nt, Homo Sapiens; identical to SEQ ID NO: 271004

SEQ ID NO: 536099 - RNA, 64 nt, Homo Sapiens; identical to SEQ ID NO: 271005

SEQ ID NO: 536100 - RNA, 64 nt, Homo Sapiens; identical to SEQ ID NO: 271006

SEQ ID NO: 536101 - RNA, 64 nt, Homo Sapiens; identical to SEQ ID NO: 271007

SEQ ID NO: 536102 - RNA, 64 nt, Homo Sapiens; identical to SEQ ID NO: 271008

SEQ ID NO: 536103 - RNA, 64 nt, Homo Sapiens; identical to SEQ ID NO: 271009

SEQ ID NO: 536104 - RNA, 64 nt, Homo Sapiens; identical to SEQ ID NO: 271010

SEQ ID NO: 536105 - RNA, 64 nt, Homo Sapiens; identical to SEQ ID NO: 271011

SEQ ID NO: 536106 - RNA, 64 nt, Homo Sapiens; identical to SEQ ID NO: 271012

SEQ ID NO: 536107 - RNA, 64 nt, Homo Sapiens; identical to SEQ ID NO: 271013

SEQ ID NO: 536108 - RNA, 64 nt, Homo Sapiens; identical to SEQ ID NO: 271014

SEQ ID NO: 536109 - RNA, 64 nt, Homo Sapiens; identical to SEQ ID NO: 311803

SEQ ID NO: 536110 - RNA, 64 nt, Homo Sapiens; identical to SEQ ID NO: 311804

SEQ ID NO: 536111 - RNA, 64 nt, Homo Sapiens; identical to SEQ ID NO: 311805

SEQ ID NO: 536112 - RNA, 64 nt, Homo Sapiens; identical to SEQ ID NO: 311806

SEQ ID NO: 536113 - RNA, 64 nt, Homo Sapiens; identical to SEQ ID NO: 311807

SEQ ID NO: 536114 - RNA, 64 nt, Homo Sapiens; identical to SEQ ID NO: 311808

SEQ ID NO: 536115 - RNA, 64 nt, Homo Sapiens; identical to SEQ ID NO: 311809

SEQ ID NO: 536116 - RNA, 64 nt, Homo Sapiens; identical to SEQ ID NO: 311810

SEQ ID NO: 536117 - RNA, 64 nt, Homo Sapiens; identical to SEQ ID NO: 311811

SEQ ID NO: 536118 - RNA, 64 nt, Homo Sapiens; identical to SEQ ID NO: 311812

SEQ ID NO: 536119 - RNA, 64 nt, Homo Sapiens; identical to SEQ ID NO: 311813

SEQ ID NO: 536120 - RNA, 64 nt, Homo Sapiens; identical to SEQ ID NO: 311814

SEQ ID NO: 536121 - RNA, 64 nt, Homo Sapiens; identical to SEQ ID NO: 311815

SEQ ID NO: 536122 - RNA, 64 nt, Homo Sapiens; identical to SEQ ID NO: 311816

SEQ ID NO: 536123 - RNA, 64 nt, Homo Sapiens; identical to SEQ ID NO: 311817

SEQ ID NO: 536124 - RNA, 64 nt, Homo Sapiens; identical to SEQ ID NO: 311818

SEQ ID NO: 536125 - RNA, 64 nt, Homo Sapiens; identical to SEQ ID NO: 311819

SEQ ID NO: 536126 - RNA, 64 nt, Homo Sapiens; identical to SEQ ID NO: 311820

SEQ ID NO: 536127 - RNA, 64 nt, Homo Sapiens; identical to SEQ ID NO: 311821

SEQ ID NO: 536128 - RNA, 64 nt, Homo Sapiens; identical to SEQ ID NO: 311822

SEQ ID NO: 536129 - RNA, 64 nt, Homo Sapiens; identical to SEQ ID NO: 311823

SEQ ID NO: 536130 - RNA, 64 nt, Homo Sapiens; identical to SEQ ID NO: 311824

SEQ ID NO: 536131 - RNA, 64 nt, Homo Sapiens; identical to SEQ ID NO: 311825

SEQ ID NO: 536132 - RNA, 64 nt, Homo Sapiens; identical to SEQ ID NO: 311824

SEQ ID NO: 536133 - RNA, 64 nt, Homo Sapiens; identical to SEQ ID NO: 311824

SEQ ID NO: 536134 - RNA, 64 nt, Homo Sapiens; identical to SEQ ID NO: 311828

SEQ ID NO: 536135 - RNA, 64 nt, Homo Sapiens; identical to SEQ ID NO: 311829

SEQ ID NO: 536136 - RNA, 64 nt, Homo Sapiens; identical to SEQ ID NO: 311830

SEQ ID NO: 536137 - RNA, 64 nt, Homo Sapiens; identical to SEQ ID NO: 311831

SEQ ID NO: 536138 - RNA, 64 nt, Homo Sapiens; identical to SEQ ID NO: 311832

SEQ ID NO: 536139 - RNA, 64 nt, Homo Sapiens; identical to SEQ ID NO: 311833

SEQ ID NO: 536140 - RNA, 64 nt, Homo Sapiens; identical to SEQ ID NO: 311834

SEQ ID NO: 536141 - RNA, 64 nt, Homo Sapiens; identical to SEQ ID NO: 311835

SEQ ID NO: 536142 - RNA, 64 nt, Homo Sapiens; identical to SEQ ID NO: 311836

SEQ ID NO: 536143 - RNA, 64 nt, Homo Sapiens; identical to SEQ ID NO: 311837

SEQ ID NO: 536144 - RNA, 64 nt, Homo Sapiens; identical to SEQ ID NO: 311838

SEQ ID NO: 536145 - RNA, 64 nt, Homo Sapiens; identical to SEQ ID NO: 311839

SEQ ID NO: 536146 - RNA, 64 nt, Homo Sapiens; identical to SEQ ID NO: 311840

SEQ ID NO: 536147 - RNA, 64 nt, Homo Sapiens; identical to SEQ ID NO: 311841

SEQ ID NO: 536148 - RNA, 64 nt, Homo Sapiens; identical to SEQ ID NO: 311842

SEQ ID NO: 536149 - RNA, 64 nt, Homo Sapiens; identical to SEQ ID NO: 311843

SEQ ID NO: 536150 - RNA, 64 nt, Homo Sapiens; identical to SEQ ID NO: 311844

SEQ ID NO: 536151 - RNA, 64 nt, Homo Sapiens; identical to SEQ ID NO: 311845

SEQ ID NO: 536152 - RNA, 64 nt, Homo Sapiens; identical to SEQ ID NO: 311846

SEQ ID NO: 536153 - RNA, 64 nt, Homo Sapiens
caaccgacccuggcucaggagguugaugccaugggaaccugaaccugaaacacuucaugguagu

SEQ ID NO: 536154 - RNA, 64 nt, Homo Sapiens
acccuggcucaggagguugaugccaugggaaccugaaccugaaacacuucaugguaguaauuuc

SEQ ID NO: 536155 - RNA, 64 nt, Homo Sapiens
aguaaaaguugugccucaaauuagaauagaacuugaaccugaagacaaugauuauuucuggagg

SEQ ID NO: 536156 - RNA, 64 nt, Homo Sapiens
auccuuuucauacuacuuaaugauuuuggugcaggaaccugagauuuucugauuuauauuucau

SEQ ID NO: 536157 - RNA, 64 nt, Homo Sapiens
ccucuccucaccuccuuuucucucagugacucuggaaccugaaugcagcuuacaagacaagccu

SEQ ID NO: 536158 - RNA, 64 nt, Homo Sapiens
agucuguuuaauugccuauuacuucucucaaagagaaccugaagucagaacacaugagcagggu

SEQ ID NO: 536159 - RNA, 64 nt, Homo Sapiens
gacaccuugauuuguguugucauccacagcuauggaaccugagcacaucugacacccuaaaagc

SEQ ID NO: 536160 - RNA, 64 nt, Homo Sapiens
aaaccuacaccucuacagcagguugcugaugagagaaccugaaacccacacuuaccuuccggug

SEQ ID NO: 536161 - RNA, 64 nt, Homo Sapiens
cuggcugagauggcuaggcgaugggugggagaaggaaccugagcgacaaguccugcuuggccug

SEQ ID NO: 536162 - RNA, 64 nt, Homo Sapiens
aucugaggcaagcuggacagccucagagaagagagaaccugaagaggauguagaagcuuagcug

SEQ ID NO: 536163 - RNA, 64 nt, Homo Sapiens
uuguguaaaggacaaaagacuaauugcgugcaaugaaccugaaaccgauuugugggaguuuaug

SEQ ID NO: 536164 - RNA, 64 nt, Homo Sapiens
agaaauuuuggaaggguucuuucucacguccuaagaaccugauccugcccucuugagaggucau

SEQ ID NO: 536165 - RNA, 64 nt, Homo Sapiens; identical to SEQ ID NO: 99218

SEQ ID NO: 536166 - RNA, 64 nt, Homo Sapiens; identical to SEQ ID NO: 99219

SEQ ID NO: 536167 - RNA, 64 nt, Homo Sapiens; identical to SEQ ID NO: 99220

SEQ ID NO: 536168 - RNA, 64 nt, Homo Sapiens; identical to SEQ ID NO: 99221

SEQ ID NO: 536169 - RNA, 64 nt, Homo Sapiens; identical to SEQ ID NO: 99222

SEQ ID NO: 536170 - RNA, 64 nt, Homo Sapiens; identical to SEQ ID NO: 99223

SEQ ID NO: 536171 - RNA, 64 nt, Homo Sapiens; identical to SEQ ID NO: 99224

SEQ ID NO: 536172 - RNA, 64 nt, Homo Sapiens; identical to SEQ ID NO: 99225

SEQ ID NO: 536173 - RNA, 64 nt, Homo Sapiens; identical to SEQ ID NO: 99226

SEQ ID NO: 536174 - RNA, 64 nt, Homo Sapiens; identical to SEQ ID NO: 99227

SEQ ID NO: 536175 - RNA, 64 nt, Homo Sapiens; identical to SEQ ID NO: 99228

SEQ ID NO: 536176 - RNA, 64 nt, Homo Sapiens; identical to SEQ ID NO: 99229

SEQ ID NO: 536177 - RNA, 64 nt, Homo Sapiens; identical to SEQ ID NO: 99230

SEQ ID NO: 536178 - RNA, 64 nt, Homo Sapiens; identical to SEQ ID NO: 99231

SEQ ID NO: 536179 - RNA, 64 nt, Homo Sapiens; identical to SEQ ID NO: 99232

SEQ ID NO: 536180 - RNA, 64 nt, Homo Sapiens; identical to SEQ ID NO: 99233

SEQ ID NO: 536181 - RNA, 64 nt, Homo Sapiens; identical to SEQ ID NO: 99234

SEQ ID NO: 536182 - RNA, 64 nt, Homo Sapiens; identical to SEQ ID NO: 99235

SEQ ID NO: 536183 - RNA, 64 nt, Homo Sapiens; identical to SEQ ID NO: 99236

SEQ ID NO: 536184 - RNA, 64 nt, Homo Sapiens; identical to SEQ ID NO: 99237

SEQ ID NO: 536185 - RNA, 64 nt, Homo Sapiens; identical to SEQ ID NO: 99238

SEQ ID NO: 536186 - RNA, 64 nt, Homo Sapiens; identical to SEQ ID NO: 99239

SEQ ID NO: 536187 - RNA, 64 nt, Homo Sapiens; identical to SEQ ID NO: 99240

SEQ ID NO: 536188 - RNA, 64 nt, Homo Sapiens; identical to SEQ ID NO: 99241

SEQ ID NO: 536189 - RNA, 64 nt, Homo Sapiens
ggacguucuaggagcaauuggggcaagaagaggacagugauauuuuaaaacaaaguguguuaca

SEQ ID NO: 536190 - RNA, 64 nt, Homo Sapiens
ggguaaguucuccuccacuguuugaccaaauucucagugauaaauaugugugcagaucccuaga

SEQ ID NO: 536191 - RNA, 64 nt, Homo Sapiens
uccuuguuaaaaaaaaaaaaagcuaaaauaagcucagugauaccauaauaugaugccacuuugc

SEQ ID NO: 536192 - RNA, 64 nt, Homo Sapiens
uuucuauguguaugcaaguaaggacgaauuugcacagugauauagaaauucaguuauaaaguca

SEQ ID NO: 536193 - RNA, 64 nt, Homo Sapiens
accuucugguugcuucagaccugacaccgucccucagugauacguacagccaaaaaggaccaac

SEQ ID NO: 536194 - RNA, 64 nt, Homo Sapiens
uuugggccaagguguuuccauuucucaaucagugcagugauacauguacuccagagggacaggg

SEQ ID NO: 536195 - RNA, 64 nt, Homo Sapiens
gaaaugacuuuuaagcaguuaccucacuagucaccagugauacacccauuucacugugcaagac

SEQ ID NO: 536196 - RNA, 64 nt, Homo Sapiens
aaaagguuaaguaugccaguugaauaaauguuuucagugauaugaucgaucuacauacaauaga

SEQ ID NO: 536197 - RNA, 64 nt, Homo Sapiens
cuuaaagauuguauuuucacugaucugcugauaccagugauagggguacuguauuuuuuuauau

SEQ ID NO: 536198 - RNA, 64 nt, Homo Sapiens
uauauuuugaaguucuuaauaaggacuauggucucagugauaagaguggacugaaaacuaaugc

SEQ ID NO: 536199 - RNA, 64 nt, Homo Sapiens
cgagagagggcuggacauccuacguggaggacgggaccggaagaauccggcaacagucugaaag

SEQ ID NO: 536200 - RNA, 64 nt, Homo Sapiens
accaaaugcuggugcugcuuacguggcgccuguggaccggaagccagagauaguccuggaagac

SEQ ID NO: 536201 - RNA, 64 nt, Homo Sapiens
uagaaagccccuauaaugugguugggaaauugaugaccggaaacagguauagggaagggcauuc

SEQ ID NO: 536202 - RNA, 64 nt, Homo Sapiens
gccgggaacuguccgaggugcugagcuggggcgggaccggaauccucccgguaggguaccaggg

SEQ ID NO: 536203 - RNA, 64 nt, Homo Sapiens
gugaccuguuaaaagccacgacugaucgccuugugaccggaagacaggggagagacccagcggc

SEQ ID NO: 536204 - RNA, 51 nt, Homo Sapiens
uugagcucuuuggccccugaugaccggaacacagcugaggacccuuguccu

SEQ ID NO: 536205 - RNA, 64 nt, Homo Sapiens
gucauugccagacagaauuggauggcccauuuuggaccggaacuuuuuuuuuaaaugaucauaa

SEQ ID NO: 536206 - RNA, 64 nt, Homo Sapiens
cgaaucccccaugugucucuuucagagcuggccagaccggaaauaaaucauucucauaaauuca

SEQ ID NO: 536207 - RNA, 64 nt, Homo Sapiens
ccuggguccccaccaugcucucaccgccaggggggaccggaauggaacgaggccauugguaccc

SEQ ID NO: 536208 - RNA, 64 nt, Homo Sapiens
accuucucuucugucaugacucuaucaucucuaggaccggaacuacuccuuuuuuucccauugu

SEQ ID NO: 536209 - RNA, 64 nt, Homo Sapiens
caugguuuauaggaaaugaucucaguaauauagagaccggaauaaccaagaaucuaacaucacu

SEQ ID NO: 536210 - RNA, 64 nt, Homo Sapiens
ccugggacccuaagaacccccagauccuucucuugaccggaaaccucugcccuggccacguuca

SEQ ID NO: 536211 - RNA, 64 nt, Homo Sapiens
gucaaaucucuccaccucuaugaauucauuugcugaccggaauguacacuuaaacuugcacauu

SEQ ID NO: 536212 - RNA, 64 nt, Homo Sapiens
ggcucuuccucccagagcagccggcagcuaccuggaccggaaauguccucauccccucccuggg

SEQ ID NO: 536213 - RNA, 64 nt, Homo Sapiens
cacccuggacugaaguucugcaaaguccuccgaggaccggaacacguuucugcgacccggggcu

SEQ ID NO: 536214 - RNA, 64 nt, Homo Sapiens
gggcucucucaaguucugaagggaggcccggggcgaccggaaaaaggaagagcugaggcugccu

SEQ ID NO: 536215 - RNA, 64 nt, Homo Sapiens
ugaggcuuagcuauguuuccauuacuuucugcuugaccggaaguuggcauuuucggcacuuuuc

SEQ ID NO: 536216 - RNA, 64 nt, Homo Sapiens
guuuuggucauuuuuaaaaauaccuaaagugccagaccggaaccuauagcuacugcuagaaguc

SEQ ID NO: 536217 - RNA, 52 nt, Homo Sapiens
ugaagagucagaacuaacuucagaccggaaagccccugcucccacacaguga

SEQ ID NO: 536218 - RNA, 64 nt, Homo Sapiens
ugugugagggcaguucuggagaugagcagagagagaccggaauaaacucaaucuuuucuuuccc

SEQ ID NO: 536219 - RNA, 64 nt, Homo Sapiens
gaggguuguuuugguuucggacgacccuugcucugaccggaagagaagucccuaucccacaccu

SEQ ID NO: 536220 - RNA, 64 nt, Homo Sapiens
uccaggugaaucucgucauaguucugagcucacugaccggaagggugacgcuguggugugaggu

SEQ ID NO: 536221 - RNA, 64 nt, Homo Sapiens
caccaugcuucacagagaccauucuguagcaagagaccggaacauugugacuuggaccuuuuca

SEQ ID NO: 536222 - RNA, 64 nt, Homo Sapiens
ucgagucucgagagggccacggggugguuuuuaugaccggaaucccgcuuccucccucacgucu

SEQ ID NO: 536223 - RNA, 64 nt, Homo Sapiens
ccugguggcccugaugcagaagaaccggcggaaggaccggaagcuaggggccagucucuucacc

SEQ ID NO: 536224 - RNA, 64 nt, Homo Sapiens
ugcagaacaggaccuuggcucuaaauuaaugguugaccggaagggauuggaggcggcagaacca

SEQ ID NO: 536225 - RNA, 64 nt, Homo Sapiens
auggacuuggucugaugcugaaugggccacuugggaccggaagugacuugcuccagacaagagg

SEQ ID NO: 536226 - RNA, 64 nt, Homo Sapiens
gugaaagugucaucuucacugccaaucaggcaaagaccggaaagauuugcauuuuauuaugucu

SEQ ID NO: 536227 - RNA, 64 nt, Homo Sapiens
uccccagcccacuggaucagaaagaguucaguaagaccggaagcuccugguauggguuucuccc

SEQ ID NO: 536228 - RNA, 64 nt, Homo Sapiens
ggguuuucccacagauccccugcuguccucgauagaccggaaugaccugagaaugcguguggcc

SEQ ID NO: 536229 - RNA, 64 nt, Homo Sapiens
uucuuggugcugaagguaagcugaucuguaccgggaccggaaacugucaauagccucuuccuca

SEQ ID NO: 536230 - RNA, 64 nt, Homo Sapiens
gagcgcgccugcuuuagagacacaggaugauucagaccggaaacagaccucguggguguaagag

SEQ ID NO: 536231 - RNA, 64 nt, Homo Sapiens
gcgcuccagggagcggagcaaggacaaggaccgggaccggaagcggcgaagcagccggagucgg

SEQ ID NO: 536232 - RNA, 64 nt, Homo Sapiens
gacccacacuacccucccuugaccagcugucugggaccggaaaccagcuuugucuccagguaga

SEQ ID NO: 536233 - RNA, 64 nt, Homo Sapiens
ugagggagcucagggcaaaggccaggcuagcgcggaccggaaggggccgaggcugcacgggccu

SEQ ID NO: 536234 - RNA, 64 nt, Homo Sapiens
gguuaauuuaaagggggggacuuaguggcauauggaccggaaaguuucucuagguugguaccug

SEQ ID NO: 536235 - RNA, 64 nt, Homo Sapiens
gggaggggacggggaaggaagaaagaauuuaaaggaccggaaugcgagaguccagguggccuug

SEQ ID NO: 536236 - RNA, 64 nt, Homo Sapiens; identical to SEQ ID NO: 297017

SEQ ID NO: 536237 - RNA, 64 nt, Homo Sapiens; identical to SEQ ID NO: 297018

SEQ ID NO: 536238 - RNA, 64 nt, Homo Sapiens; identical to SEQ ID NO: 297019

SEQ ID NO: 536239 - RNA, 64 nt, Homo Sapiens; identical to SEQ ID NO: 297020

SEQ ID NO: 536240 - RNA, 64 nt, Homo Sapiens; identical to SEQ ID NO: 297021

SEQ ID NO: 536241 - RNA, 64 nt, Homo Sapiens; identical to SEQ ID NO: 297022

SEQ ID NO: 536242 - RNA, 64 nt, Homo Sapiens; identical to SEQ ID NO: 297023

SEQ ID NO: 536243 - RNA, 64 nt, Homo Sapiens; identical to SEQ ID NO: 297024

SEQ ID NO: 536244 - RNA, 64 nt, Homo Sapiens; identical to SEQ ID NO: 297025

SEQ ID NO: 536245 - RNA, 64 nt, Homo Sapiens; identical to SEQ ID NO: 297026

SEQ ID NO: 536246 - RNA, 64 nt, Homo Sapiens; identical to SEQ ID NO: 297027

SEQ ID NO: 536247 - RNA, 64 nt, Homo Sapiens; identical to SEQ ID NO: 297028

SEQ ID NO: 536248 - RNA, 64 nt, Homo Sapiens; identical to SEQ ID NO: 297029

SEQ ID NO: 536249 - RNA, 64 nt, Homo Sapiens; identical to SEQ ID NO: 297030

SEQ ID NO: 536250 - RNA, 64 nt, Homo Sapiens; identical to SEQ ID NO: 297031

SEQ ID NO: 536251 - RNA, 64 nt, Homo Sapiens; identical to SEQ ID NO: 297032

SEQ ID NO: 536252 - RNA, 64 nt, Homo Sapiens; identical to SEQ ID NO: 297033

SEQ ID NO: 536253 - RNA, 64 nt, Homo Sapiens; identical to SEQ ID NO: 297034

SEQ ID NO: 536254 - RNA, 64 nt, Homo Sapiens; identical to SEQ ID NO: 297035

SEQ ID NO: 536255 - RNA, 64 nt, Homo Sapiens; identical to SEQ ID NO: 297036

SEQ ID NO: 536256 - RNA, 62 nt, Homo Sapiens
gccauuccgaggccgggccuucuucugacacgggcuccaaccccaccugaccaagcccggga

SEQ ID NO: 536257 - RNA, 62 nt, Homo Sapiens
ugucagagucuggggacucggcgugcagggcgggcuccaagcgcuuugcuuccggaacuccg

SEQ ID NO: 536258 - RNA, 64 nt, Homo Sapiens; identical to SEQ ID NO: 300664

SEQ ID NO: 536259 - RNA, 64 nt, Homo Sapiens; identical to SEQ ID NO: 300665

SEQ ID NO: 536260 - RNA, 64 nt, Homo Sapiens; identical to SEQ ID NO: 300666

SEQ ID NO: 536261 - RNA, 64 nt, Homo Sapiens; identical to SEQ ID NO: 300667

SEQ ID NO: 536262 - RNA, 64 nt, Homo Sapiens; identical to SEQ ID NO: 300668

SEQ ID NO: 536263 - RNA, 64 nt, Homo Sapiens; identical to SEQ ID NO: 300669

SEQ ID NO: 536264 - RNA, 64 nt, Homo Sapiens; identical to SEQ ID NO: 300670

SEQ ID NO: 536265 - RNA, 64 nt, Homo Sapiens; identical to SEQ ID NO: 300671

SEQ ID NO: 536266 - RNA, 64 nt, Homo Sapiens; identical to SEQ ID NO: 300672

SEQ ID NO: 536267 - RNA, 64 nt, Homo Sapiens; identical to SEQ ID NO: 300673

SEQ ID NO: 536268 - RNA, 64 nt, Homo Sapiens; identical to SEQ ID NO: 300674

SEQ ID NO: 536269 - RNA, 64 nt, Homo Sapiens; identical to SEQ ID NO: 300675

SEQ ID NO: 536270 - RNA, 64 nt, Homo Sapiens; identical to SEQ ID NO: 300676

SEQ ID NO: 536271 - RNA, 64 nt, Homo Sapiens; identical to SEQ ID NO: 300677

SEQ ID NO: 536272 - RNA, 64 nt, Homo Sapiens; identical to SEQ ID NO: 300678

SEQ ID NO: 536273 - RNA, 64 nt, Homo Sapiens; identical to SEQ ID NO: 300679

SEQ ID NO: 536274 - RNA, 64 nt, Homo Sapiens; identical to SEQ ID NO: 300680

SEQ ID NO: 536275 - RNA, 64 nt, Homo Sapiens; identical to SEQ ID NO: 300681

SEQ ID NO: 536276 - RNA, 64 nt, Homo Sapiens; identical to SEQ ID NO: 300682

SEQ ID NO: 536277 - RNA, 64 nt, Homo Sapiens; identical to SEQ ID NO: 300683

SEQ ID NO: 536278 - RNA, 64 nt, Homo Sapiens; identical to SEQ ID NO: 300684

SEQ ID NO: 536279 - RNA, 64 nt, Homo Sapiens; identical to SEQ ID NO: 300685

SEQ ID NO: 536280 - RNA, 64 nt, Homo Sapiens; identical to SEQ ID NO: 300686

SEQ ID NO: 536281 - RNA, 64 nt, Homo Sapiens; identical to SEQ ID NO: 300687

SEQ ID NO: 536282 - RNA, 64 nt, Homo Sapiens; identical to SEQ ID NO: 300688

SEQ ID NO: 536283 - RNA, 64 nt, Homo Sapiens; identical to SEQ ID NO: 300689

SEQ ID NO: 536284 - RNA, 64 nt, Homo Sapiens; identical to SEQ ID NO: 300690

SEQ ID NO: 536285 - RNA, 64 nt, Homo Sapiens; identical to SEQ ID NO: 300691

SEQ ID NO: 536286 - RNA, 64 nt, Homo Sapiens; identical to SEQ ID NO: 300692

SEQ ID NO: 536287 - RNA, 64 nt, Homo Sapiens; identical to SEQ ID NO: 300693

SEQ ID NO: 536288 - RNA, 64 nt, Homo Sapiens; identical to SEQ ID NO: 225411

SEQ ID NO: 536289 - RNA, 64 nt, Homo Sapiens; identical to SEQ ID NO: 225412

SEQ ID NO: 536290 - RNA, 64 nt, Homo Sapiens; identical to SEQ ID NO: 225413

SEQ ID NO: 536291 - RNA, 64 nt, Homo Sapiens; identical to SEQ ID NO: 225414

SEQ ID NO: 536292 - RNA, 64 nt, Homo Sapiens; identical to SEQ ID NO: 225415

SEQ ID NO: 536293 - RNA, 64 nt, Homo Sapiens; identical to SEQ ID NO: 225416

SEQ ID NO: 536294 - RNA, 64 nt, Homo Sapiens; identical to SEQ ID NO: 225417

SEQ ID NO: 536295 - RNA, 64 nt, Homo Sapiens; identical to SEQ ID NO: 225418

SEQ ID NO: 536296 - RNA, 64 nt, Homo Sapiens; identical to SEQ ID NO: 225419

SEQ ID NO: 536297 - RNA, 64 nt, Homo Sapiens; identical to SEQ ID NO: 225420

SEQ ID NO: 536298 - RNA, 64 nt, Homo Sapiens; identical to SEQ ID NO: 225421

SEQ ID NO: 536299 - RNA, 64 nt, Homo Sapiens; identical to SEQ ID NO: 225422

SEQ ID NO: 536300 - RNA, 64 nt, Homo Sapiens; identical to SEQ ID NO: 225423

SEQ ID NO: 536301 - RNA, 64 nt, Homo Sapiens; identical to SEQ ID NO: 225424

SEQ ID NO: 536302 - RNA, 64 nt, Homo Sapiens; identical to SEQ ID NO: 225425

SEQ ID NO: 536303 - RNA, 64 nt, Homo Sapiens; identical to SEQ ID NO: 225426

SEQ ID NO: 536304 - RNA, 64 nt, Homo Sapiens; identical to SEQ ID NO: 225427

SEQ ID NO: 536305 - RNA, 64 nt, Homo Sapiens; identical to SEQ ID NO: 164780

SEQ ID NO: 536306 - RNA, 64 nt, Homo Sapiens; identical to SEQ ID NO: 164781

SEQ ID NO: 536307 - RNA, 64 nt, Homo Sapiens; identical to SEQ ID NO: 164782

SEQ ID NO: 536308 - RNA, 64 nt, Homo Sapiens; identical to SEQ ID NO: 164783

SEQ ID NO: 536309 - RNA, 64 nt, Homo Sapiens; identical to SEQ ID NO: 164784

SEQ ID NO: 536310 - RNA, 64 nt, Homo Sapiens; identical to SEQ ID NO: 164785

SEQ ID NO: 536311 - RNA, 64 nt, Homo Sapiens; identical to SEQ ID NO: 164786

SEQ ID NO: 536312 - RNA, 64 nt, Homo Sapiens; identical to SEQ ID NO: 164787

SEQ ID NO: 536313 - RNA, 64 nt, Homo Sapiens; identical to SEQ ID NO: 164788

SEQ ID NO: 536314 - RNA, 64 nt, Homo Sapiens; identical to SEQ ID NO: 164789

SEQ ID NO: 536315 - RNA, 64 nt, Homo Sapiens; identical to SEQ ID NO: 164790

SEQ ID NO: 536316 - RNA, 64 nt, Homo Sapiens; identical to SEQ ID NO: 164791

SEQ ID NO: 536317 - RNA, 64 nt, Homo Sapiens; identical to SEQ ID NO: 164792

SEQ ID NO: 536318 - RNA, 64 nt, Homo Sapiens; identical to SEQ ID NO: 164793

SEQ ID NO: 536319 - RNA, 64 nt, Homo Sapiens; identical to SEQ ID NO: 83158

SEQ ID NO: 536320 - RNA, 64 nt, Homo Sapiens; identical to SEQ ID NO: 83159

SEQ ID NO: 536321 - RNA, 64 nt, Homo Sapiens; identical to SEQ ID NO: 83160

SEQ ID NO: 536322 - RNA, 64 nt, Homo Sapiens; identical to SEQ ID NO: 83161

SEQ ID NO: 536323 - RNA, 64 nt, Homo Sapiens
agcuacuuaucaaccagacugaccacaagaacugucaucucaucaaugaaggaguaacugauca

SEQ ID NO: 536324 - RNA, 64 nt, Homo Sapiens
caaagcugacauuuagaagagaugcuggugauagucaucucauccuacucaauuuuucaaaggc

SEQ ID NO: 536325 - RNA, 64 nt, Homo Sapiens
gauguuguuaugaucgccuguggauuuuguccauucaucucaugcucucugaacagaagguaua

SEQ ID NO: 536326 - RNA, 64 nt, Homo Sapiens
cuuguuugaguuuauggccaccuggaauuuucagucaucucaugauacaggcgggaggggcaga

SEQ ID NO: 536327 - RNA, 64 nt, Homo Sapiens
uguauuccauugauuuuuuucaguuugcacaaguucaucucauuuuguggggcauguuaaguua

SEQ ID NO: 536328 - RNA, 64 nt, Homo Sapiens
cucuuaguuuuuuuuuuuuacauguuaaaagaagucaucucaaaucacuuacuauccauuucuu

SEQ ID NO: 536329 - RNA, 64 nt, Homo Sapiens
ccugagccaagcacagguguuugaggacuacaguucaucucaggguuucuuggaguacaagacc

SEQ ID NO: 536330 - RNA, 64 nt, Homo Sapiens
cacugcacuccagacugggugacacagcgagacuucaucucaaaaaaaaaaagaaaagaaaagc

SEQ ID NO: 536331 - RNA, 64 nt, Homo Sapiens
gaaugauccugucggaugaccucuuggauucaucucaucucauguuacauuuuggucuaaaaag

SEQ ID NO: 536332 - RNA, 64 nt, Homo Sapiens
ucauggaaugauccugucggaaaagcucuuggauucaucucaucaguuuuuacauuuuggucua

SEQ ID NO: 536333 - RNA, 64 nt, Homo Sapiens
ggaagggagaccacugugucaccuggaggagaagucaucucaugacaacagaagggagguggcc

SEQ ID NO: 536334 - RNA, 64 nt, Homo Sapiens
ccuuacacagugcauuuuagaaucuuccagucugucaucucagcucuuuuguaacaugcuuccc

SEQ ID NO: 536335 - RNA, 64 nt, Homo Sapiens
guucaaccggggaugggucgccugggcuguggucucaucucaacaggcagcagucacagugucu

SEQ ID NO: 536336 - RNA, 64 nt, Homo Sapiens
guuucugugagucaggggucacuacagacguuuaucaucucacaagcaaacugagcaccuuagg

SEQ ID NO: 536337 - RNA, 64 nt, Homo Sapiens
cccaguccacuccuaacacuagcaucagucccacucaucucaggcugagccacaucucacuuuu

SEQ ID NO: 536338 - RNA, 64 nt, Homo Sapiens
uguauacacauggcaaaaugugaagaaacuccuuucaucucagcagguagaggaggacugauga

SEQ ID NO: 536339 - RNA, 64 nt, Homo Sapiens; identical to SEQ ID NO: 313115

SEQ ID NO: 536340 - RNA, 64 nt, Homo Sapiens; identical to SEQ ID NO: 313116

SEQ ID NO: 536341 - RNA, 64 nt, Homo Sapiens; identical to SEQ ID NO: 313117

SEQ ID NO: 536342 - RNA, 64 nt, Homo Sapiens; identical to SEQ ID NO: 313118

SEQ ID NO: 536343 - RNA, 64 nt, Homo Sapiens; identical to SEQ ID NO: 313119

SEQ ID NO: 536344 - RNA, 64 nt, Homo Sapiens; identical to SEQ ID NO: 313120

SEQ ID NO: 536345 - RNA, 64 nt, Homo Sapiens; identical to SEQ ID NO: 313121

SEQ ID NO: 536346 - RNA, 64 nt, Homo Sapiens; identical to SEQ ID NO: 313122

SEQ ID NO: 536347 - RNA, 64 nt, Homo Sapiens; identical to SEQ ID NO: 313123

SEQ ID NO: 536348 - RNA, 64 nt, Homo Sapiens; identical to SEQ ID NO: 313124

SEQ ID NO: 536349 - RNA, 64 nt, Homo Sapiens
cccgccuugcacugcgccugccccacgguguccccgccgggaagcagccccggcuccugaauca

SEQ ID NO: 536350 - RNA, 64 nt, Homo Sapiens
cgcucgcgcaaggccacggugagccagagagcaccgccgggaggggaagcguccuguuuggaga

SEQ ID NO: 536351 - RNA, 64 nt, Homo Sapiens
cguugggcagaaacccucggaguguugucccgagcgccgggagguuccaguaucaaugcuacac

SEQ ID NO: 536352 - RNA, 64 nt, Homo Sapiens
uucuugcaggaauacugcucuguaaauauacaugcgccgggagcugcugcauguacauauuuuc

SEQ ID NO: 536353 - RNA, 64 nt, Homo Sapiens
cagcgccuucggguggcggcagaccgcgccgagccgccgggacuaaccccaccgacccagacca

SEQ ID NO: 536354 - RNA, 64 nt, Homo Sapiens
cgaagagcaacgggcgcugcuugcagaggacuggcgccgggacggaaaaucuucucaguucucc

SEQ ID NO: 536355 - RNA, 64 nt, Homo Sapiens
cuggauagcuacuuccaucccccggggacucccgcgccgggacgcggggugggaccaggcgcgg

SEQ ID NO: 536356 - RNA, 64 nt, Homo Sapiens
gcagcgcaacgcacuggugaccagacuguccccacgccgggaaccaagcaggagacgacaggcg

SEQ ID NO: 536357 - RNA, 63 nt, Homo Sapiens
cuaggaccuugccggauggggccgcacccacagcgccgggauccaguggaccggcccguguga

SEQ ID NO: 536358 - RNA, 64 nt, Homo Sapiens
acgaauuuggccgauggcagauguuuugggggaacgccgggacugagagacuccacgcaggcga

SEQ ID NO: 536359 - RNA, 64 nt, Homo Sapiens
auacacauucuagaaaugauccaccaucacuuaacgccgggauucuuuuaaaggcaaaucauuc

SEQ ID NO: 536360 - RNA, 64 nt, Homo Sapiens
ucgcccgcuccugugguuuuucugagcgugcgggcgccgggaggggaugcugaggcugauggag

SEQ ID NO: 536361 - RNA, 64 nt, Homo Sapiens
ccuugcagaggcgccucucaaggccccaucagcucgccgggaccucugugaagccucucuguca

SEQ ID NO: 536362 - RNA, 64 nt, Homo Sapiens
augguucagcugccaccggccucugggugcccaucgccgggaguguuccaaguacucacagggg

SEQ ID NO: 536363 - RNA, 64 nt, Homo Sapiens
aagccacuacuuccagaagcaucuccucauuccccgccgggagcaacaucucucuucucgagac

SEQ ID NO: 536364 - RNA, 64 nt, Homo Sapiens
caacugauccaccugccucagccucccaaagugccgccgggauuacaggcgugagccaccaugc

SEQ ID NO: 536365 - RNA, 64 nt, Homo Sapiens
cugcauggcaucagacuagccacuccugccaggccgccgggaugguucuucuccaguuagaaug

SEQ ID NO: 536366 - RNA, 64 nt, Homo Sapiens
gagcagugggcagguggccgccccugaggcuucacgccgggagaagccaccuucccaccccuuc

SEQ ID NO: 536367 - RNA, 57 nt, Homo Sapiens
caggagaaugcucgaggggcgagcagacgccgggaucaccgggaagagaagaccuag

SEQ ID NO: 536368 - RNA, 64 nt, Homo Sapiens
cccguggagcgcggccugcacuucuccccugggccgccgggagcaaacuguccuguugucgaag

SEQ ID NO: 536369 - RNA, 64 nt, Homo Sapiens
cuuagugaugugugugugucuccaugcacaugcacgccgggauuccucugcugccauuugaauu

SEQ ID NO: 536370 - RNA, 64 nt, Homo Sapiens
agauggcacugaucacugagcaggagaggagugucgccgggaggccuucagggugggggggaag

SEQ ID NO: 536371 - RNA, 64 nt, Homo Sapiens
auuaaugaccaccgccaauucagaggcugguggucgccgggauaaccccucgggcccacccgua

SEQ ID NO: 536372 - RNA, 64 nt, Homo Sapiens
cccgcgccgggcagccccgcucagcgccacacaucgccgggacaccgcugcucccgccgccgcc

SEQ ID NO: 536373 - RNA, 64 nt, Homo Sapiens
ggugacucggacugaauuccccauacuguuuccacgccgggacaccauguucuccaucaagcua

SEQ ID NO: 536374 - RNA, 64 nt, Homo Sapiens
ccgggcauggugggcacaguccugucuagaaugccgccgggagugugcccagagugggcggugg

SEQ ID NO: 536375 - RNA, 64 nt, Homo Sapiens
ugcaggccaggcugccacuccgggaacgccuuugcgccgggacuuuuuguuucugaaggcaguc

SEQ ID NO: 536376 - RNA, 64 nt, Homo Sapiens
aacacggggugagacagcaggaaggggcccugcacgccgggacgccaccuccgccagccgccuc

SEQ ID NO: 536377 - RNA, 64 nt, Homo Sapiens
aauguccuacugcccgggcagccccagcccagcccgccgggagcaaggauggugcuaggucauu

SEQ ID NO: 536378 - RNA, 64 nt, Homo Sapiens
ugagaaaggguccgcccgguggccuggaggcaggcgccgggagcgcaguagcacguggacuggg

SEQ ID NO: 536379 - RNA, 64 nt, Homo Sapiens
ugaggucgcauaacgccccauggcucaaggaagccgccgggagcugcccgcaggcccugggccg

SEQ ID NO: 536380 - RNA, 64 nt, Homo Sapiens
cgcggcgacuggaggcuggauucgaggccggaaacgccgggaccccuggacccggccugguggg

SEQ ID NO: 536381 - RNA, 64 nt, Homo Sapiens
cucuggaggggguuugcuggggaacuggcgccaucgccgggacuccagaaccgcagaagccucc

SEQ ID NO: 536382 - RNA, 64 nt, Homo Sapiens
cugaucuugucaaacccagccugaccgcuucugacgccgggauggccucguuacuagacuuuuc

SEQ ID NO: 536383 - RNA, 64 nt, Homo Sapiens
ugguguaagcacacaugcacgauuaaagaggagacgccgggacccccugcccgaucgcgcgcgg

SEQ ID NO: 536384 - RNA, 64 nt, Homo Sapiens
aggaccggguggaggcgguggggacccagccgcgcgccgggagcgcuccccggaaugagccgcc

SEQ ID NO: 536385 - RNA, 64 nt, Homo Sapiens
ccgccuccccuuccccguccccuccucccgaagacgccgggacagucggguguccgcccucagc

SEQ ID NO: 536386 - RNA, 64 nt, Homo Sapiens
gcgacggcggagccaccggagcgagcgcgagcggcgccgggaccgggaucgugaccgugaccgu

SEQ ID NO: 536387 - RNA, 64 nt, Homo Sapiens
ggcaaccaggccucccagcgagagugucccagcacgccgggagggcaucuaacugcaggaaccc

SEQ ID NO: 536388 - RNA, 64 nt, Homo Sapiens
cuuuccccacaccccagccacgugauguccugcccgccgggaguguccccaagaacgugacguu

SEQ ID NO: 536389 - RNA, 64 nt, Homo Sapiens
cccaggagaccaggucuggcggcgccuguuucgacgccgggaccgccgguucccccggucaugu

SEQ ID NO: 536390 - RNA, 64 nt, Homo Sapiens
ugaugccgcggggugggggcgacuucgggccucccgccgggaucggccguccccaccuucuagc

SEQ ID NO: 536391 - RNA, 64 nt, Homo Sapiens
cacuguaaccacaagauguuauuuauugagcuggcgccgggacuugggcggggccugcccuaca

SEQ ID NO: 536392 - RNA, 64 nt, Homo Sapiens
uugccugcgucuccuuggagcuccacuagggaggcgccgggaggggagucgaguugacucucgg

SEQ ID NO: 536393 - RNA, 53 nt, Homo Sapiens
agcccgacacggaggacugaggucgccgggaccacccugagccggccccaggc

SEQ ID NO: 536394 - RNA, 64 nt, Homo Sapiens
ccgggcccugggcccggccaguucgcgacaagcccgccgggaucuccgggcgcgcgggccuccu

SEQ ID NO: 536395 - RNA, 64 nt, Homo Sapiens
ugcccacacccagcuggccauauccaccccucgacgccgggaugagccggcucugccuguguca

SEQ ID NO: 536396 - RNA, 64 nt, Homo Sapiens
caccugcgggaggcagcgacggcccccacgcagacgccgggaacgcaggccgcuuuauuccucu

SEQ ID NO: 536397 - RNA, 64 nt, Homo Sapiens
cccgucuuggguccucgcuggacccaccucccagcgccgggaagcggaggucucuguaaaagca

SEQ ID NO: 536398 - RNA, 64 nt, Homo Sapiens
cugcagugauccccgccagaggugagcaucugggcgccgggacgacuugaaagacacugucgga

SEQ ID NO: 536399 - RNA, 64 nt, Homo Sapiens
gcugcuggggccuccacaccggccuccacgccagcgccgggaaguucaggugauccgcgggagg

SEQ ID NO: 536400 - RNA, 64 nt, Homo Sapiens
ccgcagaccccggacgugucggcucagacaccgacgccgggagggggucgggacaggagcacgu

SEQ ID NO: 536401 - RNA, 64 nt, Homo Sapiens; identical to SEQ ID NO: 226314

SEQ ID NO: 536402 - RNA, 64 nt, Homo Sapiens; identical to SEQ ID NO: 226315

SEQ ID NO: 536403 - RNA, 64 nt, Homo Sapiens; identical to SEQ ID NO: 226316

SEQ ID NO: 536404 - RNA, 64 nt, Homo Sapiens; identical to SEQ ID NO: 226317

SEQ ID NO: 536405 - RNA, 64 nt, Homo Sapiens; identical to SEQ ID NO: 226318

SEQ ID NO: 536406 - RNA, 64 nt, Homo Sapiens; identical to SEQ ID NO: 226319

SEQ ID NO: 536407 - RNA, 64 nt, Homo Sapiens; identical to SEQ ID NO: 226320

SEQ ID NO: 536408 - RNA, 64 nt, Homo Sapiens; identical to SEQ ID NO: 226321

SEQ ID NO: 536409 - RNA, 64 nt, Homo Sapiens; identical to SEQ ID NO: 226322

SEQ ID NO: 536410 - RNA, 64 nt, Homo Sapiens; identical to SEQ ID NO: 226323

SEQ ID NO: 536411 - RNA, 64 nt, Homo Sapiens; identical to SEQ ID NO: 226324

SEQ ID NO: 536412 - RNA, 64 nt, Homo Sapiens; identical to SEQ ID NO: 226325

SEQ ID NO: 536413 - RNA, 64 nt, Homo Sapiens; identical to SEQ ID NO: 226326

SEQ ID NO: 536414 - RNA, 64 nt, Homo Sapiens; identical to SEQ ID NO: 226327

SEQ ID NO: 536415 - RNA, 64 nt, Homo Sapiens; identical to SEQ ID NO: 226328

SEQ ID NO: 536416 - RNA, 64 nt, Homo Sapiens; identical to SEQ ID NO: 226329

SEQ ID NO: 536417 - RNA, 64 nt, Homo Sapiens; identical to SEQ ID NO: 226330

SEQ ID NO: 536418 - RNA, 64 nt, Homo Sapiens; identical to SEQ ID NO: 226331

SEQ ID NO: 536419 - RNA, 64 nt, Homo Sapiens; identical to SEQ ID NO: 226332

SEQ ID NO: 536420 - RNA, 64 nt, Homo Sapiens; identical to SEQ ID NO: 226333

SEQ ID NO: 536421 - RNA, 64 nt, Homo Sapiens; identical to SEQ ID NO: 226334

SEQ ID NO: 536422 - RNA, 64 nt, Homo Sapiens; identical to SEQ ID NO: 226335

SEQ ID NO: 536423 - RNA, 64 nt, Homo Sapiens; identical to SEQ ID NO: 226336

SEQ ID NO: 536424 - RNA, 64 nt, Homo Sapiens; identical to SEQ ID NO: 226337

SEQ ID NO: 536425 - RNA, 64 nt, Homo Sapiens; identical to SEQ ID NO: 226338

SEQ ID NO: 536426 - RNA, 64 nt, Homo Sapiens; identical to SEQ ID NO: 226339

SEQ ID NO: 536427 - RNA, 64 nt, Homo Sapiens; identical to SEQ ID NO: 226340

SEQ ID NO: 536428 - RNA, 64 nt, Homo Sapiens; identical to SEQ ID NO: 226341

SEQ ID NO: 536429 - RNA, 64 nt, Homo Sapiens
gauguuguuccuuuuuugaaguugucauuaaaguaggugcaacaaccaagaaagugucucuucc

SEQ ID NO: 536430 - RNA, 64 nt, Homo Sapiens
ccagugauguuuuguuuuuguuuggucaagggguaggugcaacccaauggaccacuuaugcaaa

SEQ ID NO: 536431 - RNA, 64 nt, Homo Sapiens
guccauucacuguguauagauggcagaacuuuugaggugcaauguuuaauuguuaaaaauagua

SEQ ID NO: 536432 - RNA, 64 nt, Homo Sapiens
ugggccuggauggggaggcucuagcaucucucauaggugcaaccugagagugggggagcuaagc

SEQ ID NO: 536433 - RNA, 64 nt, Homo Sapiens
uaaugcaaacaaaccgaagcuacaugccaaugauaggugcaaagaauauuggcaaaaggugcuu

SEQ ID NO: 536434 - RNA, 64 nt, Homo Sapiens
acgcagcuggggccaggagggucagaguggugccaggugcaaguuaggcuaaagaagccaccac

SEQ ID NO: 536435 - RNA, 64 nt, Homo Sapiens
guucuggaaagccucacuuccuuuucuguggagaaggugcaaagcuguuaaaugagcucagagu

SEQ ID NO: 536436 - RNA, 64 nt, Homo Sapiens
aaaaucagccagugccaacauugcuugcccugcaaggugcaacugagcccacauagcgcauuca

SEQ ID NO: 536437 - RNA, 64 nt, Homo Sapiens
cucaugcaucuccuuuccugccaaaggcaccuggaggugcaagccagcucucucugcucaccuu

SEQ ID NO: 536438 - RNA, 64 nt, Homo Sapiens
ugggguauaaaacuggauaaccauugccugcccgaggugcaagggucagggucugguuggcucc

SEQ ID NO: 536439 - RNA, 64 nt, Homo Sapiens
cagugcuuuuagauggcuuguaugaguaaagaaaaggugcaaugaaaccuuuguaacuuguuug

SEQ ID NO: 536440 - RNA, 64 nt, Homo Sapiens
aagugagcagucugccugugggugauggcaagaaaggugcaagaaggaauguggguguggccga

SEQ ID NO: 536441 - RNA, 64 nt, Homo Sapiens
ugggaaaaucagguuuauuuuagucucaacuaauaggugcaauuugcaucccuaauauaugaua

SEQ ID NO: 536442 - RNA, 64 nt, Homo Sapiens
agggagcugcaggggcauggaaggagccuaggccaggugcaacccgggcagaggggcagaugga

SEQ ID NO: 536443 - RNA, 64 nt, Homo Sapiens
uauucuugaaagucucuaggaguauuuugagaaaaggugcaaaaguucauuuucuuuaaaaaaa

SEQ ID NO: 536444 - RNA, 64 nt, Homo Sapiens
ugcuaaauuucuaaaaauggaacagggggaaaaaaggugcaaaauuguugaaagaaaaugaagg

SEQ ID NO: 536445 - RNA, 63 nt, Homo Sapiens
cuguggugacuacagacuagaggaaugcucuacaggugcaacagguucagguguuugcugacg

SEQ ID NO: 536446 - RNA, 64 nt, Homo Sapiens
uuuagucuaugaaagaauaauuauaauaauguccaggugcaauacucuguaagucuauugguuc

SEQ ID NO: 536447 - RNA, 64 nt, Homo Sapiens
aaggacacucugacauucggcuugauccauguccaggugcaacuguguguacaccagggaucug

SEQ ID NO: 536448 - RNA, 64 nt, Homo Sapiens
gauccuugacauuugucaccccacuggccuucucaggugcaaucaguaaaaaugcugagaacuc

SEQ ID NO: 536449 - RNA, 64 nt, Homo Sapiens
uaugauaguguuauaaauacuguaaaagcauggaaggugcaaaacucaguauuucuacaauugc

SEQ ID NO: 536450 - RNA, 64 nt, Homo Sapiens
uacaaguuucauucucccuuucacuaaaacacacaggugcaacagacuugaaugcuaguuauac

SEQ ID NO: 536451 - RNA, 64 nt, Homo Sapiens
aaguaaugugugggccgcaugcauaaaguaaguaaggugcaaugaagaaguguugauugccaaa

SEQ ID NO: 536452 - RNA, 64 nt, Homo Sapiens
ucaugagcacuugaaguacaaggugucucccccuaggugcaauuagguuguuucuuuguuuuua

SEQ ID NO: 536453 - RNA, 64 nt, Homo Sapiens
cuagauaacacagcuagccaccugccguguaagaaggugcaauccaucuggacgugaugccgcg

SEQ ID NO: 536454 - RNA, 64 nt, Homo Sapiens
ugacuguacaucauagauauuuaaaugaccuagaaggugcaaguguugcuucuuugcuaaaaaa

SEQ ID NO: 536455 - RNA, 64 nt, Homo Sapiens
acacaaaacaaagccaguucauggacaccaggucaggugcaacccaaaugcuacaggucuuacu

SEQ ID NO: 536456 - RNA, 64 nt, Homo Sapiens
caggccuacccuacugcccgcugcguccugcuggaggugcaagugccugcugcccuugugcagu

SEQ ID NO: 536457 - RNA, 64 nt, Homo Sapiens
uaauugagggaccaucagauaacuguauuuugucaggugcaauaaaaacaaaauuaaaacccaa

SEQ ID NO: 536458 - RNA, 64 nt, Homo Sapiens
uuaguuuuagucaugggcuuucuucaccugcucuaggugcaaaggcauguugggaaagagaugg

SEQ ID NO: 536459 - RNA, 64 nt, Homo Sapiens
gaauuugaggccagccugaggaacugcaggacucaggugcaaugugccagccacuuggaacugc

SEQ ID NO: 536460 - RNA, 64 nt, Homo Sapiens
gacuaggggaugcccuugauaaugacgguuuccuaggugcaagaucagagcaugugccuacacc

SEQ ID NO: 536461 - RNA, 64 nt, Homo Sapiens
uuguucagggggcugagaagauccugaguacacuaggugcaaaccagaacucuugguggaacag

SEQ ID NO: 536462 - RNA, 64 nt, Homo Sapiens
ucugccuccaugcugcaguguucgaguggauuguaggugcaagauggaaaggauuguaggugca

SEQ ID NO: 536463 - RNA, 64 nt, Homo Sapiens
gaguggauuguaggugcaagauggaaaggauuguaggugcaagcuguccagagaaaagaguccu

SEQ ID NO: 536464 - RNA, 64 nt, Homo Sapiens
auguucgaguaccucagggacauuuaagaguuggaggugcaaauauauuccaaaagggugcaac

SEQ ID NO: 536465 - RNA, 64 nt, Homo Sapiens
cucacgcugcuaggaaauggcucccugaucuaucaggugcaagugguagggacaagcagugagg

SEQ ID NO: 536466 - RNA, 64 nt, Homo Sapiens
gcccacauauugucugacugaagugaaagaagccaggugcaaaaaugagccuugaaaacuugcu

SEQ ID NO: 536467 - RNA, 64 nt, Homo Sapiens
uucuugagagguggggaccucucucagucuagucaggugcaaugggggcccauguucacacugg

SEQ ID NO: 536468 - RNA, 64 nt, Homo Sapiens
uaauuaaaccuguacauauuacugauuuaccucaaggugcaaaaagcaguaguaguugcuaugu

SEQ ID NO: 536469 - RNA, 64 nt, Homo Sapiens
gcuuagaaaagacccuggccuuagaagccaucagaggugcaaggugugagcuguuggcaugugg

SEQ ID NO: 536470 - RNA, 64 nt, Homo Sapiens
auuuaauauuuuuaagggacuuccacuguuuguaaggugcaacaccaaauacuuuuuuuuucuu

SEQ ID NO: 536471 - RNA, 64 nt, Homo Sapiens
uagggguucuggggccacagugaagcccugcagaaggugcaaugggucagggcuuugccaccgu

SEQ ID NO: 536472 - RNA, 64 nt, Homo Sapiens
caagugcuuuaccuucuaaaacaugcuucucuauaggugcaaaguuauaagauauguagaagaa

SEQ ID NO: 536473 - RNA, 64 nt, Homo Sapiens
uauguuuuuaagugccuuggcaggcucacuucugaggugcaaaacauagauauagaacugaaca

SEQ ID NO: 536474 - RNA, 64 nt, Homo Sapiens
guugggcuucugugaaauacacagguggaaacagaggugcaagccagaggcaauguaauaugcu

SEQ ID NO: 536475 - RNA, 64 nt, Homo Sapiens
gcugcuaugaccuguguucacucugguuacagggaggugcaaaccauucugucucccagccuuu

SEQ ID NO: 536476 - RNA, 64 nt, Homo Sapiens
gaagacacuacgcuacuuggucuuccaacuuuagaggugcaauggucaagacgugggaucagaa

SEQ ID NO: 536477 - RNA, 64 nt, Homo Sapiens
cgagacagaagagugagaaguaguuuccaccaugaggugcaaaaucuuucuggacguguuuaga

SEQ ID NO: 536478 - RNA, 64 nt, Homo Sapiens
auuucuuuauuuucuucuccuucuaaaucaaaccaggugcaauucagcuuugcaaaaugagacu

SEQ ID NO: 536479 - RNA, 64 nt, Homo Sapiens
gugacuugggucugguugguagcuaguuuugaauaggugcaacuuuaaaaauagcucacuuuaa

SEQ ID NO: 536480 - RNA, 64 nt, Homo Sapiens
cugauuagccugcguccacagcacaagugauuucaggugcaauuucacucuugcaucacuaauu

SEQ ID NO: 536481 - RNA, 64 nt, Homo Sapiens
ucuaaauuuguaagaguagguuuucaucaaucuaaggugcaauuacuguaggcccugguucaug

SEQ ID NO: 536482 - RNA, 64 nt, Homo Sapiens
guuuugggcugcugagaauaauugaugcugauuaaggugcaaaucaugacuaaagacuuuucuu

SEQ ID NO: 536483 - RNA, 64 nt, Homo Sapiens
aagcaugauauguacuauagugauucuguuuuugaggugcaaaaaacauacauauauaccaguu

SEQ ID NO: 536484 - RNA, 64 nt, Homo Sapiens
gagaaggggccacccacugggcaccuaacaggacaggugcaaaguggggugcuuauuaagauuc

SEQ ID NO: 536485 - RNA, 61 nt, Homo Sapiens
cuucaggguggggugggcaugauacucugugaggugcaagauuaguaauggggaacauuaa

SEQ ID NO: 536486 - RNA, 64 nt, Homo Sapiens
uguaaagcaaaauaucuguguauacugguauuuuaggugcaagucaacuaaugaaccagcuacg

SEQ ID NO: 536487 - RNA, 64 nt, Homo Sapiens
auuuuaaugcuagucaguauuuuuauauuagaugaggugcaaaaggaauuguauuuguugccuu

SEQ ID NO: 536488 - RNA, 64 nt, Homo Sapiens
uuacaugauuuuccuacacucuguaauuuugcugaggugcaauuuggaacucugcaagaccuac

SEQ ID NO: 536489 - RNA, 64 nt, Homo Sapiens
aaaagccuuacauuaauuuaauguuugcacucugaggugcaacuuaacagggagggccugagaa

SEQ ID NO: 536490 - RNA, 64 nt, Homo Sapiens
cucaagucuauugaauaaugggagauaagaaagcaggugcaacaggaaacuuaaccaccuacaa

SEQ ID NO: 536491 - RNA, 64 nt, Homo Sapiens
ugaggcucugcuagcaagccacagaaagccacagaggugcaacuuggcuguaggacucgaauuu

SEQ ID NO: 536492 - RNA, 64 nt, Homo Sapiens
auaaaaggaaaaccagugaagaaaaaagaccaauaggugcaaaaaauucaaaccaauucaccca

SEQ ID NO: 536493 - RNA, 64 nt, Homo Sapiens
gaugucuaauaaucccugcaauagauaagguguuaggugcaaagaaaaauguaucaaauguauu

SEQ ID NO: 536494 - RNA, 51 nt, Homo Sapiens
acucuucgaagagggauuaaaaggugcaaaaagacaacuaaaauacccauu

SEQ ID NO: 536495 - RNA, 64 nt, Homo Sapiens
gcuuauaguaucuauaaauuaacaagaaguaugcaggugcaaaaaagugguggaacaaauacca

SEQ ID NO: 536496 - RNA, 64 nt, Homo Sapiens
cuagucuacuucaaaauuuuuuacacguuugcagaggugcaaucaaauggaauuaagucucucg

SEQ ID NO: 536497 - RNA, 64 nt, Homo Sapiens
cacuaauauagccuguuaaaucuuuuguggagacaggugcaaaucagaagauugacaaggaaga

SEQ ID NO: 536498 - RNA, 64 nt, Homo Sapiens
cgaaacugguugcucaaguuaacaguguuagacaaggugcaaagaacauuucuuccugauugac

SEQ ID NO: 536499 - RNA, 64 nt, Homo Sapiens
gacagagcccccaagccucuuggacccucgcagcaggugcaagaaguggcuugugauucuggga

SEQ ID NO: 536500 - RNA, 64 nt, Homo Sapiens
acgagauuaugagacaggucacugacuccagccaaggugcaaaggcccugagccauggcugcug

SEQ ID NO: 536501 - RNA, 64 nt, Homo Sapiens
aaccuguuuuggaagaaagcuggaugggaacucaaggugcaaagacuuugucccuccuuugaag

SEQ ID NO: 536502 - RNA, 64 nt, Homo Sapiens
ugacuuuguuuauucuugucaaucuucugguugcaggugcaaaguuaugguuggaaaacugagg

SEQ ID NO: 536503 - RNA, 64 nt, Homo Sapiens
caaaaggaccauuuaaaguaccaagcgaggucucaggugcaaagccagcgaaugacgucugugg

SEQ ID NO: 536504 - RNA, 64 nt, Homo Sapiens
aggcagaucuuugcugccagcaccugcuggugagaggugcaaagcucucccuccaccuccucuc

SEQ ID NO: 536505 - RNA, 64 nt, Homo Sapiens
ucuuguacugaagcagucucugcaauugaauucaaggugcaaagauuuugcuauccacacuuga

SEQ ID NO: 536506 - RNA, 64 nt, Homo Sapiens
ucuagacaugcuaccagacauggggaaccauuagaggugcaaucuacauugggcaucuggucau

SEQ ID NO: 536507 - RNA, 64 nt, Homo Sapiens
ucauaguguuaacacugguucugcaauaucucugaggugcaaagaaugcacuuuucccuauggg

SEQ ID NO: 536508 - RNA, 64 nt, Homo Sapiens
cuaugaagccuugaauuuugaaaaaaagacaagaaggugcaaaagguaagacauuugaguguuu

SEQ ID NO: 536509 - RNA, 64 nt, Homo Sapiens
agcacugggggcuacccguuacccaaucuuggagaggugcaaaagggucaggggacugguaguc

SEQ ID NO: 536510 - RNA, 64 nt, Homo Sapiens
ucauauaucaucaguuagcauguuuccaaaaagaaggugcaauauuuuuaaaucuccaacuugc

SEQ ID NO: 536511 - RNA, 64 nt, Homo Sapiens
guuauguagaaggaaagggaaaacucccacucucaggugcaagacuccuuccuguguuccuaca

SEQ ID NO: 536512 - RNA, 64 nt, Homo Sapiens
agauacuuaucuaacuggacaauucuacucucagaggugcaaaaauucugucauauuuacuucu

SEQ ID NO: 536513 - RNA, 64 nt, Homo Sapiens
gaagccucucagcaggugcgugcaaguucucuccaggugcaauuuggacacgcccguugcccac

SEQ ID NO: 536514 - RNA, 64 nt, Homo Sapiens
gaugcaguuaucccuuauggguuucuaguugugaaggugcaaaaauagaaaaagucgcugaguc

SEQ ID NO: 536515 - RNA, 64 nt, Homo Sapiens
cccugacucccaaaguuaguacugcggcuuguugaggugcaauaguagcaaucacaaacuaaag

SEQ ID NO: 536516 - RNA, 64 nt, Homo Sapiens
acuggaucucugguuuuucuccugaaguuggggcaggugcaauuccaagcauaaccaccagaug

SEQ ID NO: 536517 - RNA, 64 nt, Homo Sapiens
acccgcugccacacacuacaggagucaauaaacaaggugcaauauuuucaaaucguuggccggc

SEQ ID NO: 536518 - RNA, 64 nt, Homo Sapiens
ggcagcugugugagcugccaagcuagugggcuucaggugcaaggguaccugugccacaccaacc

SEQ ID NO: 536519 - RNA, 64 nt, Homo Sapiens
aagcgggcuccaggagcaagagacgacugagaagaggugcaaggagccucucugcuuuagcuaa

SEQ ID NO: 536520 - RNA, 64 nt, Homo Sapiens
caaugcguacguuuccugagcagguggacacacaaggugcaaaucugcacuaauuugauguuua

SEQ ID NO: 536521 - RNA, 64 nt, Homo Sapiens
gcugccagccagugcugcuguguauucaugccagaggugcaaagucuucccaaccucagcugcc

SEQ ID NO: 536522 - RNA, 64 nt, Homo Sapiens
uaccauuagaaaauacuauuaacaaauauuuuaaaggugcaaaauucucuuaaaauagaguuug

SEQ ID NO: 536523 - RNA, 64 nt, Homo Sapiens
ccuggagauggauuguaagacuacauggggaaacaggugcaaacaagcgggaugcuauuaaaaa

SEQ ID NO: 536524 - RNA, 64 nt, Homo Sapiens
gucaugaggcccaggcagcugggauuuguaacugaggugcaacuuuaagcaaauagagccgucu

SEQ ID NO: 536525 - RNA, 64 nt, Homo Sapiens
gcagcuuagcuacugagguauugucaugccagccaggugcaaagcuguguauguugagccacug

SEQ ID NO: 536526 - RNA, 64 nt, Homo Sapiens
agaugagacuauacaucagggccagagacagcucaggugcaaggagaguucucuucuucagccc

SEQ ID NO: 536527 - RNA, 64 nt, Homo Sapiens
acacaaggaguuuggugggcuacucgcuaaucgcaggugcaaacgagggaccuaagugccuacc

SEQ ID NO: 536528 - RNA, 64 nt, Homo Sapiens
agcuguugagugagcugcuaugacuuugguagagaggugcaauauguuuuuugaaccagcuaua

SEQ ID NO: 536529 - RNA, 64 nt, Homo Sapiens
ggcuguuaccuaaugguccucucugucccauuauaggugcaaggcaccccauccacacauuugc

SEQ ID NO: 536530 - RNA, 64 nt, Homo Sapiens
uccuucugggggcuucgcuuccuuagccuugcucaggugcaagugccccagggggcggggugca

SEQ ID NO: 536531 - RNA, 64 nt, Homo Sapiens
agugaucuuggagcacacaugaauaacuuucugaaggugcaaccaaauccauuuuuauuucugc

SEQ ID NO: 536532 - RNA, 64 nt, Homo Sapiens
ccucuccauuccccaggcuccacccgugcugcucaggugcaaauggacuugagagcaucuaugu

SEQ ID NO: 536533 - RNA, 64 nt, Homo Sapiens
uuggagacacggcuuguuccagaugaggaaacugaggugcaaagcaguuaagcaacugguccaa

SEQ ID NO: 536534 - RNA, 64 nt, Homo Sapiens
ucaguagagaagggaauguaaaugaggaguuggaaggugcaaaguccugcucuucgaagacagc

SEQ ID NO: 536535 - RNA, 64 nt, Homo Sapiens
guucuugggaaucuuggagccuaaagagaaaccgaggugcaaauucauuucauggugacugacc

SEQ ID NO: 536536 - RNA, 64 nt, Homo Sapiens
cauauuaaauauuuuaucugcuuuuacaagcgcaaggugcaaaaauauauacaauagucucauu

SEQ ID NO: 536537 - RNA, 64 nt, Homo Sapiens
cuuuaaagcuaaagacaagaauaucaugcuauacaggugcaacucaauccccguuaauaaaaac

SEQ ID NO: 536538 - RNA, 64 nt, Homo Sapiens
ccuccccgucccguugucccauuuugcucugugaaggugcaaaucccuuucuucccuucccauc

SEQ ID NO: 536539 - RNA, 64 nt, Homo Sapiens
guccaaaccugggcuugucuuggaccugauaguaaggugcaaagaggcugaauggugcagccgc

SEQ ID NO: 536540 - RNA, 64 nt, Homo Sapiens
ggaggagggcaggcugggaaugugggauaagcccaggugcaagggcuucaggaugggcuauuaa

SEQ ID NO: 536541 - RNA, 64 nt, Homo Sapiens
augcacacuuauacccccaguauucccaaaaggcaggugcaaugguacaaaagauuauuaaaaa

SEQ ID NO: 536542 - RNA, 64 nt, Homo Sapiens
agaauuuagggagaaauguuugcuggagagguuaaggugcaauauuauagaguagaagauuuga

SEQ ID NO: 536543 - RNA, 64 nt, Homo Sapiens
cagggaggcagagagaaugucagauaaggaggccaggugcaagggaucuuucaagucugggaga

SEQ ID NO: 536544 - RNA, 64 nt, Homo Sapiens
ggccacuccuguaguuucuuugaaaucagaacauaggugcaaauaauggguaaaacaccaaacu

SEQ ID NO: 536545 - RNA, 64 nt, Homo Sapiens
uucuuucuuuuuuuuuuuuuuuguguagaaaaauaggugcaauaaugaucaaaguuuugauguc

SEQ ID NO: 536546 - RNA, 64 nt, Homo Sapiens
gaaucuacuguugcuauguuagugugaauguugaaggugcaauuaucacauuguuuauuaauug

SEQ ID NO: 536547 - RNA, 64 nt, Homo Sapiens
aaaccguguauuuauuacauugcugccuuuguugaggugcaaggaguguaaaauguauauuuuu

SEQ ID NO: 536548 - RNA, 64 nt, Homo Sapiens
acuugaccugcagccccagccucacugcagccaaaggugcaauuaaaccaccugcguccacacc

SEQ ID NO: 536549 - RNA, 64 nt, Homo Sapiens
acagaaguauugagagaaacagggagguggcaggaggugcaaagccacaguaagcaccaugguc

SEQ ID NO: 536550 - RNA, 64 nt, Homo Sapiens
aggagcagaguugcaaauuaacaacuugcaaaugaggugcaaauaaaaugcagaugauugcgcg

SEQ ID NO: 536551 - RNA, 64 nt, Homo Sapiens; identical to SEQ ID NO: 536550

SEQ ID NO: 536552 - RNA, 64 nt, Homo Sapiens
guuuauuauucuaacaagguguggagugucagcgaggugcaauguggggagaauacauuguaga

SEQ ID NO: 536553 - RNA, 64 nt, Homo Sapiens
ucuauuaacuuuuuuccuuuuaccaauaacuuugaggugcaaaacucaaacuuaugugggucuu

SEQ ID NO: 536554 - RNA, 64 nt, Homo Sapiens
gaguuccuuuguaucugacaaucucaggacuccaaggugcaaagccugcugcauuugcgugauc

SEQ ID NO: 536555 - RNA, 64 nt, Homo Sapiens
guuggaagucuuugguauaugcaaaugaaaggagaggugcaacaacuuaguuuaauuauaaaag

SEQ ID NO: 536556 - RNA, 64 nt, Homo Sapiens
ugaggucauuugugagcacaagaucucauagggcaggugcaaaauaggaauguuguucucaagu

SEQ ID NO: 536557 - RNA, 64 nt, Homo Sapiens
gcuacagaguucuuuucuugggaccuagacugggaggugcaaugucaggaccuccaggugaaug

SEQ ID NO: 536558 - RNA, 64 nt, Homo Sapiens
gcaaaggaaauuucccuguuauuuuuagggaccuaggugcaaguguauauuuucugaguucagc

SEQ ID NO: 536559 - RNA, 64 nt, Homo Sapiens
ggcagggccugaucagaggcgguggaaggcagggaggugcaacuagcugcuuguggguuucugg

SEQ ID NO: 536560 - RNA, 64 nt, Homo Sapiens
aaacaagcuuacuuccauugcuauagugaagaauaggugcaaacuuccucccaaaguaggugag

SEQ ID NO: 536561 - RNA, 64 nt, Homo Sapiens
gcuuuucucaugacaaaagagcacacguacgaaaaggugcaauuuuuguuggaagcagaucaga

SEQ ID NO: 536562 - RNA, 64 nt, Homo Sapiens
guagcaugucacaugugaccgcuuguuugguacuaggugcaagucagaucucauugaaguauca

SEQ ID NO: 536563 - RNA, 64 nt, Homo Sapiens
uauagugguaaagaaacagguuguucacuugcugaggugcaaaaauucuuaagacuucuguuug

SEQ ID NO: 536564 - RNA, 64 nt, Homo Sapiens
uaaagacagaucagacugauaaccuuaacaccauaggugcaaaaugaguuguucugagguuuuu

SEQ ID NO: 536565 - RNA, 64 nt, Homo Sapiens
ggggucugaauuuuugggagcaggcaauaucugaaggugcaaacaggcccuacggcuguucccu

SEQ ID NO: 536566 - RNA, 64 nt, Homo Sapiens
guaacauacucuuuguauauauuuauuauaugaaaggugcaauauuuuauuuuguacaguaugu

SEQ ID NO: 536567 - RNA, 64 nt, Homo Sapiens
aauaggaucuuuagcaacuuuuucacaucauagaaggugcaaucgcucacuugggaacacuacu

SEQ ID NO: 536568 - RNA, 64 nt, Homo Sapiens
caguggcauuucuccucuccggagacuuacugggaggugcaagacaagggcuguucaugaaaag

SEQ ID NO: 536569 - RNA, 64 nt, Homo Sapiens
cucacuucaaauuauguuuggacuugacaaaaauaggugcaaaugauggggggcaauagaagaa

SEQ ID NO: 536570 - RNA, 64 nt, Homo Sapiens
ccuaaaugaauuguguugcaucugagugaguccaaggugcaacuacuucugaaaacuauauuua

SEQ ID NO: 536571 - RNA, 64 nt, Homo Sapiens
guggcuggucucgucugccgggggaaggguggggaggugcaaugggaugggaggcaggaugcuu

SEQ ID NO: 536572 - RNA, 64 nt, Homo Sapiens
acccuaccacagcgucccgcguagcugggacuacaggugcaagccacuauguccagcuagccaa

SEQ ID NO: 536573 - RNA, 64 nt, Homo Sapiens
gagggauguacugaagcuucgguggagugggcagaggugcaagagggagggagccaacgccuca

SEQ ID NO: 536574 - RNA, 64 nt, Homo Sapiens
uuuagguuuacuuucacuuguuauuugacuuagcaggugcaacaaaaacaagaaacaaaugugc

SEQ ID NO: 536575 - RNA, 64 nt, Homo Sapiens
aaguuacacauuauagccagaaucuguaucacagaggugcaagcugacagcagagcucaguccc

SEQ ID NO: 536576 - RNA, 64 nt, Homo Sapiens
ucuucacauacuguacauaccaugaucagcucugaggugcaacuucugguguuuuuaacuugau

SEQ ID NO: 536577 - RNA, 64 nt, Homo Sapiens
ugccuacacccaauaccagggcggacuucauugcaggugcaaguaggagagaccuuccucuccu

SEQ ID NO: 536578 - RNA, 64 nt, Homo Sapiens
uacuggaaauguagcacuuagagcuuuugaugccaggugcaauccaggacccuaagaugaagcu

SEQ ID NO: 536579 - RNA, 64 nt, Homo Sapiens
cuaagauucuaaagguccacaggucuagacuauuaggugcaauuucaagguucuaacccuauac

SEQ ID NO: 536580 - RNA, 64 nt, Homo Sapiens
cccucccugugccagaccucaaaacgacgggggcaggugcaaguucauaggucuccaagaccac

SEQ ID NO: 536581 - RNA, 64 nt, Homo Sapiens
aauauguugaaucucaugaccugauguauaucaaaggugcaacggcuuguaaaugaccaguuuu

SEQ ID NO: 536582 - RNA, 64 nt, Homo Sapiens
aauguggucaggcaaccugaguccaguggaaugcaggugcaacuucuaagaguuuuccuguaag

SEQ ID NO: 536583 - RNA, 64 nt, Homo Sapiens
caggcagaucauuugaggucacuuugggaggccaaggugcaaggcucaugccuauagucccagc

SEQ ID NO: 536584 - RNA, 64 nt, Homo Sapiens
ucaggaaccaaaggucaccgccuacacuuccacaaggugcaacccaggagcuccacuacgcugu

SEQ ID NO: 536585 - RNA, 64 nt, Homo Sapiens
uauugacuuaaacuuguuuaaaacacaugagaacaggugcaauacuuacugucuaauauaggaa

SEQ ID NO: 536586 - RNA, 64 nt, Homo Sapiens
ccucugagcaacuugcucugaccuauaaugucuuaggugcaacacggaccccaccagagcucuu

SEQ ID NO: 536587 - RNA, 64 nt, Homo Sapiens
cugccuggucugucuggaucccgagguauggcagaggugcaagaccuaguccccuuuccucuaa

SEQ ID NO: 536588 - RNA, 64 nt, Homo Sapiens
gcuguguuugugagaagaguaggaucacacacacaggugcaaucuugaccacacuuaccugcaa

SEQ ID NO: 536589 - RNA, 64 nt, Homo Sapiens
gguuucugaaaaacagcagggcuccauggggcccaggugcaaagugcuccauggggcccugcug

SEQ ID NO: 536590 - RNA, 64 nt, Homo Sapiens
acauuugcugucagccacauauugagaugacacuaggugcaauagcagggauagauuuuguugg

SEQ ID NO: 536591 - RNA, 64 nt, Homo Sapiens
acaggccgcccugcgggugaacaaagcagccacgaggugcaacaagguccucugucagucacag

SEQ ID NO: 536592 - RNA, 64 nt, Homo Sapiens
aacuaaguaggcagguaggaucugaagaaggcacaggugcaaguaaaauucgucaauuaaacca

SEQ ID NO: 536593 - RNA, 64 nt, Homo Sapiens
cucaggccucugagggcaccaggcccuggagaagaggugcaauucaggguguguguguguuuuu

SEQ ID NO: 536594 - RNA, 64 nt, Homo Sapiens
uguauauauauugcauucguaugggacucugaggaggugcaaccagauacuuuuauauauuugu

SEQ ID NO: 536595 - RNA, 64 nt, Homo Sapiens
gcauucaauacuacaaaaucaacaugauuucauaaggugcaaauaaaaguuggugacagauuua

SEQ ID NO: 536596 - RNA, 64 nt, Homo Sapiens
cauuccugcauggaccuuucccaagcgcuagcacaggugcaaaauccaucagagccauuguuuu

SEQ ID NO: 536597 - RNA, 64 nt, Homo Sapiens
gauguuugcgcucgcauuacagggaccucaaccuaggugcaauccugucaugugagguuucagc

SEQ ID NO: 536598 - RNA, 64 nt, Homo Sapiens
auuuuuuugugugaaguaaauuaaucaacuagagaggugcaaaacguucucaguugauaucuga

SEQ ID NO: 536599 - RNA, 64 nt, Homo Sapiens
cagcacugguaaggacucuugugcucaaggcugcaggugcaagacaggagauuucagagugaga

SEQ ID NO: 536600 - RNA, 64 nt, Homo Sapiens
gguuuauagcccugugaaguuccacaaaugaugcaggugcaaaucugucacaguauagucacaa

SEQ ID NO: 536601 - RNA, 64 nt, Homo Sapiens
uuaucacaacgaccuuuucaaguaggcauuaucaccaugcgacagguugaggaccgugaggcac

SEQ ID NO: 536602 - RNA, 64 nt, Homo Sapiens
ccccauccugucaggcacaggugacgggggcagcccaugcgagcccuucuccugcugcucuggg

SEQ ID NO: 536603 - RNA, 64 nt, Homo Sapiens
uauccuuguuugcacaggacugguggaaaaucucccaugcgacccucggggcccagagccaucu

SEQ ID NO: 536604 - RNA, 64 nt, Homo Sapiens
ucagagugggacaguagugaacagagcugggauuccaugcgacagcuugaaugcugaccuucag

SEQ ID NO: 536605 - RNA, 64 nt, Homo Sapiens
gccugauccguuucccuggaucugacguaagcuuccaugcgacaaucaccccaaaaccaccauc

SEQ ID NO: 536606 - RNA, 64 nt, Homo Sapiens
uauuuauaccucaaacacugaugugacucuugccccaugcgagaaugucaaggccagcaagcug

SEQ ID NO: 536607 - RNA, 64 nt, Homo Sapiens
gcucauaaaagcagaaggugugcuauucacaguaccaugcgaguagcccacaguuaauucccgg

SEQ ID NO: 536608 - RNA, 64 nt, Homo Sapiens
acagccauugccuuuuuuaaagacagaaagcacuccaugcgaaauugcuaacucauggaacugc

SEQ ID NO: 536609 - RNA, 64 nt, Homo Sapiens
cccacacgacacgggcagcuuuuucucgcagaagccaugcgacuccuccgucugccuaaaucac

SEQ ID NO: 536610 - RNA, 64 nt, Homo Sapiens
uuguggagaaaguaauuauuccaacacccaucugccaugcgauguuaaaaaaaaaaaaaaggaa

SEQ ID NO: 536611 - RNA, 64 nt, Homo Sapiens
accggcgacgccgauacgguuccuccaccgaggcccaugcgaagcuuuccacuauggcuuccag

SEQ ID NO: 536612 - RNA, 64 nt, Homo Sapiens
ggugcuguguuacauacacaaaaugagaaaaggaccaugcgauuagcuuaccugagaaagcuuu

SEQ ID NO: 536613 - RNA, 64 nt, Homo Sapiens
gauaccuauuuauaaaauaauaccgcauuuggaaccaugcgaguucauauauacucucugugcc

SEQ ID NO: 536614 - RNA, 64 nt, Homo Sapiens
gcuguauauauugaacauuauauagucagauaguccaugcgaagguguuaucacucugccugug

SEQ ID NO: 536615 - RNA, 64 nt, Homo Sapiens
cugggaggccagugagccacccccucugcacggaccaugcgacaaggagacaggcagagcugcu

SEQ ID NO: 536616 - RNA, 64 nt, Homo Sapiens
ugacguguggaaagucuaggggguuccauucuggccaugcgagcccagcuccuaccaacgucgg

SEQ ID NO: 536617 - RNA, 64 nt, Homo Sapiens
caaccaccccacuccacaugcaacuguccccaacccaugcgauucauccuuucccugaaggcuu

SEQ ID NO: 536618 - RNA, 64 nt, Homo Sapiens
gcacucgccuucugccuucugggucauucuccugccaugcgagggaguggcugccccugccuca

SEQ ID NO: 536619 - RNA, 64 nt, Homo Sapiens
agcauccuuucaggccagugcccuuccucucccaccaugcgaugcuggugauuguuccuucccu

SEQ ID NO: 536620 - RNA, 64 nt, Homo Sapiens
cuaugugugcauuauuugaaguacggaauuugauccaugcgauaucucaugaccauauugaaau

SEQ ID NO: 536621 - RNA, 64 nt, Homo Sapiens
auauuuaacucaucuaguuaauaauguuuuuauuccaugcgaaugauuugauauuuucauccuu

SEQ ID NO: 536622 - RNA, 64 nt, Homo Sapiens
cacucuggcaccaaggcuuuacucggccuggacaccaugcgaugccucuaaccaucugacagag

SEQ ID NO: 536623 - RNA, 64 nt, Homo Sapiens
cuggagcugaggcugugggcggcugucccagcaaccaugcgagggguugccccaguugcucaua

SEQ ID NO: 536624 - RNA, 64 nt, Homo Sapiens
uggcggcagcccaccuugguaagggccccagggcccaugcgagagcugccugauggccucuugu

SEQ ID NO: 536625 - RNA, 64 nt, Homo Sapiens
uuccccuuggaagaugcuucugugaccuuuccagccaugcgauaacccgacaucaaagcuggcg

SEQ ID NO: 536626 - RNA, 64 nt, Homo Sapiens
aagccccaugugccuuguccaggaacugccugggccaugcgaggggccagcagagggcgccacc

SEQ ID NO: 536627 - RNA, 64 nt, Homo Sapiens
cccagcgacaaucacugaacgccgaagccugcagccaugcgaccccacgccaccccgugccucc

SEQ ID NO: 536628 - RNA, 64 nt, Homo Sapiens
auccgggucugccuccuccugcagggcagcucccccaugcgaggucgucgaagcgggcuccgau

SEQ ID NO: 536629 - RNA, 64 nt, Homo Sapiens
ggaauaaagcaggaggcucauuuucaggcuggugccaugcgauuccucucagaagggagagagg

SEQ ID NO: 536630 - RNA, 64 nt, Homo Sapiens
ggcagaccaacgaaaccagaugagaccaacgacaccaugcgagacacgcuugcagacacuguug

SEQ ID NO: 536631 - RNA, 64 nt, Homo Sapiens
caagucgcggcugcaggaucguggccuccgugacccaugcgauuccagcucugggggcuccagc

SEQ ID NO: 536632 - RNA, 64 nt, Homo Sapiens
cuggggccucgcaauucuugcuucaggaucucucccaugcgagcugcccggagggugucagcag

SEQ ID NO: 536633 - RNA, 64 nt, Homo Sapiens
cugggcuauuggccaaaggcuauacucauguaagccaugcgagccucucccacaaggcagcuug

SEQ ID NO: 536634 - RNA, 64 nt, Homo Sapiens
uggucaagccccccucacucgcuuuucuccauugccaugcgaccaguauaagcaucucccaucu

SEQ ID NO: 536635 - RNA, 64 nt, Homo Sapiens; identical to SEQ ID NO: 296587

SEQ ID NO: 536636 - RNA, 64 nt, Homo Sapiens; identical to SEQ ID NO: 296588

SEQ ID NO: 536637 - RNA, 64 nt, Homo Sapiens; identical to SEQ ID NO: 172974

SEQ ID NO: 536638 - RNA, 64 nt, Homo Sapiens; identical to SEQ ID NO: 172975

SEQ ID NO: 536639 - RNA, 64 nt, Homo Sapiens; identical to SEQ ID NO: 172976

SEQ ID NO: 536640 - RNA, 64 nt, Homo Sapiens; identical to SEQ ID NO: 172977

SEQ ID NO: 536641 - RNA, 64 nt, Homo Sapiens; identical to SEQ ID NO: 172978

SEQ ID NO: 536642 - RNA, 64 nt, Homo Sapiens; identical to SEQ ID NO: 172979

SEQ ID NO: 536643 - RNA, 64 nt, Homo Sapiens; identical to SEQ ID NO: 172980

SEQ ID NO: 536644 - RNA, 64 nt, Homo Sapiens; identical to SEQ ID NO: 172981

SEQ ID NO: 536645 - RNA, 64 nt, Homo Sapiens; identical to SEQ ID NO: 172982

SEQ ID NO: 536646 - RNA, 64 nt, Homo Sapiens; identical to SEQ ID NO: 172983

SEQ ID NO: 536647 - RNA, 64 nt, Homo Sapiens; identical to SEQ ID NO: 172984

SEQ ID NO: 536648 - RNA, 64 nt, Homo Sapiens; identical to SEQ ID NO: 172985

SEQ ID NO: 536649 - RNA, 64 nt, Homo Sapiens; identical to SEQ ID NO: 172986

SEQ ID NO: 536650 - RNA, 64 nt, Homo Sapiens; identical to SEQ ID NO: 172987

SEQ ID NO: 536651 - RNA, 64 nt, Homo Sapiens; identical to SEQ ID NO: 172988

SEQ ID NO: 536652 - RNA, 54 nt, Homo Sapiens; identical to SEQ ID NO: 172989

SEQ ID NO: 536653 - RNA, 64 nt, Homo Sapiens; identical to SEQ ID NO: 172990

SEQ ID NO: 536654 - RNA, 64 nt, Homo Sapiens; identical to SEQ ID NO: 172991

SEQ ID NO: 536655 - RNA, 64 nt, Homo Sapiens; identical to SEQ ID NO: 172992

SEQ ID NO: 536656 - RNA, 64 nt, Homo Sapiens; identical to SEQ ID NO: 172993

SEQ ID NO: 536657 - RNA, 64 nt, Homo Sapiens; identical to SEQ ID NO: 172994

SEQ ID NO: 536658 - RNA, 64 nt, Homo Sapiens; identical to SEQ ID NO: 172995

SEQ ID NO: 536659 - RNA, 64 nt, Homo Sapiens; identical to SEQ ID NO: 172996

SEQ ID NO: 536660 - RNA, 64 nt, Homo Sapiens; identical to SEQ ID NO: 172997

SEQ ID NO: 536661 - RNA, 64 nt, Homo Sapiens; identical to SEQ ID NO: 172998

SEQ ID NO: 536662 - RNA, 64 nt, Homo Sapiens; identical to SEQ ID NO: 172999

SEQ ID NO: 536663 - RNA, 64 nt, Homo Sapiens; identical to SEQ ID NO: 173000

SEQ ID NO: 536664 - RNA, 64 nt, Homo Sapiens; identical to SEQ ID NO: 173001

SEQ ID NO: 536665 - RNA, 64 nt, Homo Sapiens; identical to SEQ ID NO: 173002

SEQ ID NO: 536666 - RNA, 64 nt, Homo Sapiens; identical to SEQ ID NO: 173003

SEQ ID NO: 536667 - RNA, 64 nt, Homo Sapiens; identical to SEQ ID NO: 173004

SEQ ID NO: 536668 - RNA, 61 nt, Homo Sapiens; identical to SEQ ID NO: 173005

SEQ ID NO: 536669 - RNA, 64 nt, Homo Sapiens; identical to SEQ ID NO: 173006

SEQ ID NO: 536670 - RNA, 64 nt, Homo Sapiens; identical to SEQ ID NO: 173007

SEQ ID NO: 536671 - RNA, 64 nt, Homo Sapiens; identical to SEQ ID NO: 173008

SEQ ID NO: 536672 - RNA, 64 nt, Homo Sapiens; identical to SEQ ID NO: 173009

SEQ ID NO: 536673 - RNA, 64 nt, Homo Sapiens; identical to SEQ ID NO: 275791

SEQ ID NO: 536674 - RNA, 64 nt, Homo Sapiens; identical to SEQ ID NO: 275792

SEQ ID NO: 536675 - RNA, 64 nt, Homo Sapiens; identical to SEQ ID NO: 275793

SEQ ID NO: 536676 - RNA, 64 nt, Homo Sapiens; identical to SEQ ID NO: 275794

SEQ ID NO: 536677 - RNA, 64 nt, Homo Sapiens; identical to SEQ ID NO: 275795

SEQ ID NO: 536678 - RNA, 64 nt, Homo Sapiens; identical to SEQ ID NO: 275796

SEQ ID NO: 536679 - RNA, 64 nt, Homo Sapiens; identical to SEQ ID NO: 275797

SEQ ID NO: 536680 - RNA, 64 nt, Homo Sapiens; identical to SEQ ID NO: 275798

SEQ ID NO: 536681 - RNA, 64 nt, Homo Sapiens; identical to SEQ ID NO: 275799

SEQ ID NO: 536682 - RNA, 64 nt, Homo Sapiens; identical to SEQ ID NO: 275800

SEQ ID NO: 536683 - RNA, 64 nt, Homo Sapiens; identical to SEQ ID NO: 275801

SEQ ID NO: 536684 - RNA, 64 nt, Homo Sapiens; identical to SEQ ID NO: 275802

SEQ ID NO: 536685 - RNA, 64 nt, Homo Sapiens; identical to SEQ ID NO: 275803

SEQ ID NO: 536686 - RNA, 64 nt, Homo Sapiens; identical to SEQ ID NO: 275804

SEQ ID NO: 536687 - RNA, 64 nt, Homo Sapiens; identical to SEQ ID NO: 275805

SEQ ID NO: 536688 - RNA, 64 nt, Homo Sapiens; identical to SEQ ID NO: 275806

SEQ ID NO: 536689 - RNA, 64 nt, Homo Sapiens; identical to SEQ ID NO: 275807

SEQ ID NO: 536690 - RNA, 64 nt, Homo Sapiens; identical to SEQ ID NO: 275808

SEQ ID NO: 536691 - RNA, 64 nt, Homo Sapiens; identical to SEQ ID NO: 275809

SEQ ID NO: 536692 - RNA, 64 nt, Homo Sapiens; identical to SEQ ID NO: 275810

SEQ ID NO: 536693 - RNA, 64 nt, Homo Sapiens; identical to SEQ ID NO: 275811

SEQ ID NO: 536694 - RNA, 64 nt, Homo Sapiens; identical to SEQ ID NO: 275812

SEQ ID NO: 536695 - RNA, 64 nt, Homo Sapiens; identical to SEQ ID NO: 275813

SEQ ID NO: 536696 - RNA, 64 nt, Homo Sapiens; identical to SEQ ID NO: 275814

SEQ ID NO: 536697 - RNA, 64 nt, Homo Sapiens; identical to SEQ ID NO: 275815

SEQ ID NO: 536698 - RNA, 64 nt, Homo Sapiens; identical to SEQ ID NO: 275816

SEQ ID NO: 536699 - RNA, 64 nt, Homo Sapiens; identical to SEQ ID NO: 275817

SEQ ID NO: 536700 - RNA, 64 nt, Homo Sapiens; identical to SEQ ID NO: 275818

SEQ ID NO: 536701 - RNA, 64 nt, Homo Sapiens; identical to SEQ ID NO: 275819

SEQ ID NO: 536702 - RNA, 64 nt, Homo Sapiens; identical to SEQ ID NO: 275820

SEQ ID NO: 536703 - RNA, 64 nt, Homo Sapiens; identical to SEQ ID NO: 275821

SEQ ID NO: 536704 - RNA, 64 nt, Homo Sapiens; identical to SEQ ID NO: 275822

SEQ ID NO: 536705 - RNA, 64 nt, Homo Sapiens; identical to SEQ ID NO: 275823

SEQ ID NO: 536706 - RNA, 64 nt, Homo Sapiens; identical to SEQ ID NO: 275824

SEQ ID NO: 536707 - RNA, 64 nt, Homo Sapiens; identical to SEQ ID NO: 275825

SEQ ID NO: 536708 - RNA, 64 nt, Homo Sapiens; identical to SEQ ID NO: 275826

SEQ ID NO: 536709 - RNA, 64 nt, Homo Sapiens; identical to SEQ ID NO: 275827

SEQ ID NO: 536710 - RNA, 64 nt, Homo Sapiens; identical to SEQ ID NO: 275828

SEQ ID NO: 536711 - RNA, 64 nt, Homo Sapiens; identical to SEQ ID NO: 275829

SEQ ID NO: 536712 - RNA, 64 nt, Homo Sapiens; identical to SEQ ID NO: 275830

SEQ ID NO: 536713 - RNA, 64 nt, Homo Sapiens; identical to SEQ ID NO: 275831

SEQ ID NO: 536714 - RNA, 64 nt, Homo Sapiens; identical to SEQ ID NO: 275832

SEQ ID NO: 536715 - RNA, 64 nt, Homo Sapiens; identical to SEQ ID NO: 275833

SEQ ID NO: 536716 - RNA, 64 nt, Homo Sapiens; identical to SEQ ID NO: 275834

SEQ ID NO: 536717 - RNA, 64 nt, Homo Sapiens; identical to SEQ ID NO: 275835

SEQ ID NO: 536718 - RNA, 64 nt, Homo Sapiens; identical to SEQ ID NO: 275836

SEQ ID NO: 536719 - RNA, 64 nt, Homo Sapiens; identical to SEQ ID NO: 275837

SEQ ID NO: 536720 - RNA, 64 nt, Homo Sapiens; identical to SEQ ID NO: 275838

SEQ ID NO: 536721 - RNA, 64 nt, Homo Sapiens; identical to SEQ ID NO: 275839

SEQ ID NO: 536722 - RNA, 64 nt, Homo Sapiens; identical to SEQ ID NO: 275840

SEQ ID NO: 536723 - RNA, 64 nt, Homo Sapiens; identical to SEQ ID NO: 243256

SEQ ID NO: 536724 - RNA, 64 nt, Homo Sapiens; identical to SEQ ID NO: 243257

SEQ ID NO: 536725 - RNA, 64 nt, Homo Sapiens; identical to SEQ ID NO: 243258

SEQ ID NO: 536726 - RNA, 64 nt, Homo Sapiens; identical to SEQ ID NO: 243259

SEQ ID NO: 536727 - RNA, 64 nt, Homo Sapiens; identical to SEQ ID NO: 243260

SEQ ID NO: 536728 - RNA, 64 nt, Homo Sapiens; identical to SEQ ID NO: 243261

SEQ ID NO: 536729 - RNA, 64 nt, Homo Sapiens
accaucucugacguaagcuuauuuguccaaaucaccccaaaaccagcuuugcuaaacuaaccua

SEQ ID NO: 536730 - RNA, 64 nt, Homo Sapiens
ccccuuuccaguuacaauuacuccugaauacacuccccaaaacauaaguuuuuucuuucuuccu

SEQ ID NO: 536731 - RNA, 64 nt, Homo Sapiens
aucguaguacaugccagucaagaucuauauaggcccccaaaauguuccucugaauuuugaugua

SEQ ID NO: 536732 - RNA, 64 nt, Homo Sapiens
aggaaucuccuauggccaauagguauggggguagccccaaaaggcucacacucuuggaauuucc

SEQ ID NO: 536733 - RNA, 64 nt, Homo Sapiens
gcauggggccugacaucuucugccacuuuucccaccccaaaacaacaggcuguugagaauucuu

SEQ ID NO: 536734 - RNA, 64 nt, Homo Sapiens
aguugacgaaaggguuuuaugccucucucucaccccccaaaacacuacaucuucccuaagcacu

SEQ ID NO: 536735 - RNA, 64 nt, Homo Sapiens
agcaggcaaaugcuuuuuaaaaucaaaacaaaaaccccaaaaacuuuguaaggcugggcuucaa

SEQ ID NO: 536736 - RNA, 64 nt, Homo Sapiens
cagacaggacuuucuaugcaucaaggcuguuuuaccccaaaacuagucagcuacuucacacuug

SEQ ID NO: 536737 - RNA, 64 nt, Homo Sapiens
uucuucuaagccuguguguuauaauuuaccaguuccccaaaaugccauuuuuaacgccgaacug

SEQ ID NO: 536738 - RNA, 64 nt, Homo Sapiens
uaaauaaaauaaaaaauauuugucuccaccuuuuccccaaaagcaacagcaagacauauuuugu

SEQ ID NO: 536739 - RNA, 64 nt, Homo Sapiens
uccuauagcaagacauaguuucauuuuagaggacccccaaaaucccgugaauucucuggugaug

SEQ ID NO: 536740 - RNA, 64 nt, Homo Sapiens
auggggaaaacaauauguacuaccuuauacccuuccccaaaaacaaagggauuaaagaccuaaa

SEQ ID NO: 536741 - RNA, 64 nt, Homo Sapiens
uaucauggacucaagguguugcaagagguuucuuccccaaaauauucaugcuaauuuaaagauu

SEQ ID NO: 536742 - RNA, 64 nt, Homo Sapiens
auuucaauucuacuucauuagaagugugacuuucccccaaaaguaagauacauauacuuaaaua

SEQ ID NO: 536743 - RNA, 64 nt, Homo Sapiens
uuauaagcauugcagucagaaggaggcccaggauccccaaaauauucaucccuuaauguucuca

SEQ ID NO: 536744 - RNA, 64 nt, Homo Sapiens
uccuuuauagcuguuuauuuaauucuccaguuguccccaaaauaaauauaugauccauauucaa

SEQ ID NO: 536745 - RNA, 64 nt, Homo Sapiens
uguaauguguugcuucuacauacuuaauuuuuuuccccaaaauuuuuuaaaaauugcucuguga

SEQ ID NO: 536746 - RNA, 64 nt, Homo Sapiens
acacccaccgucgucaggguccggcaccucacucccccaaaaugggaggagcagcugugugucc

SEQ ID NO: 536747 - RNA, 64 nt, Homo Sapiens
cugauuucuuccauggauuauuuaaaguccacucccccaaaauaauuacaaaauuauguucuau

SEQ ID NO: 536748 - RNA, 64 nt, Homo Sapiens
gaugaucucaaguccuuuuuaaguuuuucucuuuccccaaaaguuauauauuauucuagcauca

SEQ ID NO: 536749 - RNA, 64 nt, Homo Sapiens
uauuuugucaucagauuacuuguggguauaccuaccccaaaauuguuuucucauucacagcauu

SEQ ID NO: 536750 - RNA, 64 nt, Homo Sapiens
uaaaaauauuauugguauuaaagaaauccauucaccccaaaacuuguuuuacaggauuacaauu

SEQ ID NO: 536751 - RNA, 64 nt, Homo Sapiens
acaaccuuuuccuuaaggucuuuuaccaccucccccccaaaaaaaucccccaaaacugauucag

SEQ ID NO: 536752 - RNA, 64 nt, Homo Sapiens
uaaggucuuuuaccaccucccccccaaaaaaaucccccaaaacugauucagauuuucauacuuu

SEQ ID NO: 536753 - RNA, 64 nt, Homo Sapiens
uauaucauauuuagaaaauaauaaugaaaagcauccccaaaauuucaaugaugugaauuuuuaa

SEQ ID NO: 536754 - RNA, 64 nt, Homo Sapiens
ggggugacagaugagguccucuguuuaccuccccccccaaaaaaaaaauucaguaggaauuccu

SEQ ID NO: 536755 - RNA, 64 nt, Homo Sapiens
cgagaagggggguucaggagaauccacuucuguuccccaaaaagaaaacccaccacaaacguag

SEQ ID NO: 536756 - RNA, 64 nt, Homo Sapiens
acaaaaaaagaaaaucuaucaucacccaccacccccccaaaaacgacagagagagagaaaaaaa

SEQ ID NO: 536757 - RNA, 64 nt, Homo Sapiens
ugguuggagagcugaacaggcccauuagaggggcccccaaaacuaagcaacuggggccaucccc

SEQ ID NO: 536758 - RNA, 57 nt, Homo Sapiens
ggcucaccccccagaacaccagggggaccccaaaacuaccgccuggucagggacuga

SEQ ID NO: 536759 - RNA, 64 nt, Homo Sapiens
ggcuccucuuuauggggcagauaucuauagccaaccccaaaacuucugucuucuaucauucugu

SEQ ID NO: 536760 - RNA, 64 nt, Homo Sapiens
gcagacagaauacauagccaccauugguaguacaccccaaaagcaaggauggcaugaugcuggu

SEQ ID NO: 536761 - RNA, 64 nt, Homo Sapiens
cacuaacaauuuuagcaaaacauacacuggccugccccaaaacccaacaaaaaaaaaaguuucc

SEQ ID NO: 536762 - RNA, 64 nt, Homo Sapiens
uucuucuaagccuuuauuguuccucacaaaguuuccccaaaaggugggcccucuggaauugugc

SEQ ID NO: 536763 - RNA, 64 nt, Homo Sapiens
gugagccaaacagcccugagaaaagcuggggaaacagucugagcuggaguccgagagugguugg

SEQ ID NO: 536764 - RNA, 64 nt, Homo Sapiens
ccccucacuuaggcaaagcauuauucauucccaucagucugaagcccgaaggacuguuuuguau

SEQ ID NO: 536765 - RNA, 64 nt, Homo Sapiens
gcuugcgacugcaucuguaucagccacugccacucagucugacaucacaucuccuggccgagag

SEQ ID NO: 536766 - RNA, 64 nt, Homo Sapiens
uagguuuuguuuguagugaauguggucaauauuucagucugacaccaacagcuuuggcuucugg

SEQ ID NO: 536767 - RNA, 64 nt, Homo Sapiens
gucuuuccuuuacaccuaugaagcccacguggaccagucugaauggguuccucugccugcuaac

SEQ ID NO: 536768 - RNA, 64 nt, Homo Sapiens
ugcagcucccuguccaagugaaacuccacuuguucagucugaaaaucccaucuaaaaacucuuc

SEQ ID NO: 536769 - RNA, 64 nt, Homo Sapiens
ggcauggagaccgggagauaaucuuggcaagguucagucugaauaggaugcgcugggacggccc

SEQ ID NO: 536770 - RNA, 64 nt, Homo Sapiens
gauuccccaccuccaaucccuggcgagaccagagcagucugaagaagcuguuuuuccguggauu

SEQ ID NO: 536771 - RNA, 64 nt, Homo Sapiens
cuccggggacccagacugccuucaucucugauggcagucugaucacuguggccacugugcgagc

SEQ ID NO: 536772 - RNA, 64 nt, Homo Sapiens
ucuuccugguuuccuagccguuccccuucugccccagucugagccagugagggguagcuuuuua

SEQ ID NO: 536773 - RNA, 64 nt, Homo Sapiens
cuggacaggggguuucuguugaacaguucagcuacagucugacuccugcuccauucuccagucu

SEQ ID NO: 536774 - RNA, 64 nt, Homo Sapiens
aguucagcuacagucugacuccugcuccauucuccagucugaacgaccaggggugcgcccacag

SEQ ID NO: 536775 - RNA, 64 nt, Homo Sapiens
uucauuuuuuggcacuaggucauuaaguagcacacagucugaaugcccuuuucuggaguggcca

SEQ ID NO: 536776 - RNA, 64 nt, Homo Sapiens
aucaucgcacugacuguggcgcacuggggaauaacagucugagcuagcaccacccucagccagg

SEQ ID NO: 536777 - RNA, 64 nt, Homo Sapiens
cuugccagcuagaaggagggucagggauuuuuuacagucugagaaugagugugugugagugagg

SEQ ID NO: 536778 - RNA, 64 nt, Homo Sapiens
caaagaaaacgcccucuccugacuuguauuguggcagucugaacgcccccagaaaauugugcca

SEQ ID NO: 536779 - RNA, 64 nt, Homo Sapiens
aagcuagagacucaggaaagacaguggcauaaugcagucugaguccaaaggccagguaaccuug

SEQ ID NO: 536780 - RNA, 64 nt, Homo Sapiens
cuuaggaacaaaguaaaguaggguaagggaaugccagucugaggaguuagaaguuaccguuuua

SEQ ID NO: 536781 - RNA, 64 nt, Homo Sapiens
gcuucugugauacuggccuugcugaaacgcaucucacugucauucuauuguuuauauuguuaaa

SEQ ID NO: 536782 - RNA, 64 nt, Homo Sapiens
aacuuacagaagacacaacuccuuccccagugaucacugucauaaccagugcucuaccguaucc

SEQ ID NO: 536783 - RNA, 64 nt, Homo Sapiens
cccacugcaccccccugugcccacugucagcccucacugucagugcuaaggccagcuagagcuu

SEQ ID NO: 536784 - RNA, 64 nt, Homo Sapiens
ccucacugucagucccacugccagcuagagcuuccacugucagcgguaugagcuggagcuaagg

SEQ ID NO: 536785 - RNA, 64 nt, Homo Sapiens
caccuauuuuuagauugggcccuggucagcaauucacugucaugcuuacucagaaaaaaaaaug

SEQ ID NO: 536786 - RNA, 64 nt, Homo Sapiens
cugccugguguucccccucacugcccuccgagcccacugucacgcgccgccgccgccucugucc

SEQ ID NO: 536787 - RNA, 64 nt, Homo Sapiens
gcgugucugguaccuuggauguucaaacagggaacacugucagggcugaggagaacagaagcuc

SEQ ID NO: 536788 - RNA, 64 nt, Homo Sapiens
uccacuaccccuaaccugccaggaugcucaaguccacugucacaaucccuuucagaaaacauua

SEQ ID NO: 536789 - RNA, 64 nt, Homo Sapiens
agcagcagggcacgccuggcuuuccuuggauacccacugucaccugcacuaugaagugcugcug

SEQ ID NO: 536790 - RNA, 64 nt, Homo Sapiens
ugcugcuggcugggcuugguggcucagaacaaggcacugucacugcccaccuccuugggccucc

SEQ ID NO: 536791 - RNA, 64 nt, Homo Sapiens
aucacagaaugcaagcuucuuuugugauuguaagcacugucauguuagaaagacccccaaaggc

SEQ ID NO: 536792 - RNA, 64 nt, Homo Sapiens
cacugaauagagaaacguguaguguuuuguagcucacugucacuccucaguuucaguucuuucc

SEQ ID NO: 536793 - RNA, 64 nt, Homo Sapiens
cuuuacaucagggauccaacuugaacacaacauacacugucaaacuuguuuagaacuguugauu

SEQ ID NO: 536794 - RNA, 64 nt, Homo Sapiens
uuuucuugacuggccaaaacgguucucccuuggccacugucagcuucuguaaauugaauauaga

SEQ ID NO: 536795 - RNA, 64 nt, Homo Sapiens
ggaaggacaugucaaucuugggcacauucuccaccacugucacaguaauggacagaguuaucaa

SEQ ID NO: 536796 - RNA, 64 nt, Homo Sapiens
ggaagaaccugccaagcuugggcacauacuucaccacugucacaguaauggacagaguuaucga

SEQ ID NO: 536797 - RNA, 64 nt, Homo Sapiens
ccggguggugacaaggagaaaagccuucuagggucacugucauucccuggccauguugcaaaca

SEQ ID NO: 536798 - RNA, 64 nt, Homo Sapiens
caaaaacaugucccuggagaguagccugcucccacacugucacuggaugucauggggccaauaa

SEQ ID NO: 536799 - RNA, 64 nt, Homo Sapiens
uaaaauauauauccaaaaauaugauauucuaaaacacugucaaaacagaaaucuuguuuacugu

SEQ ID NO: 536800 - RNA, 64 nt, Homo Sapiens
cgcauagauccacgaggcacuuuuaauuuauuuucacugucacauuagguuccgucucacggcg

SEQ ID NO: 536801 - RNA, 64 nt, Homo Sapiens
gaauucccaaauuucauuugaaauaugcuaacaucacugucauaucauuuugcauuuuacauuu

SEQ ID NO: 536802 - RNA, 64 nt, Homo Sapiens
aacuugagaucuuuuggccuuuauuuguuagauacacugucagaaaaaggagcaggccauaacu

SEQ ID NO: 536803 - RNA, 64 nt, Homo Sapiens
aaagccuggagaaguggggcuuuaaaaagcaggccacugucagcaagaaagucaggauaaaaau

SEQ ID NO: 536804 - RNA, 64 nt, Homo Sapiens
uaaaagcuggccacuaaauugaugaggugaagaucacugucaucaacggggguagacaggugca

SEQ ID NO: 536805 - RNA, 64 nt, Homo Sapiens
caagccagugucguuuuugcacugguuuccaccucacugucagauauuguucuuuugauaugca

SEQ ID NO: 536806 - RNA, 64 nt, Homo Sapiens
uucuguuugucgucuuguugauuugcugccuccacacugucagcuccuugggaacagagauugg

SEQ ID NO: 536807 - RNA, 64 nt, Homo Sapiens
uaaaagcaggccaccaaauugaugaggugaagaucacugucaucuagugagggagacaggugca

SEQ ID NO: 536808 - RNA, 64 nt, Homo Sapiens
aaagccuggagaaaugggacaucuaaaagccagccacugucagcgcaagaugaagguaacaauc

SEQ ID NO: 536809 - RNA, 64 nt, Homo Sapiens
acggagagaacaaagcccauucauccauuggauucacugucaguggagauacuaccucucgugg

SEQ ID NO: 536810 - RNA, 64 nt, Homo Sapiens
uucagcucaggcacagcaacuugcccaggacugacacugucacccugacugcaggaggcacagg

SEQ ID NO: 536811 - RNA, 64 nt, Homo Sapiens
gaaucaugucaggccugugugugaaaggaagcuccacugucacccuccaccucuucacccccca

SEQ ID NO: 536812 - RNA, 64 nt, Homo Sapiens
caccucuucaccccccacucaccaguguccccuccacugucacauuguaacugaacuucaggau

SEQ ID NO: 536813 - RNA, 64 nt, Homo Sapiens
gaugagcccacccccacccuggagagccgcaugucacugucagacuuggagucaggccucaggu

SEQ ID NO: 536814 - RNA, 64 nt, Homo Sapiens
acuuugagcccuccucgguuugacuggaaaccagcacugucagccccauuaggagaaggagaaa

SEQ ID NO: 536815 - RNA, 64 nt, Homo Sapiens
uuguuuuuguuuuuguuuuuuugagauggagucucacugucaccaggcuggagugcaguggugc

SEQ ID NO: 536816 - RNA, 64 nt, Homo Sapiens
augguuaccuguaaucuuaccaaucauagauaaucacugucaaacuuuuggagcaaauccuuua

SEQ ID NO: 536817 - RNA, 64 nt, Homo Sapiens
aacaggcaugccccuuagaagugaagggcagagacacugucacaacucacacacacccucaugu

SEQ ID NO: 536818 - RNA, 64 nt, Homo Sapiens
aacgagcaugacacccugcucacuugcuuggagacacugucaugcuuucucuuugcgcgcguca

SEQ ID NO: 536819 - RNA, 64 nt, Homo Sapiens
agccggcaggcacuggugagcaugcagucaaagccacugucacaacacgcuuaagacaccucug

SEQ ID NO: 536820 - RNA, 64 nt, Homo Sapiens
ugccgggguccauggugucauaugcagugacacacacugucaagcgccauuucccucaccccug

SEQ ID NO: 536821 - RNA, 64 nt, Homo Sapiens
cucuccacuguccccuuguggaccagcuuccacucacugucacguccccccuccugcgucuuca

SEQ ID NO: 536822 - RNA, 64 nt, Homo Sapiens
cccagcuuggagugccacgugcccacgucccgggcacugucauguggagugccacauggccgcu

SEQ ID NO: 536823 - RNA, 64 nt, Homo Sapiens
cccagcuuggagugccacaugcccacgucccgggcacugucauguggagugccacguggccgcu

SEQ ID NO: 536824 - RNA, 64 nt, Homo Sapiens
cugugggcugggccuguggugccugccgaguggucacugucagugggaaacccguuguuccucc

SEQ ID NO: 536825 - RNA, 64 nt, Homo Sapiens
gauucuaaagagagccugguuuguuaaaagaaaacacugucaugcugucaguucccaauugaca

SEQ ID NO: 536826 - RNA, 64 nt, Homo Sapiens
uucucugagaaccaaaagaugccuugaauauuuauucagugacuucuggcuuaugcucagaagc

SEQ ID NO: 536827 - RNA, 64 nt, Homo Sapiens
cugggggcauccugcuuccugaaagcuguuggauuucagugauuuuuccccccaccccccagca

SEQ ID NO: 536828 - RNA, 64 nt, Homo Sapiens
uggcucuuagagaaaucuggagaacuauaccugcuucagugaaauaauuacagaauauacuuag

SEQ ID NO: 536829 - RNA, 64 nt, Homo Sapiens
cagcuaauuggacuuuuauggcucuaucuuuuccuucagugaagaacccuauuuaaaacugggu

SEQ ID NO: 536830 - RNA, 64 nt, Homo Sapiens
uuagauaccugcagaaacccccaguccuguuauuuucagugauuuuccauuuaucuuuaauucg

SEQ ID NO: 536831 - RNA, 64 nt, Homo Sapiens
gaaaauggaaauaguauuucgcuguccugaaacuuucagugaaagagaucacccaacaucaaua

SEQ ID NO: 536832 - RNA, 64 nt, Homo Sapiens
acuuaguuaucagaaaucaguaugauaaauuauguucagugauaucaugaugccaguagccaua

SEQ ID NO: 536833 - RNA, 64 nt, Homo Sapiens
uugaccauugugcucuuggccuguuguaaaaaccuucagugaguacaauaccuccacugguuuc

SEQ ID NO: 536834 - RNA, 64 nt, Homo Sapiens
ucccucauucauucagcaaaucucuauugaguucuucagugagaaggagcaggcacugggccug

SEQ ID NO: 536835 - RNA, 64 nt, Homo Sapiens
uaaccuaaauauaccauugaugauucuucuuccauucagugacauccacagauuaugcagcuau

SEQ ID NO: 536836 - RNA, 64 nt, Homo Sapiens
cuguuaugcccacugugcucaauuugaagcagaauucagugaaaaauuauuuuuccacauugaa

SEQ ID NO: 536837 - RNA, 64 nt, Homo Sapiens
ucuuuucuacauuaagaaauauauucucaacauuuucagugagaauuucuuguaauggcaccuc

SEQ ID NO: 536838 - RNA, 64 nt, Homo Sapiens
agagaaaaaauucugaacugaauuuuauaacaguuucagugaauuaagaguuaucuuucaguga

SEQ ID NO: 536839 - RNA, 64 nt, Homo Sapiens
uuuuauaacaguuucagugauuuaagaguuaucuuucagugaaaacaggugucagaucagaauu

SEQ ID NO: 536840 - RNA, 64 nt, Homo Sapiens
gucaccuggccugguugugugcuuaaaagcaaguuucagugaaguaauaauuauguauguuaug

SEQ ID NO: 536841 - RNA, 58 nt, Homo Sapiens
uguuuuauagaauuuuauauuuuuuuaguucagugaccugacauaugaaaaaauguga

SEQ ID NO: 536842 - RNA, 64 nt, Homo Sapiens
agcauugaaugguuguuaggaaugaaaauacuaguucagugaucuauguuugucaggauaauca

SEQ ID NO: 536843 - RNA, 64 nt, Homo Sapiens
uaguuugguguguccucuuagaucauuuguacaguucagugaucuuguuuagauuaagaguaaa

SEQ ID NO: 536844 - RNA, 64 nt, Homo Sapiens
gcccaagcuggucaggagagccuaacaggauaaauucagugauaauguaguaggugcacauuug

SEQ ID NO: 536845 - RNA, 64 nt, Homo Sapiens
gauaaacaaaaaugaagcuaguuuaguucuguguuucagugacuaugaaaaacagguauauuug

SEQ ID NO: 536846 - RNA, 64 nt, Homo Sapiens
uugugguccuacuaacuacaggaaagcagauuucuucagugacuuauugccuugaaaguuaaaa

SEQ ID NO: 536847 - RNA, 64 nt, Homo Sapiens
gauguggguaguugagaacucuuuccagaugguguucagugaaacaugggcauucuguaugaac

SEQ ID NO: 536848 - RNA, 64 nt, Homo Sapiens
aaacauuaauugcuaacaauuguuagcaaacuauuucagugauaauguucauuuugaaaauaug

SEQ ID NO: 536849 - RNA, 64 nt, Homo Sapiens
uaaaauuucuugcugcagugcaacaggaggcuuuuucagugaucuucacuguauauguaaauua

SEQ ID NO: 536850 - RNA, 64 nt, Homo Sapiens
guaucaugguccagcaguacuguuuaaugggguauucagugacuaaggucugcuauuuaugcaa

SEQ ID NO: 536851 - RNA, 64 nt, Homo Sapiens
aaauucuguuuaucccguguuaccaaauuaccauuucagugagaagcuuuugaaaagucuucug

SEQ ID NO: 536852 - RNA, 64 nt, Homo Sapiens
uaaagcauauuuuauucuaucagcauauuuucuauucagugauaucuucuagaucugcuucacc

SEQ ID NO: 536853 - RNA, 64 nt, Homo Sapiens
uuuuuuguagcuggguuaaauauuuuaauuuaaguucagugaacauugcaaagauguuuacaag

SEQ ID NO: 536854 - RNA, 64 nt, Homo Sapiens
agcaaaaauacuaucaggugucauccugguggccuucagugagggcugaaccuguuuaucucug

SEQ ID NO: 536855 - RNA, 64 nt, Homo Sapiens
cagcagcagccgaugccgccaggaaggcaucagcuucagugagagcgcugccggaaccacaggg

SEQ ID NO: 536856 - RNA, 64 nt, Homo Sapiens
ucuuuuucaucaggggggauagucucuaggauuuuucagugaggacccuugggcuuuggaugca

SEQ ID NO: 536857 - RNA, 64 nt, Homo Sapiens
cagcuugaaccaagaaaacgaggagggaaagggauucagugaacuauuccucagugggaucggu

SEQ ID NO: 536858 - RNA, 64 nt, Homo Sapiens
augaaucaguguuaauucuaugguauuacagacauucagugacaauguaccucucuagucaaag

SEQ ID NO: 536859 - RNA, 64 nt, Homo Sapiens
aaacugugaaaggggcuuugaugaucaaugcuauuucagugagcucucucauuuccuucaaaua

SEQ ID NO: 536860 - RNA, 64 nt, Homo Sapiens
cuucucuuucuuguauaugaauauuggaaaauuuuucagugauucaaaaccuaugaguauauua

SEQ ID NO: 536861 - RNA, 64 nt, Homo Sapiens
ccucuguguuagggaaaauaaagaagagaaagccuucagugauggagaaacuugaaauauaaag

SEQ ID NO: 536862 - RNA, 64 nt, Homo Sapiens
gucaucccuuaagacgcacuaggucucagaaggcuucagugacacuaagggagaaaaccuguga

SEQ ID NO: 536863 - RNA, 64 nt, Homo Sapiens
aaaaaaaggggaaguuggggcauucagacaaauguucagugaggcauguucagugaggaaaaaa

SEQ ID NO: 536864 - RNA, 64 nt, Homo Sapiens
aaaaaacauucagacaaauggugaggaaaacauguucagugaggcagacaaauguucaguguga

SEQ ID NO: 536865 - RNA, 64 nt, Homo Sapiens
ccuuuuacuauagauucauguuuauucuuaaaucuucagugauuauugauaccucugauaauau

SEQ ID NO: 536866 - RNA, 64 nt, Homo Sapiens
aaaauacacaggguaauaaaucaccggggaacuuuucagugaugugacacuuuuauuuuauuag

SEQ ID NO: 536867 - RNA, 64 nt, Homo Sapiens; identical to SEQ ID NO: 226901

SEQ ID NO: 536868 - RNA, 64 nt, Homo Sapiens; identical to SEQ ID NO: 226902

SEQ ID NO: 536869 - RNA, 64 nt, Homo Sapiens; identical to SEQ ID NO: 226903

SEQ ID NO: 536870 - RNA, 64 nt, Homo Sapiens; identical to SEQ ID NO: 226904

SEQ ID NO: 536871 - RNA, 64 nt, Homo Sapiens; identical to SEQ ID NO: 226905

SEQ ID NO: 536872 - RNA, 64 nt, Homo Sapiens; identical to SEQ ID NO: 226906

SEQ ID NO: 536873 - RNA, 64 nt, Homo Sapiens; identical to SEQ ID NO: 226907

SEQ ID NO: 536874 - RNA, 64 nt, Homo Sapiens; identical to SEQ ID NO: 226908

SEQ ID NO: 536875 - RNA, 64 nt, Homo Sapiens; identical to SEQ ID NO: 226909

SEQ ID NO: 536876 - RNA, 64 nt, Homo Sapiens; identical to SEQ ID NO: 226910

SEQ ID NO: 536877 - RNA, 64 nt, Homo Sapiens; identical to SEQ ID NO: 226911

SEQ ID NO: 536878 - RNA, 64 nt, Homo Sapiens; identical to SEQ ID NO: 226912

SEQ ID NO: 536879 - RNA, 64 nt, Homo Sapiens
gcucauuguuugaagaaaaaccaaaacauuuuauggcuaguaauauuuauguaauuuuuaaaau

SEQ ID NO: 536880 - RNA, 64 nt, Homo Sapiens
augucaccucuaaaacacuuaaauugccaaauuuggcuaguaguuuuguuucaguggcauuagc

SEQ ID NO: 536881 - RNA, 64 nt, Homo Sapiens
ugcuuccggaaagcgcgguaggguucguagguagggcuaguagguaggguuaguagguagggcu

SEQ ID NO: 536882 - RNA, 64 nt, Homo Sapiens
guagguagggcuaguagguaggguuaguagguagggcuaguagguagggcuaguagguaggguu

SEQ ID NO: 536883 - RNA, 64 nt, Homo Sapiens
guagguaggguuaguagguagggcuaguagguagggcuaguagguaggguucguagguaggguu

SEQ ID NO: 536884 - RNA, 64 nt, Homo Sapiens
guagguagggcugguagguaggguuaguagguagggcuaguagguaggguuaguagguaggguu

SEQ ID NO: 536885 - RNA, 64 nt, Homo Sapiens
guagguaggguucguagguaggguucguagguagggcuaguagguaggguuaguagguaggguu

SEQ ID NO: 536886 - RNA, 64 nt, Homo Sapiens
guagguaggguucguagguaggguucguagguagggcuaguagguaggguuaguagguagggcu

SEQ ID NO: 536887 - RNA, 64 nt, Homo Sapiens; identical to SEQ ID NO: 536882

SEQ ID NO: 536888 - RNA, 64 nt, Homo Sapiens
guagguaggguuaguagguagggcuaguagguagggcuaguagguaggguuaguagguagggcu

SEQ ID NO: 536889 - RNA, 64 nt, Homo Sapiens
guagguagggcuaguagguaggguuaguagguagggcuaguagguaggguucguagguaggguu

SEQ ID NO: 536890 - RNA, 64 nt, Homo Sapiens
guagguaggguucguagguaggguuaguagguagggcuaguagguaggguucguagguaggguu

SEQ ID NO: 536891 - RNA, 64 nt, Homo Sapiens; identical to SEQ ID NO: 536886

SEQ ID NO: 536892 - RNA, 64 nt, Homo Sapiens; identical to SEQ ID NO: 536882

SEQ ID NO: 536893 - RNA, 64 nt, Homo Sapiens; identical to SEQ ID NO: 536883

SEQ ID NO: 536894 - RNA, 64 nt, Homo Sapiens
guagguaggguuaguagguaggguucguagguagggcuaguagguagggcuaguagguagggcu

SEQ ID NO: 536895 - RNA, 64 nt, Homo Sapiens
guagguaggguucguagguagggcuaguagguagggcuaguagguagggcuaguagguaggguu

SEQ ID NO: 536896 - RNA, 64 nt, Homo Sapiens
guagguagggcuaguagguagggcuaguagguagggcuaguagguaggguuaguagguagggcu

SEQ ID NO: 536897 - RNA, 64 nt, Homo Sapiens
guagguagggcuaguagguaggguuaguagguagggcuaguagguagggcuaguagguagggcu

SEQ ID NO: 536898 - RNA, 64 nt, Homo Sapiens
guagguaggguuaguagguagggcuaguagguagggcuaguagguagggcuaguagguagggcu

SEQ ID NO: 536899 - RNA, 64 nt, Homo Sapiens
guagguagggcuaguagguagggcuaguagguagggcuaguagguagggcuaguagguaggguu

SEQ ID NO: 536900 - RNA, 64 nt, Homo Sapiens
guagguagggcuaguagguagggcuaguagguagggcuaguagguaggguucguagguaggguu

SEQ ID NO: 536901 - RNA, 64 nt, Homo Sapiens
guuaagucuuuccucuaccuacauuuguuuucuuggcuaguaauaguaguagauacuucugaaa

SEQ ID NO: 536902 - RNA, 64 nt, Homo Sapiens
uuuccugauuacacagguguugaauggggaaaggggcuaguauaucaguaggauauacuauggg

SEQ ID NO: 536903 - RNA, 64 nt, Homo Sapiens; identical to SEQ ID NO: 223145

SEQ ID NO: 536904 - RNA, 64 nt, Homo Sapiens; identical to SEQ ID NO: 223146

SEQ ID NO: 536905 - RNA, 64 nt, Homo Sapiens; identical to SEQ ID NO: 223147

SEQ ID NO: 536906 - RNA, 64 nt, Homo Sapiens; identical to SEQ ID NO: 223148

SEQ ID NO: 536907 - RNA, 64 nt, Homo Sapiens; identical to SEQ ID NO: 223149

SEQ ID NO: 536908 - RNA, 64 nt, Homo Sapiens; identical to SEQ ID NO: 223150

SEQ ID NO: 536909 - RNA, 64 nt, Homo Sapiens; identical to SEQ ID NO: 223151

SEQ ID NO: 536910 - RNA, 64 nt, Homo Sapiens; identical to SEQ ID NO: 223152

SEQ ID NO: 536911 - RNA, 64 nt, Homo Sapiens; identical to SEQ ID NO: 223153

SEQ ID NO: 536912 - RNA, 64 nt, Homo Sapiens; identical to SEQ ID NO: 223154

SEQ ID NO: 536913 - RNA, 64 nt, Homo Sapiens; identical to SEQ ID NO: 223155

SEQ ID NO: 536914 - RNA, 64 nt, Homo Sapiens; identical to SEQ ID NO: 223156

SEQ ID NO: 536915 - RNA, 64 nt, Homo Sapiens; identical to SEQ ID NO: 223157

SEQ ID NO: 536916 - RNA, 64 nt, Homo Sapiens; identical to SEQ ID NO: 223158

SEQ ID NO: 536917 - RNA, 64 nt, Homo Sapiens; identical to SEQ ID NO: 223159

SEQ ID NO: 536918 - RNA, 64 nt, Homo Sapiens; identical to SEQ ID NO: 223160

SEQ ID NO: 536919 - RNA, 64 nt, Homo Sapiens; identical to SEQ ID NO: 223161

SEQ ID NO: 536920 - RNA, 64 nt, Homo Sapiens; identical to SEQ ID NO: 223162

SEQ ID NO: 536921 - RNA, 64 nt, Homo Sapiens; identical to SEQ ID NO: 223163

SEQ ID NO: 536922 - RNA, 64 nt, Homo Sapiens; identical to SEQ ID NO: 223164

SEQ ID NO: 536923 - RNA, 64 nt, Homo Sapiens; identical to SEQ ID NO: 223165

SEQ ID NO: 536924 - RNA, 64 nt, Homo Sapiens; identical to SEQ ID NO: 223166

SEQ ID NO: 536925 - RNA, 64 nt, Homo Sapiens; identical to SEQ ID NO: 223167

SEQ ID NO: 536926 - RNA, 64 nt, Homo Sapiens; identical to SEQ ID NO: 223168

SEQ ID NO: 536927 - RNA, 64 nt, Homo Sapiens; identical to SEQ ID NO: 223169

SEQ ID NO: 536928 - RNA, 64 nt, Homo Sapiens; identical to SEQ ID NO: 223170

SEQ ID NO: 536929 - RNA, 64 nt, Homo Sapiens; identical to SEQ ID NO: 223171

SEQ ID NO: 536930 - RNA, 64 nt, Homo Sapiens; identical to SEQ ID NO: 223172

SEQ ID NO: 536931 - RNA, 64 nt, Homo Sapiens; identical to SEQ ID NO: 223173

SEQ ID NO: 536932 - RNA, 64 nt, Homo Sapiens; identical to SEQ ID NO: 223174

SEQ ID NO: 536933 - RNA, 64 nt, Homo Sapiens; identical to SEQ ID NO: 223175

SEQ ID NO: 536934 - RNA, 64 nt, Homo Sapiens; identical to SEQ ID NO: 223176

SEQ ID NO: 536935 - RNA, 64 nt, Homo Sapiens; identical to SEQ ID NO: 223177

SEQ ID NO: 536936 - RNA, 64 nt, Homo Sapiens; identical to SEQ ID NO: 223178

SEQ ID NO: 536937 - RNA, 64 nt, Homo Sapiens; identical to SEQ ID NO: 223179

SEQ ID NO: 536938 - RNA, 64 nt, Homo Sapiens; identical to SEQ ID NO: 223180

SEQ ID NO: 536939 - RNA, 64 nt, Homo Sapiens; identical to SEQ ID NO: 223181

SEQ ID NO: 536940 - RNA, 64 nt, Homo Sapiens; identical to SEQ ID NO: 223182

SEQ ID NO: 536941 - RNA, 64 nt, Homo Sapiens; identical to SEQ ID NO: 223183

SEQ ID NO: 536942 - RNA, 64 nt, Homo Sapiens; identical to SEQ ID NO: 223184

SEQ ID NO: 536943 - RNA, 64 nt, Homo Sapiens; identical to SEQ ID NO: 223185

SEQ ID NO: 536944 - RNA, 64 nt, Homo Sapiens; identical to SEQ ID NO: 223186

SEQ ID NO: 536945 - RNA, 64 nt, Homo Sapiens; identical to SEQ ID NO: 223187

SEQ ID NO: 536946 - RNA, 64 nt, Homo Sapiens; identical to SEQ ID NO: 223188

SEQ ID NO: 536947 - RNA, 64 nt, Homo Sapiens; identical to SEQ ID NO: 223189

SEQ ID NO: 536948 - RNA, 64 nt, Homo Sapiens; identical to SEQ ID NO: 223190

SEQ ID NO: 536949 - RNA, 64 nt, Homo Sapiens; identical to SEQ ID NO: 223191

SEQ ID NO: 536950 - RNA, 64 nt, Homo Sapiens; identical to SEQ ID NO: 223192

SEQ ID NO: 536951 - RNA, 64 nt, Homo Sapiens; identical to SEQ ID NO: 223193

SEQ ID NO: 536952 - RNA, 64 nt, Homo Sapiens; identical to SEQ ID NO: 223194

SEQ ID NO: 536953 - RNA, 64 nt, Homo Sapiens; identical to SEQ ID NO: 223195

SEQ ID NO: 536954 - RNA, 57 nt, Homo Sapiens; identical to SEQ ID NO: 223196

SEQ ID NO: 536955 - RNA, 64 nt, Homo Sapiens; identical to SEQ ID NO: 223197

SEQ ID NO: 536956 - RNA, 54 nt, Homo Sapiens; identical to SEQ ID NO: 223198

SEQ ID NO: 536957 - RNA, 64 nt, Homo Sapiens; identical to SEQ ID NO: 53836

SEQ ID NO: 536958 - RNA, 64 nt, Homo Sapiens; identical to SEQ ID NO: 53837

SEQ ID NO: 536959 - RNA, 64 nt, Homo Sapiens; identical to SEQ ID NO: 53838

SEQ ID NO: 536960 - RNA, 64 nt, Homo Sapiens; identical to SEQ ID NO: 53839

SEQ ID NO: 536961 - RNA, 64 nt, Homo Sapiens; identical to SEQ ID NO: 53840

SEQ ID NO: 536962 - RNA, 64 nt, Homo Sapiens; identical to SEQ ID NO: 53841

SEQ ID NO: 536963 - RNA, 64 nt, Homo Sapiens; identical to SEQ ID NO: 99500

SEQ ID NO: 536964 - RNA, 64 nt, Homo Sapiens; identical to SEQ ID NO: 99501

SEQ ID NO: 536965 - RNA, 64 nt, Homo Sapiens; identical to SEQ ID NO: 99502

SEQ ID NO: 536966 - RNA, 64 nt, Homo Sapiens; identical to SEQ ID NO: 99503

SEQ ID NO: 536967 - RNA, 64 nt, Homo Sapiens; identical to SEQ ID NO: 99504

SEQ ID NO: 536968 - RNA, 64 nt, Homo Sapiens; identical to SEQ ID NO: 99505

SEQ ID NO: 536969 - RNA, 64 nt, Homo Sapiens; identical to SEQ ID NO: 99506

SEQ ID NO: 536970 - RNA, 64 nt, Homo Sapiens; identical to SEQ ID NO: 99507

SEQ ID NO: 536971 - RNA, 64 nt, Homo Sapiens; identical to SEQ ID NO: 99508

SEQ ID NO: 536972 - RNA, 64 nt, Homo Sapiens; identical to SEQ ID NO: 99509

SEQ ID NO: 536973 - RNA, 64 nt, Homo Sapiens; identical to SEQ ID NO: 99510

SEQ ID NO: 536974 - RNA, 64 nt, Homo Sapiens; identical to SEQ ID NO: 99511

SEQ ID NO: 536975 - RNA, 64 nt, Homo Sapiens; identical to SEQ ID NO: 99512

SEQ ID NO: 536976 - RNA, 64 nt, Homo Sapiens; identical to SEQ ID NO: 99513

SEQ ID NO: 536977 - RNA, 64 nt, Homo Sapiens; identical to SEQ ID NO: 99514

SEQ ID NO: 536978 - RNA, 64 nt, Homo Sapiens; identical to SEQ ID NO: 99515

SEQ ID NO: 536979 - RNA, 64 nt, Homo Sapiens; identical to SEQ ID NO: 99516

SEQ ID NO: 536980 - RNA, 64 nt, Homo Sapiens; identical to SEQ ID NO: 99517

SEQ ID NO: 536981 - RNA, 64 nt, Homo Sapiens; identical to SEQ ID NO: 99518

SEQ ID NO: 536982 - RNA, 64 nt, Homo Sapiens; identical to SEQ ID NO: 99519

SEQ ID NO: 536983 - RNA, 64 nt, Homo Sapiens; identical to SEQ ID NO: 99508

SEQ ID NO: 536984 - RNA, 64 nt, Homo Sapiens; identical to SEQ ID NO: 99521

SEQ ID NO: 536985 - RNA, 64 nt, Homo Sapiens; identical to SEQ ID NO: 99522

SEQ ID NO: 536986 - RNA, 64 nt, Homo Sapiens; identical to SEQ ID NO: 99523

SEQ ID NO: 536987 - RNA, 64 nt, Homo Sapiens; identical to SEQ ID NO: 99524

SEQ ID NO: 536988 - RNA, 64 nt, Homo Sapiens; identical to SEQ ID NO: 99525

SEQ ID NO: 536989 - RNA, 64 nt, Homo Sapiens; identical to SEQ ID NO: 99526

SEQ ID NO: 536990 - RNA, 64 nt, Homo Sapiens; identical to SEQ ID NO: 99527

SEQ ID NO: 536991 - RNA, 64 nt, Homo Sapiens; identical to SEQ ID NO: 99528

SEQ ID NO: 536992 - RNA, 64 nt, Homo Sapiens; identical to SEQ ID NO: 99529

SEQ ID NO: 536993 - RNA, 64 nt, Homo Sapiens; identical to SEQ ID NO: 99530

SEQ ID NO: 536994 - RNA, 64 nt, Homo Sapiens; identical to SEQ ID NO: 99531

SEQ ID NO: 536995 - RNA, 64 nt, Homo Sapiens; identical to SEQ ID NO: 99532

SEQ ID NO: 536996 - RNA, 64 nt, Homo Sapiens; identical to SEQ ID NO: 99533

SEQ ID NO: 536997 - RNA, 64 nt, Homo Sapiens; identical to SEQ ID NO: 99534

SEQ ID NO: 536998 - RNA, 64 nt, Homo Sapiens; identical to SEQ ID NO: 99535

SEQ ID NO: 536999 - RNA, 64 nt, Homo Sapiens; identical to SEQ ID NO: 99536

SEQ ID NO: 537000 - RNA, 64 nt, Homo Sapiens; identical to SEQ ID NO: 99537

SEQ ID NO: 537001 - RNA, 64 nt, Homo Sapiens; identical to SEQ ID NO: 99538

SEQ ID NO: 537002 - RNA, 64 nt, Homo Sapiens; identical to SEQ ID NO: 99539

SEQ ID NO: 537003 - RNA, 64 nt, Homo Sapiens; identical to SEQ ID NO: 99540

SEQ ID NO: 537004 - RNA, 64 nt, Homo Sapiens; identical to SEQ ID NO: 99541

SEQ ID NO: 537005 - RNA, 64 nt, Homo Sapiens; identical to SEQ ID NO: 99542

SEQ ID NO: 537006 - RNA, 64 nt, Homo Sapiens; identical to SEQ ID NO: 99543

SEQ ID NO: 537007 - RNA, 64 nt, Homo Sapiens; identical to SEQ ID NO: 99544

SEQ ID NO: 537008 - RNA, 64 nt, Homo Sapiens; identical to SEQ ID NO: 99545

SEQ ID NO: 537009 - RNA, 64 nt, Homo Sapiens; identical to SEQ ID NO: 99546

SEQ ID NO: 537010 - RNA, 64 nt, Homo Sapiens; identical to SEQ ID NO: 99547

SEQ ID NO: 537011 - RNA, 64 nt, Homo Sapiens; identical to SEQ ID NO: 99548

SEQ ID NO: 537012 - RNA, 64 nt, Homo Sapiens; identical to SEQ ID NO: 99549

SEQ ID NO: 537013 - RNA, 64 nt, Homo Sapiens; identical to SEQ ID NO: 99550

SEQ ID NO: 537014 - RNA, 64 nt, Homo Sapiens; identical to SEQ ID NO: 99551

SEQ ID NO: 537015 - RNA, 64 nt, Homo Sapiens; identical to SEQ ID NO: 99552

SEQ ID NO: 537016 - RNA, 64 nt, Homo Sapiens; identical to SEQ ID NO: 99553

SEQ ID NO: 537017 - RNA, 64 nt, Homo Sapiens; identical to SEQ ID NO: 99554

SEQ ID NO: 537018 - RNA, 64 nt, Homo Sapiens; identical to SEQ ID NO: 99555

SEQ ID NO: 537019 - RNA, 64 nt, Homo Sapiens; identical to SEQ ID NO: 99556

SEQ ID NO: 537020 - RNA, 64 nt, Homo Sapiens; identical to SEQ ID NO: 99557

SEQ ID NO: 537021 - RNA, 64 nt, Homo Sapiens; identical to SEQ ID NO: 99558

SEQ ID NO: 537022 - RNA, 64 nt, Homo Sapiens
acgacuacucgcugcacgggggcugccuggucacgcgcggcaccaaguggauugccaacaacug

SEQ ID NO: 537023 - RNA, 64 nt, Homo Sapiens
ugccaacaacuggauuaauguggaccccagccgagcgcggcaagcgcuguuccaacaggagaug

SEQ ID NO: 537024 - RNA, 64 nt, Homo Sapiens
ucaaauuguuugcuuuugcuucuucaauuuagcucagugguaggucuaaaaugcagguuuuucu

SEQ ID NO: 537025 - RNA, 64 nt, Homo Sapiens
aucuuggcucacugcaaccucucaggcuggagugcagugguacgugagaugaagucucacugca

SEQ ID NO: 537026 - RNA, 64 nt, Homo Sapiens
aauuguuagaauggaaaaauuccuucugaucuagcagugguaaccccugcuguugcugccacug

SEQ ID NO: 537027 - RNA, 64 nt, Homo Sapiens
uaaacaugguaauuuugauacaguuauacuuuuacagugguacauaauccaaggacuaguauag

SEQ ID NO: 537028 - RNA, 63 nt, Homo Sapiens
auuaagcucuguugucaugaacaacuggaauguaaaccacaguauuuuggagugcagaacauu

SEQ ID NO: 537029 - RNA, 63 nt, Homo Sapiens
gguguuguaaagagcugcuaguagguucgcuuuaaaccacaugagcuuaaccaagaauauguu

SEQ ID NO: 537030 - RNA, 63 nt, Homo Sapiens
aagcaauuuaaucaauugcaaagcaauuauauaaaaccacaaagaauguacugaaccuacuaa

SEQ ID NO: 537031 - RNA, 63 nt, Homo Sapiens
aaagugguuuuuuaaaauuacauaacuaaaaauaaaccacacuguggauacaucuuauaaaac

SEQ ID NO: 537032 - RNA, 63 nt, Homo Sapiens
aagaauauuccauuuuccuuuccuugugguugaaaaccacagucaguggagagauguuuggaa

SEQ ID NO: 537033 - RNA, 63 nt, Homo Sapiens
guugaaaaccacagucaguggagagauguuuggaaaccacagucaguggagccugggugguac

SEQ ID NO: 537034 - RNA, 63 nt, Homo Sapiens
uaguaccaaacuccauucaucuaguagauucgcaaaccacagacaguauauguucuaagaccc

SEQ ID NO: 537035 - RNA, 63 nt, Homo Sapiens
auccuugaucagagaagggggugaauaucaucaaaaccacagcaccaagcucucccuuaucaa

SEQ ID NO: 537036 - RNA, 63 nt, Homo Sapiens
ugacagcccacuugucaaauauguaauucaccgaaaccacaccaaguccugcuacuguagagu

SEQ ID NO: 537037 - RNA, 63 nt, Homo Sapiens
cucugaaauguggcuagguguagaaugauguugaaaccacaggcuaaaauguagaucuggaag

SEQ ID NO: 537038 - RNA, 63 nt, Homo Sapiens
cugcagaaguggcuccuuuucauaaacuccccuaaaccacacacaggagagagcgacgggccu

SEQ ID NO: 537039 - RNA, 63 nt, Homo Sapiens
aaauaaauaagaauaacucagaaacucaaaaggaaaccacaaauucagcuaauaauagcauuu

SEQ ID NO: 537040 - RNA, 63 nt, Homo Sapiens
uugccaggcaggcaccugggcuuucuggaauccaaaccacagucuuaggggcuugguaguuug

SEQ ID NO: 537041 - RNA, 63 nt, Homo Sapiens
cugguugugauuuauauuuuaaagcuuggugcuaaaccacaauauguauagcauauggagugc

SEQ ID NO: 537042 - RNA, 63 nt, Homo Sapiens
auugaaucucuuaugccaguuuucauaaaacccaaaccacauaugaaaaaauccauuaagggu

SEQ ID NO: 537043 - RNA, 63 nt, Homo Sapiens
ccaguuguugagggguauacuagaagcagaaugaaaccacauuuuuugguuugauaauaugca

SEQ ID NO: 537044 - RNA, 63 nt, Homo Sapiens
uccauuccaggaccuucauuugcauaagguaucaaaccacaucagccucugauuggccauggg

SEQ ID NO: 537045 - RNA, 63 nt, Homo Sapiens
uucauuccaggacauucauuugcauaaggagucaaaccacaccagucuuggauuggcugugag

SEQ ID NO: 537046 - RNA, 63 nt, Homo Sapiens
ggacagauccugucauuguuuaagcugagcaaaaaaccacacaaaaguuguguaagagaugag

SEQ ID NO: 537047 - RNA, 63 nt, Homo Sapiens
aagagggaacuuucuggaguuuuugagaaugccaaaccacauuuuuaucacacuucuuuggaa

SEQ ID NO: 537048 - RNA, 63 nt, Homo Sapiens
uuuucauuucuagugcuucgaaaagagcacuauaaaccacaugaaauaaggaaauaggggaaa

SEQ ID NO: 537049 - RNA, 63 nt, Homo Sapiens
ucaugacuuuuugacugugcauaauuaaaaagaaaaccacagagugugaucacaagacuaaag

SEQ ID NO: 537050 - RNA, 63 nt, Homo Sapiens
aauuuaaauggagccuuucaacacuugaccaaaaaaccacauuauuauuacaaaacaaaauga

SEQ ID NO: 537051 - RNA, 63 nt, Homo Sapiens
uuauagaauccacccaagaaaaagguuuuauucaaaccacaaauaauacuaauggaauguuuc

SEQ ID NO: 537052 - RNA, 63 nt, Homo Sapiens
ugauagagauucaaaagacuuguugaauaaaaaaaaccacauuguagaaaagugcuugucagu

SEQ ID NO: 537053 - RNA, 63 nt, Homo Sapiens
aucaacaccaacaaguuucugguugacaggaagaaaccacaccugcuucccucccaucagucu

SEQ ID NO: 537054 - RNA, 63 nt, Homo Sapiens
aacaauuucucuggagacaauuuugucuuugggaaaccacaggauuguuuaaaaccaucacuu

SEQ ID NO: 537055 - RNA, 63 nt, Homo Sapiens
caguaaauguuuauuaauaguguucaguccaacaaaccacacaagaaauacacguaugguuaa

SEQ ID NO: 537056 - RNA, 63 nt, Homo Sapiens
acuuccugggaccuuuuguaugaaugaaucaacaaaccacaauuugucauuugggcuuucugu

SEQ ID NO: 537057 - RNA, 63 nt, Homo Sapiens
guacuuuuuuuuacuuuggcuuuuggacuauguaaaccacauucgaaggcauuuuccacuagu

SEQ ID NO: 537058 - RNA, 63 nt, Homo Sapiens
uuuugugcccauuguuuuaauaugcuuuuguugaaaccacagcagcacaacauuaugauuuaa

SEQ ID NO: 537059 - RNA, 63 nt, Homo Sapiens
acauacuucuuuucuuucauuggacacgcaaagaaaccacagcagauguuguuuucagguuaa

SEQ ID NO: 537060 - RNA, 64 nt, Homo Sapiens
aaaacauuaaccaaaagauuuuuuauuuuuguaucugugguaacuuugagagaaauuauucaga

SEQ ID NO: 537061 - RNA, 64 nt, Homo Sapiens
ggccagcagaagacauggccccgccacgaucuuucugugguagcgcggacgccggcuguucuuc

SEQ ID NO: 537062 - RNA, 64 nt, Homo Sapiens
uaggcaccugcuguucuuucaggaaacagcuuggcugugguaaugcucuacugggcccuucaga

SEQ ID NO: 537063 - RNA, 64 nt, Homo Sapiens
agaaggugagagacaaaaauggaaagauccuggccugugguagugguagcaguuuucucaaaua

SEQ ID NO: 537064 - RNA, 64 nt, Homo Sapiens
ggacagacuucaauuugccauuuugagauuugaccugugguagcaucugggccuaauguuggcu

SEQ ID NO: 537065 - RNA, 64 nt, Homo Sapiens
gauagagaucccaacuugaaacaacagccagugccugugguaacuuaaugucuugucaaauacu

SEQ ID NO: 537066 - RNA, 64 nt, Homo Sapiens
ccaggcccuaauaauagaaguuguaccaaaaugccugugguacuugauggccuguuggucaaau

SEQ ID NO: 537067 - RNA, 64 nt, Homo Sapiens
cuaccuaagucagucacuuugcuaaauucuucaccugugguaacucauuuugauuguuauaaca

SEQ ID NO: 537068 - RNA, 64 nt, Homo Sapiens; identical to SEQ ID NO: 194985

SEQ ID NO: 537069 - RNA, 64 nt, Homo Sapiens; identical to SEQ ID NO: 194986

SEQ ID NO: 537070 - RNA, 64 nt, Homo Sapiens; identical to SEQ ID NO: 194987

SEQ ID NO: 537071 - RNA, 64 nt, Homo Sapiens; identical to SEQ ID NO: 194988

SEQ ID NO: 537072 - RNA, 64 nt, Homo Sapiens; identical to SEQ ID NO: 194989

SEQ ID NO: 537073 - RNA, 64 nt, Homo Sapiens; identical to SEQ ID NO: 194990

SEQ ID NO: 537074 - RNA, 64 nt, Homo Sapiens; identical to SEQ ID NO: 194991

SEQ ID NO: 537075 - RNA, 64 nt, Homo Sapiens; identical to SEQ ID NO: 194992

SEQ ID NO: 537076 - RNA, 64 nt, Homo Sapiens; identical to SEQ ID NO: 194993

SEQ ID NO: 537077 - RNA, 64 nt, Homo Sapiens; identical to SEQ ID NO: 194994

SEQ ID NO: 537078 - RNA, 64 nt, Homo Sapiens; identical to SEQ ID NO: 194995

SEQ ID NO: 537079 - RNA, 64 nt, Homo Sapiens; identical to SEQ ID NO: 194996

SEQ ID NO: 537080 - RNA, 64 nt, Homo Sapiens; identical to SEQ ID NO: 194997

SEQ ID NO: 537081 - RNA, 64 nt, Homo Sapiens; identical to SEQ ID NO: 194998

SEQ ID NO: 537082 - RNA, 64 nt, Homo Sapiens; identical to SEQ ID NO: 194999

SEQ ID NO: 537083 - RNA, 64 nt, Homo Sapiens; identical to SEQ ID NO: 195000

SEQ ID NO: 537084 - RNA, 64 nt, Homo Sapiens; identical to SEQ ID NO: 195001

SEQ ID NO: 537085 - RNA, 64 nt, Homo Sapiens; identical to SEQ ID NO: 195002

SEQ ID NO: 537086 - RNA, 64 nt, Homo Sapiens; identical to SEQ ID NO: 195003

SEQ ID NO: 537087 - RNA, 64 nt, Homo Sapiens; identical to SEQ ID NO: 195004

SEQ ID NO: 537088 - RNA, 64 nt, Homo Sapiens; identical to SEQ ID NO: 195005

SEQ ID NO: 537089 - RNA, 64 nt, Homo Sapiens; identical to SEQ ID NO: 195006

SEQ ID NO: 537090 - RNA, 64 nt, Homo Sapiens; identical to SEQ ID NO: 195007

SEQ ID NO: 537091 - RNA, 64 nt, Homo Sapiens; identical to SEQ ID NO: 195008

SEQ ID NO: 537092 - RNA, 64 nt, Homo Sapiens; identical to SEQ ID NO: 195009

SEQ ID NO: 537093 - RNA, 64 nt, Homo Sapiens; identical to SEQ ID NO: 195010

SEQ ID NO: 537094 - RNA, 64 nt, Homo Sapiens; identical to SEQ ID NO: 195011

SEQ ID NO: 537095 - RNA, 64 nt, Homo Sapiens; identical to SEQ ID NO: 195012

SEQ ID NO: 537096 - RNA, 64 nt, Homo Sapiens; identical to SEQ ID NO: 195013

SEQ ID NO: 537097 - RNA, 64 nt, Homo Sapiens; identical to SEQ ID NO: 195014

SEQ ID NO: 537098 - RNA, 64 nt, Homo Sapiens; identical to SEQ ID NO: 195015

SEQ ID NO: 537099 - RNA, 64 nt, Homo Sapiens; identical to SEQ ID NO: 195016

SEQ ID NO: 537100 - RNA, 64 nt, Homo Sapiens; identical to SEQ ID NO: 195017

SEQ ID NO: 537101 - RNA, 64 nt, Homo Sapiens; identical to SEQ ID NO: 195018

SEQ ID NO: 537102 - RNA, 64 nt, Homo Sapiens; identical to SEQ ID NO: 195019

SEQ ID NO: 537103 - RNA, 64 nt, Homo Sapiens; identical to SEQ ID NO: 195020

SEQ ID NO: 537104 - RNA, 64 nt, Homo Sapiens; identical to SEQ ID NO: 195021

SEQ ID NO: 537105 - RNA, 64 nt, Homo Sapiens; identical to SEQ ID NO: 195022

SEQ ID NO: 537106 - RNA, 64 nt, Homo Sapiens; identical to SEQ ID NO: 195023

SEQ ID NO: 537107 - RNA, 64 nt, Homo Sapiens; identical to SEQ ID NO: 195024

SEQ ID NO: 537108 - RNA, 64 nt, Homo Sapiens; identical to SEQ ID NO: 195025

SEQ ID NO: 537109 - RNA, 64 nt, Homo Sapiens; identical to SEQ ID NO: 195026

SEQ ID NO: 537110 - RNA, 64 nt, Homo Sapiens; identical to SEQ ID NO: 166184

SEQ ID NO: 537111 - RNA, 64 nt, Homo Sapiens; identical to SEQ ID NO: 166185

SEQ ID NO: 537112 - RNA, 64 nt, Homo Sapiens; identical to SEQ ID NO: 166186

SEQ ID NO: 537113 - RNA, 64 nt, Homo Sapiens; identical to SEQ ID NO: 166187

SEQ ID NO: 537114 - RNA, 64 nt, Homo Sapiens; identical to SEQ ID NO: 166188

SEQ ID NO: 537115 - RNA, 64 nt, Homo Sapiens; identical to SEQ ID NO: 166189

SEQ ID NO: 537116 - RNA, 64 nt, Homo Sapiens; identical to SEQ ID NO: 166190

SEQ ID NO: 537117 - RNA, 64 nt, Homo Sapiens; identical to SEQ ID NO: 166191

SEQ ID NO: 537118 - RNA, 64 nt, Homo Sapiens; identical to SEQ ID NO: 166192

SEQ ID NO: 537119 - RNA, 64 nt, Homo Sapiens; identical to SEQ ID NO: 166193

SEQ ID NO: 537120 - RNA, 64 nt, Homo Sapiens; identical to SEQ ID NO: 166194

SEQ ID NO: 537121 - RNA, 64 nt, Homo Sapiens; identical to SEQ ID NO: 166195

SEQ ID NO: 537122 - RNA, 64 nt, Homo Sapiens; identical to SEQ ID NO: 166196

SEQ ID NO: 537123 - RNA, 64 nt, Homo Sapiens; identical to SEQ ID NO: 166197

SEQ ID NO: 537124 - RNA, 64 nt, Homo Sapiens; identical to SEQ ID NO: 166198

SEQ ID NO: 537125 - RNA, 64 nt, Homo Sapiens; identical to SEQ ID NO: 166199

SEQ ID NO: 537126 - RNA, 64 nt, Homo Sapiens; identical to SEQ ID NO: 166200

SEQ ID NO: 537127 - RNA, 64 nt, Homo Sapiens; identical to SEQ ID NO: 166201

SEQ ID NO: 537128 - RNA, 64 nt, Homo Sapiens; identical to SEQ ID NO: 166202

SEQ ID NO: 537129 - RNA, 64 nt, Homo Sapiens; identical to SEQ ID NO: 166203

SEQ ID NO: 537130 - RNA, 64 nt, Homo Sapiens; identical to SEQ ID NO: 166204

SEQ ID NO: 537131 - RNA, 64 nt, Homo Sapiens; identical to SEQ ID NO: 166205

SEQ ID NO: 537132 - RNA, 64 nt, Homo Sapiens; identical to SEQ ID NO: 166206

SEQ ID NO: 537133 - RNA, 64 nt, Homo Sapiens; identical to SEQ ID NO: 166207

SEQ ID NO: 537134 - RNA, 64 nt, Homo Sapiens; identical to SEQ ID NO: 166208

SEQ ID NO: 537135 - RNA, 64 nt, Homo Sapiens; identical to SEQ ID NO: 166209

SEQ ID NO: 537136 - RNA, 64 nt, Homo Sapiens; identical to SEQ ID NO: 166210

SEQ ID NO: 537137 - RNA, 64 nt, Homo Sapiens; identical to SEQ ID NO: 166211

SEQ ID NO: 537138 - RNA, 64 nt, Homo Sapiens; identical to SEQ ID NO: 166212

SEQ ID NO: 537139 - RNA, 64 nt, Homo Sapiens; identical to SEQ ID NO: 166213

SEQ ID NO: 537140 - RNA, 64 nt, Homo Sapiens; identical to SEQ ID NO: 166214

SEQ ID NO: 537141 - RNA, 64 nt, Homo Sapiens; identical to SEQ ID NO: 166215

SEQ ID NO: 537142 - RNA, 64 nt, Homo Sapiens; identical to SEQ ID NO: 166216

SEQ ID NO: 537143 - RNA, 64 nt, Homo Sapiens; identical to SEQ ID NO: 166217

SEQ ID NO: 537144 - RNA, 64 nt, Homo Sapiens; identical to SEQ ID NO: 166218

SEQ ID NO: 537145 - RNA, 64 nt, Homo Sapiens; identical to SEQ ID NO: 166219

SEQ ID NO: 537146 - RNA, 64 nt, Homo Sapiens; identical to SEQ ID NO: 166220

SEQ ID NO: 537147 - RNA, 64 nt, Homo Sapiens; identical to SEQ ID NO: 166221

SEQ ID NO: 537148 - RNA, 64 nt, Homo Sapiens; identical to SEQ ID NO: 166222

SEQ ID NO: 537149 - RNA, 64 nt, Homo Sapiens; identical to SEQ ID NO: 166223

SEQ ID NO: 537150 - RNA, 64 nt, Homo Sapiens; identical to SEQ ID NO: 166224

SEQ ID NO: 537151 - RNA, 58 nt, Homo Sapiens; identical to SEQ ID NO: 96080

SEQ ID NO: 537152 - RNA, 64 nt, Homo Sapiens; identical to SEQ ID NO: 166226

SEQ ID NO: 537153 - RNA, 64 nt, Homo Sapiens; identical to SEQ ID NO: 166227

SEQ ID NO: 537154 - RNA, 64 nt, Homo Sapiens; identical to SEQ ID NO: 166228

SEQ ID NO: 537155 - RNA, 64 nt, Homo Sapiens; identical to SEQ ID NO: 166229

SEQ ID NO: 537156 - RNA, 64 nt, Homo Sapiens; identical to SEQ ID NO: 166230

SEQ ID NO: 537157 - RNA, 64 nt, Homo Sapiens; identical to SEQ ID NO: 166231

SEQ ID NO: 537158 - RNA, 64 nt, Homo Sapiens; identical to SEQ ID NO: 166232

SEQ ID NO: 537159 - RNA, 64 nt, Homo Sapiens; identical to SEQ ID NO: 166233

SEQ ID NO: 537160 - RNA, 64 nt, Homo Sapiens; identical to SEQ ID NO: 166234

SEQ ID NO: 537161 - RNA, 64 nt, Homo Sapiens; identical to SEQ ID NO: 166235

SEQ ID NO: 537162 - RNA, 64 nt, Homo Sapiens; identical to SEQ ID NO: 166236

SEQ ID NO: 537163 - RNA, 64 nt, Homo Sapiens; identical to SEQ ID NO: 166237

SEQ ID NO: 537164 - RNA, 64 nt, Homo Sapiens; identical to SEQ ID NO: 166238

SEQ ID NO: 537165 - RNA, 64 nt, Homo Sapiens; identical to SEQ ID NO: 166239

SEQ ID NO: 537166 - RNA, 64 nt, Homo Sapiens; identical to SEQ ID NO: 166240

SEQ ID NO: 537167 - RNA, 64 nt, Homo Sapiens; identical to SEQ ID NO: 166241

SEQ ID NO: 537168 - RNA, 64 nt, Homo Sapiens; identical to SEQ ID NO: 166242

SEQ ID NO: 537169 - RNA, 64 nt, Homo Sapiens; identical to SEQ ID NO: 166243

SEQ ID NO: 537170 - RNA, 64 nt, Homo Sapiens; identical to SEQ ID NO: 166244

SEQ ID NO: 537171 - RNA, 64 nt, Homo Sapiens; identical to SEQ ID NO: 166245

SEQ ID NO: 537172 - RNA, 64 nt, Homo Sapiens; identical to SEQ ID NO: 166246

SEQ ID NO: 537173 - RNA, 64 nt, Homo Sapiens; identical to SEQ ID NO: 166247

SEQ ID NO: 537174 - RNA, 64 nt, Homo Sapiens; identical to SEQ ID NO: 166248

SEQ ID NO: 537175 - RNA, 64 nt, Homo Sapiens; identical to SEQ ID NO: 166249

SEQ ID NO: 537176 - RNA, 64 nt, Homo Sapiens; identical to SEQ ID NO: 166250

SEQ ID NO: 537177 - RNA, 64 nt, Homo Sapiens; identical to SEQ ID NO: 166251

SEQ ID NO: 537178 - RNA, 64 nt, Homo Sapiens; identical to SEQ ID NO: 166252

SEQ ID NO: 537179 - RNA, 64 nt, Homo Sapiens; identical to SEQ ID NO: 166253

SEQ ID NO: 537180 - RNA, 64 nt, Homo Sapiens; identical to SEQ ID NO: 166254

SEQ ID NO: 537181 - RNA, 64 nt, Homo Sapiens; identical to SEQ ID NO: 166255

SEQ ID NO: 537182 - RNA, 64 nt, Homo Sapiens; identical to SEQ ID NO: 166256

SEQ ID NO: 537183 - RNA, 64 nt, Homo Sapiens; identical to SEQ ID NO: 166257

SEQ ID NO: 537184 - RNA, 64 nt, Homo Sapiens; identical to SEQ ID NO: 166258

SEQ ID NO: 537185 - RNA, 64 nt, Homo Sapiens; identical to SEQ ID NO: 166259

SEQ ID NO: 537186 - RNA, 64 nt, Homo Sapiens; identical to SEQ ID NO: 166260

SEQ ID NO: 537187 - RNA, 64 nt, Homo Sapiens; identical to SEQ ID NO: 166261

SEQ ID NO: 537188 - RNA, 64 nt, Homo Sapiens; identical to SEQ ID NO: 166262

SEQ ID NO: 537189 - RNA, 64 nt, Homo Sapiens; identical to SEQ ID NO: 166263

SEQ ID NO: 537190 - RNA, 64 nt, Homo Sapiens; identical to SEQ ID NO: 166264

SEQ ID NO: 537191 - RNA, 64 nt, Homo Sapiens; identical to SEQ ID NO: 166265

SEQ ID NO: 537192 - RNA, 64 nt, Homo Sapiens; identical to SEQ ID NO: 166266

SEQ ID NO: 537193 - RNA, 64 nt, Homo Sapiens; identical to SEQ ID NO: 166267

SEQ ID NO: 537194 - RNA, 64 nt, Homo Sapiens; identical to SEQ ID NO: 166268

SEQ ID NO: 537195 - RNA, 64 nt, Homo Sapiens; identical to SEQ ID NO: 166269

SEQ ID NO: 537196 - RNA, 64 nt, Homo Sapiens; identical to SEQ ID NO: 166270

SEQ ID NO: 537197 - RNA, 64 nt, Homo Sapiens; identical to SEQ ID NO: 166271

SEQ ID NO: 537198 - RNA, 64 nt, Homo Sapiens; identical to SEQ ID NO: 166272

SEQ ID NO: 537199 - RNA, 64 nt, Homo Sapiens; identical to SEQ ID NO: 166273

SEQ ID NO: 537200 - RNA, 64 nt, Homo Sapiens; identical to SEQ ID NO: 166274

SEQ ID NO: 537201 - RNA, 64 nt, Homo Sapiens; identical to SEQ ID NO: 166275

SEQ ID NO: 537202 - RNA, 64 nt, Homo Sapiens; identical to SEQ ID NO: 166276

SEQ ID NO: 537203 - RNA, 64 nt, Homo Sapiens; identical to SEQ ID NO: 166277

SEQ ID NO: 537204 - RNA, 64 nt, Homo Sapiens; identical to SEQ ID NO: 166278

SEQ ID NO: 537205 - RNA, 64 nt, Homo Sapiens; identical to SEQ ID NO: 166279

SEQ ID NO: 537206 - RNA, 64 nt, Homo Sapiens; identical to SEQ ID NO: 166280

SEQ ID NO: 537207 - RNA, 64 nt, Homo Sapiens; identical to SEQ ID NO: 166281

SEQ ID NO: 537208 - RNA, 64 nt, Homo Sapiens; identical to SEQ ID NO: 166282

SEQ ID NO: 537209 - RNA, 64 nt, Homo Sapiens; identical to SEQ ID NO: 166283

SEQ ID NO: 537210 - RNA, 64 nt, Homo Sapiens; identical to SEQ ID NO: 166284

SEQ ID NO: 537211 - RNA, 64 nt, Homo Sapiens; identical to SEQ ID NO: 166285

SEQ ID NO: 537212 - RNA, 64 nt, Homo Sapiens; identical to SEQ ID NO: 166286

SEQ ID NO: 537213 - RNA, 64 nt, Homo Sapiens; identical to SEQ ID NO: 166287

SEQ ID NO: 537214 - RNA, 64 nt, Homo Sapiens; identical to SEQ ID NO: 166288

SEQ ID NO: 537215 - RNA, 64 nt, Homo Sapiens; identical to SEQ ID NO: 166289

SEQ ID NO: 537216 - RNA, 64 nt, Homo Sapiens; identical to SEQ ID NO: 166290

SEQ ID NO: 537217 - RNA, 64 nt, Homo Sapiens; identical to SEQ ID NO: 166291

SEQ ID NO: 537218 - RNA, 64 nt, Homo Sapiens; identical to SEQ ID NO: 166292

SEQ ID NO: 537219 - RNA, 64 nt, Homo Sapiens; identical to SEQ ID NO: 166293

SEQ ID NO: 537220 - RNA, 64 nt, Homo Sapiens; identical to SEQ ID NO: 166294

SEQ ID NO: 537221 - RNA, 64 nt, Homo Sapiens; identical to SEQ ID NO: 166295

SEQ ID NO: 537222 - RNA, 64 nt, Homo Sapiens; identical to SEQ ID NO: 166296

SEQ ID NO: 537223 - RNA, 64 nt, Homo Sapiens; identical to SEQ ID NO: 166297

SEQ ID NO: 537224 - RNA, 64 nt, Homo Sapiens; identical to SEQ ID NO: 166298

SEQ ID NO: 537225 - RNA, 64 nt, Homo Sapiens; identical to SEQ ID NO: 166299

SEQ ID NO: 537226 - RNA, 64 nt, Homo Sapiens; identical to SEQ ID NO: 166300

SEQ ID NO: 537227 - RNA, 64 nt, Homo Sapiens; identical to SEQ ID NO: 166301

SEQ ID NO: 537228 - RNA, 64 nt, Homo Sapiens; identical to SEQ ID NO: 166302

SEQ ID NO: 537229 - RNA, 64 nt, Homo Sapiens; identical to SEQ ID NO: 166303

SEQ ID NO: 537230 - RNA, 64 nt, Homo Sapiens; identical to SEQ ID NO: 166304

SEQ ID NO: 537231 - RNA, 64 nt, Homo Sapiens; identical to SEQ ID NO: 166305

SEQ ID NO: 537232 - RNA, 64 nt, Homo Sapiens; identical to SEQ ID NO: 166306

SEQ ID NO: 537233 - RNA, 64 nt, Homo Sapiens; identical to SEQ ID NO: 166307

SEQ ID NO: 537234 - RNA, 64 nt, Homo Sapiens; identical to SEQ ID NO: 166308

SEQ ID NO: 537235 - RNA, 64 nt, Homo Sapiens; identical to SEQ ID NO: 166309

SEQ ID NO: 537236 - RNA, 64 nt, Homo Sapiens; identical to SEQ ID NO: 166310

SEQ ID NO: 537237 - RNA, 64 nt, Homo Sapiens; identical to SEQ ID NO: 166311

SEQ ID NO: 537238 - RNA, 64 nt, Homo Sapiens; identical to SEQ ID NO: 166312

SEQ ID NO: 537239 - RNA, 64 nt, Homo Sapiens; identical to SEQ ID NO: 166313

SEQ ID NO: 537240 - RNA, 64 nt, Homo Sapiens; identical to SEQ ID NO: 166314

SEQ ID NO: 537241 - RNA, 64 nt, Homo Sapiens; identical to SEQ ID NO: 166315

SEQ ID NO: 537242 - RNA, 64 nt, Homo Sapiens; identical to SEQ ID NO: 284748

SEQ ID NO: 537243 - RNA, 64 nt, Homo Sapiens; identical to SEQ ID NO: 284749

SEQ ID NO: 537244 - RNA, 64 nt, Homo Sapiens; identical to SEQ ID NO: 284750

SEQ ID NO: 537245 - RNA, 64 nt, Homo Sapiens; identical to SEQ ID NO: 284751

SEQ ID NO: 537246 - RNA, 64 nt, Homo Sapiens; identical to SEQ ID NO: 284752

SEQ ID NO: 537247 - RNA, 64 nt, Homo Sapiens; identical to SEQ ID NO: 284753

SEQ ID NO: 537248 - RNA, 64 nt, Homo Sapiens; identical to SEQ ID NO: 284754

SEQ ID NO: 537249 - RNA, 64 nt, Homo Sapiens; identical to SEQ ID NO: 284755

SEQ ID NO: 537250 - RNA, 64 nt, Homo Sapiens; identical to SEQ ID NO: 284756

SEQ ID NO: 537251 - RNA, 64 nt, Homo Sapiens; identical to SEQ ID NO: 284757

SEQ ID NO: 537252 - RNA, 64 nt, Homo Sapiens; identical to SEQ ID NO: 284758

SEQ ID NO: 537253 - RNA, 64 nt, Homo Sapiens; identical to SEQ ID NO: 284759

SEQ ID NO: 537254 - RNA, 64 nt, Homo Sapiens; identical to SEQ ID NO: 284760

SEQ ID NO: 537255 - RNA, 64 nt, Homo Sapiens; identical to SEQ ID NO: 284761

SEQ ID NO: 537256 - RNA, 64 nt, Homo Sapiens; identical to SEQ ID NO: 284762

SEQ ID NO: 537257 - RNA, 64 nt, Homo Sapiens; identical to SEQ ID NO: 284763

SEQ ID NO: 537258 - RNA, 64 nt, Homo Sapiens; identical to SEQ ID NO: 284764

SEQ ID NO: 537259 - RNA, 64 nt, Homo Sapiens; identical to SEQ ID NO: 284765

SEQ ID NO: 537260 - RNA, 64 nt, Homo Sapiens; identical to SEQ ID NO: 284766

SEQ ID NO: 537261 - RNA, 64 nt, Homo Sapiens; identical to SEQ ID NO: 284767

SEQ ID NO: 537262 - RNA, 64 nt, Homo Sapiens; identical to SEQ ID NO: 284768

SEQ ID NO: 537263 - RNA, 64 nt, Homo Sapiens; identical to SEQ ID NO: 284769

SEQ ID NO: 537264 - RNA, 64 nt, Homo Sapiens; identical to SEQ ID NO: 284770

SEQ ID NO: 537265 - RNA, 64 nt, Homo Sapiens; identical to SEQ ID NO: 284771

SEQ ID NO: 537266 - RNA, 64 nt, Homo Sapiens; identical to SEQ ID NO: 284772

SEQ ID NO: 537267 - RNA, 64 nt, Homo Sapiens; identical to SEQ ID NO: 284773

SEQ ID NO: 537268 - RNA, 64 nt, Homo Sapiens; identical to SEQ ID NO: 284774

SEQ ID NO: 537269 - RNA, 64 nt, Homo Sapiens; identical to SEQ ID NO: 284775

SEQ ID NO: 537270 - RNA, 64 nt, Homo Sapiens; identical to SEQ ID NO: 284776

SEQ ID NO: 537271 - RNA, 64 nt, Homo Sapiens; identical to SEQ ID NO: 284777

SEQ ID NO: 537272 - RNA, 64 nt, Homo Sapiens; identical to SEQ ID NO: 284778

SEQ ID NO: 537273 - RNA, 64 nt, Homo Sapiens; identical to SEQ ID NO: 284779

SEQ ID NO: 537274 - RNA, 64 nt, Homo Sapiens; identical to SEQ ID NO: 284780

SEQ ID NO: 537275 - RNA, 64 nt, Homo Sapiens; identical to SEQ ID NO: 284781

SEQ ID NO: 537276 - RNA, 64 nt, Homo Sapiens; identical to SEQ ID NO: 284782

SEQ ID NO: 537277 - RNA, 64 nt, Homo Sapiens; identical to SEQ ID NO: 284783

SEQ ID NO: 537278 - RNA, 64 nt, Homo Sapiens; identical to SEQ ID NO: 284784

SEQ ID NO: 537279 - RNA, 64 nt, Homo Sapiens; identical to SEQ ID NO: 284785

SEQ ID NO: 537280 - RNA, 64 nt, Homo Sapiens; identical to SEQ ID NO: 284786

SEQ ID NO: 537281 - RNA, 64 nt, Homo Sapiens; identical to SEQ ID NO: 284787

SEQ ID NO: 537282 - RNA, 64 nt, Homo Sapiens; identical to SEQ ID NO: 284788

SEQ ID NO: 537283 - RNA, 64 nt, Homo Sapiens; identical to SEQ ID NO: 284789

SEQ ID NO: 537284 - RNA, 64 nt, Homo Sapiens; identical to SEQ ID NO: 284790

SEQ ID NO: 537285 - RNA, 64 nt, Homo Sapiens; identical to SEQ ID NO: 284791

SEQ ID NO: 537286 - RNA, 64 nt, Homo Sapiens; identical to SEQ ID NO: 284792

SEQ ID NO: 537287 - RNA, 64 nt, Homo Sapiens; identical to SEQ ID NO: 284793

SEQ ID NO: 537288 - RNA, 64 nt, Homo Sapiens; identical to SEQ ID NO: 284794

SEQ ID NO: 537289 - RNA, 64 nt, Homo Sapiens; identical to SEQ ID NO: 284795

SEQ ID NO: 537290 - RNA, 64 nt, Homo Sapiens; identical to SEQ ID NO: 284796

SEQ ID NO: 537291 - RNA, 64 nt, Homo Sapiens; identical to SEQ ID NO: 284797

SEQ ID NO: 537292 - RNA, 64 nt, Homo Sapiens; identical to SEQ ID NO: 284798

SEQ ID NO: 537293 - RNA, 64 nt, Homo Sapiens; identical to SEQ ID NO: 284799

SEQ ID NO: 537294 - RNA, 64 nt, Homo Sapiens; identical to SEQ ID NO: 284800

SEQ ID NO: 537295 - RNA, 64 nt, Homo Sapiens; identical to SEQ ID NO: 284801

SEQ ID NO: 537296 - RNA, 64 nt, Homo Sapiens; identical to SEQ ID NO: 284802

SEQ ID NO: 537297 - RNA, 64 nt, Homo Sapiens; identical to SEQ ID NO: 284803

SEQ ID NO: 537298 - RNA, 64 nt, Homo Sapiens; identical to SEQ ID NO: 284804

SEQ ID NO: 537299 - RNA, 64 nt, Homo Sapiens; identical to SEQ ID NO: 284805

SEQ ID NO: 537300 - RNA, 64 nt, Homo Sapiens; identical to SEQ ID NO: 284806

SEQ ID NO: 537301 - RNA, 64 nt, Homo Sapiens; identical to SEQ ID NO: 284807

SEQ ID NO: 537302 - RNA, 64 nt, Homo Sapiens; identical to SEQ ID NO: 284808

SEQ ID NO: 537303 - RNA, 64 nt, Homo Sapiens; identical to SEQ ID NO: 284809

SEQ ID NO: 537304 - RNA, 64 nt, Homo Sapiens; identical to SEQ ID NO: 284810

SEQ ID NO: 537305 - RNA, 64 nt, Homo Sapiens; identical to SEQ ID NO: 284811

SEQ ID NO: 537306 - RNA, 64 nt, Homo Sapiens; identical to SEQ ID NO: 284812

SEQ ID NO: 537307 - RNA, 64 nt, Homo Sapiens; identical to SEQ ID NO: 284813

SEQ ID NO: 537308 - RNA, 64 nt, Homo Sapiens; identical to SEQ ID NO: 284814

SEQ ID NO: 537309 - RNA, 64 nt, Homo Sapiens; identical to SEQ ID NO: 284815

SEQ ID NO: 537310 - RNA, 64 nt, Homo Sapiens; identical to SEQ ID NO: 284816

SEQ ID NO: 537311 - RNA, 64 nt, Homo Sapiens; identical to SEQ ID NO: 284817

SEQ ID NO: 537312 - RNA, 64 nt, Homo Sapiens; identical to SEQ ID NO: 284818

SEQ ID NO: 537313 - RNA, 64 nt, Homo Sapiens; identical to SEQ ID NO: 284819

SEQ ID NO: 537314 - RNA, 64 nt, Homo Sapiens; identical to SEQ ID NO: 284820

SEQ ID NO: 537315 - RNA, 64 nt, Homo Sapiens; identical to SEQ ID NO: 284821

SEQ ID NO: 537316 - RNA, 64 nt, Homo Sapiens; identical to SEQ ID NO: 284822

SEQ ID NO: 537317 - RNA, 64 nt, Homo Sapiens; identical to SEQ ID NO: 284823

SEQ ID NO: 537318 - RNA, 64 nt, Homo Sapiens; identical to SEQ ID NO: 284824

SEQ ID NO: 537319 - RNA, 57 nt, Homo Sapiens; identical to SEQ ID NO: 284825

SEQ ID NO: 537320 - RNA, 52 nt, Homo Sapiens; identical to SEQ ID NO: 284826

SEQ ID NO: 537321 - RNA, 64 nt, Homo Sapiens; identical to SEQ ID NO: 284827

SEQ ID NO: 537322 - RNA, 64 nt, Homo Sapiens; identical to SEQ ID NO: 284828

SEQ ID NO: 537323 - RNA, 64 nt, Homo Sapiens; identical to SEQ ID NO: 284829

SEQ ID NO: 537324 - RNA, 64 nt, Homo Sapiens; identical to SEQ ID NO: 284830

SEQ ID NO: 537325 - RNA, 64 nt, Homo Sapiens; identical to SEQ ID NO: 284831

SEQ ID NO: 537326 - RNA, 64 nt, Homo Sapiens; identical to SEQ ID NO: 284832

SEQ ID NO: 537327 - RNA, 64 nt, Homo Sapiens; identical to SEQ ID NO: 284833

SEQ ID NO: 537328 - RNA, 64 nt, Homo Sapiens; identical to SEQ ID NO: 284834

SEQ ID NO: 537329 - RNA, 64 nt, Homo Sapiens; identical to SEQ ID NO: 284835

SEQ ID NO: 537330 - RNA, 64 nt, Homo Sapiens; identical to SEQ ID NO: 284836

SEQ ID NO: 537331 - RNA, 64 nt, Homo Sapiens; identical to SEQ ID NO: 284837

SEQ ID NO: 537332 - RNA, 64 nt, Homo Sapiens; identical to SEQ ID NO: 284838

SEQ ID NO: 537333 - RNA, 64 nt, Homo Sapiens; identical to SEQ ID NO: 284839

SEQ ID NO: 537334 - RNA, 64 nt, Homo Sapiens; identical to SEQ ID NO: 284840

SEQ ID NO: 537335 - RNA, 64 nt, Homo Sapiens; identical to SEQ ID NO: 22031

SEQ ID NO: 537336 - RNA, 64 nt, Homo Sapiens; identical to SEQ ID NO: 22032

SEQ ID NO: 537337 - RNA, 64 nt, Homo Sapiens; identical to SEQ ID NO: 22033

SEQ ID NO: 537338 - RNA, 64 nt, Homo Sapiens; identical to SEQ ID NO: 22034

SEQ ID NO: 537339 - RNA, 64 nt, Homo Sapiens; identical to SEQ ID NO: 22035

SEQ ID NO: 537340 - RNA, 64 nt, Homo Sapiens; identical to SEQ ID NO: 22036

SEQ ID NO: 537341 - RNA, 64 nt, Homo Sapiens; identical to SEQ ID NO: 22037

SEQ ID NO: 537342 - RNA, 64 nt, Homo Sapiens; identical to SEQ ID NO: 22038

SEQ ID NO: 537343 - RNA, 64 nt, Homo Sapiens; identical to SEQ ID NO: 22039

SEQ ID NO: 537344 - RNA, 64 nt, Homo Sapiens; identical to SEQ ID NO: 22040

SEQ ID NO: 537345 - RNA, 64 nt, Homo Sapiens; identical to SEQ ID NO: 22041

SEQ ID NO: 537346 - RNA, 64 nt, Homo Sapiens; identical to SEQ ID NO: 22042

SEQ ID NO: 537347 - RNA, 64 nt, Homo Sapiens; identical to SEQ ID NO: 22043

SEQ ID NO: 537348 - RNA, 64 nt, Homo Sapiens; identical to SEQ ID NO: 22044

SEQ ID NO: 537349 - RNA, 64 nt, Homo Sapiens; identical to SEQ ID NO: 22045

SEQ ID NO: 537350 - RNA, 64 nt, Homo Sapiens; identical to SEQ ID NO: 22046

SEQ ID NO: 537351 - RNA, 64 nt, Homo Sapiens; identical to SEQ ID NO: 22047

SEQ ID NO: 537352 - RNA, 64 nt, Homo Sapiens; identical to SEQ ID NO: 22048

SEQ ID NO: 537353 - RNA, 64 nt, Homo Sapiens; identical to SEQ ID NO: 22049

SEQ ID NO: 537354 - RNA, 64 nt, Homo Sapiens; identical to SEQ ID NO: 22050

SEQ ID NO: 537355 - RNA, 64 nt, Homo Sapiens; identical to SEQ ID NO: 22051

SEQ ID NO: 537356 - RNA, 64 nt, Homo Sapiens; identical to SEQ ID NO: 22052

SEQ ID NO: 537357 - RNA, 64 nt, Homo Sapiens; identical to SEQ ID NO: 22053

SEQ ID NO: 537358 - RNA, 64 nt, Homo Sapiens; identical to SEQ ID NO: 22054

SEQ ID NO: 537359 - RNA, 64 nt, Homo Sapiens; identical to SEQ ID NO: 22055

SEQ ID NO: 537360 - RNA, 64 nt, Homo Sapiens; identical to SEQ ID NO: 22056

SEQ ID NO: 537361 - RNA, 64 nt, Homo Sapiens; identical to SEQ ID NO: 22057

SEQ ID NO: 537362 - RNA, 64 nt, Homo Sapiens; identical to SEQ ID NO: 22058

SEQ ID NO: 537363 - RNA, 64 nt, Homo Sapiens; identical to SEQ ID NO: 22059

SEQ ID NO: 537364 - RNA, 64 nt, Homo Sapiens; identical to SEQ ID NO: 22060

SEQ ID NO: 537365 - RNA, 64 nt, Homo Sapiens; identical to SEQ ID NO: 22061

SEQ ID NO: 537366 - RNA, 64 nt, Homo Sapiens; identical to SEQ ID NO: 22062

SEQ ID NO: 537367 - RNA, 64 nt, Homo Sapiens; identical to SEQ ID NO: 22063

SEQ ID NO: 537368 - RNA, 64 nt, Homo Sapiens; identical to SEQ ID NO: 22064

SEQ ID NO: 537369 - RNA, 64 nt, Homo Sapiens; identical to SEQ ID NO: 22065

SEQ ID NO: 537370 - RNA, 64 nt, Homo Sapiens; identical to SEQ ID NO: 22066

SEQ ID NO: 537371 - RNA, 64 nt, Homo Sapiens; identical to SEQ ID NO: 22067

SEQ ID NO: 537372 - RNA, 52 nt, Homo Sapiens; identical to SEQ ID NO: 22068

SEQ ID NO: 537373 - RNA, 64 nt, Homo Sapiens; identical to SEQ ID NO: 22069

SEQ ID NO: 537374 - RNA, 64 nt, Homo Sapiens; identical to SEQ ID NO: 22070

SEQ ID NO: 537375 - RNA, 64 nt, Homo Sapiens; identical to SEQ ID NO: 22071

SEQ ID NO: 537376 - RNA, 64 nt, Homo Sapiens; identical to SEQ ID NO: 22072

SEQ ID NO: 537377 - RNA, 64 nt, Homo Sapiens; identical to SEQ ID NO: 22073

SEQ ID NO: 537378 - RNA, 64 nt, Homo Sapiens; identical to SEQ ID NO: 22074

SEQ ID NO: 537379 - RNA, 64 nt, Homo Sapiens; identical to SEQ ID NO: 22075

SEQ ID NO: 537380 - RNA, 64 nt, Homo Sapiens; identical to SEQ ID NO: 22076

SEQ ID NO: 537381 - RNA, 64 nt, Homo Sapiens; identical to SEQ ID NO: 22077

SEQ ID NO: 537382 - RNA, 64 nt, Homo Sapiens; identical to SEQ ID NO: 22078

SEQ ID NO: 537383 - RNA, 64 nt, Homo Sapiens; identical to SEQ ID NO: 22079

SEQ ID NO: 537384 - RNA, 64 nt, Homo Sapiens; identical to SEQ ID NO: 22080

SEQ ID NO: 537385 - RNA, 64 nt, Homo Sapiens; identical to SEQ ID NO: 22081

SEQ ID NO: 537386 - RNA, 64 nt, Homo Sapiens; identical to SEQ ID NO: 22082

SEQ ID NO: 537387 - RNA, 53 nt, Homo Sapiens; identical to SEQ ID NO: 22083

SEQ ID NO: 537388 - RNA, 64 nt, Homo Sapiens; identical to SEQ ID NO: 22084

SEQ ID NO: 537389 - RNA, 64 nt, Homo Sapiens; identical to SEQ ID NO: 22085

SEQ ID NO: 537390 - RNA, 64 nt, Homo Sapiens; identical to SEQ ID NO: 22086

SEQ ID NO: 537391 - RNA, 64 nt, Homo Sapiens; identical to SEQ ID NO: 22087

SEQ ID NO: 537392 - RNA, 64 nt, Homo Sapiens; identical to SEQ ID NO: 22088

SEQ ID NO: 537393 - RNA, 64 nt, Homo Sapiens; identical to SEQ ID NO: 22089

SEQ ID NO: 537394 - RNA, 64 nt, Homo Sapiens; identical to SEQ ID NO: 22090

SEQ ID NO: 537395 - RNA, 64 nt, Homo Sapiens; identical to SEQ ID NO: 22091

SEQ ID NO: 537396 - RNA, 64 nt, Homo Sapiens
agccaccaccugugcggcgcuugcuccgaggggucagcaagagcaacugauggcugccacuucc

SEQ ID NO: 537397 - RNA, 64 nt, Homo Sapiens
ccgcaaucugcuccagauucaagcaguaauauuucagcaagaggagguggucaugggaagccag

SEQ ID NO: 537398 - RNA, 64 nt, Homo Sapiens
cgaaagaauuaagagaauaccuagaacauauccucagcaagaaacaaaaccaaacuggacucuc

SEQ ID NO: 537399 - RNA, 64 nt, Homo Sapiens
aaucaccuucuuuauaaagcgucagucaugcuuccagcaagaggcagcaucagucauggcuuua

SEQ ID NO: 537400 - RNA, 64 nt, Homo Sapiens
cuaucucaaaaaaaagaaaacacccuggguaacacagcaagacuagcuaugaucagcugcaauc

SEQ ID NO: 537401 - RNA, 64 nt, Homo Sapiens
ccaucucuacaaaaauauuauagcccagguaacacagcaagaccaauauagaaacucacauaac

SEQ ID NO: 537402 - RNA, 64 nt, Homo Sapiens
auggacuguguuacaguuugucucuaacaugaaacagcaagagguagcccccucucccguccuc

SEQ ID NO: 537403 - RNA, 64 nt, Homo Sapiens
cugcucauuguagauggagaauucaacauaaauacagcaagaaaauguguuugggcuucugaag

SEQ ID NO: 537404 - RNA, 64 nt, Homo Sapiens
gcucuuaaggagaauuguauuucuccagaagcugcagcaagagguacagcucaacaaaggaaaa

SEQ ID NO: 537405 - RNA, 64 nt, Homo Sapiens
ccucagcucuguacacaugauaugcaacaaagggcagcaagaaaugcuggguccaccuaauuua

SEQ ID NO: 537406 - RNA, 64 nt, Homo Sapiens
ucuucaaacugugaagcauuuacagaaacgcauccagcaagaauauugucccuuugagcagaaa

SEQ ID NO: 537407 - RNA, 64 nt, Homo Sapiens
ucaguaugcugccccugucuugcugucaugaaaucagcaagagaggaugacacaucaaauaaua

SEQ ID NO: 537408 - RNA, 64 nt, Homo Sapiens
uuaaacauaagccagaaauuaaaaugacuauagacagcaagaauugagcuaauaauauguuuua

SEQ ID NO: 537409 - RNA, 64 nt, Homo Sapiens
aauugagcuaauaauauguuuuaacucuuaacaccagcaagaagucagucauuuauugaaguuu

SEQ ID NO: 537410 - RNA, 64 nt, Homo Sapiens
aaaaaaugccauaauacaaaauguaugaauacagcagcaagaaagaaagaugauuugcaauggg

SEQ ID NO: 537411 - RNA, 64 nt, Homo Sapiens
gaaccuaacuguaucuugagcuauuucaguacuucagcaagagauguuuauuagaugaauuauc

SEQ ID NO: 537412 - RNA, 64 nt, Homo Sapiens
uggugggaggcaaaaagcacuucuuacauggcggcagcaagagaaaaugagaaagaagcaaaag

SEQ ID NO: 537413 - RNA, 64 nt, Homo Sapiens
agggaaagaugcugccagucucuuugcuaaaacacagcaagagucaccuuuacuccaguuccca

SEQ ID NO: 537414 - RNA, 64 nt, Homo Sapiens
uugagagaaaaacacaucugcuggcuuuccuuagcagcaagaacuacaugucaggaaccuaugg

SEQ ID NO: 537415 - RNA, 64 nt, Homo Sapiens
uacauccaaguguccuauuauauaacauagugcacagcaagagcccugaagacacaacuugacu

SEQ ID NO: 537416 - RNA, 64 nt, Homo Sapiens
ccuuggcccaggccaagauugagaagaucaagggcagcaagaaggccaucaagguaguccccau

SEQ ID NO: 537417 - RNA, 64 nt, Homo Sapiens
cagaggagaagcuguuugaugcccccuuguccaucagcaagagagagcagcuggaacagcaggu

SEQ ID NO: 537418 - RNA, 64 nt, Homo Sapiens
cuuaaaguucagcguguuaaccuaacauaaaacacagcaagaaucugguugucugaacuauuuu

SEQ ID NO: 537419 - RNA, 64 nt, Homo Sapiens
aauauauaugggcuuaaucauuuaaaauuuguugcagcaagaacuuuccuaccuguaggcaaua

SEQ ID NO: 537420 - RNA, 64 nt, Homo Sapiens
aagcgcugagagcucgcagguuaaagccacauuucagcaagagaugagcucagccuccaaggcu

SEQ ID NO: 537421 - RNA, 64 nt, Homo Sapiens
caucucuacaagaaauuuaacagccugggcaacacagcaagaccugagccuagacguuaaagac

SEQ ID NO: 537422 - RNA, 64 nt, Homo Sapiens
ccaggugcacugcucacaccaacaaagcuccagacagcaagagcugaagcuuugaaauuagacu

SEQ ID NO: 537423 - RNA, 64 nt, Homo Sapiens
acagaaauacugugucucauggggagggucuacacagcaagagaaugagauuuuuuuuuggagg

SEQ ID NO: 537424 - RNA, 64 nt, Homo Sapiens; identical to SEQ ID NO: 392717

SEQ ID NO: 537425 - RNA, 64 nt, Homo Sapiens; identical to SEQ ID NO: 392718

SEQ ID NO: 537426 - RNA, 64 nt, Homo Sapiens; identical to SEQ ID NO: 392719

SEQ ID NO: 537427 - RNA, 64 nt, Homo Sapiens; identical to SEQ ID NO: 392720

SEQ ID NO: 537428 - RNA, 64 nt, Homo Sapiens; identical to SEQ ID NO: 392721

SEQ ID NO: 537429 - RNA, 64 nt, Homo Sapiens; identical to SEQ ID NO: 392722

SEQ ID NO: 537430 - RNA, 64 nt, Homo Sapiens; identical to SEQ ID NO: 392723

SEQ ID NO: 537431 - RNA, 64 nt, Homo Sapiens; identical to SEQ ID NO: 392724

SEQ ID NO: 537432 - RNA, 64 nt, Homo Sapiens; identical to SEQ ID NO: 392725

SEQ ID NO: 537433 - RNA, 64 nt, Homo Sapiens; identical to SEQ ID NO: 392726

SEQ ID NO: 537434 - RNA, 64 nt, Homo Sapiens; identical to SEQ ID NO: 297865

SEQ ID NO: 537435 - RNA, 64 nt, Homo Sapiens; identical to SEQ ID NO: 297866

SEQ ID NO: 537436 - RNA, 64 nt, Homo Sapiens; identical to SEQ ID NO: 297867

SEQ ID NO: 537437 - RNA, 64 nt, Homo Sapiens; identical to SEQ ID NO: 297868

SEQ ID NO: 537438 - RNA, 64 nt, Homo Sapiens; identical to SEQ ID NO: 297869

SEQ ID NO: 537439 - RNA, 64 nt, Homo Sapiens; identical to SEQ ID NO: 297870

SEQ ID NO: 537440 - RNA, 64 nt, Homo Sapiens; identical to SEQ ID NO: 297871

SEQ ID NO: 537441 - RNA, 64 nt, Homo Sapiens; identical to SEQ ID NO: 297872

SEQ ID NO: 537442 - RNA, 64 nt, Homo Sapiens; identical to SEQ ID NO: 297873

SEQ ID NO: 537443 - RNA, 64 nt, Homo Sapiens; identical to SEQ ID NO: 297874

SEQ ID NO: 537444 - RNA, 64 nt, Homo Sapiens; identical to SEQ ID NO: 297875

SEQ ID NO: 537445 - RNA, 64 nt, Homo Sapiens; identical to SEQ ID NO: 297876

SEQ ID NO: 537446 - RNA, 64 nt, Homo Sapiens; identical to SEQ ID NO: 297877

SEQ ID NO: 537447 - RNA, 64 nt, Homo Sapiens; identical to SEQ ID NO: 297878

SEQ ID NO: 537448 - RNA, 64 nt, Homo Sapiens; identical to SEQ ID NO: 297879

SEQ ID NO: 537449 - RNA, 64 nt, Homo Sapiens; identical to SEQ ID NO: 297880

SEQ ID NO: 537450 - RNA, 64 nt, Homo Sapiens; identical to SEQ ID NO: 297881

SEQ ID NO: 537451 - RNA, 64 nt, Homo Sapiens; identical to SEQ ID NO: 297882

SEQ ID NO: 537452 - RNA, 64 nt, Homo Sapiens; identical to SEQ ID NO: 297883

SEQ ID NO: 537453 - RNA, 64 nt, Homo Sapiens; identical to SEQ ID NO: 297884

SEQ ID NO: 537454 - RNA, 64 nt, Homo Sapiens; identical to SEQ ID NO: 297885

SEQ ID NO: 537455 - RNA, 64 nt, Homo Sapiens; identical to SEQ ID NO: 297886

SEQ ID NO: 537456 - RNA, 64 nt, Homo Sapiens; identical to SEQ ID NO: 297887

SEQ ID NO: 537457 - RNA, 64 nt, Homo Sapiens; identical to SEQ ID NO: 297888

SEQ ID NO: 537458 - RNA, 64 nt, Homo Sapiens
uauagcaacguauaauuugcauaaugccaaauacacaauguauuacuggauuaaacaaauucac

SEQ ID NO: 537459 - RNA, 64 nt, Homo Sapiens
guuauccguuagaucaagacgcuucuuagugaagacaauguacauaucaaggacaaccacccua

SEQ ID NO: 537460 - RNA, 64 nt, Homo Sapiens
cacuugaagguuuuguguauguuuuauuuauugaacaauguaguuaaaaacaaaacaauguaga

SEQ ID NO: 537461 - RNA, 64 nt, Homo Sapiens
guuuuauuuauugaacaauggcuguaaaaacaaaacaauguagacugaguuauaagcucacuag

SEQ ID NO: 537462 - RNA, 64 nt, Homo Sapiens
gaucuguuguacagcuuggugacuguaauuaacaacaauguauuuugaaagucacugaguaaau

SEQ ID NO: 537463 - RNA, 64 nt, Homo Sapiens
uaaugcacguuaauuagcuauauugagccauuccacaauguauagauauuucaaaacauguuac

SEQ ID NO: 537464 - RNA, 64 nt, Homo Sapiens
uguaaauauaaaaaaugagaaaccugaacagcucacaauguagcaaugaacguuacaucacucu

SEQ ID NO: 537465 - RNA, 64 nt, Homo Sapiens
agcuguaacagaauuuugaauaguccuacaaaagacaauguauaacuuagaagguuuuuuauua

SEQ ID NO: 537466 - RNA, 64 nt, Homo Sapiens
uuuguuuuaacugaacuaaaaccguuucaaugaaacaauguauguuguuggcaaagagugcuac

SEQ ID NO: 537467 - RNA, 64 nt, Homo Sapiens
gcuuaguuguguucauguuugugugaauuacuugacaauguaugaaaaugcucaccuacuggaa

SEQ ID NO: 537468 - RNA, 64 nt, Homo Sapiens
auuaugucucuugagcaucaaauguauguacaauacaauguacacagccagcuuaaacccauac

SEQ ID NO: 537469 - RNA, 64 nt, Homo Sapiens
uacaauacaauguacaauuacagcuuaaacccauacaauguaugugaaauauauaauauucagc

SEQ ID NO: 537470 - RNA, 64 nt, Homo Sapiens
ccagcuuucacccccacaugcgaaaaugaucuuuacaauguaucaaaagaaagguacaggcuua

SEQ ID NO: 537471 - RNA, 64 nt, Homo Sapiens
ggaugaaaacauaaggcaguccaguggaguaauuacaauguauuaaaugcuacgccauuauaag

SEQ ID NO: 537472 - RNA, 64 nt, Homo Sapiens
aucacaaaagaagugaaaagggccgguuccugccuuaacugaugacauuccaccauugugauuu

SEQ ID NO: 537473 - RNA, 64 nt, Homo Sapiens
acauuccaccauugugauuuguuccugccccaccuuaacugagcgauuaaccugugaacuuccu

SEQ ID NO: 537474 - RNA, 64 nt, Homo Sapiens
guacuuuugaaacaauuacauugguucucuugguuuaacugagguuuaugaauauucaaaccuu

SEQ ID NO: 537475 - RNA, 64 nt, Homo Sapiens
gaaguuauguuacaacugaucagcccuauaugaauuaacugaucagcccuauaugaaacauaag

SEQ ID NO: 537476 - RNA, 64 nt, Homo Sapiens
uucuuauugauauuuuuguaacagaauauagcucuuaacugaaaauccagaaccagaaacauaa

SEQ ID NO: 537477 - RNA, 64 nt, Homo Sapiens
aauugcucuggucaaaaccaagcacaccauagccuuaacugaauauuuaggaaaucugccuaau

SEQ ID NO: 537478 - RNA, 64 nt, Homo Sapiens
aaaauguagaaauauauguauaucuguacuuuguuuaacugaaaguuugccauuguugcagagu

SEQ ID NO: 537479 - RNA, 64 nt, Homo Sapiens
ugcugccuauagugucuuuucagggcuaauacuuuuaacugagcgcucaaauucucuaccucuu

SEQ ID NO: 537480 - RNA, 64 nt, Homo Sapiens
gagguuuaccuagugacaccaaauuaucgguauuuuaacugaauuuacccauugacuaagaaug

SEQ ID NO: 537481 - RNA, 64 nt, Homo Sapiens
aaucaagguugaggaguggggcuggggagaggacuuaacugacuuaagaaguaggaaaacaaaa

SEQ ID NO: 537482 - RNA, 64 nt, Homo Sapiens
gucggugcuaauggauggaacuccugcacaaguuuuaacugaacaagaaaucccagcaaaaggc

SEQ ID NO: 537483 - RNA, 64 nt, Homo Sapiens
aaauaaaaugacacaaggccaaaaacaaauggguuuaacugaccagagcgagagaacucugcac

SEQ ID NO: 537484 - RNA, 64 nt, Homo Sapiens
ggaauuaaacauagcaauugaacaaaauggaauguuaacugaauuucccccaauuuuuuaaacu

SEQ ID NO: 537485 - RNA, 64 nt, Homo Sapiens
gcuuugaucagcauugagguauuagguuaaucuguuaacugaaugaauguauuaauauauugcu

SEQ ID NO: 537486 - RNA, 64 nt, Homo Sapiens
gaauccuacaaaugugaaaaauguggcaaauccuuuaacugauccucaacuuuuacuaaacaua

SEQ ID NO: 537487 - RNA, 64 nt, Homo Sapiens
aaacccuacaaaugugaagucuguggcaaagcuuuuaacugauucucaacucuuacuacaugua

SEQ ID NO: 537488 - RNA, 64 nt, Homo Sapiens
uacuugcacuuauuaucuuuugucuaauuuaaccuuaacugaauucuccguuucuccuggaggc

SEQ ID NO: 537489 - RNA, 64 nt, Homo Sapiens
gacauagaaugugugcuuauucucagaagguucauuaacugaggugaugaguuaacaacuaguu

SEQ ID NO: 537490 - RNA, 64 nt, Homo Sapiens
uuuaugaguauaagaaagguuaggcauauuuucauuaacugaauaaacgacuugauuuauauaa

SEQ ID NO: 537491 - RNA, 64 nt, Homo Sapiens
acuaauaauguuuauuaucuuuccuaauaaugcauuaacugauuaaucagguguuuaaauuuuu

SEQ ID NO: 537492 - RNA, 64 nt, Homo Sapiens
ucuggaaacuuucauaucaauaauugauuauguauuaacugaaacaaaagacuagagaaagaca

SEQ ID NO: 537493 - RNA, 64 nt, Homo Sapiens
acuagagaaagacacagugggaauugauuauguauuaacugaggaauaaaagacugaagaaaga

SEQ ID NO: 537494 - RNA, 64 nt, Homo Sapiens
gaauuuugacucucuuaauacuauguauauccaguuaacugagacugcuuuaagauauauacca

SEQ ID NO: 537495 - RNA, 64 nt, Homo Sapiens
guugacauguauuuucuuuuucaggucaaaauauuuaacugacuaucacuauuuguagaaacug

SEQ ID NO: 537496 - RNA, 64 nt, Homo Sapiens
ucagcauuaaaaaaaaaaaagaugacuacugcuguuaacugacccauuuagggguuccuuugau

SEQ ID NO: 537497 - RNA, 64 nt, Homo Sapiens
gaucccuuaagcuacagaaugaaagaccaacauuuuaacugaugaaugggaggguaauaaagau

SEQ ID NO: 537498 - RNA, 64 nt, Homo Sapiens
aaaaagucaaaaaucaaaaugaccaggacccacuggggcauauacuucccaguugagcucccaa

SEQ ID NO: 537499 - RNA, 64 nt, Homo Sapiens
aaaucucugcuguauccuuugaccaggacccacuggggcauauacuucccaguugagcucccaa

SEQ ID NO: 537500 - RNA, 64 nt, Homo Sapiens
gcugccuuuaauguguuuuuggagaaaugagaauuagcuuaauuugaaaaaguugaugcccaag

SEQ ID NO: 537501 - RNA, 64 nt, Homo Sapiens
acauugaaaaaacuaaaguacucaggugagaucauagcuuaaauauuagaacuucuagcuaaug

SEQ ID NO: 537502 - RNA, 64 nt, Homo Sapiens
cgugaaucccgagggagccgguggcauacaccguuagcuuaaccuuagcuuaaacuagcugaag

SEQ ID NO: 537503 - RNA, 64 nt, Homo Sapiens
agggagccgguggcauacaccguuagcuuaaccuuagcuuaaacuagcugaaggcuccugugcc

SEQ ID NO: 537504 - RNA, 64 nt, Homo Sapiens; identical to SEQ ID NO: 166430

SEQ ID NO: 537505 - RNA, 64 nt, Homo Sapiens; identical to SEQ ID NO: 166431

SEQ ID NO: 537506 - RNA, 64 nt, Homo Sapiens; identical to SEQ ID NO: 166432

SEQ ID NO: 537507 - RNA, 64 nt, Homo Sapiens; identical to SEQ ID NO: 166433

SEQ ID NO: 537508 - RNA, 64 nt, Homo Sapiens; identical to SEQ ID NO: 166434

SEQ ID NO: 537509 - RNA, 64 nt, Homo Sapiens; identical to SEQ ID NO: 166435

SEQ ID NO: 537510 - RNA, 64 nt, Homo Sapiens; identical to SEQ ID NO: 166436

SEQ ID NO: 537511 - RNA, 64 nt, Homo Sapiens; identical to SEQ ID NO: 166437

SEQ ID NO: 537512 - RNA, 64 nt, Homo Sapiens; identical to SEQ ID NO: 166438

SEQ ID NO: 537513 - RNA, 64 nt, Homo Sapiens; identical to SEQ ID NO: 166439

SEQ ID NO: 537514 - RNA, 64 nt, Homo Sapiens; identical to SEQ ID NO: 166440

SEQ ID NO: 537515 - RNA, 64 nt, Homo Sapiens; identical to SEQ ID NO: 166441

SEQ ID NO: 537516 - RNA, 64 nt, Homo Sapiens; identical to SEQ ID NO: 166442

SEQ ID NO: 537517 - RNA, 64 nt, Homo Sapiens; identical to SEQ ID NO: 166443

SEQ ID NO: 537518 - RNA, 64 nt, Homo Sapiens; identical to SEQ ID NO: 166444

SEQ ID NO: 537519 - RNA, 64 nt, Homo Sapiens; identical to SEQ ID NO: 166445

SEQ ID NO: 537520 - RNA, 64 nt, Homo Sapiens; identical to SEQ ID NO: 166446

SEQ ID NO: 537521 - RNA, 64 nt, Homo Sapiens; identical to SEQ ID NO: 166447

SEQ ID NO: 537522 - RNA, 64 nt, Homo Sapiens; identical to SEQ ID NO: 166448

SEQ ID NO: 537523 - RNA, 64 nt, Homo Sapiens; identical to SEQ ID NO: 166449

SEQ ID NO: 537524 - RNA, 64 nt, Homo Sapiens; identical to SEQ ID NO: 166450

SEQ ID NO: 537525 - RNA, 64 nt, Homo Sapiens; identical to SEQ ID NO: 166451

SEQ ID NO: 537526 - RNA, 64 nt, Homo Sapiens; identical to SEQ ID NO: 166452

SEQ ID NO: 537527 - RNA, 64 nt, Homo Sapiens; identical to SEQ ID NO: 166453

SEQ ID NO: 537528 - RNA, 64 nt, Homo Sapiens; identical to SEQ ID NO: 166454

SEQ ID NO: 537529 - RNA, 64 nt, Homo Sapiens; identical to SEQ ID NO: 166455

SEQ ID NO: 537530 - RNA, 64 nt, Homo Sapiens; identical to SEQ ID NO: 166456

SEQ ID NO: 537531 - RNA, 64 nt, Homo Sapiens; identical to SEQ ID NO: 166457

SEQ ID NO: 537532 - RNA, 64 nt, Homo Sapiens; identical to SEQ ID NO: 166458

SEQ ID NO: 537533 - RNA, 64 nt, Homo Sapiens; identical to SEQ ID NO: 166459

SEQ ID NO: 537534 - RNA, 64 nt, Homo Sapiens; identical to SEQ ID NO: 166460

SEQ ID NO: 537535 - RNA, 64 nt, Homo Sapiens; identical to SEQ ID NO: 166461

SEQ ID NO: 537536 - RNA, 64 nt, Homo Sapiens; identical to SEQ ID NO: 166462

SEQ ID NO: 537537 - RNA, 64 nt, Homo Sapiens; identical to SEQ ID NO: 166463

SEQ ID NO: 537538 - RNA, 64 nt, Homo Sapiens; identical to SEQ ID NO: 166464

SEQ ID NO: 537539 - RNA, 64 nt, Homo Sapiens; identical to SEQ ID NO: 166465

SEQ ID NO: 537540 - RNA, 64 nt, Homo Sapiens; identical to SEQ ID NO: 166466

SEQ ID NO: 537541 - RNA, 64 nt, Homo Sapiens; identical to SEQ ID NO: 166467

SEQ ID NO: 537542 - RNA, 64 nt, Homo Sapiens; identical to SEQ ID NO: 166468

SEQ ID NO: 537543 - RNA, 64 nt, Homo Sapiens; identical to SEQ ID NO: 166469

SEQ ID NO: 537544 - RNA, 64 nt, Homo Sapiens; identical to SEQ ID NO: 166470

SEQ ID NO: 537545 - RNA, 64 nt, Homo Sapiens; identical to SEQ ID NO: 166471

SEQ ID NO: 537546 - RNA, 64 nt, Homo Sapiens; identical to SEQ ID NO: 166472

SEQ ID NO: 537547 - RNA, 64 nt, Homo Sapiens; identical to SEQ ID NO: 166473

SEQ ID NO: 537548 - RNA, 64 nt, Homo Sapiens; identical to SEQ ID NO: 166474

SEQ ID NO: 537549 - RNA, 64 nt, Homo Sapiens; identical to SEQ ID NO: 166475

SEQ ID NO: 537550 - RNA, 64 nt, Homo Sapiens; identical to SEQ ID NO: 166476

SEQ ID NO: 537551 - RNA, 64 nt, Homo Sapiens; identical to SEQ ID NO: 166477

SEQ ID NO: 537552 - RNA, 64 nt, Homo Sapiens; identical to SEQ ID NO: 166478

SEQ ID NO: 537553 - RNA, 64 nt, Homo Sapiens; identical to SEQ ID NO: 166479

SEQ ID NO: 537554 - RNA, 64 nt, Homo Sapiens; identical to SEQ ID NO: 166480

SEQ ID NO: 537555 - RNA, 64 nt, Homo Sapiens; identical to SEQ ID NO: 166481

SEQ ID NO: 537556 - RNA, 64 nt, Homo Sapiens; identical to SEQ ID NO: 166482

SEQ ID NO: 537557 - RNA, 64 nt, Homo Sapiens; identical to SEQ ID NO: 166483

SEQ ID NO: 537558 - RNA, 64 nt, Homo Sapiens; identical to SEQ ID NO: 166484

SEQ ID NO: 537559 - RNA, 64 nt, Homo Sapiens; identical to SEQ ID NO: 166485

SEQ ID NO: 537560 - RNA, 64 nt, Homo Sapiens; identical to SEQ ID NO: 166486

SEQ ID NO: 537561 - RNA, 64 nt, Homo Sapiens; identical to SEQ ID NO: 166487

SEQ ID NO: 537562 - RNA, 64 nt, Homo Sapiens; identical to SEQ ID NO: 166488

SEQ ID NO: 537563 - RNA, 64 nt, Homo Sapiens; identical to SEQ ID NO: 166489

SEQ ID NO: 537564 - RNA, 64 nt, Homo Sapiens; identical to SEQ ID NO: 166490

SEQ ID NO: 537565 - RNA, 64 nt, Homo Sapiens; identical to SEQ ID NO: 166491

SEQ ID NO: 537566 - RNA, 64 nt, Homo Sapiens; identical to SEQ ID NO: 166492

SEQ ID NO: 537567 - RNA, 64 nt, Homo Sapiens; identical to SEQ ID NO: 166493

SEQ ID NO: 537568 - RNA, 64 nt, Homo Sapiens; identical to SEQ ID NO: 166494

SEQ ID NO: 537569 - RNA, 64 nt, Homo Sapiens; identical to SEQ ID NO: 166495

SEQ ID NO: 537570 - RNA, 64 nt, Homo Sapiens; identical to SEQ ID NO: 166496

SEQ ID NO: 537571 - RNA, 64 nt, Homo Sapiens; identical to SEQ ID NO: 166497

SEQ ID NO: 537572 - RNA, 64 nt, Homo Sapiens; identical to SEQ ID NO: 166498

SEQ ID NO: 537573 - RNA, 64 nt, Homo Sapiens; identical to SEQ ID NO: 166499

SEQ ID NO: 537574 - RNA, 64 nt, Homo Sapiens; identical to SEQ ID NO: 166500

SEQ ID NO: 537575 - RNA, 64 nt, Homo Sapiens; identical to SEQ ID NO: 166501

SEQ ID NO: 537576 - RNA, 50 nt, Homo Sapiens; identical to SEQ ID NO: 166502

SEQ ID NO: 537577 - RNA, 64 nt, Homo Sapiens; identical to SEQ ID NO: 166503

SEQ ID NO: 537578 - RNA, 64 nt, Homo Sapiens; identical to SEQ ID NO: 166504

SEQ ID NO: 537579 - RNA, 64 nt, Homo Sapiens; identical to SEQ ID NO: 166505

SEQ ID NO: 537580 - RNA, 64 nt, Homo Sapiens; identical to SEQ ID NO: 166506

SEQ ID NO: 537581 - RNA, 64 nt, Homo Sapiens; identical to SEQ ID NO: 166507

SEQ ID NO: 537582 - RNA, 64 nt, Homo Sapiens; identical to SEQ ID NO: 166508

SEQ ID NO: 537583 - RNA, 64 nt, Homo Sapiens; identical to SEQ ID NO: 166509

SEQ ID NO: 537584 - RNA, 64 nt, Homo Sapiens; identical to SEQ ID NO: 166510

SEQ ID NO: 537585 - RNA, 64 nt, Homo Sapiens; identical to SEQ ID NO: 166511

SEQ ID NO: 537586 - RNA, 64 nt, Homo Sapiens; identical to SEQ ID NO: 166512

SEQ ID NO: 537587 - RNA, 64 nt, Homo Sapiens; identical to SEQ ID NO: 166513

SEQ ID NO: 537588 - RNA, 64 nt, Homo Sapiens; identical to SEQ ID NO: 166514

SEQ ID NO: 537589 - RNA, 64 nt, Homo Sapiens; identical to SEQ ID NO: 166515

SEQ ID NO: 537590 - RNA, 64 nt, Homo Sapiens; identical to SEQ ID NO: 166516

SEQ ID NO: 537591 - RNA, 64 nt, Homo Sapiens; identical to SEQ ID NO: 166517

SEQ ID NO: 537592 - RNA, 64 nt, Homo Sapiens; identical to SEQ ID NO: 166518

SEQ ID NO: 537593 - RNA, 64 nt, Homo Sapiens; identical to SEQ ID NO: 166519

SEQ ID NO: 537594 - RNA, 58 nt, Homo Sapiens; identical to SEQ ID NO: 166520

SEQ ID NO: 537595 - RNA, 64 nt, Homo Sapiens; identical to SEQ ID NO: 166521

SEQ ID NO: 537596 - RNA, 64 nt, Homo Sapiens; identical to SEQ ID NO: 166522

SEQ ID NO: 537597 - RNA, 64 nt, Homo Sapiens; identical to SEQ ID NO: 166523

SEQ ID NO: 537598 - RNA, 64 nt, Homo Sapiens; identical to SEQ ID NO: 166524

SEQ ID NO: 537599 - RNA, 64 nt, Homo Sapiens; identical to SEQ ID NO: 166525

SEQ ID NO: 537600 - RNA, 64 nt, Homo Sapiens; identical to SEQ ID NO: 166526

SEQ ID NO: 537601 - RNA, 64 nt, Homo Sapiens; identical to SEQ ID NO: 166527

SEQ ID NO: 537602 - RNA, 64 nt, Homo Sapiens; identical to SEQ ID NO: 166528

SEQ ID NO: 537603 - RNA, 64 nt, Homo Sapiens; identical to SEQ ID NO: 166529

SEQ ID NO: 537604 - RNA, 64 nt, Homo Sapiens; identical to SEQ ID NO: 166530

SEQ ID NO: 537605 - RNA, 64 nt, Homo Sapiens; identical to SEQ ID NO: 166531

SEQ ID NO: 537606 - RNA, 64 nt, Homo Sapiens; identical to SEQ ID NO: 166532

SEQ ID NO: 537607 - RNA, 64 nt, Homo Sapiens; identical to SEQ ID NO: 166533

SEQ ID NO: 537608 - RNA, 64 nt, Homo Sapiens; identical to SEQ ID NO: 166534

SEQ ID NO: 537609 - RNA, 64 nt, Homo Sapiens; identical to SEQ ID NO: 166535

SEQ ID NO: 537610 - RNA, 64 nt, Homo Sapiens; identical to SEQ ID NO: 166536

SEQ ID NO: 537611 - RNA, 64 nt, Homo Sapiens; identical to SEQ ID NO: 166537

SEQ ID NO: 537612 - RNA, 64 nt, Homo Sapiens; identical to SEQ ID NO: 166538

SEQ ID NO: 537613 - RNA, 64 nt, Homo Sapiens; identical to SEQ ID NO: 166539

SEQ ID NO: 537614 - RNA, 64 nt, Homo Sapiens; identical to SEQ ID NO: 166540

SEQ ID NO: 537615 - RNA, 64 nt, Homo Sapiens; identical to SEQ ID NO: 166541

SEQ ID NO: 537616 - RNA, 64 nt, Homo Sapiens; identical to SEQ ID NO: 166542

SEQ ID NO: 537617 - RNA, 64 nt, Homo Sapiens; identical to SEQ ID NO: 166543

SEQ ID NO: 537618 - RNA, 64 nt, Homo Sapiens; identical to SEQ ID NO: 166544

SEQ ID NO: 537619 - RNA, 64 nt, Homo Sapiens; identical to SEQ ID NO: 166545

SEQ ID NO: 537620 - RNA, 64 nt, Homo Sapiens; identical to SEQ ID NO: 166546

SEQ ID NO: 537621 - RNA, 64 nt, Homo Sapiens; identical to SEQ ID NO: 166547

SEQ ID NO: 537622 - RNA, 64 nt, Homo Sapiens; identical to SEQ ID NO: 166548

SEQ ID NO: 537623 - RNA, 64 nt, Homo Sapiens; identical to SEQ ID NO: 166549

SEQ ID NO: 537624 - RNA, 64 nt, Homo Sapiens; identical to SEQ ID NO: 166550

SEQ ID NO: 537625 - RNA, 64 nt, Homo Sapiens; identical to SEQ ID NO: 166551

SEQ ID NO: 537626 - RNA, 64 nt, Homo Sapiens; identical to SEQ ID NO: 166552

SEQ ID NO: 537627 - RNA, 64 nt, Homo Sapiens; identical to SEQ ID NO: 166553

SEQ ID NO: 537628 - RNA, 64 nt, Homo Sapiens; identical to SEQ ID NO: 166554

SEQ ID NO: 537629 - RNA, 64 nt, Homo Sapiens; identical to SEQ ID NO: 166555

SEQ ID NO: 537630 - RNA, 64 nt, Homo Sapiens; identical to SEQ ID NO: 166556

SEQ ID NO: 537631 - RNA, 64 nt, Homo Sapiens; identical to SEQ ID NO: 166557

SEQ ID NO: 537632 - RNA, 64 nt, Homo Sapiens; identical to SEQ ID NO: 166558

SEQ ID NO: 537633 - RNA, 64 nt, Homo Sapiens; identical to SEQ ID NO: 166559

SEQ ID NO: 537634 - RNA, 64 nt, Homo Sapiens; identical to SEQ ID NO: 166560

SEQ ID NO: 537635 - RNA, 64 nt, Homo Sapiens; identical to SEQ ID NO: 166561

SEQ ID NO: 537636 - RNA, 64 nt, Homo Sapiens; identical to SEQ ID NO: 166562

SEQ ID NO: 537637 - RNA, 64 nt, Homo Sapiens; identical to SEQ ID NO: 166563

SEQ ID NO: 537638 - RNA, 64 nt, Homo Sapiens; identical to SEQ ID NO: 166564

SEQ ID NO: 537639 - RNA, 64 nt, Homo Sapiens; identical to SEQ ID NO: 166565

SEQ ID NO: 537640 - RNA, 64 nt, Homo Sapiens; identical to SEQ ID NO: 166566

SEQ ID NO: 537641 - RNA, 64 nt, Homo Sapiens; identical to SEQ ID NO: 166567

SEQ ID NO: 537642 - RNA, 64 nt, Homo Sapiens; identical to SEQ ID NO: 166568

SEQ ID NO: 537643 - RNA, 64 nt, Homo Sapiens; identical to SEQ ID NO: 166569

SEQ ID NO: 537644 - RNA, 64 nt, Homo Sapiens; identical to SEQ ID NO: 166570

SEQ ID NO: 537645 - RNA, 64 nt, Homo Sapiens; identical to SEQ ID NO: 166571

SEQ ID NO: 537646 - RNA, 64 nt, Homo Sapiens; identical to SEQ ID NO: 166572

SEQ ID NO: 537647 - RNA, 64 nt, Homo Sapiens; identical to SEQ ID NO: 166573

SEQ ID NO: 537648 - RNA, 64 nt, Homo Sapiens; identical to SEQ ID NO: 166574

SEQ ID NO: 537649 - RNA, 64 nt, Homo Sapiens; identical to SEQ ID NO: 166575

SEQ ID NO: 537650 - RNA, 64 nt, Homo Sapiens; identical to SEQ ID NO: 166576

SEQ ID NO: 537651 - RNA, 64 nt, Homo Sapiens; identical to SEQ ID NO: 166577

SEQ ID NO: 537652 - RNA, 64 nt, Homo Sapiens; identical to SEQ ID NO: 166578

SEQ ID NO: 537653 - RNA, 64 nt, Homo Sapiens; identical to SEQ ID NO: 166579

SEQ ID NO: 537654 - RNA, 64 nt, Homo Sapiens; identical to SEQ ID NO: 166580

SEQ ID NO: 537655 - RNA, 64 nt, Homo Sapiens; identical to SEQ ID NO: 166581

SEQ ID NO: 537656 - RNA, 64 nt, Homo Sapiens; identical to SEQ ID NO: 166582

SEQ ID NO: 537657 - RNA, 64 nt, Homo Sapiens; identical to SEQ ID NO: 166583

SEQ ID NO: 537658 - RNA, 64 nt, Homo Sapiens; identical to SEQ ID NO: 166584

SEQ ID NO: 537659 - RNA, 64 nt, Homo Sapiens; identical to SEQ ID NO: 166585

SEQ ID NO: 537660 - RNA, 64 nt, Homo Sapiens; identical to SEQ ID NO: 166586

SEQ ID NO: 537661 - RNA, 64 nt, Homo Sapiens; identical to SEQ ID NO: 166587

SEQ ID NO: 537662 - RNA, 64 nt, Homo Sapiens; identical to SEQ ID NO: 166588

SEQ ID NO: 537663 - RNA, 64 nt, Homo Sapiens; identical to SEQ ID NO: 166589

SEQ ID NO: 537664 - RNA, 64 nt, Homo Sapiens; identical to SEQ ID NO: 166590

SEQ ID NO: 537665 - RNA, 64 nt, Homo Sapiens; identical to SEQ ID NO: 166591

SEQ ID NO: 537666 - RNA, 64 nt, Homo Sapiens; identical to SEQ ID NO: 166592

SEQ ID NO: 537667 - RNA, 64 nt, Homo Sapiens; identical to SEQ ID NO: 166593

SEQ ID NO: 537668 - RNA, 64 nt, Homo Sapiens; identical to SEQ ID NO: 166594

SEQ ID NO: 537669 - RNA, 64 nt, Homo Sapiens; identical to SEQ ID NO: 166595

SEQ ID NO: 537670 - RNA, 64 nt, Homo Sapiens; identical to SEQ ID NO: 166596

SEQ ID NO: 537671 - RNA, 64 nt, Homo Sapiens; identical to SEQ ID NO: 166597

SEQ ID NO: 537672 - RNA, 64 nt, Homo Sapiens; identical to SEQ ID NO: 166598

SEQ ID NO: 537673 - RNA, 64 nt, Homo Sapiens; identical to SEQ ID NO: 166599

SEQ ID NO: 537674 - RNA, 64 nt, Homo Sapiens; identical to SEQ ID NO: 166600

SEQ ID NO: 537675 - RNA, 62 nt, Homo Sapiens; identical to SEQ ID NO: 166601

SEQ ID NO: 537676 - RNA, 64 nt, Homo Sapiens; identical to SEQ ID NO: 166602

SEQ ID NO: 537677 - RNA, 64 nt, Homo Sapiens; identical to SEQ ID NO: 166603

SEQ ID NO: 537678 - RNA, 64 nt, Homo Sapiens; identical to SEQ ID NO: 166604

SEQ ID NO: 537679 - RNA, 64 nt, Homo Sapiens; identical to SEQ ID NO: 166605

SEQ ID NO: 537680 - RNA, 64 nt, Homo Sapiens; identical to SEQ ID NO: 166606

SEQ ID NO: 537681 - RNA, 64 nt, Homo Sapiens; identical to SEQ ID NO: 166607

SEQ ID NO: 537682 - RNA, 64 nt, Homo Sapiens; identical to SEQ ID NO: 166608

SEQ ID NO: 537683 - RNA, 64 nt, Homo Sapiens; identical to SEQ ID NO: 166609

SEQ ID NO: 537684 - RNA, 52 nt, Homo Sapiens; identical to SEQ ID NO: 166610

SEQ ID NO: 537685 - RNA, 64 nt, Homo Sapiens; identical to SEQ ID NO: 166611

SEQ ID NO: 537686 - RNA, 64 nt, Homo Sapiens; identical to SEQ ID NO: 166612

SEQ ID NO: 537687 - RNA, 64 nt, Homo Sapiens; identical to SEQ ID NO: 166613

SEQ ID NO: 537688 - RNA, 64 nt, Homo Sapiens; identical to SEQ ID NO: 166614

SEQ ID NO: 537689 - RNA, 64 nt, Homo Sapiens; identical to SEQ ID NO: 166615

SEQ ID NO: 537690 - RNA, 64 nt, Homo Sapiens; identical to SEQ ID NO: 166616

SEQ ID NO: 537691 - RNA, 64 nt, Homo Sapiens; identical to SEQ ID NO: 166617

SEQ ID NO: 537692 - RNA, 64 nt, Homo Sapiens; identical to SEQ ID NO: 333348

SEQ ID NO: 537693 - RNA, 64 nt, Homo Sapiens; identical to SEQ ID NO: 333349

SEQ ID NO: 537694 - RNA, 64 nt, Homo Sapiens; identical to SEQ ID NO: 333350

SEQ ID NO: 537695 - RNA, 64 nt, Homo Sapiens; identical to SEQ ID NO: 333351

SEQ ID NO: 537696 - RNA, 64 nt, Homo Sapiens; identical to SEQ ID NO: 333352

SEQ ID NO: 537697 - RNA, 64 nt, Homo Sapiens; identical to SEQ ID NO: 333353

SEQ ID NO: 537698 - RNA, 64 nt, Homo Sapiens; identical to SEQ ID NO: 333354

SEQ ID NO: 537699 - RNA, 64 nt, Homo Sapiens; identical to SEQ ID NO: 333355

SEQ ID NO: 537700 - RNA, 64 nt, Homo Sapiens; identical to SEQ ID NO: 333356

SEQ ID NO: 537701 - RNA, 64 nt, Homo Sapiens; identical to SEQ ID NO: 333357

SEQ ID NO: 537702 - RNA, 64 nt, Homo Sapiens; identical to SEQ ID NO: 333358

SEQ ID NO: 537703 - RNA, 64 nt, Homo Sapiens; identical to SEQ ID NO: 333359

SEQ ID NO: 537704 - RNA, 64 nt, Homo Sapiens; identical to SEQ ID NO: 333360

SEQ ID NO: 537705 - RNA, 64 nt, Homo Sapiens; identical to SEQ ID NO: 333361

SEQ ID NO: 537706 - RNA, 64 nt, Homo Sapiens; identical to SEQ ID NO: 333362

SEQ ID NO: 537707 - RNA, 64 nt, Homo Sapiens; identical to SEQ ID NO: 333363

SEQ ID NO: 537708 - RNA, 64 nt, Homo Sapiens; identical to SEQ ID NO: 333364

SEQ ID NO: 537709 - RNA, 64 nt, Homo Sapiens; identical to SEQ ID NO: 333365

SEQ ID NO: 537710 - RNA, 64 nt, Homo Sapiens; identical to SEQ ID NO: 333366

SEQ ID NO: 537711 - RNA, 64 nt, Homo Sapiens; identical to SEQ ID NO: 333367

SEQ ID NO: 537712 - RNA, 64 nt, Homo Sapiens; identical to SEQ ID NO: 333368

SEQ ID NO: 537713 - RNA, 64 nt, Homo Sapiens; identical to SEQ ID NO: 333369

SEQ ID NO: 537714 - RNA, 64 nt, Homo Sapiens; identical to SEQ ID NO: 333370

SEQ ID NO: 537715 - RNA, 64 nt, Homo Sapiens; identical to SEQ ID NO: 333371

SEQ ID NO: 537716 - RNA, 64 nt, Homo Sapiens; identical to SEQ ID NO: 333372

SEQ ID NO: 537717 - RNA, 64 nt, Homo Sapiens; identical to SEQ ID NO: 333373

SEQ ID NO: 537718 - RNA, 64 nt, Homo Sapiens; identical to SEQ ID NO: 333374

SEQ ID NO: 537719 - RNA, 64 nt, Homo Sapiens; identical to SEQ ID NO: 333375

SEQ ID NO: 537720 - RNA, 64 nt, Homo Sapiens; identical to SEQ ID NO: 333376

SEQ ID NO: 537721 - RNA, 64 nt, Homo Sapiens; identical to SEQ ID NO: 333377

SEQ ID NO: 537722 - RNA, 64 nt, Homo Sapiens; identical to SEQ ID NO: 333378

SEQ ID NO: 537723 - RNA, 64 nt, Homo Sapiens; identical to SEQ ID NO: 333379

SEQ ID NO: 537724 - RNA, 64 nt, Homo Sapiens; identical to SEQ ID NO: 333380

SEQ ID NO: 537725 - RNA, 64 nt, Homo Sapiens; identical to SEQ ID NO: 333381

SEQ ID NO: 537726 - RNA, 64 nt, Homo Sapiens; identical to SEQ ID NO: 333382

SEQ ID NO: 537727 - RNA, 64 nt, Homo Sapiens; identical to SEQ ID NO: 333383

SEQ ID NO: 537728 - RNA, 64 nt, Homo Sapiens; identical to SEQ ID NO: 333384

SEQ ID NO: 537729 - RNA, 64 nt, Homo Sapiens; identical to SEQ ID NO: 333385

SEQ ID NO: 537730 - RNA, 64 nt, Homo Sapiens; identical to SEQ ID NO: 333386

SEQ ID NO: 537731 - RNA, 64 nt, Homo Sapiens; identical to SEQ ID NO: 333387

SEQ ID NO: 537732 - RNA, 64 nt, Homo Sapiens; identical to SEQ ID NO: 333388

SEQ ID NO: 537733 - RNA, 64 nt, Homo Sapiens; identical to SEQ ID NO: 333389

SEQ ID NO: 537734 - RNA, 64 nt, Homo Sapiens; identical to SEQ ID NO: 333390

SEQ ID NO: 537735 - RNA, 64 nt, Homo Sapiens; identical to SEQ ID NO: 333391

SEQ ID NO: 537736 - RNA, 64 nt, Homo Sapiens; identical to SEQ ID NO: 333392

SEQ ID NO: 537737 - RNA, 64 nt, Homo Sapiens; identical to SEQ ID NO: 333393

SEQ ID NO: 537738 - RNA, 64 nt, Homo Sapiens; identical to SEQ ID NO: 333394

SEQ ID NO: 537739 - RNA, 64 nt, Homo Sapiens; identical to SEQ ID NO: 333395

SEQ ID NO: 537740 - RNA, 64 nt, Homo Sapiens; identical to SEQ ID NO: 333396

SEQ ID NO: 537741 - RNA, 64 nt, Homo Sapiens; identical to SEQ ID NO: 333397

SEQ ID NO: 537742 - RNA, 64 nt, Homo Sapiens; identical to SEQ ID NO: 333398

SEQ ID NO: 537743 - RNA, 64 nt, Homo Sapiens; identical to SEQ ID NO: 333399

SEQ ID NO: 537744 - RNA, 64 nt, Homo Sapiens; identical to SEQ ID NO: 333400

SEQ ID NO: 537745 - RNA, 64 nt, Homo Sapiens; identical to SEQ ID NO: 333401

SEQ ID NO: 537746 - RNA, 64 nt, Homo Sapiens; identical to SEQ ID NO: 333402

SEQ ID NO: 537747 - RNA, 64 nt, Homo Sapiens; identical to SEQ ID NO: 333403

SEQ ID NO: 537748 - RNA, 64 nt, Homo Sapiens; identical to SEQ ID NO: 333404

SEQ ID NO: 537749 - RNA, 64 nt, Homo Sapiens; identical to SEQ ID NO: 333405

SEQ ID NO: 537750 - RNA, 64 nt, Homo Sapiens; identical to SEQ ID NO: 333406

SEQ ID NO: 537751 - RNA, 64 nt, Homo Sapiens; identical to SEQ ID NO: 333407

SEQ ID NO: 537752 - RNA, 64 nt, Homo Sapiens; identical to SEQ ID NO: 333408

SEQ ID NO: 537753 - RNA, 64 nt, Homo Sapiens; identical to SEQ ID NO: 333409

SEQ ID NO: 537754 - RNA, 64 nt, Homo Sapiens; identical to SEQ ID NO: 333410

SEQ ID NO: 537755 - RNA, 64 nt, Homo Sapiens; identical to SEQ ID NO: 333411

SEQ ID NO: 537756 - RNA, 64 nt, Homo Sapiens; identical to SEQ ID NO: 333412

SEQ ID NO: 537757 - RNA, 64 nt, Homo Sapiens; identical to SEQ ID NO: 333413

SEQ ID NO: 537758 - RNA, 64 nt, Homo Sapiens; identical to SEQ ID NO: 333414

SEQ ID NO: 537759 - RNA, 64 nt, Homo Sapiens; identical to SEQ ID NO: 333415

SEQ ID NO: 537760 - RNA, 64 nt, Homo Sapiens; identical to SEQ ID NO: 333416

SEQ ID NO: 537761 - RNA, 64 nt, Homo Sapiens; identical to SEQ ID NO: 333417

SEQ ID NO: 537762 - RNA, 64 nt, Homo Sapiens; identical to SEQ ID NO: 333418

SEQ ID NO: 537763 - RNA, 64 nt, Homo Sapiens; identical to SEQ ID NO: 333419

SEQ ID NO: 537764 - RNA, 64 nt, Homo Sapiens; identical to SEQ ID NO: 333420

SEQ ID NO: 537765 - RNA, 64 nt, Homo Sapiens; identical to SEQ ID NO: 333421

SEQ ID NO: 537766 - RNA, 64 nt, Homo Sapiens; identical to SEQ ID NO: 333422

SEQ ID NO: 537767 - RNA, 64 nt, Homo Sapiens; identical to SEQ ID NO: 333423

SEQ ID NO: 537768 - RNA, 64 nt, Homo Sapiens; identical to SEQ ID NO: 333424

SEQ ID NO: 537769 - RNA, 64 nt, Homo Sapiens; identical to SEQ ID NO: 333425

SEQ ID NO: 537770 - RNA, 64 nt, Homo Sapiens; identical to SEQ ID NO: 333426

SEQ ID NO: 537771 - RNA, 64 nt, Homo Sapiens; identical to SEQ ID NO: 333427

SEQ ID NO: 537772 - RNA, 64 nt, Homo Sapiens; identical to SEQ ID NO: 333428

SEQ ID NO: 537773 - RNA, 64 nt, Homo Sapiens; identical to SEQ ID NO: 333429

SEQ ID NO: 537774 - RNA, 64 nt, Homo Sapiens; identical to SEQ ID NO: 333430

SEQ ID NO: 537775 - RNA, 64 nt, Homo Sapiens; identical to SEQ ID NO: 333431

SEQ ID NO: 537776 - RNA, 64 nt, Homo Sapiens; identical to SEQ ID NO: 333432

SEQ ID NO: 537777 - RNA, 64 nt, Homo Sapiens; identical to SEQ ID NO: 333433

SEQ ID NO: 537778 - RNA, 64 nt, Homo Sapiens; identical to SEQ ID NO: 333434

SEQ ID NO: 537779 - RNA, 64 nt, Homo Sapiens; identical to SEQ ID NO: 333435

SEQ ID NO: 537780 - RNA, 64 nt, Homo Sapiens; identical to SEQ ID NO: 333436

SEQ ID NO: 537781 - RNA, 64 nt, Homo Sapiens; identical to SEQ ID NO: 333437

SEQ ID NO: 537782 - RNA, 64 nt, Homo Sapiens; identical to SEQ ID NO: 333438

SEQ ID NO: 537783 - RNA, 64 nt, Homo Sapiens; identical to SEQ ID NO: 333439

SEQ ID NO: 537784 - RNA, 64 nt, Homo Sapiens; identical to SEQ ID NO: 333440

SEQ ID NO: 537785 - RNA, 64 nt, Homo Sapiens; identical to SEQ ID NO: 333441

SEQ ID NO: 537786 - RNA, 64 nt, Homo Sapiens; identical to SEQ ID NO: 333442

SEQ ID NO: 537787 - RNA, 64 nt, Homo Sapiens; identical to SEQ ID NO: 333443

SEQ ID NO: 537788 - RNA, 64 nt, Homo Sapiens; identical to SEQ ID NO: 333444

SEQ ID NO: 537789 - RNA, 64 nt, Homo Sapiens; identical to SEQ ID NO: 333445

SEQ ID NO: 537790 - RNA, 64 nt, Homo Sapiens; identical to SEQ ID NO: 333446

SEQ ID NO: 537791 - RNA, 64 nt, Homo Sapiens; identical to SEQ ID NO: 333447

SEQ ID NO: 537792 - RNA, 64 nt, Homo Sapiens; identical to SEQ ID NO: 333448

SEQ ID NO: 537793 - RNA, 64 nt, Homo Sapiens; identical to SEQ ID NO: 333449

SEQ ID NO: 537794 - RNA, 64 nt, Homo Sapiens; identical to SEQ ID NO: 333450

SEQ ID NO: 537795 - RNA, 64 nt, Homo Sapiens; identical to SEQ ID NO: 333451

SEQ ID NO: 537796 - RNA, 64 nt, Homo Sapiens; identical to SEQ ID NO: 333452

SEQ ID NO: 537797 - RNA, 64 nt, Homo Sapiens; identical to SEQ ID NO: 333453

SEQ ID NO: 537798 - RNA, 64 nt, Homo Sapiens; identical to SEQ ID NO: 333454

SEQ ID NO: 537799 - RNA, 55 nt, Homo Sapiens; identical to SEQ ID NO: 333455

SEQ ID NO: 537800 - RNA, 64 nt, Homo Sapiens; identical to SEQ ID NO: 333456

SEQ ID NO: 537801 - RNA, 64 nt, Homo Sapiens; identical to SEQ ID NO: 333457

SEQ ID NO: 537802 - RNA, 64 nt, Homo Sapiens; identical to SEQ ID NO: 333458

SEQ ID NO: 537803 - RNA, 64 nt, Homo Sapiens
uagcuaacccccuucccacuccugagucacugaauucgaggaggguggggcagggaaagggcug

SEQ ID NO: 537804 - RNA, 64 nt, Homo Sapiens
aacaggcugcggugauugcaauuaccauccgguguucgaggaucauuggugaagucagcagaua

SEQ ID NO: 537805 - RNA, 64 nt, Homo Sapiens
uuaaguaaaaguugggcacuaaucuggauuaacauucgaggaaaucaguugagcugaauuuaag

SEQ ID NO: 537806 - RNA, 64 nt, Homo Sapiens
ggaauuccgagguaagaauuugucaccuuucaacuucgaggacuauugaaauuggaaauggucu

SEQ ID NO: 537807 - RNA, 64 nt, Homo Sapiens
cuagcacauuuaaacugugcaaauaugaaaauuuuucgaggauuacauuuuaucugaaggcugc

SEQ ID NO: 537808 - RNA, 64 nt, Homo Sapiens
aguauuuuaaucaccaacauggugagccuacccuuucgaggaggagugguguaccaagguuggg

SEQ ID NO: 537809 - RNA, 64 nt, Homo Sapiens
aaccugucccaggucuucucggaagaggggcguuuucgaggaagccgcggcgacuuggagagag

SEQ ID NO: 537810 - RNA, 64 nt, Homo Sapiens
accaaacacuuuccgccucuaugaugucccaugcuucgaggaaacauuuugaauaccaugaucg

SEQ ID NO: 537811 - RNA, 64 nt, Homo Sapiens
uaccaacuguaguuuuagcccaaaaaaguuagaguucgaggaauaaacccaaaaggccaaaaaa

SEQ ID NO: 537812 - RNA, 64 nt, Homo Sapiens
aaaacgccuggcgccgccaccgucgggggcuggcuucgaggacgcccgccugccucgcgggucg

SEQ ID NO: 537813 - RNA, 64 nt, Homo Sapiens
gcugcaggaaacgauugccaacuauacgaauggcuucgaggagauaaacugaaauuugcuauau

SEQ ID NO: 537814 - RNA, 64 nt, Homo Sapiens
uaaaaucgaacaaaacauaggaugaaaaacuaaauucgaggaauaaaaaugaaacuucaaaauu

SEQ ID NO: 537815 - RNA, 64 nt, Homo Sapiens
aggcuguuauuuugggccugcaaggccaacacuauucgaggaggcccauggcucaagagggcug

SEQ ID NO: 537816 - RNA, 64 nt, Homo Sapiens
ccuuucugcucuugugaagaaaaaaaaaagcauuuucgaggaaagaauuaugcaauuucuuuug

SEQ ID NO: 537817 - RNA, 64 nt, Homo Sapiens
cacuguguaagaagacuguuaguggugauauuauuucgaggaucgauugauugugguugaaagg

SEQ ID NO: 537818 - RNA, 64 nt, Homo Sapiens
ugcagugcgucuagcaccuaucaucuuaaacacuuucgaggauuaucuuaaguguauugcucuu

SEQ ID NO: 537819 - RNA, 64 nt, Homo Sapiens
acguagguaacucuccccucgggggaaagugagguucgaggauguuucuaucacuguuaagggg

SEQ ID NO: 537820 - RNA, 64 nt, Homo Sapiens
gacaccauaacucaugcaauaaaacugauugucauucgaggagcaaacuuaagaguaguuuauu

SEQ ID NO: 537821 - RNA, 64 nt, Homo Sapiens
ccuccucucccuaguguagagcaagccaguguccuucgaggaacccacccggcuggccgggaag

SEQ ID NO: 537822 - RNA, 64 nt, Homo Sapiens
gucaucuccuucaaauacuuuaauaaagaaguauuucgaggagauaucuguccaaaaagguuug

SEQ ID NO: 537823 - RNA, 64 nt, Homo Sapiens
guccuauauaucaaaccucuaacugacguuucuuuucgaggaaguggcuuggugggugcagccc

SEQ ID NO: 537824 - RNA, 64 nt, Homo Sapiens
uuucuuuagcaugcuacaguuauuaaucuggacauucgaggaauuggccgcugucacugcuugu

SEQ ID NO: 537825 - RNA, 64 nt, Homo Sapiens
ccagaucuccggauugucgggggacgcaggacucuucgaggaaaaccagccgaaugagaucaaa

SEQ ID NO: 537826 - RNA, 64 nt, Homo Sapiens
caauuaauugugguugugucauugagcccuggaauucgaggaugaggcugaggugggaggaucu

SEQ ID NO: 537827 - RNA, 64 nt, Homo Sapiens
uuuuaauucaaugaaaucugagguuaaugcgagguucgaggagagguuauagauaaaacuacca

SEQ ID NO: 537828 - RNA, 64 nt, Homo Sapiens
uccaggcgcauaggguagaaugcagggacugggauucgaggacuccauguguacagccuaccca

SEQ ID NO: 537829 - RNA, 64 nt, Homo Sapiens
uccugaagguggguggccugacgaggggaucaccuucgaggacuccaggagccugaucaggugu

SEQ ID NO: 537830 - RNA, 64 nt, Homo Sapiens
ccucugaugugaggagggacuccuggggccucccuucgaggagccagcaaaucugagagaaccg

SEQ ID NO: 537831 - RNA, 64 nt, Homo Sapiens
uuauaauggcauauuuuuucacuuacuaauucuauucgaggauugaaccgaggaagcacgugaa

SEQ ID NO: 537832 - RNA, 64 nt, Homo Sapiens
cucaggucccgucacaugucucaaggguccagcguucgaggaagcacuguuguagaugacagag

SEQ ID NO: 537833 - RNA, 64 nt, Homo Sapiens
aaagaaauugucagcuauacaaaacaagugugacuucgaggaccauguuuggcauuuuaaagua

SEQ ID NO: 537834 - RNA, 64 nt, Homo Sapiens
accacgcaguaacuaaagcuuuaggaugacuguauucgaggagugccguguguugcaugcagcu

SEQ ID NO: 537835 - RNA, 64 nt, Homo Sapiens
ccuguacgagcagcgggccgagccacgcagcggcuucgaggagcuggugcguugccccaccugg

SEQ ID NO: 537836 - RNA, 64 nt, Homo Sapiens
aggcauuggaggugguuucuaggagcuuggaugguucgaggaauaaaacagacuagauugcaau

SEQ ID NO: 537837 - RNA, 64 nt, Homo Sapiens
gcaaugcagagagggcauagcuuuggaugcugucuucgaggacagugggagggaccuagggccu

SEQ ID NO: 537838 - RNA, 64 nt, Homo Sapiens
agagcagagaaagaaguccuuucucuuuauugaguucgaggacuacaaccaauuuacacugcca

SEQ ID NO: 537839 - RNA, 64 nt, Homo Sapiens
ggaaaggccccaaucuugcccaccuuugugcagcuucgaggacaccuguguucugggcuggggc

SEQ ID NO: 537840 - RNA, 64 nt, Homo Sapiens
aggaggggacuuucuauguucacgucccaccuucuucgaggacaugaccaagggacaggaucau

SEQ ID NO: 537841 - RNA, 64 nt, Homo Sapiens
cucggacggccgugcauuuucucgucucacgcaguucgaggaggacccuagaaagccaggagcu

SEQ ID NO: 537842 - RNA, 64 nt, Homo Sapiens
ggccgacuugggagccucaggcccacgcccacccuucgaggaaggugucaccuggaccccuuca

SEQ ID NO: 537843 - RNA, 64 nt, Homo Sapiens
caguauaaugugcuauuaauggaaccaauaguaauucgaggacuaguugggagauucuggggua

SEQ ID NO: 537844 - RNA, 58 nt, Homo Sapiens
gcacccgcccguccuaagccgacuccccuucgaggauugugucccccauggucgcuga

SEQ ID NO: 537845 - RNA, 64 nt, Homo Sapiens
cuccaggagagaagugccuggcccgccagcuggcuucgaggaacugggcugggcccuccgcacg

SEQ ID NO: 537846 - RNA, 64 nt, Homo Sapiens
auugcaacaaagccaguagugccacugugugguauucgaggauuuuuuuaugaugccaaaagcu

SEQ ID NO: 537847 - RNA, 64 nt, Homo Sapiens
cagagaaccuguucagauacaggccaguuucuucuucgaggaaagccaagcuccucaaacaggg

SEQ ID NO: 537848 - RNA, 64 nt, Homo Sapiens
aagaggauuuuggugugaaaaaggauggguaaccuucgaggaagauuaaaaauuagcaacccga

SEQ ID NO: 537849 - RNA, 64 nt, Homo Sapiens
ucagcaaggugggggaggggcggcuggcaguuucuucgaggacccuccaucuacggccgcagag

SEQ ID NO: 537850 - RNA, 64 nt, Homo Sapiens
ccggaacccgucacuauucuagacuucccuggcauucgaggagcccuuugaacuuuccaaagug

SEQ ID NO: 537851 - RNA, 64 nt, Homo Sapiens
cuugccacuugaagccuggagguuuccuuccagauucgaggaucacccccagcaguugccaugg

SEQ ID NO: 537852 - RNA, 64 nt, Homo Sapiens; identical to SEQ ID NO: 74792

SEQ ID NO: 537853 - RNA, 64 nt, Homo Sapiens; identical to SEQ ID NO: 74793

SEQ ID NO: 537854 - RNA, 64 nt, Homo Sapiens; identical to SEQ ID NO: 74794

SEQ ID NO: 537855 - RNA, 64 nt, Homo Sapiens; identical to SEQ ID NO: 74795

SEQ ID NO: 537856 - RNA, 64 nt, Homo Sapiens; identical to SEQ ID NO: 74796

SEQ ID NO: 537857 - RNA, 64 nt, Homo Sapiens; identical to SEQ ID NO: 74797

SEQ ID NO: 537858 - RNA, 64 nt, Homo Sapiens; identical to SEQ ID NO: 74798

SEQ ID NO: 537859 - RNA, 64 nt, Homo Sapiens; identical to SEQ ID NO: 74799

SEQ ID NO: 537860 - RNA, 64 nt, Homo Sapiens; identical to SEQ ID NO: 74800

SEQ ID NO: 537861 - RNA, 64 nt, Homo Sapiens; identical to SEQ ID NO: 74801

SEQ ID NO: 537862 - RNA, 64 nt, Homo Sapiens; identical to SEQ ID NO: 74802

SEQ ID NO: 537863 - RNA, 64 nt, Homo Sapiens; identical to SEQ ID NO: 74803

SEQ ID NO: 537864 - RNA, 64 nt, Homo Sapiens; identical to SEQ ID NO: 74804

SEQ ID NO: 537865 - RNA, 64 nt, Homo Sapiens; identical to SEQ ID NO: 74805

SEQ ID NO: 537866 - RNA, 64 nt, Homo Sapiens; identical to SEQ ID NO: 74806

SEQ ID NO: 537867 - RNA, 64 nt, Homo Sapiens; identical to SEQ ID NO: 74807

SEQ ID NO: 537868 - RNA, 62 nt, Homo Sapiens
gacgaggacucguggcuggagagagccacacagcguguaaccugaagucaucuagauuaugg

SEQ ID NO: 537869 - RNA, 62 nt, Homo Sapiens
gcguuugggagcucguguguugccuauugagagcguguaaugggagggggugugucugggug

SEQ ID NO: 537870 - RNA, 62 nt, Homo Sapiens
uguuaccugguuugucucuuacacuuuugcaagcguguaagaacauguuuguggugugaugc

SEQ ID NO: 537871 - RNA, 62 nt, Homo Sapiens
uagcugggcggggcucgaggcuggugccaggcgcguguaaaugguuuuguuuugcacguuug

SEQ ID NO: 537872 - RNA, 62 nt, Homo Sapiens
gagggcggggauacugauucagaaauccuguagcguguaauaaaagaagaggaaauggcaug

SEQ ID NO: 537873 - RNA, 62 nt, Homo Sapiens
cucguucgguuguuggaccucuuucacucccugcguguaagaaggugaaucacgugggaaaa

SEQ ID NO: 537874 - RNA, 62 nt, Homo Sapiens
cacgcacuggccugcacagagagcaugggugagcguguaaaagcuuggcccugugcccuaca

SEQ ID NO: 537875 - RNA, 62 nt, Homo Sapiens
guaguguagucaggugcucacuucgggggcgugcguguaacugccuggaugccagcuguguc

SEQ ID NO: 537876 - RNA, 62 nt, Homo Sapiens
aaauacuauuaaucauaggcucaaacaaaagugcguguaauucagaaagcaaggaaguaaac

SEQ ID NO: 537877 - RNA, 62 nt, Homo Sapiens
aauaaguuaucuaaauuuccaacucaaauaaagcguguaauaguauauuguuuuuuaucuuu

SEQ ID NO: 537878 - RNA, 62 nt, Homo Sapiens
ggcggggaaccuaggcagggcuggcuuucuuagcguguaacuuguguagcagcacagggccc

SEQ ID NO: 537879 - RNA, 62 nt, Homo Sapiens
gacauaaauggagggguguguacauuauacaugcguguaaggauaguguaugcaaguuaaug

SEQ ID NO: 537880 - RNA, 62 nt, Homo Sapiens
acauguucugugccugcucagggcccacaacagcguguaaacggugcccgcucuucccuccu

SEQ ID NO: 537881 - RNA, 62 nt, Homo Sapiens
aauugccuacauuuaucaugguccugaauguagcguguaagcuuguguuucuugggcagucu

SEQ ID NO: 537882 - RNA, 62 nt, Homo Sapiens
ucacuggguugcgguuauuuuccugguaguuugcguguaagaaagggagaauauaguuuuag

SEQ ID NO: 537883 - RNA, 62 nt, Homo Sapiens
uccuauuucacuuugccucccaucacacaacugcguguaaauggugucacuuguucaccucu

SEQ ID NO: 537884 - RNA, 62 nt, Homo Sapiens
gggccugccccucaucugcgcugggccuaucagcguguaagguuagaacagugccaaagaac

SEQ ID NO: 537885 - RNA, 62 nt, Homo Sapiens
ggaagcacugccauuagacugcuuugccuuuagcguguaaauugauguugagugggagauug

SEQ ID NO: 537886 - RNA, 62 nt, Homo Sapiens
uauuuccugaagcauauuuuucauagaauguagcguguaaauagcuuuuuaaauaacuucuu

SEQ ID NO: 537887 - RNA, 62 nt, Homo Sapiens
aaauacaaaaguagccaggcaugguggcgcaugcguguaaucccagcuacuugggaggcuga

SEQ ID NO: 537888 - RNA, 62 nt, Homo Sapiens
augaauucauuuuauccugaguugauauaacugcguguaauuuauuugcugcuuuguugcaa

SEQ ID NO: 537889 - RNA, 62 nt, Homo Sapiens
uaauccauuuagaucuuuaaugcuuuggaaaugcguguaacaguacugcaauaaucacagcu

SEQ ID NO: 537890 - RNA, 62 nt, Homo Sapiens
auccacuagagauggguuugaggauuuuccaagcguguaauaaugauguuuuuccuaacaug

SEQ ID NO: 537891 - RNA, 62 nt, Homo Sapiens
uucccaaguagcaaagagaccauggagaaggugcguguaaagagauauauuuuuguaagagg

SEQ ID NO: 537892 - RNA, 62 nt, Homo Sapiens
aggagugacgagaaaguuaaucagcuaaagcagcguguaaauacccaaauaccgcgaaugca

SEQ ID NO: 537893 - RNA, 62 nt, Homo Sapiens
acccacaacccuuaucugguucugaccagugugcguguaacuuuaugaucugaggggaaaaa

SEQ ID NO: 537894 - RNA, 62 nt, Homo Sapiens
aaugcagcccccugaagacaucacaagagguggcguguaaggggcuugaccaaugaccuaug

SEQ ID NO: 537895 - RNA, 62 nt, Homo Sapiens
gcguugaugcucagaaucgccuaccugugccugcguguaaaccacagccucagaccagcuau

SEQ ID NO: 537896 - RNA, 62 nt, Homo Sapiens
gggggcucuccuaggauccccuuuccguaaaagcguguaacaaggguguaaauauuuauaau

SEQ ID NO: 537897 - RNA, 62 nt, Homo Sapiens
cagcccugcccccauugcgucugcacaccccugcguguaacugcauuccaaccacuaauaaa

SEQ ID NO: 537898 - RNA, 62 nt, Homo Sapiens
ggcucugcuauugugcguccgcccccuccccagcguguaagugggaggaggacccccgcacc

SEQ ID NO: 537899 - RNA, 62 nt, Homo Sapiens
auggcaguagaaucugaauccauuggcaauuggcguguaaugaagugcuuucuuuuaagugg

SEQ ID NO: 537900 - RNA, 62 nt, Homo Sapiens
ucuauaacuugagaucuuuccggggccuacaggcguguaagacagcuuggucuggucugugc

SEQ ID NO: 537901 - RNA, 62 nt, Homo Sapiens
uguugacaugcaaaagcagcaauagacaauaugcguguaaaugaguguggcuguaauccaag

SEQ ID NO: 537902 - RNA, 64 nt, Homo Sapiens
aggaauugcaaaaaauauuuuaaaaauuuauuacugaauuuaaaaauauuuuagaaguuuugua

SEQ ID NO: 537903 - RNA, 64 nt, Homo Sapiens
ccuguuggcccugacaggaagggaggaagccuggugaauuuagugagcagcuggccugggucac

SEQ ID NO: 537904 - RNA, 64 nt, Homo Sapiens
uguuauuuacuacauugugauuuaacuuuggaugugaauuuagucacccuuagcccuucagaua

SEQ ID NO: 537905 - RNA, 64 nt, Homo Sapiens
gaauauuuuagggucaaaguguaauuauucauaaugaauuuacucuguugauauuaaaaagacg

SEQ ID NO: 537906 - RNA, 64 nt, Homo Sapiens
uuccccaccuaagucgaaacagucauaaaacuccugaauuuaauugauacucagaacaaaagaa

SEQ ID NO: 537907 - RNA, 62 nt, Homo Sapiens
aacacuuaugaaguuucuuaagcagacuguggugaauuuagccuguuccccuuucuagguga

SEQ ID NO: 537908 - RNA, 64 nt, Homo Sapiens
augcauuauaucuggagacuugcacuuguauggaugaauuuauuacauucaacauauuuaauuu

SEQ ID NO: 537909 - RNA, 64 nt, Homo Sapiens
gccaacauuugggccucugaauguaucuguuauuugaauuuaaguauuugaaaaggaaugguca

SEQ ID NO: 537910 - RNA, 64 nt, Homo Sapiens
aaaugaauucauggguagaugauuugugcagaucugaauuuaagaacauuuccuuuuucugugg

SEQ ID NO: 537911 - RNA, 64 nt, Homo Sapiens
uaaaaauguauuucaaacuauucuuacugugcugugaauuuauaucuucuucugcaagaccugg

SEQ ID NO: 537912 - RNA, 64 nt, Homo Sapiens
cauuauuauuacuuuuuaaacugaagucuugcauugaauuuaguaggauucuaaacagaugucc

SEQ ID NO: 537913 - RNA, 64 nt, Homo Sapiens
caugaguggccuuaauaaauuaaaggacaaacagugaauuuaaggagaugaaaaccugcauuuu

SEQ ID NO: 537914 - RNA, 64 nt, Homo Sapiens
cuuugcucuguguucucccgagaugucuucacccugaauuuagauuaauugaagggcauuaauu

SEQ ID NO: 537915 - RNA, 64 nt, Homo Sapiens
aaucuggauuugccuuguguagcacaaaauuuagugaauuuauauaauuugcccaaauacaugg

SEQ ID NO: 537916 - RNA, 64 nt, Homo Sapiens
caguaggagcaaacuagccaacagguacugucuuugaauuuacuacuguaagacuaagcagugu

SEQ ID NO: 537917 - RNA, 64 nt, Homo Sapiens
gaauauugugcuuuuuguuguuuguaaauagaauugaauuuaaauacaccaggauaaaucuuau

SEQ ID NO: 537918 - RNA, 64 nt, Homo Sapiens
agaguauuuggaaguuaagaauugauuagacuagugaauuuaggaguauuugaggugggugggg

SEQ ID NO: 537919 - RNA, 64 nt, Homo Sapiens
ccuacauguuucaauaccaguuauauggagugcuugaauuuaauaagcaguuuuuacggaguuu

SEQ ID NO: 537920 - RNA, 64 nt, Homo Sapiens
gaaacaacaugguuccaagaauguuuugaguauuugaauuuagagccauuucaaguucugaaaa

SEQ ID NO: 537921 - RNA, 64 nt, Homo Sapiens
cugacauuccuaaaauagauaccaaaauacaaugugaauuuauuuaaaaaggcucagguuuuug

SEQ ID NO: 537922 - RNA, 64 nt, Homo Sapiens
uugaugcagcuuuaagaugguggggaggauggggugaauuuaggaaaggaauuugugguuauaa

SEQ ID NO: 537923 - RNA, 64 nt, Homo Sapiens
ucuuguccucguaauaccauuuggauuuuauuucugaauuuaaauaguaaaauauuuaugaugc

SEQ ID NO: 537924 - RNA, 64 nt, Homo Sapiens
acaauugaccuauacauugcauucagcaagcuccugaauuuagaacugccgucaguguagugua

SEQ ID NO: 537925 - RNA, 64 nt, Homo Sapiens
aacucacugcacugauucauuagggccuacaaauugaauuuaaaaaauacaaagacauuuuugc

SEQ ID NO: 537926 - RNA, 64 nt, Homo Sapiens
uguuguaagucuauuuuaacagucuucagaaugcugaauuuacugaugugcaugcauucuauuu

SEQ ID NO: 537927 - RNA, 64 nt, Homo Sapiens
uguagaauaaauuuuaccaaaaauucugacuuucugaauuuaaaguggauuguaauacacacug

SEQ ID NO: 537928 - RNA, 64 nt, Homo Sapiens
gaaugugaagacccaguggaaauuacagaccugaugaauuuauaugaucaugaucuuacuggug

SEQ ID NO: 537929 - RNA, 64 nt, Homo Sapiens
gaauuuguggaggcauugccaaggccaaagcuacugaauuuagcauuguguaaaugaaucuugg

SEQ ID NO: 537930 - RNA, 64 nt, Homo Sapiens
ggaaucaaguuaaguaggugggaggccuguugggugaauuuaauaaagcaguaauaucuucucu

SEQ ID NO: 537931 - RNA, 64 nt, Homo Sapiens
augaaaauucauguccauauuaucuaugucuuucugaauuuaaaauacuauaaaacacugagag

SEQ ID NO: 537932 - RNA, 64 nt, Homo Sapiens
ugaauuaauuaacauuugagacuucauaacagcaugaauuuauuaauuuuaggagacuucauua

SEQ ID NO: 537933 - RNA, 64 nt, Homo Sapiens
auguuuauauaccuaauauuuauuaugccauaucugaauuuauuaaaaacaacacagaaaucuc

SEQ ID NO: 537934 - RNA, 64 nt, Homo Sapiens
agaaugagagucaugauguuuugauuuaugaaggugaauuuaaugcaaaaguggguaacacuac

SEQ ID NO: 537935 - RNA, 64 nt, Homo Sapiens
uucaggucuucaacaugaugcaucacuacaaccuugaauuuaaugaccuugacuuuaaauuuuu

SEQ ID NO: 537936 - RNA, 64 nt, Homo Sapiens
gucuuuaucgcuaagaccuuagacaaucugucuuugaauuuaaaaacgcuagugguuuguccuu

SEQ ID NO: 537937 - RNA, 64 nt, Homo Sapiens
augauuuaugucuauacaaauaauuucucugaggugaauuuaauucauuuauuuucaaauaagc

SEQ ID NO: 537938 - RNA, 64 nt, Homo Sapiens
aaauaagcauaauuugcucaauuaaguaugaguuugaauuuaguuugaaaucuggaauuggcca

SEQ ID NO: 537939 - RNA, 64 nt, Homo Sapiens
ucauuugacaagccuauuuuuucccuggaaaggaugaauuuacaugguagggucuaccuucugc

SEQ ID NO: 537940 - RNA, 64 nt, Homo Sapiens
uguauuuuuaaauuuaaccuuucagaaguuagccugaauuuaacgaggugaauaaaacgggauu

SEQ ID NO: 537941 - RNA, 64 nt, Homo Sapiens
gaaauucuuuaggauaaccaaauuuugcaaaaucugaauuuaaguugaugacuuggagaguagg

SEQ ID NO: 537942 - RNA, 64 nt, Homo Sapiens
auuaaaucucaauuaguucacagaaaucacaggaugaauuuagauuuuauaccaauauuauaug

SEQ ID NO: 537943 - RNA, 64 nt, Homo Sapiens
agacguaaggaaagugauuauuguuuaauaucugugaauuuaggaugugcaucucuuuucagag

SEQ ID NO: 537944 - RNA, 64 nt, Homo Sapiens
auaauagcccagugagagcugaaugaaaagggacugaauuuaaauauuuguaagaacuuuguga

SEQ ID NO: 537945 - RNA, 64 nt, Homo Sapiens
uuaaaauauucaauucugcuuuuuaauuuuuaagugaauuuaguuugaaaagcaugauuauaca

SEQ ID NO: 537946 - RNA, 64 nt, Homo Sapiens
gacaguuccucuucauucuaaagguuuacuccauugaauuuaaggcauuuguucauuccagugu

SEQ ID NO: 537947 - RNA, 64 nt, Homo Sapiens
caacaucuaggugcuuaauuaaaugcugcucaaaugaauuuaacagaaucucuauucaaaauca

SEQ ID NO: 537948 - RNA, 64 nt, Homo Sapiens
uuaaaauuuuaauagccaccuuauucccaagauuugaauuuauucacauauuucacuacuuaaa

SEQ ID NO: 537949 - RNA, 64 nt, Homo Sapiens
uuguuuagaaaaacuaaugcgauuuaaaauguuuugaauuuaaccccuuugaaaaaauauaaca

SEQ ID NO: 537950 - RNA, 64 nt, Homo Sapiens
agcacuuuauuuaaaaaaaagggcaacauauauuugaauuuaaaguauauuucaguuuucuuua

SEQ ID NO: 537951 - RNA, 64 nt, Homo Sapiens
ggagaaugagguuguccgugguggcuguuuguagugaauuuauucaaaaaguaucaauguguau

SEQ ID NO: 537952 - RNA, 64 nt, Homo Sapiens
aaccagacaacgucaugcaguagauugcgagagcugaauuuagaaaccuggaauuaagaccacc

SEQ ID NO: 537953 - RNA, 64 nt, Homo Sapiens
acagcagcauaagaaauauacaaacaguauccuaugaauuuagugguuuuauguggauaugcca

SEQ ID NO: 537954 - RNA, 64 nt, Homo Sapiens
aaaacacaagugguaugcuuuagaucugcacaugugaauuuagcauaaucacugggaauuugaa

SEQ ID NO: 537955 - RNA, 64 nt, Homo Sapiens
ugcguaugaaucuaugacagagcaaugcuuuuaaugaauuuaaggcaaaaaagguggagaggga

SEQ ID NO: 537956 - RNA, 64 nt, Homo Sapiens
gggcuagaucuaagauuauucccaugagaaauguugaauuuaugaagaauagauuuuaaggcuu

SEQ ID NO: 537957 - RNA, 64 nt, Homo Sapiens
cuuccauugagaaaaaaaugaaacugauauauucugaauuuauuuauucucauucguuuuuuaa

SEQ ID NO: 537958 - RNA, 64 nt, Homo Sapiens
agcguauuucaggguccaaauaauguaccaaugaugaauuuaucuuuccccaaguauuaaacuc

SEQ ID NO: 537959 - RNA, 64 nt, Homo Sapiens
ggauaagaaggucugaggugucuaauuauacucuugaauuuauuuuuauuccaaauaauguacu

SEQ ID NO: 537960 - RNA, 64 nt, Homo Sapiens
aauuggaaagauauauauagagccagaaagaaucugaauuuauggaauaaugacugcugucugc

SEQ ID NO: 537961 - RNA, 64 nt, Homo Sapiens
ugauaccuaaauccuucuuaaacacacauuucuuugaauuuagguuugaauuuagcaaccuaga

SEQ ID NO: 537962 - RNA, 64 nt, Homo Sapiens
aaccuagaaacacacauuucucauacuuuuucuuugaauuuagcuuuaaaugaaccaaaccaaa

SEQ ID NO: 537963 - RNA, 64 nt, Homo Sapiens
gagaaguucugcaucuuuuaaugcugaaucuugcugaauuuaaagacauaguuuccaggcugca

SEQ ID NO: 537964 - RNA, 64 nt, Homo Sapiens
acuguacauucuguggcuuaucucugcuuuguauugaauuuauuaaugcuaaaagaaaauguau

SEQ ID NO: 537965 - RNA, 64 nt, Homo Sapiens
aaacuguuuugguaguuggauuucauuaucuuagugaauuuagucauuuuacaauauguuugua

SEQ ID NO: 537966 - RNA, 64 nt, Homo Sapiens
uucccaaaaaaagggccauuugcuugcauuacuuugaauuuaauguugcgcuugugcacugugu

SEQ ID NO: 537967 - RNA, 64 nt, Homo Sapiens
caaaaguccuaaauaccuucagugagcaaagucuugaauuuauucuaaaaauuacggucugacu

SEQ ID NO: 537968 - RNA, 64 nt, Homo Sapiens
auauuugcacuaugaagguaaaguaaaaugcaugugaauuuaucaucuuguuaugaguauguaa

SEQ ID NO: 537969 - RNA, 64 nt, Homo Sapiens
aauuacaucuuugcaguucuuuguacaacuuucuugaauuuagagguuucuuuuguuuuucauu

SEQ ID NO: 537970 - RNA, 64 nt, Homo Sapiens
ggguuuagauuucugaaagcuuucauuuuuucuuugaauuuauaugaaacugaaauuacaugag

SEQ ID NO: 537971 - RNA, 64 nt, Homo Sapiens; identical to SEQ ID NO: 218432

SEQ ID NO: 537972 - RNA, 64 nt, Homo Sapiens; identical to SEQ ID NO: 218433

SEQ ID NO: 537973 - RNA, 64 nt, Homo Sapiens; identical to SEQ ID NO: 218434

SEQ ID NO: 537974 - RNA, 64 nt, Homo Sapiens; identical to SEQ ID NO: 218435

SEQ ID NO: 537975 - RNA, 64 nt, Homo Sapiens; identical to SEQ ID NO: 218436

SEQ ID NO: 537976 - RNA, 64 nt, Homo Sapiens; identical to SEQ ID NO: 218437

SEQ ID NO: 537977 - RNA, 64 nt, Homo Sapiens; identical to SEQ ID NO: 218438

SEQ ID NO: 537978 - RNA, 64 nt, Homo Sapiens; identical to SEQ ID NO: 218439

SEQ ID NO: 537979 - RNA, 64 nt, Homo Sapiens; identical to SEQ ID NO: 352829

SEQ ID NO: 537980 - RNA, 64 nt, Homo Sapiens; identical to SEQ ID NO: 352830

SEQ ID NO: 537981 - RNA, 64 nt, Homo Sapiens; identical to SEQ ID NO: 352831

SEQ ID NO: 537982 - RNA, 64 nt, Homo Sapiens; identical to SEQ ID NO: 352832

SEQ ID NO: 537983 - RNA, 64 nt, Homo Sapiens; identical to SEQ ID NO: 352833

SEQ ID NO: 537984 - RNA, 64 nt, Homo Sapiens; identical to SEQ ID NO: 352834

SEQ ID NO: 537985 - RNA, 64 nt, Homo Sapiens; identical to SEQ ID NO: 352835

SEQ ID NO: 537986 - RNA, 64 nt, Homo Sapiens; identical to SEQ ID NO: 352836

SEQ ID NO: 537987 - RNA, 64 nt, Homo Sapiens; identical to SEQ ID NO: 352837

SEQ ID NO: 537988 - RNA, 64 nt, Homo Sapiens; identical to SEQ ID NO: 352838

SEQ ID NO: 537989 - RNA, 64 nt, Homo Sapiens; identical to SEQ ID NO: 352839

SEQ ID NO: 537990 - RNA, 64 nt, Homo Sapiens; identical to SEQ ID NO: 352840

SEQ ID NO: 537991 - RNA, 64 nt, Homo Sapiens; identical to SEQ ID NO: 352841

SEQ ID NO: 537992 - RNA, 64 nt, Homo Sapiens; identical to SEQ ID NO: 352842

SEQ ID NO: 537993 - RNA, 64 nt, Homo Sapiens; identical to SEQ ID NO: 352843

SEQ ID NO: 537994 - RNA, 64 nt, Homo Sapiens; identical to SEQ ID NO: 352844

SEQ ID NO: 537995 - RNA, 64 nt, Homo Sapiens; identical to SEQ ID NO: 352845

SEQ ID NO: 537996 - RNA, 64 nt, Homo Sapiens; identical to SEQ ID NO: 352846

SEQ ID NO: 537997 - RNA, 64 nt, Homo Sapiens; identical to SEQ ID NO: 352847

SEQ ID NO: 537998 - RNA, 64 nt, Homo Sapiens; identical to SEQ ID NO: 352848

SEQ ID NO: 537999 - RNA, 64 nt, Homo Sapiens; identical to SEQ ID NO: 352849

SEQ ID NO: 538000 - RNA, 64 nt, Homo Sapiens; identical to SEQ ID NO: 352850

SEQ ID NO: 538001 - RNA, 64 nt, Homo Sapiens; identical to SEQ ID NO: 352851

SEQ ID NO: 538002 - RNA, 64 nt, Homo Sapiens; identical to SEQ ID NO: 352852

SEQ ID NO: 538003 - RNA, 64 nt, Homo Sapiens; identical to SEQ ID NO: 352853

SEQ ID NO: 538004 - RNA, 64 nt, Homo Sapiens; identical to SEQ ID NO: 352854

SEQ ID NO: 538005 - RNA, 64 nt, Homo Sapiens; identical to SEQ ID NO: 352855

SEQ ID NO: 538006 - RNA, 64 nt, Homo Sapiens; identical to SEQ ID NO: 352856

SEQ ID NO: 538007 - RNA, 64 nt, Homo Sapiens; identical to SEQ ID NO: 352857

SEQ ID NO: 538008 - RNA, 64 nt, Homo Sapiens; identical to SEQ ID NO: 352858

SEQ ID NO: 538009 - RNA, 64 nt, Homo Sapiens; identical to SEQ ID NO: 352859

SEQ ID NO: 538010 - RNA, 64 nt, Homo Sapiens; identical to SEQ ID NO: 352860

SEQ ID NO: 538011 - RNA, 64 nt, Homo Sapiens; identical to SEQ ID NO: 352861

SEQ ID NO: 538012 - RNA, 64 nt, Homo Sapiens; identical to SEQ ID NO: 352862

SEQ ID NO: 538013 - RNA, 64 nt, Homo Sapiens; identical to SEQ ID NO: 352863

SEQ ID NO: 538014 - RNA, 64 nt, Homo Sapiens; identical to SEQ ID NO: 352864

SEQ ID NO: 538015 - RNA, 64 nt, Homo Sapiens; identical to SEQ ID NO: 352865

SEQ ID NO: 538016 - RNA, 64 nt, Homo Sapiens; identical to SEQ ID NO: 352866

SEQ ID NO: 538017 - RNA, 64 nt, Homo Sapiens; identical to SEQ ID NO: 352867

SEQ ID NO: 538018 - RNA, 64 nt, Homo Sapiens; identical to SEQ ID NO: 352868

SEQ ID NO: 538019 - RNA, 64 nt, Homo Sapiens; identical to SEQ ID NO: 352869

SEQ ID NO: 538020 - RNA, 64 nt, Homo Sapiens; identical to SEQ ID NO: 485963

SEQ ID NO: 538021 - RNA, 64 nt, Homo Sapiens; identical to SEQ ID NO: 485964

SEQ ID NO: 538022 - RNA, 64 nt, Homo Sapiens; identical to SEQ ID NO: 485965

SEQ ID NO: 538023 - RNA, 64 nt, Homo Sapiens; identical to SEQ ID NO: 485966

SEQ ID NO: 538024 - RNA, 64 nt, Homo Sapiens; identical to SEQ ID NO: 485967

SEQ ID NO: 538025 - RNA, 64 nt, Homo Sapiens; identical to SEQ ID NO: 485968

SEQ ID NO: 538026 - RNA, 64 nt, Homo Sapiens; identical to SEQ ID NO: 485969

SEQ ID NO: 538027 - RNA, 64 nt, Homo Sapiens; identical to SEQ ID NO: 485970

SEQ ID NO: 538028 - RNA, 64 nt, Homo Sapiens; identical to SEQ ID NO: 316995

SEQ ID NO: 538029 - RNA, 64 nt, Homo Sapiens; identical to SEQ ID NO: 316996

SEQ ID NO: 538030 - RNA, 64 nt, Homo Sapiens; identical to SEQ ID NO: 316997

SEQ ID NO: 538031 - RNA, 64 nt, Homo Sapiens; identical to SEQ ID NO: 316998

SEQ ID NO: 538032 - RNA, 64 nt, Homo Sapiens; identical to SEQ ID NO: 316999

SEQ ID NO: 538033 - RNA, 64 nt, Homo Sapiens; identical to SEQ ID NO: 317000

SEQ ID NO: 538034 - RNA, 64 nt, Homo Sapiens; identical to SEQ ID NO: 317001

SEQ ID NO: 538035 - RNA, 64 nt, Homo Sapiens; identical to SEQ ID NO: 317002

SEQ ID NO: 538036 - RNA, 64 nt, Homo Sapiens; identical to SEQ ID NO: 317003

SEQ ID NO: 538037 - RNA, 60 nt, Homo Sapiens; identical to SEQ ID NO: 317004

SEQ ID NO: 538038 - RNA, 64 nt, Homo Sapiens; identical to SEQ ID NO: 317005

SEQ ID NO: 538039 - RNA, 64 nt, Homo Sapiens; identical to SEQ ID NO: 317006

SEQ ID NO: 538040 - RNA, 64 nt, Homo Sapiens; identical to SEQ ID NO: 317007

SEQ ID NO: 538041 - RNA, 64 nt, Homo Sapiens; identical to SEQ ID NO: 317008

SEQ ID NO: 538042 - RNA, 64 nt, Homo Sapiens; identical to SEQ ID NO: 317009

SEQ ID NO: 538043 - RNA, 64 nt, Homo Sapiens; identical to SEQ ID NO: 317010

SEQ ID NO: 538044 - RNA, 64 nt, Homo Sapiens; identical to SEQ ID NO: 317011

SEQ ID NO: 538045 - RNA, 64 nt, Homo Sapiens; identical to SEQ ID NO: 317012

SEQ ID NO: 538046 - RNA, 64 nt, Homo Sapiens; identical to SEQ ID NO: 317013

SEQ ID NO: 538047 - RNA, 64 nt, Homo Sapiens; identical to SEQ ID NO: 317014

SEQ ID NO: 538048 - RNA, 64 nt, Homo Sapiens; identical to SEQ ID NO: 317015

SEQ ID NO: 538049 - RNA, 64 nt, Homo Sapiens; identical to SEQ ID NO: 317016

SEQ ID NO: 538050 - RNA, 64 nt, Homo Sapiens; identical to SEQ ID NO: 317017

SEQ ID NO: 538051 - RNA, 64 nt, Homo Sapiens; identical to SEQ ID NO: 317018

SEQ ID NO: 538052 - RNA, 64 nt, Homo Sapiens; identical to SEQ ID NO: 317019

SEQ ID NO: 538053 - RNA, 64 nt, Homo Sapiens; identical to SEQ ID NO: 317020

SEQ ID NO: 538054 - RNA, 64 nt, Homo Sapiens; identical to SEQ ID NO: 317021

SEQ ID NO: 538055 - RNA, 62 nt, Homo Sapiens; identical to SEQ ID NO: 317022

SEQ ID NO: 538056 - RNA, 64 nt, Homo Sapiens; identical to SEQ ID NO: 317023

SEQ ID NO: 538057 - RNA, 64 nt, Homo Sapiens; identical to SEQ ID NO: 317024

SEQ ID NO: 538058 - RNA, 64 nt, Homo Sapiens; identical to SEQ ID NO: 317025

SEQ ID NO: 538059 - RNA, 64 nt, Homo Sapiens; identical to SEQ ID NO: 317026

SEQ ID NO: 538060 - RNA, 64 nt, Homo Sapiens; identical to SEQ ID NO: 317027

SEQ ID NO: 538061 - RNA, 64 nt, Homo Sapiens; identical to SEQ ID NO: 317028

SEQ ID NO: 538062 - RNA, 64 nt, Homo Sapiens; identical to SEQ ID NO: 317029

SEQ ID NO: 538063 - RNA, 53 nt, Homo Sapiens; identical to SEQ ID NO: 317030

SEQ ID NO: 538064 - RNA, 54 nt, Homo Sapiens; identical to SEQ ID NO: 317031

SEQ ID NO: 538065 - RNA, 64 nt, Homo Sapiens; identical to SEQ ID NO: 317032

SEQ ID NO: 538066 - RNA, 64 nt, Homo Sapiens; identical to SEQ ID NO: 317033

SEQ ID NO: 538067 - RNA, 64 nt, Homo Sapiens; identical to SEQ ID NO: 317034

SEQ ID NO: 538068 - RNA, 64 nt, Homo Sapiens; identical to SEQ ID NO: 317035

SEQ ID NO: 538069 - RNA, 64 nt, Homo Sapiens; identical to SEQ ID NO: 317036

SEQ ID NO: 538070 - RNA, 64 nt, Homo Sapiens; identical to SEQ ID NO: 317037

SEQ ID NO: 538071 - RNA, 64 nt, Homo Sapiens; identical to SEQ ID NO: 317038

SEQ ID NO: 538072 - RNA, 64 nt, Homo Sapiens; identical to SEQ ID NO: 317039

SEQ ID NO: 538073 - RNA, 64 nt, Homo Sapiens; identical to SEQ ID NO: 317040

SEQ ID NO: 538074 - RNA, 64 nt, Homo Sapiens; identical to SEQ ID NO: 317041

SEQ ID NO: 538075 - RNA, 64 nt, Homo Sapiens; identical to SEQ ID NO: 317042

SEQ ID NO: 538076 - RNA, 64 nt, Homo Sapiens; identical to SEQ ID NO: 317043

SEQ ID NO: 538077 - RNA, 64 nt, Homo Sapiens; identical to SEQ ID NO: 317044

SEQ ID NO: 538078 - RNA, 64 nt, Homo Sapiens; identical to SEQ ID NO: 317045

SEQ ID NO: 538079 - RNA, 64 nt, Homo Sapiens; identical to SEQ ID NO: 317046

SEQ ID NO: 538080 - RNA, 64 nt, Homo Sapiens; identical to SEQ ID NO: 317047

SEQ ID NO: 538081 - RNA, 64 nt, Homo Sapiens; identical to SEQ ID NO: 317048

SEQ ID NO: 538082 - RNA, 64 nt, Homo Sapiens; identical to SEQ ID NO: 317049

SEQ ID NO: 538083 - RNA, 64 nt, Homo Sapiens; identical to SEQ ID NO: 317050

SEQ ID NO: 538084 - RNA, 64 nt, Homo Sapiens; identical to SEQ ID NO: 317051

SEQ ID NO: 538085 - RNA, 64 nt, Homo Sapiens; identical to SEQ ID NO: 317052

SEQ ID NO: 538086 - RNA, 64 nt, Homo Sapiens; identical to SEQ ID NO: 317053

SEQ ID NO: 538087 - RNA, 64 nt, Homo Sapiens; identical to SEQ ID NO: 317054

SEQ ID NO: 538088 - RNA, 64 nt, Homo Sapiens; identical to SEQ ID NO: 317055

SEQ ID NO: 538089 - RNA, 64 nt, Homo Sapiens; identical to SEQ ID NO: 317056

SEQ ID NO: 538090 - RNA, 64 nt, Homo Sapiens; identical to SEQ ID NO: 317057

SEQ ID NO: 538091 - RNA, 64 nt, Homo Sapiens; identical to SEQ ID NO: 317058

SEQ ID NO: 538092 - RNA, 64 nt, Homo Sapiens; identical to SEQ ID NO: 317059

SEQ ID NO: 538093 - RNA, 64 nt, Homo Sapiens; identical to SEQ ID NO: 317060

SEQ ID NO: 538094 - RNA, 64 nt, Homo Sapiens; identical to SEQ ID NO: 317061

SEQ ID NO: 538095 - RNA, 64 nt, Homo Sapiens; identical to SEQ ID NO: 317062

SEQ ID NO: 538096 - RNA, 64 nt, Homo Sapiens; identical to SEQ ID NO: 317063

SEQ ID NO: 538097 - RNA, 64 nt, Homo Sapiens; identical to SEQ ID NO: 317064

SEQ ID NO: 538098 - RNA, 55 nt, Homo Sapiens; identical to SEQ ID NO: 317065

SEQ ID NO: 538099 - RNA, 64 nt, Homo Sapiens; identical to SEQ ID NO: 317066

SEQ ID NO: 538100 - RNA, 63 nt, Homo Sapiens; identical to SEQ ID NO: 317067

SEQ ID NO: 538101 - RNA, 64 nt, Homo Sapiens; identical to SEQ ID NO: 317068

SEQ ID NO: 538102 - RNA, 64 nt, Homo Sapiens; identical to SEQ ID NO: 317069

SEQ ID NO: 538103 - RNA, 64 nt, Homo Sapiens; identical to SEQ ID NO: 317070

SEQ ID NO: 538104 - RNA, 64 nt, Homo Sapiens; identical to SEQ ID NO: 317071

SEQ ID NO: 538105 - RNA, 64 nt, Homo Sapiens; identical to SEQ ID NO: 317072

SEQ ID NO: 538106 - RNA, 64 nt, Homo Sapiens; identical to SEQ ID NO: 317073

SEQ ID NO: 538107 - RNA, 64 nt, Homo Sapiens; identical to SEQ ID NO: 317074

SEQ ID NO: 538108 - RNA, 64 nt, Homo Sapiens; identical to SEQ ID NO: 317075

SEQ ID NO: 538109 - RNA, 64 nt, Homo Sapiens; identical to SEQ ID NO: 317076

SEQ ID NO: 538110 - RNA, 64 nt, Homo Sapiens; identical to SEQ ID NO: 317077

SEQ ID NO: 538111 - RNA, 64 nt, Homo Sapiens; identical to SEQ ID NO: 317078

SEQ ID NO: 538112 - RNA, 64 nt, Homo Sapiens; identical to SEQ ID NO: 317079

SEQ ID NO: 538113 - RNA, 64 nt, Homo Sapiens; identical to SEQ ID NO: 317080

SEQ ID NO: 538114 - RNA, 64 nt, Homo Sapiens; identical to SEQ ID NO: 317081

SEQ ID NO: 538115 - RNA, 64 nt, Homo Sapiens; identical to SEQ ID NO: 317082

SEQ ID NO: 538116 - RNA, 64 nt, Homo Sapiens; identical to SEQ ID NO: 317083

SEQ ID NO: 538117 - RNA, 64 nt, Homo Sapiens; identical to SEQ ID NO: 317084

SEQ ID NO: 538118 - RNA, 64 nt, Homo Sapiens; identical to SEQ ID NO: 317085

SEQ ID NO: 538119 - RNA, 64 nt, Homo Sapiens; identical to SEQ ID NO: 317086

SEQ ID NO: 538120 - RNA, 64 nt, Homo Sapiens; identical to SEQ ID NO: 317087

SEQ ID NO: 538121 - RNA, 64 nt, Homo Sapiens; identical to SEQ ID NO: 317088

SEQ ID NO: 538122 - RNA, 64 nt, Homo Sapiens; identical to SEQ ID NO: 317089

SEQ ID NO: 538123 - RNA, 64 nt, Homo Sapiens; identical to SEQ ID NO: 317090

SEQ ID NO: 538124 - RNA, 64 nt, Homo Sapiens; identical to SEQ ID NO: 316995

SEQ ID NO: 538125 - RNA, 64 nt, Homo Sapiens; identical to SEQ ID NO: 316996

SEQ ID NO: 538126 - RNA, 64 nt, Homo Sapiens; identical to SEQ ID NO: 316997

SEQ ID NO: 538127 - RNA, 64 nt, Homo Sapiens; identical to SEQ ID NO: 316998

SEQ ID NO: 538128 - RNA, 64 nt, Homo Sapiens; identical to SEQ ID NO: 316999

SEQ ID NO: 538129 - RNA, 64 nt, Homo Sapiens; identical to SEQ ID NO: 317000

SEQ ID NO: 538130 - RNA, 64 nt, Homo Sapiens; identical to SEQ ID NO: 317001

SEQ ID NO: 538131 - RNA, 64 nt, Homo Sapiens; identical to SEQ ID NO: 317002

SEQ ID NO: 538132 - RNA, 64 nt, Homo Sapiens; identical to SEQ ID NO: 317003

SEQ ID NO: 538133 - RNA, 60 nt, Homo Sapiens; identical to SEQ ID NO: 317004

SEQ ID NO: 538134 - RNA, 64 nt, Homo Sapiens; identical to SEQ ID NO: 317005

SEQ ID NO: 538135 - RNA, 64 nt, Homo Sapiens; identical to SEQ ID NO: 317006

SEQ ID NO: 538136 - RNA, 64 nt, Homo Sapiens; identical to SEQ ID NO: 317007

SEQ ID NO: 538137 - RNA, 64 nt, Homo Sapiens; identical to SEQ ID NO: 317008

SEQ ID NO: 538138 - RNA, 64 nt, Homo Sapiens; identical to SEQ ID NO: 317009

SEQ ID NO: 538139 - RNA, 64 nt, Homo Sapiens; identical to SEQ ID NO: 317010

SEQ ID NO: 538140 - RNA, 64 nt, Homo Sapiens; identical to SEQ ID NO: 317011

SEQ ID NO: 538141 - RNA, 64 nt, Homo Sapiens; identical to SEQ ID NO: 317012

SEQ ID NO: 538142 - RNA, 64 nt, Homo Sapiens; identical to SEQ ID NO: 317013

SEQ ID NO: 538143 - RNA, 64 nt, Homo Sapiens; identical to SEQ ID NO: 317014

SEQ ID NO: 538144 - RNA, 64 nt, Homo Sapiens; identical to SEQ ID NO: 317015

SEQ ID NO: 538145 - RNA, 64 nt, Homo Sapiens; identical to SEQ ID NO: 317016

SEQ ID NO: 538146 - RNA, 64 nt, Homo Sapiens; identical to SEQ ID NO: 317017

SEQ ID NO: 538147 - RNA, 64 nt, Homo Sapiens; identical to SEQ ID NO: 317018

SEQ ID NO: 538148 - RNA, 64 nt, Homo Sapiens; identical to SEQ ID NO: 317019

SEQ ID NO: 538149 - RNA, 64 nt, Homo Sapiens; identical to SEQ ID NO: 317020

SEQ ID NO: 538150 - RNA, 64 nt, Homo Sapiens; identical to SEQ ID NO: 317021

SEQ ID NO: 538151 - RNA, 62 nt, Homo Sapiens; identical to SEQ ID NO: 317022

SEQ ID NO: 538152 - RNA, 64 nt, Homo Sapiens; identical to SEQ ID NO: 317023

SEQ ID NO: 538153 - RNA, 64 nt, Homo Sapiens; identical to SEQ ID NO: 317024

SEQ ID NO: 538154 - RNA, 64 nt, Homo Sapiens; identical to SEQ ID NO: 317025

SEQ ID NO: 538155 - RNA, 64 nt, Homo Sapiens; identical to SEQ ID NO: 317026

SEQ ID NO: 538156 - RNA, 64 nt, Homo Sapiens; identical to SEQ ID NO: 317027

SEQ ID NO: 538157 - RNA, 64 nt, Homo Sapiens; identical to SEQ ID NO: 317028

SEQ ID NO: 538158 - RNA, 64 nt, Homo Sapiens; identical to SEQ ID NO: 317029

SEQ ID NO: 538159 - RNA, 53 nt, Homo Sapiens; identical to SEQ ID NO: 317030

SEQ ID NO: 538160 - RNA, 54 nt, Homo Sapiens; identical to SEQ ID NO: 317031

SEQ ID NO: 538161 - RNA, 64 nt, Homo Sapiens; identical to SEQ ID NO: 317032

SEQ ID NO: 538162 - RNA, 64 nt, Homo Sapiens; identical to SEQ ID NO: 317033

SEQ ID NO: 538163 - RNA, 64 nt, Homo Sapiens; identical to SEQ ID NO: 317034

SEQ ID NO: 538164 - RNA, 64 nt, Homo Sapiens; identical to SEQ ID NO: 317035

SEQ ID NO: 538165 - RNA, 64 nt, Homo Sapiens; identical to SEQ ID NO: 317036

SEQ ID NO: 538166 - RNA, 64 nt, Homo Sapiens; identical to SEQ ID NO: 317037

SEQ ID NO: 538167 - RNA, 64 nt, Homo Sapiens; identical to SEQ ID NO: 317038

SEQ ID NO: 538168 - RNA, 64 nt, Homo Sapiens; identical to SEQ ID NO: 317039

SEQ ID NO: 538169 - RNA, 64 nt, Homo Sapiens; identical to SEQ ID NO: 317040

SEQ ID NO: 538170 - RNA, 64 nt, Homo Sapiens; identical to SEQ ID NO: 317041

SEQ ID NO: 538171 - RNA, 64 nt, Homo Sapiens; identical to SEQ ID NO: 317042

SEQ ID NO: 538172 - RNA, 64 nt, Homo Sapiens; identical to SEQ ID NO: 317043

SEQ ID NO: 538173 - RNA, 64 nt, Homo Sapiens; identical to SEQ ID NO: 317044

SEQ ID NO: 538174 - RNA, 64 nt, Homo Sapiens; identical to SEQ ID NO: 317045

SEQ ID NO: 538175 - RNA, 64 nt, Homo Sapiens; identical to SEQ ID NO: 317046

SEQ ID NO: 538176 - RNA, 64 nt, Homo Sapiens; identical to SEQ ID NO: 317047

SEQ ID NO: 538177 - RNA, 64 nt, Homo Sapiens; identical to SEQ ID NO: 317048

SEQ ID NO: 538178 - RNA, 64 nt, Homo Sapiens; identical to SEQ ID NO: 317049

SEQ ID NO: 538179 - RNA, 64 nt, Homo Sapiens; identical to SEQ ID NO: 317050

SEQ ID NO: 538180 - RNA, 64 nt, Homo Sapiens; identical to SEQ ID NO: 317051

SEQ ID NO: 538181 - RNA, 64 nt, Homo Sapiens; identical to SEQ ID NO: 317052

SEQ ID NO: 538182 - RNA, 64 nt, Homo Sapiens; identical to SEQ ID NO: 317053

SEQ ID NO: 538183 - RNA, 64 nt, Homo Sapiens; identical to SEQ ID NO: 317054

SEQ ID NO: 538184 - RNA, 64 nt, Homo Sapiens; identical to SEQ ID NO: 317055

SEQ ID NO: 538185 - RNA, 64 nt, Homo Sapiens; identical to SEQ ID NO: 317056

SEQ ID NO: 538186 - RNA, 64 nt, Homo Sapiens; identical to SEQ ID NO: 317057

SEQ ID NO: 538187 - RNA, 64 nt, Homo Sapiens; identical to SEQ ID NO: 317058

SEQ ID NO: 538188 - RNA, 64 nt, Homo Sapiens; identical to SEQ ID NO: 317059

SEQ ID NO: 538189 - RNA, 64 nt, Homo Sapiens; identical to SEQ ID NO: 317060

SEQ ID NO: 538190 - RNA, 64 nt, Homo Sapiens; identical to SEQ ID NO: 317061

SEQ ID NO: 538191 - RNA, 64 nt, Homo Sapiens; identical to SEQ ID NO: 317062

SEQ ID NO: 538192 - RNA, 64 nt, Homo Sapiens; identical to SEQ ID NO: 317063

SEQ ID NO: 538193 - RNA, 64 nt, Homo Sapiens; identical to SEQ ID NO: 317064

SEQ ID NO: 538194 - RNA, 55 nt, Homo Sapiens; identical to SEQ ID NO: 317065

SEQ ID NO: 538195 - RNA, 64 nt, Homo Sapiens; identical to SEQ ID NO: 317066

SEQ ID NO: 538196 - RNA, 63 nt, Homo Sapiens; identical to SEQ ID NO: 317067

SEQ ID NO: 538197 - RNA, 64 nt, Homo Sapiens; identical to SEQ ID NO: 317068

SEQ ID NO: 538198 - RNA, 64 nt, Homo Sapiens; identical to SEQ ID NO: 317069

SEQ ID NO: 538199 - RNA, 64 nt, Homo Sapiens; identical to SEQ ID NO: 317070

SEQ ID NO: 538200 - RNA, 64 nt, Homo Sapiens; identical to SEQ ID NO: 317071

SEQ ID NO: 538201 - RNA, 64 nt, Homo Sapiens; identical to SEQ ID NO: 317072

SEQ ID NO: 538202 - RNA, 64 nt, Homo Sapiens; identical to SEQ ID NO: 317073

SEQ ID NO: 538203 - RNA, 64 nt, Homo Sapiens; identical to SEQ ID NO: 317074

SEQ ID NO: 538204 - RNA, 64 nt, Homo Sapiens; identical to SEQ ID NO: 317075

SEQ ID NO: 538205 - RNA, 64 nt, Homo Sapiens; identical to SEQ ID NO: 317076

SEQ ID NO: 538206 - RNA, 64 nt, Homo Sapiens; identical to SEQ ID NO: 317077

SEQ ID NO: 538207 - RNA, 64 nt, Homo Sapiens; identical to SEQ ID NO: 317078

SEQ ID NO: 538208 - RNA, 64 nt, Homo Sapiens; identical to SEQ ID NO: 317079

SEQ ID NO: 538209 - RNA, 64 nt, Homo Sapiens; identical to SEQ ID NO: 317080

SEQ ID NO: 538210 - RNA, 64 nt, Homo Sapiens; identical to SEQ ID NO: 317081

SEQ ID NO: 538211 - RNA, 64 nt, Homo Sapiens; identical to SEQ ID NO: 317082

SEQ ID NO: 538212 - RNA, 64 nt, Homo Sapiens; identical to SEQ ID NO: 317083

SEQ ID NO: 538213 - RNA, 64 nt, Homo Sapiens; identical to SEQ ID NO: 317084

SEQ ID NO: 538214 - RNA, 64 nt, Homo Sapiens; identical to SEQ ID NO: 317085

SEQ ID NO: 538215 - RNA, 64 nt, Homo Sapiens; identical to SEQ ID NO: 317086

SEQ ID NO: 538216 - RNA, 64 nt, Homo Sapiens; identical to SEQ ID NO: 317087

SEQ ID NO: 538217 - RNA, 64 nt, Homo Sapiens; identical to SEQ ID NO: 317088

SEQ ID NO: 538218 - RNA, 64 nt, Homo Sapiens; identical to SEQ ID NO: 317089

SEQ ID NO: 538219 - RNA, 64 nt, Homo Sapiens; identical to SEQ ID NO: 317090

SEQ ID NO: 538220 - RNA, 64 nt, Homo Sapiens
uucuucuauaaauguuuuucccugcacaacaaaaacagugaaagaaaugcuuaucuguaauuuu

SEQ ID NO: 538221 - RNA, 64 nt, Homo Sapiens
acaguguuacagauaacuucaaguuuauaaaaauacagugaaauuucuacaaagcucuaaaucu

SEQ ID NO: 538222 - RNA, 64 nt, Homo Sapiens
uccuacugagcauuugcaccucuguucauuucacacagugaaacgcaauuuuaccuaguuugca

SEQ ID NO: 538223 - RNA, 64 nt, Homo Sapiens
ugacgacauacaugcuacuuuuuuuuaguucaauacagugaaggucuuuguuaugacagugaau

SEQ ID NO: 538224 - RNA, 64 nt, Homo Sapiens
uuuuuaguucaauacagugaaggucuuuguuaugacagugaauauugcuuuuauuauuauuauu

SEQ ID NO: 538225 - RNA, 64 nt, Homo Sapiens
uauccuucuaagcagauucuuccuacugcaaaggacagugaauccagcaacucaguggauccaa

SEQ ID NO: 538226 - RNA, 64 nt, Homo Sapiens
gggaccaggaugcuaaaugucaagguaguccuauacagugaagaauuguccugcucaagaugcc

SEQ ID NO: 538227 - RNA, 64 nt, Homo Sapiens
uggagcugagagacaguaaaggagcgggcaaccaacagugaauggagucuauaucuauuuucac

SEQ ID NO: 538228 - RNA, 64 nt, Homo Sapiens
acuguguuagucuguaucaaaaagucguaucuuaacagugaacauggccacuaaguauaugaaa

SEQ ID NO: 538229 - RNA, 64 nt, Homo Sapiens
ccaaacacuuaaagcaauucuggcaugcacgggaacagugaauguguuugcaguaagaagcugc

SEQ ID NO: 538230 - RNA, 64 nt, Homo Sapiens
auugaaaacaaccuggaaguccaccuuguuuguaacagugaaaaagguuuguagauaaauguug

SEQ ID NO: 538231 - RNA, 64 nt, Homo Sapiens
ugcacacacuuucaugcagugcucuuuguagcuaacagugaagauuuaccucguucugcucaga

SEQ ID NO: 538232 - RNA, 64 nt, Homo Sapiens
agacugugccauggugagaaaaauguaaaauccuacagugaaaugagcagcccuuacaguauug

SEQ ID NO: 538233 - RNA, 64 nt, Homo Sapiens
uucuuugaaucuuucugugucuucacauuuuucuacagugaauuuaaucaaauaguaaaguugu

SEQ ID NO: 538234 - RNA, 64 nt, Homo Sapiens
aacucugguacgguggcacccucaggaguggaggacagugaacuuccuugaagagggagugacu

SEQ ID NO: 538235 - RNA, 57 nt, Homo Sapiens
gugcagaggagaacaacuaguuccaaaacagugaacguggaggaugaagaugcugcg

SEQ ID NO: 538236 - RNA, 64 nt, Homo Sapiens
ucccaaaccaggcugccccagccccagcccagcaacagugaacucccuugggucaagacaguac

SEQ ID NO: 538237 - RNA, 64 nt, Homo Sapiens
gguuaucaagaaagugcccugugcuaaugaugagacagugaauuuuuuuuuuuuuucgagaugg

SEQ ID NO: 538238 - RNA, 64 nt, Homo Sapiens
acaaccucugccuuccagguucaagugauuagagacagugaaauuuuuauggaauacugcaccu

SEQ ID NO: 538239 - RNA, 64 nt, Homo Sapiens
gaaaacacagaguaaacccugcagagaauggaaaacagugaacgguacuguaauuugucaaaau

SEQ ID NO: 538240 - RNA, 64 nt, Homo Sapiens
uacucuguaggguacuguaaaggugauuuuuaggacagugaaagggaaaggagggauggcaggu

SEQ ID NO: 538241 - RNA, 64 nt, Homo Sapiens
ugaaaugauuuuuauuuuuccuuugguauuugcuacagugaaaagaaguuuggaaaguagauac

SEQ ID NO: 538242 - RNA, 64 nt, Homo Sapiens
aggaauuuaggcauuaccucagggaaaagccuugacagugaaaagaaacuacuuaaucgcuaau

SEQ ID NO: 538243 - RNA, 64 nt, Homo Sapiens
ggcuugauugcuuaaacuauuguaaagaaacugaacagugaaguaccaaguauucauuucauga

SEQ ID NO: 538244 - RNA, 64 nt, Homo Sapiens; identical to SEQ ID NO: 538243

SEQ ID NO: 538245 - RNA, 64 nt, Homo Sapiens
ugccuuccaccugccagagguggaaaaaaagaggacagugaacccaccaccauauugccauuag

SEQ ID NO: 538246 - RNA, 64 nt, Homo Sapiens
ugucauucacaaaaacucaaccuucccauuguuuacagugaaggagggcugccugguugacucu

SEQ ID NO: 538247 - RNA, 64 nt, Homo Sapiens
uggcuuccggcacacuccccgaucugugcacugaacagugaagguuugcacugaaguugcaaaa

SEQ ID NO: 538248 - RNA, 64 nt, Homo Sapiens
cagugaacagggauucuccaaaucaugaagaaaaacagugaaucgguccugagcugcuguuucc

SEQ ID NO: 538249 - RNA, 64 nt, Homo Sapiens
cucaacagcagaaaagaacaauggugugugugaaacagugaaguuauuaaaggucuugggguag

SEQ ID NO: 538250 - RNA, 64 nt, Homo Sapiens
uucauucauguucuuucaguaauauuuuuuauucacagugaaauagugauacuuuauuuuauau

SEQ ID NO: 538251 - RNA, 64 nt, Homo Sapiens
uugcuuaaaggcacuggccauuugucagggaagcacagugaagccuaaaauucugugauucaga

SEQ ID NO: 538252 - RNA, 64 nt, Homo Sapiens
guuccaguuuccacugggcaccaaaacacugcacacagugaaguagcagcuaaaaaagagugga

SEQ ID NO: 538253 - RNA, 64 nt, Homo Sapiens
ccugucuccacuaaaaauacgaccauccuggcuaacagugaaacucaugaggucaggagaucgc

SEQ ID NO: 538254 - RNA, 64 nt, Homo Sapiens
cccaugucugcuaaaauuacccauccuggcuaauacagugaaacacaaggucaggaaauugaga

SEQ ID NO: 538255 - RNA, 64 nt, Homo Sapiens
gucuuguuggacgagaaaacaauaacgauaaaagacagugaaagaaaauaacgauaaaagacag

SEQ ID NO: 538256 - RNA, 64 nt, Homo Sapiens
gauaaaagacagugaaagaaaauaacgauaaaagacagugaaagaaaauaacaauaaaagacaa

SEQ ID NO: 538257 - RNA, 64 nt, Homo Sapiens
uacagaaacagaacauagccaaaaagauguuaaaacagugaaaugaccccaucucuauauaaaa

SEQ ID NO: 538258 - RNA, 64 nt, Homo Sapiens
ugggugcgguggugcacuccuaaggcuuuaaaagacagugaagcauugaagagaacguccaccu

SEQ ID NO: 538259 - RNA, 64 nt, Homo Sapiens
uaugaagagaacguccacuuuaaggcuuuaaaagacagugaagcugguuguagggcucacuuuu

SEQ ID NO: 538260 - RNA, 64 nt, Homo Sapiens
gaccccaucucuauauaaaaaaaaagauguuaaaacagugaaauuacagaaacagaacauagcc

SEQ ID NO: 538261 - RNA, 64 nt, Homo Sapiens
gugcaacaagaaacuucucccucacccccuccuuuacccucagauuuggagaugguaaccaaag

SEQ ID NO: 538262 - RNA, 64 nt, Homo Sapiens
uuuugcccaucuggagacugcaggcucccuuccuuacccucagagagugcuuaugguggguguu

SEQ ID NO: 538263 - RNA, 64 nt, Homo Sapiens
cacaggacugaagcuuaauucuaccuuagacugguacccucaaacagaacugaacuagacuccc

SEQ ID NO: 538264 - RNA, 64 nt, Homo Sapiens
gucguuuucaacauagcggguuuuuuccuggaucuacccucaugucaccaaucaguuuuuguuc

SEQ ID NO: 538265 - RNA, 64 nt, Homo Sapiens
acuucuucucccccgcgaguuuuccccacuuacuuacccucaccugucaggccugacggggagg

SEQ ID NO: 538266 - RNA, 64 nt, Homo Sapiens
ugcucauccccaccugucuucaacagcuccccauuacccucaggacaaugucugaacucuccag

SEQ ID NO: 538267 - RNA, 64 nt, Homo Sapiens; identical to SEQ ID NO: 180322

SEQ ID NO: 538268 - RNA, 64 nt, Homo Sapiens; identical to SEQ ID NO: 180323

SEQ ID NO: 538269 - RNA, 64 nt, Homo Sapiens; identical to SEQ ID NO: 180324

SEQ ID NO: 538270 - RNA, 64 nt, Homo Sapiens; identical to SEQ ID NO: 180325

SEQ ID NO: 538271 - RNA, 64 nt, Homo Sapiens; identical to SEQ ID NO: 180326

SEQ ID NO: 538272 - RNA, 64 nt, Homo Sapiens; identical to SEQ ID NO: 180327

SEQ ID NO: 538273 - RNA, 64 nt, Homo Sapiens; identical to SEQ ID NO: 180328

SEQ ID NO: 538274 - RNA, 64 nt, Homo Sapiens; identical to SEQ ID NO: 180329

SEQ ID NO: 538275 - RNA, 64 nt, Homo Sapiens; identical to SEQ ID NO: 180330

SEQ ID NO: 538276 - RNA, 64 nt, Homo Sapiens; identical to SEQ ID NO: 180331

SEQ ID NO: 538277 - RNA, 64 nt, Homo Sapiens; identical to SEQ ID NO: 180332

SEQ ID NO: 538278 - RNA, 64 nt, Homo Sapiens; identical to SEQ ID NO: 180333

SEQ ID NO: 538279 - RNA, 64 nt, Homo Sapiens; identical to SEQ ID NO: 180334

SEQ ID NO: 538280 - RNA, 64 nt, Homo Sapiens; identical to SEQ ID NO: 180335

SEQ ID NO: 538281 - RNA, 64 nt, Homo Sapiens; identical to SEQ ID NO: 180336

SEQ ID NO: 538282 - RNA, 64 nt, Homo Sapiens; identical to SEQ ID NO: 180337

SEQ ID NO: 538283 - RNA, 64 nt, Homo Sapiens; identical to SEQ ID NO: 180338

SEQ ID NO: 538284 - RNA, 64 nt, Homo Sapiens; identical to SEQ ID NO: 180339

SEQ ID NO: 538285 - RNA, 64 nt, Homo Sapiens
cuaauaaaccuccaguguuagcuaauuuguuauucuaggagaauuuuagaugucgguucuuuga

SEQ ID NO: 538286 - RNA, 64 nt, Homo Sapiens
uuuauaaaacaacagaacagccaggaaaauggugcuaggagagacaguggagaggccagagaag

SEQ ID NO: 538287 - RNA, 64 nt, Homo Sapiens
uaaaucuuacaacucaagagguggcagccacccucuaggagacaaaacuacccccacugacaag

SEQ ID NO: 538288 - RNA, 64 nt, Homo Sapiens
aagcccauguaucugaccuuacgugccuuuugaacuaggagaaucgggcuaauuuauuaaugau

SEQ ID NO: 538289 - RNA, 64 nt, Homo Sapiens
auuuuaagguugagacuccaagucuccuaaaauucuaggagagaaauaaagagucuguuuuugc

SEQ ID NO: 538290 - RNA, 64 nt, Homo Sapiens
agcacuucuauaugcaaggugaauauguacugagcuaggagacuucccugcaaaaucucuguuc

SEQ ID NO: 538291 - RNA, 64 nt, Homo Sapiens; identical to SEQ ID NO: 84248

SEQ ID NO: 538292 - RNA, 64 nt, Homo Sapiens; identical to SEQ ID NO: 84249

SEQ ID NO: 538293 - RNA, 64 nt, Homo Sapiens; identical to SEQ ID NO: 84250

SEQ ID NO: 538294 - RNA, 64 nt, Homo Sapiens; identical to SEQ ID NO: 84251

SEQ ID NO: 538295 - RNA, 64 nt, Homo Sapiens; identical to SEQ ID NO: 84252

SEQ ID NO: 538296 - RNA, 64 nt, Homo Sapiens; identical to SEQ ID NO: 84253

SEQ ID NO: 538297 - RNA, 64 nt, Homo Sapiens; identical to SEQ ID NO: 84254

SEQ ID NO: 538298 - RNA, 64 nt, Homo Sapiens; identical to SEQ ID NO: 84255

SEQ ID NO: 538299 - RNA, 64 nt, Homo Sapiens; identical to SEQ ID NO: 84256

SEQ ID NO: 538300 - RNA, 64 nt, Homo Sapiens; identical to SEQ ID NO: 84257

SEQ ID NO: 538301 - RNA, 64 nt, Homo Sapiens; identical to SEQ ID NO: 84258

SEQ ID NO: 538302 - RNA, 64 nt, Homo Sapiens; identical to SEQ ID NO: 84259

SEQ ID NO: 538303 - RNA, 64 nt, Homo Sapiens; identical to SEQ ID NO: 84260

SEQ ID NO: 538304 - RNA, 55 nt, Homo Sapiens; identical to SEQ ID NO: 84261

SEQ ID NO: 538305 - RNA, 64 nt, Homo Sapiens; identical to SEQ ID NO: 84262

SEQ ID NO: 538306 - RNA, 64 nt, Homo Sapiens; identical to SEQ ID NO: 84263

SEQ ID NO: 538307 - RNA, 64 nt, Homo Sapiens; identical to SEQ ID NO: 84264

SEQ ID NO: 538308 - RNA, 64 nt, Homo Sapiens; identical to SEQ ID NO: 84265

SEQ ID NO: 538309 - RNA, 64 nt, Homo Sapiens; identical to SEQ ID NO: 84266

SEQ ID NO: 538310 - RNA, 64 nt, Homo Sapiens; identical to SEQ ID NO: 84267

SEQ ID NO: 538311 - RNA, 64 nt, Homo Sapiens; identical to SEQ ID NO: 84268

SEQ ID NO: 538312 - RNA, 64 nt, Homo Sapiens; identical to SEQ ID NO: 414052

SEQ ID NO: 538313 - RNA, 64 nt, Homo Sapiens; identical to SEQ ID NO: 414053

SEQ ID NO: 538314 - RNA, 64 nt, Homo Sapiens; identical to SEQ ID NO: 414054

SEQ ID NO: 538315 - RNA, 64 nt, Homo Sapiens; identical to SEQ ID NO: 414055

SEQ ID NO: 538316 - RNA, 64 nt, Homo Sapiens; identical to SEQ ID NO: 414056

SEQ ID NO: 538317 - RNA, 64 nt, Homo Sapiens; identical to SEQ ID NO: 414057

SEQ ID NO: 538318 - RNA, 64 nt, Homo Sapiens; identical to SEQ ID NO: 414058

SEQ ID NO: 538319 - RNA, 64 nt, Homo Sapiens; identical to SEQ ID NO: 414059

SEQ ID NO: 538320 - RNA, 64 nt, Homo Sapiens
ccugcaaaauaaguucugccuccagugcugugaugcccaugacauggcuacacugcaacuuccg

SEQ ID NO: 538321 - RNA, 64 nt, Homo Sapiens
gcaacuuuggucuccuuuccuuuugaucauucuggcccaugaaaauagggcaagaccuuugugc

SEQ ID NO: 538322 - RNA, 64 nt, Homo Sapiens
uauuugcccagaguuugcucaauuccaagacagugcccaugaaugggacaccuguaauguaacc

SEQ ID NO: 538323 - RNA, 64 nt, Homo Sapiens
uauuaaaauauauuuaauauguuuugccuuuguggcccaugaaagucuuacugggcccugggga

SEQ ID NO: 538324 - RNA, 64 nt, Homo Sapiens
uguguagcuucuuguagcuuagaaagcgcuuuaugcccaugaugucauuucaggcucaaccaaa

SEQ ID NO: 538325 - RNA, 64 nt, Homo Sapiens
uucaagggccaagcugccccuuucccuccucuccgcccaugaaaaugccuccaaacugagaugc

SEQ ID NO: 538326 - RNA, 64 nt, Homo Sapiens; identical to SEQ ID NO: 524971

SEQ ID NO: 538327 - RNA, 64 nt, Homo Sapiens; identical to SEQ ID NO: 524972

SEQ ID NO: 538328 - RNA, 64 nt, Homo Sapiens; identical to SEQ ID NO: 524973

SEQ ID NO: 538329 - RNA, 64 nt, Homo Sapiens; identical to SEQ ID NO: 524974

SEQ ID NO: 538330 - RNA, 64 nt, Homo Sapiens; identical to SEQ ID NO: 524975

SEQ ID NO: 538331 - RNA, 64 nt, Homo Sapiens; identical to SEQ ID NO: 524976

SEQ ID NO: 538332 - RNA, 64 nt, Homo Sapiens; identical to SEQ ID NO: 524977

SEQ ID NO: 538333 - RNA, 64 nt, Homo Sapiens; identical to SEQ ID NO: 524978

SEQ ID NO: 538334 - RNA, 64 nt, Homo Sapiens; identical to SEQ ID NO: 524979

SEQ ID NO: 538335 - RNA, 64 nt, Homo Sapiens; identical to SEQ ID NO: 524980

SEQ ID NO: 538336 - RNA, 64 nt, Homo Sapiens; identical to SEQ ID NO: 524981

SEQ ID NO: 538337 - RNA, 64 nt, Homo Sapiens; identical to SEQ ID NO: 524982

SEQ ID NO: 538338 - RNA, 64 nt, Homo Sapiens; identical to SEQ ID NO: 524983

SEQ ID NO: 538339 - RNA, 64 nt, Homo Sapiens; identical to SEQ ID NO: 524984

SEQ ID NO: 538340 - RNA, 64 nt, Homo Sapiens; identical to SEQ ID NO: 524985

SEQ ID NO: 538341 - RNA, 64 nt, Homo Sapiens; identical to SEQ ID NO: 524986

SEQ ID NO: 538342 - RNA, 64 nt, Homo Sapiens; identical to SEQ ID NO: 524987

SEQ ID NO: 538343 - RNA, 64 nt, Homo Sapiens; identical to SEQ ID NO: 524988

SEQ ID NO: 538344 - RNA, 64 nt, Homo Sapiens; identical to SEQ ID NO: 524989

SEQ ID NO: 538345 - RNA, 64 nt, Homo Sapiens; identical to SEQ ID NO: 524990

SEQ ID NO: 538346 - RNA, 64 nt, Homo Sapiens; identical to SEQ ID NO: 524991

SEQ ID NO: 538347 - RNA, 64 nt, Homo Sapiens; identical to SEQ ID NO: 524992

SEQ ID NO: 538348 - RNA, 64 nt, Homo Sapiens; identical to SEQ ID NO: 524993

SEQ ID NO: 538349 - RNA, 64 nt, Homo Sapiens; identical to SEQ ID NO: 524994

SEQ ID NO: 538350 - RNA, 64 nt, Homo Sapiens; identical to SEQ ID NO: 524995

SEQ ID NO: 538351 - RNA, 64 nt, Homo Sapiens; identical to SEQ ID NO: 524996

SEQ ID NO: 538352 - RNA, 64 nt, Homo Sapiens; identical to SEQ ID NO: 524997

SEQ ID NO: 538353 - RNA, 64 nt, Homo Sapiens; identical to SEQ ID NO: 524998

SEQ ID NO: 538354 - RNA, 64 nt, Homo Sapiens; identical to SEQ ID NO: 524999

SEQ ID NO: 538355 - RNA, 64 nt, Homo Sapiens; identical to SEQ ID NO: 525000

SEQ ID NO: 538356 - RNA, 64 nt, Homo Sapiens; identical to SEQ ID NO: 525001

SEQ ID NO: 538357 - RNA, 64 nt, Homo Sapiens; identical to SEQ ID NO: 525002

SEQ ID NO: 538358 - RNA, 64 nt, Homo Sapiens; identical to SEQ ID NO: 525003

SEQ ID NO: 538359 - RNA, 64 nt, Homo Sapiens; identical to SEQ ID NO: 525004

SEQ ID NO: 538360 - RNA, 64 nt, Homo Sapiens; identical to SEQ ID NO: 525005

SEQ ID NO: 538361 - RNA, 64 nt, Homo Sapiens; identical to SEQ ID NO: 525006

SEQ ID NO: 538362 - RNA, 64 nt, Homo Sapiens; identical to SEQ ID NO: 525007

SEQ ID NO: 538363 - RNA, 64 nt, Homo Sapiens; identical to SEQ ID NO: 525008

SEQ ID NO: 538364 - RNA, 64 nt, Homo Sapiens; identical to SEQ ID NO: 525009

SEQ ID NO: 538365 - RNA, 64 nt, Homo Sapiens; identical to SEQ ID NO: 525010

SEQ ID NO: 538366 - RNA, 64 nt, Homo Sapiens; identical to SEQ ID NO: 525011

SEQ ID NO: 538367 - RNA, 64 nt, Homo Sapiens; identical to SEQ ID NO: 525012

SEQ ID NO: 538368 - RNA, 64 nt, Homo Sapiens; identical to SEQ ID NO: 525013

SEQ ID NO: 538369 - RNA, 64 nt, Homo Sapiens; identical to SEQ ID NO: 525014

SEQ ID NO: 538370 - RNA, 64 nt, Homo Sapiens; identical to SEQ ID NO: 414866

SEQ ID NO: 538371 - RNA, 64 nt, Homo Sapiens; identical to SEQ ID NO: 414867

SEQ ID NO: 538372 - RNA, 64 nt, Homo Sapiens; identical to SEQ ID NO: 414868

SEQ ID NO: 538373 - RNA, 64 nt, Homo Sapiens; identical to SEQ ID NO: 414869

SEQ ID NO: 538374 - RNA, 64 nt, Homo Sapiens; identical to SEQ ID NO: 414870

SEQ ID NO: 538375 - RNA, 64 nt, Homo Sapiens; identical to SEQ ID NO: 414871

SEQ ID NO: 538376 - RNA, 64 nt, Homo Sapiens; identical to SEQ ID NO: 414872

SEQ ID NO: 538377 - RNA, 64 nt, Homo Sapiens; identical to SEQ ID NO: 414873

SEQ ID NO: 538378 - RNA, 64 nt, Homo Sapiens; identical to SEQ ID NO: 300837

SEQ ID NO: 538379 - RNA, 64 nt, Homo Sapiens; identical to SEQ ID NO: 300838

SEQ ID NO: 538380 - RNA, 64 nt, Homo Sapiens; identical to SEQ ID NO: 300839

SEQ ID NO: 538381 - RNA, 64 nt, Homo Sapiens; identical to SEQ ID NO: 300840

SEQ ID NO: 538382 - RNA, 64 nt, Homo Sapiens; identical to SEQ ID NO: 300841

SEQ ID NO: 538383 - RNA, 64 nt, Homo Sapiens; identical to SEQ ID NO: 300842

SEQ ID NO: 538384 - RNA, 64 nt, Homo Sapiens; identical to SEQ ID NO: 300843

SEQ ID NO: 538385 - RNA, 64 nt, Homo Sapiens; identical to SEQ ID NO: 300844

SEQ ID NO: 538386 - RNA, 64 nt, Homo Sapiens; identical to SEQ ID NO: 300845

SEQ ID NO: 538387 - RNA, 64 nt, Homo Sapiens; identical to SEQ ID NO: 300846

SEQ ID NO: 538388 - RNA, 64 nt, Homo Sapiens; identical to SEQ ID NO: 300847

SEQ ID NO: 538389 - RNA, 64 nt, Homo Sapiens; identical to SEQ ID NO: 300848

SEQ ID NO: 538390 - RNA, 64 nt, Homo Sapiens; identical to SEQ ID NO: 300849

SEQ ID NO: 538391 - RNA, 64 nt, Homo Sapiens; identical to SEQ ID NO: 300850

SEQ ID NO: 538392 - RNA, 64 nt, Homo Sapiens; identical to SEQ ID NO: 300851

SEQ ID NO: 538393 - RNA, 64 nt, Homo Sapiens; identical to SEQ ID NO: 300852

SEQ ID NO: 538394 - RNA, 64 nt, Homo Sapiens; identical to SEQ ID NO: 300853

SEQ ID NO: 538395 - RNA, 64 nt, Homo Sapiens; identical to SEQ ID NO: 300854

SEQ ID NO: 538396 - RNA, 64 nt, Homo Sapiens; identical to SEQ ID NO: 511547

SEQ ID NO: 538397 - RNA, 64 nt, Homo Sapiens; identical to SEQ ID NO: 511548

SEQ ID NO: 538398 - RNA, 64 nt, Homo Sapiens; identical to SEQ ID NO: 511549

SEQ ID NO: 538399 - RNA, 64 nt, Homo Sapiens; identical to SEQ ID NO: 511550

SEQ ID NO: 538400 - RNA, 64 nt, Homo Sapiens; identical to SEQ ID NO: 511551

SEQ ID NO: 538401 - RNA, 64 nt, Homo Sapiens; identical to SEQ ID NO: 511552

SEQ ID NO: 538402 - RNA, 64 nt, Homo Sapiens; identical to SEQ ID NO: 511553

SEQ ID NO: 538403 - RNA, 64 nt, Homo Sapiens; identical to SEQ ID NO: 511554

SEQ ID NO: 538404 - RNA, 64 nt, Homo Sapiens; identical to SEQ ID NO: 511555

SEQ ID NO: 538405 - RNA, 64 nt, Homo Sapiens; identical to SEQ ID NO: 511556

SEQ ID NO: 538406 - RNA, 64 nt, Homo Sapiens; identical to SEQ ID NO: 511557

SEQ ID NO: 538407 - RNA, 64 nt, Homo Sapiens; identical to SEQ ID NO: 511558

SEQ ID NO: 538408 - RNA, 64 nt, Homo Sapiens; identical to SEQ ID NO: 511559

SEQ ID NO: 538409 - RNA, 64 nt, Homo Sapiens; identical to SEQ ID NO: 511560

SEQ ID NO: 538410 - RNA, 64 nt, Homo Sapiens; identical to SEQ ID NO: 511561

SEQ ID NO: 538411 - RNA, 64 nt, Homo Sapiens; identical to SEQ ID NO: 511562

SEQ ID NO: 538412 - RNA, 64 nt, Homo Sapiens; identical to SEQ ID NO: 511563

SEQ ID NO: 538413 - RNA, 64 nt, Homo Sapiens; identical to SEQ ID NO: 511564

SEQ ID NO: 538414 - RNA, 64 nt, Homo Sapiens; identical to SEQ ID NO: 511565

SEQ ID NO: 538415 - RNA, 64 nt, Homo Sapiens; identical to SEQ ID NO: 511566

SEQ ID NO: 538416 - RNA, 64 nt, Homo Sapiens; identical to SEQ ID NO: 318834

SEQ ID NO: 538417 - RNA, 64 nt, Homo Sapiens; identical to SEQ ID NO: 318835

SEQ ID NO: 538418 - RNA, 62 nt, Homo Sapiens; identical to SEQ ID NO: 318836

SEQ ID NO: 538419 - RNA, 64 nt, Homo Sapiens; identical to SEQ ID NO: 318837

SEQ ID NO: 538420 - RNA, 64 nt, Homo Sapiens; identical to SEQ ID NO: 318838

SEQ ID NO: 538421 - RNA, 64 nt, Homo Sapiens; identical to SEQ ID NO: 318839

SEQ ID NO: 538422 - RNA, 64 nt, Homo Sapiens; identical to SEQ ID NO: 318840

SEQ ID NO: 538423 - RNA, 64 nt, Homo Sapiens; identical to SEQ ID NO: 318841

SEQ ID NO: 538424 - RNA, 64 nt, Homo Sapiens; identical to SEQ ID NO: 318842

SEQ ID NO: 538425 - RNA, 64 nt, Homo Sapiens; identical to SEQ ID NO: 318843

SEQ ID NO: 538426 - RNA, 64 nt, Homo Sapiens; identical to SEQ ID NO: 318844

SEQ ID NO: 538427 - RNA, 64 nt, Homo Sapiens; identical to SEQ ID NO: 318845

SEQ ID NO: 538428 - RNA, 64 nt, Homo Sapiens; identical to SEQ ID NO: 318846

SEQ ID NO: 538429 - RNA, 64 nt, Homo Sapiens; identical to SEQ ID NO: 318847

SEQ ID NO: 538430 - RNA, 64 nt, Homo Sapiens; identical to SEQ ID NO: 318848

SEQ ID NO: 538431 - RNA, 64 nt, Homo Sapiens; identical to SEQ ID NO: 318849

SEQ ID NO: 538432 - RNA, 64 nt, Homo Sapiens; identical to SEQ ID NO: 318850

SEQ ID NO: 538433 - RNA, 64 nt, Homo Sapiens; identical to SEQ ID NO: 318851

SEQ ID NO: 538434 - RNA, 64 nt, Homo Sapiens; identical to SEQ ID NO: 318852

SEQ ID NO: 538435 - RNA, 64 nt, Homo Sapiens; identical to SEQ ID NO: 318853

SEQ ID NO: 538436 - RNA, 64 nt, Homo Sapiens; identical to SEQ ID NO: 318854

SEQ ID NO: 538437 - RNA, 64 nt, Homo Sapiens; identical to SEQ ID NO: 318855

SEQ ID NO: 538438 - RNA, 64 nt, Homo Sapiens; identical to SEQ ID NO: 318856

SEQ ID NO: 538439 - RNA, 64 nt, Homo Sapiens; identical to SEQ ID NO: 318857

SEQ ID NO: 538440 - RNA, 64 nt, Homo Sapiens; identical to SEQ ID NO: 318858

SEQ ID NO: 538441 - RNA, 64 nt, Homo Sapiens; identical to SEQ ID NO: 318859

SEQ ID NO: 538442 - RNA, 64 nt, Homo Sapiens; identical to SEQ ID NO: 318860

SEQ ID NO: 538443 - RNA, 64 nt, Homo Sapiens; identical to SEQ ID NO: 318861

SEQ ID NO: 538444 - RNA, 64 nt, Homo Sapiens; identical to SEQ ID NO: 318862

SEQ ID NO: 538445 - RNA, 64 nt, Homo Sapiens; identical to SEQ ID NO: 318863

SEQ ID NO: 538446 - RNA, 64 nt, Homo Sapiens; identical to SEQ ID NO: 318864

SEQ ID NO: 538447 - RNA, 64 nt, Homo Sapiens; identical to SEQ ID NO: 318865

SEQ ID NO: 538448 - RNA, 64 nt, Homo Sapiens; identical to SEQ ID NO: 318866

SEQ ID NO: 538449 - RNA, 64 nt, Homo Sapiens; identical to SEQ ID NO: 318867

SEQ ID NO: 538450 - RNA, 64 nt, Homo Sapiens; identical to SEQ ID NO: 318868

SEQ ID NO: 538451 - RNA, 64 nt, Homo Sapiens; identical to SEQ ID NO: 318869

SEQ ID NO: 538452 - RNA, 64 nt, Homo Sapiens; identical to SEQ ID NO: 318870

SEQ ID NO: 538453 - RNA, 64 nt, Homo Sapiens; identical to SEQ ID NO: 318871

SEQ ID NO: 538454 - RNA, 64 nt, Homo Sapiens; identical to SEQ ID NO: 318872

SEQ ID NO: 538455 - RNA, 64 nt, Homo Sapiens; identical to SEQ ID NO: 318873

SEQ ID NO: 538456 - RNA, 64 nt, Homo Sapiens; identical to SEQ ID NO: 318874

SEQ ID NO: 538457 - RNA, 64 nt, Homo Sapiens; identical to SEQ ID NO: 318875

SEQ ID NO: 538458 - RNA, 64 nt, Homo Sapiens; identical to SEQ ID NO: 318876

SEQ ID NO: 538459 - RNA, 64 nt, Homo Sapiens; identical to SEQ ID NO: 318877

SEQ ID NO: 538460 - RNA, 64 nt, Homo Sapiens; identical to SEQ ID NO: 318878

SEQ ID NO: 538461 - RNA, 64 nt, Homo Sapiens; identical to SEQ ID NO: 318879

SEQ ID NO: 538462 - RNA, 64 nt, Homo Sapiens; identical to SEQ ID NO: 318880

SEQ ID NO: 538463 - RNA, 64 nt, Homo Sapiens; identical to SEQ ID NO: 318881

SEQ ID NO: 538464 - RNA, 64 nt, Homo Sapiens; identical to SEQ ID NO: 318882

SEQ ID NO: 538465 - RNA, 64 nt, Homo Sapiens; identical to SEQ ID NO: 318883

SEQ ID NO: 538466 - RNA, 64 nt, Homo Sapiens; identical to SEQ ID NO: 318884

SEQ ID NO: 538467 - RNA, 64 nt, Homo Sapiens; identical to SEQ ID NO: 318885

SEQ ID NO: 538468 - RNA, 64 nt, Homo Sapiens; identical to SEQ ID NO: 318886

SEQ ID NO: 538469 - RNA, 64 nt, Homo Sapiens; identical to SEQ ID NO: 318887

SEQ ID NO: 538470 - RNA, 64 nt, Homo Sapiens; identical to SEQ ID NO: 318888

SEQ ID NO: 538471 - RNA, 64 nt, Homo Sapiens; identical to SEQ ID NO: 318889

SEQ ID NO: 538472 - RNA, 64 nt, Homo Sapiens; identical to SEQ ID NO: 318890

SEQ ID NO: 538473 - RNA, 64 nt, Homo Sapiens; identical to SEQ ID NO: 318891

SEQ ID NO: 538474 - RNA, 64 nt, Homo Sapiens; identical to SEQ ID NO: 318892

SEQ ID NO: 538475 - RNA, 64 nt, Homo Sapiens; identical to SEQ ID NO: 318893

SEQ ID NO: 538476 - RNA, 64 nt, Homo Sapiens; identical to SEQ ID NO: 318894

SEQ ID NO: 538477 - RNA, 64 nt, Homo Sapiens; identical to SEQ ID NO: 318895

SEQ ID NO: 538478 - RNA, 64 nt, Homo Sapiens; identical to SEQ ID NO: 318896

SEQ ID NO: 538479 - RNA, 64 nt, Homo Sapiens; identical to SEQ ID NO: 318897

SEQ ID NO: 538480 - RNA, 64 nt, Homo Sapiens; identical to SEQ ID NO: 318898

SEQ ID NO: 538481 - RNA, 64 nt, Homo Sapiens; identical to SEQ ID NO: 318899

SEQ ID NO: 538482 - RNA, 64 nt, Homo Sapiens; identical to SEQ ID NO: 318900

SEQ ID NO: 538483 - RNA, 64 nt, Homo Sapiens; identical to SEQ ID NO: 318901

SEQ ID NO: 538484 - RNA, 64 nt, Homo Sapiens; identical to SEQ ID NO: 318902

SEQ ID NO: 538485 - RNA, 64 nt, Homo Sapiens; identical to SEQ ID NO: 318903

SEQ ID NO: 538486 - RNA, 64 nt, Homo Sapiens; identical to SEQ ID NO: 318904

SEQ ID NO: 538487 - RNA, 64 nt, Homo Sapiens; identical to SEQ ID NO: 318905

SEQ ID NO: 538488 - RNA, 64 nt, Homo Sapiens; identical to SEQ ID NO: 318906

SEQ ID NO: 538489 - RNA, 64 nt, Homo Sapiens; identical to SEQ ID NO: 318907

SEQ ID NO: 538490 - RNA, 64 nt, Homo Sapiens; identical to SEQ ID NO: 318908

SEQ ID NO: 538491 - RNA, 64 nt, Homo Sapiens; identical to SEQ ID NO: 318909

SEQ ID NO: 538492 - RNA, 64 nt, Homo Sapiens; identical to SEQ ID NO: 318910

SEQ ID NO: 538493 - RNA, 64 nt, Homo Sapiens; identical to SEQ ID NO: 318911

SEQ ID NO: 538494 - RNA, 64 nt, Homo Sapiens; identical to SEQ ID NO: 318912

SEQ ID NO: 538495 - RNA, 64 nt, Homo Sapiens; identical to SEQ ID NO: 318913

SEQ ID NO: 538496 - RNA, 64 nt, Homo Sapiens; identical to SEQ ID NO: 318914

SEQ ID NO: 538497 - RNA, 64 nt, Homo Sapiens; identical to SEQ ID NO: 318915

SEQ ID NO: 538498 - RNA, 64 nt, Homo Sapiens; identical to SEQ ID NO: 318916

SEQ ID NO: 538499 - RNA, 58 nt, Homo Sapiens; identical to SEQ ID NO: 318917

SEQ ID NO: 538500 - RNA, 64 nt, Homo Sapiens; identical to SEQ ID NO: 318918

SEQ ID NO: 538501 - RNA, 64 nt, Homo Sapiens; identical to SEQ ID NO: 318919

SEQ ID NO: 538502 - RNA, 64 nt, Homo Sapiens; identical to SEQ ID NO: 318920

SEQ ID NO: 538503 - RNA, 64 nt, Homo Sapiens
cugcgguuucagcuuuucugggcgguguaaauugacucagaaacagagggcaggucagggauug

SEQ ID NO: 538504 - RNA, 64 nt, Homo Sapiens
ggaagcauugggaaaccauguguccucacuggagacucagaaggacaaaaccucauggcaaucu

SEQ ID NO: 538505 - RNA, 64 nt, Homo Sapiens
agaaagagaacauggucacccaaaagcaacuguaacucagaaauuaaguuacucagaaauuaag

SEQ ID NO: 538506 - RNA, 64 nt, Homo Sapiens
cacccaaaagcaacuguaacucagaaauuaaguuacucagaaauuaaguagcucagaaauuaag

SEQ ID NO: 538507 - RNA, 64 nt, Homo Sapiens
uuaauucauguuucuuaaauauagauguagauaaacucagaaauuucaaaaguugaaauuaacc

SEQ ID NO: 538508 - RNA, 64 nt, Homo Sapiens
aucaguuacucugaagggcaugaauuuuucucuaacucagaaacugcaaccuguugauagcaag

SEQ ID NO: 538509 - RNA, 64 nt, Homo Sapiens
aagguaugaagucuuuccauggucagaaacauugacucagaaaacuggaaagaccuuaucugaa

SEQ ID NO: 538510 - RNA, 64 nt, Homo Sapiens
cacaguaauacuuaaggcuuucccaucuccuaaaacucagaaugagaaacagaaaaaucuaucu

SEQ ID NO: 538511 - RNA, 64 nt, Homo Sapiens
uuuaaaaaaaaaaauggagcaacaguugcccaagacucagaauucuguaaaguaguuacaagag

SEQ ID NO: 538512 - RNA, 64 nt, Homo Sapiens
augccaugugaugcuaccuuuaucucgggaauggacucagaaguuauuuacagguacaacagaa

SEQ ID NO: 538513 - RNA, 64 nt, Homo Sapiens
gaagggacauaugcauaaaucuccuaauaaacagacucagaacaaucagagaaagggaaacuua

SEQ ID NO: 538514 - RNA, 64 nt, Homo Sapiens
cuuuuuaugagcucucuuguauuauguuccuuauacucagaauagaguaguauggaauauuaag

SEQ ID NO: 538515 - RNA, 64 nt, Homo Sapiens
uaacacaaagcucauguuaagaaaacaguugaggacucagaagucaguucgaaaaugcacuuuc

SEQ ID NO: 538516 - RNA, 64 nt, Homo Sapiens
agcaccucacgcugggggaaucaaucccugagggacucagaaucuucuccgugcaaccuggaaa

SEQ ID NO: 538517 - RNA, 64 nt, Homo Sapiens
uugcacugcuaagagugguucugaauaauuuucaacucagaagcgugccuucaaugaaacaagc

SEQ ID NO: 538518 - RNA, 64 nt, Homo Sapiens
auuuaaagcauucauguuucugaaaauaacccgaacucagaauucuuuggcuguuacccuuccu

SEQ ID NO: 538519 - RNA, 64 nt, Homo Sapiens
cuucaccagaagacccugcaggccaugaagagccacucagaaaaggcccauggccauggagcuu

SEQ ID NO: 538520 - RNA, 64 nt, Homo Sapiens
ggcuaccuuaccaguauaaagagcugauaacaguacucagaagaaucugugaacaaauacuuga

SEQ ID NO: 538521 - RNA, 64 nt, Homo Sapiens
acuggaaaauguuguccugccuucucuuugauuuacucagaaggcugcaaucaccaagcugaga

SEQ ID NO: 538522 - RNA, 64 nt, Homo Sapiens
acuugcuauaauuagaaaguuauccuaaauggaaacucagaaucaaaaagaaacuuccuauuac

SEQ ID NO: 538523 - RNA, 64 nt, Homo Sapiens
gcggaauacccuacagcaaacacaauggaacaacacucagaaauuuaagacgcacuggaaauca

SEQ ID NO: 538524 - RNA, 64 nt, Homo Sapiens
aucugggaaauuugccauggccaggaaacagauaacucagaagcgacugcagaagguaugaaua

SEQ ID NO: 538525 - RNA, 64 nt, Homo Sapiens
agcaaaacaaaacaaacaaaagagcgagacuccaacucagaaaaugcacuccagccugggcaac

SEQ ID NO: 538526 - RNA, 64 nt, Homo Sapiens
caagauacacaagugaggaacaccgacacugaguacucagaaaucaaccucaggaaccaaaggu

SEQ ID NO: 538527 - RNA, 64 nt, Homo Sapiens
ggaagcagaacugagggcugcuggcuuuugugggacucagaaaggaacccaaggcuguccacau

SEQ ID NO: 538528 - RNA, 64 nt, Homo Sapiens
gcaagaguuccaaagagccuauggacagucccccacucagaagugucuagagguugugggcagc

SEQ ID NO: 538529 - RNA, 64 nt, Homo Sapiens; identical to SEQ ID NO: 77016

SEQ ID NO: 538530 - RNA, 64 nt, Homo Sapiens; identical to SEQ ID NO: 77017

SEQ ID NO: 538531 - RNA, 64 nt, Homo Sapiens; identical to SEQ ID NO: 77018

SEQ ID NO: 538532 - RNA, 64 nt, Homo Sapiens; identical to SEQ ID NO: 77019

SEQ ID NO: 538533 - RNA, 64 nt, Homo Sapiens
aguacucaguaacagugaaguacucaguaauacaguacaguauucaguaaggcagugaaguacu

SEQ ID NO: 538534 - RNA, 64 nt, Homo Sapiens
uacucaguaacacagugcaguacucaguaauacaguacaguacucaguaaggcaguaugguacu

SEQ ID NO: 538535 - RNA, 64 nt, Homo Sapiens
uuuacuuuaaauuauuuaaauuuauuuucauauuguacaguaaugauucuaacauuuauguauc

SEQ ID NO: 538536 - RNA, 64 nt, Homo Sapiens
uuuacuggcauuuuucuccuugcaacacuugaugguacaguaaagagcagcagcaguuauguga

SEQ ID NO: 538537 - RNA, 64 nt, Homo Sapiens
uuauauuaucuuaagcauguguaaugcuggauguguacaguacaguacugaacuuguaauuuga

SEQ ID NO: 538538 - RNA, 64 nt, Homo Sapiens
uuaucuuaagcauguguaaugcuggauguguacaguacaguacugaacuuguaauuugaaucua

SEQ ID NO: 538539 - RNA, 64 nt, Homo Sapiens
aaacuacucuucuagugguuaaugcacuugacauguacaguauguuucccaugccguugugauu

SEQ ID NO: 538540 - RNA, 64 nt, Homo Sapiens
caguauguuucccaugccguugugauuuugacauguacaguauguuuucaugccguugugaauu

SEQ ID NO: 538541 - RNA, 64 nt, Homo Sapiens
uuuuaaggcaaauaaagauguaaauauccagccaguacaguauuuauaacuaaacuaacaagau

SEQ ID NO: 538542 - RNA, 64 nt, Homo Sapiens
accaccugccaaaagcuggacauuuauaacuucuguacaguaagcaggggaagguuguaugugu

SEQ ID NO: 538543 - RNA, 64 nt, Homo Sapiens
gaucggagaauacucuuguuucaccauuauguugguacaguauaguaccauuauuuuauguugu

SEQ ID NO: 538544 - RNA, 64 nt, Homo Sapiens
uuuuaagaaucugcagauggcauccauagauacaguacaguauuuacugucaaugcaaaagaau

SEQ ID NO: 538545 - RNA, 64 nt, Homo Sapiens
auuugguuguucuuaaggcuagaguguuugcacaguacaguaacaagugagugaacagcaagga

SEQ ID NO: 538546 - RNA, 64 nt, Homo Sapiens
ggucaacuuugccacuugcauccuugcagauacuguacaguaauuuuuguuuuuguuuuuguuu

SEQ ID NO: 538547 - RNA, 64 nt, Homo Sapiens
gcuuauugugacuuuggcaucucuauaauuugugguacaguauuaaagaagcaaaucauuugca

SEQ ID NO: 538548 - RNA, 64 nt, Homo Sapiens
auguguggguuuuucuguaucauuuuaagguggaguacaguaaguaaacaaacccaauaugaug

SEQ ID NO: 538549 - RNA, 64 nt, Homo Sapiens
auuguaaaguuucaauuguagaaacaacugguauguacaguaccauaauuuaauuacauuuuac

SEQ ID NO: 538550 - RNA, 64 nt, Homo Sapiens
ucaggccaaggugggaguauagugcauaauaauuguacaguagcaauuuuuauccuaauuaacc

SEQ ID NO: 538551 - RNA, 64 nt, Homo Sapiens
cucugaaaagaaaucugaaacuauaacauguuauguacaguacaucagaaguaaagcaaagaag

SEQ ID NO: 538552 - RNA, 64 nt, Homo Sapiens
uaccgugacauccugaacccguagaagaaugggcguacaguauaacugugucucacaucaccau

SEQ ID NO: 538553 - RNA, 64 nt, Homo Sapiens
cuaaaagacuuugauaaaaaacaguauagcgcugguacaguacaguucauuuaaaaaaauaacu

SEQ ID NO: 538554 - RNA, 64 nt, Homo Sapiens
ugaaacccaauucagauccauucacaaggaccagguacaguagcuugugacuuuauuuuuuuaa

SEQ ID NO: 538555 - RNA, 64 nt, Homo Sapiens
uccaucaaaauauguaauaauauguauacauucuguacaguaguauucuaucuauagauuuaua

SEQ ID NO: 538556 - RNA, 64 nt, Homo Sapiens
acugcuuuguuuuacuaaagcauugcacuucuguguacaguaaauuacucaggacuuaauguag

SEQ ID NO: 538557 - RNA, 64 nt, Homo Sapiens
aaaagaaaaggaauuuaacaauuugcauccccuuguacaguaaggcuuaucaugacagagcgca

SEQ ID NO: 538558 - RNA, 64 nt, Homo Sapiens
aaggcuuaucaugacagagcgcacuauuucugauguacaguauuuuuuguuguuuuuaucauca

SEQ ID NO: 538559 - RNA, 64 nt, Homo Sapiens
aaaagaaaaggaauuuaacaauuugcauccccuuguacaguaaggcuuaucaugacagagcgua

SEQ ID NO: 538560 - RNA, 64 nt, Homo Sapiens
aaggcuuaucaugacagagcguacuauuucugauguacaguauuuuuuguuguuuuuaucauca

SEQ ID NO: 538561 - RNA, 64 nt, Homo Sapiens
acaggguuucuucauguuggucaggcuggucucaaacuccuaaccucgugauccgccugccucg

SEQ ID NO: 538562 - RNA, 64 nt, Homo Sapiens
auggggucuugcuguguugcccaggcuggucucaaacuccuaggcuuaagcaguccuccagccu

SEQ ID NO: 538563 - RNA, 64 nt, Homo Sapiens
guggaacaguaagagucauuauguauguauaccuaacuccuaaaauauacauauauauacacau

SEQ ID NO: 538564 - RNA, 64 nt, Homo Sapiens
agagagaaaccuuuuguaugucaccccaccugugaacuccuaccggaaagaauuucuguauucc

SEQ ID NO: 538565 - RNA, 64 nt, Homo Sapiens
ccagccgaccugcugugucgccucucugggcagcaacuccuaggcacuggacauucucccuuug

SEQ ID NO: 538566 - RNA, 64 nt, Homo Sapiens
cucaagcaauccucccaccucuaggcugaucuugaacuccuaacauagggacuugcuauguugc

SEQ ID NO: 538567 - RNA, 64 nt, Homo Sapiens
uauaaucuccaaagaaagaauaagucuccaaggagcacaaaaaaaucauauguaccaaggaugu

SEQ ID NO: 538568 - RNA, 64 nt, Homo Sapiens
agcaggagguggacagagucucucauggaugccggcacaaaacugccuuaaaauauucauaguu

SEQ ID NO: 538569 - RNA, 64 nt, Homo Sapiens
aucuccccguccaaggagcuggaucugaagcccagcacaaaauaaucuacagaccuggcuccuc

SEQ ID NO: 538570 - RNA, 64 nt, Homo Sapiens
gugguuguagauguugcucuccauguguguaagugcacaaaaauuccccacucaguguaucuga

SEQ ID NO: 538571 - RNA, 64 nt, Homo Sapiens
uaaauauggcuuugaaauuaaacuaaaauuuauggcacaaaagaacauuauaauguaauauaua

SEQ ID NO: 538572 - RNA, 64 nt, Homo Sapiens
agguuaagaaguccuaguugcacagcagcucauagcacaaaaaaagagggauggaccagacugc

SEQ ID NO: 538573 - RNA, 64 nt, Homo Sapiens
uguacagauuuuuuuuuuuaaaaucaugauaagggcacaaaagcuuuacucccuuucuacugac

SEQ ID NO: 538574 - RNA, 64 nt, Homo Sapiens
gcaagucacuuccuauuccuaggacacaaguuuugcacaaaauuugguagugcccacaagaaag

SEQ ID NO: 538575 - RNA, 64 nt, Homo Sapiens
cuaaauaaucauugaugaaguaugucaguuacaagcacaaaagaauauaacugcuuuuauaaau

SEQ ID NO: 538576 - RNA, 64 nt, Homo Sapiens
aaaucagcuuuuuaauguagguuaccacuuauaagcacaaaagaaacauguauaagaaaccaga

SEQ ID NO: 538577 - RNA, 64 nt, Homo Sapiens
ccugcuguguguguuaauuccaggcagggaauuagcacaaaagguuuaggaaggaaucuuuuuu

SEQ ID NO: 538578 - RNA, 64 nt, Homo Sapiens
cuuuuaggaagcuucguucacaugcuauuuaaaugcacaaaauagacaguaaggauuuaucugu

SEQ ID NO: 538579 - RNA, 64 nt, Homo Sapiens
gaugacauuuaccuagcacuacaaugagucaguagcacaaaagaaaacagugcagagacguuug

SEQ ID NO: 538580 - RNA, 64 nt, Homo Sapiens
cauuuuuucguaucaaaaagauaccucaccagcugcacaaaaugcccugcuuuugcuuuggauu

SEQ ID NO: 538581 - RNA, 64 nt, Homo Sapiens
ccauauuuaugugccuuuugucuauuuauaaugccacuggaagaggagggauaacuuuuucugu

SEQ ID NO: 538582 - RNA, 64 nt, Homo Sapiens
aaaacuugccaacuggaucuuuguuuagcaaacucacuggaaaugaacacuuaauggaauuuuu

SEQ ID NO: 538583 - RNA, 64 nt, Homo Sapiens
cacugaaucaauacaaugcggagcaagcuguguacacuggaaaaaauaaaggucaaacaucagu

SEQ ID NO: 538584 - RNA, 64 nt, Homo Sapiens
uuccucucucgacauucucucucccgcauaucgucacuggaaacggcaaaauaccacauggcuu

SEQ ID NO: 538585 - RNA, 64 nt, Homo Sapiens
aauuuauucauugcagauacgaucugcagugcuucacuggaaauuuagcagacuggugugugug

SEQ ID NO: 538586 - RNA, 64 nt, Homo Sapiens
agugaagugccauuuguugaaaacauuucagggucacuggaaacgcccaggccccacuuacgua

SEQ ID NO: 538587 - RNA, 64 nt, Homo Sapiens
ggaaacaaacugccccguuaacuccagaucauugcacuggaauguaaucaagaaaguuagucau

SEQ ID NO: 538588 - RNA, 64 nt, Homo Sapiens
ugaguaccuacuagguaccaaguacucuuuuaggcacuggaaauacagugauggacaaaacagg

SEQ ID NO: 538589 - RNA, 64 nt, Homo Sapiens
gaaacucacuuuggucaaaugauuauuguguugucacuggaaguacugucaaagacuuuggggg

SEQ ID NO: 538590 - RNA, 64 nt, Homo Sapiens
uggaguuaucaagugagguccagguagccugcaacacuggaaaugaguucuggguaagugaguu

SEQ ID NO: 538591 - RNA, 64 nt, Homo Sapiens
guauggguaggaguuuaggugagcuugggaguaccacuggaaacggaugauuauuagucacaua

SEQ ID NO: 538592 - RNA, 64 nt, Homo Sapiens
caauauagcagauuaaaauacuugaagcagagggcacuggaagacaagcagaauuccaggaguc

SEQ ID NO: 538593 - RNA, 64 nt, Homo Sapiens
aaucuuuuccauuccucuuucauacauuccaacccacuggaagucuuuagagguauuuugauuu

SEQ ID NO: 538594 - RNA, 64 nt, Homo Sapiens
guugauuagcagauuuauuauucuauugagaaagcacuggaauguuuugugagauuauuuuuau

SEQ ID NO: 538595 - RNA, 64 nt, Homo Sapiens
auugcucuuccuggacuuuggcaucagcacugcacacuggaaucaacauguuaggcucacacau

SEQ ID NO: 538596 - RNA, 64 nt, Homo Sapiens
ugauugccauagggcugggaaacucuguguaggucacuggaaagaugauuccccuugagaauau

SEQ ID NO: 538597 - RNA, 64 nt, Homo Sapiens
gguuggaguuccagggcugggcccugguggaguccacuggaagucccauuauggauguugaaau

SEQ ID NO: 538598 - RNA, 64 nt, Homo Sapiens
ugugcaauaaugucuguguuucucucccaccugccacuggaacuggagaaugcacuuuauucug

SEQ ID NO: 538599 - RNA, 64 nt, Homo Sapiens
gggaccugcgcccccacaucacaggaagccuucacacuggaaggggucaggaacacuacacugc

SEQ ID NO: 538600 - RNA, 64 nt, Homo Sapiens
ggagcugggucagccucugcggagucacagcauacacuggaacagagcuccagcugccuuagga

SEQ ID NO: 538601 - RNA, 64 nt, Homo Sapiens
uaggcuuuaggagcucuguauccuaucuugauuucacuggaauauaaacuuaagggaaaaguuc

SEQ ID NO: 538602 - RNA, 64 nt, Homo Sapiens
auugcuuuacucugguuggaaugaagcagauuugcacuggaaccuuugagagacauuugucuuc

SEQ ID NO: 538603 - RNA, 64 nt, Homo Sapiens
cccagaggaugucacaaagaucaugaaaguccagcacuggaagccagagaaaauguuggaagag

SEQ ID NO: 538604 - RNA, 64 nt, Homo Sapiens
uguaaucccagcuaggaggcugaggcaggagaaucacuggaaccugggagccggaggcugcagu

SEQ ID NO: 538605 - RNA, 64 nt, Homo Sapiens
uauccaagagcccacugucagggacuguggaucucacuggaagcccugagucacagauuucugu

SEQ ID NO: 538606 - RNA, 64 nt, Homo Sapiens
uuggcaaagcacuuuugacauuaaauuuguauggcacuggaacuaaucaaucaaucaaauuccc

SEQ ID NO: 538607 - RNA, 64 nt, Homo Sapiens; identical to SEQ ID NO: 503093

SEQ ID NO: 538608 - RNA, 64 nt, Homo Sapiens; identical to SEQ ID NO: 503094

SEQ ID NO: 538609 - RNA, 64 nt, Homo Sapiens; identical to SEQ ID NO: 503095

SEQ ID NO: 538610 - RNA, 64 nt, Homo Sapiens; identical to SEQ ID NO: 503096

SEQ ID NO: 538611 - RNA, 64 nt, Homo Sapiens; identical to SEQ ID NO: 503097

SEQ ID NO: 538612 - RNA, 64 nt, Homo Sapiens; identical to SEQ ID NO: 503098

SEQ ID NO: 538613 - RNA, 64 nt, Homo Sapiens; identical to SEQ ID NO: 503099

SEQ ID NO: 538614 - RNA, 64 nt, Homo Sapiens; identical to SEQ ID NO: 503100

SEQ ID NO: 538615 - RNA, 64 nt, Homo Sapiens; identical to SEQ ID NO: 503101

SEQ ID NO: 538616 - RNA, 64 nt, Homo Sapiens; identical to SEQ ID NO: 503102

SEQ ID NO: 538617 - RNA, 64 nt, Homo Sapiens; identical to SEQ ID NO: 503103

SEQ ID NO: 538618 - RNA, 64 nt, Homo Sapiens; identical to SEQ ID NO: 503104

SEQ ID NO: 538619 - RNA, 64 nt, Homo Sapiens; identical to SEQ ID NO: 503105

SEQ ID NO: 538620 - RNA, 54 nt, Homo Sapiens; identical to SEQ ID NO: 375573

SEQ ID NO: 538621 - RNA, 64 nt, Homo Sapiens; identical to SEQ ID NO: 503107

SEQ ID NO: 538622 - RNA, 64 nt, Homo Sapiens; identical to SEQ ID NO: 503108

SEQ ID NO: 538623 - RNA, 64 nt, Homo Sapiens; identical to SEQ ID NO: 503109

SEQ ID NO: 538624 - RNA, 64 nt, Homo Sapiens; identical to SEQ ID NO: 503110

SEQ ID NO: 538625 - RNA, 64 nt, Homo Sapiens; identical to SEQ ID NO: 503111

SEQ ID NO: 538626 - RNA, 64 nt, Homo Sapiens; identical to SEQ ID NO: 503112

SEQ ID NO: 538627 - RNA, 64 nt, Homo Sapiens; identical to SEQ ID NO: 503113

SEQ ID NO: 538628 - RNA, 64 nt, Homo Sapiens; identical to SEQ ID NO: 503114

SEQ ID NO: 538629 - RNA, 64 nt, Homo Sapiens; identical to SEQ ID NO: 503115

SEQ ID NO: 538630 - RNA, 64 nt, Homo Sapiens; identical to SEQ ID NO: 503116

SEQ ID NO: 538631 - RNA, 64 nt, Homo Sapiens; identical to SEQ ID NO: 503117

SEQ ID NO: 538632 - RNA, 64 nt, Homo Sapiens; identical to SEQ ID NO: 503118

SEQ ID NO: 538633 - RNA, 64 nt, Homo Sapiens; identical to SEQ ID NO: 503119

SEQ ID NO: 538634 - RNA, 64 nt, Homo Sapiens; identical to SEQ ID NO: 503120

SEQ ID NO: 538635 - RNA, 64 nt, Homo Sapiens; identical to SEQ ID NO: 503121

SEQ ID NO: 538636 - RNA, 64 nt, Homo Sapiens; identical to SEQ ID NO: 503122

SEQ ID NO: 538637 - RNA, 64 nt, Homo Sapiens; identical to SEQ ID NO: 312321

SEQ ID NO: 538638 - RNA, 64 nt, Homo Sapiens; identical to SEQ ID NO: 312322

SEQ ID NO: 538639 - RNA, 64 nt, Homo Sapiens; identical to SEQ ID NO: 312323

SEQ ID NO: 538640 - RNA, 64 nt, Homo Sapiens; identical to SEQ ID NO: 312324

SEQ ID NO: 538641 - RNA, 64 nt, Homo Sapiens; identical to SEQ ID NO: 312325

SEQ ID NO: 538642 - RNA, 64 nt, Homo Sapiens; identical to SEQ ID NO: 312326

SEQ ID NO: 538643 - RNA, 64 nt, Homo Sapiens; identical to SEQ ID NO: 312327

SEQ ID NO: 538644 - RNA, 64 nt, Homo Sapiens; identical to SEQ ID NO: 312328

SEQ ID NO: 538645 - RNA, 64 nt, Homo Sapiens; identical to SEQ ID NO: 85116

SEQ ID NO: 538646 - RNA, 64 nt, Homo Sapiens; identical to SEQ ID NO: 85117

SEQ ID NO: 538647 - RNA, 64 nt, Homo Sapiens; identical to SEQ ID NO: 85118

SEQ ID NO: 538648 - RNA, 64 nt, Homo Sapiens; identical to SEQ ID NO: 85119

SEQ ID NO: 538649 - RNA, 64 nt, Homo Sapiens; identical to SEQ ID NO: 85120

SEQ ID NO: 538650 - RNA, 64 nt, Homo Sapiens; identical to SEQ ID NO: 85121

SEQ ID NO: 538651 - RNA, 64 nt, Homo Sapiens
ggaauuacuuuuuguuguuuuugccaccguggagagcaacuauuuggagugcacagccuauuga

SEQ ID NO: 538652 - RNA, 64 nt, Homo Sapiens
uauuauaaagacuguauuucccauagacguuuacagcaacuauguuuaaaaaacaaaaacaaaa

SEQ ID NO: 538653 - RNA, 64 nt, Homo Sapiens
ccaaugucaccucagagguuucaaacauugcacaagcaacuaacuuuauuccuccacaggaacc

SEQ ID NO: 538654 - RNA, 64 nt, Homo Sapiens
aguccaggagaacccguacccccacagagccuuaagcaacuacuucugugaaguauuuuuugac

SEQ ID NO: 538655 - RNA, 64 nt, Homo Sapiens
uugcacggcaaccacuccucccauggcauugcucagcaacuacuucucccuucccggccacccu

SEQ ID NO: 538656 - RNA, 64 nt, Homo Sapiens
auugcccaguacugccugccagcugggucucccaagcaacuaccccaagacauaccaacaguga

SEQ ID NO: 538657 - RNA, 64 nt, Homo Sapiens
cccugcuguuaguaacagucaccaaaauguucuaagcaacuacuuuccuagaguaucauuugcc

SEQ ID NO: 538658 - RNA, 64 nt, Homo Sapiens
guuucucaacagaugguuucauggccaagacuugagcaacuacaagauguggcuucugaugaca

SEQ ID NO: 538659 - RNA, 64 nt, Homo Sapiens
gacuugaucaguucagccaauggugaguuugucaagcaacuaucacgauuggccauucuaaagu

SEQ ID NO: 538660 - RNA, 64 nt, Homo Sapiens
gucaccuccauccagauucuggggguuuuauaaaagcaacuacuaagcuuugaaauuauuguuu

SEQ ID NO: 538661 - RNA, 64 nt, Homo Sapiens
guuugaacaaagcucaaaguaccuucaugauuauagcaacuaauucugacugguuuuaauaguc

SEQ ID NO: 538662 - RNA, 64 nt, Homo Sapiens
ugacuguauucuucagguaaaauauugaaagugaagcaacuauguuauuugguuauuuccuaag

SEQ ID NO: 538663 - RNA, 64 nt, Homo Sapiens
cuugccagaguuuuuucauucacauuuucaggccagcaacuaucgucacugcuaagagacagag

SEQ ID NO: 538664 - RNA, 64 nt, Homo Sapiens
guacaaaauguucacauuuauuuuacuguucuucagcaacuauuacaugauauuucggaauugg

SEQ ID NO: 538665 - RNA, 64 nt, Homo Sapiens
acaaaugccaauaugauaauauggugguaggaauagcaacuaauuauaauauaaauguauagac

SEQ ID NO: 538666 - RNA, 64 nt, Homo Sapiens
cuuucuuaguuauuugcuccuugcaaauuaaaaaagcaacuaagagaaagaaaaacauuguaga

SEQ ID NO: 538667 - RNA, 64 nt, Homo Sapiens
gaauaaaaagauugguggaagggcucaugugguuagcaacuaugaaacagaaauaggacacuca

SEQ ID NO: 538668 - RNA, 64 nt, Homo Sapiens
cugcucccccaaagcuguuucugauccugcugggagcaacuaacuaguuauuaugcacaucugc

SEQ ID NO: 538669 - RNA, 64 nt, Homo Sapiens
uaggaaaccaugaaugggaaggauggcaauaaguagcaacuauacuuuccaaugacuaaagaaa

SEQ ID NO: 538670 - RNA, 64 nt, Homo Sapiens
cauuucuuuuuuucuaugcgcaaaacugccugaaagcaacuacagaauuucauucauuugugcu

SEQ ID NO: 538671 - RNA, 64 nt, Homo Sapiens
aucugugcuguuucaaaguucucuguggcaaagcagcaacuauucacaaaauaucaccaaaaac

SEQ ID NO: 538672 - RNA, 64 nt, Homo Sapiens
cauuguauagagcagacagaaagauguugggucaagcaacuauugaagagaaauacaaagaaaa

SEQ ID NO: 538673 - RNA, 64 nt, Homo Sapiens
ggaaucauuuuuaaaaaucuguaacaagacaccuagcaacuauaaugaagccuuuauuucugaa

SEQ ID NO: 538674 - RNA, 62 nt, Homo Sapiens
uuaauugaccugaaaaagccuuuauauuugcaagcaacuaaauggaacuggagcaagcuuga

SEQ ID NO: 538675 - RNA, 64 nt, Homo Sapiens
aaaaccucuaauucugcaacaaucaauacaaaccagcaacuaauuucugaaguuauaaacuuau

SEQ ID NO: 538676 - RNA, 64 nt, Homo Sapiens
aaauauaugguaauuuaaagauuaauuucuuucaagcaacuaaacuaaaccaauuaagaaaaua

SEQ ID NO: 538677 - RNA, 64 nt, Homo Sapiens
uauauuucagagcaaauuagaugcaucacagaaaagcaacuacucuaaggcacaaagacauguc

SEQ ID NO: 538678 - RNA, 64 nt, Homo Sapiens
agggcagcucugccuccuccagaccaaggcgcagagcaacuaucaugcagcccuauggccgcuc

SEQ ID NO: 538679 - RNA, 64 nt, Homo Sapiens
uccgaauagaauguuuucuuuaagaggcaugaaaagcaacuauuguuguguuacaguguuaaaa

SEQ ID NO: 538680 - RNA, 64 nt, Homo Sapiens
ggaucacugacaaaaaacacugcaccaguaaggaagcaacuaaauuuuguuuuguucuuugaaa

SEQ ID NO: 538681 - RNA, 64 nt, Homo Sapiens
uggugaauaugcuguuuccucaguucagagagguagcaacuagguaaacuccuuauaaaaagca

SEQ ID NO: 538682 - RNA, 64 nt, Homo Sapiens
gcuuuuuauauugacauugccauugaauagcucuagcaacuauuauuauucccccaaacccuaa

SEQ ID NO: 538683 - RNA, 64 nt, Homo Sapiens
aaccauuacccaagaacguuugcugaauaagcucagcaacuaaauuugccacuuuuaaauaaug

SEQ ID NO: 538684 - RNA, 64 nt, Homo Sapiens
ugugauaaaagcaaauuagauuuuccuaaaauguagcaacuacauguuucauauuuaaaucaug

SEQ ID NO: 538685 - RNA, 64 nt, Homo Sapiens
uuaauaauaaugacucuaaauuaacugacgaagaagcaacuaagcaaagcgcuaaguaaaaaua

SEQ ID NO: 538686 - RNA, 64 nt, Homo Sapiens
ggagcugcauuaauucuggaagacgacuccaugcagcaacuacugaagaaaggaccagacuuca

SEQ ID NO: 538687 - RNA, 64 nt, Homo Sapiens
auuauuuuuggagcugaaaucuuuguaauauuaaagcaacuaguuucuaauucccaguuucugu

SEQ ID NO: 538688 - RNA, 64 nt, Homo Sapiens
uauugacaggcauugguauuauuagucauugcuaagcaacuaaaacuucaucaguucaaauaag

SEQ ID NO: 538689 - RNA, 64 nt, Homo Sapiens
aucuuuucugcuuuugaauugggcagaagauuuuagcaacuauauucuacaaauguuacuuaua

SEQ ID NO: 538690 - RNA, 64 nt, Homo Sapiens
uuagcucuguuagauauguuucuuucuaaggacaagcaacuauguauagacuuguuguuugaau

SEQ ID NO: 538691 - RNA, 64 nt, Homo Sapiens
gggugcuugagagacacuggcagauaccuugcaaagcaacuaguucaaguuauaggaaaggaag

SEQ ID NO: 538692 - RNA, 64 nt, Homo Sapiens
uacaaaagauucuaaggccucaacuucaaguuucagcaacuaccuaguacuucaaaguauuauu

SEQ ID NO: 538693 - RNA, 64 nt, Homo Sapiens
auguuuucugaaaccaggauauggcuuagcaaagagcaacuaauuauugacauaaaauaugaau

SEQ ID NO: 538694 - RNA, 64 nt, Homo Sapiens
guacugcaguugguaugaccccucuaaggaguguagcaacuacagucuaaagcugguuuaaugu

SEQ ID NO: 538695 - RNA, 64 nt, Homo Sapiens
aaaacuguucucuuuaaaauauuugucuuuaaacagcaacuacagaaguggaagugcuugauau

SEQ ID NO: 538696 - RNA, 64 nt, Homo Sapiens
gaaccaagcacugucagcaaaucucagguauuagagcaacuaugguugauugaaaagugucuca

SEQ ID NO: 538697 - RNA, 64 nt, Homo Sapiens
guuauuuuaucuugucauuuacaacauccauauaagcaacuagccauauaagcaaaauucauag

SEQ ID NO: 538698 - RNA, 64 nt, Homo Sapiens
augagcgauuaaauaguaauggauacaauuaaggagcaacuauuuuauaugacuguucuguaca

SEQ ID NO: 538699 - RNA, 64 nt, Homo Sapiens
cauuuucucuuuggauaauuuucaucgcauauccagcaacuauagaccaaaguuugcuuaaggu

SEQ ID NO: 538700 - RNA, 64 nt, Homo Sapiens
cauccuauauuuuuauucucagauucaaagaaagagcaacuacuuuggaccaaaagcccauggc

SEQ ID NO: 538701 - RNA, 64 nt, Homo Sapiens
acaguauaacacagaugaucugugagauuacucuagcaacuauugacaguuccuuauuggugug

SEQ ID NO: 538702 - RNA, 64 nt, Homo Sapiens
acuucuccuuagacacuuuguaaaguaaaauugaagcaacuacacaucaguuacagagaauuuc

SEQ ID NO: 538703 - RNA, 64 nt, Homo Sapiens
cuuccuuaauggacagccacacgguuuuaaguguagcaacuacuaucaggaacaucccugagaa

SEQ ID NO: 538704 - RNA, 64 nt, Homo Sapiens
uuuuauuccccacuacucuuuauaauuauuucuaagcaacuaguuuuuuuguugacuuuagauc

SEQ ID NO: 538705 - RNA, 64 nt, Homo Sapiens
auauauaauugauuuauguugaauauauggacuuagcaacuaaaaauaccacagaugguuaacc

SEQ ID NO: 538706 - RNA, 64 nt, Homo Sapiens
ccuuaaaaagacaaaaaaaauaaggcaaaaggaaagcaacuaagacacuggacuauccuuuaaa

SEQ ID NO: 538707 - RNA, 64 nt, Homo Sapiens
acaaauccaucuuugaaucuaaugguguacucauagcaacuauuacugguuuaaaugacaaaua

SEQ ID NO: 538708 - RNA, 64 nt, Homo Sapiens
ugagaccuaauaauuggccuaagugaacaaaauaagcaacuaaacacuagggaaagguaaauac

SEQ ID NO: 538709 - RNA, 64 nt, Homo Sapiens
gacuuugauucccauggagguaugggcugcugggagcaacuagucucuggcuucagaagugaac

SEQ ID NO: 538710 - RNA, 64 nt, Homo Sapiens
ggagauaugaugccucauaaggauuuucuccuucagcaacuacaguugcggguugucgaagggu

SEQ ID NO: 538711 - RNA, 64 nt, Homo Sapiens
ucggccuucacaaucugucaguucuaaccuccuaagcaacuaggccuucaguaaaugugauuca

SEQ ID NO: 538712 - RNA, 64 nt, Homo Sapiens
uuuaugaaacguaccacuauaaagacuguaagugagcaacuauuccauguauuaauagucacag

SEQ ID NO: 538713 - RNA, 64 nt, Homo Sapiens
uagaugauuaguugcauuauaaauagauuaacauagcaacuaagugauaauuugcugaagaagc

SEQ ID NO: 538714 - RNA, 64 nt, Homo Sapiens
ucuuuauauuguucuucauaaucacuguggcaccagcaacuacuuggcauagacuccuucacac

SEQ ID NO: 538715 - RNA, 64 nt, Homo Sapiens
uuuccugcaaaucaaauuuuuuuaaacuaggccaagcaacuaguaaacggauuuuguaacuagc

SEQ ID NO: 538716 - RNA, 64 nt, Homo Sapiens
agcaaagccauaagaagugguugaaaggaccaugagcaacuauaaagguagcuaccacaucauu

SEQ ID NO: 538717 - RNA, 64 nt, Homo Sapiens
guauucuuauucugaagauugguaaaagauauuuagcaacuaugaagaagaaauuauuguucau

SEQ ID NO: 538718 - RNA, 64 nt, Homo Sapiens
uuucucccaagcugauuuuauccaugauuuagcaagcaacuaauucaaaaagauauuguuguuu

SEQ ID NO: 538719 - RNA, 64 nt, Homo Sapiens
uauuuccauagcuuuuggcuuuauuugcuaccacagcaacuauacacuaucacuuuaaauacua

SEQ ID NO: 538720 - RNA, 64 nt, Homo Sapiens
ucuauugcaguagauauccuaaacaagguaaugaagcaacuauuuuuacauuugcaaauguagc

SEQ ID NO: 538721 - RNA, 64 nt, Homo Sapiens
agggauacccugcgaaaguaccucugucaguuucagcaacuacaguauguaacugucccagacu

SEQ ID NO: 538722 - RNA, 63 nt, Homo Sapiens
aauaaaauaagaaaauagcaauaaacuucuuuucagcaacuacagaaaacuaccucagcaucu

SEQ ID NO: 538723 - RNA, 64 nt, Homo Sapiens
ugaauuccaaguguauuuuaaaauagaggcuuugagcaacuaacuaaccacauuuuaggaucuc

SEQ ID NO: 538724 - RNA, 64 nt, Homo Sapiens
aaccggagaacuaacauguacucuuaaacaguuuagcaacuaauggcuuccagcugcccagugg

SEQ ID NO: 538725 - RNA, 64 nt, Homo Sapiens
ucccuaauggucuauaauuuuugaaggaacuaaaagcaacuagcgcuaaacuaugcaguuuuuc

SEQ ID NO: 538726 - RNA, 64 nt, Homo Sapiens
cuaaacaauguuauuguguuuuuuagcagauuucagcaacuauccuaucucauugcaauuugua

SEQ ID NO: 538727 - RNA, 64 nt, Homo Sapiens
gcuagucuucccuuaccucaguuaaaugguaguuagcaacuaggguguacccuggggcaauagg

SEQ ID NO: 538728 - RNA, 64 nt, Homo Sapiens
uuacagaauugaugugcuaacugaauaucauugcagcaacuagacuaagauauucaagaucucu

SEQ ID NO: 538729 - RNA, 64 nt, Homo Sapiens
ucguucuauguaccagguauuuuauuacugaacuagcaacuagccuuuuccaccuuuaaaaguu

SEQ ID NO: 538730 - RNA, 64 nt, Homo Sapiens
cuguacuguauaggcaacauguuguacucccaguagcaacuagaucucuuuuaccucuucuuua

SEQ ID NO: 538731 - RNA, 64 nt, Homo Sapiens
cauagugacccaaacaggaugagguaauuuccauagcaacuaaucauuggaaucauuuccauag

SEQ ID NO: 538732 - RNA, 64 nt, Homo Sapiens
uuauugcuuuauguuuaucuauauauuuuuuuaaagcaacuaacugaagagaaacaccugagcu

SEQ ID NO: 538733 - RNA, 64 nt, Homo Sapiens
caugcuccccccccuccuuauuuguagcaaucguagcaacuaauuccacuaaguacaagggagu

SEQ ID NO: 538734 - RNA, 64 nt, Homo Sapiens
uuaagacugggaggauuuugcuggggaaaguagcagcaacuagauuugggucuuuuugagagag

SEQ ID NO: 538735 - RNA, 64 nt, Homo Sapiens
uucaggaccugacuggacagauggaccuggcucaagcaacuacucuggaugcacuuugcugugu

SEQ ID NO: 538736 - RNA, 64 nt, Homo Sapiens
guccuguaaacacagaauuaaauuaggggacucaagcaacuauuauuauauuucuccuuuuugc

SEQ ID NO: 538737 - RNA, 64 nt, Homo Sapiens
ucuggccuucucugugggaccucugcuuuugugaagcaacuauuuauuugaagaccaggguaug

SEQ ID NO: 538738 - RNA, 64 nt, Homo Sapiens
ggccagaaaaugggcaaauucuuaccccuauucaagcaacuagaaucauuuaauauuucccugu

SEQ ID NO: 538739 - RNA, 64 nt, Homo Sapiens
uguccucccuucaacugccuacuguuuccacuccagcaacuacauccauuguuaacugaauguu

SEQ ID NO: 538740 - RNA, 64 nt, Homo Sapiens
aauguaaaauugguuaaaaaacuuuccugggaagagcaacuaaaggccaaaacacuacucagac

SEQ ID NO: 538741 - RNA, 64 nt, Homo Sapiens
ccuaaagaauauguauuaagguuaugaguuaguuagcaacuauuuguuaagucaaaucuaaaua

SEQ ID NO: 538742 - RNA, 64 nt, Homo Sapiens
gcaauaguauuaguauuuaccauuuuuccaaauuagcaacuaccagaccucacguguugcagug

SEQ ID NO: 538743 - RNA, 64 nt, Homo Sapiens
aaagcuaugauggcauugucgcugaguugacagaagcaacuauuguacaaauuaaaaauaacca

SEQ ID NO: 538744 - RNA, 64 nt, Homo Sapiens
ugaauauuuuagcuauauuuaguggcuuucugcaagcaacuagaacagagaaguaaugggucaa

SEQ ID NO: 538745 - RNA, 64 nt, Homo Sapiens
uagaagugucauaagaguucguuggcaacaaaccagcaacuauuccagugcuuuugauaaugug

SEQ ID NO: 538746 - RNA, 64 nt, Homo Sapiens
uagagaagaaacacugguccuucuuucaaaauuaagcaacuauuaaaagcgccauuuuauuuau

SEQ ID NO: 538747 - RNA, 64 nt, Homo Sapiens
aaccccuucagugcauuuucauuuuuuuauuaacagcaacuaaaauuuuauauauuguaaccag

SEQ ID NO: 538748 - RNA, 64 nt, Homo Sapiens
uuuacccuuuacuuauuaguguaauuuuaaguaaagcaacuaaauuuuaccaaaacugaagcug

SEQ ID NO: 538749 - RNA, 64 nt, Homo Sapiens
accccaauaauguucuauauagccuuugcuaaagagcaacuaauaaauuaaaccuauucuuucu

SEQ ID NO: 538750 - RNA, 64 nt, Homo Sapiens
uguuaacaauuaugacaucugcaauguuuuauaaagcaacuaauuuaauaaaaucacuguugug

SEQ ID NO: 538751 - RNA, 64 nt, Homo Sapiens
ccgcagggacuagaggcuuucggcuuuuugggacagcaacuaccuugcuuuuggaaaauacauu

SEQ ID NO: 538752 - RNA, 64 nt, Homo Sapiens
ugggcacaguggcucaugccucacuuaagaaguaagcaacuagcgcacugaagucaccauuagg

SEQ ID NO: 538753 - RNA, 64 nt, Homo Sapiens
auaaacuugagucaucccgaggaaaaccgugugaagcaacuacucuggguggcauccaagucuu

SEQ ID NO: 538754 - RNA, 64 nt, Homo Sapiens
auggugggggagaggggguuuuccaccccccugcagcaacuaagcucugggcucacgggguguu

SEQ ID NO: 538755 - RNA, 64 nt, Homo Sapiens
gagauucaggaugcagcuggucuuuacaccagcaagcaacuaaguagcuaacaguaaacagaca

SEQ ID NO: 538756 - RNA, 64 nt, Homo Sapiens
ugaguccggcucuucagcaggcugcacaaguggaagcaacuaauucuggugcucaggcugggcu

SEQ ID NO: 538757 - RNA, 62 nt, Homo Sapiens
gacgcaagccgaggaccgugaccagaagccugagcaacuacggcgccgccgcccagcccuga

SEQ ID NO: 538758 - RNA, 64 nt, Homo Sapiens
aaaugcaaagacacauuuuucuauaaaaagaaaaagcaacuaagguuaaaagcuauauuguggc

SEQ ID NO: 538759 - RNA, 64 nt, Homo Sapiens
ggguuuuucugggagcgaauaucaagugccugagagcaacuacaggacuaacuguguuuggguu

SEQ ID NO: 538760 - RNA, 64 nt, Homo Sapiens
guaaauccuuucuuaaugguuaaauaggauuguuagcaacuauggguuugcaguuuucugagua

SEQ ID NO: 538761 - RNA, 64 nt, Homo Sapiens
aguguggucguuauaaaccaauauugugaaaaauagcaacuauucauuuguucacaacaugcgu

SEQ ID NO: 538762 - RNA, 64 nt, Homo Sapiens
uacaucauuauuaauauaaagauagaauuuuagaagcaacuacgaccuaagaauucaaaagcug

SEQ ID NO: 538763 - RNA, 64 nt, Homo Sapiens
agacuaagccagcaccggacccuccuccagggacagcaacuaucagacaucagcccuugggggu

SEQ ID NO: 538764 - RNA, 54 nt, Homo Sapiens
ucuuccuucaaaguugugauagucagcaacuaagcaguuccaggauauaauuga

SEQ ID NO: 538765 - RNA, 64 nt, Homo Sapiens
aacugcaagcaacuugguaaauucuggccauagcagcaacuaaauaauguaccauaugugaaac

SEQ ID NO: 538766 - RNA, 64 nt, Homo Sapiens
ucuuagcucauaaaaauauaauaugacuugauaaagcaacuaaacucuuuccacaguguucaga

SEQ ID NO: 538767 - RNA, 64 nt, Homo Sapiens
cacuacccaacuuuaaaccauacuacaaggcuacagcaacuaaaacagcaugguacugguauaa

SEQ ID NO: 538768 - RNA, 64 nt, Homo Sapiens
augugucuugcugucauuuaugcuguucuuuaguagcaacuaaacuuaaaaugauugaaaauaa

SEQ ID NO: 538769 - RNA, 64 nt, Homo Sapiens
aaaaucacuugccaaaauccgagaacccacuagaagcaacuagguucuggcaagccugucuuca

SEQ ID NO: 538770 - RNA, 64 nt, Homo Sapiens
aguuuuguauguuaacaguaaucaguuucuggcuagcaacuagagcuuguuaguggguucagaa

SEQ ID NO: 538771 - RNA, 64 nt, Homo Sapiens
aagaggaccaaacaauucuuuauacaaauggaguagcaacuaguuuuguagcacuacauuuaau

SEQ ID NO: 538772 - RNA, 64 nt, Homo Sapiens
guccucugguaggaggcaaagguucuaucugcuuagcaacuaguuaauaagugguaucugacac

SEQ ID NO: 538773 - RNA, 64 nt, Homo Sapiens
ugugacugauagcuuuucccccccaacccccuccagcaacuacaagagucccccagcacacacu

SEQ ID NO: 538774 - RNA, 64 nt, Homo Sapiens
aagucugaaaagcaauugauccaccuuuugaagcagcaacuaucaauuuaguauuuguguaaaa

SEQ ID NO: 538775 - RNA, 64 nt, Homo Sapiens
ggcuguuccuggacacugugcuguccccguccugagcaacuaugcccccgccccaguagguuca

SEQ ID NO: 538776 - RNA, 64 nt, Homo Sapiens
augucaugguaugaacuagacucucauggugaacagcaacuauucuaccuucgaggcaggagcc

SEQ ID NO: 538777 - RNA, 64 nt, Homo Sapiens
cugcuuucuaagugggaagaggaagggagaggcaagcaacuagguacaaugucuaucaggaaag

SEQ ID NO: 538778 - RNA, 64 nt, Homo Sapiens
ucgagacacagaagugcaauaacugcccuaauuaagcaacuauuuguuaaaaagggccucuuuu

SEQ ID NO: 538779 - RNA, 64 nt, Homo Sapiens
cauucucuguucugagaucuuggauagggauuucagcaacuaaaagcaugagaaauaugauauu

SEQ ID NO: 538780 - RNA, 64 nt, Homo Sapiens
gaaaauuaaagugaaaguugaaaauguacaacuaagcaacuaaauccaauggauuugccuucuc

SEQ ID NO: 538781 - RNA, 64 nt, Homo Sapiens
augaaacauaaaaccuuuuaaaguauaaacauaaagcaacuaaauuuuuuccaggggugagaau

SEQ ID NO: 538782 - RNA, 64 nt, Homo Sapiens
ucgagacacagaagugcaauaacugcccuaauuaagcaacuauuuguuaaaaagggccccuuuu

SEQ ID NO: 538783 - RNA, 52 nt, Homo Sapiens
cuacuccccuaucucccugagcagcaacuaaguuuaggcccagcugccagac

SEQ ID NO: 538784 - RNA, 64 nt, Homo Sapiens
uuggaaauaccuggauauuugcuagaggaaaaaugaaagcaaaacuucguacacagugccuugc

SEQ ID NO: 538785 - RNA, 64 nt, Homo Sapiens
uggucaaaaaauaagucaucagcacuuaagaaaugaaagcaacuuuugaaauuuucuguuaaaa

SEQ ID NO: 538786 - RNA, 64 nt, Homo Sapiens
acaauguucuuuaccacacggccaggugggaccugaaagcaaagaccagcuacggccagaaagg

SEQ ID NO: 538787 - RNA, 64 nt, Homo Sapiens
uguugcccugaugauaacugaggaugaacuaggagaaagcaauucucuuucauauuguaagucc

SEQ ID NO: 538788 - RNA, 64 nt, Homo Sapiens
agagaaaugaacccuacuugcuaucucuaucuuagaaagcaaaaacaaacaggaguuuccaggg

SEQ ID NO: 538789 - RNA, 64 nt, Homo Sapiens
ucagagagcuaaaaccagaaauuuccagacucaugaaagcaaccccccagccucuccccaaccc

SEQ ID NO: 538790 - RNA, 64 nt, Homo Sapiens
acaaauacaagccaagcuagaaggaagcaccuaugaaagcaacaacuuuguuucucauccauag

SEQ ID NO: 538791 - RNA, 64 nt, Homo Sapiens
gcaaaaaguacauagugaauuuuaaaauguagaagaaagcaaaaaauaaaauaaguccuaaagu

SEQ ID NO: 538792 - RNA, 50 nt, Homo Sapiens
caacaucaacaaauaaauaagaaagcaaaaagaucugggauauguguugg

SEQ ID NO: 538793 - RNA, 64 nt, Homo Sapiens
aauucucaucaucucuguuauacaccuguaucaugaaagcaaaaagaaguaaacaucaggaguc

SEQ ID NO: 538794 - RNA, 64 nt, Homo Sapiens
uaaagcuuucuuaagccucauuaagaaaaaaacugaaagcaaucuauccuugugugccacuggu

SEQ ID NO: 538795 - RNA, 64 nt, Homo Sapiens
cuugugugccacugguguucuuuccacuuuauacgaaagcaaguagccaugcuuugguugugug

SEQ ID NO: 538796 - RNA, 64 nt, Homo Sapiens
cauuauaaaaguaauuuuaauaacaaacauuaaugaaagcaaaagaaaucuuacauuuuugcaa

SEQ ID NO: 538797 - RNA, 64 nt, Homo Sapiens
ucuuuaauauugcagggagcagaauaucuucagagaaagcaaaacuuaaagaugaucaugguuc

SEQ ID NO: 538798 - RNA, 64 nt, Homo Sapiens
caaaggcaugugauugauuaaugauucccccuuagaaagcaaguguuaccaaaguuguguuauc

SEQ ID NO: 538799 - RNA, 64 nt, Homo Sapiens
uuccaaugaauguacagcacuuccauuaacuuuugaaagcaacacagccuuaaacucaaugcuu

SEQ ID NO: 538800 - RNA, 64 nt, Homo Sapiens
aagauugagaagccauguacuuugugaacuggaagaaagcaacaaggagagcaagaaggaaaga

SEQ ID NO: 538801 - RNA, 64 nt, Homo Sapiens
gcaagggaccuucaugcccuuaucuggguaagaagaaagcaaaaaaacagaguauguccgaugg

SEQ ID NO: 538802 - RNA, 64 nt, Homo Sapiens
aauauauauuugauauacccuuguuccacauuuugaaagcaaaagaaaagccuuauauuuuagu

SEQ ID NO: 538803 - RNA, 64 nt, Homo Sapiens
cauggggaaugaauacuuugcaaaaauggaaacugaaagcaaguagaauuuuuuuuuaauggcu

SEQ ID NO: 538804 - RNA, 64 nt, Homo Sapiens
uggaugugauucccaacacaacuuauuuacgugugaaagcaacaauucuccuguucagaauaau

SEQ ID NO: 538805 - RNA, 64 nt, Homo Sapiens
aguggccuauaaagaacauuauguuauuuuuacugaaagcaagcgauugaaaaguuuugagaaa

SEQ ID NO: 538806 - RNA, 64 nt, Homo Sapiens
aucagaacaauguaacauuuacaaaugacauauugaaagcaaaggcuguuuuauuuagccaaga

SEQ ID NO: 538807 - RNA, 64 nt, Homo Sapiens
augauuaccauuaggaguuacuuuauguauuguugaaagcaaauuuuaaacaugauguuuuaga

SEQ ID NO: 538808 - RNA, 64 nt, Homo Sapiens
cuuuuggaacuuguuucaagccaaaaacucucaagaaagcaaauugcaccucagcuggauugau

SEQ ID NO: 538809 - RNA, 64 nt, Homo Sapiens
acaaaaauuaugaaaagguauauuugcuucucgggaaagcaaagaagcugcuuuaaaaaauaaa

SEQ ID NO: 538810 - RNA, 64 nt, Homo Sapiens
uuuuggaguauguuaaguuguugauauuauacaggaaagcaauaacaugcauuuaauauuuccu

SEQ ID NO: 538811 - RNA, 64 nt, Homo Sapiens
aagaaauccggagaagcugcucagaagcgauuaugaaagcaacaagauuuuugaaagcgcaaug

SEQ ID NO: 538812 - RNA, 64 nt, Homo Sapiens
gcuuugugacuauuaaauguucauuaucuguacugaaagcaaauaaaccucacacuacuguauu

SEQ ID NO: 538813 - RNA, 64 nt, Homo Sapiens
ugauggucaggaucucaugaaugacuagugccuagaaagcaauguguaaguuugcauaucaguc

SEQ ID NO: 538814 - RNA, 64 nt, Homo Sapiens
acaaaaaaaaaaaacaaaaauguuauauucuggggaaagcaaaaauuucugaaaaaacacucca

SEQ ID NO: 538815 - RNA, 64 nt, Homo Sapiens
gccuuuggguuuauuuugggucuuucuuaaccgugaaagcaaaaauuugaagaaaacguauaaa

SEQ ID NO: 538816 - RNA, 64 nt, Homo Sapiens
aggaauuugcugccccccaccaguggcuucuagggaaagcaaggaccucacaugccaggugccc

SEQ ID NO: 538817 - RNA, 64 nt, Homo Sapiens
ggcuuucaauccuuuguuucuaugccuacagacagaaagcaagaugucuaauauuagacauaca

SEQ ID NO: 538818 - RNA, 64 nt, Homo Sapiens
acaugcggccugcaugguggcuacaguacugacagaaagcaaggggaggcucucucugccuagu

SEQ ID NO: 538819 - RNA, 64 nt, Homo Sapiens
acugcccuucauucagccuugugccagucuuccagaaagcaaggggguucacauaggcucucag

SEQ ID NO: 538820 - RNA, 64 nt, Homo Sapiens
cuccauugucagaggaggaaacggggucaggcaggaaagcaacuuaaaggagggccugcaagca

SEQ ID NO: 538821 - RNA, 64 nt, Homo Sapiens
uuacagugacugcuucuucucagcuucucugguugaaagcaagcuggcgaaguaagaggaggua

SEQ ID NO: 538822 - RNA, 64 nt, Homo Sapiens
ugcauggguaagguaaagugcgauaguucaaguggaaagcaagagaaugaccagugaccuugcu

SEQ ID NO: 538823 - RNA, 64 nt, Homo Sapiens
agggccuucaugccggcagcagcuagcaaagccagaaagcaagucuaacaggaucuaagaugac

SEQ ID NO: 538824 - RNA, 64 nt, Homo Sapiens
gacugcugccucaucgauaccccauuuagcuccagaaagcaaagaaaacucgaguaacacuugu

SEQ ID NO: 538825 - RNA, 64 nt, Homo Sapiens
guugacggcccuucuccccacgccuguuucuuuugaaagcaaguguagacaccuucgagggcag

SEQ ID NO: 538826 - RNA, 64 nt, Homo Sapiens
auagucagguauucucuccaaugcaccuaccucagaaagcaaguguauuucgguuuguguaucc

SEQ ID NO: 538827 - RNA, 64 nt, Homo Sapiens
guucacaacagugaaaaguuggugcauagcaagugaaagcaagucugcggaccccucgucauca

SEQ ID NO: 538828 - RNA, 64 nt, Homo Sapiens; identical to SEQ ID NO: 175085

SEQ ID NO: 538829 - RNA, 64 nt, Homo Sapiens; identical to SEQ ID NO: 175086

SEQ ID NO: 538830 - RNA, 64 nt, Homo Sapiens
uugagggcaagucucuggaaaagaggcuguaggcaucuggcagcuaccaugcaugguagugugu

SEQ ID NO: 538831 - RNA, 64 nt, Homo Sapiens
ggguggggguccugggcacuggcugugugaagggaucuggcagggcaccacagcgcccccuacu

SEQ ID NO: 538832 - RNA, 64 nt, Homo Sapiens
uuuaaacauuuaaaaauuauuagaaauuaguuuuaucuggcauuauggccuucccaccuucugu

SEQ ID NO: 538833 - RNA, 64 nt, Homo Sapiens
uaguuuuauugguuccuuagucaaaaguaauagaaucuggcauaauuucauacucugugaauau

SEQ ID NO: 538834 - RNA, 64 nt, Homo Sapiens
ggggguagaauacacucuugauaauagcccuuccaucuggcaguacugcugccuuucauuuaua

SEQ ID NO: 538835 - RNA, 64 nt, Homo Sapiens
caacaaaagugccuggcaucaucuggacuuuagaaucuggcacacucagggguaaccugcuuac

SEQ ID NO: 538836 - RNA, 64 nt, Homo Sapiens
uucuaaucagguuauagguccaauauugauucccaucuggcauaauucuguacaacuuucugua

SEQ ID NO: 538837 - RNA, 64 nt, Homo Sapiens
guuugcggagguuagauuuauauuaaaauaacaaaucuggcaugacagaauuuaacguugaaua

SEQ ID NO: 538838 - RNA, 64 nt, Homo Sapiens
cuucuucaacagguugcuaauaauuuauacuggaaucuggcauuuuuccaagccaagagaagau

SEQ ID NO: 538839 - RNA, 64 nt, Homo Sapiens
cuacgugguucaucuacaaugguuaccauaaaaaaucuggcaggauuuuaaaacucaaucaguc

SEQ ID NO: 538840 - RNA, 64 nt, Homo Sapiens
ugucccagucacuugcagaauggguuguguguauaucuggcauguguggggugugugugggaug

SEQ ID NO: 538841 - RNA, 64 nt, Homo Sapiens
uguguguugggugguguguguaugugggcuguguaucuggcacauguggcguguguguaugaug

SEQ ID NO: 538842 - RNA, 64 nt, Homo Sapiens
cucggagccuguuuccaagaaggaauugguugucaucuggcaguguugcgcgucacaagagagc

SEQ ID NO: 538843 - RNA, 64 nt, Homo Sapiens
aaacgcauccccauugugugauguguucagaugcaucuggcaccaauuagguauuucuuaaaac

SEQ ID NO: 538844 - RNA, 64 nt, Homo Sapiens
gcacugaguguggcacaggcguguuuguccugccaucuggcacuugauaaccacgauggagccc

SEQ ID NO: 538845 - RNA, 64 nt, Homo Sapiens
acagcugcaucuugcuugugagaaaagccaccccaucuggcaccuaauaauaaucuuaaagaug

SEQ ID NO: 538846 - RNA, 64 nt, Homo Sapiens
aguuuaacuauauuccaaguuuugcuugauuauguaaugucaaauaauauaguaugcacugcua

SEQ ID NO: 538847 - RNA, 64 nt, Homo Sapiens
gacuaaaaaacuuagaguuaaaccugguuaguauuaaugucaguuguuaaacuucaauuccugu

SEQ ID NO: 538848 - RNA, 64 nt, Homo Sapiens
cuuuugaagaagagaauagcguagugugcaacucuaaugucaugauguauucuaacauuucuau

SEQ ID NO: 538849 - RNA, 64 nt, Homo Sapiens
uaccugaaaacagugagauuuaaccuuuaccauuuaaugucaucaugucagaacugcuuaaaau

SEQ ID NO: 538850 - RNA, 64 nt, Homo Sapiens
guuucacuaaauaaaugaauguguugggacgcuuuaaugucaggguuauguucgaaucugcuuu

SEQ ID NO: 538851 - RNA, 64 nt, Homo Sapiens
gcccaguuuugacuuuuguucaguaaacuaccauuaaugucaaugagauuugcaggggaaacau

SEQ ID NO: 538852 - RNA, 64 nt, Homo Sapiens
uuuugcaauaaaguacauuuugacuuuguuggcauaaugucaguaacauacauauuccaguggu

SEQ ID NO: 538853 - RNA, 64 nt, Homo Sapiens
uauucuaugucuuuaaaaauuugaucuugacauuuaaugucacaaaguuuuguuuuuuuaaaaa

SEQ ID NO: 538854 - RNA, 64 nt, Homo Sapiens
uauaagcauguuaaauaccauauuuacauauugauaaugucauugguauaugguggcuguuuac

SEQ ID NO: 538855 - RNA, 64 nt, Homo Sapiens
uuggaauccuagccuacuaugugaaaauuaagucuaaugucagaauaacuuacagaaaaauaga

SEQ ID NO: 538856 - RNA, 64 nt, Homo Sapiens
uaggucauuaguuuuguuaauaggguauauuucuuaaugucauccauguguugugcaucuuguu

SEQ ID NO: 538857 - RNA, 64 nt, Homo Sapiens
uuuauggauuguagacccaguuuaagaucuccauuaaugucauugcugguauaaucagauuguu

SEQ ID NO: 538858 - RNA, 64 nt, Homo Sapiens
cuacgaacagguaccuugcugucuugacaaauccuaaugucacgccuacagccccaacacaagc

SEQ ID NO: 538859 - RNA, 64 nt, Homo Sapiens
uuaaaaaaaccuguaguuucauuaccuuuuugaauaaugucauacaaaaaauguauuuguuuuu

SEQ ID NO: 538860 - RNA, 64 nt, Homo Sapiens
uuugggucuuggguucaaguaaauagguuguauauaaugucagggucuguccauauguauuugu

SEQ ID NO: 538861 - RNA, 64 nt, Homo Sapiens
gguauuuaaaaaugaauauuuaaauuccauaaaauaaugucauuuauucagaagcaguuaucaa

SEQ ID NO: 538862 - RNA, 64 nt, Homo Sapiens
auuuugaaaaaauaaauuuauguaaaauuuuuacuaaugucauuugugaauucaauacaggcua

SEQ ID NO: 538863 - RNA, 64 nt, Homo Sapiens
gcuaaaaaauaaauaaaagcuggcaaaaucuuguuaaugucauuaagcccucauuuuuauaacc

SEQ ID NO: 538864 - RNA, 64 nt, Homo Sapiens
auagaaccaacugguaaucauucugcauagcaucuaaugucaaaaauuuuuggcccugcauaag

SEQ ID NO: 538865 - RNA, 64 nt, Homo Sapiens
uaauauugaccugccauacguuggagguccuccauaaugucagaaguuuugcuuauuuuuaaau

SEQ ID NO: 538866 - RNA, 64 nt, Homo Sapiens
gacauuaaacuaacuccagguaacuaaagcuaguuaaugucaguccauuugaauaaaaugacaa

SEQ ID NO: 538867 - RNA, 64 nt, Homo Sapiens
caucuuuaagguauugugcaugugcauaaguucuuaaugucaacccuuuuggucauuauuucag

SEQ ID NO: 538868 - RNA, 64 nt, Homo Sapiens
uggcagccaguuguguuuuuggaucacagggugauaaugucaauacaugguauguagaagccua

SEQ ID NO: 538869 - RNA, 64 nt, Homo Sapiens
aggcacuucuuuauuaauuaaguuaauugcagucuaaugucaaggaagcugccccccaccccuc

SEQ ID NO: 538870 - RNA, 64 nt, Homo Sapiens
caaacacaggaggacuuaauggcagcuuggcauuuaaugucaaaauccaagccguggcauuuaa

SEQ ID NO: 538871 - RNA, 64 nt, Homo Sapiens
uggcauuuaaugucaaaauccaagccguggcauuuaaugucaaaaugacuucagaccacuucua

SEQ ID NO: 538872 - RNA, 64 nt, Homo Sapiens; identical to SEQ ID NO: 385426

SEQ ID NO: 538873 - RNA, 64 nt, Homo Sapiens; identical to SEQ ID NO: 385427

SEQ ID NO: 538874 - RNA, 64 nt, Homo Sapiens; identical to SEQ ID NO: 385428

SEQ ID NO: 538875 - RNA, 64 nt, Homo Sapiens; identical to SEQ ID NO: 385429

SEQ ID NO: 538876 - RNA, 64 nt, Homo Sapiens; identical to SEQ ID NO: 385430

SEQ ID NO: 538877 - RNA, 64 nt, Homo Sapiens; identical to SEQ ID NO: 385431

SEQ ID NO: 538878 - RNA, 64 nt, Homo Sapiens; identical to SEQ ID NO: 385432

SEQ ID NO: 538879 - RNA, 64 nt, Homo Sapiens; identical to SEQ ID NO: 385433

SEQ ID NO: 538880 - RNA, 64 nt, Homo Sapiens; identical to SEQ ID NO: 385434

SEQ ID NO: 538881 - RNA, 64 nt, Homo Sapiens; identical to SEQ ID NO: 385435

SEQ ID NO: 538882 - RNA, 64 nt, Homo Sapiens; identical to SEQ ID NO: 385436

SEQ ID NO: 538883 - RNA, 64 nt, Homo Sapiens; identical to SEQ ID NO: 385437

SEQ ID NO: 538884 - RNA, 64 nt, Homo Sapiens; identical to SEQ ID NO: 385438

SEQ ID NO: 538885 - RNA, 64 nt, Homo Sapiens; identical to SEQ ID NO: 385439

SEQ ID NO: 538886 - RNA, 64 nt, Homo Sapiens; identical to SEQ ID NO: 385440

SEQ ID NO: 538887 - RNA, 64 nt, Homo Sapiens; identical to SEQ ID NO: 385441

SEQ ID NO: 538888 - RNA, 64 nt, Homo Sapiens; identical to SEQ ID NO: 385442

SEQ ID NO: 538889 - RNA, 63 nt, Homo Sapiens; identical to SEQ ID NO: 65136

SEQ ID NO: 538890 - RNA, 63 nt, Homo Sapiens; identical to SEQ ID NO: 65137

SEQ ID NO: 538891 - RNA, 63 nt, Homo Sapiens; identical to SEQ ID NO: 65138

SEQ ID NO: 538892 - RNA, 63 nt, Homo Sapiens; identical to SEQ ID NO: 65139

SEQ ID NO: 538893 - RNA, 63 nt, Homo Sapiens; identical to SEQ ID NO: 65140

SEQ ID NO: 538894 - RNA, 63 nt, Homo Sapiens; identical to SEQ ID NO: 65141

SEQ ID NO: 538895 - RNA, 63 nt, Homo Sapiens; identical to SEQ ID NO: 65142

SEQ ID NO: 538896 - RNA, 63 nt, Homo Sapiens; identical to SEQ ID NO: 65143

SEQ ID NO: 538897 - RNA, 63 nt, Homo Sapiens; identical to SEQ ID NO: 65144

SEQ ID NO: 538898 - RNA, 63 nt, Homo Sapiens; identical to SEQ ID NO: 65145

SEQ ID NO: 538899 - RNA, 63 nt, Homo Sapiens; identical to SEQ ID NO: 65146

SEQ ID NO: 538900 - RNA, 63 nt, Homo Sapiens; identical to SEQ ID NO: 65147

SEQ ID NO: 538901 - RNA, 63 nt, Homo Sapiens; identical to SEQ ID NO: 65148

SEQ ID NO: 538902 - RNA, 63 nt, Homo Sapiens; identical to SEQ ID NO: 65149

SEQ ID NO: 538903 - RNA, 63 nt, Homo Sapiens; identical to SEQ ID NO: 65150

SEQ ID NO: 538904 - RNA, 63 nt, Homo Sapiens; identical to SEQ ID NO: 65151

SEQ ID NO: 538905 - RNA, 63 nt, Homo Sapiens; identical to SEQ ID NO: 65152

SEQ ID NO: 538906 - RNA, 63 nt, Homo Sapiens; identical to SEQ ID NO: 65153

SEQ ID NO: 538907 - RNA, 63 nt, Homo Sapiens; identical to SEQ ID NO: 65154

SEQ ID NO: 538908 - RNA, 63 nt, Homo Sapiens; identical to SEQ ID NO: 65155

SEQ ID NO: 538909 - RNA, 63 nt, Homo Sapiens; identical to SEQ ID NO: 65156

SEQ ID NO: 538910 - RNA, 63 nt, Homo Sapiens; identical to SEQ ID NO: 65157

SEQ ID NO: 538911 - RNA, 63 nt, Homo Sapiens; identical to SEQ ID NO: 65158

SEQ ID NO: 538912 - RNA, 63 nt, Homo Sapiens; identical to SEQ ID NO: 65159

SEQ ID NO: 538913 - RNA, 63 nt, Homo Sapiens; identical to SEQ ID NO: 65160

SEQ ID NO: 538914 - RNA, 63 nt, Homo Sapiens; identical to SEQ ID NO: 65161

SEQ ID NO: 538915 - RNA, 63 nt, Homo Sapiens; identical to SEQ ID NO: 65162

SEQ ID NO: 538916 - RNA, 63 nt, Homo Sapiens; identical to SEQ ID NO: 65163

SEQ ID NO: 538917 - RNA, 63 nt, Homo Sapiens; identical to SEQ ID NO: 65164

SEQ ID NO: 538918 - RNA, 63 nt, Homo Sapiens; identical to SEQ ID NO: 65165

SEQ ID NO: 538919 - RNA, 63 nt, Homo Sapiens; identical to SEQ ID NO: 65166

SEQ ID NO: 538920 - RNA, 63 nt, Homo Sapiens; identical to SEQ ID NO: 65167

SEQ ID NO: 538921 - RNA, 63 nt, Homo Sapiens; identical to SEQ ID NO: 65168

SEQ ID NO: 538922 - RNA, 63 nt, Homo Sapiens; identical to SEQ ID NO: 65169

SEQ ID NO: 538923 - RNA, 63 nt, Homo Sapiens; identical to SEQ ID NO: 65170

SEQ ID NO: 538924 - RNA, 63 nt, Homo Sapiens; identical to SEQ ID NO: 65171

SEQ ID NO: 538925 - RNA, 63 nt, Homo Sapiens; identical to SEQ ID NO: 65172

SEQ ID NO: 538926 - RNA, 63 nt, Homo Sapiens; identical to SEQ ID NO: 65173

SEQ ID NO: 538927 - RNA, 63 nt, Homo Sapiens; identical to SEQ ID NO: 65174

SEQ ID NO: 538928 - RNA, 63 nt, Homo Sapiens; identical to SEQ ID NO: 65175

SEQ ID NO: 538929 - RNA, 63 nt, Homo Sapiens; identical to SEQ ID NO: 65176

SEQ ID NO: 538930 - RNA, 63 nt, Homo Sapiens; identical to SEQ ID NO: 65177

SEQ ID NO: 538931 - RNA, 63 nt, Homo Sapiens; identical to SEQ ID NO: 65178

SEQ ID NO: 538932 - RNA, 63 nt, Homo Sapiens; identical to SEQ ID NO: 65179

SEQ ID NO: 538933 - RNA, 63 nt, Homo Sapiens; identical to SEQ ID NO: 65180

SEQ ID NO: 538934 - RNA, 63 nt, Homo Sapiens; identical to SEQ ID NO: 65181

SEQ ID NO: 538935 - RNA, 63 nt, Homo Sapiens; identical to SEQ ID NO: 65182

SEQ ID NO: 538936 - RNA, 63 nt, Homo Sapiens; identical to SEQ ID NO: 65183

SEQ ID NO: 538937 - RNA, 63 nt, Homo Sapiens; identical to SEQ ID NO: 65184

SEQ ID NO: 538938 - RNA, 63 nt, Homo Sapiens; identical to SEQ ID NO: 65185

SEQ ID NO: 538939 - RNA, 63 nt, Homo Sapiens; identical to SEQ ID NO: 65186

SEQ ID NO: 538940 - RNA, 63 nt, Homo Sapiens; identical to SEQ ID NO: 65187

SEQ ID NO: 538941 - RNA, 63 nt, Homo Sapiens; identical to SEQ ID NO: 65188

SEQ ID NO: 538942 - RNA, 63 nt, Homo Sapiens; identical to SEQ ID NO: 65189

SEQ ID NO: 538943 - RNA, 63 nt, Homo Sapiens; identical to SEQ ID NO: 65190

SEQ ID NO: 538944 - RNA, 63 nt, Homo Sapiens; identical to SEQ ID NO: 65191

SEQ ID NO: 538945 - RNA, 63 nt, Homo Sapiens; identical to SEQ ID NO: 65192

SEQ ID NO: 538946 - RNA, 63 nt, Homo Sapiens; identical to SEQ ID NO: 65193

SEQ ID NO: 538947 - RNA, 63 nt, Homo Sapiens; identical to SEQ ID NO: 65194

SEQ ID NO: 538948 - RNA, 63 nt, Homo Sapiens; identical to SEQ ID NO: 65195

SEQ ID NO: 538949 - RNA, 63 nt, Homo Sapiens; identical to SEQ ID NO: 65196

SEQ ID NO: 538950 - RNA, 63 nt, Homo Sapiens; identical to SEQ ID NO: 65197

SEQ ID NO: 538951 - RNA, 63 nt, Homo Sapiens; identical to SEQ ID NO: 65198

SEQ ID NO: 538952 - RNA, 63 nt, Homo Sapiens; identical to SEQ ID NO: 65199

SEQ ID NO: 538953 - RNA, 63 nt, Homo Sapiens; identical to SEQ ID NO: 65200

SEQ ID NO: 538954 - RNA, 63 nt, Homo Sapiens; identical to SEQ ID NO: 65201

SEQ ID NO: 538955 - RNA, 63 nt, Homo Sapiens; identical to SEQ ID NO: 65202

SEQ ID NO: 538956 - RNA, 63 nt, Homo Sapiens; identical to SEQ ID NO: 65203

SEQ ID NO: 538957 - RNA, 63 nt, Homo Sapiens; identical to SEQ ID NO: 65204

SEQ ID NO: 538958 - RNA, 63 nt, Homo Sapiens; identical to SEQ ID NO: 65205

SEQ ID NO: 538959 - RNA, 63 nt, Homo Sapiens; identical to SEQ ID NO: 65206

SEQ ID NO: 538960 - RNA, 63 nt, Homo Sapiens; identical to SEQ ID NO: 65207

SEQ ID NO: 538961 - RNA, 63 nt, Homo Sapiens; identical to SEQ ID NO: 65208

SEQ ID NO: 538962 - RNA, 63 nt, Homo Sapiens; identical to SEQ ID NO: 65209

SEQ ID NO: 538963 - RNA, 63 nt, Homo Sapiens; identical to SEQ ID NO: 65210

SEQ ID NO: 538964 - RNA, 63 nt, Homo Sapiens; identical to SEQ ID NO: 65211

SEQ ID NO: 538965 - RNA, 63 nt, Homo Sapiens; identical to SEQ ID NO: 65212

SEQ ID NO: 538966 - RNA, 63 nt, Homo Sapiens; identical to SEQ ID NO: 65213

SEQ ID NO: 538967 - RNA, 63 nt, Homo Sapiens; identical to SEQ ID NO: 65214

SEQ ID NO: 538968 - RNA, 63 nt, Homo Sapiens; identical to SEQ ID NO: 65215

SEQ ID NO: 538969 - RNA, 63 nt, Homo Sapiens; identical to SEQ ID NO: 65216

SEQ ID NO: 538970 - RNA, 63 nt, Homo Sapiens; identical to SEQ ID NO: 65217

SEQ ID NO: 538971 - RNA, 63 nt, Homo Sapiens; identical to SEQ ID NO: 65218

SEQ ID NO: 538972 - RNA, 63 nt, Homo Sapiens; identical to SEQ ID NO: 65219

SEQ ID NO: 538973 - RNA, 63 nt, Homo Sapiens; identical to SEQ ID NO: 65220

SEQ ID NO: 538974 - RNA, 63 nt, Homo Sapiens; identical to SEQ ID NO: 65221

SEQ ID NO: 538975 - RNA, 63 nt, Homo Sapiens; identical to SEQ ID NO: 65222

SEQ ID NO: 538976 - RNA, 63 nt, Homo Sapiens; identical to SEQ ID NO: 65223

SEQ ID NO: 538977 - RNA, 63 nt, Homo Sapiens; identical to SEQ ID NO: 65224

SEQ ID NO: 538978 - RNA, 63 nt, Homo Sapiens; identical to SEQ ID NO: 65225

SEQ ID NO: 538979 - RNA, 63 nt, Homo Sapiens; identical to SEQ ID NO: 65226

SEQ ID NO: 538980 - RNA, 63 nt, Homo Sapiens; identical to SEQ ID NO: 65227

SEQ ID NO: 538981 - RNA, 63 nt, Homo Sapiens; identical to SEQ ID NO: 65228

SEQ ID NO: 538982 - RNA, 63 nt, Homo Sapiens; identical to SEQ ID NO: 65229

SEQ ID NO: 538983 - RNA, 63 nt, Homo Sapiens; identical to SEQ ID NO: 65230

SEQ ID NO: 538984 - RNA, 63 nt, Homo Sapiens; identical to SEQ ID NO: 65231

SEQ ID NO: 538985 - RNA, 63 nt, Homo Sapiens; identical to SEQ ID NO: 65232

SEQ ID NO: 538986 - RNA, 63 nt, Homo Sapiens; identical to SEQ ID NO: 65233

SEQ ID NO: 538987 - RNA, 63 nt, Homo Sapiens; identical to SEQ ID NO: 65234

SEQ ID NO: 538988 - RNA, 63 nt, Homo Sapiens; identical to SEQ ID NO: 65235

SEQ ID NO: 538989 - RNA, 63 nt, Homo Sapiens; identical to SEQ ID NO: 65236

SEQ ID NO: 538990 - RNA, 63 nt, Homo Sapiens; identical to SEQ ID NO: 65237

SEQ ID NO: 538991 - RNA, 63 nt, Homo Sapiens; identical to SEQ ID NO: 65238

SEQ ID NO: 538992 - RNA, 63 nt, Homo Sapiens; identical to SEQ ID NO: 65239

SEQ ID NO: 538993 - RNA, 63 nt, Homo Sapiens; identical to SEQ ID NO: 65240

SEQ ID NO: 538994 - RNA, 63 nt, Homo Sapiens; identical to SEQ ID NO: 65241

SEQ ID NO: 538995 - RNA, 63 nt, Homo Sapiens; identical to SEQ ID NO: 65242

SEQ ID NO: 538996 - RNA, 63 nt, Homo Sapiens; identical to SEQ ID NO: 65243

SEQ ID NO: 538997 - RNA, 63 nt, Homo Sapiens; identical to SEQ ID NO: 65244

SEQ ID NO: 538998 - RNA, 63 nt, Homo Sapiens; identical to SEQ ID NO: 65245

SEQ ID NO: 538999 - RNA, 63 nt, Homo Sapiens; identical to SEQ ID NO: 65246

SEQ ID NO: 539000 - RNA, 63 nt, Homo Sapiens; identical to SEQ ID NO: 65247

SEQ ID NO: 539001 - RNA, 63 nt, Homo Sapiens; identical to SEQ ID NO: 65248

SEQ ID NO: 539002 - RNA, 63 nt, Homo Sapiens; identical to SEQ ID NO: 65249

SEQ ID NO: 539003 - RNA, 63 nt, Homo Sapiens; identical to SEQ ID NO: 65250

SEQ ID NO: 539004 - RNA, 63 nt, Homo Sapiens; identical to SEQ ID NO: 65251

SEQ ID NO: 539005 - RNA, 63 nt, Homo Sapiens; identical to SEQ ID NO: 65252

SEQ ID NO: 539006 - RNA, 63 nt, Homo Sapiens; identical to SEQ ID NO: 65253

SEQ ID NO: 539007 - RNA, 63 nt, Homo Sapiens; identical to SEQ ID NO: 65254

SEQ ID NO: 539008 - RNA, 63 nt, Homo Sapiens; identical to SEQ ID NO: 65255

SEQ ID NO: 539009 - RNA, 63 nt, Homo Sapiens; identical to SEQ ID NO: 65256

SEQ ID NO: 539010 - RNA, 63 nt, Homo Sapiens; identical to SEQ ID NO: 65257

SEQ ID NO: 539011 - RNA, 63 nt, Homo Sapiens; identical to SEQ ID NO: 65258

SEQ ID NO: 539012 - RNA, 63 nt, Homo Sapiens; identical to SEQ ID NO: 65259

SEQ ID NO: 539013 - RNA, 63 nt, Homo Sapiens; identical to SEQ ID NO: 65260

SEQ ID NO: 539014 - RNA, 63 nt, Homo Sapiens; identical to SEQ ID NO: 65261

SEQ ID NO: 539015 - RNA, 63 nt, Homo Sapiens; identical to SEQ ID NO: 65262

SEQ ID NO: 539016 - RNA, 63 nt, Homo Sapiens; identical to SEQ ID NO: 65263

SEQ ID NO: 539017 - RNA, 63 nt, Homo Sapiens; identical to SEQ ID NO: 65264

SEQ ID NO: 539018 - RNA, 63 nt, Homo Sapiens; identical to SEQ ID NO: 65265

SEQ ID NO: 539019 - RNA, 63 nt, Homo Sapiens; identical to SEQ ID NO: 65266

SEQ ID NO: 539020 - RNA, 63 nt, Homo Sapiens; identical to SEQ ID NO: 65267

SEQ ID NO: 539021 - RNA, 63 nt, Homo Sapiens; identical to SEQ ID NO: 65268

SEQ ID NO: 539022 - RNA, 63 nt, Homo Sapiens; identical to SEQ ID NO: 65269

SEQ ID NO: 539023 - RNA, 63 nt, Homo Sapiens; identical to SEQ ID NO: 65270

SEQ ID NO: 539024 - RNA, 63 nt, Homo Sapiens; identical to SEQ ID NO: 65271

SEQ ID NO: 539025 - RNA, 63 nt, Homo Sapiens; identical to SEQ ID NO: 65272

SEQ ID NO: 539026 - RNA, 63 nt, Homo Sapiens; identical to SEQ ID NO: 65273

SEQ ID NO: 539027 - RNA, 56 nt, Homo Sapiens; identical to SEQ ID NO: 61369

SEQ ID NO: 539028 - RNA, 63 nt, Homo Sapiens; identical to SEQ ID NO: 65275

SEQ ID NO: 539029 - RNA, 63 nt, Homo Sapiens; identical to SEQ ID NO: 65276

SEQ ID NO: 539030 - RNA, 63 nt, Homo Sapiens; identical to SEQ ID NO: 65277

SEQ ID NO: 539031 - RNA, 63 nt, Homo Sapiens; identical to SEQ ID NO: 65278

SEQ ID NO: 539032 - RNA, 63 nt, Homo Sapiens; identical to SEQ ID NO: 65279

SEQ ID NO: 539033 - RNA, 63 nt, Homo Sapiens; identical to SEQ ID NO: 65280

SEQ ID NO: 539034 - RNA, 63 nt, Homo Sapiens; identical to SEQ ID NO: 65281

SEQ ID NO: 539035 - RNA, 63 nt, Homo Sapiens; identical to SEQ ID NO: 65282

SEQ ID NO: 539036 - RNA, 63 nt, Homo Sapiens; identical to SEQ ID NO: 65283

SEQ ID NO: 539037 - RNA, 63 nt, Homo Sapiens; identical to SEQ ID NO: 65284

SEQ ID NO: 539038 - RNA, 63 nt, Homo Sapiens; identical to SEQ ID NO: 65285

SEQ ID NO: 539039 - RNA, 63 nt, Homo Sapiens; identical to SEQ ID NO: 65286

SEQ ID NO: 539040 - RNA, 63 nt, Homo Sapiens; identical to SEQ ID NO: 65287

SEQ ID NO: 539041 - RNA, 63 nt, Homo Sapiens; identical to SEQ ID NO: 65288

SEQ ID NO: 539042 - RNA, 63 nt, Homo Sapiens; identical to SEQ ID NO: 65289

SEQ ID NO: 539043 - RNA, 63 nt, Homo Sapiens; identical to SEQ ID NO: 65290

SEQ ID NO: 539044 - RNA, 63 nt, Homo Sapiens; identical to SEQ ID NO: 65291

SEQ ID NO: 539045 - RNA, 63 nt, Homo Sapiens; identical to SEQ ID NO: 65292

SEQ ID NO: 539046 - RNA, 63 nt, Homo Sapiens; identical to SEQ ID NO: 65293

SEQ ID NO: 539047 - RNA, 63 nt, Homo Sapiens; identical to SEQ ID NO: 65294

SEQ ID NO: 539048 - RNA, 63 nt, Homo Sapiens; identical to SEQ ID NO: 65295

SEQ ID NO: 539049 - RNA, 63 nt, Homo Sapiens; identical to SEQ ID NO: 65296

SEQ ID NO: 539050 - RNA, 63 nt, Homo Sapiens; identical to SEQ ID NO: 65297

SEQ ID NO: 539051 - RNA, 63 nt, Homo Sapiens; identical to SEQ ID NO: 65298

SEQ ID NO: 539052 - RNA, 63 nt, Homo Sapiens; identical to SEQ ID NO: 65299

SEQ ID NO: 539053 - RNA, 63 nt, Homo Sapiens; identical to SEQ ID NO: 65300

SEQ ID NO: 539054 - RNA, 63 nt, Homo Sapiens; identical to SEQ ID NO: 65301

SEQ ID NO: 539055 - RNA, 63 nt, Homo Sapiens; identical to SEQ ID NO: 65302

SEQ ID NO: 539056 - RNA, 63 nt, Homo Sapiens; identical to SEQ ID NO: 65303

SEQ ID NO: 539057 - RNA, 63 nt, Homo Sapiens; identical to SEQ ID NO: 65304

SEQ ID NO: 539058 - RNA, 63 nt, Homo Sapiens; identical to SEQ ID NO: 65305

SEQ ID NO: 539059 - RNA, 63 nt, Homo Sapiens; identical to SEQ ID NO: 65306

SEQ ID NO: 539060 - RNA, 63 nt, Homo Sapiens; identical to SEQ ID NO: 65307

SEQ ID NO: 539061 - RNA, 63 nt, Homo Sapiens; identical to SEQ ID NO: 65308

SEQ ID NO: 539062 - RNA, 63 nt, Homo Sapiens; identical to SEQ ID NO: 65309

SEQ ID NO: 539063 - RNA, 63 nt, Homo Sapiens; identical to SEQ ID NO: 65310

SEQ ID NO: 539064 - RNA, 63 nt, Homo Sapiens; identical to SEQ ID NO: 65311

SEQ ID NO: 539065 - RNA, 63 nt, Homo Sapiens; identical to SEQ ID NO: 65312

SEQ ID NO: 539066 - RNA, 63 nt, Homo Sapiens; identical to SEQ ID NO: 65313

SEQ ID NO: 539067 - RNA, 63 nt, Homo Sapiens; identical to SEQ ID NO: 65314

SEQ ID NO: 539068 - RNA, 63 nt, Homo Sapiens; identical to SEQ ID NO: 65315

SEQ ID NO: 539069 - RNA, 63 nt, Homo Sapiens; identical to SEQ ID NO: 65316

SEQ ID NO: 539070 - RNA, 63 nt, Homo Sapiens; identical to SEQ ID NO: 65317

SEQ ID NO: 539071 - RNA, 63 nt, Homo Sapiens; identical to SEQ ID NO: 65318

SEQ ID NO: 539072 - RNA, 63 nt, Homo Sapiens; identical to SEQ ID NO: 65319

SEQ ID NO: 539073 - RNA, 63 nt, Homo Sapiens; identical to SEQ ID NO: 65320

SEQ ID NO: 539074 - RNA, 63 nt, Homo Sapiens; identical to SEQ ID NO: 65321

SEQ ID NO: 539075 - RNA, 63 nt, Homo Sapiens; identical to SEQ ID NO: 65322

SEQ ID NO: 539076 - RNA, 63 nt, Homo Sapiens; identical to SEQ ID NO: 65323

SEQ ID NO: 539077 - RNA, 63 nt, Homo Sapiens; identical to SEQ ID NO: 65324

SEQ ID NO: 539078 - RNA, 63 nt, Homo Sapiens; identical to SEQ ID NO: 65325

SEQ ID NO: 539079 - RNA, 63 nt, Homo Sapiens; identical to SEQ ID NO: 65326

SEQ ID NO: 539080 - RNA, 63 nt, Homo Sapiens; identical to SEQ ID NO: 65327

SEQ ID NO: 539081 - RNA, 63 nt, Homo Sapiens; identical to SEQ ID NO: 65328

SEQ ID NO: 539082 - RNA, 63 nt, Homo Sapiens; identical to SEQ ID NO: 65329

SEQ ID NO: 539083 - RNA, 63 nt, Homo Sapiens; identical to SEQ ID NO: 65330

SEQ ID NO: 539084 - RNA, 63 nt, Homo Sapiens; identical to SEQ ID NO: 65331

SEQ ID NO: 539085 - RNA, 63 nt, Homo Sapiens; identical to SEQ ID NO: 65332

SEQ ID NO: 539086 - RNA, 63 nt, Homo Sapiens; identical to SEQ ID NO: 65333

SEQ ID NO: 539087 - RNA, 63 nt, Homo Sapiens; identical to SEQ ID NO: 65334

SEQ ID NO: 539088 - RNA, 63 nt, Homo Sapiens; identical to SEQ ID NO: 65335

SEQ ID NO: 539089 - RNA, 63 nt, Homo Sapiens; identical to SEQ ID NO: 65336

SEQ ID NO: 539090 - RNA, 63 nt, Homo Sapiens; identical to SEQ ID NO: 65337

SEQ ID NO: 539091 - RNA, 63 nt, Homo Sapiens; identical to SEQ ID NO: 65338

SEQ ID NO: 539092 - RNA, 63 nt, Homo Sapiens; identical to SEQ ID NO: 65339

SEQ ID NO: 539093 - RNA, 63 nt, Homo Sapiens; identical to SEQ ID NO: 65340

SEQ ID NO: 539094 - RNA, 63 nt, Homo Sapiens; identical to SEQ ID NO: 65341

SEQ ID NO: 539095 - RNA, 63 nt, Homo Sapiens; identical to SEQ ID NO: 65342

SEQ ID NO: 539096 - RNA, 63 nt, Homo Sapiens; identical to SEQ ID NO: 65343

SEQ ID NO: 539097 - RNA, 63 nt, Homo Sapiens; identical to SEQ ID NO: 65344

SEQ ID NO: 539098 - RNA, 63 nt, Homo Sapiens; identical to SEQ ID NO: 65345

SEQ ID NO: 539099 - RNA, 63 nt, Homo Sapiens; identical to SEQ ID NO: 65346

SEQ ID NO: 539100 - RNA, 63 nt, Homo Sapiens; identical to SEQ ID NO: 65347

SEQ ID NO: 539101 - RNA, 63 nt, Homo Sapiens; identical to SEQ ID NO: 65348

SEQ ID NO: 539102 - RNA, 63 nt, Homo Sapiens; identical to SEQ ID NO: 65349

SEQ ID NO: 539103 - RNA, 63 nt, Homo Sapiens; identical to SEQ ID NO: 65350

SEQ ID NO: 539104 - RNA, 63 nt, Homo Sapiens; identical to SEQ ID NO: 65351

SEQ ID NO: 539105 - RNA, 63 nt, Homo Sapiens; identical to SEQ ID NO: 65352

SEQ ID NO: 539106 - RNA, 63 nt, Homo Sapiens; identical to SEQ ID NO: 65353

SEQ ID NO: 539107 - RNA, 63 nt, Homo Sapiens; identical to SEQ ID NO: 65354

SEQ ID NO: 539108 - RNA, 63 nt, Homo Sapiens; identical to SEQ ID NO: 65355

SEQ ID NO: 539109 - RNA, 63 nt, Homo Sapiens; identical to SEQ ID NO: 65356

SEQ ID NO: 539110 - RNA, 63 nt, Homo Sapiens; identical to SEQ ID NO: 65357

SEQ ID NO: 539111 - RNA, 63 nt, Homo Sapiens; identical to SEQ ID NO: 65358

SEQ ID NO: 539112 - RNA, 63 nt, Homo Sapiens; identical to SEQ ID NO: 65359

SEQ ID NO: 539113 - RNA, 63 nt, Homo Sapiens; identical to SEQ ID NO: 65360

SEQ ID NO: 539114 - RNA, 63 nt, Homo Sapiens; identical to SEQ ID NO: 65361

SEQ ID NO: 539115 - RNA, 63 nt, Homo Sapiens; identical to SEQ ID NO: 65362

SEQ ID NO: 539116 - RNA, 63 nt, Homo Sapiens; identical to SEQ ID NO: 65363

SEQ ID NO: 539117 - RNA, 63 nt, Homo Sapiens; identical to SEQ ID NO: 65364

SEQ ID NO: 539118 - RNA, 63 nt, Homo Sapiens; identical to SEQ ID NO: 65365

SEQ ID NO: 539119 - RNA, 60 nt, Homo Sapiens; identical to SEQ ID NO: 65087

SEQ ID NO: 539120 - RNA, 63 nt, Homo Sapiens; identical to SEQ ID NO: 65367

SEQ ID NO: 539121 - RNA, 63 nt, Homo Sapiens; identical to SEQ ID NO: 65368

SEQ ID NO: 539122 - RNA, 63 nt, Homo Sapiens; identical to SEQ ID NO: 65369

SEQ ID NO: 539123 - RNA, 63 nt, Homo Sapiens; identical to SEQ ID NO: 65370

SEQ ID NO: 539124 - RNA, 63 nt, Homo Sapiens; identical to SEQ ID NO: 65371

SEQ ID NO: 539125 - RNA, 63 nt, Homo Sapiens; identical to SEQ ID NO: 65372

SEQ ID NO: 539126 - RNA, 51 nt, Homo Sapiens; identical to SEQ ID NO: 65094

SEQ ID NO: 539127 - RNA, 63 nt, Homo Sapiens; identical to SEQ ID NO: 65374

SEQ ID NO: 539128 - RNA, 63 nt, Homo Sapiens; identical to SEQ ID NO: 65375

SEQ ID NO: 539129 - RNA, 63 nt, Homo Sapiens; identical to SEQ ID NO: 65376

SEQ ID NO: 539130 - RNA, 63 nt, Homo Sapiens; identical to SEQ ID NO: 65377

SEQ ID NO: 539131 - RNA, 63 nt, Homo Sapiens; identical to SEQ ID NO: 65378

SEQ ID NO: 539132 - RNA, 63 nt, Homo Sapiens; identical to SEQ ID NO: 65379

SEQ ID NO: 539133 - RNA, 63 nt, Homo Sapiens; identical to SEQ ID NO: 65380

SEQ ID NO: 539134 - RNA, 63 nt, Homo Sapiens; identical to SEQ ID NO: 65381

SEQ ID NO: 539135 - RNA, 63 nt, Homo Sapiens; identical to SEQ ID NO: 65382

SEQ ID NO: 539136 - RNA, 63 nt, Homo Sapiens; identical to SEQ ID NO: 65383

SEQ ID NO: 539137 - RNA, 63 nt, Homo Sapiens; identical to SEQ ID NO: 65384

SEQ ID NO: 539138 - RNA, 63 nt, Homo Sapiens; identical to SEQ ID NO: 65385

SEQ ID NO: 539139 - RNA, 63 nt, Homo Sapiens; identical to SEQ ID NO: 65386

SEQ ID NO: 539140 - RNA, 63 nt, Homo Sapiens; identical to SEQ ID NO: 65387

SEQ ID NO: 539141 - RNA, 63 nt, Homo Sapiens; identical to SEQ ID NO: 65388

SEQ ID NO: 539142 - RNA, 63 nt, Homo Sapiens; identical to SEQ ID NO: 65389

SEQ ID NO: 539143 - RNA, 63 nt, Homo Sapiens; identical to SEQ ID NO: 65390

SEQ ID NO: 539144 - RNA, 63 nt, Homo Sapiens; identical to SEQ ID NO: 65391

SEQ ID NO: 539145 - RNA, 63 nt, Homo Sapiens; identical to SEQ ID NO: 65392

SEQ ID NO: 539146 - RNA, 63 nt, Homo Sapiens; identical to SEQ ID NO: 65393

SEQ ID NO: 539147 - RNA, 63 nt, Homo Sapiens; identical to SEQ ID NO: 65394

SEQ ID NO: 539148 - RNA, 63 nt, Homo Sapiens; identical to SEQ ID NO: 65395

SEQ ID NO: 539149 - RNA, 63 nt, Homo Sapiens; identical to SEQ ID NO: 65396

SEQ ID NO: 539150 - RNA, 63 nt, Homo Sapiens; identical to SEQ ID NO: 65397

SEQ ID NO: 539151 - RNA, 63 nt, Homo Sapiens; identical to SEQ ID NO: 65398

SEQ ID NO: 539152 - RNA, 63 nt, Homo Sapiens; identical to SEQ ID NO: 65399

SEQ ID NO: 539153 - RNA, 63 nt, Homo Sapiens; identical to SEQ ID NO: 65400

SEQ ID NO: 539154 - RNA, 63 nt, Homo Sapiens; identical to SEQ ID NO: 65401

SEQ ID NO: 539155 - RNA, 63 nt, Homo Sapiens; identical to SEQ ID NO: 65402

SEQ ID NO: 539156 - RNA, 63 nt, Homo Sapiens; identical to SEQ ID NO: 65403

SEQ ID NO: 539157 - RNA, 63 nt, Homo Sapiens; identical to SEQ ID NO: 65404

SEQ ID NO: 539158 - RNA, 63 nt, Homo Sapiens; identical to SEQ ID NO: 65405

SEQ ID NO: 539159 - RNA, 63 nt, Homo Sapiens; identical to SEQ ID NO: 65406

SEQ ID NO: 539160 - RNA, 63 nt, Homo Sapiens; identical to SEQ ID NO: 65407

SEQ ID NO: 539161 - RNA, 63 nt, Homo Sapiens; identical to SEQ ID NO: 65408

SEQ ID NO: 539162 - RNA, 63 nt, Homo Sapiens; identical to SEQ ID NO: 65409

SEQ ID NO: 539163 - RNA, 63 nt, Homo Sapiens; identical to SEQ ID NO: 65410

SEQ ID NO: 539164 - RNA, 63 nt, Homo Sapiens; identical to SEQ ID NO: 65411

SEQ ID NO: 539165 - RNA, 63 nt, Homo Sapiens; identical to SEQ ID NO: 65412

SEQ ID NO: 539166 - RNA, 63 nt, Homo Sapiens; identical to SEQ ID NO: 65413

SEQ ID NO: 539167 - RNA, 63 nt, Homo Sapiens; identical to SEQ ID NO: 65414

SEQ ID NO: 539168 - RNA, 64 nt, Homo Sapiens; identical to SEQ ID NO: 315750

SEQ ID NO: 539169 - RNA, 64 nt, Homo Sapiens; identical to SEQ ID NO: 315751

SEQ ID NO: 539170 - RNA, 64 nt, Homo Sapiens; identical to SEQ ID NO: 315752

SEQ ID NO: 539171 - RNA, 64 nt, Homo Sapiens; identical to SEQ ID NO: 315753

SEQ ID NO: 539172 - RNA, 64 nt, Homo Sapiens; identical to SEQ ID NO: 315754

SEQ ID NO: 539173 - RNA, 64 nt, Homo Sapiens; identical to SEQ ID NO: 315755

SEQ ID NO: 539174 - RNA, 64 nt, Homo Sapiens; identical to SEQ ID NO: 315756

SEQ ID NO: 539175 - RNA, 64 nt, Homo Sapiens; identical to SEQ ID NO: 315757

SEQ ID NO: 539176 - RNA, 64 nt, Homo Sapiens; identical to SEQ ID NO: 315758

SEQ ID NO: 539177 - RNA, 64 nt, Homo Sapiens; identical to SEQ ID NO: 315759

SEQ ID NO: 539178 - RNA, 64 nt, Homo Sapiens; identical to SEQ ID NO: 315760

SEQ ID NO: 539179 - RNA, 64 nt, Homo Sapiens; identical to SEQ ID NO: 315761

SEQ ID NO: 539180 - RNA, 64 nt, Homo Sapiens; identical to SEQ ID NO: 315762

SEQ ID NO: 539181 - RNA, 64 nt, Homo Sapiens; identical to SEQ ID NO: 315763

SEQ ID NO: 539182 - RNA, 64 nt, Homo Sapiens; identical to SEQ ID NO: 315764

SEQ ID NO: 539183 - RNA, 64 nt, Homo Sapiens; identical to SEQ ID NO: 315765

SEQ ID NO: 539184 - RNA, 64 nt, Homo Sapiens; identical to SEQ ID NO: 315766

SEQ ID NO: 539185 - RNA, 64 nt, Homo Sapiens; identical to SEQ ID NO: 315767

SEQ ID NO: 539186 - RNA, 64 nt, Homo Sapiens; identical to SEQ ID NO: 315768

SEQ ID NO: 539187 - RNA, 64 nt, Homo Sapiens; identical to SEQ ID NO: 315769

SEQ ID NO: 539188 - RNA, 64 nt, Homo Sapiens; identical to SEQ ID NO: 315770

SEQ ID NO: 539189 - RNA, 64 nt, Homo Sapiens; identical to SEQ ID NO: 315771

SEQ ID NO: 539190 - RNA, 64 nt, Homo Sapiens; identical to SEQ ID NO: 315772

SEQ ID NO: 539191 - RNA, 64 nt, Homo Sapiens; identical to SEQ ID NO: 315773

SEQ ID NO: 539192 - RNA, 64 nt, Homo Sapiens; identical to SEQ ID NO: 315774

SEQ ID NO: 539193 - RNA, 64 nt, Homo Sapiens; identical to SEQ ID NO: 315775

SEQ ID NO: 539194 - RNA, 64 nt, Homo Sapiens; identical to SEQ ID NO: 315776

SEQ ID NO: 539195 - RNA, 64 nt, Homo Sapiens; identical to SEQ ID NO: 315776

SEQ ID NO: 539196 - RNA, 64 nt, Homo Sapiens; identical to SEQ ID NO: 315778

SEQ ID NO: 539197 - RNA, 64 nt, Homo Sapiens; identical to SEQ ID NO: 315779

SEQ ID NO: 539198 - RNA, 60 nt, Homo Sapiens; identical to SEQ ID NO: 315780

SEQ ID NO: 539199 - RNA, 64 nt, Homo Sapiens; identical to SEQ ID NO: 315781

SEQ ID NO: 539200 - RNA, 64 nt, Homo Sapiens; identical to SEQ ID NO: 315782

SEQ ID NO: 539201 - RNA, 64 nt, Homo Sapiens; identical to SEQ ID NO: 315783

SEQ ID NO: 539202 - RNA, 64 nt, Homo Sapiens; identical to SEQ ID NO: 315784

SEQ ID NO: 539203 - RNA, 64 nt, Homo Sapiens; identical to SEQ ID NO: 315785

SEQ ID NO: 539204 - RNA, 64 nt, Homo Sapiens; identical to SEQ ID NO: 315786

SEQ ID NO: 539205 - RNA, 64 nt, Homo Sapiens; identical to SEQ ID NO: 315787

SEQ ID NO: 539206 - RNA, 64 nt, Homo Sapiens; identical to SEQ ID NO: 426082

SEQ ID NO: 539207 - RNA, 64 nt, Homo Sapiens; identical to SEQ ID NO: 426083

SEQ ID NO: 539208 - RNA, 64 nt, Homo Sapiens; identical to SEQ ID NO: 426084

SEQ ID NO: 539209 - RNA, 64 nt, Homo Sapiens; identical to SEQ ID NO: 426085

SEQ ID NO: 539210 - RNA, 64 nt, Homo Sapiens; identical to SEQ ID NO: 426086

SEQ ID NO: 539211 - RNA, 64 nt, Homo Sapiens; identical to SEQ ID NO: 426087

SEQ ID NO: 539212 - RNA, 64 nt, Homo Sapiens; identical to SEQ ID NO: 426088

SEQ ID NO: 539213 - RNA, 64 nt, Homo Sapiens; identical to SEQ ID NO: 426089

SEQ ID NO: 539214 - RNA, 64 nt, Homo Sapiens; identical to SEQ ID NO: 426090

SEQ ID NO: 539215 - RNA, 64 nt, Homo Sapiens; identical to SEQ ID NO: 426091

SEQ ID NO: 539216 - RNA, 64 nt, Homo Sapiens; identical to SEQ ID NO: 426092

SEQ ID NO: 539217 - RNA, 64 nt, Homo Sapiens; identical to SEQ ID NO: 426093

SEQ ID NO: 539218 - RNA, 64 nt, Homo Sapiens; identical to SEQ ID NO: 426094

SEQ ID NO: 539219 - RNA, 64 nt, Homo Sapiens; identical to SEQ ID NO: 426095

SEQ ID NO: 539220 - RNA, 64 nt, Homo Sapiens; identical to SEQ ID NO: 426096

SEQ ID NO: 539221 - RNA, 64 nt, Homo Sapiens; identical to SEQ ID NO: 426097

SEQ ID NO: 539222 - RNA, 64 nt, Homo Sapiens; identical to SEQ ID NO: 426098

SEQ ID NO: 539223 - RNA, 64 nt, Homo Sapiens; identical to SEQ ID NO: 426099

SEQ ID NO: 539224 - RNA, 59 nt, Homo Sapiens; identical to SEQ ID NO: 426100

SEQ ID NO: 539225 - RNA, 64 nt, Homo Sapiens; identical to SEQ ID NO: 426101

SEQ ID NO: 539226 - RNA, 64 nt, Homo Sapiens; identical to SEQ ID NO: 426102

SEQ ID NO: 539227 - RNA, 64 nt, Homo Sapiens; identical to SEQ ID NO: 426103

SEQ ID NO: 539228 - RNA, 64 nt, Homo Sapiens; identical to SEQ ID NO: 426104

SEQ ID NO: 539229 - RNA, 64 nt, Homo Sapiens; identical to SEQ ID NO: 426105

SEQ ID NO: 539230 - RNA, 64 nt, Homo Sapiens; identical to SEQ ID NO: 426106

SEQ ID NO: 539231 - RNA, 64 nt, Homo Sapiens; identical to SEQ ID NO: 426107

SEQ ID NO: 539232 - RNA, 64 nt, Homo Sapiens; identical to SEQ ID NO: 426108

SEQ ID NO: 539233 - RNA, 64 nt, Homo Sapiens; identical to SEQ ID NO: 426109

SEQ ID NO: 539234 - RNA, 64 nt, Homo Sapiens; identical to SEQ ID NO: 426110

SEQ ID NO: 539235 - RNA, 64 nt, Homo Sapiens; identical to SEQ ID NO: 426111

SEQ ID NO: 539236 - RNA, 64 nt, Homo Sapiens; identical to SEQ ID NO: 426112

SEQ ID NO: 539237 - RNA, 64 nt, Homo Sapiens; identical to SEQ ID NO: 426113

SEQ ID NO: 539238 - RNA, 64 nt, Homo Sapiens; identical to SEQ ID NO: 426114

SEQ ID NO: 539239 - RNA, 64 nt, Homo Sapiens; identical to SEQ ID NO: 426115

SEQ ID NO: 539240 - RNA, 64 nt, Homo Sapiens; identical to SEQ ID NO: 426116

SEQ ID NO: 539241 - RNA, 64 nt, Homo Sapiens; identical to SEQ ID NO: 426117

SEQ ID NO: 539242 - RNA, 64 nt, Homo Sapiens; identical to SEQ ID NO: 426118

SEQ ID NO: 539243 - RNA, 64 nt, Homo Sapiens; identical to SEQ ID NO: 426119

SEQ ID NO: 539244 - RNA, 64 nt, Homo Sapiens; identical to SEQ ID NO: 426120

SEQ ID NO: 539245 - RNA, 64 nt, Homo Sapiens; identical to SEQ ID NO: 426121

SEQ ID NO: 539246 - RNA, 64 nt, Homo Sapiens; identical to SEQ ID NO: 426122

SEQ ID NO: 539247 - RNA, 64 nt, Homo Sapiens; identical to SEQ ID NO: 426123

SEQ ID NO: 539248 - RNA, 64 nt, Homo Sapiens; identical to SEQ ID NO: 426124

SEQ ID NO: 539249 - RNA, 64 nt, Homo Sapiens; identical to SEQ ID NO: 21544

SEQ ID NO: 539250 - RNA, 55 nt, Homo Sapiens; identical to SEQ ID NO: 21545

SEQ ID NO: 539251 - RNA, 64 nt, Homo Sapiens; identical to SEQ ID NO: 21546

SEQ ID NO: 539252 - RNA, 64 nt, Homo Sapiens; identical to SEQ ID NO: 21547

SEQ ID NO: 539253 - RNA, 64 nt, Homo Sapiens; identical to SEQ ID NO: 21548

SEQ ID NO: 539254 - RNA, 64 nt, Homo Sapiens; identical to SEQ ID NO: 21549

SEQ ID NO: 539255 - RNA, 64 nt, Homo Sapiens; identical to SEQ ID NO: 21550

SEQ ID NO: 539256 - RNA, 64 nt, Homo Sapiens; identical to SEQ ID NO: 21551

SEQ ID NO: 539257 - RNA, 64 nt, Homo Sapiens; identical to SEQ ID NO: 21552

SEQ ID NO: 539258 - RNA, 64 nt, Homo Sapiens; identical to SEQ ID NO: 21553

SEQ ID NO: 539259 - RNA, 64 nt, Homo Sapiens; identical to SEQ ID NO: 21554

SEQ ID NO: 539260 - RNA, 64 nt, Homo Sapiens; identical to SEQ ID NO: 21555

SEQ ID NO: 539261 - RNA, 64 nt, Homo Sapiens; identical to SEQ ID NO: 21556

SEQ ID NO: 539262 - RNA, 64 nt, Homo Sapiens; identical to SEQ ID NO: 21557

SEQ ID NO: 539263 - RNA, 64 nt, Homo Sapiens; identical to SEQ ID NO: 21558

SEQ ID NO: 539264 - RNA, 64 nt, Homo Sapiens; identical to SEQ ID NO: 21559

SEQ ID NO: 539265 - RNA, 64 nt, Homo Sapiens
uggugugagaaggucuacacugcucagagugcaggcauugcacacugggcccagucagcccugc

SEQ ID NO: 539266 - RNA, 64 nt, Homo Sapiens
cggugugaggaguguacaccugcacauggcacaggcauugcacacugggcccagucagcccugc

SEQ ID NO: 539267 - RNA, 64 nt, Homo Sapiens
gagcaugaaugggccuacacugcauggggugcaggcauugcacaucccugggcucaguccuagc

SEQ ID NO: 539268 - RNA, 64 nt, Homo Sapiens
cagugugaaugggucuacacugcgugggguacaggcauugcacacugggcucgaccagcccagc

SEQ ID NO: 539269 - RNA, 64 nt, Homo Sapiens
cggugugaagggucuacaccugcacagggugcaggcauugcacaccaggcccugccagcccugc

SEQ ID NO: 539270 - RNA, 64 nt, Homo Sapiens
uuuuugaauucagauuuaaaaaccaacuuauaaagcauugcaacaagguuaccucuauuuugcc

SEQ ID NO: 539271 - RNA, 64 nt, Homo Sapiens
aaaaaaaaaaaggaaacuuuuuuuguuugcucuugcauugcaaaaauuauaaaguaauuuauua

SEQ ID NO: 539272 - RNA, 64 nt, Homo Sapiens
gaauuuauagguuaauuuugaaauuuauuaauuggcauugcauucauugaauuauuaauuaaau

SEQ ID NO: 539273 - RNA, 64 nt, Homo Sapiens
gaauuauuaauuaaauaaaugcaaaaucugauuggcauugcauucuucuuuccagguucaaaaa

SEQ ID NO: 539274 - RNA, 64 nt, Homo Sapiens; identical to SEQ ID NO: 111815

SEQ ID NO: 539275 - RNA, 64 nt, Homo Sapiens; identical to SEQ ID NO: 111816

SEQ ID NO: 539276 - RNA, 64 nt, Homo Sapiens; identical to SEQ ID NO: 111817

SEQ ID NO: 539277 - RNA, 64 nt, Homo Sapiens; identical to SEQ ID NO: 111818

SEQ ID NO: 539278 - RNA, 64 nt, Homo Sapiens; identical to SEQ ID NO: 111819

SEQ ID NO: 539279 - RNA, 64 nt, Homo Sapiens; identical to SEQ ID NO: 111820

SEQ ID NO: 539280 - RNA, 64 nt, Homo Sapiens; identical to SEQ ID NO: 111821

SEQ ID NO: 539281 - RNA, 64 nt, Homo Sapiens; identical to SEQ ID NO: 111822

SEQ ID NO: 539282 - RNA, 64 nt, Homo Sapiens; identical to SEQ ID NO: 111823

SEQ ID NO: 539283 - RNA, 64 nt, Homo Sapiens; identical to SEQ ID NO: 111824

SEQ ID NO: 539284 - RNA, 64 nt, Homo Sapiens; identical to SEQ ID NO: 111825

SEQ ID NO: 539285 - RNA, 64 nt, Homo Sapiens; identical to SEQ ID NO: 111826

SEQ ID NO: 539286 - RNA, 64 nt, Homo Sapiens; identical to SEQ ID NO: 111827

SEQ ID NO: 539287 - RNA, 64 nt, Homo Sapiens; identical to SEQ ID NO: 111828

SEQ ID NO: 539288 - RNA, 64 nt, Homo Sapiens; identical to SEQ ID NO: 111829

SEQ ID NO: 539289 - RNA, 64 nt, Homo Sapiens; identical to SEQ ID NO: 373477

SEQ ID NO: 539290 - RNA, 64 nt, Homo Sapiens; identical to SEQ ID NO: 373478

SEQ ID NO: 539291 - RNA, 64 nt, Homo Sapiens; identical to SEQ ID NO: 373479

SEQ ID NO: 539292 - RNA, 64 nt, Homo Sapiens; identical to SEQ ID NO: 373480

SEQ ID NO: 539293 - RNA, 64 nt, Homo Sapiens; identical to SEQ ID NO: 373481

SEQ ID NO: 539294 - RNA, 64 nt, Homo Sapiens; identical to SEQ ID NO: 373482

SEQ ID NO: 539295 - RNA, 64 nt, Homo Sapiens; identical to SEQ ID NO: 373483

SEQ ID NO: 539296 - RNA, 64 nt, Homo Sapiens; identical to SEQ ID NO: 373484

SEQ ID NO: 539297 - RNA, 64 nt, Homo Sapiens; identical to SEQ ID NO: 373485

SEQ ID NO: 539298 - RNA, 64 nt, Homo Sapiens; identical to SEQ ID NO: 373486

SEQ ID NO: 539299 - RNA, 64 nt, Homo Sapiens; identical to SEQ ID NO: 373487

SEQ ID NO: 539300 - RNA, 64 nt, Homo Sapiens; identical to SEQ ID NO: 373488

SEQ ID NO: 539301 - RNA, 64 nt, Homo Sapiens; identical to SEQ ID NO: 373489

SEQ ID NO: 539302 - RNA, 64 nt, Homo Sapiens; identical to SEQ ID NO: 373490

SEQ ID NO: 539303 - RNA, 64 nt, Homo Sapiens; identical to SEQ ID NO: 373491

SEQ ID NO: 539304 - RNA, 64 nt, Homo Sapiens; identical to SEQ ID NO: 373492

SEQ ID NO: 539305 - RNA, 64 nt, Homo Sapiens; identical to SEQ ID NO: 373493

SEQ ID NO: 539306 - RNA, 64 nt, Homo Sapiens; identical to SEQ ID NO: 373494

SEQ ID NO: 539307 - RNA, 64 nt, Homo Sapiens; identical to SEQ ID NO: 373495

SEQ ID NO: 539308 - RNA, 64 nt, Homo Sapiens; identical to SEQ ID NO: 373496

SEQ ID NO: 539309 - RNA, 64 nt, Homo Sapiens; identical to SEQ ID NO: 373497

SEQ ID NO: 539310 - RNA, 64 nt, Homo Sapiens; identical to SEQ ID NO: 373498

SEQ ID NO: 539311 - RNA, 64 nt, Homo Sapiens; identical to SEQ ID NO: 373499

SEQ ID NO: 539312 - RNA, 64 nt, Homo Sapiens; identical to SEQ ID NO: 373500

SEQ ID NO: 539313 - RNA, 64 nt, Homo Sapiens; identical to SEQ ID NO: 373501

SEQ ID NO: 539314 - RNA, 64 nt, Homo Sapiens; identical to SEQ ID NO: 373502

SEQ ID NO: 539315 - RNA, 64 nt, Homo Sapiens; identical to SEQ ID NO: 373503

SEQ ID NO: 539316 - RNA, 64 nt, Homo Sapiens; identical to SEQ ID NO: 373504

SEQ ID NO: 539317 - RNA, 64 nt, Homo Sapiens; identical to SEQ ID NO: 373505

SEQ ID NO: 539318 - RNA, 64 nt, Homo Sapiens; identical to SEQ ID NO: 373506

SEQ ID NO: 539319 - RNA, 64 nt, Homo Sapiens; identical to SEQ ID NO: 373507

SEQ ID NO: 539320 - RNA, 64 nt, Homo Sapiens; identical to SEQ ID NO: 373508

SEQ ID NO: 539321 - RNA, 64 nt, Homo Sapiens; identical to SEQ ID NO: 373509

SEQ ID NO: 539322 - RNA, 64 nt, Homo Sapiens; identical to SEQ ID NO: 373510

SEQ ID NO: 539323 - RNA, 64 nt, Homo Sapiens; identical to SEQ ID NO: 373511

SEQ ID NO: 539324 - RNA, 64 nt, Homo Sapiens; identical to SEQ ID NO: 373512

SEQ ID NO: 539325 - RNA, 64 nt, Homo Sapiens; identical to SEQ ID NO: 373513

SEQ ID NO: 539326 - RNA, 64 nt, Homo Sapiens; identical to SEQ ID NO: 373514

SEQ ID NO: 539327 - RNA, 64 nt, Homo Sapiens; identical to SEQ ID NO: 373515

SEQ ID NO: 539328 - RNA, 64 nt, Homo Sapiens; identical to SEQ ID NO: 373516

SEQ ID NO: 539329 - RNA, 64 nt, Homo Sapiens; identical to SEQ ID NO: 373517

SEQ ID NO: 539330 - RNA, 64 nt, Homo Sapiens; identical to SEQ ID NO: 373518

SEQ ID NO: 539331 - RNA, 64 nt, Homo Sapiens; identical to SEQ ID NO: 373519

SEQ ID NO: 539332 - RNA, 64 nt, Homo Sapiens; identical to SEQ ID NO: 373520

SEQ ID NO: 539333 - RNA, 64 nt, Homo Sapiens; identical to SEQ ID NO: 373521

SEQ ID NO: 539334 - RNA, 64 nt, Homo Sapiens; identical to SEQ ID NO: 373522

SEQ ID NO: 539335 - RNA, 64 nt, Homo Sapiens; identical to SEQ ID NO: 373523

SEQ ID NO: 539336 - RNA, 64 nt, Homo Sapiens; identical to SEQ ID NO: 373524

SEQ ID NO: 539337 - RNA, 64 nt, Homo Sapiens; identical to SEQ ID NO: 373525

SEQ ID NO: 539338 - RNA, 64 nt, Homo Sapiens; identical to SEQ ID NO: 373526

SEQ ID NO: 539339 - RNA, 64 nt, Homo Sapiens; identical to SEQ ID NO: 373527

SEQ ID NO: 539340 - RNA, 64 nt, Homo Sapiens; identical to SEQ ID NO: 373528

SEQ ID NO: 539341 - RNA, 64 nt, Homo Sapiens; identical to SEQ ID NO: 373529

SEQ ID NO: 539342 - RNA, 64 nt, Homo Sapiens; identical to SEQ ID NO: 373530

SEQ ID NO: 539343 - RNA, 64 nt, Homo Sapiens; identical to SEQ ID NO: 373531

SEQ ID NO: 539344 - RNA, 64 nt, Homo Sapiens; identical to SEQ ID NO: 373532

SEQ ID NO: 539345 - RNA, 64 nt, Homo Sapiens; identical to SEQ ID NO: 373533

SEQ ID NO: 539346 - RNA, 64 nt, Homo Sapiens; identical to SEQ ID NO: 373534

SEQ ID NO: 539347 - RNA, 64 nt, Homo Sapiens; identical to SEQ ID NO: 373535

SEQ ID NO: 539348 - RNA, 64 nt, Homo Sapiens; identical to SEQ ID NO: 373536

SEQ ID NO: 539349 - RNA, 64 nt, Homo Sapiens; identical to SEQ ID NO: 373537

SEQ ID NO: 539350 - RNA, 64 nt, Homo Sapiens; identical to SEQ ID NO: 373538

SEQ ID NO: 539351 - RNA, 64 nt, Homo Sapiens; identical to SEQ ID NO: 373539

SEQ ID NO: 539352 - RNA, 64 nt, Homo Sapiens; identical to SEQ ID NO: 373540

SEQ ID NO: 539353 - RNA, 64 nt, Homo Sapiens; identical to SEQ ID NO: 373541

SEQ ID NO: 539354 - RNA, 64 nt, Homo Sapiens; identical to SEQ ID NO: 373542

SEQ ID NO: 539355 - RNA, 64 nt, Homo Sapiens; identical to SEQ ID NO: 373543

SEQ ID NO: 539356 - RNA, 64 nt, Homo Sapiens; identical to SEQ ID NO: 373544

SEQ ID NO: 539357 - RNA, 64 nt, Homo Sapiens; identical to SEQ ID NO: 373545

SEQ ID NO: 539358 - RNA, 64 nt, Homo Sapiens; identical to SEQ ID NO: 373546

SEQ ID NO: 539359 - RNA, 64 nt, Homo Sapiens; identical to SEQ ID NO: 373547

SEQ ID NO: 539360 - RNA, 64 nt, Homo Sapiens; identical to SEQ ID NO: 373548

SEQ ID NO: 539361 - RNA, 64 nt, Homo Sapiens; identical to SEQ ID NO: 373549

SEQ ID NO: 539362 - RNA, 64 nt, Homo Sapiens; identical to SEQ ID NO: 373550

SEQ ID NO: 539363 - RNA, 64 nt, Homo Sapiens; identical to SEQ ID NO: 373551

SEQ ID NO: 539364 - RNA, 64 nt, Homo Sapiens; identical to SEQ ID NO: 373552

SEQ ID NO: 539365 - RNA, 64 nt, Homo Sapiens; identical to SEQ ID NO: 373553

SEQ ID NO: 539366 - RNA, 64 nt, Homo Sapiens; identical to SEQ ID NO: 373554

SEQ ID NO: 539367 - RNA, 64 nt, Homo Sapiens; identical to SEQ ID NO: 373555

SEQ ID NO: 539368 - RNA, 64 nt, Homo Sapiens; identical to SEQ ID NO: 373556

SEQ ID NO: 539369 - RNA, 64 nt, Homo Sapiens; identical to SEQ ID NO: 373557

SEQ ID NO: 539370 - RNA, 64 nt, Homo Sapiens; identical to SEQ ID NO: 373558

SEQ ID NO: 539371 - RNA, 64 nt, Homo Sapiens; identical to SEQ ID NO: 373559

SEQ ID NO: 539372 - RNA, 64 nt, Homo Sapiens; identical to SEQ ID NO: 373560

SEQ ID NO: 539373 - RNA, 64 nt, Homo Sapiens; identical to SEQ ID NO: 373561

SEQ ID NO: 539374 - RNA, 64 nt, Homo Sapiens; identical to SEQ ID NO: 373562

SEQ ID NO: 539375 - RNA, 64 nt, Homo Sapiens; identical to SEQ ID NO: 373563

SEQ ID NO: 539376 - RNA, 64 nt, Homo Sapiens; identical to SEQ ID NO: 373564

SEQ ID NO: 539377 - RNA, 64 nt, Homo Sapiens; identical to SEQ ID NO: 373565

SEQ ID NO: 539378 - RNA, 64 nt, Homo Sapiens; identical to SEQ ID NO: 373566

SEQ ID NO: 539379 - RNA, 64 nt, Homo Sapiens; identical to SEQ ID NO: 373567

SEQ ID NO: 539380 - RNA, 64 nt, Homo Sapiens; identical to SEQ ID NO: 373568

SEQ ID NO: 539381 - RNA, 64 nt, Homo Sapiens; identical to SEQ ID NO: 373569

SEQ ID NO: 539382 - RNA, 64 nt, Homo Sapiens; identical to SEQ ID NO: 373570

SEQ ID NO: 539383 - RNA, 64 nt, Homo Sapiens; identical to SEQ ID NO: 373571

SEQ ID NO: 539384 - RNA, 64 nt, Homo Sapiens; identical to SEQ ID NO: 373572

SEQ ID NO: 539385 - RNA, 64 nt, Homo Sapiens; identical to SEQ ID NO: 373573

SEQ ID NO: 539386 - RNA, 64 nt, Homo Sapiens; identical to SEQ ID NO: 373574

SEQ ID NO: 539387 - RNA, 64 nt, Homo Sapiens; identical to SEQ ID NO: 373575

SEQ ID NO: 539388 - RNA, 64 nt, Homo Sapiens; identical to SEQ ID NO: 373576

SEQ ID NO: 539389 - RNA, 64 nt, Homo Sapiens; identical to SEQ ID NO: 373577

SEQ ID NO: 539390 - RNA, 64 nt, Homo Sapiens; identical to SEQ ID NO: 373578

SEQ ID NO: 539391 - RNA, 64 nt, Homo Sapiens; identical to SEQ ID NO: 373579

SEQ ID NO: 539392 - RNA, 64 nt, Homo Sapiens; identical to SEQ ID NO: 373580

SEQ ID NO: 539393 - RNA, 64 nt, Homo Sapiens; identical to SEQ ID NO: 373581

SEQ ID NO: 539394 - RNA, 64 nt, Homo Sapiens; identical to SEQ ID NO: 373582

SEQ ID NO: 539395 - RNA, 64 nt, Homo Sapiens; identical to SEQ ID NO: 373583

SEQ ID NO: 539396 - RNA, 64 nt, Homo Sapiens; identical to SEQ ID NO: 373584

SEQ ID NO: 539397 - RNA, 64 nt, Homo Sapiens; identical to SEQ ID NO: 373585

SEQ ID NO: 539398 - RNA, 64 nt, Homo Sapiens; identical to SEQ ID NO: 373586

SEQ ID NO: 539399 - RNA, 64 nt, Homo Sapiens; identical to SEQ ID NO: 373587

SEQ ID NO: 539400 - RNA, 64 nt, Homo Sapiens; identical to SEQ ID NO: 373588

SEQ ID NO: 539401 - RNA, 64 nt, Homo Sapiens; identical to SEQ ID NO: 373589

SEQ ID NO: 539402 - RNA, 64 nt, Homo Sapiens; identical to SEQ ID NO: 373590

SEQ ID NO: 539403 - RNA, 64 nt, Homo Sapiens; identical to SEQ ID NO: 373591

SEQ ID NO: 539404 - RNA, 64 nt, Homo Sapiens; identical to SEQ ID NO: 373592

SEQ ID NO: 539405 - RNA, 64 nt, Homo Sapiens; identical to SEQ ID NO: 373593

SEQ ID NO: 539406 - RNA, 64 nt, Homo Sapiens; identical to SEQ ID NO: 373594

SEQ ID NO: 539407 - RNA, 64 nt, Homo Sapiens; identical to SEQ ID NO: 373595

SEQ ID NO: 539408 - RNA, 64 nt, Homo Sapiens; identical to SEQ ID NO: 373596

SEQ ID NO: 539409 - RNA, 64 nt, Homo Sapiens; identical to SEQ ID NO: 373597

SEQ ID NO: 539410 - RNA, 64 nt, Homo Sapiens; identical to SEQ ID NO: 373598

SEQ ID NO: 539411 - RNA, 64 nt, Homo Sapiens; identical to SEQ ID NO: 373599

SEQ ID NO: 539412 - RNA, 64 nt, Homo Sapiens; identical to SEQ ID NO: 373600

SEQ ID NO: 539413 - RNA, 64 nt, Homo Sapiens; identical to SEQ ID NO: 373601

SEQ ID NO: 539414 - RNA, 64 nt, Homo Sapiens; identical to SEQ ID NO: 373602

SEQ ID NO: 539415 - RNA, 64 nt, Homo Sapiens; identical to SEQ ID NO: 373603

SEQ ID NO: 539416 - RNA, 64 nt, Homo Sapiens; identical to SEQ ID NO: 373604

SEQ ID NO: 539417 - RNA, 64 nt, Homo Sapiens; identical to SEQ ID NO: 373605

SEQ ID NO: 539418 - RNA, 64 nt, Homo Sapiens; identical to SEQ ID NO: 373606

SEQ ID NO: 539419 - RNA, 64 nt, Homo Sapiens; identical to SEQ ID NO: 373607

SEQ ID NO: 539420 - RNA, 64 nt, Homo Sapiens; identical to SEQ ID NO: 373608

SEQ ID NO: 539421 - RNA, 64 nt, Homo Sapiens; identical to SEQ ID NO: 373609

SEQ ID NO: 539422 - RNA, 64 nt, Homo Sapiens; identical to SEQ ID NO: 373610

SEQ ID NO: 539423 - RNA, 64 nt, Homo Sapiens; identical to SEQ ID NO: 373611

SEQ ID NO: 539424 - RNA, 64 nt, Homo Sapiens; identical to SEQ ID NO: 373612

SEQ ID NO: 539425 - RNA, 64 nt, Homo Sapiens; identical to SEQ ID NO: 373613

SEQ ID NO: 539426 - RNA, 64 nt, Homo Sapiens; identical to SEQ ID NO: 373614

SEQ ID NO: 539427 - RNA, 64 nt, Homo Sapiens; identical to SEQ ID NO: 373615

SEQ ID NO: 539428 - RNA, 64 nt, Homo Sapiens; identical to SEQ ID NO: 373616

SEQ ID NO: 539429 - RNA, 64 nt, Homo Sapiens; identical to SEQ ID NO: 373617

SEQ ID NO: 539430 - RNA, 64 nt, Homo Sapiens; identical to SEQ ID NO: 373618

SEQ ID NO: 539431 - RNA, 64 nt, Homo Sapiens; identical to SEQ ID NO: 373619

SEQ ID NO: 539432 - RNA, 64 nt, Homo Sapiens; identical to SEQ ID NO: 373620

SEQ ID NO: 539433 - RNA, 64 nt, Homo Sapiens; identical to SEQ ID NO: 373621

SEQ ID NO: 539434 - RNA, 64 nt, Homo Sapiens; identical to SEQ ID NO: 373622

SEQ ID NO: 539435 - RNA, 64 nt, Homo Sapiens; identical to SEQ ID NO: 373623

SEQ ID NO: 539436 - RNA, 64 nt, Homo Sapiens; identical to SEQ ID NO: 373624

SEQ ID NO: 539437 - RNA, 64 nt, Homo Sapiens; identical to SEQ ID NO: 373625

SEQ ID NO: 539438 - RNA, 64 nt, Homo Sapiens; identical to SEQ ID NO: 373626

SEQ ID NO: 539439 - RNA, 64 nt, Homo Sapiens; identical to SEQ ID NO: 373627

SEQ ID NO: 539440 - RNA, 64 nt, Homo Sapiens; identical to SEQ ID NO: 373628

SEQ ID NO: 539441 - RNA, 64 nt, Homo Sapiens; identical to SEQ ID NO: 373629

SEQ ID NO: 539442 - RNA, 64 nt, Homo Sapiens; identical to SEQ ID NO: 373630

SEQ ID NO: 539443 - RNA, 64 nt, Homo Sapiens; identical to SEQ ID NO: 373631

SEQ ID NO: 539444 - RNA, 64 nt, Homo Sapiens; identical to SEQ ID NO: 373632

SEQ ID NO: 539445 - RNA, 64 nt, Homo Sapiens; identical to SEQ ID NO: 373633

SEQ ID NO: 539446 - RNA, 64 nt, Homo Sapiens; identical to SEQ ID NO: 373634

SEQ ID NO: 539447 - RNA, 64 nt, Homo Sapiens; identical to SEQ ID NO: 373635

SEQ ID NO: 539448 - RNA, 64 nt, Homo Sapiens; identical to SEQ ID NO: 373636

SEQ ID NO: 539449 - RNA, 64 nt, Homo Sapiens; identical to SEQ ID NO: 373637

SEQ ID NO: 539450 - RNA, 64 nt, Homo Sapiens; identical to SEQ ID NO: 373638

SEQ ID NO: 539451 - RNA, 64 nt, Homo Sapiens; identical to SEQ ID NO: 373639

SEQ ID NO: 539452 - RNA, 64 nt, Homo Sapiens; identical to SEQ ID NO: 373640

SEQ ID NO: 539453 - RNA, 64 nt, Homo Sapiens; identical to SEQ ID NO: 373641

SEQ ID NO: 539454 - RNA, 64 nt, Homo Sapiens; identical to SEQ ID NO: 373642

SEQ ID NO: 539455 - RNA, 64 nt, Homo Sapiens; identical to SEQ ID NO: 373643

SEQ ID NO: 539456 - RNA, 64 nt, Homo Sapiens; identical to SEQ ID NO: 373644

SEQ ID NO: 539457 - RNA, 64 nt, Homo Sapiens; identical to SEQ ID NO: 373645

SEQ ID NO: 539458 - RNA, 64 nt, Homo Sapiens; identical to SEQ ID NO: 373646

SEQ ID NO: 539459 - RNA, 64 nt, Homo Sapiens; identical to SEQ ID NO: 373647

SEQ ID NO: 539460 - RNA, 64 nt, Homo Sapiens; identical to SEQ ID NO: 373648

SEQ ID NO: 539461 - RNA, 64 nt, Homo Sapiens; identical to SEQ ID NO: 373649

SEQ ID NO: 539462 - RNA, 64 nt, Homo Sapiens; identical to SEQ ID NO: 373650

SEQ ID NO: 539463 - RNA, 64 nt, Homo Sapiens; identical to SEQ ID NO: 373651

SEQ ID NO: 539464 - RNA, 64 nt, Homo Sapiens; identical to SEQ ID NO: 373652

SEQ ID NO: 539465 - RNA, 64 nt, Homo Sapiens; identical to SEQ ID NO: 373653

SEQ ID NO: 539466 - RNA, 64 nt, Homo Sapiens; identical to SEQ ID NO: 373654

SEQ ID NO: 539467 - RNA, 64 nt, Homo Sapiens; identical to SEQ ID NO: 373655

SEQ ID NO: 539468 - RNA, 64 nt, Homo Sapiens; identical to SEQ ID NO: 373656

SEQ ID NO: 539469 - RNA, 64 nt, Homo Sapiens; identical to SEQ ID NO: 373657

SEQ ID NO: 539470 - RNA, 64 nt, Homo Sapiens; identical to SEQ ID NO: 373658

SEQ ID NO: 539471 - RNA, 64 nt, Homo Sapiens; identical to SEQ ID NO: 373659

SEQ ID NO: 539472 - RNA, 64 nt, Homo Sapiens; identical to SEQ ID NO: 373660

SEQ ID NO: 539473 - RNA, 64 nt, Homo Sapiens; identical to SEQ ID NO: 373661

SEQ ID NO: 539474 - RNA, 64 nt, Homo Sapiens; identical to SEQ ID NO: 235822

SEQ ID NO: 539475 - RNA, 64 nt, Homo Sapiens; identical to SEQ ID NO: 235823

SEQ ID NO: 539476 - RNA, 64 nt, Homo Sapiens; identical to SEQ ID NO: 235824

SEQ ID NO: 539477 - RNA, 64 nt, Homo Sapiens; identical to SEQ ID NO: 235825

SEQ ID NO: 539478 - RNA, 64 nt, Homo Sapiens; identical to SEQ ID NO: 235826

SEQ ID NO: 539479 - RNA, 64 nt, Homo Sapiens; identical to SEQ ID NO: 235827

SEQ ID NO: 539480 - RNA, 64 nt, Homo Sapiens; identical to SEQ ID NO: 235828

SEQ ID NO: 539481 - RNA, 64 nt, Homo Sapiens; identical to SEQ ID NO: 235829

SEQ ID NO: 539482 - RNA, 64 nt, Homo Sapiens; identical to SEQ ID NO: 235830

SEQ ID NO: 539483 - RNA, 64 nt, Homo Sapiens; identical to SEQ ID NO: 235831

SEQ ID NO: 539484 - RNA, 64 nt, Homo Sapiens; identical to SEQ ID NO: 235832

SEQ ID NO: 539485 - RNA, 64 nt, Homo Sapiens; identical to SEQ ID NO: 235833

SEQ ID NO: 539486 - RNA, 64 nt, Homo Sapiens; identical to SEQ ID NO: 235834

SEQ ID NO: 539487 - RNA, 64 nt, Homo Sapiens; identical to SEQ ID NO: 235835

SEQ ID NO: 539488 - RNA, 64 nt, Homo Sapiens; identical to SEQ ID NO: 235836

SEQ ID NO: 539489 - RNA, 64 nt, Homo Sapiens; identical to SEQ ID NO: 235837

SEQ ID NO: 539490 - RNA, 64 nt, Homo Sapiens; identical to SEQ ID NO: 235838

SEQ ID NO: 539491 - RNA, 64 nt, Homo Sapiens; identical to SEQ ID NO: 235839

SEQ ID NO: 539492 - RNA, 64 nt, Homo Sapiens; identical to SEQ ID NO: 235840

SEQ ID NO: 539493 - RNA, 64 nt, Homo Sapiens; identical to SEQ ID NO: 235841

SEQ ID NO: 539494 - RNA, 64 nt, Homo Sapiens; identical to SEQ ID NO: 235842

SEQ ID NO: 539495 - RNA, 64 nt, Homo Sapiens; identical to SEQ ID NO: 235843

SEQ ID NO: 539496 - RNA, 64 nt, Homo Sapiens; identical to SEQ ID NO: 235844

SEQ ID NO: 539497 - RNA, 64 nt, Homo Sapiens; identical to SEQ ID NO: 235845

SEQ ID NO: 539498 - RNA, 55 nt, Homo Sapiens; identical to SEQ ID NO: 235846

SEQ ID NO: 539499 - RNA, 64 nt, Homo Sapiens; identical to SEQ ID NO: 235847

SEQ ID NO: 539500 - RNA, 64 nt, Homo Sapiens; identical to SEQ ID NO: 235848

SEQ ID NO: 539501 - RNA, 64 nt, Homo Sapiens; identical to SEQ ID NO: 235849

SEQ ID NO: 539502 - RNA, 64 nt, Homo Sapiens; identical to SEQ ID NO: 235850

SEQ ID NO: 539503 - RNA, 64 nt, Homo Sapiens; identical to SEQ ID NO: 235851

SEQ ID NO: 539504 - RNA, 64 nt, Homo Sapiens; identical to SEQ ID NO: 235852

SEQ ID NO: 539505 - RNA, 64 nt, Homo Sapiens; identical to SEQ ID NO: 235853

SEQ ID NO: 539506 - RNA, 64 nt, Homo Sapiens; identical to SEQ ID NO: 235854

SEQ ID NO: 539507 - RNA, 64 nt, Homo Sapiens; identical to SEQ ID NO: 235855

SEQ ID NO: 539508 - RNA, 64 nt, Homo Sapiens; identical to SEQ ID NO: 235856

SEQ ID NO: 539509 - RNA, 64 nt, Homo Sapiens; identical to SEQ ID NO: 235857

SEQ ID NO: 539510 - RNA, 64 nt, Homo Sapiens; identical to SEQ ID NO: 235858

SEQ ID NO: 539511 - RNA, 64 nt, Homo Sapiens; identical to SEQ ID NO: 235859

SEQ ID NO: 539512 - RNA, 64 nt, Homo Sapiens; identical to SEQ ID NO: 235860

SEQ ID NO: 539513 - RNA, 64 nt, Homo Sapiens; identical to SEQ ID NO: 235861

SEQ ID NO: 539514 - RNA, 64 nt, Homo Sapiens; identical to SEQ ID NO: 235862

SEQ ID NO: 539515 - RNA, 64 nt, Homo Sapiens; identical to SEQ ID NO: 235863

SEQ ID NO: 539516 - RNA, 64 nt, Homo Sapiens; identical to SEQ ID NO: 235864

SEQ ID NO: 539517 - RNA, 64 nt, Homo Sapiens; identical to SEQ ID NO: 235865

SEQ ID NO: 539518 - RNA, 64 nt, Homo Sapiens; identical to SEQ ID NO: 235866

SEQ ID NO: 539519 - RNA, 64 nt, Homo Sapiens; identical to SEQ ID NO: 235867

SEQ ID NO: 539520 - RNA, 64 nt, Homo Sapiens; identical to SEQ ID NO: 235868

SEQ ID NO: 539521 - RNA, 64 nt, Homo Sapiens; identical to SEQ ID NO: 235869

SEQ ID NO: 539522 - RNA, 64 nt, Homo Sapiens; identical to SEQ ID NO: 235870

SEQ ID NO: 539523 - RNA, 64 nt, Homo Sapiens; identical to SEQ ID NO: 235871

SEQ ID NO: 539524 - RNA, 64 nt, Homo Sapiens; identical to SEQ ID NO: 235872

SEQ ID NO: 539525 - RNA, 64 nt, Homo Sapiens; identical to SEQ ID NO: 235873

SEQ ID NO: 539526 - RNA, 64 nt, Homo Sapiens; identical to SEQ ID NO: 235874

SEQ ID NO: 539527 - RNA, 64 nt, Homo Sapiens; identical to SEQ ID NO: 235875

SEQ ID NO: 539528 - RNA, 64 nt, Homo Sapiens; identical to SEQ ID NO: 235876

SEQ ID NO: 539529 - RNA, 64 nt, Homo Sapiens; identical to SEQ ID NO: 235877

SEQ ID NO: 539530 - RNA, 64 nt, Homo Sapiens; identical to SEQ ID NO: 235878

SEQ ID NO: 539531 - RNA, 64 nt, Homo Sapiens; identical to SEQ ID NO: 235879

SEQ ID NO: 539532 - RNA, 64 nt, Homo Sapiens; identical to SEQ ID NO: 235880

SEQ ID NO: 539533 - RNA, 64 nt, Homo Sapiens; identical to SEQ ID NO: 235881

SEQ ID NO: 539534 - RNA, 64 nt, Homo Sapiens; identical to SEQ ID NO: 235882

SEQ ID NO: 539535 - RNA, 64 nt, Homo Sapiens; identical to SEQ ID NO: 235883

SEQ ID NO: 539536 - RNA, 64 nt, Homo Sapiens; identical to SEQ ID NO: 235884

SEQ ID NO: 539537 - RNA, 64 nt, Homo Sapiens; identical to SEQ ID NO: 235885

SEQ ID NO: 539538 - RNA, 64 nt, Homo Sapiens; identical to SEQ ID NO: 235886

SEQ ID NO: 539539 - RNA, 64 nt, Homo Sapiens
gaaguguuuccaugguagcgugagcauuaggugacguggcuagcggaggacuacccuugcucac

SEQ ID NO: 539540 - RNA, 64 nt, Homo Sapiens
ccucgggugggagggauggggccaucuccuucaccguggcuaccauugucacucguaggggaug

SEQ ID NO: 539541 - RNA, 64 nt, Homo Sapiens
cuuccauuuauaagucuuaguuuuuuaacaguaacguggcuaggucugcuccaggccacauuug

SEQ ID NO: 539542 - RNA, 64 nt, Homo Sapiens
cugagcuggaguccgagagugguugggggugggccguggcuaguguccugcugcagucagcaca

SEQ ID NO: 539543 - RNA, 64 nt, Homo Sapiens
ugauuacauuuauauuccaagaacccauuaauaucguggcuaucucagugccacugaaaauaca

SEQ ID NO: 539544 - RNA, 64 nt, Homo Sapiens
auuccacuuccugugucauggagagcuccgcagccguggcuaggagcacucuggccuucaucac

SEQ ID NO: 539545 - RNA, 64 nt, Homo Sapiens
uuuccgagucaagugauugacaacugaagagacacguggcuaggguuccacuggagaauugaaa

SEQ ID NO: 539546 - RNA, 64 nt, Homo Sapiens
uagagauugucaucucauauauauaaaauggacacguggcuauaaaacaccauauaagagauga

SEQ ID NO: 539547 - RNA, 64 nt, Homo Sapiens
ugguggugcagaaacaugaugccuggcugauuuucguggcuaaagggguaggccuuauguugau

SEQ ID NO: 539548 - RNA, 64 nt, Homo Sapiens
ggcugagcuccuccgcgcgucgccggcgcuccaccguggcuacccauccguggucccgacaacc

SEQ ID NO: 539549 - RNA, 64 nt, Homo Sapiens
augauuuuauagggaaucuaucuuaugaauauuucguggcuaaaauuaacauuugaaguugguu

SEQ ID NO: 539550 - RNA, 64 nt, Homo Sapiens
cgaauaccugagcaacugugugcaaaucauagaccguggcuauaaccauaacgagaccgcccua

SEQ ID NO: 539551 - RNA, 64 nt, Homo Sapiens
ucuucuuuugcauauaguagagugaggugagggucguggcuaaaaccccacaauaacuuuacau

SEQ ID NO: 539552 - RNA, 64 nt, Homo Sapiens
gacucccagucccaccugugcugugacagucccacguggcuaugacagacuguuuaguacuuac

SEQ ID NO: 539553 - RNA, 64 nt, Homo Sapiens
gucaggcucuggccagggcaagagccuguuagcccguggcuacgaguccuggggaaacuuuucc

SEQ ID NO: 539554 - RNA, 64 nt, Homo Sapiens
aaaugccuaagggaguucguugaacuacuggcuacguggcuaccuccucaggguuuucuagucu

SEQ ID NO: 539555 - RNA, 64 nt, Homo Sapiens
uuuuaacaucugagaaaagcuuugaacccugggacguggcuagucauaaccuuaccagauuuuu

SEQ ID NO: 539556 - RNA, 64 nt, Homo Sapiens
auuggggacaagaagccaugaacucuaucuaugucguggcuaauucagcugccuggccaaggac

SEQ ID NO: 539557 - RNA, 64 nt, Homo Sapiens
uuccaagugcuacucucacuccuccaccacagaacguggcuaugcagucuaacgaggcccaccu

SEQ ID NO: 539558 - RNA, 64 nt, Homo Sapiens
uuuuggcaacauguacauuucuaacaaaguuuaucguggcuauuaaaguguuuuauuucccaau

SEQ ID NO: 539559 - RNA, 64 nt, Homo Sapiens
uugucgucccaucuuuuggcagcaaaaccaccugcguggcuaggaugauuaauuaugaggauga

SEQ ID NO: 539560 - RNA, 64 nt, Homo Sapiens
aacguuucgaagcacaguggccagcgagcgagcacguggcuacucccuguugcaugucaaaucc

SEQ ID NO: 539561 - RNA, 64 nt, Homo Sapiens
auccugcuuugauucccucuagaauggugccaugcguggcuaacaacauugaauaucaguugac

SEQ ID NO: 539562 - RNA, 64 nt, Homo Sapiens
ccuggggacuugauguuccugggccaagagccgccguggcuauacuccuuggccaccagaccau

SEQ ID NO: 539563 - RNA, 64 nt, Homo Sapiens
aagaaaaacccauaaccaccucagauggaucugacguggcuaagggacaaacagcaaauauuuc

SEQ ID NO: 539564 - RNA, 64 nt, Homo Sapiens
cauauuaugaauaaaugaggaggaaaugcuaccucguggcuacaauguuucuccaggaugccaa

SEQ ID NO: 539565 - RNA, 64 nt, Homo Sapiens
ccuuccaacaggagcugggauccuaagggcucaccguggcuaagaguguccuaggaguauccuc

SEQ ID NO: 539566 - RNA, 64 nt, Homo Sapiens
aaguucuaguauuuggaguccuuauccaaaguuucguggcuauugguuugaggaauuaguuuaa

SEQ ID NO: 539567 - RNA, 64 nt, Homo Sapiens
ucucgccuuuaagggcuaugguuguagugugacccguggcuaaccugcuuucaaaaucaaguau

SEQ ID NO: 539568 - RNA, 64 nt, Homo Sapiens
ccuuuccugccgagugcucucuucuaauguuccccguggcuaggucucugcaaugcuucuguag

SEQ ID NO: 539569 - RNA, 64 nt, Homo Sapiens
guuuuaucaagacucugaacauaauguuguaagccguggcuauauucuguaagaagcuuguuua

SEQ ID NO: 539570 - RNA, 64 nt, Homo Sapiens
gagugguaaacaaaucucacgaugugugucccuccguggcuacaauuuauggucugaaccggca

SEQ ID NO: 539571 - RNA, 64 nt, Homo Sapiens
aggaguucuaggaacucagucuggcaucugugugcguggcuauccgcguggcguggcccguggc

SEQ ID NO: 539572 - RNA, 62 nt, Homo Sapiens
acaucuacuacaagguaugagggcuccucucacguggcuauccugaauccagcccuucuugg

SEQ ID NO: 539573 - RNA, 64 nt, Homo Sapiens
gggcucucccccugcggccccgcuccaccgggggcguggcuagaucugaccgcgcccuuccagg

SEQ ID NO: 539574 - RNA, 64 nt, Homo Sapiens
guaagaacgugcuuguggaauggcuuggucacuucguggcuaagaguucaaccuuuaguacgug

SEQ ID NO: 539575 - RNA, 64 nt, Homo Sapiens
gcugcuauuggcaaagagcacaggacucagcccucguggcuaaaaaugguauuuuggcaguuug

SEQ ID NO: 539576 - RNA, 64 nt, Homo Sapiens
uacuacuguaggcaguuuccuccucagucuccuccguggcuagugugucuaguucacgaagcaa

SEQ ID NO: 539577 - RNA, 64 nt, Homo Sapiens
auuuauuggacccagagaaccgggccgggcacagcguggcuacagagggucucccucgaugacg

SEQ ID NO: 539578 - RNA, 64 nt, Homo Sapiens
cgcugaucccauucauuuagaguugauguuuccacguggcuauuuccaagcuuugccuucaaau

SEQ ID NO: 539579 - RNA, 64 nt, Homo Sapiens
ugaucugcuauagcuguccaucagagagaauacacguggcuauaacaucuauaacaaaacgacg

SEQ ID NO: 539580 - RNA, 64 nt, Homo Sapiens
ugugagccuaagugcagccgugcuagcugcgcaccguggcuaaggaugacgucuguguuccugu

SEQ ID NO: 539581 - RNA, 64 nt, Homo Sapiens
auucaaagguauccaaugucaugucacuacuguccguggcuacacagugugacaggaaagauuc

SEQ ID NO: 539582 - RNA, 64 nt, Homo Sapiens
guuaggugcccccgccaggcauugcaggcuuagucguggcuacuguucuccugugccgcugcau

SEQ ID NO: 539583 - RNA, 64 nt, Homo Sapiens
ucuuuaccuucucauagcugaccucggaccuugccguggcuaaaaugaaaagaguugauuuugg

SEQ ID NO: 539584 - RNA, 64 nt, Homo Sapiens
aguguagguacagaacuauacaaaccauguuaaacguggcuaacugaguugguuccugcucccc

SEQ ID NO: 539585 - RNA, 64 nt, Homo Sapiens; identical to SEQ ID NO: 164072

SEQ ID NO: 539586 - RNA, 64 nt, Homo Sapiens; identical to SEQ ID NO: 164073

SEQ ID NO: 539587 - RNA, 64 nt, Homo Sapiens; identical to SEQ ID NO: 164074

SEQ ID NO: 539588 - RNA, 64 nt, Homo Sapiens; identical to SEQ ID NO: 164075

SEQ ID NO: 539589 - RNA, 64 nt, Homo Sapiens; identical to SEQ ID NO: 164076

SEQ ID NO: 539590 - RNA, 64 nt, Homo Sapiens; identical to SEQ ID NO: 164077

SEQ ID NO: 539591 - RNA, 64 nt, Homo Sapiens; identical to SEQ ID NO: 164078

SEQ ID NO: 539592 - RNA, 64 nt, Homo Sapiens; identical to SEQ ID NO: 164079

SEQ ID NO: 539593 - RNA, 64 nt, Homo Sapiens; identical to SEQ ID NO: 164080

SEQ ID NO: 539594 - RNA, 64 nt, Homo Sapiens; identical to SEQ ID NO: 164081

SEQ ID NO: 539595 - RNA, 64 nt, Homo Sapiens; identical to SEQ ID NO: 164082

SEQ ID NO: 539596 - RNA, 64 nt, Homo Sapiens; identical to SEQ ID NO: 164083

SEQ ID NO: 539597 - RNA, 64 nt, Homo Sapiens; identical to SEQ ID NO: 164084

SEQ ID NO: 539598 - RNA, 64 nt, Homo Sapiens; identical to SEQ ID NO: 164085

SEQ ID NO: 539599 - RNA, 64 nt, Homo Sapiens; identical to SEQ ID NO: 164080

SEQ ID NO: 539600 - RNA, 64 nt, Homo Sapiens; identical to SEQ ID NO: 164081

SEQ ID NO: 539601 - RNA, 64 nt, Homo Sapiens; identical to SEQ ID NO: 164088

SEQ ID NO: 539602 - RNA, 64 nt, Homo Sapiens; identical to SEQ ID NO: 164089

SEQ ID NO: 539603 - RNA, 64 nt, Homo Sapiens; identical to SEQ ID NO: 164090

SEQ ID NO: 539604 - RNA, 64 nt, Homo Sapiens; identical to SEQ ID NO: 164091

SEQ ID NO: 539605 - RNA, 64 nt, Homo Sapiens; identical to SEQ ID NO: 164092

SEQ ID NO: 539606 - RNA, 64 nt, Homo Sapiens; identical to SEQ ID NO: 164093

SEQ ID NO: 539607 - RNA, 64 nt, Homo Sapiens; identical to SEQ ID NO: 164094

SEQ ID NO: 539608 - RNA, 64 nt, Homo Sapiens; identical to SEQ ID NO: 164095

SEQ ID NO: 539609 - RNA, 64 nt, Homo Sapiens; identical to SEQ ID NO: 164096

SEQ ID NO: 539610 - RNA, 64 nt, Homo Sapiens; identical to SEQ ID NO: 164097

SEQ ID NO: 539611 - RNA, 64 nt, Homo Sapiens; identical to SEQ ID NO: 164098

SEQ ID NO: 539612 - RNA, 64 nt, Homo Sapiens; identical to SEQ ID NO: 164099

SEQ ID NO: 539613 - RNA, 64 nt, Homo Sapiens; identical to SEQ ID NO: 164100

SEQ ID NO: 539614 - RNA, 64 nt, Homo Sapiens; identical to SEQ ID NO: 164101

SEQ ID NO: 539615 - RNA, 64 nt, Homo Sapiens
ccagccccucccccugccccaccuccucccuugggacugagagggccccuaccaaccuuugccu

SEQ ID NO: 539616 - RNA, 64 nt, Homo Sapiens
ucagguggccuucccauuuaagugccuucucugugacugagagcccuagugugaugagaacuaa

SEQ ID NO: 539617 - RNA, 54 nt, Homo Sapiens
ugaugcucuucucaaggugacacugacugagauguucucuuacugacugagaug

SEQ ID NO: 539618 - RNA, 64 nt, Homo Sapiens
cucaaggugacacugacugagauguucucuuacugacugagauguucucuuggcaugcuaaauc

SEQ ID NO: 539619 - RNA, 64 nt, Homo Sapiens
augagaguauauuuuuaugagggagcaaaaguuagacugagaacaaacguuagaaaaucacuuc

SEQ ID NO: 539620 - RNA, 64 nt, Homo Sapiens
acugccuuuccuucccacagaccugagugugaaagacugagaguugaggaguuacuuuguggau

SEQ ID NO: 539621 - RNA, 64 nt, Homo Sapiens
gcucacggcaaagucagcagcacugguaagccaagacugagaaauacaagguugcuugucugac

SEQ ID NO: 539622 - RNA, 64 nt, Homo Sapiens
cuguguucugaagucucuuacccuaccugcucaggacugagacaguuauucacugaacauauuu

SEQ ID NO: 539623 - RNA, 64 nt, Homo Sapiens
gaaucaaaggcagagaagacuugaggcaucuggagacugagaaacuuggccugagcuaugccug

SEQ ID NO: 539624 - RNA, 64 nt, Homo Sapiens
guagggggggcauuuuugguuuuucaauagaggugacugagauuccauggcuuuuguuugaugg

SEQ ID NO: 539625 - RNA, 64 nt, Homo Sapiens
ucuaaugacuucaccauaaauauuaaggcaguuagacugagauuugauaacuugucuuaaguuc

SEQ ID NO: 539626 - RNA, 64 nt, Homo Sapiens
guaaguuaacugauaaaaccgaaaguggaaaccagacugagaugaacauuuucccucauccucu

SEQ ID NO: 539627 - RNA, 64 nt, Homo Sapiens
gguccagggaguguggagagcuccuggugucgaggacugagacugagaggggagcccccuccau

SEQ ID NO: 539628 - RNA, 64 nt, Homo Sapiens
gggaguguggagagcuccuggugucgaggacugagacugagaggggagcccccuccaucuggcc

SEQ ID NO: 539629 - RNA, 64 nt, Homo Sapiens; identical to SEQ ID NO: 138909

SEQ ID NO: 539630 - RNA, 64 nt, Homo Sapiens; identical to SEQ ID NO: 138910

SEQ ID NO: 539631 - RNA, 64 nt, Homo Sapiens; identical to SEQ ID NO: 138911

SEQ ID NO: 539632 - RNA, 64 nt, Homo Sapiens; identical to SEQ ID NO: 138912

SEQ ID NO: 539633 - RNA, 64 nt, Homo Sapiens; identical to SEQ ID NO: 138913

SEQ ID NO: 539634 - RNA, 64 nt, Homo Sapiens; identical to SEQ ID NO: 138914

SEQ ID NO: 539635 - RNA, 64 nt, Homo Sapiens; identical to SEQ ID NO: 138915

SEQ ID NO: 539636 - RNA, 64 nt, Homo Sapiens; identical to SEQ ID NO: 138916

SEQ ID NO: 539637 - RNA, 64 nt, Homo Sapiens; identical to SEQ ID NO: 138917

SEQ ID NO: 539638 - RNA, 64 nt, Homo Sapiens; identical to SEQ ID NO: 138918

SEQ ID NO: 539639 - RNA, 64 nt, Homo Sapiens; identical to SEQ ID NO: 138919

SEQ ID NO: 539640 - RNA, 64 nt, Homo Sapiens; identical to SEQ ID NO: 138920

SEQ ID NO: 539641 - RNA, 64 nt, Homo Sapiens; identical to SEQ ID NO: 138921

SEQ ID NO: 539642 - RNA, 64 nt, Homo Sapiens; identical to SEQ ID NO: 138922

SEQ ID NO: 539643 - RNA, 64 nt, Homo Sapiens; identical to SEQ ID NO: 138923

SEQ ID NO: 539644 - RNA, 64 nt, Homo Sapiens; identical to SEQ ID NO: 138924

SEQ ID NO: 539645 - RNA, 64 nt, Homo Sapiens; identical to SEQ ID NO: 138925

SEQ ID NO: 539646 - RNA, 64 nt, Homo Sapiens; identical to SEQ ID NO: 138926

SEQ ID NO: 539647 - RNA, 64 nt, Homo Sapiens; identical to SEQ ID NO: 138927

SEQ ID NO: 539648 - RNA, 64 nt, Homo Sapiens; identical to SEQ ID NO: 138928

SEQ ID NO: 539649 - RNA, 64 nt, Homo Sapiens; identical to SEQ ID NO: 138929

SEQ ID NO: 539650 - RNA, 64 nt, Homo Sapiens; identical to SEQ ID NO: 138930

SEQ ID NO: 539651 - RNA, 64 nt, Homo Sapiens; identical to SEQ ID NO: 138931

SEQ ID NO: 539652 - RNA, 64 nt, Homo Sapiens; identical to SEQ ID NO: 138932

SEQ ID NO: 539653 - RNA, 64 nt, Homo Sapiens; identical to SEQ ID NO: 138933

SEQ ID NO: 539654 - RNA, 64 nt, Homo Sapiens; identical to SEQ ID NO: 138934

SEQ ID NO: 539655 - RNA, 64 nt, Homo Sapiens; identical to SEQ ID NO: 138935

SEQ ID NO: 539656 - RNA, 64 nt, Homo Sapiens; identical to SEQ ID NO: 138936

SEQ ID NO: 539657 - RNA, 64 nt, Homo Sapiens; identical to SEQ ID NO: 138937

SEQ ID NO: 539658 - RNA, 64 nt, Homo Sapiens; identical to SEQ ID NO: 138938

SEQ ID NO: 539659 - RNA, 64 nt, Homo Sapiens; identical to SEQ ID NO: 138939

SEQ ID NO: 539660 - RNA, 64 nt, Homo Sapiens; identical to SEQ ID NO: 138940

SEQ ID NO: 539661 - RNA, 64 nt, Homo Sapiens
uagggguggacucagcucugucuggcucacccucacgggcuacccccaccucacccugugcucc

SEQ ID NO: 539662 - RNA, 64 nt, Homo Sapiens
auuuuugaaacccgaauugaaaauguugcaggcaacgggcuacagcuuuauuagugguucucua

SEQ ID NO: 539663 - RNA, 64 nt, Homo Sapiens
cuugcugaugucuaugguguuacagaagugcuacacgggcuacagcugaagauuggaauacuaa

SEQ ID NO: 539664 - RNA, 62 nt, Homo Sapiens
cgcagggggccgagggcugaggccaggcaaucacgggcuaugcccggggagcugucgggagu

SEQ ID NO: 539665 - RNA, 64 nt, Homo Sapiens
ccuuuauuuuuuucucuguaaauauguacagugcacgggcuaugagauagcaacaaaaaaugca

SEQ ID NO: 539666 - RNA, 64 nt, Homo Sapiens
aggacucauuaacugaugaaacaaauuuguccccacgggcuaguuuaccugugucgugagaagg

SEQ ID NO: 539667 - RNA, 64 nt, Homo Sapiens
gcggcguguucauccccacaccacgccgugugucacgggcuaggauuauguggcguguucaucc

SEQ ID NO: 539668 - RNA, 64 nt, Homo Sapiens
accaggaaaaucacugccggcuagucccaagcaaacgggcuaggaggaaagauuaaaaaaacaa

SEQ ID NO: 539669 - RNA, 64 nt, Homo Sapiens
ucuacucuggcucaggacccaguccaggccuucuacgggcuaggcccagagacuuggguugcug

SEQ ID NO: 539670 - RNA, 54 nt, Homo Sapiens
ucaagagcagcuuaauccuguguuacgggcuaaaugagcaaaaugaaaccuuga

SEQ ID NO: 539671 - RNA, 64 nt, Homo Sapiens
gugccguggccagugaacucagaggugcugguggacgggcuaggacuuugggguuaggccaugg

SEQ ID NO: 539672 - RNA, 64 nt, Homo Sapiens
cagccugggaagaugucucacuguccaccucccaacgggcuaggggagcacgggguuggacagg

SEQ ID NO: 539673 - RNA, 64 nt, Homo Sapiens
gcuacauuugguuuuuuccccugucccuuugauuacgggcuaagguaggguagaguggguguag

SEQ ID NO: 539674 - RNA, 64 nt, Homo Sapiens
ggcuguggcuugcacuccagccugcagccuggccuccccgcacagggcccagggucugcccgcc

SEQ ID NO: 539675 - RNA, 64 nt, Homo Sapiens
cuggucccaucgaccagcaagccaccuccccaccuccccgcaagguggagcuggcugagucaca

SEQ ID NO: 539676 - RNA, 64 nt, Homo Sapiens
cagcgagaacaaacaccuccccagcccccagcccuccccgcagugggaagugaauccuuaaccc

SEQ ID NO: 539677 - RNA, 64 nt, Homo Sapiens
cuaggccgccuggcagaaucuagcaccguccgaauccccgcaggacccauggagcuaugaccac

SEQ ID NO: 539678 - RNA, 64 nt, Homo Sapiens; identical to SEQ ID NO: 411269

SEQ ID NO: 539679 - RNA, 64 nt, Homo Sapiens; identical to SEQ ID NO: 411270

SEQ ID NO: 539680 - RNA, 64 nt, Homo Sapiens; identical to SEQ ID NO: 411271

SEQ ID NO: 539681 - RNA, 64 nt, Homo Sapiens; identical to SEQ ID NO: 411272

SEQ ID NO: 539682 - RNA, 64 nt, Homo Sapiens; identical to SEQ ID NO: 411273

SEQ ID NO: 539683 - RNA, 64 nt, Homo Sapiens; identical to SEQ ID NO: 411274

SEQ ID NO: 539684 - RNA, 64 nt, Homo Sapiens; identical to SEQ ID NO: 411275

SEQ ID NO: 539685 - RNA, 64 nt, Homo Sapiens; identical to SEQ ID NO: 411276

SEQ ID NO: 539686 - RNA, 64 nt, Homo Sapiens; identical to SEQ ID NO: 411277

SEQ ID NO: 539687 - RNA, 64 nt, Homo Sapiens; identical to SEQ ID NO: 411278

SEQ ID NO: 539688 - RNA, 64 nt, Homo Sapiens; identical to SEQ ID NO: 411279

SEQ ID NO: 539689 - RNA, 64 nt, Homo Sapiens; identical to SEQ ID NO: 411280

SEQ ID NO: 539690 - RNA, 64 nt, Homo Sapiens; identical to SEQ ID NO: 411281

SEQ ID NO: 539691 - RNA, 64 nt, Homo Sapiens; identical to SEQ ID NO: 411282

SEQ ID NO: 539692 - RNA, 64 nt, Homo Sapiens; identical to SEQ ID NO: 411283

SEQ ID NO: 539693 - RNA, 64 nt, Homo Sapiens; identical to SEQ ID NO: 411284

SEQ ID NO: 539694 - RNA, 64 nt, Homo Sapiens; identical to SEQ ID NO: 411285

SEQ ID NO: 539695 - RNA, 64 nt, Homo Sapiens; identical to SEQ ID NO: 411286

SEQ ID NO: 539696 - RNA, 64 nt, Homo Sapiens; identical to SEQ ID NO: 411287

SEQ ID NO: 539697 - RNA, 64 nt, Homo Sapiens; identical to SEQ ID NO: 411288

SEQ ID NO: 539698 - RNA, 64 nt, Homo Sapiens; identical to SEQ ID NO: 411289

SEQ ID NO: 539699 - RNA, 64 nt, Homo Sapiens; identical to SEQ ID NO: 411290

SEQ ID NO: 539700 - RNA, 64 nt, Homo Sapiens; identical to SEQ ID NO: 411291

SEQ ID NO: 539701 - RNA, 64 nt, Homo Sapiens; identical to SEQ ID NO: 411292

SEQ ID NO: 539702 - RNA, 64 nt, Homo Sapiens; identical to SEQ ID NO: 411293

SEQ ID NO: 539703 - RNA, 64 nt, Homo Sapiens; identical to SEQ ID NO: 411294

SEQ ID NO: 539704 - RNA, 64 nt, Homo Sapiens; identical to SEQ ID NO: 411295

SEQ ID NO: 539705 - RNA, 64 nt, Homo Sapiens; identical to SEQ ID NO: 411296

SEQ ID NO: 539706 - RNA, 64 nt, Homo Sapiens; identical to SEQ ID NO: 411297

SEQ ID NO: 539707 - RNA, 64 nt, Homo Sapiens; identical to SEQ ID NO: 411298

SEQ ID NO: 539708 - RNA, 64 nt, Homo Sapiens; identical to SEQ ID NO: 411299

SEQ ID NO: 539709 - RNA, 64 nt, Homo Sapiens; identical to SEQ ID NO: 411300

SEQ ID NO: 539710 - RNA, 64 nt, Homo Sapiens; identical to SEQ ID NO: 411301

SEQ ID NO: 539711 - RNA, 64 nt, Homo Sapiens; identical to SEQ ID NO: 411302

SEQ ID NO: 539712 - RNA, 64 nt, Homo Sapiens; identical to SEQ ID NO: 411303

SEQ ID NO: 539713 - RNA, 64 nt, Homo Sapiens; identical to SEQ ID NO: 411304

SEQ ID NO: 539714 - RNA, 64 nt, Homo Sapiens; identical to SEQ ID NO: 411305

SEQ ID NO: 539715 - RNA, 64 nt, Homo Sapiens; identical to SEQ ID NO: 411306

SEQ ID NO: 539716 - RNA, 64 nt, Homo Sapiens; identical to SEQ ID NO: 411307

SEQ ID NO: 539717 - RNA, 64 nt, Homo Sapiens; identical to SEQ ID NO: 411308

SEQ ID NO: 539718 - RNA, 64 nt, Homo Sapiens; identical to SEQ ID NO: 411309

SEQ ID NO: 539719 - RNA, 64 nt, Homo Sapiens; identical to SEQ ID NO: 411310

SEQ ID NO: 539720 - RNA, 64 nt, Homo Sapiens; identical to SEQ ID NO: 411311

SEQ ID NO: 539721 - RNA, 64 nt, Homo Sapiens; identical to SEQ ID NO: 411312

SEQ ID NO: 539722 - RNA, 64 nt, Homo Sapiens; identical to SEQ ID NO: 411313

SEQ ID NO: 539723 - RNA, 64 nt, Homo Sapiens; identical to SEQ ID NO: 411314

SEQ ID NO: 539724 - RNA, 64 nt, Homo Sapiens; identical to SEQ ID NO: 411315

SEQ ID NO: 539725 - RNA, 64 nt, Homo Sapiens; identical to SEQ ID NO: 411316

SEQ ID NO: 539726 - RNA, 64 nt, Homo Sapiens; identical to SEQ ID NO: 411317

SEQ ID NO: 539727 - RNA, 64 nt, Homo Sapiens; identical to SEQ ID NO: 411318

SEQ ID NO: 539728 - RNA, 64 nt, Homo Sapiens; identical to SEQ ID NO: 411319

SEQ ID NO: 539729 - RNA, 64 nt, Homo Sapiens; identical to SEQ ID NO: 411320

SEQ ID NO: 539730 - RNA, 64 nt, Homo Sapiens; identical to SEQ ID NO: 411321

SEQ ID NO: 539731 - RNA, 64 nt, Homo Sapiens; identical to SEQ ID NO: 411322

SEQ ID NO: 539732 - RNA, 64 nt, Homo Sapiens; identical to SEQ ID NO: 411323

SEQ ID NO: 539733 - RNA, 64 nt, Homo Sapiens; identical to SEQ ID NO: 411324

SEQ ID NO: 539734 - RNA, 64 nt, Homo Sapiens; identical to SEQ ID NO: 411325

SEQ ID NO: 539735 - RNA, 64 nt, Homo Sapiens; identical to SEQ ID NO: 411326

SEQ ID NO: 539736 - RNA, 64 nt, Homo Sapiens; identical to SEQ ID NO: 411327

SEQ ID NO: 539737 - RNA, 64 nt, Homo Sapiens; identical to SEQ ID NO: 411328

SEQ ID NO: 539738 - RNA, 64 nt, Homo Sapiens; identical to SEQ ID NO: 411329

SEQ ID NO: 539739 - RNA, 64 nt, Homo Sapiens; identical to SEQ ID NO: 411330

SEQ ID NO: 539740 - RNA, 64 nt, Homo Sapiens; identical to SEQ ID NO: 411331

SEQ ID NO: 539741 - RNA, 52 nt, Homo Sapiens; identical to SEQ ID NO: 264778

SEQ ID NO: 539742 - RNA, 64 nt, Homo Sapiens; identical to SEQ ID NO: 411333

SEQ ID NO: 539743 - RNA, 64 nt, Homo Sapiens; identical to SEQ ID NO: 411334

SEQ ID NO: 539744 - RNA, 64 nt, Homo Sapiens; identical to SEQ ID NO: 411335

SEQ ID NO: 539745 - RNA, 64 nt, Homo Sapiens; identical to SEQ ID NO: 411336

SEQ ID NO: 539746 - RNA, 64 nt, Homo Sapiens; identical to SEQ ID NO: 411337

SEQ ID NO: 539747 - RNA, 64 nt, Homo Sapiens; identical to SEQ ID NO: 411338

SEQ ID NO: 539748 - RNA, 64 nt, Homo Sapiens; identical to SEQ ID NO: 411339

SEQ ID NO: 539749 - RNA, 64 nt, Homo Sapiens; identical to SEQ ID NO: 411340

SEQ ID NO: 539750 - RNA, 64 nt, Homo Sapiens; identical to SEQ ID NO: 411341

SEQ ID NO: 539751 - RNA, 64 nt, Homo Sapiens; identical to SEQ ID NO: 411342

SEQ ID NO: 539752 - RNA, 64 nt, Homo Sapiens; identical to SEQ ID NO: 411343

SEQ ID NO: 539753 - RNA, 64 nt, Homo Sapiens; identical to SEQ ID NO: 411344

SEQ ID NO: 539754 - RNA, 64 nt, Homo Sapiens; identical to SEQ ID NO: 411345

SEQ ID NO: 539755 - RNA, 64 nt, Homo Sapiens; identical to SEQ ID NO: 411346

SEQ ID NO: 539756 - RNA, 64 nt, Homo Sapiens; identical to SEQ ID NO: 411347

SEQ ID NO: 539757 - RNA, 64 nt, Homo Sapiens; identical to SEQ ID NO: 411348

SEQ ID NO: 539758 - RNA, 64 nt, Homo Sapiens; identical to SEQ ID NO: 411349

SEQ ID NO: 539759 - RNA, 64 nt, Homo Sapiens
cugggacuuggcauuuaggauuccaucuggcccagccccugaagguccuggggaagcaggucuc

SEQ ID NO: 539760 - RNA, 64 nt, Homo Sapiens
aacugcagcgcccuccuccccacugcccccugcagccccugagauauuuugcucacuaucccuc

SEQ ID NO: 539761 - RNA, 64 nt, Homo Sapiens
guuguagcacauuccuuuugcaggucugagcuaagccccugaaagcaggguaaugcucauaaaa

SEQ ID NO: 539762 - RNA, 64 nt, Homo Sapiens
aaguucccucucugacccaggcugaguccauacugccccugaucccagaaggaaugcugacccc

SEQ ID NO: 539763 - RNA, 64 nt, Homo Sapiens
guucuccuaaggucuggccuugccccuuugcucugccccugaagucuaucugcaggauggucuu

SEQ ID NO: 539764 - RNA, 64 nt, Homo Sapiens
ccucaugucugcuaaaacagccaucuucaagacagccccugaaaagagaccaguucagguccug

SEQ ID NO: 539765 - RNA, 64 nt, Homo Sapiens
gucuucaaggguaggcugagcuccccacccuggagccccugagggcggccccugagcacuccuc

SEQ ID NO: 539766 - RNA, 64 nt, Homo Sapiens
ggcugagcuccccacccuggagccccugagggcggccccugagcacuccucucucuccacucuc

SEQ ID NO: 539767 - RNA, 64 nt, Homo Sapiens
caaaagcaggggccagggagggggcgacuugccugccccugaagcccuuguucccauuggcccc

SEQ ID NO: 539768 - RNA, 64 nt, Homo Sapiens
cuguccaccugcuccauccucuaggguuccacaggccccugaccgcacagggaggcuggggcca

SEQ ID NO: 539769 - RNA, 64 nt, Homo Sapiens
gcacggagaagaugaaggagaucguaggguggaugccccugauggccgcacagaaggacuucuu

SEQ ID NO: 539770 - RNA, 64 nt, Homo Sapiens
ggcugaaggaggcgggggugguguagggcccccagccccugagaccuaaucccccucaugcuag

SEQ ID NO: 539771 - RNA, 64 nt, Homo Sapiens
uaucccaagcaugcuuccuucccuaacugaaacagccccugacuuccuccacugcugaacuggu

SEQ ID NO: 539772 - RNA, 64 nt, Homo Sapiens
guugcugucucccaguggaaugaguuuuccuccagccccugagauuuaaguauauuccuucaag

SEQ ID NO: 539773 - RNA, 64 nt, Homo Sapiens
gucaucagggaggguuaggaaaaccacaaacggagccccugaaagccucacguauuucacagag

SEQ ID NO: 539774 - RNA, 64 nt, Homo Sapiens
agcagcuaacuccgagagcagugggcagguggccgccccugaggcuucacgccgggagaagcca

SEQ ID NO: 539775 - RNA, 64 nt, Homo Sapiens
ucaugcccucugugcccacacaggucucugagcggccccugauguuccuguuggacacuccugg

SEQ ID NO: 539776 - RNA, 64 nt, Homo Sapiens
ccccauaccccacacacucaucagccugaaguuagccccugagugccaccugcaucgugccaua

SEQ ID NO: 539777 - RNA, 64 nt, Homo Sapiens
gacgacauccuucuccucaggucuucuggguggggccccugaugggagcccuccuggccucacu

SEQ ID NO: 539778 - RNA, 64 nt, Homo Sapiens
uagagguggggacaggggcaggggcaggggcggagccccugaagaaggaaucccagccggguuc

SEQ ID NO: 539779 - RNA, 64 nt, Homo Sapiens
uugcuauuuuucuuuaagugcagaguucauuuuugccccugaaaaguuuuugcugaguuugcug

SEQ ID NO: 539780 - RNA, 64 nt, Homo Sapiens
augaaaauaaaacaccuccuguuguggauggugagccccugaugccgcuuauuugccgugaguu

SEQ ID NO: 539781 - RNA, 64 nt, Homo Sapiens
cucuaugccaagaacacagcgauggcccaucccagccccugaaguaucauacucagcuuccccu

SEQ ID NO: 539782 - RNA, 64 nt, Homo Sapiens
caugcuucugcugauucccggugcucccucugcugccccugauggacacccauggucuccauga

SEQ ID NO: 539783 - RNA, 64 nt, Homo Sapiens
uccaauagcucacucccuagagccugacgccggggccccugaccccugagccucagauuccaau

SEQ ID NO: 539784 - RNA, 64 nt, Homo Sapiens
uccaauaccucacuccccagagccugaugccggggccccugaccccugaucuacggaggccugc

SEQ ID NO: 539785 - RNA, 64 nt, Homo Sapiens
cacuucucccuggaaguccccaggacagaccgaugccccugacagccccguccaccagccacau

SEQ ID NO: 539786 - RNA, 64 nt, Homo Sapiens
ugaggcuguugcuagcgugacccccacuggaccagccccugacccagcucgggcccccgacccu

SEQ ID NO: 539787 - RNA, 64 nt, Homo Sapiens
acauccaagcagacagggaauccuaucuucugcugccccugagccacuguuugggucccgcuuu

SEQ ID NO: 539788 - RNA, 64 nt, Homo Sapiens
accuuugaguucagucuacaccuccauguugccugccccugaagcccucuucaguguucuuccc

SEQ ID NO: 539789 - RNA, 64 nt, Homo Sapiens; identical to SEQ ID NO: 311389

SEQ ID NO: 539790 - RNA, 64 nt, Homo Sapiens; identical to SEQ ID NO: 311390

SEQ ID NO: 539791 - RNA, 64 nt, Homo Sapiens; identical to SEQ ID NO: 311391

SEQ ID NO: 539792 - RNA, 64 nt, Homo Sapiens; identical to SEQ ID NO: 311392

SEQ ID NO: 539793 - RNA, 64 nt, Homo Sapiens; identical to SEQ ID NO: 311393

SEQ ID NO: 539794 - RNA, 64 nt, Homo Sapiens; identical to SEQ ID NO: 311394

SEQ ID NO: 539795 - RNA, 64 nt, Homo Sapiens; identical to SEQ ID NO: 311395

SEQ ID NO: 539796 - RNA, 64 nt, Homo Sapiens; identical to SEQ ID NO: 311396

SEQ ID NO: 539797 - RNA, 64 nt, Homo Sapiens; identical to SEQ ID NO: 311397

SEQ ID NO: 539798 - RNA, 64 nt, Homo Sapiens; identical to SEQ ID NO: 311398

SEQ ID NO: 539799 - RNA, 64 nt, Homo Sapiens; identical to SEQ ID NO: 311399

SEQ ID NO: 539800 - RNA, 64 nt, Homo Sapiens; identical to SEQ ID NO: 311400

SEQ ID NO: 539801 - RNA, 64 nt, Homo Sapiens; identical to SEQ ID NO: 173401

SEQ ID NO: 539802 - RNA, 64 nt, Homo Sapiens; identical to SEQ ID NO: 173402

SEQ ID NO: 539803 - RNA, 64 nt, Homo Sapiens; identical to SEQ ID NO: 173403

SEQ ID NO: 539804 - RNA, 64 nt, Homo Sapiens; identical to SEQ ID NO: 173404

SEQ ID NO: 539805 - RNA, 64 nt, Homo Sapiens; identical to SEQ ID NO: 370212

SEQ ID NO: 539806 - RNA, 64 nt, Homo Sapiens; identical to SEQ ID NO: 370213

SEQ ID NO: 539807 - RNA, 64 nt, Homo Sapiens; identical to SEQ ID NO: 370214

SEQ ID NO: 539808 - RNA, 64 nt, Homo Sapiens; identical to SEQ ID NO: 370215

SEQ ID NO: 539809 - RNA, 64 nt, Homo Sapiens; identical to SEQ ID NO: 119725

SEQ ID NO: 539810 - RNA, 64 nt, Homo Sapiens; identical to SEQ ID NO: 119726

SEQ ID NO: 539811 - RNA, 64 nt, Homo Sapiens; identical to SEQ ID NO: 119727

SEQ ID NO: 539812 - RNA, 64 nt, Homo Sapiens; identical to SEQ ID NO: 119728

SEQ ID NO: 539813 - RNA, 64 nt, Homo Sapiens; identical to SEQ ID NO: 119729

SEQ ID NO: 539814 - RNA, 64 nt, Homo Sapiens; identical to SEQ ID NO: 119730

SEQ ID NO: 539815 - RNA, 64 nt, Homo Sapiens; identical to SEQ ID NO: 119731

SEQ ID NO: 539816 - RNA, 64 nt, Homo Sapiens; identical to SEQ ID NO: 119732

SEQ ID NO: 539817 - RNA, 64 nt, Homo Sapiens; identical to SEQ ID NO: 119733

SEQ ID NO: 539818 - RNA, 64 nt, Homo Sapiens; identical to SEQ ID NO: 119734

SEQ ID NO: 539819 - RNA, 64 nt, Homo Sapiens; identical to SEQ ID NO: 119735

SEQ ID NO: 539820 - RNA, 64 nt, Homo Sapiens; identical to SEQ ID NO: 119736

SEQ ID NO: 539821 - RNA, 64 nt, Homo Sapiens; identical to SEQ ID NO: 119737

SEQ ID NO: 539822 - RNA, 64 nt, Homo Sapiens; identical to SEQ ID NO: 119738

SEQ ID NO: 539823 - RNA, 64 nt, Homo Sapiens; identical to SEQ ID NO: 119739

SEQ ID NO: 539824 - RNA, 64 nt, Homo Sapiens; identical to SEQ ID NO: 119740

SEQ ID NO: 539825 - RNA, 62 nt, Homo Sapiens; identical to SEQ ID NO: 119741

SEQ ID NO: 539826 - RNA, 64 nt, Homo Sapiens; identical to SEQ ID NO: 119742

SEQ ID NO: 539827 - RNA, 64 nt, Homo Sapiens; identical to SEQ ID NO: 119743

SEQ ID NO: 539828 - RNA, 64 nt, Homo Sapiens; identical to SEQ ID NO: 119744

SEQ ID NO: 539829 - RNA, 64 nt, Homo Sapiens; identical to SEQ ID NO: 119745

SEQ ID NO: 539830 - RNA, 64 nt, Homo Sapiens; identical to SEQ ID NO: 119746

SEQ ID NO: 539831 - RNA, 64 nt, Homo Sapiens; identical to SEQ ID NO: 119747

SEQ ID NO: 539832 - RNA, 64 nt, Homo Sapiens; identical to SEQ ID NO: 119748

SEQ ID NO: 539833 - RNA, 64 nt, Homo Sapiens; identical to SEQ ID NO: 119749

SEQ ID NO: 539834 - RNA, 64 nt, Homo Sapiens; identical to SEQ ID NO: 119750

SEQ ID NO: 539835 - RNA, 64 nt, Homo Sapiens; identical to SEQ ID NO: 119751

SEQ ID NO: 539836 - RNA, 64 nt, Homo Sapiens; identical to SEQ ID NO: 119752

SEQ ID NO: 539837 - RNA, 64 nt, Homo Sapiens; identical to SEQ ID NO: 119753

SEQ ID NO: 539838 - RNA, 64 nt, Homo Sapiens; identical to SEQ ID NO: 119754

SEQ ID NO: 539839 - RNA, 64 nt, Homo Sapiens; identical to SEQ ID NO: 119755

SEQ ID NO: 539840 - RNA, 64 nt, Homo Sapiens; identical to SEQ ID NO: 119756

SEQ ID NO: 539841 - RNA, 64 nt, Homo Sapiens; identical to SEQ ID NO: 119757

SEQ ID NO: 539842 - RNA, 64 nt, Homo Sapiens; identical to SEQ ID NO: 119758

SEQ ID NO: 539843 - RNA, 64 nt, Homo Sapiens; identical to SEQ ID NO: 119759

SEQ ID NO: 539844 - RNA, 64 nt, Homo Sapiens; identical to SEQ ID NO: 119760

SEQ ID NO: 539845 - RNA, 64 nt, Homo Sapiens; identical to SEQ ID NO: 119761

SEQ ID NO: 539846 - RNA, 64 nt, Homo Sapiens; identical to SEQ ID NO: 119762

SEQ ID NO: 539847 - RNA, 64 nt, Homo Sapiens; identical to SEQ ID NO: 119763

SEQ ID NO: 539848 - RNA, 64 nt, Homo Sapiens; identical to SEQ ID NO: 119764

SEQ ID NO: 539849 - RNA, 64 nt, Homo Sapiens; identical to SEQ ID NO: 119765

SEQ ID NO: 539850 - RNA, 64 nt, Homo Sapiens; identical to SEQ ID NO: 119766

SEQ ID NO: 539851 - RNA, 64 nt, Homo Sapiens; identical to SEQ ID NO: 119767

SEQ ID NO: 539852 - RNA, 64 nt, Homo Sapiens; identical to SEQ ID NO: 119768

SEQ ID NO: 539853 - RNA, 64 nt, Homo Sapiens; identical to SEQ ID NO: 119769

SEQ ID NO: 539854 - RNA, 64 nt, Homo Sapiens; identical to SEQ ID NO: 119770

SEQ ID NO: 539855 - RNA, 64 nt, Homo Sapiens; identical to SEQ ID NO: 119771

SEQ ID NO: 539856 - RNA, 64 nt, Homo Sapiens; identical to SEQ ID NO: 119772

SEQ ID NO: 539857 - RNA, 64 nt, Homo Sapiens; identical to SEQ ID NO: 119773

SEQ ID NO: 539858 - RNA, 64 nt, Homo Sapiens; identical to SEQ ID NO: 119774

SEQ ID NO: 539859 - RNA, 64 nt, Homo Sapiens; identical to SEQ ID NO: 119775

SEQ ID NO: 539860 - RNA, 64 nt, Homo Sapiens; identical to SEQ ID NO: 119776

SEQ ID NO: 539861 - RNA, 64 nt, Homo Sapiens; identical to SEQ ID NO: 119777

SEQ ID NO: 539862 - RNA, 64 nt, Homo Sapiens; identical to SEQ ID NO: 119778

SEQ ID NO: 539863 - RNA, 64 nt, Homo Sapiens; identical to SEQ ID NO: 119779

SEQ ID NO: 539864 - RNA, 64 nt, Homo Sapiens; identical to SEQ ID NO: 119780

SEQ ID NO: 539865 - RNA, 64 nt, Homo Sapiens; identical to SEQ ID NO: 119781

SEQ ID NO: 539866 - RNA, 64 nt, Homo Sapiens; identical to SEQ ID NO: 119782

SEQ ID NO: 539867 - RNA, 64 nt, Homo Sapiens; identical to SEQ ID NO: 119783

SEQ ID NO: 539868 - RNA, 64 nt, Homo Sapiens; identical to SEQ ID NO: 119784

SEQ ID NO: 539869 - RNA, 64 nt, Homo Sapiens; identical to SEQ ID NO: 119785

SEQ ID NO: 539870 - RNA, 64 nt, Homo Sapiens; identical to SEQ ID NO: 119786

SEQ ID NO: 539871 - RNA, 64 nt, Homo Sapiens; identical to SEQ ID NO: 119787

SEQ ID NO: 539872 - RNA, 64 nt, Homo Sapiens; identical to SEQ ID NO: 119788

SEQ ID NO: 539873 - RNA, 64 nt, Homo Sapiens; identical to SEQ ID NO: 119789

SEQ ID NO: 539874 - RNA, 64 nt, Homo Sapiens; identical to SEQ ID NO: 119790

SEQ ID NO: 539875 - RNA, 64 nt, Homo Sapiens; identical to SEQ ID NO: 119791

SEQ ID NO: 539876 - RNA, 64 nt, Homo Sapiens; identical to SEQ ID NO: 119792

SEQ ID NO: 539877 - RNA, 64 nt, Homo Sapiens; identical to SEQ ID NO: 119793

SEQ ID NO: 539878 - RNA, 64 nt, Homo Sapiens; identical to SEQ ID NO: 119794

SEQ ID NO: 539879 - RNA, 64 nt, Homo Sapiens; identical to SEQ ID NO: 119795

SEQ ID NO: 539880 - RNA, 64 nt, Homo Sapiens; identical to SEQ ID NO: 119796

SEQ ID NO: 539881 - RNA, 64 nt, Homo Sapiens; identical to SEQ ID NO: 119795

SEQ ID NO: 539882 - RNA, 64 nt, Homo Sapiens; identical to SEQ ID NO: 119798

SEQ ID NO: 539883 - RNA, 64 nt, Homo Sapiens; identical to SEQ ID NO: 119799

SEQ ID NO: 539884 - RNA, 64 nt, Homo Sapiens; identical to SEQ ID NO: 119800

SEQ ID NO: 539885 - RNA, 64 nt, Homo Sapiens; identical to SEQ ID NO: 119801

SEQ ID NO: 539886 - RNA, 64 nt, Homo Sapiens; identical to SEQ ID NO: 119802

SEQ ID NO: 539887 - RNA, 64 nt, Homo Sapiens; identical to SEQ ID NO: 119803

SEQ ID NO: 539888 - RNA, 64 nt, Homo Sapiens; identical to SEQ ID NO: 119804

SEQ ID NO: 539889 - RNA, 64 nt, Homo Sapiens; identical to SEQ ID NO: 119805

SEQ ID NO: 539890 - RNA, 64 nt, Homo Sapiens; identical to SEQ ID NO: 119806

SEQ ID NO: 539891 - RNA, 64 nt, Homo Sapiens; identical to SEQ ID NO: 119807

SEQ ID NO: 539892 - RNA, 64 nt, Homo Sapiens; identical to SEQ ID NO: 119808

SEQ ID NO: 539893 - RNA, 64 nt, Homo Sapiens; identical to SEQ ID NO: 119809

SEQ ID NO: 539894 - RNA, 64 nt, Homo Sapiens; identical to SEQ ID NO: 119810

SEQ ID NO: 539895 - RNA, 64 nt, Homo Sapiens; identical to SEQ ID NO: 119811

SEQ ID NO: 539896 - RNA, 64 nt, Homo Sapiens; identical to SEQ ID NO: 119812

SEQ ID NO: 539897 - RNA, 64 nt, Homo Sapiens; identical to SEQ ID NO: 119813

SEQ ID NO: 539898 - RNA, 64 nt, Homo Sapiens; identical to SEQ ID NO: 119814

SEQ ID NO: 539899 - RNA, 64 nt, Homo Sapiens; identical to SEQ ID NO: 119815

SEQ ID NO: 539900 - RNA, 64 nt, Homo Sapiens; identical to SEQ ID NO: 119816

SEQ ID NO: 539901 - RNA, 64 nt, Homo Sapiens; identical to SEQ ID NO: 119817

SEQ ID NO: 539902 - RNA, 64 nt, Homo Sapiens; identical to SEQ ID NO: 119818

SEQ ID NO: 539903 - RNA, 64 nt, Homo Sapiens; identical to SEQ ID NO: 119819

SEQ ID NO: 539904 - RNA, 64 nt, Homo Sapiens; identical to SEQ ID NO: 119820

SEQ ID NO: 539905 - RNA, 64 nt, Homo Sapiens; identical to SEQ ID NO: 119821

SEQ ID NO: 539906 - RNA, 64 nt, Homo Sapiens; identical to SEQ ID NO: 119822

SEQ ID NO: 539907 - RNA, 64 nt, Homo Sapiens; identical to SEQ ID NO: 119823

SEQ ID NO: 539908 - RNA, 64 nt, Homo Sapiens; identical to SEQ ID NO: 119824

SEQ ID NO: 539909 - RNA, 64 nt, Homo Sapiens; identical to SEQ ID NO: 119825

SEQ ID NO: 539910 - RNA, 64 nt, Homo Sapiens; identical to SEQ ID NO: 119826

SEQ ID NO: 539911 - RNA, 64 nt, Homo Sapiens; identical to SEQ ID NO: 119827

SEQ ID NO: 539912 - RNA, 64 nt, Homo Sapiens; identical to SEQ ID NO: 119828

SEQ ID NO: 539913 - RNA, 64 nt, Homo Sapiens; identical to SEQ ID NO: 119829

SEQ ID NO: 539914 - RNA, 64 nt, Homo Sapiens; identical to SEQ ID NO: 119830

SEQ ID NO: 539915 - RNA, 64 nt, Homo Sapiens; identical to SEQ ID NO: 119831

SEQ ID NO: 539916 - RNA, 64 nt, Homo Sapiens; identical to SEQ ID NO: 119832

SEQ ID NO: 539917 - RNA, 64 nt, Homo Sapiens; identical to SEQ ID NO: 119833

SEQ ID NO: 539918 - RNA, 64 nt, Homo Sapiens; identical to SEQ ID NO: 119834

SEQ ID NO: 539919 - RNA, 64 nt, Homo Sapiens; identical to SEQ ID NO: 119835

SEQ ID NO: 539920 - RNA, 64 nt, Homo Sapiens; identical to SEQ ID NO: 119836

SEQ ID NO: 539921 - RNA, 64 nt, Homo Sapiens; identical to SEQ ID NO: 119837

SEQ ID NO: 539922 - RNA, 64 nt, Homo Sapiens; identical to SEQ ID NO: 119838

SEQ ID NO: 539923 - RNA, 64 nt, Homo Sapiens; identical to SEQ ID NO: 119839

SEQ ID NO: 539924 - RNA, 64 nt, Homo Sapiens
ugauacaugugggccuguuaacaguggaguugaagucuaauacaccaucaaaaaaugcacucuc

SEQ ID NO: 539925 - RNA, 64 nt, Homo Sapiens
ucuacaguaaauguuacacuaacaaaaaacuguugucuaauauaaaagagaaucuaaaaaaaaa

SEQ ID NO: 539926 - RNA, 64 nt, Homo Sapiens
aagccuguacagacaguuaacaaggaaagaaugagucuaauaucgugaacaaaaggaagaaaau

SEQ ID NO: 539927 - RNA, 64 nt, Homo Sapiens
gcugaagaccccaaagaucugaaacaguuaaagugucuaauaauaagaaaaagaagagaaacua

SEQ ID NO: 539928 - RNA, 56 nt, Homo Sapiens; identical to SEQ ID NO: 44915

SEQ ID NO: 539929 - RNA, 64 nt, Homo Sapiens; identical to SEQ ID NO: 44916

SEQ ID NO: 539930 - RNA, 64 nt, Homo Sapiens; identical to SEQ ID NO: 44917

SEQ ID NO: 539931 - RNA, 64 nt, Homo Sapiens; identical to SEQ ID NO: 44918

SEQ ID NO: 539932 - RNA, 64 nt, Homo Sapiens; identical to SEQ ID NO: 44919

SEQ ID NO: 539933 - RNA, 64 nt, Homo Sapiens; identical to SEQ ID NO: 44920

SEQ ID NO: 539934 - RNA, 64 nt, Homo Sapiens; identical to SEQ ID NO: 44921

SEQ ID NO: 539935 - RNA, 64 nt, Homo Sapiens; identical to SEQ ID NO: 44922

SEQ ID NO: 539936 - RNA, 64 nt, Homo Sapiens; identical to SEQ ID NO: 44923

SEQ ID NO: 539937 - RNA, 64 nt, Homo Sapiens; identical to SEQ ID NO: 44924

SEQ ID NO: 539938 - RNA, 64 nt, Homo Sapiens; identical to SEQ ID NO: 44925

SEQ ID NO: 539939 - RNA, 64 nt, Homo Sapiens; identical to SEQ ID NO: 44926

SEQ ID NO: 539940 - RNA, 64 nt, Homo Sapiens; identical to SEQ ID NO: 44927

SEQ ID NO: 539941 - RNA, 64 nt, Homo Sapiens; identical to SEQ ID NO: 44928

SEQ ID NO: 539942 - RNA, 64 nt, Homo Sapiens; identical to SEQ ID NO: 44929

SEQ ID NO: 539943 - RNA, 64 nt, Homo Sapiens; identical to SEQ ID NO: 44930

SEQ ID NO: 539944 - RNA, 64 nt, Homo Sapiens; identical to SEQ ID NO: 44931

SEQ ID NO: 539945 - RNA, 64 nt, Homo Sapiens; identical to SEQ ID NO: 44932

SEQ ID NO: 539946 - RNA, 64 nt, Homo Sapiens; identical to SEQ ID NO: 44933

SEQ ID NO: 539947 - RNA, 64 nt, Homo Sapiens; identical to SEQ ID NO: 77887

SEQ ID NO: 539948 - RNA, 64 nt, Homo Sapiens; identical to SEQ ID NO: 77888

SEQ ID NO: 539949 - RNA, 64 nt, Homo Sapiens; identical to SEQ ID NO: 77889

SEQ ID NO: 539950 - RNA, 64 nt, Homo Sapiens; identical to SEQ ID NO: 77890

SEQ ID NO: 539951 - RNA, 64 nt, Homo Sapiens; identical to SEQ ID NO: 77891

SEQ ID NO: 539952 - RNA, 64 nt, Homo Sapiens; identical to SEQ ID NO: 77892

SEQ ID NO: 539953 - RNA, 64 nt, Homo Sapiens; identical to SEQ ID NO: 77893

SEQ ID NO: 539954 - RNA, 64 nt, Homo Sapiens; identical to SEQ ID NO: 77894

SEQ ID NO: 539955 - RNA, 64 nt, Homo Sapiens; identical to SEQ ID NO: 77895

SEQ ID NO: 539956 - RNA, 64 nt, Homo Sapiens; identical to SEQ ID NO: 77896

SEQ ID NO: 539957 - RNA, 64 nt, Homo Sapiens; identical to SEQ ID NO: 77897

SEQ ID NO: 539958 - RNA, 64 nt, Homo Sapiens; identical to SEQ ID NO: 77898

SEQ ID NO: 539959 - RNA, 64 nt, Homo Sapiens; identical to SEQ ID NO: 77899

SEQ ID NO: 539960 - RNA, 64 nt, Homo Sapiens; identical to SEQ ID NO: 77900

SEQ ID NO: 539961 - RNA, 64 nt, Homo Sapiens; identical to SEQ ID NO: 77901

SEQ ID NO: 539962 - RNA, 64 nt, Homo Sapiens; identical to SEQ ID NO: 77902

SEQ ID NO: 539963 - RNA, 64 nt, Homo Sapiens; identical to SEQ ID NO: 77903

SEQ ID NO: 539964 - RNA, 64 nt, Homo Sapiens; identical to SEQ ID NO: 77904

SEQ ID NO: 539965 - RNA, 64 nt, Homo Sapiens; identical to SEQ ID NO: 77905

SEQ ID NO: 539966 - RNA, 64 nt, Homo Sapiens; identical to SEQ ID NO: 77906

SEQ ID NO: 539967 - RNA, 64 nt, Homo Sapiens; identical to SEQ ID NO: 77907

SEQ ID NO: 539968 - RNA, 64 nt, Homo Sapiens; identical to SEQ ID NO: 77908

SEQ ID NO: 539969 - RNA, 64 nt, Homo Sapiens; identical to SEQ ID NO: 77909

SEQ ID NO: 539970 - RNA, 64 nt, Homo Sapiens; identical to SEQ ID NO: 77910

SEQ ID NO: 539971 - RNA, 64 nt, Homo Sapiens; identical to SEQ ID NO: 77911

SEQ ID NO: 539972 - RNA, 64 nt, Homo Sapiens; identical to SEQ ID NO: 77912

SEQ ID NO: 539973 - RNA, 64 nt, Homo Sapiens; identical to SEQ ID NO: 77913

SEQ ID NO: 539974 - RNA, 64 nt, Homo Sapiens; identical to SEQ ID NO: 77914

SEQ ID NO: 539975 - RNA, 64 nt, Homo Sapiens; identical to SEQ ID NO: 77915

SEQ ID NO: 539976 - RNA, 64 nt, Homo Sapiens; identical to SEQ ID NO: 77916

SEQ ID NO: 539977 - RNA, 64 nt, Homo Sapiens; identical to SEQ ID NO: 77917

SEQ ID NO: 539978 - RNA, 64 nt, Homo Sapiens; identical to SEQ ID NO: 77918

SEQ ID NO: 539979 - RNA, 64 nt, Homo Sapiens; identical to SEQ ID NO: 77919

SEQ ID NO: 539980 - RNA, 64 nt, Homo Sapiens; identical to SEQ ID NO: 77920

SEQ ID NO: 539981 - RNA, 64 nt, Homo Sapiens; identical to SEQ ID NO: 77921

SEQ ID NO: 539982 - RNA, 64 nt, Homo Sapiens; identical to SEQ ID NO: 77922

SEQ ID NO: 539983 - RNA, 64 nt, Homo Sapiens; identical to SEQ ID NO: 77923

SEQ ID NO: 539984 - RNA, 64 nt, Homo Sapiens; identical to SEQ ID NO: 77924

SEQ ID NO: 539985 - RNA, 64 nt, Homo Sapiens; identical to SEQ ID NO: 77925

SEQ ID NO: 539986 - RNA, 64 nt, Homo Sapiens; identical to SEQ ID NO: 77926

SEQ ID NO: 539987 - RNA, 64 nt, Homo Sapiens; identical to SEQ ID NO: 77927

SEQ ID NO: 539988 - RNA, 64 nt, Homo Sapiens; identical to SEQ ID NO: 77928

SEQ ID NO: 539989 - RNA, 64 nt, Homo Sapiens; identical to SEQ ID NO: 77929

SEQ ID NO: 539990 - RNA, 64 nt, Homo Sapiens; identical to SEQ ID NO: 77930

SEQ ID NO: 539991 - RNA, 64 nt, Homo Sapiens; identical to SEQ ID NO: 77931

SEQ ID NO: 539992 - RNA, 64 nt, Homo Sapiens; identical to SEQ ID NO: 77932

SEQ ID NO: 539993 - RNA, 64 nt, Homo Sapiens; identical to SEQ ID NO: 77933

SEQ ID NO: 539994 - RNA, 64 nt, Homo Sapiens; identical to SEQ ID NO: 77934

SEQ ID NO: 539995 - RNA, 64 nt, Homo Sapiens; identical to SEQ ID NO: 77935

SEQ ID NO: 539996 - RNA, 64 nt, Homo Sapiens; identical to SEQ ID NO: 77936

SEQ ID NO: 539997 - RNA, 64 nt, Homo Sapiens; identical to SEQ ID NO: 77937

SEQ ID NO: 539998 - RNA, 64 nt, Homo Sapiens; identical to SEQ ID NO: 77938

SEQ ID NO: 539999 - RNA, 64 nt, Homo Sapiens
guuugauauaccaaauuaaacaacauuuauauguagccuuuacucaaaguacauucuggggaaa

SEQ ID NO: 540000 - RNA, 64 nt, Homo Sapiens
ugugaaguguuacuacagccaugucccagaacuuagccuuuaccugaauuuucuaaaagcuuuc

SEQ ID NO: 540001 - RNA, 64 nt, Homo Sapiens
uuugacucaaauggaaauugauuuuucuaaauacagccuuuaaauccauuucauaauucucaag

SEQ ID NO: 540002 - RNA, 64 nt, Homo Sapiens
aaaauguaaauuuuuuaaaaauacucugcaaaguagccuuuaaaccuuuaagcaucuuugauga

SEQ ID NO: 540003 - RNA, 64 nt, Homo Sapiens
agcgguuuccaucauaaaccaagaugaugaguucagccuuuaucccucgugguuccacuagaug

SEQ ID NO: 540004 - RNA, 64 nt, Homo Sapiens
agcgguuuccaucauaaaccaagaugaugaguucagccuuuaucccucgugguuccgcuagaug

SEQ ID NO: 540005 - RNA, 64 nt, Homo Sapiens
auuuuuucugguugagucauaaaaaggaaaaggcagccuuuacuauaaagcuaauaagcacuuu

SEQ ID NO: 540006 - RNA, 64 nt, Homo Sapiens
aaaaacacuccguuucagaagguauguuuguauuagccuuuagagugcucagaaauucuauuuu

SEQ ID NO: 540007 - RNA, 64 nt, Homo Sapiens
uggagagaaacuacaaaugugaagaauguguuaaagccuuuaacaagucuucaacuuuuucugc

SEQ ID NO: 540008 - RNA, 64 nt, Homo Sapiens
gugaaaaauccuagaaaugugaaaaauaucacaaagccuuuaaaugguugucacacuugauugu

SEQ ID NO: 540009 - RNA, 64 nt, Homo Sapiens
gcaauuuuugucaagagaucuuucagaaaauauaagccuuuaaagugaagaagaggagccaguu

SEQ ID NO: 540010 - RNA, 64 nt, Homo Sapiens
gagagaaagccuacaaaugugaagaauguggcaaagccuuuaaccaguuuucaacccuuauuac

SEQ ID NO: 540011 - RNA, 64 nt, Homo Sapiens
gggagaaaccccacaaauguggagaaugcggaaaagccuuuaacugguccucaacucuuauuac

SEQ ID NO: 540012 - RNA, 64 nt, Homo Sapiens
accaguaacgugcugcucaacaacuuuaccauaaagccuuuaaacagaaaaaugaaaagcaaua

SEQ ID NO: 540013 - RNA, 64 nt, Homo Sapiens
ucuuuaguccgggggacuugggaaugagucaaucagccuuuaggacuuuccauuaaaucaauca

SEQ ID NO: 540014 - RNA, 64 nt, Homo Sapiens
gcucucuuuagcucaaccacucuuucccagcacgagccuuuauaaagucuaagcauaacagcuu

SEQ ID NO: 540015 - RNA, 64 nt, Homo Sapiens
ucauaaagagaggguagggcucggggaccaaauuagccuuuaaccuagccuuccaagcaugaag

SEQ ID NO: 540016 - RNA, 64 nt, Homo Sapiens
uuguucugugaaauguguauuuuagucucugugaagccuuuacucucuaggugccuuauaaugu

SEQ ID NO: 540017 - RNA, 64 nt, Homo Sapiens
aaaacuguauauuuagcaguagcacccaaaaccaagccuuuaaccccaacaauguguguaucuu

SEQ ID NO: 540018 - RNA, 64 nt, Homo Sapiens
gguuucuuugcagacugauugugcaaugaaaaauagccuuuaaguucagacaacugcucugccu

SEQ ID NO: 540019 - RNA, 64 nt, Homo Sapiens
uaaaaucuucagugucuuguccuucauuucaccaagccuuuacuacaaauaucccuuuuuuucc

SEQ ID NO: 540020 - RNA, 64 nt, Homo Sapiens
uacaaaaaccccacaagugugaaaaacauggcaaagccuuuaagaagcccucaauucuuaacag

SEQ ID NO: 540021 - RNA, 64 nt, Homo Sapiens
gugagaaauccuagaaaucugaagagugagauaaagccuuuaaaugguugucacacuucauugu

SEQ ID NO: 540022 - RNA, 64 nt, Homo Sapiens
gagagaaaaccuacaaaugugaggaauguggcaaagccuuuagccugucccuccaauuuacugc

SEQ ID NO: 540023 - RNA, 64 nt, Homo Sapiens
gagaaaaaucuuacaaaugugaagaauguggcaaagccuuuauccaguccucaacuccuaguaa

SEQ ID NO: 540024 - RNA, 64 nt, Homo Sapiens
gagagaaacccuacaaaugugaagaaugugacaaagccuuuaaccaguccucaauuuuuacuaa

SEQ ID NO: 540025 - RNA, 64 nt, Homo Sapiens
gauugaaacccuacgaaugcaguauaugugggaaagccuuuagucauaggucgucccugcuuca

SEQ ID NO: 540026 - RNA, 64 nt, Homo Sapiens
ggagagaaacccaauagugugguaaguguggaaaagccuuuagaucauaugaaucccuauacau

SEQ ID NO: 540027 - RNA, 64 nt, Homo Sapiens
gagagaaaccuuacaaguguaaugaguguggcaaagccuuuagugaccagucaacacuuaccau

SEQ ID NO: 540028 - RNA, 64 nt, Homo Sapiens
gagagaaaugucacaagugugaugaguguugcaaagccuuuacuucauguucacaccucauuag

SEQ ID NO: 540029 - RNA, 64 nt, Homo Sapiens
uggcugucacacuugauugugaagaaugugacaaagccuuuaaaaugagaaauccuagaaaugu

SEQ ID NO: 540030 - RNA, 64 nt, Homo Sapiens
caguccuuaaggcuuacuacguggaauguggcaaagccuuuaacgagggaauuccuauaauugu

SEQ ID NO: 540031 - RNA, 64 nt, Homo Sapiens
uuaggucuacagcucucaugagucucccgcacucagccuuuagcaauucauuaaaaauucuugu

SEQ ID NO: 540032 - RNA, 64 nt, Homo Sapiens
ugagugaacuuugaagcauauccucccccaguuuagccuuuagaugaggaccacagccaaauag

SEQ ID NO: 540033 - RNA, 64 nt, Homo Sapiens
aagugaugucggcugcuagcuuccuucagaugacugaugucauaaguguauguaagacuuuuau

SEQ ID NO: 540034 - RNA, 64 nt, Homo Sapiens
cuacuccuguuggcuaucaguacggucaaggaucugaugucacauccaaaagcuuuccagguac

SEQ ID NO: 540035 - RNA, 64 nt, Homo Sapiens
guccccucucuuaggugcucguguuguuugucuuugaugucaugggccuaaguauauguugugu

SEQ ID NO: 540036 - RNA, 64 nt, Homo Sapiens
uagcacuaagaaguuauuguuaucaaauucaaucugaugucaaaaagaaaugaggugauccuau

SEQ ID NO: 540037 - RNA, 64 nt, Homo Sapiens
uuuuauagucuuuuuaaauauuuuuuaucucucuugaugucagauuaaaucuuaugggucuuuu

SEQ ID NO: 540038 - RNA, 64 nt, Homo Sapiens
uaaaaaaaagauuguuuuguugcaccuugguuguugaugucaagcagcaacuucguguuuauac

SEQ ID NO: 540039 - RNA, 64 nt, Homo Sapiens
gucuucuggauucuuugugggguuaauuuugauuugaugucaucuguuugcccuucaucuugcu

SEQ ID NO: 540040 - RNA, 64 nt, Homo Sapiens
uaaagauggaaaggugggaaaauucuuugauauuugaugucauuguauccacauuuguuguaag

SEQ ID NO: 540041 - RNA, 64 nt, Homo Sapiens
agacaccauccaaggauggguucaugcacggaacugaugucauucacccaggugaggugcugug

SEQ ID NO: 540042 - RNA, 64 nt, Homo Sapiens
uuauuccccucccaaaacaucagaauucugacagugaugucauuacacacgcgagccaucuugc

SEQ ID NO: 540043 - RNA, 64 nt, Homo Sapiens
aacuuuuccagauguaucgaauuuaauuugacauugaugucacucuucauaccaagugaaucua

SEQ ID NO: 540044 - RNA, 64 nt, Homo Sapiens
aguuaaacaaggguaccacaauaucauuuauaauugaugucaauauuaguaguccacuuuaugc

SEQ ID NO: 540045 - RNA, 64 nt, Homo Sapiens
aacauuuuuggugagugcugcuuuuauaaauaugugaugucacauauuucagugacagcugaug

SEQ ID NO: 540046 - RNA, 64 nt, Homo Sapiens
ugccuuuacaugccagaggcugaugcugcacuguugaugucaugugaggaaauaaugcacaugc

SEQ ID NO: 540047 - RNA, 64 nt, Homo Sapiens
uguuuaaaucgugcccucagacaaauaaagcuucugaugucaaauccuuaucugugugagguuu

SEQ ID NO: 540048 - RNA, 64 nt, Homo Sapiens
guuauaaauggcacagugcaagagccuugggaggugaugucagguuuaaaauaaaucuuccuug

SEQ ID NO: 540049 - RNA, 64 nt, Homo Sapiens; identical to SEQ ID NO: 223465

SEQ ID NO: 540050 - RNA, 64 nt, Homo Sapiens; identical to SEQ ID NO: 223466

SEQ ID NO: 540051 - RNA, 64 nt, Homo Sapiens; identical to SEQ ID NO: 223467

SEQ ID NO: 540052 - RNA, 64 nt, Homo Sapiens; identical to SEQ ID NO: 223468

SEQ ID NO: 540053 - RNA, 64 nt, Homo Sapiens; identical to SEQ ID NO: 223469

SEQ ID NO: 540054 - RNA, 64 nt, Homo Sapiens; identical to SEQ ID NO: 223470

SEQ ID NO: 540055 - RNA, 64 nt, Homo Sapiens; identical to SEQ ID NO: 223471

SEQ ID NO: 540056 - RNA, 64 nt, Homo Sapiens; identical to SEQ ID NO: 223472

SEQ ID NO: 540057 - RNA, 64 nt, Homo Sapiens; identical to SEQ ID NO: 223473

SEQ ID NO: 540058 - RNA, 64 nt, Homo Sapiens; identical to SEQ ID NO: 223474

SEQ ID NO: 540059 - RNA, 64 nt, Homo Sapiens; identical to SEQ ID NO: 223475

SEQ ID NO: 540060 - RNA, 64 nt, Homo Sapiens; identical to SEQ ID NO: 223476

SEQ ID NO: 540061 - RNA, 64 nt, Homo Sapiens; identical to SEQ ID NO: 223477

SEQ ID NO: 540062 - RNA, 64 nt, Homo Sapiens; identical to SEQ ID NO: 223478

SEQ ID NO: 540063 - RNA, 64 nt, Homo Sapiens; identical to SEQ ID NO: 223479

SEQ ID NO: 540064 - RNA, 64 nt, Homo Sapiens; identical to SEQ ID NO: 223480

SEQ ID NO: 540065 - RNA, 64 nt, Homo Sapiens; identical to SEQ ID NO: 223481

SEQ ID NO: 540066 - RNA, 64 nt, Homo Sapiens; identical to SEQ ID NO: 223482

SEQ ID NO: 540067 - RNA, 64 nt, Homo Sapiens; identical to SEQ ID NO: 223483

SEQ ID NO: 540068 - RNA, 64 nt, Homo Sapiens; identical to SEQ ID NO: 223484

SEQ ID NO: 540069 - RNA, 64 nt, Homo Sapiens; identical to SEQ ID NO: 223485

SEQ ID NO: 540070 - RNA, 64 nt, Homo Sapiens; identical to SEQ ID NO: 223486

SEQ ID NO: 540071 - RNA, 64 nt, Homo Sapiens; identical to SEQ ID NO: 223487

SEQ ID NO: 540072 - RNA, 64 nt, Homo Sapiens; identical to SEQ ID NO: 223488

SEQ ID NO: 540073 - RNA, 64 nt, Homo Sapiens; identical to SEQ ID NO: 223489

SEQ ID NO: 540074 - RNA, 64 nt, Homo Sapiens; identical to SEQ ID NO: 223490

SEQ ID NO: 540075 - RNA, 64 nt, Homo Sapiens; identical to SEQ ID NO: 223491

SEQ ID NO: 540076 - RNA, 64 nt, Homo Sapiens; identical to SEQ ID NO: 223492

SEQ ID NO: 540077 - RNA, 64 nt, Homo Sapiens; identical to SEQ ID NO: 223493

SEQ ID NO: 540078 - RNA, 64 nt, Homo Sapiens; identical to SEQ ID NO: 223494

SEQ ID NO: 540079 - RNA, 64 nt, Homo Sapiens; identical to SEQ ID NO: 223495

SEQ ID NO: 540080 - RNA, 64 nt, Homo Sapiens; identical to SEQ ID NO: 223496

SEQ ID NO: 540081 - RNA, 64 nt, Homo Sapiens; identical to SEQ ID NO: 223497

SEQ ID NO: 540082 - RNA, 64 nt, Homo Sapiens; identical to SEQ ID NO: 223498

SEQ ID NO: 540083 - RNA, 64 nt, Homo Sapiens; identical to SEQ ID NO: 223499

SEQ ID NO: 540084 - RNA, 64 nt, Homo Sapiens; identical to SEQ ID NO: 223500

SEQ ID NO: 540085 - RNA, 64 nt, Homo Sapiens; identical to SEQ ID NO: 223501

SEQ ID NO: 540086 - RNA, 64 nt, Homo Sapiens; identical to SEQ ID NO: 223502

SEQ ID NO: 540087 - RNA, 64 nt, Homo Sapiens; identical to SEQ ID NO: 223503

SEQ ID NO: 540088 - RNA, 64 nt, Homo Sapiens; identical to SEQ ID NO: 223504

SEQ ID NO: 540089 - RNA, 64 nt, Homo Sapiens; identical to SEQ ID NO: 223505

SEQ ID NO: 540090 - RNA, 64 nt, Homo Sapiens; identical to SEQ ID NO: 223506

SEQ ID NO: 540091 - RNA, 64 nt, Homo Sapiens; identical to SEQ ID NO: 223507

SEQ ID NO: 540092 - RNA, 64 nt, Homo Sapiens; identical to SEQ ID NO: 223508

SEQ ID NO: 540093 - RNA, 64 nt, Homo Sapiens; identical to SEQ ID NO: 223509

SEQ ID NO: 540094 - RNA, 64 nt, Homo Sapiens; identical to SEQ ID NO: 223510

SEQ ID NO: 540095 - RNA, 64 nt, Homo Sapiens; identical to SEQ ID NO: 223511

SEQ ID NO: 540096 - RNA, 64 nt, Homo Sapiens; identical to SEQ ID NO: 223512

SEQ ID NO: 540097 - RNA, 64 nt, Homo Sapiens; identical to SEQ ID NO: 223513

SEQ ID NO: 540098 - RNA, 64 nt, Homo Sapiens; identical to SEQ ID NO: 223514

SEQ ID NO: 540099 - RNA, 64 nt, Homo Sapiens; identical to SEQ ID NO: 223515

SEQ ID NO: 540100 - RNA, 64 nt, Homo Sapiens; identical to SEQ ID NO: 223516

SEQ ID NO: 540101 - RNA, 64 nt, Homo Sapiens; identical to SEQ ID NO: 223517

SEQ ID NO: 540102 - RNA, 64 nt, Homo Sapiens; identical to SEQ ID NO: 223518

SEQ ID NO: 540103 - RNA, 64 nt, Homo Sapiens; identical to SEQ ID NO: 223519

SEQ ID NO: 540104 - RNA, 64 nt, Homo Sapiens; identical to SEQ ID NO: 223520

SEQ ID NO: 540105 - RNA, 64 nt, Homo Sapiens; identical to SEQ ID NO: 223521

SEQ ID NO: 540106 - RNA, 64 nt, Homo Sapiens; identical to SEQ ID NO: 223522

SEQ ID NO: 540107 - RNA, 64 nt, Homo Sapiens; identical to SEQ ID NO: 223523

SEQ ID NO: 540108 - RNA, 64 nt, Homo Sapiens; identical to SEQ ID NO: 223524

SEQ ID NO: 540109 - RNA, 64 nt, Homo Sapiens; identical to SEQ ID NO: 223525

SEQ ID NO: 540110 - RNA, 64 nt, Homo Sapiens; identical to SEQ ID NO: 223526

SEQ ID NO: 540111 - RNA, 64 nt, Homo Sapiens; identical to SEQ ID NO: 223527

SEQ ID NO: 540112 - RNA, 64 nt, Homo Sapiens; identical to SEQ ID NO: 223528

SEQ ID NO: 540113 - RNA, 64 nt, Homo Sapiens; identical to SEQ ID NO: 223529

SEQ ID NO: 540114 - RNA, 64 nt, Homo Sapiens; identical to SEQ ID NO: 223530

SEQ ID NO: 540115 - RNA, 64 nt, Homo Sapiens; identical to SEQ ID NO: 223531

SEQ ID NO: 540116 - RNA, 64 nt, Homo Sapiens; identical to SEQ ID NO: 223532

SEQ ID NO: 540117 - RNA, 64 nt, Homo Sapiens; identical to SEQ ID NO: 223533

SEQ ID NO: 540118 - RNA, 64 nt, Homo Sapiens; identical to SEQ ID NO: 223534

SEQ ID NO: 540119 - RNA, 64 nt, Homo Sapiens; identical to SEQ ID NO: 223535

SEQ ID NO: 540120 - RNA, 64 nt, Homo Sapiens; identical to SEQ ID NO: 223536

SEQ ID NO: 540121 - RNA, 64 nt, Homo Sapiens; identical to SEQ ID NO: 223537

SEQ ID NO: 540122 - RNA, 64 nt, Homo Sapiens; identical to SEQ ID NO: 223538

SEQ ID NO: 540123 - RNA, 64 nt, Homo Sapiens; identical to SEQ ID NO: 223539

SEQ ID NO: 540124 - RNA, 64 nt, Homo Sapiens; identical to SEQ ID NO: 223540

SEQ ID NO: 540125 - RNA, 64 nt, Homo Sapiens; identical to SEQ ID NO: 223541

SEQ ID NO: 540126 - RNA, 64 nt, Homo Sapiens; identical to SEQ ID NO: 223542

SEQ ID NO: 540127 - RNA, 64 nt, Homo Sapiens; identical to SEQ ID NO: 223543

SEQ ID NO: 540128 - RNA, 64 nt, Homo Sapiens; identical to SEQ ID NO: 223544

SEQ ID NO: 540129 - RNA, 64 nt, Homo Sapiens; identical to SEQ ID NO: 223545

SEQ ID NO: 540130 - RNA, 64 nt, Homo Sapiens; identical to SEQ ID NO: 223546

SEQ ID NO: 540131 - RNA, 64 nt, Homo Sapiens; identical to SEQ ID NO: 223547

SEQ ID NO: 540132 - RNA, 64 nt, Homo Sapiens; identical to SEQ ID NO: 223548

SEQ ID NO: 540133 - RNA, 64 nt, Homo Sapiens; identical to SEQ ID NO: 223549

SEQ ID NO: 540134 - RNA, 64 nt, Homo Sapiens; identical to SEQ ID NO: 223550

SEQ ID NO: 540135 - RNA, 64 nt, Homo Sapiens; identical to SEQ ID NO: 223551

SEQ ID NO: 540136 - RNA, 64 nt, Homo Sapiens; identical to SEQ ID NO: 223552

SEQ ID NO: 540137 - RNA, 64 nt, Homo Sapiens; identical to SEQ ID NO: 223553

SEQ ID NO: 540138 - RNA, 64 nt, Homo Sapiens; identical to SEQ ID NO: 223554

SEQ ID NO: 540139 - RNA, 64 nt, Homo Sapiens; identical to SEQ ID NO: 223555

SEQ ID NO: 540140 - RNA, 64 nt, Homo Sapiens; identical to SEQ ID NO: 223556

SEQ ID NO: 540141 - RNA, 64 nt, Homo Sapiens; identical to SEQ ID NO: 223557

SEQ ID NO: 540142 - RNA, 64 nt, Homo Sapiens; identical to SEQ ID NO: 223558

SEQ ID NO: 540143 - RNA, 64 nt, Homo Sapiens; identical to SEQ ID NO: 223559

SEQ ID NO: 540144 - RNA, 64 nt, Homo Sapiens; identical to SEQ ID NO: 223560

SEQ ID NO: 540145 - RNA, 64 nt, Homo Sapiens; identical to SEQ ID NO: 223561

SEQ ID NO: 540146 - RNA, 64 nt, Homo Sapiens; identical to SEQ ID NO: 223562

SEQ ID NO: 540147 - RNA, 64 nt, Homo Sapiens; identical to SEQ ID NO: 223563

SEQ ID NO: 540148 - RNA, 64 nt, Homo Sapiens; identical to SEQ ID NO: 223564

SEQ ID NO: 540149 - RNA, 64 nt, Homo Sapiens; identical to SEQ ID NO: 223565

SEQ ID NO: 540150 - RNA, 64 nt, Homo Sapiens; identical to SEQ ID NO: 223566

SEQ ID NO: 540151 - RNA, 64 nt, Homo Sapiens; identical to SEQ ID NO: 223567

SEQ ID NO: 540152 - RNA, 64 nt, Homo Sapiens; identical to SEQ ID NO: 223568

SEQ ID NO: 540153 - RNA, 64 nt, Homo Sapiens; identical to SEQ ID NO: 223569

SEQ ID NO: 540154 - RNA, 64 nt, Homo Sapiens; identical to SEQ ID NO: 223570

SEQ ID NO: 540155 - RNA, 64 nt, Homo Sapiens; identical to SEQ ID NO: 223571

SEQ ID NO: 540156 - RNA, 64 nt, Homo Sapiens; identical to SEQ ID NO: 95526

SEQ ID NO: 540157 - RNA, 64 nt, Homo Sapiens; identical to SEQ ID NO: 95527

SEQ ID NO: 540158 - RNA, 64 nt, Homo Sapiens; identical to SEQ ID NO: 95528

SEQ ID NO: 540159 - RNA, 64 nt, Homo Sapiens; identical to SEQ ID NO: 95529

SEQ ID NO: 540160 - RNA, 64 nt, Homo Sapiens; identical to SEQ ID NO: 95530

SEQ ID NO: 540161 - RNA, 64 nt, Homo Sapiens; identical to SEQ ID NO: 95531

SEQ ID NO: 540162 - RNA, 64 nt, Homo Sapiens; identical to SEQ ID NO: 95532

SEQ ID NO: 540163 - RNA, 64 nt, Homo Sapiens; identical to SEQ ID NO: 95533

SEQ ID NO: 540164 - RNA, 64 nt, Homo Sapiens; identical to SEQ ID NO: 95534

SEQ ID NO: 540165 - RNA, 64 nt, Homo Sapiens; identical to SEQ ID NO: 95535

SEQ ID NO: 540166 - RNA, 64 nt, Homo Sapiens; identical to SEQ ID NO: 95536

SEQ ID NO: 540167 - RNA, 64 nt, Homo Sapiens; identical to SEQ ID NO: 95537

SEQ ID NO: 540168 - RNA, 64 nt, Homo Sapiens; identical to SEQ ID NO: 95538

SEQ ID NO: 540169 - RNA, 64 nt, Homo Sapiens; identical to SEQ ID NO: 95539

SEQ ID NO: 540170 - RNA, 64 nt, Homo Sapiens; identical to SEQ ID NO: 95540

SEQ ID NO: 540171 - RNA, 64 nt, Homo Sapiens; identical to SEQ ID NO: 95541

SEQ ID NO: 540172 - RNA, 64 nt, Homo Sapiens; identical to SEQ ID NO: 95542

SEQ ID NO: 540173 - RNA, 64 nt, Homo Sapiens; identical to SEQ ID NO: 95543

SEQ ID NO: 540174 - RNA, 64 nt, Homo Sapiens; identical to SEQ ID NO: 95544

SEQ ID NO: 540175 - RNA, 64 nt, Homo Sapiens; identical to SEQ ID NO: 95545

SEQ ID NO: 540176 - RNA, 50 nt, Homo Sapiens; identical to SEQ ID NO: 95546

SEQ ID NO: 540177 - RNA, 64 nt, Homo Sapiens; identical to SEQ ID NO: 95547

SEQ ID NO: 540178 - RNA, 64 nt, Homo Sapiens; identical to SEQ ID NO: 95548

SEQ ID NO: 540179 - RNA, 64 nt, Homo Sapiens; identical to SEQ ID NO: 95549

SEQ ID NO: 540180 - RNA, 64 nt, Homo Sapiens; identical to SEQ ID NO: 95550

SEQ ID NO: 540181 - RNA, 64 nt, Homo Sapiens; identical to SEQ ID NO: 95551

SEQ ID NO: 540182 - RNA, 64 nt, Homo Sapiens; identical to SEQ ID NO: 95552

SEQ ID NO: 540183 - RNA, 64 nt, Homo Sapiens; identical to SEQ ID NO: 95553

SEQ ID NO: 540184 - RNA, 64 nt, Homo Sapiens; identical to SEQ ID NO: 95554

SEQ ID NO: 540185 - RNA, 64 nt, Homo Sapiens; identical to SEQ ID NO: 95555

SEQ ID NO: 540186 - RNA, 64 nt, Homo Sapiens; identical to SEQ ID NO: 95556

SEQ ID NO: 540187 - RNA, 64 nt, Homo Sapiens; identical to SEQ ID NO: 95557

SEQ ID NO: 540188 - RNA, 64 nt, Homo Sapiens; identical to SEQ ID NO: 95558

SEQ ID NO: 540189 - RNA, 64 nt, Homo Sapiens; identical to SEQ ID NO: 95559

SEQ ID NO: 540190 - RNA, 64 nt, Homo Sapiens; identical to SEQ ID NO: 95560

SEQ ID NO: 540191 - RNA, 64 nt, Homo Sapiens; identical to SEQ ID NO: 95561

SEQ ID NO: 540192 - RNA, 64 nt, Homo Sapiens; identical to SEQ ID NO: 95562

SEQ ID NO: 540193 - RNA, 64 nt, Homo Sapiens; identical to SEQ ID NO: 95563

SEQ ID NO: 540194 - RNA, 64 nt, Homo Sapiens; identical to SEQ ID NO: 95564

SEQ ID NO: 540195 - RNA, 64 nt, Homo Sapiens; identical to SEQ ID NO: 95565

SEQ ID NO: 540196 - RNA, 64 nt, Homo Sapiens; identical to SEQ ID NO: 95566

SEQ ID NO: 540197 - RNA, 64 nt, Homo Sapiens; identical to SEQ ID NO: 95567

SEQ ID NO: 540198 - RNA, 64 nt, Homo Sapiens; identical to SEQ ID NO: 95568

SEQ ID NO: 540199 - RNA, 64 nt, Homo Sapiens; identical to SEQ ID NO: 95569

SEQ ID NO: 540200 - RNA, 64 nt, Homo Sapiens; identical to SEQ ID NO: 95570

SEQ ID NO: 540201 - RNA, 64 nt, Homo Sapiens; identical to SEQ ID NO: 95571

SEQ ID NO: 540202 - RNA, 64 nt, Homo Sapiens; identical to SEQ ID NO: 95572

SEQ ID NO: 540203 - RNA, 64 nt, Homo Sapiens; identical to SEQ ID NO: 95573

SEQ ID NO: 540204 - RNA, 64 nt, Homo Sapiens; identical to SEQ ID NO: 95574

SEQ ID NO: 540205 - RNA, 64 nt, Homo Sapiens; identical to SEQ ID NO: 95575

SEQ ID NO: 540206 - RNA, 64 nt, Homo Sapiens; identical to SEQ ID NO: 95576

SEQ ID NO: 540207 - RNA, 64 nt, Homo Sapiens; identical to SEQ ID NO: 95577

SEQ ID NO: 540208 - RNA, 64 nt, Homo Sapiens; identical to SEQ ID NO: 95578

SEQ ID NO: 540209 - RNA, 64 nt, Homo Sapiens; identical to SEQ ID NO: 95579

SEQ ID NO: 540210 - RNA, 64 nt, Homo Sapiens; identical to SEQ ID NO: 95580

SEQ ID NO: 540211 - RNA, 64 nt, Homo Sapiens; identical to SEQ ID NO: 95581

SEQ ID NO: 540212 - RNA, 64 nt, Homo Sapiens; identical to SEQ ID NO: 95582

SEQ ID NO: 540213 - RNA, 64 nt, Homo Sapiens; identical to SEQ ID NO: 95583

SEQ ID NO: 540214 - RNA, 64 nt, Homo Sapiens; identical to SEQ ID NO: 95584

SEQ ID NO: 540215 - RNA, 64 nt, Homo Sapiens; identical to SEQ ID NO: 95585

SEQ ID NO: 540216 - RNA, 64 nt, Homo Sapiens; identical to SEQ ID NO: 95586

SEQ ID NO: 540217 - RNA, 64 nt, Homo Sapiens; identical to SEQ ID NO: 95587

SEQ ID NO: 540218 - RNA, 64 nt, Homo Sapiens; identical to SEQ ID NO: 95588

SEQ ID NO: 540219 - RNA, 64 nt, Homo Sapiens; identical to SEQ ID NO: 95589

SEQ ID NO: 540220 - RNA, 64 nt, Homo Sapiens; identical to SEQ ID NO: 95590

SEQ ID NO: 540221 - RNA, 64 nt, Homo Sapiens; identical to SEQ ID NO: 95591

SEQ ID NO: 540222 - RNA, 64 nt, Homo Sapiens; identical to SEQ ID NO: 95592

SEQ ID NO: 540223 - RNA, 64 nt, Homo Sapiens; identical to SEQ ID NO: 95593

SEQ ID NO: 540224 - RNA, 64 nt, Homo Sapiens; identical to SEQ ID NO: 95594

SEQ ID NO: 540225 - RNA, 64 nt, Homo Sapiens; identical to SEQ ID NO: 95595

SEQ ID NO: 540226 - RNA, 64 nt, Homo Sapiens; identical to SEQ ID NO: 84377

SEQ ID NO: 540227 - RNA, 64 nt, Homo Sapiens; identical to SEQ ID NO: 84378

SEQ ID NO: 540228 - RNA, 64 nt, Homo Sapiens; identical to SEQ ID NO: 84379

SEQ ID NO: 540229 - RNA, 64 nt, Homo Sapiens; identical to SEQ ID NO: 84380

SEQ ID NO: 540230 - RNA, 64 nt, Homo Sapiens; identical to SEQ ID NO: 84381

SEQ ID NO: 540231 - RNA, 64 nt, Homo Sapiens; identical to SEQ ID NO: 84382

SEQ ID NO: 540232 - RNA, 64 nt, Homo Sapiens; identical to SEQ ID NO: 84383

SEQ ID NO: 540233 - RNA, 64 nt, Homo Sapiens; identical to SEQ ID NO: 84384

SEQ ID NO: 540234 - RNA, 64 nt, Homo Sapiens; identical to SEQ ID NO: 84385

SEQ ID NO: 540235 - RNA, 64 nt, Homo Sapiens; identical to SEQ ID NO: 84386

SEQ ID NO: 540236 - RNA, 64 nt, Homo Sapiens; identical to SEQ ID NO: 84387

SEQ ID NO: 540237 - RNA, 64 nt, Homo Sapiens; identical to SEQ ID NO: 84388

SEQ ID NO: 540238 - RNA, 64 nt, Homo Sapiens; identical to SEQ ID NO: 84389

SEQ ID NO: 540239 - RNA, 64 nt, Homo Sapiens; identical to SEQ ID NO: 84390

SEQ ID NO: 540240 - RNA, 64 nt, Homo Sapiens; identical to SEQ ID NO: 84391

SEQ ID NO: 540241 - RNA, 64 nt, Homo Sapiens; identical to SEQ ID NO: 84392

SEQ ID NO: 540242 - RNA, 64 nt, Homo Sapiens; identical to SEQ ID NO: 84393

SEQ ID NO: 540243 - RNA, 64 nt, Homo Sapiens; identical to SEQ ID NO: 84394

SEQ ID NO: 540244 - RNA, 64 nt, Homo Sapiens; identical to SEQ ID NO: 84395

SEQ ID NO: 540245 - RNA, 64 nt, Homo Sapiens; identical to SEQ ID NO: 84396

SEQ ID NO: 540246 - RNA, 64 nt, Homo Sapiens; identical to SEQ ID NO: 84397

SEQ ID NO: 540247 - RNA, 64 nt, Homo Sapiens; identical to SEQ ID NO: 84398

SEQ ID NO: 540248 - RNA, 64 nt, Homo Sapiens; identical to SEQ ID NO: 84399

SEQ ID NO: 540249 - RNA, 64 nt, Homo Sapiens; identical to SEQ ID NO: 84400

SEQ ID NO: 540250 - RNA, 64 nt, Homo Sapiens; identical to SEQ ID NO: 84401

SEQ ID NO: 540251 - RNA, 64 nt, Homo Sapiens; identical to SEQ ID NO: 84402

SEQ ID NO: 540252 - RNA, 64 nt, Homo Sapiens; identical to SEQ ID NO: 84403

SEQ ID NO: 540253 - RNA, 64 nt, Homo Sapiens; identical to SEQ ID NO: 84404

SEQ ID NO: 540254 - RNA, 64 nt, Homo Sapiens; identical to SEQ ID NO: 84405

SEQ ID NO: 540255 - RNA, 64 nt, Homo Sapiens; identical to SEQ ID NO: 84406

SEQ ID NO: 540256 - RNA, 64 nt, Homo Sapiens; identical to SEQ ID NO: 84407

SEQ ID NO: 540257 - RNA, 64 nt, Homo Sapiens; identical to SEQ ID NO: 84408

SEQ ID NO: 540258 - RNA, 64 nt, Homo Sapiens; identical to SEQ ID NO: 84409

SEQ ID NO: 540259 - RNA, 64 nt, Homo Sapiens; identical to SEQ ID NO: 84410

SEQ ID NO: 540260 - RNA, 64 nt, Homo Sapiens; identical to SEQ ID NO: 84411

SEQ ID NO: 540261 - RNA, 64 nt, Homo Sapiens; identical to SEQ ID NO: 84412

SEQ ID NO: 540262 - RNA, 64 nt, Homo Sapiens; identical to SEQ ID NO: 84413

SEQ ID NO: 540263 - RNA, 64 nt, Homo Sapiens; identical to SEQ ID NO: 84414

SEQ ID NO: 540264 - RNA, 64 nt, Homo Sapiens; identical to SEQ ID NO: 84415

SEQ ID NO: 540265 - RNA, 64 nt, Homo Sapiens; identical to SEQ ID NO: 84416

SEQ ID NO: 540266 - RNA, 64 nt, Homo Sapiens; identical to SEQ ID NO: 84417

SEQ ID NO: 540267 - RNA, 64 nt, Homo Sapiens; identical to SEQ ID NO: 84418

SEQ ID NO: 540268 - RNA, 64 nt, Homo Sapiens; identical to SEQ ID NO: 84419

SEQ ID NO: 540269 - RNA, 64 nt, Homo Sapiens; identical to SEQ ID NO: 84420

SEQ ID NO: 540270 - RNA, 64 nt, Homo Sapiens; identical to SEQ ID NO: 349054

SEQ ID NO: 540271 - RNA, 64 nt, Homo Sapiens; identical to SEQ ID NO: 349055

SEQ ID NO: 540272 - RNA, 64 nt, Homo Sapiens; identical to SEQ ID NO: 349056

SEQ ID NO: 540273 - RNA, 64 nt, Homo Sapiens; identical to SEQ ID NO: 349057

SEQ ID NO: 540274 - RNA, 64 nt, Homo Sapiens; identical to SEQ ID NO: 349058

SEQ ID NO: 540275 - RNA, 64 nt, Homo Sapiens; identical to SEQ ID NO: 349059

SEQ ID NO: 540276 - RNA, 64 nt, Homo Sapiens; identical to SEQ ID NO: 349060

SEQ ID NO: 540277 - RNA, 64 nt, Homo Sapiens; identical to SEQ ID NO: 349061

SEQ ID NO: 540278 - RNA, 64 nt, Homo Sapiens; identical to SEQ ID NO: 349062

SEQ ID NO: 540279 - RNA, 64 nt, Homo Sapiens; identical to SEQ ID NO: 349063

SEQ ID NO: 540280 - RNA, 64 nt, Homo Sapiens; identical to SEQ ID NO: 349064

SEQ ID NO: 540281 - RNA, 64 nt, Homo Sapiens; identical to SEQ ID NO: 349065

SEQ ID NO: 540282 - RNA, 64 nt, Homo Sapiens; identical to SEQ ID NO: 349066

SEQ ID NO: 540283 - RNA, 64 nt, Homo Sapiens; identical to SEQ ID NO: 349067

SEQ ID NO: 540284 - RNA, 64 nt, Homo Sapiens; identical to SEQ ID NO: 349068

SEQ ID NO: 540285 - RNA, 64 nt, Homo Sapiens; identical to SEQ ID NO: 349069

SEQ ID NO: 540286 - RNA, 65 nt, Homo Sapiens
uguauugaauucuuuuuagaguaguuuuauguacuguuaaagaauugccauuuucuuuugcaauu

SEQ ID NO: 540287 - RNA, 65 nt, Homo Sapiens
uguacugaauucuuuuuagauuaguuuuauguacuguuaaagaauuuucauuuucuuuugcaauu

SEQ ID NO: 540288 - RNA, 65 nt, Homo Sapiens
gauuucuuuaauaaguuuuuggcauuuuauuuuaaguuaaagacagaauuagauaacuaauugga

SEQ ID NO: 540289 - RNA, 65 nt, Homo Sapiens
gaguuuuguuagaggcaucucagccucaaaaucauguuaaagagguuuuuucuagaaacuggggg

SEQ ID NO: 540290 - RNA, 65 nt, Homo Sapiens
guuucacacaccacuuaauggggaaauaguuaauuguuaaagaaaacuucuuguagccucacauu

SEQ ID NO: 540291 - RNA, 65 nt, Homo Sapiens
gccugcaucacaauugagguaauguagagcaacauguuaaagaaugaugguuagcagaagcuguu

SEQ ID NO: 540292 - RNA, 65 nt, Homo Sapiens
gcguugguaacuuugcucugccuguagccaaucagguuaaagaguagucaaucagugacuagcuu

SEQ ID NO: 540293 - RNA, 65 nt, Homo Sapiens
aggauugaagucacugaccaaugaacuguuaaaguguuaaagauuugucugcaauguuaucauuc

SEQ ID NO: 540294 - RNA, 65 nt, Homo Sapiens
ucuuuccauauuguacuuuaaauaaagaccacacgguuaaagaaaaucuguaacacuggcacuga

SEQ ID NO: 540295 - RNA, 65 nt, Homo Sapiens
aauguccucuccuccacuguugaccuugaagcauuguuaaagacugauuuuccuaaaguuacugc

SEQ ID NO: 540296 - RNA, 65 nt, Homo Sapiens; identical to SEQ ID NO: 65698

SEQ ID NO: 540297 - RNA, 65 nt, Homo Sapiens; identical to SEQ ID NO: 65699

SEQ ID NO: 540298 - RNA, 65 nt, Homo Sapiens; identical to SEQ ID NO: 65706

SEQ ID NO: 540299 - RNA, 65 nt, Homo Sapiens; identical to SEQ ID NO: 65707

SEQ ID NO: 540300 - RNA, 65 nt, Homo Sapiens; identical to SEQ ID NO: 65720

SEQ ID NO: 540301 - RNA, 65 nt, Homo Sapiens; identical to SEQ ID NO: 65721

SEQ ID NO: 540302 - RNA, 65 nt, Homo Sapiens; identical to SEQ ID NO: 65744

SEQ ID NO: 540303 - RNA, 65 nt, Homo Sapiens; identical to SEQ ID NO: 65745

SEQ ID NO: 540304 - RNA, 65 nt, Homo Sapiens; identical to SEQ ID NO: 65788

SEQ ID NO: 540305 - RNA, 65 nt, Homo Sapiens; identical to SEQ ID NO: 65789

SEQ ID NO: 540306 - RNA, 65 nt, Homo Sapiens; identical to SEQ ID NO: 65808

SEQ ID NO: 540307 - RNA, 65 nt, Homo Sapiens; identical to SEQ ID NO: 65809

SEQ ID NO: 540308 - RNA, 65 nt, Homo Sapiens; identical to SEQ ID NO: 65810

SEQ ID NO: 540309 - RNA, 65 nt, Homo Sapiens; identical to SEQ ID NO: 65811

SEQ ID NO: 540310 - RNA, 65 nt, Homo Sapiens; identical to SEQ ID NO: 65827

SEQ ID NO: 540311 - RNA, 65 nt, Homo Sapiens; identical to SEQ ID NO: 65828

SEQ ID NO: 540312 - RNA, 65 nt, Homo Sapiens; identical to SEQ ID NO: 65831

SEQ ID NO: 540313 - RNA, 56 nt, Homo Sapiens; identical to SEQ ID NO: 61369

SEQ ID NO: 540314 - RNA, 65 nt, Homo Sapiens; identical to SEQ ID NO: 65853

SEQ ID NO: 540315 - RNA, 65 nt, Homo Sapiens; identical to SEQ ID NO: 65854

SEQ ID NO: 540316 - RNA, 65 nt, Homo Sapiens; identical to SEQ ID NO: 65891

SEQ ID NO: 540317 - RNA, 65 nt, Homo Sapiens; identical to SEQ ID NO: 65892

SEQ ID NO: 540318 - RNA, 65 nt, Homo Sapiens; identical to SEQ ID NO: 65896

SEQ ID NO: 540319 - RNA, 65 nt, Homo Sapiens; identical to SEQ ID NO: 65897

SEQ ID NO: 540320 - RNA, 64 nt, Homo Sapiens
uuuauuaggcuauuucaaaguuacuugcucugggcaaguggauaaguuccccuggccuaaauga

SEQ ID NO: 540321 - RNA, 64 nt, Homo Sapiens
cuuuucaguaacagugaaguacaacaggcuuugccaaguggaugcacaucaccugaaaaguaaa

SEQ ID NO: 540322 - RNA, 64 nt, Homo Sapiens
gccaacgccaacuggcaaccucuuuacucuuagucaaguggaaugugcaugcuggcaucugaau

SEQ ID NO: 540323 - RNA, 64 nt, Homo Sapiens
agguauguacugccugaggucacaugacagugaccaaguggagacaguaaguuagaucccuccc

SEQ ID NO: 540324 - RNA, 64 nt, Homo Sapiens
aaaaggaaagggccccagcccacaauuuuccccccaaguggaggauucuccugcaaguuggaag

SEQ ID NO: 540325 - RNA, 64 nt, Homo Sapiens
auggcccucccuggcucccugaagaccccgcagucaaguggagcgcagggcgggagggagauaa

SEQ ID NO: 540326 - RNA, 64 nt, Homo Sapiens
gugggggauucuguaucuggauuccguaucacuccaaguggaggcuggcagguuuuucugcaag

SEQ ID NO: 540327 - RNA, 64 nt, Homo Sapiens
uauccaucuauagugguagagacccaccagggcucaaguggaguccaucauccucccacggggg

SEQ ID NO: 540328 - RNA, 64 nt, Homo Sapiens
agccuuccaugaccuccccuccccagcccaaugccaaguggacuuggagcugcacaaagucagc

SEQ ID NO: 540329 - RNA, 64 nt, Homo Sapiens
cccuuuuccuuucuggccccagccuagguggaggcaaguggaauaucuuauauugggcgauuug

SEQ ID NO: 540330 - RNA, 62 nt, Homo Sapiens
ugacuuguagcuuccucugguuuucaaguaaacucaacaagguggagucuuaccugguuuuc

SEQ ID NO: 540331 - RNA, 62 nt, Homo Sapiens
cauauugucaugucaguucuugccaggaacuucucaacaaaauggaauuuuuuuuuucagua

SEQ ID NO: 540332 - RNA, 62 nt, Homo Sapiens
acuguuacuuuuauuuuauaaacugaugcuaucucaacaauaauuaucugaaaugaagaaua

SEQ ID NO: 540333 - RNA, 62 nt, Homo Sapiens
uugaagcugugaaauuaagugaagguuuuccccucaacaauuucauaacuuccuaaaacaug

SEQ ID NO: 540334 - RNA, 62 nt, Homo Sapiens
ccucgaagcucgguacugucacaguggagccucucaacaacgcugugaggcagcaccauuug

SEQ ID NO: 540335 - RNA, 62 nt, Homo Sapiens
accacaguaguauuagcagugccugggaccuccucaacaacagaaauugccgguauuuauag

SEQ ID NO: 540336 - RNA, 62 nt, Homo Sapiens
ucaguaacagggccuugcuaaucggguugucacucaacaaaagugcuuuggauuuaaguuac

SEQ ID NO: 540337 - RNA, 62 nt, Homo Sapiens
cucugcuucagcuugcuucauugggcuguuuucucaacaaauggaaugccauuugcacuuac

SEQ ID NO: 540338 - RNA, 62 nt, Homo Sapiens
auaaaauucaacaucccuucauuuuaaaaacccucaacaaauuacacauugagggaacauac

SEQ ID NO: 540339 - RNA, 62 nt, Homo Sapiens
aaauaaaggcauauaccuacaaccaugugauccucaacaaaacugacaagcaaugaaguaag

SEQ ID NO: 540340 - RNA, 62 nt, Homo Sapiens
uauguccuauaaauggaccaccaucagcccaucucaacaauauggcacauucuuaaauauuu

SEQ ID NO: 540341 - RNA, 62 nt, Homo Sapiens
ugaaugucccaacccagacaucccugaaacaucucaacaaccgcagucucccagauguugca

SEQ ID NO: 540342 - RNA, 62 nt, Homo Sapiens
ucuuuguguugcuuucaccacugugcugcucacucaacaacaccugugcgagacccccuguc

SEQ ID NO: 540343 - RNA, 62 nt, Homo Sapiens
gucucauaucuaacuuccucuuuucugccaggcucaacaaggcaaggaucagaaguauggaa

SEQ ID NO: 540344 - RNA, 64 nt, Homo Sapiens; identical to SEQ ID NO: 48305

SEQ ID NO: 540345 - RNA, 64 nt, Homo Sapiens; identical to SEQ ID NO: 48306

SEQ ID NO: 540346 - RNA, 64 nt, Homo Sapiens; identical to SEQ ID NO: 48307

SEQ ID NO: 540347 - RNA, 64 nt, Homo Sapiens; identical to SEQ ID NO: 48308

SEQ ID NO: 540348 - RNA, 64 nt, Homo Sapiens; identical to SEQ ID NO: 48309

SEQ ID NO: 540349 - RNA, 64 nt, Homo Sapiens; identical to SEQ ID NO: 48310

SEQ ID NO: 540350 - RNA, 64 nt, Homo Sapiens; identical to SEQ ID NO: 48311

SEQ ID NO: 540351 - RNA, 64 nt, Homo Sapiens; identical to SEQ ID NO: 48312

SEQ ID NO: 540352 - RNA, 64 nt, Homo Sapiens; identical to SEQ ID NO: 48313

SEQ ID NO: 540353 - RNA, 64 nt, Homo Sapiens; identical to SEQ ID NO: 48314

SEQ ID NO: 540354 - RNA, 64 nt, Homo Sapiens; identical to SEQ ID NO: 48315

SEQ ID NO: 540355 - RNA, 64 nt, Homo Sapiens; identical to SEQ ID NO: 48316

SEQ ID NO: 540356 - RNA, 64 nt, Homo Sapiens; identical to SEQ ID NO: 48317

SEQ ID NO: 540357 - RNA, 64 nt, Homo Sapiens; identical to SEQ ID NO: 48318

SEQ ID NO: 540358 - RNA, 64 nt, Homo Sapiens; identical to SEQ ID NO: 48319

SEQ ID NO: 540359 - RNA, 64 nt, Homo Sapiens; identical to SEQ ID NO: 48320

SEQ ID NO: 540360 - RNA, 64 nt, Homo Sapiens; identical to SEQ ID NO: 48321

SEQ ID NO: 540361 - RNA, 64 nt, Homo Sapiens; identical to SEQ ID NO: 48322

SEQ ID NO: 540362 - RNA, 64 nt, Homo Sapiens; identical to SEQ ID NO: 48323

SEQ ID NO: 540363 - RNA, 64 nt, Homo Sapiens; identical to SEQ ID NO: 48324

SEQ ID NO: 540364 - RNA, 64 nt, Homo Sapiens; identical to SEQ ID NO: 48325

SEQ ID NO: 540365 - RNA, 64 nt, Homo Sapiens; identical to SEQ ID NO: 48326

SEQ ID NO: 540366 - RNA, 64 nt, Homo Sapiens; identical to SEQ ID NO: 48327

SEQ ID NO: 540367 - RNA, 64 nt, Homo Sapiens; identical to SEQ ID NO: 48328

SEQ ID NO: 540368 - RNA, 64 nt, Homo Sapiens; identical to SEQ ID NO: 48329

SEQ ID NO: 540369 - RNA, 51 nt, Homo Sapiens; identical to SEQ ID NO: 48330

SEQ ID NO: 540370 - RNA, 64 nt, Homo Sapiens; identical to SEQ ID NO: 48331

SEQ ID NO: 540371 - RNA, 64 nt, Homo Sapiens; identical to SEQ ID NO: 48332

SEQ ID NO: 540372 - RNA, 64 nt, Homo Sapiens; identical to SEQ ID NO: 48333

SEQ ID NO: 540373 - RNA, 64 nt, Homo Sapiens; identical to SEQ ID NO: 48334

SEQ ID NO: 540374 - RNA, 64 nt, Homo Sapiens; identical to SEQ ID NO: 48335

SEQ ID NO: 540375 - RNA, 64 nt, Homo Sapiens; identical to SEQ ID NO: 48336

SEQ ID NO: 540376 - RNA, 64 nt, Homo Sapiens; identical to SEQ ID NO: 48337

SEQ ID NO: 540377 - RNA, 64 nt, Homo Sapiens; identical to SEQ ID NO: 48338

SEQ ID NO: 540378 - RNA, 64 nt, Homo Sapiens; identical to SEQ ID NO: 48339

SEQ ID NO: 540379 - RNA, 64 nt, Homo Sapiens; identical to SEQ ID NO: 48340

SEQ ID NO: 540380 - RNA, 64 nt, Homo Sapiens; identical to SEQ ID NO: 48341

SEQ ID NO: 540381 - RNA, 64 nt, Homo Sapiens; identical to SEQ ID NO: 48342

SEQ ID NO: 540382 - RNA, 64 nt, Homo Sapiens; identical to SEQ ID NO: 48343

SEQ ID NO: 540383 - RNA, 64 nt, Homo Sapiens; identical to SEQ ID NO: 48344

SEQ ID NO: 540384 - RNA, 64 nt, Homo Sapiens; identical to SEQ ID NO: 48345

SEQ ID NO: 540385 - RNA, 64 nt, Homo Sapiens; identical to SEQ ID NO: 48346

SEQ ID NO: 540386 - RNA, 64 nt, Homo Sapiens; identical to SEQ ID NO: 48347

SEQ ID NO: 540387 - RNA, 64 nt, Homo Sapiens; identical to SEQ ID NO: 48348

SEQ ID NO: 540388 - RNA, 64 nt, Homo Sapiens; identical to SEQ ID NO: 48349

SEQ ID NO: 540389 - RNA, 64 nt, Homo Sapiens; identical to SEQ ID NO: 48350

SEQ ID NO: 540390 - RNA, 64 nt, Homo Sapiens; identical to SEQ ID NO: 48351

SEQ ID NO: 540391 - RNA, 64 nt, Homo Sapiens; identical to SEQ ID NO: 48352

SEQ ID NO: 540392 - RNA, 64 nt, Homo Sapiens; identical to SEQ ID NO: 48353

SEQ ID NO: 540393 - RNA, 64 nt, Homo Sapiens; identical to SEQ ID NO: 48354

SEQ ID NO: 540394 - RNA, 64 nt, Homo Sapiens; identical to SEQ ID NO: 48355

SEQ ID NO: 540395 - RNA, 64 nt, Homo Sapiens; identical to SEQ ID NO: 259113

SEQ ID NO: 540396 - RNA, 64 nt, Homo Sapiens; identical to SEQ ID NO: 259114

SEQ ID NO: 540397 - RNA, 64 nt, Homo Sapiens; identical to SEQ ID NO: 259115

SEQ ID NO: 540398 - RNA, 64 nt, Homo Sapiens; identical to SEQ ID NO: 259116

SEQ ID NO: 540399 - RNA, 64 nt, Homo Sapiens; identical to SEQ ID NO: 259117

SEQ ID NO: 540400 - RNA, 64 nt, Homo Sapiens; identical to SEQ ID NO: 259118

SEQ ID NO: 540401 - RNA, 64 nt, Homo Sapiens; identical to SEQ ID NO: 259119

SEQ ID NO: 540402 - RNA, 64 nt, Homo Sapiens; identical to SEQ ID NO: 259120

SEQ ID NO: 540403 - RNA, 64 nt, Homo Sapiens; identical to SEQ ID NO: 259121

SEQ ID NO: 540404 - RNA, 64 nt, Homo Sapiens; identical to SEQ ID NO: 259122

SEQ ID NO: 540405 - RNA, 64 nt, Homo Sapiens; identical to SEQ ID NO: 259123

SEQ ID NO: 540406 - RNA, 64 nt, Homo Sapiens; identical to SEQ ID NO: 259124

SEQ ID NO: 540407 - RNA, 64 nt, Homo Sapiens; identical to SEQ ID NO: 259125

SEQ ID NO: 540408 - RNA, 64 nt, Homo Sapiens; identical to SEQ ID NO: 259126

SEQ ID NO: 540409 - RNA, 64 nt, Homo Sapiens; identical to SEQ ID NO: 259127

SEQ ID NO: 540410 - RNA, 64 nt, Homo Sapiens; identical to SEQ ID NO: 259128

SEQ ID NO: 540411 - RNA, 64 nt, Homo Sapiens; identical to SEQ ID NO: 259129

SEQ ID NO: 540412 - RNA, 64 nt, Homo Sapiens; identical to SEQ ID NO: 259130

SEQ ID NO: 540413 - RNA, 64 nt, Homo Sapiens; identical to SEQ ID NO: 259131

SEQ ID NO: 540414 - RNA, 64 nt, Homo Sapiens; identical to SEQ ID NO: 259132

SEQ ID NO: 540415 - RNA, 64 nt, Homo Sapiens; identical to SEQ ID NO: 259133

SEQ ID NO: 540416 - RNA, 64 nt, Homo Sapiens; identical to SEQ ID NO: 259134

SEQ ID NO: 540417 - RNA, 64 nt, Homo Sapiens; identical to SEQ ID NO: 259135

SEQ ID NO: 540418 - RNA, 64 nt, Homo Sapiens; identical to SEQ ID NO: 259136

SEQ ID NO: 540419 - RNA, 64 nt, Homo Sapiens; identical to SEQ ID NO: 259137

SEQ ID NO: 540420 - RNA, 64 nt, Homo Sapiens; identical to SEQ ID NO: 259138

SEQ ID NO: 540421 - RNA, 64 nt, Homo Sapiens; identical to SEQ ID NO: 259139

SEQ ID NO: 540422 - RNA, 64 nt, Homo Sapiens; identical to SEQ ID NO: 259140

SEQ ID NO: 540423 - RNA, 64 nt, Homo Sapiens; identical to SEQ ID NO: 259141

SEQ ID NO: 540424 - RNA, 64 nt, Homo Sapiens; identical to SEQ ID NO: 259142

SEQ ID NO: 540425 - RNA, 64 nt, Homo Sapiens; identical to SEQ ID NO: 259143

SEQ ID NO: 540426 - RNA, 64 nt, Homo Sapiens; identical to SEQ ID NO: 259144

SEQ ID NO: 540427 - RNA, 64 nt, Homo Sapiens; identical to SEQ ID NO: 259145

SEQ ID NO: 540428 - RNA, 64 nt, Homo Sapiens; identical to SEQ ID NO: 259146

SEQ ID NO: 540429 - RNA, 64 nt, Homo Sapiens; identical to SEQ ID NO: 259147

SEQ ID NO: 540430 - RNA, 64 nt, Homo Sapiens; identical to SEQ ID NO: 259148

SEQ ID NO: 540431 - RNA, 64 nt, Homo Sapiens; identical to SEQ ID NO: 259149

SEQ ID NO: 540432 - RNA, 64 nt, Homo Sapiens; identical to SEQ ID NO: 259150

SEQ ID NO: 540433 - RNA, 64 nt, Homo Sapiens; identical to SEQ ID NO: 259151

SEQ ID NO: 540434 - RNA, 64 nt, Homo Sapiens; identical to SEQ ID NO: 259152

SEQ ID NO: 540435 - RNA, 64 nt, Homo Sapiens; identical to SEQ ID NO: 259153

SEQ ID NO: 540436 - RNA, 64 nt, Homo Sapiens; identical to SEQ ID NO: 259154

SEQ ID NO: 540437 - RNA, 64 nt, Homo Sapiens; identical to SEQ ID NO: 259155

SEQ ID NO: 540438 - RNA, 64 nt, Homo Sapiens; identical to SEQ ID NO: 259156

SEQ ID NO: 540439 - RNA, 64 nt, Homo Sapiens; identical to SEQ ID NO: 259157

SEQ ID NO: 540440 - RNA, 64 nt, Homo Sapiens; identical to SEQ ID NO: 259158

SEQ ID NO: 540441 - RNA, 64 nt, Homo Sapiens; identical to SEQ ID NO: 259159

SEQ ID NO: 540442 - RNA, 64 nt, Homo Sapiens; identical to SEQ ID NO: 259160

SEQ ID NO: 540443 - RNA, 64 nt, Homo Sapiens; identical to SEQ ID NO: 259161

SEQ ID NO: 540444 - RNA, 64 nt, Homo Sapiens; identical to SEQ ID NO: 259162

SEQ ID NO: 540445 - RNA, 64 nt, Homo Sapiens; identical to SEQ ID NO: 259163

SEQ ID NO: 540446 - RNA, 64 nt, Homo Sapiens; identical to SEQ ID NO: 259164

SEQ ID NO: 540447 - RNA, 64 nt, Homo Sapiens; identical to SEQ ID NO: 259165

SEQ ID NO: 540448 - RNA, 64 nt, Homo Sapiens; identical to SEQ ID NO: 259166

SEQ ID NO: 540449 - RNA, 64 nt, Homo Sapiens; identical to SEQ ID NO: 259167

SEQ ID NO: 540450 - RNA, 64 nt, Homo Sapiens; identical to SEQ ID NO: 259168

SEQ ID NO: 540451 - RNA, 64 nt, Homo Sapiens; identical to SEQ ID NO: 259169

SEQ ID NO: 540452 - RNA, 64 nt, Homo Sapiens; identical to SEQ ID NO: 259170

SEQ ID NO: 540453 - RNA, 64 nt, Homo Sapiens; identical to SEQ ID NO: 292819

SEQ ID NO: 540454 - RNA, 64 nt, Homo Sapiens; identical to SEQ ID NO: 292820

SEQ ID NO: 540455 - RNA, 64 nt, Homo Sapiens; identical to SEQ ID NO: 292821

SEQ ID NO: 540456 - RNA, 64 nt, Homo Sapiens; identical to SEQ ID NO: 292822

SEQ ID NO: 540457 - RNA, 64 nt, Homo Sapiens; identical to SEQ ID NO: 292823

SEQ ID NO: 540458 - RNA, 64 nt, Homo Sapiens; identical to SEQ ID NO: 292824

SEQ ID NO: 540459 - RNA, 64 nt, Homo Sapiens; identical to SEQ ID NO: 292825

SEQ ID NO: 540460 - RNA, 64 nt, Homo Sapiens; identical to SEQ ID NO: 292826

SEQ ID NO: 540461 - RNA, 64 nt, Homo Sapiens; identical to SEQ ID NO: 292827

SEQ ID NO: 540462 - RNA, 64 nt, Homo Sapiens; identical to SEQ ID NO: 292828

SEQ ID NO: 540463 - RNA, 64 nt, Homo Sapiens; identical to SEQ ID NO: 292829

SEQ ID NO: 540464 - RNA, 64 nt, Homo Sapiens; identical to SEQ ID NO: 292830

SEQ ID NO: 540465 - RNA, 64 nt, Homo Sapiens; identical to SEQ ID NO: 292831

SEQ ID NO: 540466 - RNA, 64 nt, Homo Sapiens; identical to SEQ ID NO: 292832

SEQ ID NO: 540467 - RNA, 64 nt, Homo Sapiens; identical to SEQ ID NO: 292833

SEQ ID NO: 540468 - RNA, 64 nt, Homo Sapiens; identical to SEQ ID NO: 292834

SEQ ID NO: 540469 - RNA, 64 nt, Homo Sapiens; identical to SEQ ID NO: 292835

SEQ ID NO: 540470 - RNA, 64 nt, Homo Sapiens; identical to SEQ ID NO: 292836

SEQ ID NO: 540471 - RNA, 64 nt, Homo Sapiens; identical to SEQ ID NO: 260283

SEQ ID NO: 540472 - RNA, 64 nt, Homo Sapiens; identical to SEQ ID NO: 260284

SEQ ID NO: 540473 - RNA, 64 nt, Homo Sapiens; identical to SEQ ID NO: 260285

SEQ ID NO: 540474 - RNA, 64 nt, Homo Sapiens; identical to SEQ ID NO: 260286

SEQ ID NO: 540475 - RNA, 64 nt, Homo Sapiens; identical to SEQ ID NO: 260287

SEQ ID NO: 540476 - RNA, 64 nt, Homo Sapiens; identical to SEQ ID NO: 260288

SEQ ID NO: 540477 - RNA, 64 nt, Homo Sapiens; identical to SEQ ID NO: 260289

SEQ ID NO: 540478 - RNA, 64 nt, Homo Sapiens; identical to SEQ ID NO: 260290

SEQ ID NO: 540479 - RNA, 64 nt, Homo Sapiens; identical to SEQ ID NO: 260291

SEQ ID NO: 540480 - RNA, 64 nt, Homo Sapiens; identical to SEQ ID NO: 260292

SEQ ID NO: 540481 - RNA, 64 nt, Homo Sapiens; identical to SEQ ID NO: 260293

SEQ ID NO: 540482 - RNA, 64 nt, Homo Sapiens; identical to SEQ ID NO: 260294

SEQ ID NO: 540483 - RNA, 64 nt, Homo Sapiens; identical to SEQ ID NO: 260295

SEQ ID NO: 540484 - RNA, 64 nt, Homo Sapiens; identical to SEQ ID NO: 260296

SEQ ID NO: 540485 - RNA, 64 nt, Homo Sapiens; identical to SEQ ID NO: 260297

SEQ ID NO: 540486 - RNA, 64 nt, Homo Sapiens; identical to SEQ ID NO: 260298

SEQ ID NO: 540487 - RNA, 64 nt, Homo Sapiens; identical to SEQ ID NO: 260299

SEQ ID NO: 540488 - RNA, 64 nt, Homo Sapiens; identical to SEQ ID NO: 260300

SEQ ID NO: 540489 - RNA, 64 nt, Homo Sapiens; identical to SEQ ID NO: 260301

SEQ ID NO: 540490 - RNA, 64 nt, Homo Sapiens; identical to SEQ ID NO: 260302

SEQ ID NO: 540491 - RNA, 64 nt, Homo Sapiens; identical to SEQ ID NO: 260303

SEQ ID NO: 540492 - RNA, 64 nt, Homo Sapiens; identical to SEQ ID NO: 260304

SEQ ID NO: 540493 - RNA, 64 nt, Homo Sapiens; identical to SEQ ID NO: 260305

SEQ ID NO: 540494 - RNA, 64 nt, Homo Sapiens; identical to SEQ ID NO: 260306

SEQ ID NO: 540495 - RNA, 64 nt, Homo Sapiens; identical to SEQ ID NO: 260307

SEQ ID NO: 540496 - RNA, 64 nt, Homo Sapiens; identical to SEQ ID NO: 260308

SEQ ID NO: 540497 - RNA, 64 nt, Homo Sapiens; identical to SEQ ID NO: 260309

SEQ ID NO: 540498 - RNA, 59 nt, Homo Sapiens; identical to SEQ ID NO: 260310

SEQ ID NO: 540499 - RNA, 64 nt, Homo Sapiens; identical to SEQ ID NO: 260311

SEQ ID NO: 540500 - RNA, 64 nt, Homo Sapiens; identical to SEQ ID NO: 260312

SEQ ID NO: 540501 - RNA, 64 nt, Homo Sapiens; identical to SEQ ID NO: 260313

SEQ ID NO: 540502 - RNA, 64 nt, Homo Sapiens; identical to SEQ ID NO: 260314

SEQ ID NO: 540503 - RNA, 64 nt, Homo Sapiens; identical to SEQ ID NO: 260315

SEQ ID NO: 540504 - RNA, 64 nt, Homo Sapiens; identical to SEQ ID NO: 260316

SEQ ID NO: 540505 - RNA, 64 nt, Homo Sapiens; identical to SEQ ID NO: 260317

SEQ ID NO: 540506 - RNA, 64 nt, Homo Sapiens; identical to SEQ ID NO: 260318

SEQ ID NO: 540507 - RNA, 64 nt, Homo Sapiens; identical to SEQ ID NO: 260319

SEQ ID NO: 540508 - RNA, 64 nt, Homo Sapiens; identical to SEQ ID NO: 260320

SEQ ID NO: 540509 - RNA, 64 nt, Homo Sapiens; identical to SEQ ID NO: 260321

SEQ ID NO: 540510 - RNA, 64 nt, Homo Sapiens; identical to SEQ ID NO: 260322

SEQ ID NO: 540511 - RNA, 64 nt, Homo Sapiens; identical to SEQ ID NO: 260323

SEQ ID NO: 540512 - RNA, 64 nt, Homo Sapiens; identical to SEQ ID NO: 260324

SEQ ID NO: 540513 - RNA, 64 nt, Homo Sapiens; identical to SEQ ID NO: 260325

SEQ ID NO: 540514 - RNA, 64 nt, Homo Sapiens; identical to SEQ ID NO: 260326

SEQ ID NO: 540515 - RNA, 64 nt, Homo Sapiens; identical to SEQ ID NO: 260327

SEQ ID NO: 540516 - RNA, 64 nt, Homo Sapiens; identical to SEQ ID NO: 260328

SEQ ID NO: 540517 - RNA, 64 nt, Homo Sapiens; identical to SEQ ID NO: 260329

SEQ ID NO: 540518 - RNA, 64 nt, Homo Sapiens; identical to SEQ ID NO: 260330

SEQ ID NO: 540519 - RNA, 64 nt, Homo Sapiens; identical to SEQ ID NO: 260331

SEQ ID NO: 540520 - RNA, 64 nt, Homo Sapiens; identical to SEQ ID NO: 260332

SEQ ID NO: 540521 - RNA, 64 nt, Homo Sapiens; identical to SEQ ID NO: 260333

SEQ ID NO: 540522 - RNA, 64 nt, Homo Sapiens; identical to SEQ ID NO: 260334

SEQ ID NO: 540523 - RNA, 64 nt, Homo Sapiens; identical to SEQ ID NO: 260335

SEQ ID NO: 540524 - RNA, 64 nt, Homo Sapiens; identical to SEQ ID NO: 260336

SEQ ID NO: 540525 - RNA, 64 nt, Homo Sapiens; identical to SEQ ID NO: 260337

SEQ ID NO: 540526 - RNA, 64 nt, Homo Sapiens; identical to SEQ ID NO: 260338

SEQ ID NO: 540527 - RNA, 64 nt, Homo Sapiens; identical to SEQ ID NO: 260339

SEQ ID NO: 540528 - RNA, 64 nt, Homo Sapiens; identical to SEQ ID NO: 260340

SEQ ID NO: 540529 - RNA, 64 nt, Homo Sapiens; identical to SEQ ID NO: 260341

SEQ ID NO: 540530 - RNA, 64 nt, Homo Sapiens; identical to SEQ ID NO: 260342

SEQ ID NO: 540531 - RNA, 63 nt, Homo Sapiens
gggugcccaagcucagaaggcucuucugacuacugggcaaagaguguagaucagagcagcagu

SEQ ID NO: 540532 - RNA, 63 nt, Homo Sapiens
uaauccagaauaacuagcaccagggacuaugaaugggcaaaacugaauuauaagaggcugaua

SEQ ID NO: 540533 - RNA, 63 nt, Homo Sapiens
ggaucacuugaggccaggaauuugaaaccagccugggcaaaacccugucucuacuaaaaauau

SEQ ID NO: 540534 - RNA, 63 nt, Homo Sapiens
gcagaugggcacaggugcuggugaugccucuccugggcaaaacgccccauuuguggcacuuuc

SEQ ID NO: 540535 - RNA, 63 nt, Homo Sapiens
ugccuguaaucccaguacuuugggaggcugaggugggcaaaucaccugaggucaggaguucca

SEQ ID NO: 540536 - RNA, 63 nt, Homo Sapiens
aaaacaucggggaaucucuccaggacauuggagugggcaaagauuucuuguguaauaccugac

SEQ ID NO: 540537 - RNA, 63 nt, Homo Sapiens
auaguuagauauacuuucucuuaggaaaaauaaugggcaaaaauuuuuguugcaacuuuucau

SEQ ID NO: 540538 - RNA, 63 nt, Homo Sapiens
aaaguugcagauccacaaaacuaacaggauaauugggcaaauaaauuacauauaaacacacac

SEQ ID NO: 540539 - RNA, 63 nt, Homo Sapiens
ggucccacuggggacugugauaggauugagagcugggcaaacagucucucggcuccuuuaaug

SEQ ID NO: 540540 - RNA, 63 nt, Homo Sapiens
ggagauguagcuaacuggugguucaaucacugaugggcaaaggccucugcccuagagcuguuu

SEQ ID NO: 540541 - RNA, 63 nt, Homo Sapiens
gaagguccucagccaugcccuucagggucacucugggcaaagaugauugugaugcuauuuauc

SEQ ID NO: 540542 - RNA, 63 nt, Homo Sapiens
uggagaacccuccuaaaucccaaagaggccuugugggcaaaccuaggaugaauggucccuaca

SEQ ID NO: 540543 - RNA, 63 nt, Homo Sapiens
ugucccgagcugccauguuugugggggaggccgugggcaaaggcaccucugcucgagaggucc

SEQ ID NO: 540544 - RNA, 63 nt, Homo Sapiens
ggugaaaccaugucucuacauuugaggccugccugggcaaaauaaauugcuugaccucaggaa

SEQ ID NO: 540545 - RNA, 63 nt, Homo Sapiens
gcuugaccucaggaauuugaccagcacuuagggugggcaaauuaguggcucacgccuguaauc

SEQ ID NO: 540546 - RNA, 64 nt, Homo Sapiens; identical to SEQ ID NO: 92187

SEQ ID NO: 540547 - RNA, 64 nt, Homo Sapiens; identical to SEQ ID NO: 92188

SEQ ID NO: 540548 - RNA, 64 nt, Homo Sapiens; identical to SEQ ID NO: 92189

SEQ ID NO: 540549 - RNA, 64 nt, Homo Sapiens; identical to SEQ ID NO: 92190

SEQ ID NO: 540550 - RNA, 64 nt, Homo Sapiens; identical to SEQ ID NO: 92191

SEQ ID NO: 540551 - RNA, 64 nt, Homo Sapiens; identical to SEQ ID NO: 92192

SEQ ID NO: 540552 - RNA, 64 nt, Homo Sapiens; identical to SEQ ID NO: 92193

SEQ ID NO: 540553 - RNA, 64 nt, Homo Sapiens; identical to SEQ ID NO: 92194

SEQ ID NO: 540554 - RNA, 64 nt, Homo Sapiens; identical to SEQ ID NO: 92195

SEQ ID NO: 540555 - RNA, 64 nt, Homo Sapiens; identical to SEQ ID NO: 92196

SEQ ID NO: 540556 - RNA, 64 nt, Homo Sapiens; identical to SEQ ID NO: 92197

SEQ ID NO: 540557 - RNA, 64 nt, Homo Sapiens; identical to SEQ ID NO: 92198

SEQ ID NO: 540558 - RNA, 64 nt, Homo Sapiens; identical to SEQ ID NO: 92199

SEQ ID NO: 540559 - RNA, 64 nt, Homo Sapiens; identical to SEQ ID NO: 92200

SEQ ID NO: 540560 - RNA, 64 nt, Homo Sapiens; identical to SEQ ID NO: 92201

SEQ ID NO: 540561 - RNA, 64 nt, Homo Sapiens; identical to SEQ ID NO: 92202

SEQ ID NO: 540562 - RNA, 64 nt, Homo Sapiens; identical to SEQ ID NO: 92203

SEQ ID NO: 540563 - RNA, 64 nt, Homo Sapiens; identical to SEQ ID NO: 92204

SEQ ID NO: 540564 - RNA, 64 nt, Homo Sapiens; identical to SEQ ID NO: 92205

SEQ ID NO: 540565 - RNA, 64 nt, Homo Sapiens; identical to SEQ ID NO: 92206

SEQ ID NO: 540566 - RNA, 64 nt, Homo Sapiens; identical to SEQ ID NO: 92207

SEQ ID NO: 540567 - RNA, 64 nt, Homo Sapiens; identical to SEQ ID NO: 92208

SEQ ID NO: 540568 - RNA, 64 nt, Homo Sapiens; identical to SEQ ID NO: 92209

SEQ ID NO: 540569 - RNA, 64 nt, Homo Sapiens; identical to SEQ ID NO: 92210

SEQ ID NO: 540570 - RNA, 64 nt, Homo Sapiens; identical to SEQ ID NO: 128751

SEQ ID NO: 540571 - RNA, 64 nt, Homo Sapiens; identical to SEQ ID NO: 128752

SEQ ID NO: 540572 - RNA, 64 nt, Homo Sapiens; identical to SEQ ID NO: 128753

SEQ ID NO: 540573 - RNA, 64 nt, Homo Sapiens; identical to SEQ ID NO: 128754

SEQ ID NO: 540574 - RNA, 64 nt, Homo Sapiens; identical to SEQ ID NO: 128755

SEQ ID NO: 540575 - RNA, 64 nt, Homo Sapiens; identical to SEQ ID NO: 128756

SEQ ID NO: 540576 - RNA, 64 nt, Homo Sapiens; identical to SEQ ID NO: 128757

SEQ ID NO: 540577 - RNA, 64 nt, Homo Sapiens; identical to SEQ ID NO: 128758

SEQ ID NO: 540578 - RNA, 64 nt, Homo Sapiens; identical to SEQ ID NO: 128759

SEQ ID NO: 540579 - RNA, 64 nt, Homo Sapiens; identical to SEQ ID NO: 128760

SEQ ID NO: 540580 - RNA, 64 nt, Homo Sapiens; identical to SEQ ID NO: 128761

SEQ ID NO: 540581 - RNA, 64 nt, Homo Sapiens; identical to SEQ ID NO: 128762

SEQ ID NO: 540582 - RNA, 64 nt, Homo Sapiens; identical to SEQ ID NO: 128763

SEQ ID NO: 540583 - RNA, 64 nt, Homo Sapiens; identical to SEQ ID NO: 128764

SEQ ID NO: 540584 - RNA, 64 nt, Homo Sapiens; identical to SEQ ID NO: 128765

SEQ ID NO: 540585 - RNA, 64 nt, Homo Sapiens; identical to SEQ ID NO: 128766

SEQ ID NO: 540586 - RNA, 64 nt, Homo Sapiens; identical to SEQ ID NO: 128767

SEQ ID NO: 540587 - RNA, 64 nt, Homo Sapiens; identical to SEQ ID NO: 128768

SEQ ID NO: 540588 - RNA, 64 nt, Homo Sapiens; identical to SEQ ID NO: 128769

SEQ ID NO: 540589 - RNA, 64 nt, Homo Sapiens; identical to SEQ ID NO: 128770

SEQ ID NO: 540590 - RNA, 64 nt, Homo Sapiens; identical to SEQ ID NO: 128771

SEQ ID NO: 540591 - RNA, 64 nt, Homo Sapiens; identical to SEQ ID NO: 128772

SEQ ID NO: 540592 - RNA, 64 nt, Homo Sapiens; identical to SEQ ID NO: 128773

SEQ ID NO: 540593 - RNA, 64 nt, Homo Sapiens; identical to SEQ ID NO: 128774

SEQ ID NO: 540594 - RNA, 64 nt, Homo Sapiens; identical to SEQ ID NO: 128775

SEQ ID NO: 540595 - RNA, 64 nt, Homo Sapiens; identical to SEQ ID NO: 128776

SEQ ID NO: 540596 - RNA, 64 nt, Homo Sapiens; identical to SEQ ID NO: 128777

SEQ ID NO: 540597 - RNA, 64 nt, Homo Sapiens; identical to SEQ ID NO: 128778

SEQ ID NO: 540598 - RNA, 64 nt, Homo Sapiens; identical to SEQ ID NO: 128779

SEQ ID NO: 540599 - RNA, 64 nt, Homo Sapiens; identical to SEQ ID NO: 128780

SEQ ID NO: 540600 - RNA, 64 nt, Homo Sapiens; identical to SEQ ID NO: 128781

SEQ ID NO: 540601 - RNA, 64 nt, Homo Sapiens; identical to SEQ ID NO: 128782

SEQ ID NO: 540602 - RNA, 64 nt, Homo Sapiens; identical to SEQ ID NO: 128783

SEQ ID NO: 540603 - RNA, 64 nt, Homo Sapiens; identical to SEQ ID NO: 128784

SEQ ID NO: 540604 - RNA, 64 nt, Homo Sapiens; identical to SEQ ID NO: 128785

SEQ ID NO: 540605 - RNA, 64 nt, Homo Sapiens; identical to SEQ ID NO: 128786

SEQ ID NO: 540606 - RNA, 64 nt, Homo Sapiens; identical to SEQ ID NO: 128787

SEQ ID NO: 540607 - RNA, 64 nt, Homo Sapiens; identical to SEQ ID NO: 128788

SEQ ID NO: 540608 - RNA, 64 nt, Homo Sapiens; identical to SEQ ID NO: 128789

SEQ ID NO: 540609 - RNA, 64 nt, Homo Sapiens; identical to SEQ ID NO: 355656

SEQ ID NO: 540610 - RNA, 64 nt, Homo Sapiens; identical to SEQ ID NO: 355657

SEQ ID NO: 540611 - RNA, 64 nt, Homo Sapiens; identical to SEQ ID NO: 355658

SEQ ID NO: 540612 - RNA, 64 nt, Homo Sapiens; identical to SEQ ID NO: 355659

SEQ ID NO: 540613 - RNA, 64 nt, Homo Sapiens; identical to SEQ ID NO: 355660

SEQ ID NO: 540614 - RNA, 64 nt, Homo Sapiens; identical to SEQ ID NO: 355661

SEQ ID NO: 540615 - RNA, 64 nt, Homo Sapiens; identical to SEQ ID NO: 355662

SEQ ID NO: 540616 - RNA, 64 nt, Homo Sapiens; identical to SEQ ID NO: 355663

SEQ ID NO: 540617 - RNA, 64 nt, Homo Sapiens; identical to SEQ ID NO: 355664

SEQ ID NO: 540618 - RNA, 64 nt, Homo Sapiens; identical to SEQ ID NO: 355665

SEQ ID NO: 540619 - RNA, 64 nt, Homo Sapiens; identical to SEQ ID NO: 355666

SEQ ID NO: 540620 - RNA, 64 nt, Homo Sapiens; identical to SEQ ID NO: 355667

SEQ ID NO: 540621 - RNA, 64 nt, Homo Sapiens; identical to SEQ ID NO: 355668

SEQ ID NO: 540622 - RNA, 64 nt, Homo Sapiens; identical to SEQ ID NO: 355669

SEQ ID NO: 540623 - RNA, 62 nt, Homo Sapiens
ucuguuuccuaauucaggaccccacucaucuagcccuccaagagccuccgccaaauuguagc

SEQ ID NO: 540624 - RNA, 62 nt, Homo Sapiens
gucaacaguccccugauccccuaccucugccugcccuccagccccaucaccagcuucuugcu

SEQ ID NO: 540625 - RNA, 62 nt, Homo Sapiens
cacaucaguuaaugccagugaggucagcuucugcccuccagcaauacaugugcagggguugc

SEQ ID NO: 540626 - RNA, 62 nt, Homo Sapiens
guacugaggguacuggccuaggaauucccacagcccuccaguccccaucaugggcaaggaag

SEQ ID NO: 540627 - RNA, 62 nt, Homo Sapiens
aaacagaggugacaaaugugccaggacucacugcccuccagaguauuaccaccagacugacu

SEQ ID NO: 540628 - RNA, 55 nt, Homo Sapiens
agauuccagcucaucacuagaggcagcccuccauggacccaugaaaacugagaug

SEQ ID NO: 540629 - RNA, 62 nt, Homo Sapiens
agggugaauccuucccacacuccuccaugguugcccuccagggucuagcccagccuauuugu

SEQ ID NO: 540630 - RNA, 62 nt, Homo Sapiens
aucuucacauuccaagacugagccagcagcuggcccuccacccccuggcgggccacccugcc

SEQ ID NO: 540631 - RNA, 62 nt, Homo Sapiens
gccagcccuccuggguaccgcugccaagcccagcccuccagaaccuccuugcucuccccagc

SEQ ID NO: 540632 - RNA, 62 nt, Homo Sapiens
ggaucagaagcuccaaguucuccaagauauaagcccuccaaggacuuuaugcccuccagagc

SEQ ID NO: 540633 - RNA, 62 nt, Homo Sapiens
gcuccaagauauaagcccucuagagacuuuaugcccuccagaauccucucucaggaagcuuc

SEQ ID NO: 540634 - RNA, 62 nt, Homo Sapiens
ccugacuggggaugggcggcgcugcgaggccugcccuccaaaccacugcguuccugggaagg

SEQ ID NO: 540635 - RNA, 62 nt, Homo Sapiens
aaugguggucgugugauugacaaucaguacccgcccuccaucgagcaggcgaacgccacccu

SEQ ID NO: 540636 - RNA, 62 nt, Homo Sapiens
cagacacagcuguuguucggggcuguggaacugcccuccaagcugcuggucuacuugucggu

SEQ ID NO: 540637 - RNA, 62 nt, Homo Sapiens
gcagguccagaacuaagugggaguggaggcaggcccuccacagaagcucugcagcaggggcu

SEQ ID NO: 540638 - RNA, 62 nt, Homo Sapiens
cccguuacucaaauccuuggcacuacuacaaugcccuccauucuucagggcugagaauugac

SEQ ID NO: 540639 - RNA, 62 nt, Homo Sapiens
guuucaggagaggacugugcuggaucaugcuugcccuccacagggaauacagcauccuuaca

SEQ ID NO: 540640 - RNA, 62 nt, Homo Sapiens
ucuguggccuucuggggcaccgauucuaccaggcccuccagcugcguggucuccgcagacca

SEQ ID NO: 540641 - RNA, 62 nt, Homo Sapiens
uccagcccuccggagagugggcuuggcccuaggcccuccagcucagccagaaaaagcccaga

SEQ ID NO: 540642 - RNA, 62 nt, Homo Sapiens
ggcugcuugaggaaacgcagaagcacuuugcugcccuccagugcggggugggauuuuugcau

SEQ ID NO: 540643 - RNA, 62 nt, Homo Sapiens
ccccagaggggcgccugugggggugugcgucagcccuccaacggcggcugggaucucaggca

SEQ ID NO: 540644 - RNA, 62 nt, Homo Sapiens
uuccgccugccucccagcgaguacgucaucgugcccuccaccuacgagccccaccaggaggg

SEQ ID NO: 540645 - RNA, 62 nt, Homo Sapiens
gccgguggcacucagcaccuccuugugcuagagcccuccaucaccuucacgcugucccacca

SEQ ID NO: 540646 - RNA, 62 nt, Homo Sapiens
ucgacaaucugucagccgacgcagggcuggaggcccuccauuucccuccccuuuuaauuuau

SEQ ID NO: 540647 - RNA, 62 nt, Homo Sapiens
gcugcagcucugcucaacugcgucuucucucagcccuccacacacacucacccccacuccca

SEQ ID NO: 540648 - RNA, 62 nt, Homo Sapiens
ucuggggccagaauggcuguccuugucguagagcccuccacauuuucuuuuucuuuuuugag

SEQ ID NO: 540649 - RNA, 62 nt, Homo Sapiens
acuacaagugugagccaccgcgccuggcccaagcccuccacauuuucaauccaggagccuug

SEQ ID NO: 540650 - RNA, 62 nt, Homo Sapiens
aguaucugagaagcugcuacucaggcugaugugcccuccagccagauaaaccccaugagggg

SEQ ID NO: 540651 - RNA, 62 nt, Homo Sapiens
ggcaacuggugcagggacuguggagcugcccugcccuccauacccuccacuggccccagggc

SEQ ID NO: 540652 - RNA, 62 nt, Homo Sapiens
ggccccagggcuggagcugcuggcucuggcuggcccuccacucacuagcugacugugcuggc

SEQ ID NO: 540653 - RNA, 62 nt, Homo Sapiens
agccguaccuggugaacugcguccgcaucccugcccuccagucccuccugcuuuuuagccgg

SEQ ID NO: 540654 - RNA, 62 nt, Homo Sapiens
aggagcccugcccaccuccgugcagcugaccugcccuccagcccaggacuaggggcaggacu

SEQ ID NO: 540655 - RNA, 62 nt, Homo Sapiens
uccaaauccagacgcaggcccgugaggccccggcccuccaaacaggggaccucgggacugcg

SEQ ID NO: 540656 - RNA, 62 nt, Homo Sapiens
cagccuccuggacucggccuugcgugcgcccugcccuccaccgcauggacugacugccaggc

SEQ ID NO: 540657 - RNA, 62 nt, Homo Sapiens
gguccccaucccugucucucccuuucacccuugcccuccaguccucuaccucuggccugccc

SEQ ID NO: 540658 - RNA, 62 nt, Homo Sapiens
guagagccugugcagccugggcugcugucauugcccuccaguaagggcucaggguuuugcuu

SEQ ID NO: 540659 - RNA, 62 nt, Homo Sapiens
gcaucuccacagccccggguccucugucuaacgcccuccauuucacgcccuccaucucacag

SEQ ID NO: 540660 - RNA, 62 nt, Homo Sapiens
ccggguccucugucuaacgcccuccauuucacgcccuccaucucacagucaagauaaaggcc

SEQ ID NO: 540661 - RNA, 64 nt, Homo Sapiens
uacaaagugagaguaggaagacucaaacacgauauuacccaaguuccugagacuagagaagugu

SEQ ID NO: 540662 - RNA, 64 nt, Homo Sapiens
gcaaauggaaaaacucgacaccacauuucaggcuuuacccaacaucgaaauaauggagagaaaa

SEQ ID NO: 540663 - RNA, 64 nt, Homo Sapiens; identical to SEQ ID NO: 139174

SEQ ID NO: 540664 - RNA, 64 nt, Homo Sapiens; identical to SEQ ID NO: 139175

SEQ ID NO: 540665 - RNA, 64 nt, Homo Sapiens; identical to SEQ ID NO: 139176

SEQ ID NO: 540666 - RNA, 64 nt, Homo Sapiens; identical to SEQ ID NO: 139177

SEQ ID NO: 540667 - RNA, 64 nt, Homo Sapiens; identical to SEQ ID NO: 305774

SEQ ID NO: 540668 - RNA, 64 nt, Homo Sapiens; identical to SEQ ID NO: 305775

SEQ ID NO: 540669 - RNA, 64 nt, Homo Sapiens; identical to SEQ ID NO: 305776

SEQ ID NO: 540670 - RNA, 64 nt, Homo Sapiens; identical to SEQ ID NO: 305777

SEQ ID NO: 540671 - RNA, 64 nt, Homo Sapiens; identical to SEQ ID NO: 305778

SEQ ID NO: 540672 - RNA, 64 nt, Homo Sapiens; identical to SEQ ID NO: 305779

SEQ ID NO: 540673 - RNA, 64 nt, Homo Sapiens; identical to SEQ ID NO: 305780

SEQ ID NO: 540674 - RNA, 64 nt, Homo Sapiens; identical to SEQ ID NO: 305781

SEQ ID NO: 540675 - RNA, 64 nt, Homo Sapiens; identical to SEQ ID NO: 305782

SEQ ID NO: 540676 - RNA, 64 nt, Homo Sapiens; identical to SEQ ID NO: 305783

SEQ ID NO: 540677 - RNA, 64 nt, Homo Sapiens; identical to SEQ ID NO: 305784

SEQ ID NO: 540678 - RNA, 64 nt, Homo Sapiens; identical to SEQ ID NO: 305785

SEQ ID NO: 540679 - RNA, 64 nt, Homo Sapiens; identical to SEQ ID NO: 305786

SEQ ID NO: 540680 - RNA, 64 nt, Homo Sapiens; identical to SEQ ID NO: 305787

SEQ ID NO: 540681 - RNA, 64 nt, Homo Sapiens; identical to SEQ ID NO: 305788

SEQ ID NO: 540682 - RNA, 64 nt, Homo Sapiens; identical to SEQ ID NO: 305789

SEQ ID NO: 540683 - RNA, 64 nt, Homo Sapiens; identical to SEQ ID NO: 305790

SEQ ID NO: 540684 - RNA, 64 nt, Homo Sapiens; identical to SEQ ID NO: 305791

SEQ ID NO: 540685 - RNA, 64 nt, Homo Sapiens; identical to SEQ ID NO: 305792

SEQ ID NO: 540686 - RNA, 64 nt, Homo Sapiens; identical to SEQ ID NO: 305793

SEQ ID NO: 540687 - RNA, 63 nt, Homo Sapiens; identical to SEQ ID NO: 305794

SEQ ID NO: 540688 - RNA, 64 nt, Homo Sapiens; identical to SEQ ID NO: 305795

SEQ ID NO: 540689 - RNA, 64 nt, Homo Sapiens; identical to SEQ ID NO: 305796

SEQ ID NO: 540690 - RNA, 64 nt, Homo Sapiens; identical to SEQ ID NO: 305797

SEQ ID NO: 540691 - RNA, 64 nt, Homo Sapiens; identical to SEQ ID NO: 305798

SEQ ID NO: 540692 - RNA, 64 nt, Homo Sapiens; identical to SEQ ID NO: 305799

SEQ ID NO: 540693 - RNA, 64 nt, Homo Sapiens; identical to SEQ ID NO: 305800

SEQ ID NO: 540694 - RNA, 64 nt, Homo Sapiens; identical to SEQ ID NO: 305801

SEQ ID NO: 540695 - RNA, 64 nt, Homo Sapiens; identical to SEQ ID NO: 305802

SEQ ID NO: 540696 - RNA, 64 nt, Homo Sapiens; identical to SEQ ID NO: 305803

SEQ ID NO: 540697 - RNA, 64 nt, Homo Sapiens; identical to SEQ ID NO: 305804

SEQ ID NO: 540698 - RNA, 64 nt, Homo Sapiens; identical to SEQ ID NO: 305805

SEQ ID NO: 540699 - RNA, 64 nt, Homo Sapiens; identical to SEQ ID NO: 305806

SEQ ID NO: 540700 - RNA, 64 nt, Homo Sapiens; identical to SEQ ID NO: 305807

SEQ ID NO: 540701 - RNA, 64 nt, Homo Sapiens; identical to SEQ ID NO: 305808

SEQ ID NO: 540702 - RNA, 64 nt, Homo Sapiens; identical to SEQ ID NO: 305809

SEQ ID NO: 540703 - RNA, 64 nt, Homo Sapiens; identical to SEQ ID NO: 305810

SEQ ID NO: 540704 - RNA, 64 nt, Homo Sapiens; identical to SEQ ID NO: 305811

SEQ ID NO: 540705 - RNA, 64 nt, Homo Sapiens; identical to SEQ ID NO: 305812

SEQ ID NO: 540706 - RNA, 64 nt, Homo Sapiens; identical to SEQ ID NO: 305813

SEQ ID NO: 540707 - RNA, 64 nt, Homo Sapiens; identical to SEQ ID NO: 305814

SEQ ID NO: 540708 - RNA, 64 nt, Homo Sapiens; identical to SEQ ID NO: 305815

SEQ ID NO: 540709 - RNA, 64 nt, Homo Sapiens; identical to SEQ ID NO: 305816

SEQ ID NO: 540710 - RNA, 64 nt, Homo Sapiens; identical to SEQ ID NO: 305817

SEQ ID NO: 540711 - RNA, 63 nt, Homo Sapiens
caaauuaaggcaacaaacauccagacccugccuggccacaauucuuacucugaauuuagaucu

SEQ ID NO: 540712 - RNA, 58 nt, Homo Sapiens
aagcaugcaaagucauuguuugugccucggccacaaaacuuaccugaugcuaaaauaa

SEQ ID NO: 540713 - RNA, 63 nt, Homo Sapiens
uuuuucuauccuguuuucauccccgggcucccuggccacaagcgacacaaugccucacucagg

SEQ ID NO: 540714 - RNA, 63 nt, Homo Sapiens
augccauaaugccuguuggugaccccagacucuggccacaaaagauggcucuuguucagucaa

SEQ ID NO: 540715 - RNA, 63 nt, Homo Sapiens
acugugcucaucaagaacaauaucgacuuccccggccacaacuacaccacguaagugcccagg

SEQ ID NO: 540716 - RNA, 63 nt, Homo Sapiens
cauccuggcuggagaauguggagaacuaaagguggccacaaauucuuugacacucaagucccc

SEQ ID NO: 540717 - RNA, 63 nt, Homo Sapiens
accuaagccuuuaaggcugugucaccaagguauggccacaaggaagaauaguguacagagauu

SEQ ID NO: 540718 - RNA, 63 nt, Homo Sapiens
ugaugauugaugaagcagaugaguuuguagcagggccacaaaacaaagugaaacguccagggg

SEQ ID NO: 540719 - RNA, 64 nt, Homo Sapiens; identical to SEQ ID NO: 265889

SEQ ID NO: 540720 - RNA, 64 nt, Homo Sapiens; identical to SEQ ID NO: 265890

SEQ ID NO: 540721 - RNA, 64 nt, Homo Sapiens; identical to SEQ ID NO: 265891

SEQ ID NO: 540722 - RNA, 64 nt, Homo Sapiens; identical to SEQ ID NO: 265892

SEQ ID NO: 540723 - RNA, 64 nt, Homo Sapiens; identical to SEQ ID NO: 265893

SEQ ID NO: 540724 - RNA, 64 nt, Homo Sapiens; identical to SEQ ID NO: 265894

SEQ ID NO: 540725 - RNA, 64 nt, Homo Sapiens; identical to SEQ ID NO: 265895

SEQ ID NO: 540726 - RNA, 64 nt, Homo Sapiens; identical to SEQ ID NO: 265896

SEQ ID NO: 540727 - RNA, 64 nt, Homo Sapiens; identical to SEQ ID NO: 265897

SEQ ID NO: 540728 - RNA, 64 nt, Homo Sapiens; identical to SEQ ID NO: 265898

SEQ ID NO: 540729 - RNA, 64 nt, Homo Sapiens; identical to SEQ ID NO: 265899

SEQ ID NO: 540730 - RNA, 64 nt, Homo Sapiens; identical to SEQ ID NO: 265900

SEQ ID NO: 540731 - RNA, 64 nt, Homo Sapiens; identical to SEQ ID NO: 265901

SEQ ID NO: 540732 - RNA, 64 nt, Homo Sapiens; identical to SEQ ID NO: 265902

SEQ ID NO: 540733 - RNA, 64 nt, Homo Sapiens; identical to SEQ ID NO: 265903

SEQ ID NO: 540734 - RNA, 64 nt, Homo Sapiens; identical to SEQ ID NO: 265904

SEQ ID NO: 540735 - RNA, 64 nt, Homo Sapiens; identical to SEQ ID NO: 265905

SEQ ID NO: 540736 - RNA, 64 nt, Homo Sapiens; identical to SEQ ID NO: 265906

SEQ ID NO: 540737 - RNA, 64 nt, Homo Sapiens; identical to SEQ ID NO: 267144

SEQ ID NO: 540738 - RNA, 64 nt, Homo Sapiens; identical to SEQ ID NO: 267145

SEQ ID NO: 540739 - RNA, 64 nt, Homo Sapiens; identical to SEQ ID NO: 267146

SEQ ID NO: 540740 - RNA, 64 nt, Homo Sapiens; identical to SEQ ID NO: 267147

SEQ ID NO: 540741 - RNA, 64 nt, Homo Sapiens; identical to SEQ ID NO: 267148

SEQ ID NO: 540742 - RNA, 64 nt, Homo Sapiens; identical to SEQ ID NO: 267149

SEQ ID NO: 540743 - RNA, 64 nt, Homo Sapiens; identical to SEQ ID NO: 267150

SEQ ID NO: 540744 - RNA, 64 nt, Homo Sapiens; identical to SEQ ID NO: 267151

SEQ ID NO: 540745 - RNA, 64 nt, Homo Sapiens; identical to SEQ ID NO: 267152

SEQ ID NO: 540746 - RNA, 64 nt, Homo Sapiens; identical to SEQ ID NO: 267153

SEQ ID NO: 540747 - RNA, 64 nt, Homo Sapiens; identical to SEQ ID NO: 267154

SEQ ID NO: 540748 - RNA, 64 nt, Homo Sapiens; identical to SEQ ID NO: 267155

SEQ ID NO: 540749 - RNA, 64 nt, Homo Sapiens; identical to SEQ ID NO: 267156

SEQ ID NO: 540750 - RNA, 64 nt, Homo Sapiens; identical to SEQ ID NO: 267157

SEQ ID NO: 540751 - RNA, 64 nt, Homo Sapiens; identical to SEQ ID NO: 267157

SEQ ID NO: 540752 - RNA, 64 nt, Homo Sapiens; identical to SEQ ID NO: 267159

SEQ ID NO: 540753 - RNA, 64 nt, Homo Sapiens; identical to SEQ ID NO: 267160

SEQ ID NO: 540754 - RNA, 64 nt, Homo Sapiens; identical to SEQ ID NO: 267161

SEQ ID NO: 540755 - RNA, 64 nt, Homo Sapiens; identical to SEQ ID NO: 267162

SEQ ID NO: 540756 - RNA, 64 nt, Homo Sapiens; identical to SEQ ID NO: 267163

SEQ ID NO: 540757 - RNA, 64 nt, Homo Sapiens; identical to SEQ ID NO: 267164

SEQ ID NO: 540758 - RNA, 64 nt, Homo Sapiens; identical to SEQ ID NO: 267165

SEQ ID NO: 540759 - RNA, 64 nt, Homo Sapiens
cagucucccaaagagccauuucaacagagaagggaaaugacaaaggggcagcuggccagauaag

SEQ ID NO: 540760 - RNA, 64 nt, Homo Sapiens
uggcagagauaaucgugucuuaaaaguuguuuuuaaaugacaauaaaacaagccagaaugucuu

SEQ ID NO: 540761 - RNA, 64 nt, Homo Sapiens
uagggaaccuuuccagagaagucccauuaguaagaaaugacauaaaauacgugcuuucucaggu

SEQ ID NO: 540762 - RNA, 64 nt, Homo Sapiens
uaaauaaaauccaggccuagacucaagguauuguaaaugacaagauaccaaauacaagauuuua

SEQ ID NO: 540763 - RNA, 64 nt, Homo Sapiens
uuuugccaauuauuaauuugcuaaauaguaauacaaaugacaaacugcauuaaauuuacuaauu

SEQ ID NO: 540764 - RNA, 64 nt, Homo Sapiens
uguccccccacccuuuuuuccuuaaauaaaguaaaaaugacaccuauuuuauguggcaugaguu

SEQ ID NO: 540765 - RNA, 64 nt, Homo Sapiens
cccccucacuccacacuggcacguuugugagaagaaaugacauuuugcuaggaagugaccgagu

SEQ ID NO: 540766 - RNA, 64 nt, Homo Sapiens
cuuauuugcaauaaaagguauugagccauuuuuuaaaugacauuuuugauaaauuauguuugua

SEQ ID NO: 540767 - RNA, 64 nt, Homo Sapiens
cucaaauguauugcauaaguaaagcuggaagaacaaaugacaugcaauuuagaaaaauggggag

SEQ ID NO: 540768 - RNA, 64 nt, Homo Sapiens
uugagaucauuguuguuucaauagcugguggucaaaaugacaugaucgauucagaaaucauaua

SEQ ID NO: 540769 - RNA, 64 nt, Homo Sapiens
cuuuaccuucuaggucuuaaaaucacacauuggaaaaugacaauaucaacaaaacuguauucuu

SEQ ID NO: 540770 - RNA, 64 nt, Homo Sapiens
aaaaaaucagcaaaauaauaaaaugaacgaaaaaaaaugacacccagggaguucccaaccccag

SEQ ID NO: 540771 - RNA, 64 nt, Homo Sapiens
aacaugggaugggaaggaaugggcaaagagauuaaaaugacagaaguuagcuguagaugaccua

SEQ ID NO: 540772 - RNA, 64 nt, Homo Sapiens
ucauucacuuuugaaauaaaccaucgagaacacaaaaugacaagugaguuagguugggcugaug

SEQ ID NO: 540773 - RNA, 64 nt, Homo Sapiens
uuuuacuagcuaaguagagaacuuaagugagcaaaaaugacaagaaggaaucacaaaugaucau

SEQ ID NO: 540774 - RNA, 64 nt, Homo Sapiens
cuuguuucuccccuuugaauaguuuuuggauacuaaaugacagcaagcagaacauacauguacc

SEQ ID NO: 540775 - RNA, 64 nt, Homo Sapiens
gagugcucccagcaaccgccacguacaaggucugaaaugacaagggcaagagugagauaggaaa

SEQ ID NO: 540776 - RNA, 64 nt, Homo Sapiens
aauaguauaugccacuauauaaauuuguauuaauaaaugacagucuuguugguuuuuuguuugu

SEQ ID NO: 540777 - RNA, 64 nt, Homo Sapiens
gcuauaaaguugaacuuuguauggcuugaaaaagaaaugacaauauggaacaucccaaggcugu

SEQ ID NO: 540778 - RNA, 64 nt, Homo Sapiens
agagugaacugauguuucauuuauauuuucauccaaaugacauuaucugcacguuuuuaaaauu

SEQ ID NO: 540779 - RNA, 64 nt, Homo Sapiens
auaauaaaaguuuuaugaaauguuacauuuguacaaaugacaugaaaagagaauuuaucauuac

SEQ ID NO: 540780 - RNA, 64 nt, Homo Sapiens
guggggaacuggagggugggucagccaccuugauaaaugacagguagugggagaccauaaugug

SEQ ID NO: 540781 - RNA, 64 nt, Homo Sapiens
aacuauguaauccaucagggauucauuacuuggaaaaugacaggucaugcauuauccaaaaaca

SEQ ID NO: 540782 - RNA, 64 nt, Homo Sapiens
auccaaaaacaauaccaaaaagacauauuuuauaaaaugacaaaaaauauuuuacauaauuacu

SEQ ID NO: 540783 - RNA, 64 nt, Homo Sapiens
gaauguacuaucaggauuuuacagcaaugcugggaaaugacagggaaaaugacaggaaugaauc

SEQ ID NO: 540784 - RNA, 64 nt, Homo Sapiens
aggauuuuacagcaaugcugggaaaugacagggaaaaugacaggaaugaaucucaccagauuuu

SEQ ID NO: 540785 - RNA, 64 nt, Homo Sapiens
uacaaauaacaaugaauguuagauacacaaguauaaaugacaagggcuuaccguuuugucuaua

SEQ ID NO: 540786 - RNA, 64 nt, Homo Sapiens
cugguugaagcugguaaucagacaaaguguaaugaaaugacaagggaaugucucuugacuaauu

SEQ ID NO: 540787 - RNA, 64 nt, Homo Sapiens
cccaacuacuguguuaugcaaaagcaagcugauuaaaugacacucauauaauuauauguuguaa

SEQ ID NO: 540788 - RNA, 64 nt, Homo Sapiens
uuuauuaugaagaaggugaauagccauauuuguaaaaugacaaucauguguguuaacccagugc

SEQ ID NO: 540789 - RNA, 64 nt, Homo Sapiens
uuaguuuaucagauugguaauaauuccagauuggaaaugacauugcagccacuaaaagauuauu

SEQ ID NO: 540790 - RNA, 64 nt, Homo Sapiens
cauugcaucccagucuuguguuguccuuuuggaaaaaugacaaggccugugacuugguuucucu

SEQ ID NO: 540791 - RNA, 64 nt, Homo Sapiens
ugauauguuuuucugauauacuguccgguggacaaaaugacaauagcaucauuuccuuacaaua

SEQ ID NO: 540792 - RNA, 64 nt, Homo Sapiens
uuaucauguuuuccugcagcguaguuagagaucuaaaugacauucucucuagucuaacggucuu

SEQ ID NO: 540793 - RNA, 64 nt, Homo Sapiens
aaauaucugcaguuauccaguugaaacagaauggaaaugacaagcaguguauuguucugcagug

SEQ ID NO: 540794 - RNA, 53 nt, Homo Sapiens
guauucucggcugcaaaaauggaaaaugacaaaaccacucccuuaaagacuga

SEQ ID NO: 540795 - RNA, 64 nt, Homo Sapiens
cgugugacccguuccagguccccugggcucccucaaaugacagaccuaacuauuccuguguaaa

SEQ ID NO: 540796 - RNA, 64 nt, Homo Sapiens
uaucgagauguucgcucgugcaguacuguugguuaaaugacaauuuauguggauuuugcaugua

SEQ ID NO: 540797 - RNA, 64 nt, Homo Sapiens
gaaauguaaaaauuagauuuaaauaguauauuuuaaaugacagaacuauaauuacagagaucag

SEQ ID NO: 540798 - RNA, 64 nt, Homo Sapiens
caagugcauaaggcuguugucuucggcuugggugaaaugacaguuccucuucauucuaaagguu

SEQ ID NO: 540799 - RNA, 64 nt, Homo Sapiens
guauacagacuuauuuucauaaugcaaauuaauaaaaugacacuuuuacugcacuauagaaaua

SEQ ID NO: 540800 - RNA, 64 nt, Homo Sapiens
aucuucacaccuugaauaagcauaauaccauaaaaaaugacacuugacaugucaauguauuugu

SEQ ID NO: 540801 - RNA, 64 nt, Homo Sapiens
ggaauauguuuaguagauuauauguaaaacuacuaaaugacacuuccaaguauagugcagauuc

SEQ ID NO: 540802 - RNA, 64 nt, Homo Sapiens
gccuucaaaaauauuuuuggaauuugguuuuagcaaaugacagaguuguguacauagagaagaa

SEQ ID NO: 540803 - RNA, 64 nt, Homo Sapiens
aaggaaaguucugcuguuuuacuaguuuugcugaaaaugacauuauggugaaauaaaggaagau

SEQ ID NO: 540804 - RNA, 64 nt, Homo Sapiens
gaaggcuuuaaguauccauuuccaaagauaauagaaaugacacaagggacuaauucaugguugu

SEQ ID NO: 540805 - RNA, 64 nt, Homo Sapiens
accuugcaaaaggagaucuaaaaaacacaaucagaaaugacaaaggggacauuaccaccaaccc

SEQ ID NO: 540806 - RNA, 64 nt, Homo Sapiens
gcaaaagcuggaagcauuccccuugagaacuggaaaaugacagggaugaccacucucaccacuc

SEQ ID NO: 540807 - RNA, 64 nt, Homo Sapiens
gcuaaagacugcauuauuuuuaucauuuacuucaaaaugacauuguucaagcaucuacucuuuu

SEQ ID NO: 540808 - RNA, 64 nt, Homo Sapiens
aaucuauauuacuuucucaacuauaaagccaugcaaaugacaaauguauguuuuuuuaacuuua

SEQ ID NO: 540809 - RNA, 64 nt, Homo Sapiens
ccauuaauuauauuguuaaucuugucaggguauaaaaugacaucccaauuuauuuacauuuaaa

SEQ ID NO: 540810 - RNA, 64 nt, Homo Sapiens
cauggccggccgggugcuucauuuuccgcccucaaaaugacagcaauuaaccagaaauccaguu

SEQ ID NO: 540811 - RNA, 64 nt, Homo Sapiens
ccgaucaucuuuccuugccuaugacauguguauaaaaugacauugugggagcuguucgauuuuu

SEQ ID NO: 540812 - RNA, 64 nt, Homo Sapiens
caaggcccauuagccaguuuagcauuuacuuuaaaaaugacaugaggcagauucuuauccagga

SEQ ID NO: 540813 - RNA, 62 nt, Homo Sapiens; identical to SEQ ID NO: 438948

SEQ ID NO: 540814 - RNA, 62 nt, Homo Sapiens; identical to SEQ ID NO: 438949

SEQ ID NO: 540815 - RNA, 62 nt, Homo Sapiens; identical to SEQ ID NO: 438950

SEQ ID NO: 540816 - RNA, 62 nt, Homo Sapiens; identical to SEQ ID NO: 438951

SEQ ID NO: 540817 - RNA, 62 nt, Homo Sapiens; identical to SEQ ID NO: 438952

SEQ ID NO: 540818 - RNA, 62 nt, Homo Sapiens; identical to SEQ ID NO: 438953

SEQ ID NO: 540819 - RNA, 62 nt, Homo Sapiens; identical to SEQ ID NO: 438954

SEQ ID NO: 540820 - RNA, 62 nt, Homo Sapiens; identical to SEQ ID NO: 438955

SEQ ID NO: 540821 - RNA, 64 nt, Homo Sapiens; identical to SEQ ID NO: 119503

SEQ ID NO: 540822 - RNA, 64 nt, Homo Sapiens; identical to SEQ ID NO: 119504

SEQ ID NO: 540823 - RNA, 64 nt, Homo Sapiens; identical to SEQ ID NO: 119505

SEQ ID NO: 540824 - RNA, 64 nt, Homo Sapiens; identical to SEQ ID NO: 119506

SEQ ID NO: 540825 - RNA, 64 nt, Homo Sapiens; identical to SEQ ID NO: 119507

SEQ ID NO: 540826 - RNA, 64 nt, Homo Sapiens; identical to SEQ ID NO: 119508

SEQ ID NO: 540827 - RNA, 64 nt, Homo Sapiens; identical to SEQ ID NO: 119509

SEQ ID NO: 540828 - RNA, 64 nt, Homo Sapiens; identical to SEQ ID NO: 119510

SEQ ID NO: 540829 - RNA, 64 nt, Homo Sapiens; identical to SEQ ID NO: 119511

SEQ ID NO: 540830 - RNA, 64 nt, Homo Sapiens; identical to SEQ ID NO: 119512

SEQ ID NO: 540831 - RNA, 64 nt, Homo Sapiens; identical to SEQ ID NO: 119513

SEQ ID NO: 540832 - RNA, 64 nt, Homo Sapiens; identical to SEQ ID NO: 119514

SEQ ID NO: 540833 - RNA, 64 nt, Homo Sapiens; identical to SEQ ID NO: 119515

SEQ ID NO: 540834 - RNA, 64 nt, Homo Sapiens; identical to SEQ ID NO: 119516

SEQ ID NO: 540835 - RNA, 64 nt, Homo Sapiens; identical to SEQ ID NO: 119517

SEQ ID NO: 540836 - RNA, 64 nt, Homo Sapiens; identical to SEQ ID NO: 119518

SEQ ID NO: 540837 - RNA, 64 nt, Homo Sapiens; identical to SEQ ID NO: 119519

SEQ ID NO: 540838 - RNA, 64 nt, Homo Sapiens; identical to SEQ ID NO: 119520

SEQ ID NO: 540839 - RNA, 64 nt, Homo Sapiens; identical to SEQ ID NO: 119521

SEQ ID NO: 540840 - RNA, 64 nt, Homo Sapiens; identical to SEQ ID NO: 119522

SEQ ID NO: 540841 - RNA, 64 nt, Homo Sapiens; identical to SEQ ID NO: 119523

SEQ ID NO: 540842 - RNA, 64 nt, Homo Sapiens; identical to SEQ ID NO: 119524

SEQ ID NO: 540843 - RNA, 64 nt, Homo Sapiens; identical to SEQ ID NO: 119525

SEQ ID NO: 540844 - RNA, 64 nt, Homo Sapiens; identical to SEQ ID NO: 119526

SEQ ID NO: 540845 - RNA, 64 nt, Homo Sapiens; identical to SEQ ID NO: 119527

SEQ ID NO: 540846 - RNA, 64 nt, Homo Sapiens; identical to SEQ ID NO: 119528

SEQ ID NO: 540847 - RNA, 64 nt, Homo Sapiens; identical to SEQ ID NO: 119529

SEQ ID NO: 540848 - RNA, 64 nt, Homo Sapiens; identical to SEQ ID NO: 119530

SEQ ID NO: 540849 - RNA, 64 nt, Homo Sapiens; identical to SEQ ID NO: 119531

SEQ ID NO: 540850 - RNA, 64 nt, Homo Sapiens; identical to SEQ ID NO: 119532

SEQ ID NO: 540851 - RNA, 64 nt, Homo Sapiens; identical to SEQ ID NO: 119533

SEQ ID NO: 540852 - RNA, 64 nt, Homo Sapiens; identical to SEQ ID NO: 119534

SEQ ID NO: 540853 - RNA, 64 nt, Homo Sapiens; identical to SEQ ID NO: 119535

SEQ ID NO: 540854 - RNA, 64 nt, Homo Sapiens; identical to SEQ ID NO: 119536

SEQ ID NO: 540855 - RNA, 64 nt, Homo Sapiens; identical to SEQ ID NO: 119537

SEQ ID NO: 540856 - RNA, 64 nt, Homo Sapiens; identical to SEQ ID NO: 119538

SEQ ID NO: 540857 - RNA, 64 nt, Homo Sapiens; identical to SEQ ID NO: 119539

SEQ ID NO: 540858 - RNA, 64 nt, Homo Sapiens; identical to SEQ ID NO: 119540

SEQ ID NO: 540859 - RNA, 64 nt, Homo Sapiens; identical to SEQ ID NO: 119541

SEQ ID NO: 540860 - RNA, 64 nt, Homo Sapiens; identical to SEQ ID NO: 119542

SEQ ID NO: 540861 - RNA, 64 nt, Homo Sapiens; identical to SEQ ID NO: 119543

SEQ ID NO: 540862 - RNA, 64 nt, Homo Sapiens; identical to SEQ ID NO: 119544

SEQ ID NO: 540863 - RNA, 64 nt, Homo Sapiens; identical to SEQ ID NO: 119545

SEQ ID NO: 540864 - RNA, 64 nt, Homo Sapiens; identical to SEQ ID NO: 119546

SEQ ID NO: 540865 - RNA, 64 nt, Homo Sapiens; identical to SEQ ID NO: 119547

SEQ ID NO: 540866 - RNA, 64 nt, Homo Sapiens; identical to SEQ ID NO: 119548

SEQ ID NO: 540867 - RNA, 64 nt, Homo Sapiens; identical to SEQ ID NO: 119549

SEQ ID NO: 540868 - RNA, 64 nt, Homo Sapiens; identical to SEQ ID NO: 119550

SEQ ID NO: 540869 - RNA, 64 nt, Homo Sapiens; identical to SEQ ID NO: 119551

SEQ ID NO: 540870 - RNA, 64 nt, Homo Sapiens; identical to SEQ ID NO: 119552

SEQ ID NO: 540871 - RNA, 64 nt, Homo Sapiens; identical to SEQ ID NO: 119553

SEQ ID NO: 540872 - RNA, 64 nt, Homo Sapiens; identical to SEQ ID NO: 119554

SEQ ID NO: 540873 - RNA, 64 nt, Homo Sapiens; identical to SEQ ID NO: 119555

SEQ ID NO: 540874 - RNA, 64 nt, Homo Sapiens; identical to SEQ ID NO: 119556

SEQ ID NO: 540875 - RNA, 64 nt, Homo Sapiens; identical to SEQ ID NO: 119557

SEQ ID NO: 540876 - RNA, 64 nt, Homo Sapiens; identical to SEQ ID NO: 119558

SEQ ID NO: 540877 - RNA, 64 nt, Homo Sapiens; identical to SEQ ID NO: 119559

SEQ ID NO: 540878 - RNA, 64 nt, Homo Sapiens; identical to SEQ ID NO: 119560

SEQ ID NO: 540879 - RNA, 64 nt, Homo Sapiens; identical to SEQ ID NO: 119561

SEQ ID NO: 540880 - RNA, 64 nt, Homo Sapiens; identical to SEQ ID NO: 119562

SEQ ID NO: 540881 - RNA, 64 nt, Homo Sapiens; identical to SEQ ID NO: 119563

SEQ ID NO: 540882 - RNA, 64 nt, Homo Sapiens; identical to SEQ ID NO: 119564

SEQ ID NO: 540883 - RNA, 64 nt, Homo Sapiens; identical to SEQ ID NO: 119565

SEQ ID NO: 540884 - RNA, 64 nt, Homo Sapiens; identical to SEQ ID NO: 119566

SEQ ID NO: 540885 - RNA, 64 nt, Homo Sapiens; identical to SEQ ID NO: 119567

SEQ ID NO: 540886 - RNA, 64 nt, Homo Sapiens; identical to SEQ ID NO: 119568

SEQ ID NO: 540887 - RNA, 64 nt, Homo Sapiens; identical to SEQ ID NO: 119569

SEQ ID NO: 540888 - RNA, 64 nt, Homo Sapiens; identical to SEQ ID NO: 119570

SEQ ID NO: 540889 - RNA, 64 nt, Homo Sapiens; identical to SEQ ID NO: 119571

SEQ ID NO: 540890 - RNA, 64 nt, Homo Sapiens; identical to SEQ ID NO: 119572

SEQ ID NO: 540891 - RNA, 64 nt, Homo Sapiens; identical to SEQ ID NO: 119573

SEQ ID NO: 540892 - RNA, 64 nt, Homo Sapiens; identical to SEQ ID NO: 119574

SEQ ID NO: 540893 - RNA, 64 nt, Homo Sapiens; identical to SEQ ID NO: 119575

SEQ ID NO: 540894 - RNA, 64 nt, Homo Sapiens; identical to SEQ ID NO: 119576

SEQ ID NO: 540895 - RNA, 64 nt, Homo Sapiens; identical to SEQ ID NO: 119577

SEQ ID NO: 540896 - RNA, 64 nt, Homo Sapiens; identical to SEQ ID NO: 119578

SEQ ID NO: 540897 - RNA, 64 nt, Homo Sapiens; identical to SEQ ID NO: 119579

SEQ ID NO: 540898 - RNA, 64 nt, Homo Sapiens; identical to SEQ ID NO: 119580

SEQ ID NO: 540899 - RNA, 64 nt, Homo Sapiens; identical to SEQ ID NO: 119581

SEQ ID NO: 540900 - RNA, 64 nt, Homo Sapiens; identical to SEQ ID NO: 119582

SEQ ID NO: 540901 - RNA, 64 nt, Homo Sapiens; identical to SEQ ID NO: 119583

SEQ ID NO: 540902 - RNA, 64 nt, Homo Sapiens; identical to SEQ ID NO: 119584

SEQ ID NO: 540903 - RNA, 64 nt, Homo Sapiens; identical to SEQ ID NO: 119585

SEQ ID NO: 540904 - RNA, 64 nt, Homo Sapiens; identical to SEQ ID NO: 119586

SEQ ID NO: 540905 - RNA, 64 nt, Homo Sapiens; identical to SEQ ID NO: 119587

SEQ ID NO: 540906 - RNA, 64 nt, Homo Sapiens; identical to SEQ ID NO: 119588

SEQ ID NO: 540907 - RNA, 64 nt, Homo Sapiens; identical to SEQ ID NO: 119589

SEQ ID NO: 540908 - RNA, 64 nt, Homo Sapiens; identical to SEQ ID NO: 119590

SEQ ID NO: 540909 - RNA, 64 nt, Homo Sapiens; identical to SEQ ID NO: 119591

SEQ ID NO: 540910 - RNA, 64 nt, Homo Sapiens; identical to SEQ ID NO: 119592

SEQ ID NO: 540911 - RNA, 64 nt, Homo Sapiens; identical to SEQ ID NO: 119593

SEQ ID NO: 540912 - RNA, 64 nt, Homo Sapiens; identical to SEQ ID NO: 119594

SEQ ID NO: 540913 - RNA, 64 nt, Homo Sapiens; identical to SEQ ID NO: 119595

SEQ ID NO: 540914 - RNA, 64 nt, Homo Sapiens; identical to SEQ ID NO: 119596

SEQ ID NO: 540915 - RNA, 64 nt, Homo Sapiens; identical to SEQ ID NO: 119597

SEQ ID NO: 540916 - RNA, 64 nt, Homo Sapiens; identical to SEQ ID NO: 205933

SEQ ID NO: 540917 - RNA, 64 nt, Homo Sapiens; identical to SEQ ID NO: 205934

SEQ ID NO: 540918 - RNA, 64 nt, Homo Sapiens; identical to SEQ ID NO: 205935

SEQ ID NO: 540919 - RNA, 64 nt, Homo Sapiens; identical to SEQ ID NO: 205936

SEQ ID NO: 540920 - RNA, 64 nt, Homo Sapiens; identical to SEQ ID NO: 205937

SEQ ID NO: 540921 - RNA, 64 nt, Homo Sapiens; identical to SEQ ID NO: 205938

SEQ ID NO: 540922 - RNA, 64 nt, Homo Sapiens; identical to SEQ ID NO: 205939

SEQ ID NO: 540923 - RNA, 64 nt, Homo Sapiens; identical to SEQ ID NO: 205940

SEQ ID NO: 540924 - RNA, 64 nt, Homo Sapiens; identical to SEQ ID NO: 205941

SEQ ID NO: 540925 - RNA, 64 nt, Homo Sapiens; identical to SEQ ID NO: 205942

SEQ ID NO: 540926 - RNA, 64 nt, Homo Sapiens; identical to SEQ ID NO: 205943

SEQ ID NO: 540927 - RNA, 64 nt, Homo Sapiens; identical to SEQ ID NO: 205944

SEQ ID NO: 540928 - RNA, 64 nt, Homo Sapiens; identical to SEQ ID NO: 205945

SEQ ID NO: 540929 - RNA, 64 nt, Homo Sapiens; identical to SEQ ID NO: 205946

SEQ ID NO: 540930 - RNA, 64 nt, Homo Sapiens; identical to SEQ ID NO: 205947

SEQ ID NO: 540931 - RNA, 64 nt, Homo Sapiens; identical to SEQ ID NO: 205948

SEQ ID NO: 540932 - RNA, 64 nt, Homo Sapiens; identical to SEQ ID NO: 205949

SEQ ID NO: 540933 - RNA, 64 nt, Homo Sapiens; identical to SEQ ID NO: 205950

SEQ ID NO: 540934 - RNA, 64 nt, Homo Sapiens; identical to SEQ ID NO: 205951

SEQ ID NO: 540935 - RNA, 64 nt, Homo Sapiens; identical to SEQ ID NO: 205952

SEQ ID NO: 540936 - RNA, 64 nt, Homo Sapiens; identical to SEQ ID NO: 205953

SEQ ID NO: 540937 - RNA, 64 nt, Homo Sapiens; identical to SEQ ID NO: 205954

SEQ ID NO: 540938 - RNA, 64 nt, Homo Sapiens; identical to SEQ ID NO: 205955

SEQ ID NO: 540939 - RNA, 64 nt, Homo Sapiens; identical to SEQ ID NO: 205956

SEQ ID NO: 540940 - RNA, 64 nt, Homo Sapiens; identical to SEQ ID NO: 205957

SEQ ID NO: 540941 - RNA, 64 nt, Homo Sapiens; identical to SEQ ID NO: 205958

SEQ ID NO: 540942 - RNA, 64 nt, Homo Sapiens; identical to SEQ ID NO: 205959

SEQ ID NO: 540943 - RNA, 64 nt, Homo Sapiens; identical to SEQ ID NO: 205960

SEQ ID NO: 540944 - RNA, 64 nt, Homo Sapiens; identical to SEQ ID NO: 205961

SEQ ID NO: 540945 - RNA, 64 nt, Homo Sapiens; identical to SEQ ID NO: 205962

SEQ ID NO: 540946 - RNA, 64 nt, Homo Sapiens; identical to SEQ ID NO: 205963

SEQ ID NO: 540947 - RNA, 64 nt, Homo Sapiens; identical to SEQ ID NO: 205964

SEQ ID NO: 540948 - RNA, 64 nt, Homo Sapiens; identical to SEQ ID NO: 205965

SEQ ID NO: 540949 - RNA, 64 nt, Homo Sapiens; identical to SEQ ID NO: 205966

SEQ ID NO: 540950 - RNA, 64 nt, Homo Sapiens; identical to SEQ ID NO: 205967

SEQ ID NO: 540951 - RNA, 64 nt, Homo Sapiens; identical to SEQ ID NO: 205968

SEQ ID NO: 540952 - RNA, 64 nt, Homo Sapiens; identical to SEQ ID NO: 205969

SEQ ID NO: 540953 - RNA, 64 nt, Homo Sapiens; identical to SEQ ID NO: 205970

SEQ ID NO: 540954 - RNA, 64 nt, Homo Sapiens; identical to SEQ ID NO: 205971

SEQ ID NO: 540955 - RNA, 64 nt, Homo Sapiens; identical to SEQ ID NO: 205972

SEQ ID NO: 540956 - RNA, 64 nt, Homo Sapiens; identical to SEQ ID NO: 205973

SEQ ID NO: 540957 - RNA, 64 nt, Homo Sapiens; identical to SEQ ID NO: 205974

SEQ ID NO: 540958 - RNA, 64 nt, Homo Sapiens; identical to SEQ ID NO: 205975

SEQ ID NO: 540959 - RNA, 64 nt, Homo Sapiens; identical to SEQ ID NO: 205976

SEQ ID NO: 540960 - RNA, 64 nt, Homo Sapiens; identical to SEQ ID NO: 205977

SEQ ID NO: 540961 - RNA, 64 nt, Homo Sapiens; identical to SEQ ID NO: 205978

SEQ ID NO: 540962 - RNA, 64 nt, Homo Sapiens; identical to SEQ ID NO: 205979

SEQ ID NO: 540963 - RNA, 64 nt, Homo Sapiens; identical to SEQ ID NO: 205980

SEQ ID NO: 540964 - RNA, 64 nt, Homo Sapiens; identical to SEQ ID NO: 205981

SEQ ID NO: 540965 - RNA, 64 nt, Homo Sapiens; identical to SEQ ID NO: 205982

SEQ ID NO: 540966 - RNA, 64 nt, Homo Sapiens; identical to SEQ ID NO: 205983

SEQ ID NO: 540967 - RNA, 54 nt, Homo Sapiens; identical to SEQ ID NO: 205984

SEQ ID NO: 540968 - RNA, 64 nt, Homo Sapiens; identical to SEQ ID NO: 205985

SEQ ID NO: 540969 - RNA, 64 nt, Homo Sapiens; identical to SEQ ID NO: 205986

SEQ ID NO: 540970 - RNA, 64 nt, Homo Sapiens; identical to SEQ ID NO: 205987

SEQ ID NO: 540971 - RNA, 64 nt, Homo Sapiens; identical to SEQ ID NO: 205988

SEQ ID NO: 540972 - RNA, 64 nt, Homo Sapiens; identical to SEQ ID NO: 205989

SEQ ID NO: 540973 - RNA, 64 nt, Homo Sapiens
ccucaaagguaaauugcaguuguagacaccgaggaugguugacaacccaugguugagaugggca

SEQ ID NO: 540974 - RNA, 64 nt, Homo Sapiens
ugcaguuguagacaccgaggaugguugacaacccaugguugagaugggcaccguuuugcaggaa

SEQ ID NO: 540975 - RNA, 64 nt, Homo Sapiens
agcaaaugaaaggugguuuaguuauaagugaagcaugguugaauaccagcuggggagacacuag

SEQ ID NO: 540976 - RNA, 64 nt, Homo Sapiens
uuugaguguccagugaaacuuaugacuuggauauaugguugaagaaucaaaacaaaagcaaaaa

SEQ ID NO: 540977 - RNA, 64 nt, Homo Sapiens
ucagacccagacauagaaugacaggaacagagaaaugguugaugagauagcucuguagaaacac

SEQ ID NO: 540978 - RNA, 64 nt, Homo Sapiens
cuggacccagaucaagaaugauggguacagagaaaugguugauuagagaacucuguggauacuc

SEQ ID NO: 540979 - RNA, 64 nt, Homo Sapiens
uggcugugcuaugguuucuaggccugugugucucugugccuaugguguguguucuuggugcugu

SEQ ID NO: 540980 - RNA, 64 nt, Homo Sapiens
ccugggggaggucaguagggcuaugugcuguuggugugccuaugggcugggggcaucugccugu

SEQ ID NO: 540981 - RNA, 64 nt, Homo Sapiens
cuuuuagcugcguuacuaagaugucuuacucuacugugccuaugagcucauuugguuuaguuaa

SEQ ID NO: 540982 - RNA, 64 nt, Homo Sapiens
ucacagcucucuuggucacacuaaguauuuuaaaugugccuauuuagcuuuaaaauaacagggu

SEQ ID NO: 540983 - RNA, 64 nt, Homo Sapiens
cuuccucccucccugcccugcugaauccuaaagcugugccuauaucugugauuugaaugaggga

SEQ ID NO: 540984 - RNA, 64 nt, Homo Sapiens
cagacuuuuaaauagaugaccccuucagaucaucugugccuaccuccugcccaucaggcgucua

SEQ ID NO: 540985 - RNA, 64 nt, Homo Sapiens
uugccugaguucuucuacccaucucccccauuccugugccuacugcguuugucccuuggcucuc

SEQ ID NO: 540986 - RNA, 64 nt, Homo Sapiens
cuggaccuaauuauauggggcagcuguggcuuccugugccuagaagaagcccugaucagucaac

SEQ ID NO: 540987 - RNA, 64 nt, Homo Sapiens
uauuaugccuaacccugcccaacaaauuaagguuugugccuaaaauguuagauuggacuguaug

SEQ ID NO: 540988 - RNA, 64 nt, Homo Sapiens
ucaguacaaugcgucaaaaguugcugaaagaugcugugccuaugggguucuagagaguguugag

SEQ ID NO: 540989 - RNA, 64 nt, Homo Sapiens; identical to SEQ ID NO: 182986

SEQ ID NO: 540990 - RNA, 64 nt, Homo Sapiens; identical to SEQ ID NO: 182987

SEQ ID NO: 540991 - RNA, 64 nt, Homo Sapiens; identical to SEQ ID NO: 182988

SEQ ID NO: 540992 - RNA, 64 nt, Homo Sapiens; identical to SEQ ID NO: 182989

SEQ ID NO: 540993 - RNA, 64 nt, Homo Sapiens; identical to SEQ ID NO: 182990

SEQ ID NO: 540994 - RNA, 64 nt, Homo Sapiens; identical to SEQ ID NO: 182991

SEQ ID NO: 540995 - RNA, 64 nt, Homo Sapiens; identical to SEQ ID NO: 182992

SEQ ID NO: 540996 - RNA, 64 nt, Homo Sapiens; identical to SEQ ID NO: 182993

SEQ ID NO: 540997 - RNA, 64 nt, Homo Sapiens; identical to SEQ ID NO: 182994

SEQ ID NO: 540998 - RNA, 64 nt, Homo Sapiens; identical to SEQ ID NO: 182995

SEQ ID NO: 540999 - RNA, 64 nt, Homo Sapiens; identical to SEQ ID NO: 182996

SEQ ID NO: 541000 - RNA, 64 nt, Homo Sapiens; identical to SEQ ID NO: 182997

SEQ ID NO: 541001 - RNA, 64 nt, Homo Sapiens; identical to SEQ ID NO: 182998

SEQ ID NO: 541002 - RNA, 64 nt, Homo Sapiens; identical to SEQ ID NO: 182999

SEQ ID NO: 541003 - RNA, 64 nt, Homo Sapiens; identical to SEQ ID NO: 183000

SEQ ID NO: 541004 - RNA, 64 nt, Homo Sapiens; identical to SEQ ID NO: 183001

SEQ ID NO: 541005 - RNA, 64 nt, Homo Sapiens; identical to SEQ ID NO: 183002

SEQ ID NO: 541006 - RNA, 64 nt, Homo Sapiens; identical to SEQ ID NO: 183003

SEQ ID NO: 541007 - RNA, 64 nt, Homo Sapiens; identical to SEQ ID NO: 183004

SEQ ID NO: 541008 - RNA, 64 nt, Homo Sapiens; identical to SEQ ID NO: 183005

SEQ ID NO: 541009 - RNA, 64 nt, Homo Sapiens; identical to SEQ ID NO: 183006

SEQ ID NO: 541010 - RNA, 64 nt, Homo Sapiens; identical to SEQ ID NO: 183007

SEQ ID NO: 541011 - RNA, 64 nt, Homo Sapiens; identical to SEQ ID NO: 183008

SEQ ID NO: 541012 - RNA, 64 nt, Homo Sapiens; identical to SEQ ID NO: 183009

SEQ ID NO: 541013 - RNA, 64 nt, Homo Sapiens; identical to SEQ ID NO: 183010

SEQ ID NO: 541014 - RNA, 64 nt, Homo Sapiens; identical to SEQ ID NO: 183011

SEQ ID NO: 541015 - RNA, 64 nt, Homo Sapiens; identical to SEQ ID NO: 183012

SEQ ID NO: 541016 - RNA, 64 nt, Homo Sapiens; identical to SEQ ID NO: 183013

SEQ ID NO: 541017 - RNA, 64 nt, Homo Sapiens; identical to SEQ ID NO: 183014

SEQ ID NO: 541018 - RNA, 64 nt, Homo Sapiens; identical to SEQ ID NO: 183015

SEQ ID NO: 541019 - RNA, 64 nt, Homo Sapiens; identical to SEQ ID NO: 183016

SEQ ID NO: 541020 - RNA, 64 nt, Homo Sapiens; identical to SEQ ID NO: 183017

SEQ ID NO: 541021 - RNA, 64 nt, Homo Sapiens; identical to SEQ ID NO: 183018

SEQ ID NO: 541022 - RNA, 64 nt, Homo Sapiens; identical to SEQ ID NO: 183019

SEQ ID NO: 541023 - RNA, 64 nt, Homo Sapiens; identical to SEQ ID NO: 183020

SEQ ID NO: 541024 - RNA, 64 nt, Homo Sapiens; identical to SEQ ID NO: 183021

SEQ ID NO: 541025 - RNA, 64 nt, Homo Sapiens; identical to SEQ ID NO: 183022

SEQ ID NO: 541026 - RNA, 64 nt, Homo Sapiens; identical to SEQ ID NO: 183023

SEQ ID NO: 541027 - RNA, 64 nt, Homo Sapiens; identical to SEQ ID NO: 183024

SEQ ID NO: 541028 - RNA, 64 nt, Homo Sapiens; identical to SEQ ID NO: 183025

SEQ ID NO: 541029 - RNA, 64 nt, Homo Sapiens; identical to SEQ ID NO: 183026

SEQ ID NO: 541030 - RNA, 64 nt, Homo Sapiens; identical to SEQ ID NO: 183027

SEQ ID NO: 541031 - RNA, 64 nt, Homo Sapiens; identical to SEQ ID NO: 183028

SEQ ID NO: 541032 - RNA, 64 nt, Homo Sapiens; identical to SEQ ID NO: 183029

SEQ ID NO: 541033 - RNA, 64 nt, Homo Sapiens; identical to SEQ ID NO: 183030

SEQ ID NO: 541034 - RNA, 64 nt, Homo Sapiens; identical to SEQ ID NO: 183031

SEQ ID NO: 541035 - RNA, 64 nt, Homo Sapiens; identical to SEQ ID NO: 183032

SEQ ID NO: 541036 - RNA, 64 nt, Homo Sapiens; identical to SEQ ID NO: 183033

SEQ ID NO: 541037 - RNA, 64 nt, Homo Sapiens; identical to SEQ ID NO: 183034

SEQ ID NO: 541038 - RNA, 64 nt, Homo Sapiens; identical to SEQ ID NO: 183035

SEQ ID NO: 541039 - RNA, 64 nt, Homo Sapiens; identical to SEQ ID NO: 183036

SEQ ID NO: 541040 - RNA, 64 nt, Homo Sapiens; identical to SEQ ID NO: 183037

SEQ ID NO: 541041 - RNA, 64 nt, Homo Sapiens; identical to SEQ ID NO: 183038

SEQ ID NO: 541042 - RNA, 64 nt, Homo Sapiens; identical to SEQ ID NO: 183039

SEQ ID NO: 541043 - RNA, 64 nt, Homo Sapiens; identical to SEQ ID NO: 183040

SEQ ID NO: 541044 - RNA, 64 nt, Homo Sapiens; identical to SEQ ID NO: 183041

SEQ ID NO: 541045 - RNA, 64 nt, Homo Sapiens; identical to SEQ ID NO: 183042

SEQ ID NO: 541046 - RNA, 64 nt, Homo Sapiens; identical to SEQ ID NO: 183043

SEQ ID NO: 541047 - RNA, 64 nt, Homo Sapiens; identical to SEQ ID NO: 183044

SEQ ID NO: 541048 - RNA, 64 nt, Homo Sapiens; identical to SEQ ID NO: 183045

SEQ ID NO: 541049 - RNA, 64 nt, Homo Sapiens; identical to SEQ ID NO: 183046

SEQ ID NO: 541050 - RNA, 64 nt, Homo Sapiens; identical to SEQ ID NO: 183047

SEQ ID NO: 541051 - RNA, 64 nt, Homo Sapiens; identical to SEQ ID NO: 183048

SEQ ID NO: 541052 - RNA, 64 nt, Homo Sapiens; identical to SEQ ID NO: 183049

SEQ ID NO: 541053 - RNA, 64 nt, Homo Sapiens; identical to SEQ ID NO: 183050

SEQ ID NO: 541054 - RNA, 64 nt, Homo Sapiens; identical to SEQ ID NO: 183051

SEQ ID NO: 541055 - RNA, 64 nt, Homo Sapiens; identical to SEQ ID NO: 183052

SEQ ID NO: 541056 - RNA, 64 nt, Homo Sapiens; identical to SEQ ID NO: 183053

SEQ ID NO: 541057 - RNA, 64 nt, Homo Sapiens; identical to SEQ ID NO: 183054

SEQ ID NO: 541058 - RNA, 64 nt, Homo Sapiens; identical to SEQ ID NO: 183055

SEQ ID NO: 541059 - RNA, 64 nt, Homo Sapiens; identical to SEQ ID NO: 183056

SEQ ID NO: 541060 - RNA, 64 nt, Homo Sapiens; identical to SEQ ID NO: 183057

SEQ ID NO: 541061 - RNA, 64 nt, Homo Sapiens; identical to SEQ ID NO: 183058

SEQ ID NO: 541062 - RNA, 64 nt, Homo Sapiens; identical to SEQ ID NO: 183059

SEQ ID NO: 541063 - RNA, 64 nt, Homo Sapiens; identical to SEQ ID NO: 183060

SEQ ID NO: 541064 - RNA, 64 nt, Homo Sapiens; identical to SEQ ID NO: 183061

SEQ ID NO: 541065 - RNA, 64 nt, Homo Sapiens; identical to SEQ ID NO: 183062

SEQ ID NO: 541066 - RNA, 64 nt, Homo Sapiens; identical to SEQ ID NO: 183063

SEQ ID NO: 541067 - RNA, 64 nt, Homo Sapiens; identical to SEQ ID NO: 183064

SEQ ID NO: 541068 - RNA, 64 nt, Homo Sapiens; identical to SEQ ID NO: 183065

SEQ ID NO: 541069 - RNA, 64 nt, Homo Sapiens; identical to SEQ ID NO: 183066

SEQ ID NO: 541070 - RNA, 64 nt, Homo Sapiens; identical to SEQ ID NO: 183067

SEQ ID NO: 541071 - RNA, 64 nt, Homo Sapiens; identical to SEQ ID NO: 183068

SEQ ID NO: 541072 - RNA, 64 nt, Homo Sapiens; identical to SEQ ID NO: 183069

SEQ ID NO: 541073 - RNA, 64 nt, Homo Sapiens; identical to SEQ ID NO: 183070

SEQ ID NO: 541074 - RNA, 64 nt, Homo Sapiens; identical to SEQ ID NO: 183071

SEQ ID NO: 541075 - RNA, 64 nt, Homo Sapiens; identical to SEQ ID NO: 183072

SEQ ID NO: 541076 - RNA, 64 nt, Homo Sapiens; identical to SEQ ID NO: 183073

SEQ ID NO: 541077 - RNA, 64 nt, Homo Sapiens; identical to SEQ ID NO: 183074

SEQ ID NO: 541078 - RNA, 64 nt, Homo Sapiens; identical to SEQ ID NO: 183075

SEQ ID NO: 541079 - RNA, 64 nt, Homo Sapiens; identical to SEQ ID NO: 183076

SEQ ID NO: 541080 - RNA, 64 nt, Homo Sapiens; identical to SEQ ID NO: 183077

SEQ ID NO: 541081 - RNA, 64 nt, Homo Sapiens; identical to SEQ ID NO: 183078

SEQ ID NO: 541082 - RNA, 64 nt, Homo Sapiens; identical to SEQ ID NO: 183079

SEQ ID NO: 541083 - RNA, 64 nt, Homo Sapiens; identical to SEQ ID NO: 183080

SEQ ID NO: 541084 - RNA, 64 nt, Homo Sapiens; identical to SEQ ID NO: 183081

SEQ ID NO: 541085 - RNA, 64 nt, Homo Sapiens; identical to SEQ ID NO: 183082

SEQ ID NO: 541086 - RNA, 64 nt, Homo Sapiens; identical to SEQ ID NO: 183083

SEQ ID NO: 541087 - RNA, 64 nt, Homo Sapiens; identical to SEQ ID NO: 183084

SEQ ID NO: 541088 - RNA, 64 nt, Homo Sapiens; identical to SEQ ID NO: 183085

SEQ ID NO: 541089 - RNA, 64 nt, Homo Sapiens; identical to SEQ ID NO: 183086

SEQ ID NO: 541090 - RNA, 64 nt, Homo Sapiens; identical to SEQ ID NO: 183087

SEQ ID NO: 541091 - RNA, 64 nt, Homo Sapiens; identical to SEQ ID NO: 183088

SEQ ID NO: 541092 - RNA, 64 nt, Homo Sapiens; identical to SEQ ID NO: 183089

SEQ ID NO: 541093 - RNA, 64 nt, Homo Sapiens; identical to SEQ ID NO: 183090

SEQ ID NO: 541094 - RNA, 64 nt, Homo Sapiens; identical to SEQ ID NO: 183091

SEQ ID NO: 541095 - RNA, 64 nt, Homo Sapiens; identical to SEQ ID NO: 183092

SEQ ID NO: 541096 - RNA, 64 nt, Homo Sapiens; identical to SEQ ID NO: 183093

SEQ ID NO: 541097 - RNA, 64 nt, Homo Sapiens; identical to SEQ ID NO: 183094

SEQ ID NO: 541098 - RNA, 64 nt, Homo Sapiens; identical to SEQ ID NO: 183095

SEQ ID NO: 541099 - RNA, 64 nt, Homo Sapiens; identical to SEQ ID NO: 183096

SEQ ID NO: 541100 - RNA, 64 nt, Homo Sapiens; identical to SEQ ID NO: 183097

SEQ ID NO: 541101 - RNA, 64 nt, Homo Sapiens; identical to SEQ ID NO: 183098

SEQ ID NO: 541102 - RNA, 64 nt, Homo Sapiens; identical to SEQ ID NO: 183099

SEQ ID NO: 541103 - RNA, 64 nt, Homo Sapiens; identical to SEQ ID NO: 183100

SEQ ID NO: 541104 - RNA, 64 nt, Homo Sapiens; identical to SEQ ID NO: 183101

SEQ ID NO: 541105 - RNA, 64 nt, Homo Sapiens; identical to SEQ ID NO: 183102

SEQ ID NO: 541106 - RNA, 64 nt, Homo Sapiens; identical to SEQ ID NO: 183103

SEQ ID NO: 541107 - RNA, 64 nt, Homo Sapiens; identical to SEQ ID NO: 183104

SEQ ID NO: 541108 - RNA, 64 nt, Homo Sapiens; identical to SEQ ID NO: 183105

SEQ ID NO: 541109 - RNA, 64 nt, Homo Sapiens; identical to SEQ ID NO: 183106

SEQ ID NO: 541110 - RNA, 64 nt, Homo Sapiens; identical to SEQ ID NO: 183107

SEQ ID NO: 541111 - RNA, 64 nt, Homo Sapiens; identical to SEQ ID NO: 183108

SEQ ID NO: 541112 - RNA, 64 nt, Homo Sapiens; identical to SEQ ID NO: 183109

SEQ ID NO: 541113 - RNA, 64 nt, Homo Sapiens; identical to SEQ ID NO: 183110

SEQ ID NO: 541114 - RNA, 64 nt, Homo Sapiens; identical to SEQ ID NO: 183111

SEQ ID NO: 541115 - RNA, 64 nt, Homo Sapiens; identical to SEQ ID NO: 183112

SEQ ID NO: 541116 - RNA, 64 nt, Homo Sapiens; identical to SEQ ID NO: 183113

SEQ ID NO: 541117 - RNA, 64 nt, Homo Sapiens; identical to SEQ ID NO: 183114

SEQ ID NO: 541118 - RNA, 64 nt, Homo Sapiens; identical to SEQ ID NO: 183115

SEQ ID NO: 541119 - RNA, 64 nt, Homo Sapiens; identical to SEQ ID NO: 183116

SEQ ID NO: 541120 - RNA, 64 nt, Homo Sapiens; identical to SEQ ID NO: 183117

SEQ ID NO: 541121 - RNA, 64 nt, Homo Sapiens; identical to SEQ ID NO: 183118

SEQ ID NO: 541122 - RNA, 64 nt, Homo Sapiens; identical to SEQ ID NO: 183119

SEQ ID NO: 541123 - RNA, 64 nt, Homo Sapiens; identical to SEQ ID NO: 183120

SEQ ID NO: 541124 - RNA, 64 nt, Homo Sapiens; identical to SEQ ID NO: 183121

SEQ ID NO: 541125 - RNA, 64 nt, Homo Sapiens; identical to SEQ ID NO: 183122

SEQ ID NO: 541126 - RNA, 64 nt, Homo Sapiens; identical to SEQ ID NO: 183123

SEQ ID NO: 541127 - RNA, 64 nt, Homo Sapiens; identical to SEQ ID NO: 183124

SEQ ID NO: 541128 - RNA, 64 nt, Homo Sapiens; identical to SEQ ID NO: 183125

SEQ ID NO: 541129 - RNA, 64 nt, Homo Sapiens; identical to SEQ ID NO: 183126

SEQ ID NO: 541130 - RNA, 64 nt, Homo Sapiens; identical to SEQ ID NO: 183127

SEQ ID NO: 541131 - RNA, 64 nt, Homo Sapiens; identical to SEQ ID NO: 183128

SEQ ID NO: 541132 - RNA, 64 nt, Homo Sapiens; identical to SEQ ID NO: 183129

SEQ ID NO: 541133 - RNA, 64 nt, Homo Sapiens; identical to SEQ ID NO: 183130

SEQ ID NO: 541134 - RNA, 64 nt, Homo Sapiens; identical to SEQ ID NO: 183131

SEQ ID NO: 541135 - RNA, 64 nt, Homo Sapiens; identical to SEQ ID NO: 183132

SEQ ID NO: 541136 - RNA, 64 nt, Homo Sapiens; identical to SEQ ID NO: 183133

SEQ ID NO: 541137 - RNA, 64 nt, Homo Sapiens; identical to SEQ ID NO: 183134

SEQ ID NO: 541138 - RNA, 64 nt, Homo Sapiens; identical to SEQ ID NO: 183135

SEQ ID NO: 541139 - RNA, 64 nt, Homo Sapiens; identical to SEQ ID NO: 183136

SEQ ID NO: 541140 - RNA, 64 nt, Homo Sapiens; identical to SEQ ID NO: 183137

SEQ ID NO: 541141 - RNA, 64 nt, Homo Sapiens; identical to SEQ ID NO: 183138

SEQ ID NO: 541142 - RNA, 64 nt, Homo Sapiens; identical to SEQ ID NO: 183139

SEQ ID NO: 541143 - RNA, 64 nt, Homo Sapiens; identical to SEQ ID NO: 183140

SEQ ID NO: 541144 - RNA, 64 nt, Homo Sapiens; identical to SEQ ID NO: 183141

SEQ ID NO: 541145 - RNA, 64 nt, Homo Sapiens; identical to SEQ ID NO: 183142

SEQ ID NO: 541146 - RNA, 64 nt, Homo Sapiens; identical to SEQ ID NO: 183143

SEQ ID NO: 541147 - RNA, 64 nt, Homo Sapiens; identical to SEQ ID NO: 183144

SEQ ID NO: 541148 - RNA, 64 nt, Homo Sapiens; identical to SEQ ID NO: 183145

SEQ ID NO: 541149 - RNA, 64 nt, Homo Sapiens; identical to SEQ ID NO: 183146

SEQ ID NO: 541150 - RNA, 64 nt, Homo Sapiens; identical to SEQ ID NO: 183147

SEQ ID NO: 541151 - RNA, 64 nt, Homo Sapiens; identical to SEQ ID NO: 183148

SEQ ID NO: 541152 - RNA, 64 nt, Homo Sapiens; identical to SEQ ID NO: 183149

SEQ ID NO: 541153 - RNA, 64 nt, Homo Sapiens; identical to SEQ ID NO: 183150

SEQ ID NO: 541154 - RNA, 64 nt, Homo Sapiens; identical to SEQ ID NO: 183151

SEQ ID NO: 541155 - RNA, 64 nt, Homo Sapiens; identical to SEQ ID NO: 183152

SEQ ID NO: 541156 - RNA, 64 nt, Homo Sapiens; identical to SEQ ID NO: 183153

SEQ ID NO: 541157 - RNA, 64 nt, Homo Sapiens; identical to SEQ ID NO: 183154

SEQ ID NO: 541158 - RNA, 64 nt, Homo Sapiens; identical to SEQ ID NO: 183155

SEQ ID NO: 541159 - RNA, 64 nt, Homo Sapiens; identical to SEQ ID NO: 183156

SEQ ID NO: 541160 - RNA, 64 nt, Homo Sapiens; identical to SEQ ID NO: 183157

SEQ ID NO: 541161 - RNA, 64 nt, Homo Sapiens; identical to SEQ ID NO: 183158

SEQ ID NO: 541162 - RNA, 64 nt, Homo Sapiens; identical to SEQ ID NO: 183159

SEQ ID NO: 541163 - RNA, 64 nt, Homo Sapiens; identical to SEQ ID NO: 183160

SEQ ID NO: 541164 - RNA, 64 nt, Homo Sapiens; identical to SEQ ID NO: 183161

SEQ ID NO: 541165 - RNA, 64 nt, Homo Sapiens; identical to SEQ ID NO: 183162

SEQ ID NO: 541166 - RNA, 64 nt, Homo Sapiens; identical to SEQ ID NO: 183163

SEQ ID NO: 541167 - RNA, 64 nt, Homo Sapiens; identical to SEQ ID NO: 183164

SEQ ID NO: 541168 - RNA, 64 nt, Homo Sapiens; identical to SEQ ID NO: 183165

SEQ ID NO: 541169 - RNA, 64 nt, Homo Sapiens; identical to SEQ ID NO: 183166

SEQ ID NO: 541170 - RNA, 64 nt, Homo Sapiens; identical to SEQ ID NO: 183167

SEQ ID NO: 541171 - RNA, 64 nt, Homo Sapiens; identical to SEQ ID NO: 183168

SEQ ID NO: 541172 - RNA, 64 nt, Homo Sapiens; identical to SEQ ID NO: 183169

SEQ ID NO: 541173 - RNA, 64 nt, Homo Sapiens; identical to SEQ ID NO: 183170

SEQ ID NO: 541174 - RNA, 64 nt, Homo Sapiens; identical to SEQ ID NO: 183171

SEQ ID NO: 541175 - RNA, 64 nt, Homo Sapiens; identical to SEQ ID NO: 183172

SEQ ID NO: 541176 - RNA, 64 nt, Homo Sapiens; identical to SEQ ID NO: 183173

SEQ ID NO: 541177 - RNA, 64 nt, Homo Sapiens; identical to SEQ ID NO: 183174

SEQ ID NO: 541178 - RNA, 64 nt, Homo Sapiens; identical to SEQ ID NO: 183175

SEQ ID NO: 541179 - RNA, 64 nt, Homo Sapiens; identical to SEQ ID NO: 183176

SEQ ID NO: 541180 - RNA, 64 nt, Homo Sapiens; identical to SEQ ID NO: 183177

SEQ ID NO: 541181 - RNA, 64 nt, Homo Sapiens; identical to SEQ ID NO: 183178

SEQ ID NO: 541182 - RNA, 64 nt, Homo Sapiens; identical to SEQ ID NO: 183179

SEQ ID NO: 541183 - RNA, 64 nt, Homo Sapiens; identical to SEQ ID NO: 183180

SEQ ID NO: 541184 - RNA, 64 nt, Homo Sapiens; identical to SEQ ID NO: 183181

SEQ ID NO: 541185 - RNA, 64 nt, Homo Sapiens; identical to SEQ ID NO: 183182

SEQ ID NO: 541186 - RNA, 64 nt, Homo Sapiens; identical to SEQ ID NO: 183183

SEQ ID NO: 541187 - RNA, 64 nt, Homo Sapiens; identical to SEQ ID NO: 183184

SEQ ID NO: 541188 - RNA, 64 nt, Homo Sapiens; identical to SEQ ID NO: 183185

SEQ ID NO: 541189 - RNA, 64 nt, Homo Sapiens; identical to SEQ ID NO: 183186

SEQ ID NO: 541190 - RNA, 64 nt, Homo Sapiens; identical to SEQ ID NO: 183187

SEQ ID NO: 541191 - RNA, 64 nt, Homo Sapiens; identical to SEQ ID NO: 183188

SEQ ID NO: 541192 - RNA, 64 nt, Homo Sapiens; identical to SEQ ID NO: 183189

SEQ ID NO: 541193 - RNA, 64 nt, Homo Sapiens; identical to SEQ ID NO: 183190

SEQ ID NO: 541194 - RNA, 64 nt, Homo Sapiens; identical to SEQ ID NO: 183191

SEQ ID NO: 541195 - RNA, 64 nt, Homo Sapiens; identical to SEQ ID NO: 183192

SEQ ID NO: 541196 - RNA, 64 nt, Homo Sapiens; identical to SEQ ID NO: 183193

SEQ ID NO: 541197 - RNA, 64 nt, Homo Sapiens; identical to SEQ ID NO: 183194

SEQ ID NO: 541198 - RNA, 64 nt, Homo Sapiens; identical to SEQ ID NO: 183195

SEQ ID NO: 541199 - RNA, 64 nt, Homo Sapiens; identical to SEQ ID NO: 183196

SEQ ID NO: 541200 - RNA, 64 nt, Homo Sapiens; identical to SEQ ID NO: 183197

SEQ ID NO: 541201 - RNA, 64 nt, Homo Sapiens; identical to SEQ ID NO: 183198

SEQ ID NO: 541202 - RNA, 64 nt, Homo Sapiens; identical to SEQ ID NO: 183199

SEQ ID NO: 541203 - RNA, 64 nt, Homo Sapiens; identical to SEQ ID NO: 183200

SEQ ID NO: 541204 - RNA, 64 nt, Homo Sapiens; identical to SEQ ID NO: 183201

SEQ ID NO: 541205 - RNA, 64 nt, Homo Sapiens; identical to SEQ ID NO: 183202

SEQ ID NO: 541206 - RNA, 64 nt, Homo Sapiens; identical to SEQ ID NO: 183203

SEQ ID NO: 541207 - RNA, 64 nt, Homo Sapiens; identical to SEQ ID NO: 183204

SEQ ID NO: 541208 - RNA, 64 nt, Homo Sapiens; identical to SEQ ID NO: 183205

SEQ ID NO: 541209 - RNA, 64 nt, Homo Sapiens; identical to SEQ ID NO: 183206

SEQ ID NO: 541210 - RNA, 64 nt, Homo Sapiens; identical to SEQ ID NO: 183207

SEQ ID NO: 541211 - RNA, 64 nt, Homo Sapiens; identical to SEQ ID NO: 183208

SEQ ID NO: 541212 - RNA, 64 nt, Homo Sapiens; identical to SEQ ID NO: 183209

SEQ ID NO: 541213 - RNA, 64 nt, Homo Sapiens; identical to SEQ ID NO: 183210

SEQ ID NO: 541214 - RNA, 64 nt, Homo Sapiens; identical to SEQ ID NO: 183211

SEQ ID NO: 541215 - RNA, 64 nt, Homo Sapiens; identical to SEQ ID NO: 183212

SEQ ID NO: 541216 - RNA, 64 nt, Homo Sapiens; identical to SEQ ID NO: 183213

SEQ ID NO: 541217 - RNA, 64 nt, Homo Sapiens; identical to SEQ ID NO: 183214

SEQ ID NO: 541218 - RNA, 64 nt, Homo Sapiens; identical to SEQ ID NO: 183215

SEQ ID NO: 541219 - RNA, 64 nt, Homo Sapiens; identical to SEQ ID NO: 183216

SEQ ID NO: 541220 - RNA, 64 nt, Homo Sapiens; identical to SEQ ID NO: 183217

SEQ ID NO: 541221 - RNA, 64 nt, Homo Sapiens; identical to SEQ ID NO: 183218

SEQ ID NO: 541222 - RNA, 64 nt, Homo Sapiens; identical to SEQ ID NO: 183219

SEQ ID NO: 541223 - RNA, 64 nt, Homo Sapiens; identical to SEQ ID NO: 183220

SEQ ID NO: 541224 - RNA, 64 nt, Homo Sapiens; identical to SEQ ID NO: 183221

SEQ ID NO: 541225 - RNA, 64 nt, Homo Sapiens; identical to SEQ ID NO: 183222

SEQ ID NO: 541226 - RNA, 64 nt, Homo Sapiens; identical to SEQ ID NO: 183223

SEQ ID NO: 541227 - RNA, 64 nt, Homo Sapiens; identical to SEQ ID NO: 183224

SEQ ID NO: 541228 - RNA, 64 nt, Homo Sapiens; identical to SEQ ID NO: 183225

SEQ ID NO: 541229 - RNA, 64 nt, Homo Sapiens; identical to SEQ ID NO: 183226

SEQ ID NO: 541230 - RNA, 64 nt, Homo Sapiens; identical to SEQ ID NO: 183227

SEQ ID NO: 541231 - RNA, 64 nt, Homo Sapiens; identical to SEQ ID NO: 183228

SEQ ID NO: 541232 - RNA, 64 nt, Homo Sapiens; identical to SEQ ID NO: 183229

SEQ ID NO: 541233 - RNA, 64 nt, Homo Sapiens; identical to SEQ ID NO: 183230

SEQ ID NO: 541234 - RNA, 64 nt, Homo Sapiens; identical to SEQ ID NO: 183231

SEQ ID NO: 541235 - RNA, 64 nt, Homo Sapiens; identical to SEQ ID NO: 183232

SEQ ID NO: 541236 - RNA, 64 nt, Homo Sapiens; identical to SEQ ID NO: 183233

SEQ ID NO: 541237 - RNA, 64 nt, Homo Sapiens; identical to SEQ ID NO: 183234

SEQ ID NO: 541238 - RNA, 64 nt, Homo Sapiens; identical to SEQ ID NO: 183235

SEQ ID NO: 541239 - RNA, 64 nt, Homo Sapiens; identical to SEQ ID NO: 183236

SEQ ID NO: 541240 - RNA, 64 nt, Homo Sapiens; identical to SEQ ID NO: 183237

SEQ ID NO: 541241 - RNA, 64 nt, Homo Sapiens; identical to SEQ ID NO: 183238

SEQ ID NO: 541242 - RNA, 64 nt, Homo Sapiens; identical to SEQ ID NO: 183239

SEQ ID NO: 541243 - RNA, 64 nt, Homo Sapiens; identical to SEQ ID NO: 183240

SEQ ID NO: 541244 - RNA, 64 nt, Homo Sapiens; identical to SEQ ID NO: 183241

SEQ ID NO: 541245 - RNA, 64 nt, Homo Sapiens; identical to SEQ ID NO: 183242

SEQ ID NO: 541246 - RNA, 64 nt, Homo Sapiens; identical to SEQ ID NO: 183243

SEQ ID NO: 541247 - RNA, 64 nt, Homo Sapiens; identical to SEQ ID NO: 183244

SEQ ID NO: 541248 - RNA, 64 nt, Homo Sapiens; identical to SEQ ID NO: 183245

SEQ ID NO: 541249 - RNA, 64 nt, Homo Sapiens; identical to SEQ ID NO: 183246

SEQ ID NO: 541250 - RNA, 64 nt, Homo Sapiens; identical to SEQ ID NO: 183247

SEQ ID NO: 541251 - RNA, 64 nt, Homo Sapiens; identical to SEQ ID NO: 183248

SEQ ID NO: 541252 - RNA, 64 nt, Homo Sapiens; identical to SEQ ID NO: 183249

SEQ ID NO: 541253 - RNA, 64 nt, Homo Sapiens; identical to SEQ ID NO: 183250

SEQ ID NO: 541254 - RNA, 64 nt, Homo Sapiens; identical to SEQ ID NO: 183251

SEQ ID NO: 541255 - RNA, 64 nt, Homo Sapiens; identical to SEQ ID NO: 183252

SEQ ID NO: 541256 - RNA, 64 nt, Homo Sapiens; identical to SEQ ID NO: 183253

SEQ ID NO: 541257 - RNA, 64 nt, Homo Sapiens; identical to SEQ ID NO: 183254

SEQ ID NO: 541258 - RNA, 64 nt, Homo Sapiens; identical to SEQ ID NO: 183255

SEQ ID NO: 541259 - RNA, 64 nt, Homo Sapiens; identical to SEQ ID NO: 183256

SEQ ID NO: 541260 - RNA, 64 nt, Homo Sapiens; identical to SEQ ID NO: 183257

SEQ ID NO: 541261 - RNA, 64 nt, Homo Sapiens; identical to SEQ ID NO: 183258

SEQ ID NO: 541262 - RNA, 64 nt, Homo Sapiens; identical to SEQ ID NO: 183259

SEQ ID NO: 541263 - RNA, 64 nt, Homo Sapiens; identical to SEQ ID NO: 183260

SEQ ID NO: 541264 - RNA, 64 nt, Homo Sapiens; identical to SEQ ID NO: 183261

SEQ ID NO: 541265 - RNA, 64 nt, Homo Sapiens; identical to SEQ ID NO: 183262

SEQ ID NO: 541266 - RNA, 64 nt, Homo Sapiens; identical to SEQ ID NO: 183263

SEQ ID NO: 541267 - RNA, 64 nt, Homo Sapiens; identical to SEQ ID NO: 183264

SEQ ID NO: 541268 - RNA, 64 nt, Homo Sapiens; identical to SEQ ID NO: 183265

SEQ ID NO: 541269 - RNA, 64 nt, Homo Sapiens; identical to SEQ ID NO: 183266

SEQ ID NO: 541270 - RNA, 64 nt, Homo Sapiens; identical to SEQ ID NO: 183267

SEQ ID NO: 541271 - RNA, 64 nt, Homo Sapiens; identical to SEQ ID NO: 183268

SEQ ID NO: 541272 - RNA, 64 nt, Homo Sapiens; identical to SEQ ID NO: 183269

SEQ ID NO: 541273 - RNA, 64 nt, Homo Sapiens; identical to SEQ ID NO: 183270

SEQ ID NO: 541274 - RNA, 64 nt, Homo Sapiens; identical to SEQ ID NO: 183271

SEQ ID NO: 541275 - RNA, 64 nt, Homo Sapiens; identical to SEQ ID NO: 183272

SEQ ID NO: 541276 - RNA, 64 nt, Homo Sapiens; identical to SEQ ID NO: 183273

SEQ ID NO: 541277 - RNA, 64 nt, Homo Sapiens; identical to SEQ ID NO: 183274

SEQ ID NO: 541278 - RNA, 64 nt, Homo Sapiens; identical to SEQ ID NO: 183275

SEQ ID NO: 541279 - RNA, 64 nt, Homo Sapiens; identical to SEQ ID NO: 183276

SEQ ID NO: 541280 - RNA, 64 nt, Homo Sapiens; identical to SEQ ID NO: 183277

SEQ ID NO: 541281 - RNA, 64 nt, Homo Sapiens; identical to SEQ ID NO: 183278

SEQ ID NO: 541282 - RNA, 64 nt, Homo Sapiens; identical to SEQ ID NO: 183279

SEQ ID NO: 541283 - RNA, 64 nt, Homo Sapiens; identical to SEQ ID NO: 183280

SEQ ID NO: 541284 - RNA, 64 nt, Homo Sapiens; identical to SEQ ID NO: 183281

SEQ ID NO: 541285 - RNA, 64 nt, Homo Sapiens; identical to SEQ ID NO: 183282

SEQ ID NO: 541286 - RNA, 64 nt, Homo Sapiens; identical to SEQ ID NO: 183283

SEQ ID NO: 541287 - RNA, 64 nt, Homo Sapiens; identical to SEQ ID NO: 183284

SEQ ID NO: 541288 - RNA, 64 nt, Homo Sapiens; identical to SEQ ID NO: 183285

SEQ ID NO: 541289 - RNA, 64 nt, Homo Sapiens; identical to SEQ ID NO: 183286

SEQ ID NO: 541290 - RNA, 64 nt, Homo Sapiens; identical to SEQ ID NO: 183287

SEQ ID NO: 541291 - RNA, 64 nt, Homo Sapiens; identical to SEQ ID NO: 183288

SEQ ID NO: 541292 - RNA, 64 nt, Homo Sapiens; identical to SEQ ID NO: 183289

SEQ ID NO: 541293 - RNA, 64 nt, Homo Sapiens; identical to SEQ ID NO: 183290

SEQ ID NO: 541294 - RNA, 64 nt, Homo Sapiens; identical to SEQ ID NO: 183291

SEQ ID NO: 541295 - RNA, 64 nt, Homo Sapiens; identical to SEQ ID NO: 183292

SEQ ID NO: 541296 - RNA, 64 nt, Homo Sapiens; identical to SEQ ID NO: 183293

SEQ ID NO: 541297 - RNA, 64 nt, Homo Sapiens; identical to SEQ ID NO: 183294

SEQ ID NO: 541298 - RNA, 64 nt, Homo Sapiens; identical to SEQ ID NO: 183295

SEQ ID NO: 541299 - RNA, 64 nt, Homo Sapiens; identical to SEQ ID NO: 183296

SEQ ID NO: 541300 - RNA, 64 nt, Homo Sapiens; identical to SEQ ID NO: 183297

SEQ ID NO: 541301 - RNA, 64 nt, Homo Sapiens; identical to SEQ ID NO: 183298

SEQ ID NO: 541302 - RNA, 64 nt, Homo Sapiens; identical to SEQ ID NO: 183299

SEQ ID NO: 541303 - RNA, 64 nt, Homo Sapiens; identical to SEQ ID NO: 183300

SEQ ID NO: 541304 - RNA, 64 nt, Homo Sapiens; identical to SEQ ID NO: 183301

SEQ ID NO: 541305 - RNA, 64 nt, Homo Sapiens; identical to SEQ ID NO: 183302

SEQ ID NO: 541306 - RNA, 64 nt, Homo Sapiens; identical to SEQ ID NO: 183303

SEQ ID NO: 541307 - RNA, 64 nt, Homo Sapiens; identical to SEQ ID NO: 183304

SEQ ID NO: 541308 - RNA, 64 nt, Homo Sapiens; identical to SEQ ID NO: 183305

SEQ ID NO: 541309 - RNA, 64 nt, Homo Sapiens; identical to SEQ ID NO: 183306

SEQ ID NO: 541310 - RNA, 64 nt, Homo Sapiens; identical to SEQ ID NO: 183307

SEQ ID NO: 541311 - RNA, 64 nt, Homo Sapiens; identical to SEQ ID NO: 183308

SEQ ID NO: 541312 - RNA, 64 nt, Homo Sapiens; identical to SEQ ID NO: 183309

SEQ ID NO: 541313 - RNA, 64 nt, Homo Sapiens; identical to SEQ ID NO: 183310

SEQ ID NO: 541314 - RNA, 64 nt, Homo Sapiens; identical to SEQ ID NO: 183311

SEQ ID NO: 541315 - RNA, 64 nt, Homo Sapiens; identical to SEQ ID NO: 183312

SEQ ID NO: 541316 - RNA, 64 nt, Homo Sapiens; identical to SEQ ID NO: 183313

SEQ ID NO: 541317 - RNA, 64 nt, Homo Sapiens; identical to SEQ ID NO: 183314

SEQ ID NO: 541318 - RNA, 64 nt, Homo Sapiens; identical to SEQ ID NO: 183315

SEQ ID NO: 541319 - RNA, 64 nt, Homo Sapiens; identical to SEQ ID NO: 183316

SEQ ID NO: 541320 - RNA, 64 nt, Homo Sapiens; identical to SEQ ID NO: 183317

SEQ ID NO: 541321 - RNA, 64 nt, Homo Sapiens; identical to SEQ ID NO: 183318

SEQ ID NO: 541322 - RNA, 64 nt, Homo Sapiens; identical to SEQ ID NO: 183319

SEQ ID NO: 541323 - RNA, 64 nt, Homo Sapiens; identical to SEQ ID NO: 183320

SEQ ID NO: 541324 - RNA, 64 nt, Homo Sapiens; identical to SEQ ID NO: 183321

SEQ ID NO: 541325 - RNA, 64 nt, Homo Sapiens; identical to SEQ ID NO: 183322

SEQ ID NO: 541326 - RNA, 64 nt, Homo Sapiens; identical to SEQ ID NO: 183323

SEQ ID NO: 541327 - RNA, 64 nt, Homo Sapiens; identical to SEQ ID NO: 183324

SEQ ID NO: 541328 - RNA, 64 nt, Homo Sapiens; identical to SEQ ID NO: 183325

SEQ ID NO: 541329 - RNA, 64 nt, Homo Sapiens; identical to SEQ ID NO: 183326

SEQ ID NO: 541330 - RNA, 64 nt, Homo Sapiens; identical to SEQ ID NO: 183327

SEQ ID NO: 541331 - RNA, 64 nt, Homo Sapiens; identical to SEQ ID NO: 183328

SEQ ID NO: 541332 - RNA, 64 nt, Homo Sapiens; identical to SEQ ID NO: 183329

SEQ ID NO: 541333 - RNA, 64 nt, Homo Sapiens; identical to SEQ ID NO: 183330

SEQ ID NO: 541334 - RNA, 64 nt, Homo Sapiens; identical to SEQ ID NO: 183331

SEQ ID NO: 541335 - RNA, 64 nt, Homo Sapiens; identical to SEQ ID NO: 183332

SEQ ID NO: 541336 - RNA, 64 nt, Homo Sapiens; identical to SEQ ID NO: 183333

SEQ ID NO: 541337 - RNA, 64 nt, Homo Sapiens; identical to SEQ ID NO: 183334

SEQ ID NO: 541338 - RNA, 64 nt, Homo Sapiens; identical to SEQ ID NO: 183335

SEQ ID NO: 541339 - RNA, 64 nt, Homo Sapiens; identical to SEQ ID NO: 183336

SEQ ID NO: 541340 - RNA, 64 nt, Homo Sapiens; identical to SEQ ID NO: 183337

SEQ ID NO: 541341 - RNA, 64 nt, Homo Sapiens; identical to SEQ ID NO: 183338

SEQ ID NO: 541342 - RNA, 64 nt, Homo Sapiens; identical to SEQ ID NO: 183339

SEQ ID NO: 541343 - RNA, 64 nt, Homo Sapiens; identical to SEQ ID NO: 183340

SEQ ID NO: 541344 - RNA, 64 nt, Homo Sapiens; identical to SEQ ID NO: 183341

SEQ ID NO: 541345 - RNA, 64 nt, Homo Sapiens; identical to SEQ ID NO: 183342

SEQ ID NO: 541346 - RNA, 64 nt, Homo Sapiens; identical to SEQ ID NO: 183343

SEQ ID NO: 541347 - RNA, 64 nt, Homo Sapiens; identical to SEQ ID NO: 183344

SEQ ID NO: 541348 - RNA, 64 nt, Homo Sapiens; identical to SEQ ID NO: 183345

SEQ ID NO: 541349 - RNA, 64 nt, Homo Sapiens; identical to SEQ ID NO: 183346

SEQ ID NO: 541350 - RNA, 64 nt, Homo Sapiens; identical to SEQ ID NO: 183347

SEQ ID NO: 541351 - RNA, 64 nt, Homo Sapiens; identical to SEQ ID NO: 183348

SEQ ID NO: 541352 - RNA, 64 nt, Homo Sapiens; identical to SEQ ID NO: 183349

SEQ ID NO: 541353 - RNA, 64 nt, Homo Sapiens; identical to SEQ ID NO: 183350

SEQ ID NO: 541354 - RNA, 64 nt, Homo Sapiens; identical to SEQ ID NO: 183351

SEQ ID NO: 541355 - RNA, 64 nt, Homo Sapiens; identical to SEQ ID NO: 183352

SEQ ID NO: 541356 - RNA, 64 nt, Homo Sapiens; identical to SEQ ID NO: 183353

SEQ ID NO: 541357 - RNA, 64 nt, Homo Sapiens; identical to SEQ ID NO: 183354

SEQ ID NO: 541358 - RNA, 64 nt, Homo Sapiens; identical to SEQ ID NO: 183355

SEQ ID NO: 541359 - RNA, 64 nt, Homo Sapiens; identical to SEQ ID NO: 183356

SEQ ID NO: 541360 - RNA, 64 nt, Homo Sapiens; identical to SEQ ID NO: 183357

SEQ ID NO: 541361 - RNA, 64 nt, Homo Sapiens; identical to SEQ ID NO: 183358

SEQ ID NO: 541362 - RNA, 64 nt, Homo Sapiens; identical to SEQ ID NO: 183359

SEQ ID NO: 541363 - RNA, 64 nt, Homo Sapiens; identical to SEQ ID NO: 183360

SEQ ID NO: 541364 - RNA, 64 nt, Homo Sapiens; identical to SEQ ID NO: 183361

SEQ ID NO: 541365 - RNA, 64 nt, Homo Sapiens; identical to SEQ ID NO: 183362

SEQ ID NO: 541366 - RNA, 64 nt, Homo Sapiens; identical to SEQ ID NO: 183363

SEQ ID NO: 541367 - RNA, 64 nt, Homo Sapiens; identical to SEQ ID NO: 183364

SEQ ID NO: 541368 - RNA, 64 nt, Homo Sapiens; identical to SEQ ID NO: 183365

SEQ ID NO: 541369 - RNA, 64 nt, Homo Sapiens; identical to SEQ ID NO: 183366

SEQ ID NO: 541370 - RNA, 64 nt, Homo Sapiens; identical to SEQ ID NO: 183367

SEQ ID NO: 541371 - RNA, 64 nt, Homo Sapiens; identical to SEQ ID NO: 183368

SEQ ID NO: 541372 - RNA, 63 nt, Homo Sapiens; identical to SEQ ID NO: 183369

SEQ ID NO: 541373 - RNA, 64 nt, Homo Sapiens; identical to SEQ ID NO: 183370

SEQ ID NO: 541374 - RNA, 64 nt, Homo Sapiens; identical to SEQ ID NO: 183371

SEQ ID NO: 541375 - RNA, 64 nt, Homo Sapiens; identical to SEQ ID NO: 183372

SEQ ID NO: 541376 - RNA, 64 nt, Homo Sapiens; identical to SEQ ID NO: 183373

SEQ ID NO: 541377 - RNA, 64 nt, Homo Sapiens; identical to SEQ ID NO: 183374

SEQ ID NO: 541378 - RNA, 64 nt, Homo Sapiens; identical to SEQ ID NO: 183375

SEQ ID NO: 541379 - RNA, 64 nt, Homo Sapiens; identical to SEQ ID NO: 183376

SEQ ID NO: 541380 - RNA, 64 nt, Homo Sapiens; identical to SEQ ID NO: 183377

SEQ ID NO: 541381 - RNA, 64 nt, Homo Sapiens; identical to SEQ ID NO: 183378

SEQ ID NO: 541382 - RNA, 64 nt, Homo Sapiens; identical to SEQ ID NO: 183379

SEQ ID NO: 541383 - RNA, 64 nt, Homo Sapiens; identical to SEQ ID NO: 183380

SEQ ID NO: 541384 - RNA, 64 nt, Homo Sapiens; identical to SEQ ID NO: 183381

SEQ ID NO: 541385 - RNA, 64 nt, Homo Sapiens; identical to SEQ ID NO: 183382

SEQ ID NO: 541386 - RNA, 64 nt, Homo Sapiens; identical to SEQ ID NO: 183383

SEQ ID NO: 541387 - RNA, 64 nt, Homo Sapiens; identical to SEQ ID NO: 183384

SEQ ID NO: 541388 - RNA, 64 nt, Homo Sapiens; identical to SEQ ID NO: 183385

SEQ ID NO: 541389 - RNA, 64 nt, Homo Sapiens; identical to SEQ ID NO: 183386

SEQ ID NO: 541390 - RNA, 64 nt, Homo Sapiens; identical to SEQ ID NO: 183387

SEQ ID NO: 541391 - RNA, 64 nt, Homo Sapiens; identical to SEQ ID NO: 183388

SEQ ID NO: 541392 - RNA, 64 nt, Homo Sapiens; identical to SEQ ID NO: 183389

SEQ ID NO: 541393 - RNA, 64 nt, Homo Sapiens; identical to SEQ ID NO: 183390

SEQ ID NO: 541394 - RNA, 64 nt, Homo Sapiens; identical to SEQ ID NO: 183391

SEQ ID NO: 541395 - RNA, 64 nt, Homo Sapiens; identical to SEQ ID NO: 183392

SEQ ID NO: 541396 - RNA, 64 nt, Homo Sapiens; identical to SEQ ID NO: 183393

SEQ ID NO: 541397 - RNA, 64 nt, Homo Sapiens; identical to SEQ ID NO: 183394

SEQ ID NO: 541398 - RNA, 64 nt, Homo Sapiens; identical to SEQ ID NO: 183395

SEQ ID NO: 541399 - RNA, 64 nt, Homo Sapiens; identical to SEQ ID NO: 183396

SEQ ID NO: 541400 - RNA, 64 nt, Homo Sapiens; identical to SEQ ID NO: 183397

SEQ ID NO: 541401 - RNA, 64 nt, Homo Sapiens; identical to SEQ ID NO: 183398

SEQ ID NO: 541402 - RNA, 64 nt, Homo Sapiens; identical to SEQ ID NO: 183399

SEQ ID NO: 541403 - RNA, 64 nt, Homo Sapiens; identical to SEQ ID NO: 183400

SEQ ID NO: 541404 - RNA, 64 nt, Homo Sapiens; identical to SEQ ID NO: 183401

SEQ ID NO: 541405 - RNA, 64 nt, Homo Sapiens; identical to SEQ ID NO: 183402

SEQ ID NO: 541406 - RNA, 64 nt, Homo Sapiens; identical to SEQ ID NO: 183403

SEQ ID NO: 541407 - RNA, 64 nt, Homo Sapiens; identical to SEQ ID NO: 183404

SEQ ID NO: 541408 - RNA, 64 nt, Homo Sapiens; identical to SEQ ID NO: 183405

SEQ ID NO: 541409 - RNA, 64 nt, Homo Sapiens; identical to SEQ ID NO: 183406

SEQ ID NO: 541410 - RNA, 64 nt, Homo Sapiens; identical to SEQ ID NO: 183407

SEQ ID NO: 541411 - RNA, 64 nt, Homo Sapiens; identical to SEQ ID NO: 183408

SEQ ID NO: 541412 - RNA, 64 nt, Homo Sapiens; identical to SEQ ID NO: 183409

SEQ ID NO: 541413 - RNA, 64 nt, Homo Sapiens; identical to SEQ ID NO: 183410

SEQ ID NO: 541414 - RNA, 64 nt, Homo Sapiens; identical to SEQ ID NO: 183411

SEQ ID NO: 541415 - RNA, 64 nt, Homo Sapiens; identical to SEQ ID NO: 183412

SEQ ID NO: 541416 - RNA, 64 nt, Homo Sapiens; identical to SEQ ID NO: 183413

SEQ ID NO: 541417 - RNA, 64 nt, Homo Sapiens; identical to SEQ ID NO: 183414

SEQ ID NO: 541418 - RNA, 64 nt, Homo Sapiens; identical to SEQ ID NO: 183415

SEQ ID NO: 541419 - RNA, 64 nt, Homo Sapiens; identical to SEQ ID NO: 183416

SEQ ID NO: 541420 - RNA, 64 nt, Homo Sapiens; identical to SEQ ID NO: 183417

SEQ ID NO: 541421 - RNA, 64 nt, Homo Sapiens; identical to SEQ ID NO: 183418

SEQ ID NO: 541422 - RNA, 64 nt, Homo Sapiens; identical to SEQ ID NO: 183419

SEQ ID NO: 541423 - RNA, 64 nt, Homo Sapiens; identical to SEQ ID NO: 183420

SEQ ID NO: 541424 - RNA, 64 nt, Homo Sapiens; identical to SEQ ID NO: 183421

SEQ ID NO: 541425 - RNA, 64 nt, Homo Sapiens; identical to SEQ ID NO: 183422

SEQ ID NO: 541426 - RNA, 64 nt, Homo Sapiens; identical to SEQ ID NO: 183423

SEQ ID NO: 541427 - RNA, 64 nt, Homo Sapiens; identical to SEQ ID NO: 183424

SEQ ID NO: 541428 - RNA, 64 nt, Homo Sapiens; identical to SEQ ID NO: 183425

SEQ ID NO: 541429 - RNA, 64 nt, Homo Sapiens; identical to SEQ ID NO: 183426

SEQ ID NO: 541430 - RNA, 64 nt, Homo Sapiens; identical to SEQ ID NO: 183427

SEQ ID NO: 541431 - RNA, 64 nt, Homo Sapiens; identical to SEQ ID NO: 183428

SEQ ID NO: 541432 - RNA, 64 nt, Homo Sapiens; identical to SEQ ID NO: 183429

SEQ ID NO: 541433 - RNA, 64 nt, Homo Sapiens; identical to SEQ ID NO: 183430

SEQ ID NO: 541434 - RNA, 64 nt, Homo Sapiens; identical to SEQ ID NO: 183431

SEQ ID NO: 541435 - RNA, 64 nt, Homo Sapiens; identical to SEQ ID NO: 183432

SEQ ID NO: 541436 - RNA, 64 nt, Homo Sapiens; identical to SEQ ID NO: 183433

SEQ ID NO: 541437 - RNA, 64 nt, Homo Sapiens; identical to SEQ ID NO: 183434

SEQ ID NO: 541438 - RNA, 64 nt, Homo Sapiens; identical to SEQ ID NO: 183435

SEQ ID NO: 541439 - RNA, 64 nt, Homo Sapiens; identical to SEQ ID NO: 183436

SEQ ID NO: 541440 - RNA, 64 nt, Homo Sapiens; identical to SEQ ID NO: 183437

SEQ ID NO: 541441 - RNA, 64 nt, Homo Sapiens; identical to SEQ ID NO: 183438

SEQ ID NO: 541442 - RNA, 64 nt, Homo Sapiens; identical to SEQ ID NO: 183439

SEQ ID NO: 541443 - RNA, 64 nt, Homo Sapiens; identical to SEQ ID NO: 183440

SEQ ID NO: 541444 - RNA, 64 nt, Homo Sapiens; identical to SEQ ID NO: 183441

SEQ ID NO: 541445 - RNA, 64 nt, Homo Sapiens; identical to SEQ ID NO: 183442

SEQ ID NO: 541446 - RNA, 64 nt, Homo Sapiens; identical to SEQ ID NO: 183443

SEQ ID NO: 541447 - RNA, 64 nt, Homo Sapiens; identical to SEQ ID NO: 183444

SEQ ID NO: 541448 - RNA, 64 nt, Homo Sapiens; identical to SEQ ID NO: 183445

SEQ ID NO: 541449 - RNA, 64 nt, Homo Sapiens; identical to SEQ ID NO: 183446

SEQ ID NO: 541450 - RNA, 64 nt, Homo Sapiens; identical to SEQ ID NO: 183447

SEQ ID NO: 541451 - RNA, 64 nt, Homo Sapiens; identical to SEQ ID NO: 183448

SEQ ID NO: 541452 - RNA, 64 nt, Homo Sapiens; identical to SEQ ID NO: 183449

SEQ ID NO: 541453 - RNA, 64 nt, Homo Sapiens; identical to SEQ ID NO: 183450

SEQ ID NO: 541454 - RNA, 64 nt, Homo Sapiens; identical to SEQ ID NO: 183451

SEQ ID NO: 541455 - RNA, 64 nt, Homo Sapiens; identical to SEQ ID NO: 183452

SEQ ID NO: 541456 - RNA, 64 nt, Homo Sapiens; identical to SEQ ID NO: 183453

SEQ ID NO: 541457 - RNA, 64 nt, Homo Sapiens; identical to SEQ ID NO: 183454

SEQ ID NO: 541458 - RNA, 64 nt, Homo Sapiens; identical to SEQ ID NO: 183455

SEQ ID NO: 541459 - RNA, 64 nt, Homo Sapiens; identical to SEQ ID NO: 183456

SEQ ID NO: 541460 - RNA, 64 nt, Homo Sapiens; identical to SEQ ID NO: 183457

SEQ ID NO: 541461 - RNA, 64 nt, Homo Sapiens; identical to SEQ ID NO: 183458

SEQ ID NO: 541462 - RNA, 64 nt, Homo Sapiens; identical to SEQ ID NO: 183459

SEQ ID NO: 541463 - RNA, 64 nt, Homo Sapiens; identical to SEQ ID NO: 183460

SEQ ID NO: 541464 - RNA, 64 nt, Homo Sapiens; identical to SEQ ID NO: 183461

SEQ ID NO: 541465 - RNA, 64 nt, Homo Sapiens; identical to SEQ ID NO: 183462

SEQ ID NO: 541466 - RNA, 64 nt, Homo Sapiens; identical to SEQ ID NO: 183463

SEQ ID NO: 541467 - RNA, 64 nt, Homo Sapiens; identical to SEQ ID NO: 183464

SEQ ID NO: 541468 - RNA, 64 nt, Homo Sapiens; identical to SEQ ID NO: 183465

SEQ ID NO: 541469 - RNA, 64 nt, Homo Sapiens; identical to SEQ ID NO: 183466

SEQ ID NO: 541470 - RNA, 64 nt, Homo Sapiens; identical to SEQ ID NO: 183467

SEQ ID NO: 541471 - RNA, 64 nt, Homo Sapiens; identical to SEQ ID NO: 183468

SEQ ID NO: 541472 - RNA, 64 nt, Homo Sapiens; identical to SEQ ID NO: 183469

SEQ ID NO: 541473 - RNA, 64 nt, Homo Sapiens; identical to SEQ ID NO: 183470

SEQ ID NO: 541474 - RNA, 64 nt, Homo Sapiens; identical to SEQ ID NO: 183471

SEQ ID NO: 541475 - RNA, 64 nt, Homo Sapiens; identical to SEQ ID NO: 183472

SEQ ID NO: 541476 - RNA, 64 nt, Homo Sapiens; identical to SEQ ID NO: 183473

SEQ ID NO: 541477 - RNA, 64 nt, Homo Sapiens; identical to SEQ ID NO: 183474

SEQ ID NO: 541478 - RNA, 64 nt, Homo Sapiens; identical to SEQ ID NO: 183475

SEQ ID NO: 541479 - RNA, 64 nt, Homo Sapiens; identical to SEQ ID NO: 183476

SEQ ID NO: 541480 - RNA, 64 nt, Homo Sapiens; identical to SEQ ID NO: 183477

SEQ ID NO: 541481 - RNA, 64 nt, Homo Sapiens; identical to SEQ ID NO: 183478

SEQ ID NO: 541482 - RNA, 64 nt, Homo Sapiens; identical to SEQ ID NO: 183479

SEQ ID NO: 541483 - RNA, 64 nt, Homo Sapiens; identical to SEQ ID NO: 183480

SEQ ID NO: 541484 - RNA, 64 nt, Homo Sapiens; identical to SEQ ID NO: 183481

SEQ ID NO: 541485 - RNA, 64 nt, Homo Sapiens; identical to SEQ ID NO: 183482

SEQ ID NO: 541486 - RNA, 64 nt, Homo Sapiens; identical to SEQ ID NO: 183483

SEQ ID NO: 541487 - RNA, 64 nt, Homo Sapiens; identical to SEQ ID NO: 183484

SEQ ID NO: 541488 - RNA, 64 nt, Homo Sapiens; identical to SEQ ID NO: 183485

SEQ ID NO: 541489 - RNA, 64 nt, Homo Sapiens; identical to SEQ ID NO: 183486

SEQ ID NO: 541490 - RNA, 64 nt, Homo Sapiens; identical to SEQ ID NO: 183487

SEQ ID NO: 541491 - RNA, 64 nt, Homo Sapiens; identical to SEQ ID NO: 183488

SEQ ID NO: 541492 - RNA, 64 nt, Homo Sapiens; identical to SEQ ID NO: 183489

SEQ ID NO: 541493 - RNA, 64 nt, Homo Sapiens; identical to SEQ ID NO: 183490

SEQ ID NO: 541494 - RNA, 64 nt, Homo Sapiens; identical to SEQ ID NO: 183491

SEQ ID NO: 541495 - RNA, 64 nt, Homo Sapiens; identical to SEQ ID NO: 183492

SEQ ID NO: 541496 - RNA, 64 nt, Homo Sapiens; identical to SEQ ID NO: 183493

SEQ ID NO: 541497 - RNA, 64 nt, Homo Sapiens; identical to SEQ ID NO: 183494

SEQ ID NO: 541498 - RNA, 64 nt, Homo Sapiens; identical to SEQ ID NO: 183495

SEQ ID NO: 541499 - RNA, 64 nt, Homo Sapiens; identical to SEQ ID NO: 183496

SEQ ID NO: 541500 - RNA, 64 nt, Homo Sapiens; identical to SEQ ID NO: 183497

SEQ ID NO: 541501 - RNA, 64 nt, Homo Sapiens; identical to SEQ ID NO: 183498

SEQ ID NO: 541502 - RNA, 64 nt, Homo Sapiens; identical to SEQ ID NO: 183499

SEQ ID NO: 541503 - RNA, 64 nt, Homo Sapiens; identical to SEQ ID NO: 183500

SEQ ID NO: 541504 - RNA, 64 nt, Homo Sapiens; identical to SEQ ID NO: 183501

SEQ ID NO: 541505 - RNA, 64 nt, Homo Sapiens; identical to SEQ ID NO: 183502

SEQ ID NO: 541506 - RNA, 64 nt, Homo Sapiens; identical to SEQ ID NO: 183503

SEQ ID NO: 541507 - RNA, 64 nt, Homo Sapiens; identical to SEQ ID NO: 183504

SEQ ID NO: 541508 - RNA, 64 nt, Homo Sapiens; identical to SEQ ID NO: 183505

SEQ ID NO: 541509 - RNA, 64 nt, Homo Sapiens; identical to SEQ ID NO: 183506

SEQ ID NO: 541510 - RNA, 64 nt, Homo Sapiens; identical to SEQ ID NO: 183507

SEQ ID NO: 541511 - RNA, 64 nt, Homo Sapiens; identical to SEQ ID NO: 183508

SEQ ID NO: 541512 - RNA, 64 nt, Homo Sapiens; identical to SEQ ID NO: 183509

SEQ ID NO: 541513 - RNA, 64 nt, Homo Sapiens; identical to SEQ ID NO: 183510

SEQ ID NO: 541514 - RNA, 64 nt, Homo Sapiens; identical to SEQ ID NO: 183511

SEQ ID NO: 541515 - RNA, 64 nt, Homo Sapiens; identical to SEQ ID NO: 183512

SEQ ID NO: 541516 - RNA, 64 nt, Homo Sapiens; identical to SEQ ID NO: 183513

SEQ ID NO: 541517 - RNA, 64 nt, Homo Sapiens; identical to SEQ ID NO: 183514

SEQ ID NO: 541518 - RNA, 64 nt, Homo Sapiens; identical to SEQ ID NO: 183515

SEQ ID NO: 541519 - RNA, 64 nt, Homo Sapiens; identical to SEQ ID NO: 183516

SEQ ID NO: 541520 - RNA, 64 nt, Homo Sapiens; identical to SEQ ID NO: 183517

SEQ ID NO: 541521 - RNA, 64 nt, Homo Sapiens; identical to SEQ ID NO: 183518

SEQ ID NO: 541522 - RNA, 64 nt, Homo Sapiens; identical to SEQ ID NO: 183519

SEQ ID NO: 541523 - RNA, 64 nt, Homo Sapiens; identical to SEQ ID NO: 183520

SEQ ID NO: 541524 - RNA, 64 nt, Homo Sapiens; identical to SEQ ID NO: 183521

SEQ ID NO: 541525 - RNA, 64 nt, Homo Sapiens; identical to SEQ ID NO: 183522

SEQ ID NO: 541526 - RNA, 64 nt, Homo Sapiens; identical to SEQ ID NO: 183523

SEQ ID NO: 541527 - RNA, 64 nt, Homo Sapiens; identical to SEQ ID NO: 183524

SEQ ID NO: 541528 - RNA, 64 nt, Homo Sapiens; identical to SEQ ID NO: 183525

SEQ ID NO: 541529 - RNA, 64 nt, Homo Sapiens; identical to SEQ ID NO: 183526

SEQ ID NO: 541530 - RNA, 64 nt, Homo Sapiens; identical to SEQ ID NO: 183527

SEQ ID NO: 541531 - RNA, 64 nt, Homo Sapiens; identical to SEQ ID NO: 183528

SEQ ID NO: 541532 - RNA, 64 nt, Homo Sapiens; identical to SEQ ID NO: 183529

SEQ ID NO: 541533 - RNA, 64 nt, Homo Sapiens; identical to SEQ ID NO: 183530

SEQ ID NO: 541534 - RNA, 64 nt, Homo Sapiens; identical to SEQ ID NO: 183531

SEQ ID NO: 541535 - RNA, 64 nt, Homo Sapiens; identical to SEQ ID NO: 183532

SEQ ID NO: 541536 - RNA, 64 nt, Homo Sapiens; identical to SEQ ID NO: 183533

SEQ ID NO: 541537 - RNA, 64 nt, Homo Sapiens; identical to SEQ ID NO: 183534

SEQ ID NO: 541538 - RNA, 64 nt, Homo Sapiens; identical to SEQ ID NO: 183535

SEQ ID NO: 541539 - RNA, 64 nt, Homo Sapiens; identical to SEQ ID NO: 183536

SEQ ID NO: 541540 - RNA, 64 nt, Homo Sapiens; identical to SEQ ID NO: 183537

SEQ ID NO: 541541 - RNA, 64 nt, Homo Sapiens; identical to SEQ ID NO: 183538

SEQ ID NO: 541542 - RNA, 64 nt, Homo Sapiens; identical to SEQ ID NO: 183539

SEQ ID NO: 541543 - RNA, 64 nt, Homo Sapiens; identical to SEQ ID NO: 183540

SEQ ID NO: 541544 - RNA, 64 nt, Homo Sapiens; identical to SEQ ID NO: 183541

SEQ ID NO: 541545 - RNA, 64 nt, Homo Sapiens; identical to SEQ ID NO: 183542

SEQ ID NO: 541546 - RNA, 64 nt, Homo Sapiens; identical to SEQ ID NO: 183543

SEQ ID NO: 541547 - RNA, 64 nt, Homo Sapiens; identical to SEQ ID NO: 183544

SEQ ID NO: 541548 - RNA, 64 nt, Homo Sapiens; identical to SEQ ID NO: 183545

SEQ ID NO: 541549 - RNA, 64 nt, Homo Sapiens; identical to SEQ ID NO: 183546

SEQ ID NO: 541550 - RNA, 64 nt, Homo Sapiens; identical to SEQ ID NO: 183547

SEQ ID NO: 541551 - RNA, 64 nt, Homo Sapiens; identical to SEQ ID NO: 183548

SEQ ID NO: 541552 - RNA, 64 nt, Homo Sapiens; identical to SEQ ID NO: 183549

SEQ ID NO: 541553 - RNA, 64 nt, Homo Sapiens; identical to SEQ ID NO: 183550

SEQ ID NO: 541554 - RNA, 64 nt, Homo Sapiens; identical to SEQ ID NO: 183551

SEQ ID NO: 541555 - RNA, 64 nt, Homo Sapiens; identical to SEQ ID NO: 183552

SEQ ID NO: 541556 - RNA, 64 nt, Homo Sapiens; identical to SEQ ID NO: 183553

SEQ ID NO: 541557 - RNA, 64 nt, Homo Sapiens; identical to SEQ ID NO: 183554

SEQ ID NO: 541558 - RNA, 64 nt, Homo Sapiens; identical to SEQ ID NO: 183555

SEQ ID NO: 541559 - RNA, 64 nt, Homo Sapiens; identical to SEQ ID NO: 183556

SEQ ID NO: 541560 - RNA, 64 nt, Homo Sapiens; identical to SEQ ID NO: 183557

SEQ ID NO: 541561 - RNA, 64 nt, Homo Sapiens; identical to SEQ ID NO: 183558

SEQ ID NO: 541562 - RNA, 64 nt, Homo Sapiens; identical to SEQ ID NO: 183559

SEQ ID NO: 541563 - RNA, 64 nt, Homo Sapiens; identical to SEQ ID NO: 183560

SEQ ID NO: 541564 - RNA, 64 nt, Homo Sapiens; identical to SEQ ID NO: 183561

SEQ ID NO: 541565 - RNA, 64 nt, Homo Sapiens; identical to SEQ ID NO: 183562

SEQ ID NO: 541566 - RNA, 64 nt, Homo Sapiens; identical to SEQ ID NO: 183563

SEQ ID NO: 541567 - RNA, 64 nt, Homo Sapiens; identical to SEQ ID NO: 183564

SEQ ID NO: 541568 - RNA, 64 nt, Homo Sapiens; identical to SEQ ID NO: 183565

SEQ ID NO: 541569 - RNA, 64 nt, Homo Sapiens; identical to SEQ ID NO: 183566

SEQ ID NO: 541570 - RNA, 64 nt, Homo Sapiens; identical to SEQ ID NO: 183567

SEQ ID NO: 541571 - RNA, 64 nt, Homo Sapiens; identical to SEQ ID NO: 183568

SEQ ID NO: 541572 - RNA, 64 nt, Homo Sapiens; identical to SEQ ID NO: 183569

SEQ ID NO: 541573 - RNA, 64 nt, Homo Sapiens; identical to SEQ ID NO: 183570

SEQ ID NO: 541574 - RNA, 64 nt, Homo Sapiens; identical to SEQ ID NO: 183571

SEQ ID NO: 541575 - RNA, 64 nt, Homo Sapiens; identical to SEQ ID NO: 183572

SEQ ID NO: 541576 - RNA, 64 nt, Homo Sapiens; identical to SEQ ID NO: 183573

SEQ ID NO: 541577 - RNA, 64 nt, Homo Sapiens; identical to SEQ ID NO: 183574

SEQ ID NO: 541578 - RNA, 64 nt, Homo Sapiens; identical to SEQ ID NO: 183575

SEQ ID NO: 541579 - RNA, 64 nt, Homo Sapiens; identical to SEQ ID NO: 183576

SEQ ID NO: 541580 - RNA, 64 nt, Homo Sapiens; identical to SEQ ID NO: 183577

SEQ ID NO: 541581 - RNA, 64 nt, Homo Sapiens; identical to SEQ ID NO: 183578

SEQ ID NO: 541582 - RNA, 64 nt, Homo Sapiens; identical to SEQ ID NO: 183579

SEQ ID NO: 541583 - RNA, 64 nt, Homo Sapiens; identical to SEQ ID NO: 183580

SEQ ID NO: 541584 - RNA, 64 nt, Homo Sapiens; identical to SEQ ID NO: 183581

SEQ ID NO: 541585 - RNA, 64 nt, Homo Sapiens; identical to SEQ ID NO: 183582

SEQ ID NO: 541586 - RNA, 64 nt, Homo Sapiens; identical to SEQ ID NO: 183583

SEQ ID NO: 541587 - RNA, 64 nt, Homo Sapiens; identical to SEQ ID NO: 183584

SEQ ID NO: 541588 - RNA, 64 nt, Homo Sapiens; identical to SEQ ID NO: 183585

SEQ ID NO: 541589 - RNA, 64 nt, Homo Sapiens; identical to SEQ ID NO: 183586

SEQ ID NO: 541590 - RNA, 64 nt, Homo Sapiens; identical to SEQ ID NO: 183587

SEQ ID NO: 541591 - RNA, 64 nt, Homo Sapiens; identical to SEQ ID NO: 183588

SEQ ID NO: 541592 - RNA, 64 nt, Homo Sapiens; identical to SEQ ID NO: 183589

SEQ ID NO: 541593 - RNA, 64 nt, Homo Sapiens; identical to SEQ ID NO: 183590

SEQ ID NO: 541594 - RNA, 64 nt, Homo Sapiens; identical to SEQ ID NO: 183591

SEQ ID NO: 541595 - RNA, 64 nt, Homo Sapiens; identical to SEQ ID NO: 183592

SEQ ID NO: 541596 - RNA, 64 nt, Homo Sapiens; identical to SEQ ID NO: 183593

SEQ ID NO: 541597 - RNA, 64 nt, Homo Sapiens; identical to SEQ ID NO: 183594

SEQ ID NO: 541598 - RNA, 64 nt, Homo Sapiens; identical to SEQ ID NO: 183595

SEQ ID NO: 541599 - RNA, 64 nt, Homo Sapiens; identical to SEQ ID NO: 183596

SEQ ID NO: 541600 - RNA, 64 nt, Homo Sapiens; identical to SEQ ID NO: 183597

SEQ ID NO: 541601 - RNA, 64 nt, Homo Sapiens; identical to SEQ ID NO: 183598

SEQ ID NO: 541602 - RNA, 64 nt, Homo Sapiens; identical to SEQ ID NO: 183599

SEQ ID NO: 541603 - RNA, 64 nt, Homo Sapiens; identical to SEQ ID NO: 183600

SEQ ID NO: 541604 - RNA, 64 nt, Homo Sapiens; identical to SEQ ID NO: 183601

SEQ ID NO: 541605 - RNA, 64 nt, Homo Sapiens; identical to SEQ ID NO: 183602

SEQ ID NO: 541606 - RNA, 64 nt, Homo Sapiens; identical to SEQ ID NO: 183603

SEQ ID NO: 541607 - RNA, 64 nt, Homo Sapiens
ugaguugaaaauaccaaaagucaaacaucauagcuuagccuaccuuaaaagggcuccgaacacu

SEQ ID NO: 541608 - RNA, 64 nt, Homo Sapiens
cuuagccuaccuuaaaagggcuccgaacacuacauuagccuacaguugggcaaaaucgucuaau

SEQ ID NO: 541609 - RNA, 64 nt, Homo Sapiens
gugggcaaaacuauccaacaucagaacacuuacauuagccuacacuagccugccuuaaacaugc

SEQ ID NO: 541610 - RNA, 64 nt, Homo Sapiens
cugccuuaaacaugcucagaccaaacaucauagcuuagccuagcuauuuaauauaccuaaccua

SEQ ID NO: 541611 - RNA, 64 nt, Homo Sapiens; identical to SEQ ID NO: 182986

SEQ ID NO: 541612 - RNA, 64 nt, Homo Sapiens; identical to SEQ ID NO: 182987

SEQ ID NO: 541613 - RNA, 64 nt, Homo Sapiens; identical to SEQ ID NO: 182988

SEQ ID NO: 541614 - RNA, 64 nt, Homo Sapiens; identical to SEQ ID NO: 182989

SEQ ID NO: 541615 - RNA, 64 nt, Homo Sapiens; identical to SEQ ID NO: 182990

SEQ ID NO: 541616 - RNA, 64 nt, Homo Sapiens; identical to SEQ ID NO: 182991

SEQ ID NO: 541617 - RNA, 64 nt, Homo Sapiens; identical to SEQ ID NO: 182992

SEQ ID NO: 541618 - RNA, 64 nt, Homo Sapiens; identical to SEQ ID NO: 182993

SEQ ID NO: 541619 - RNA, 64 nt, Homo Sapiens; identical to SEQ ID NO: 182994

SEQ ID NO: 541620 - RNA, 64 nt, Homo Sapiens; identical to SEQ ID NO: 182995

SEQ ID NO: 541621 - RNA, 64 nt, Homo Sapiens; identical to SEQ ID NO: 182996

SEQ ID NO: 541622 - RNA, 64 nt, Homo Sapiens; identical to SEQ ID NO: 182997

SEQ ID NO: 541623 - RNA, 64 nt, Homo Sapiens; identical to SEQ ID NO: 182998

SEQ ID NO: 541624 - RNA, 64 nt, Homo Sapiens; identical to SEQ ID NO: 182999

SEQ ID NO: 541625 - RNA, 64 nt, Homo Sapiens; identical to SEQ ID NO: 183000

SEQ ID NO: 541626 - RNA, 64 nt, Homo Sapiens; identical to SEQ ID NO: 183001

SEQ ID NO: 541627 - RNA, 64 nt, Homo Sapiens; identical to SEQ ID NO: 183002

SEQ ID NO: 541628 - RNA, 64 nt, Homo Sapiens; identical to SEQ ID NO: 183003

SEQ ID NO: 541629 - RNA, 64 nt, Homo Sapiens; identical to SEQ ID NO: 183004

SEQ ID NO: 541630 - RNA, 64 nt, Homo Sapiens; identical to SEQ ID NO: 183005

SEQ ID NO: 541631 - RNA, 64 nt, Homo Sapiens; identical to SEQ ID NO: 183006

SEQ ID NO: 541632 - RNA, 64 nt, Homo Sapiens; identical to SEQ ID NO: 183007

SEQ ID NO: 541633 - RNA, 64 nt, Homo Sapiens; identical to SEQ ID NO: 183008

SEQ ID NO: 541634 - RNA, 64 nt, Homo Sapiens; identical to SEQ ID NO: 183009

SEQ ID NO: 541635 - RNA, 64 nt, Homo Sapiens; identical to SEQ ID NO: 183010

SEQ ID NO: 541636 - RNA, 64 nt, Homo Sapiens; identical to SEQ ID NO: 183011

SEQ ID NO: 541637 - RNA, 64 nt, Homo Sapiens; identical to SEQ ID NO: 183012

SEQ ID NO: 541638 - RNA, 64 nt, Homo Sapiens; identical to SEQ ID NO: 183013

SEQ ID NO: 541639 - RNA, 64 nt, Homo Sapiens; identical to SEQ ID NO: 183014

SEQ ID NO: 541640 - RNA, 64 nt, Homo Sapiens; identical to SEQ ID NO: 183015

SEQ ID NO: 541641 - RNA, 64 nt, Homo Sapiens; identical to SEQ ID NO: 183016

SEQ ID NO: 541642 - RNA, 64 nt, Homo Sapiens; identical to SEQ ID NO: 183017

SEQ ID NO: 541643 - RNA, 64 nt, Homo Sapiens; identical to SEQ ID NO: 183018

SEQ ID NO: 541644 - RNA, 64 nt, Homo Sapiens; identical to SEQ ID NO: 183019

SEQ ID NO: 541645 - RNA, 64 nt, Homo Sapiens; identical to SEQ ID NO: 183020

SEQ ID NO: 541646 - RNA, 64 nt, Homo Sapiens; identical to SEQ ID NO: 183021

SEQ ID NO: 541647 - RNA, 64 nt, Homo Sapiens; identical to SEQ ID NO: 183022

SEQ ID NO: 541648 - RNA, 64 nt, Homo Sapiens; identical to SEQ ID NO: 183023

SEQ ID NO: 541649 - RNA, 64 nt, Homo Sapiens; identical to SEQ ID NO: 183024

SEQ ID NO: 541650 - RNA, 64 nt, Homo Sapiens; identical to SEQ ID NO: 183025

SEQ ID NO: 541651 - RNA, 64 nt, Homo Sapiens; identical to SEQ ID NO: 183026

SEQ ID NO: 541652 - RNA, 64 nt, Homo Sapiens; identical to SEQ ID NO: 183027

SEQ ID NO: 541653 - RNA, 64 nt, Homo Sapiens; identical to SEQ ID NO: 183028

SEQ ID NO: 541654 - RNA, 64 nt, Homo Sapiens; identical to SEQ ID NO: 183029

SEQ ID NO: 541655 - RNA, 64 nt, Homo Sapiens; identical to SEQ ID NO: 183030

SEQ ID NO: 541656 - RNA, 64 nt, Homo Sapiens; identical to SEQ ID NO: 183031

SEQ ID NO: 541657 - RNA, 64 nt, Homo Sapiens; identical to SEQ ID NO: 183032

SEQ ID NO: 541658 - RNA, 64 nt, Homo Sapiens; identical to SEQ ID NO: 183033

SEQ ID NO: 541659 - RNA, 64 nt, Homo Sapiens; identical to SEQ ID NO: 183034

SEQ ID NO: 541660 - RNA, 64 nt, Homo Sapiens; identical to SEQ ID NO: 183035

SEQ ID NO: 541661 - RNA, 64 nt, Homo Sapiens; identical to SEQ ID NO: 183036

SEQ ID NO: 541662 - RNA, 64 nt, Homo Sapiens; identical to SEQ ID NO: 183037

SEQ ID NO: 541663 - RNA, 64 nt, Homo Sapiens; identical to SEQ ID NO: 183038

SEQ ID NO: 541664 - RNA, 64 nt, Homo Sapiens; identical to SEQ ID NO: 183039

SEQ ID NO: 541665 - RNA, 64 nt, Homo Sapiens; identical to SEQ ID NO: 183040

SEQ ID NO: 541666 - RNA, 64 nt, Homo Sapiens; identical to SEQ ID NO: 183041

SEQ ID NO: 541667 - RNA, 64 nt, Homo Sapiens; identical to SEQ ID NO: 183042

SEQ ID NO: 541668 - RNA, 64 nt, Homo Sapiens; identical to SEQ ID NO: 183043

SEQ ID NO: 541669 - RNA, 64 nt, Homo Sapiens; identical to SEQ ID NO: 183044

SEQ ID NO: 541670 - RNA, 64 nt, Homo Sapiens; identical to SEQ ID NO: 183045

SEQ ID NO: 541671 - RNA, 64 nt, Homo Sapiens; identical to SEQ ID NO: 183046

SEQ ID NO: 541672 - RNA, 64 nt, Homo Sapiens; identical to SEQ ID NO: 183047

SEQ ID NO: 541673 - RNA, 64 nt, Homo Sapiens; identical to SEQ ID NO: 183048

SEQ ID NO: 541674 - RNA, 64 nt, Homo Sapiens; identical to SEQ ID NO: 183049

SEQ ID NO: 541675 - RNA, 64 nt, Homo Sapiens; identical to SEQ ID NO: 183050

SEQ ID NO: 541676 - RNA, 64 nt, Homo Sapiens; identical to SEQ ID NO: 183051

SEQ ID NO: 541677 - RNA, 64 nt, Homo Sapiens; identical to SEQ ID NO: 183052

SEQ ID NO: 541678 - RNA, 64 nt, Homo Sapiens; identical to SEQ ID NO: 183053

SEQ ID NO: 541679 - RNA, 64 nt, Homo Sapiens; identical to SEQ ID NO: 183054

SEQ ID NO: 541680 - RNA, 64 nt, Homo Sapiens; identical to SEQ ID NO: 183055

SEQ ID NO: 541681 - RNA, 64 nt, Homo Sapiens; identical to SEQ ID NO: 183056

SEQ ID NO: 541682 - RNA, 64 nt, Homo Sapiens; identical to SEQ ID NO: 183057

SEQ ID NO: 541683 - RNA, 64 nt, Homo Sapiens; identical to SEQ ID NO: 183058

SEQ ID NO: 541684 - RNA, 64 nt, Homo Sapiens; identical to SEQ ID NO: 183059

SEQ ID NO: 541685 - RNA, 64 nt, Homo Sapiens; identical to SEQ ID NO: 183060

SEQ ID NO: 541686 - RNA, 64 nt, Homo Sapiens; identical to SEQ ID NO: 183061

SEQ ID NO: 541687 - RNA, 64 nt, Homo Sapiens; identical to SEQ ID NO: 183062

SEQ ID NO: 541688 - RNA, 64 nt, Homo Sapiens; identical to SEQ ID NO: 183063

SEQ ID NO: 541689 - RNA, 64 nt, Homo Sapiens; identical to SEQ ID NO: 183064

SEQ ID NO: 541690 - RNA, 64 nt, Homo Sapiens; identical to SEQ ID NO: 183065

SEQ ID NO: 541691 - RNA, 64 nt, Homo Sapiens; identical to SEQ ID NO: 183066

SEQ ID NO: 541692 - RNA, 64 nt, Homo Sapiens; identical to SEQ ID NO: 183067

SEQ ID NO: 541693 - RNA, 64 nt, Homo Sapiens; identical to SEQ ID NO: 183068

SEQ ID NO: 541694 - RNA, 64 nt, Homo Sapiens; identical to SEQ ID NO: 183069

SEQ ID NO: 541695 - RNA, 64 nt, Homo Sapiens; identical to SEQ ID NO: 183070

SEQ ID NO: 541696 - RNA, 64 nt, Homo Sapiens; identical to SEQ ID NO: 183071

SEQ ID NO: 541697 - RNA, 64 nt, Homo Sapiens; identical to SEQ ID NO: 183072

SEQ ID NO: 541698 - RNA, 64 nt, Homo Sapiens; identical to SEQ ID NO: 183073

SEQ ID NO: 541699 - RNA, 64 nt, Homo Sapiens; identical to SEQ ID NO: 183074

SEQ ID NO: 541700 - RNA, 64 nt, Homo Sapiens; identical to SEQ ID NO: 183075

SEQ ID NO: 541701 - RNA, 64 nt, Homo Sapiens; identical to SEQ ID NO: 183076

SEQ ID NO: 541702 - RNA, 64 nt, Homo Sapiens; identical to SEQ ID NO: 183077

SEQ ID NO: 541703 - RNA, 64 nt, Homo Sapiens; identical to SEQ ID NO: 183078

SEQ ID NO: 541704 - RNA, 64 nt, Homo Sapiens; identical to SEQ ID NO: 183079

SEQ ID NO: 541705 - RNA, 64 nt, Homo Sapiens; identical to SEQ ID NO: 183080

SEQ ID NO: 541706 - RNA, 64 nt, Homo Sapiens; identical to SEQ ID NO: 183081

SEQ ID NO: 541707 - RNA, 64 nt, Homo Sapiens; identical to SEQ ID NO: 183082

SEQ ID NO: 541708 - RNA, 64 nt, Homo Sapiens; identical to SEQ ID NO: 183083

SEQ ID NO: 541709 - RNA, 64 nt, Homo Sapiens; identical to SEQ ID NO: 183084

SEQ ID NO: 541710 - RNA, 64 nt, Homo Sapiens; identical to SEQ ID NO: 183085

SEQ ID NO: 541711 - RNA, 64 nt, Homo Sapiens; identical to SEQ ID NO: 183086

SEQ ID NO: 541712 - RNA, 64 nt, Homo Sapiens; identical to SEQ ID NO: 183087

SEQ ID NO: 541713 - RNA, 64 nt, Homo Sapiens; identical to SEQ ID NO: 183088

SEQ ID NO: 541714 - RNA, 64 nt, Homo Sapiens; identical to SEQ ID NO: 183089

SEQ ID NO: 541715 - RNA, 64 nt, Homo Sapiens; identical to SEQ ID NO: 183090

SEQ ID NO: 541716 - RNA, 64 nt, Homo Sapiens; identical to SEQ ID NO: 183091

SEQ ID NO: 541717 - RNA, 64 nt, Homo Sapiens; identical to SEQ ID NO: 183092

SEQ ID NO: 541718 - RNA, 64 nt, Homo Sapiens; identical to SEQ ID NO: 183093

SEQ ID NO: 541719 - RNA, 64 nt, Homo Sapiens; identical to SEQ ID NO: 183094

SEQ ID NO: 541720 - RNA, 64 nt, Homo Sapiens; identical to SEQ ID NO: 183095

SEQ ID NO: 541721 - RNA, 64 nt, Homo Sapiens; identical to SEQ ID NO: 183096

SEQ ID NO: 541722 - RNA, 64 nt, Homo Sapiens; identical to SEQ ID NO: 183097

SEQ ID NO: 541723 - RNA, 64 nt, Homo Sapiens; identical to SEQ ID NO: 183098

SEQ ID NO: 541724 - RNA, 64 nt, Homo Sapiens; identical to SEQ ID NO: 183099

SEQ ID NO: 541725 - RNA, 64 nt, Homo Sapiens; identical to SEQ ID NO: 183100

SEQ ID NO: 541726 - RNA, 64 nt, Homo Sapiens; identical to SEQ ID NO: 183101

SEQ ID NO: 541727 - RNA, 64 nt, Homo Sapiens; identical to SEQ ID NO: 183102

SEQ ID NO: 541728 - RNA, 64 nt, Homo Sapiens; identical to SEQ ID NO: 183103

SEQ ID NO: 541729 - RNA, 64 nt, Homo Sapiens; identical to SEQ ID NO: 183104

SEQ ID NO: 541730 - RNA, 64 nt, Homo Sapiens; identical to SEQ ID NO: 183105

SEQ ID NO: 541731 - RNA, 64 nt, Homo Sapiens; identical to SEQ ID NO: 183106

SEQ ID NO: 541732 - RNA, 64 nt, Homo Sapiens; identical to SEQ ID NO: 183107

SEQ ID NO: 541733 - RNA, 64 nt, Homo Sapiens; identical to SEQ ID NO: 183108

SEQ ID NO: 541734 - RNA, 64 nt, Homo Sapiens; identical to SEQ ID NO: 183109

SEQ ID NO: 541735 - RNA, 64 nt, Homo Sapiens; identical to SEQ ID NO: 183110

SEQ ID NO: 541736 - RNA, 64 nt, Homo Sapiens; identical to SEQ ID NO: 183111

SEQ ID NO: 541737 - RNA, 64 nt, Homo Sapiens; identical to SEQ ID NO: 183112

SEQ ID NO: 541738 - RNA, 64 nt, Homo Sapiens; identical to SEQ ID NO: 183113

SEQ ID NO: 541739 - RNA, 64 nt, Homo Sapiens; identical to SEQ ID NO: 183114

SEQ ID NO: 541740 - RNA, 64 nt, Homo Sapiens; identical to SEQ ID NO: 183115

SEQ ID NO: 541741 - RNA, 64 nt, Homo Sapiens; identical to SEQ ID NO: 183116

SEQ ID NO: 541742 - RNA, 64 nt, Homo Sapiens; identical to SEQ ID NO: 183117

SEQ ID NO: 541743 - RNA, 64 nt, Homo Sapiens; identical to SEQ ID NO: 183118

SEQ ID NO: 541744 - RNA, 64 nt, Homo Sapiens; identical to SEQ ID NO: 183119

SEQ ID NO: 541745 - RNA, 64 nt, Homo Sapiens; identical to SEQ ID NO: 183120

SEQ ID NO: 541746 - RNA, 64 nt, Homo Sapiens; identical to SEQ ID NO: 183121

SEQ ID NO: 541747 - RNA, 64 nt, Homo Sapiens; identical to SEQ ID NO: 183122

SEQ ID NO: 541748 - RNA, 64 nt, Homo Sapiens; identical to SEQ ID NO: 183123

SEQ ID NO: 541749 - RNA, 64 nt, Homo Sapiens; identical to SEQ ID NO: 183124

SEQ ID NO: 541750 - RNA, 64 nt, Homo Sapiens; identical to SEQ ID NO: 183125

SEQ ID NO: 541751 - RNA, 64 nt, Homo Sapiens; identical to SEQ ID NO: 183126

SEQ ID NO: 541752 - RNA, 64 nt, Homo Sapiens; identical to SEQ ID NO: 183127

SEQ ID NO: 541753 - RNA, 64 nt, Homo Sapiens; identical to SEQ ID NO: 183128

SEQ ID NO: 541754 - RNA, 64 nt, Homo Sapiens; identical to SEQ ID NO: 183129

SEQ ID NO: 541755 - RNA, 64 nt, Homo Sapiens; identical to SEQ ID NO: 183130

SEQ ID NO: 541756 - RNA, 64 nt, Homo Sapiens; identical to SEQ ID NO: 183131

SEQ ID NO: 541757 - RNA, 64 nt, Homo Sapiens; identical to SEQ ID NO: 183132

SEQ ID NO: 541758 - RNA, 64 nt, Homo Sapiens; identical to SEQ ID NO: 183133

SEQ ID NO: 541759 - RNA, 64 nt, Homo Sapiens; identical to SEQ ID NO: 183134

SEQ ID NO: 541760 - RNA, 64 nt, Homo Sapiens; identical to SEQ ID NO: 183135

SEQ ID NO: 541761 - RNA, 64 nt, Homo Sapiens; identical to SEQ ID NO: 183136

SEQ ID NO: 541762 - RNA, 64 nt, Homo Sapiens; identical to SEQ ID NO: 183137

SEQ ID NO: 541763 - RNA, 64 nt, Homo Sapiens; identical to SEQ ID NO: 183138

SEQ ID NO: 541764 - RNA, 64 nt, Homo Sapiens; identical to SEQ ID NO: 183139

SEQ ID NO: 541765 - RNA, 64 nt, Homo Sapiens; identical to SEQ ID NO: 183140

SEQ ID NO: 541766 - RNA, 64 nt, Homo Sapiens; identical to SEQ ID NO: 183141

SEQ ID NO: 541767 - RNA, 64 nt, Homo Sapiens; identical to SEQ ID NO: 183142

SEQ ID NO: 541768 - RNA, 64 nt, Homo Sapiens; identical to SEQ ID NO: 183143

SEQ ID NO: 541769 - RNA, 64 nt, Homo Sapiens; identical to SEQ ID NO: 183144

SEQ ID NO: 541770 - RNA, 64 nt, Homo Sapiens; identical to SEQ ID NO: 183145

SEQ ID NO: 541771 - RNA, 64 nt, Homo Sapiens; identical to SEQ ID NO: 183146

SEQ ID NO: 541772 - RNA, 64 nt, Homo Sapiens; identical to SEQ ID NO: 183147

SEQ ID NO: 541773 - RNA, 64 nt, Homo Sapiens; identical to SEQ ID NO: 183148

SEQ ID NO: 541774 - RNA, 64 nt, Homo Sapiens; identical to SEQ ID NO: 183149

SEQ ID NO: 541775 - RNA, 64 nt, Homo Sapiens; identical to SEQ ID NO: 183150

SEQ ID NO: 541776 - RNA, 64 nt, Homo Sapiens; identical to SEQ ID NO: 183151

SEQ ID NO: 541777 - RNA, 64 nt, Homo Sapiens; identical to SEQ ID NO: 183152

SEQ ID NO: 541778 - RNA, 64 nt, Homo Sapiens; identical to SEQ ID NO: 183153

SEQ ID NO: 541779 - RNA, 64 nt, Homo Sapiens; identical to SEQ ID NO: 183154

SEQ ID NO: 541780 - RNA, 64 nt, Homo Sapiens; identical to SEQ ID NO: 183155

SEQ ID NO: 541781 - RNA, 64 nt, Homo Sapiens; identical to SEQ ID NO: 183156

SEQ ID NO: 541782 - RNA, 64 nt, Homo Sapiens; identical to SEQ ID NO: 183157

SEQ ID NO: 541783 - RNA, 64 nt, Homo Sapiens; identical to SEQ ID NO: 183158

SEQ ID NO: 541784 - RNA, 64 nt, Homo Sapiens; identical to SEQ ID NO: 183159

SEQ ID NO: 541785 - RNA, 64 nt, Homo Sapiens; identical to SEQ ID NO: 183160

SEQ ID NO: 541786 - RNA, 64 nt, Homo Sapiens; identical to SEQ ID NO: 183161

SEQ ID NO: 541787 - RNA, 64 nt, Homo Sapiens; identical to SEQ ID NO: 183162

SEQ ID NO: 541788 - RNA, 64 nt, Homo Sapiens; identical to SEQ ID NO: 183163

SEQ ID NO: 541789 - RNA, 64 nt, Homo Sapiens; identical to SEQ ID NO: 183164

SEQ ID NO: 541790 - RNA, 64 nt, Homo Sapiens; identical to SEQ ID NO: 183165

SEQ ID NO: 541791 - RNA, 64 nt, Homo Sapiens; identical to SEQ ID NO: 183166

SEQ ID NO: 541792 - RNA, 64 nt, Homo Sapiens; identical to SEQ ID NO: 183167

SEQ ID NO: 541793 - RNA, 64 nt, Homo Sapiens; identical to SEQ ID NO: 183168

SEQ ID NO: 541794 - RNA, 64 nt, Homo Sapiens; identical to SEQ ID NO: 183169

SEQ ID NO: 541795 - RNA, 64 nt, Homo Sapiens; identical to SEQ ID NO: 183170

SEQ ID NO: 541796 - RNA, 64 nt, Homo Sapiens; identical to SEQ ID NO: 183171

SEQ ID NO: 541797 - RNA, 64 nt, Homo Sapiens; identical to SEQ ID NO: 183172

SEQ ID NO: 541798 - RNA, 64 nt, Homo Sapiens; identical to SEQ ID NO: 183173

SEQ ID NO: 541799 - RNA, 64 nt, Homo Sapiens; identical to SEQ ID NO: 183174

SEQ ID NO: 541800 - RNA, 64 nt, Homo Sapiens; identical to SEQ ID NO: 183175

SEQ ID NO: 541801 - RNA, 64 nt, Homo Sapiens; identical to SEQ ID NO: 183176

SEQ ID NO: 541802 - RNA, 64 nt, Homo Sapiens; identical to SEQ ID NO: 183177

SEQ ID NO: 541803 - RNA, 64 nt, Homo Sapiens; identical to SEQ ID NO: 183178

SEQ ID NO: 541804 - RNA, 64 nt, Homo Sapiens; identical to SEQ ID NO: 183179

SEQ ID NO: 541805 - RNA, 64 nt, Homo Sapiens; identical to SEQ ID NO: 183180

SEQ ID NO: 541806 - RNA, 64 nt, Homo Sapiens; identical to SEQ ID NO: 183181

SEQ ID NO: 541807 - RNA, 64 nt, Homo Sapiens; identical to SEQ ID NO: 183182

SEQ ID NO: 541808 - RNA, 64 nt, Homo Sapiens; identical to SEQ ID NO: 183183

SEQ ID NO: 541809 - RNA, 64 nt, Homo Sapiens; identical to SEQ ID NO: 183184

SEQ ID NO: 541810 - RNA, 64 nt, Homo Sapiens; identical to SEQ ID NO: 183185

SEQ ID NO: 541811 - RNA, 64 nt, Homo Sapiens; identical to SEQ ID NO: 183186

SEQ ID NO: 541812 - RNA, 64 nt, Homo Sapiens; identical to SEQ ID NO: 183187

SEQ ID NO: 541813 - RNA, 64 nt, Homo Sapiens; identical to SEQ ID NO: 183188

SEQ ID NO: 541814 - RNA, 64 nt, Homo Sapiens; identical to SEQ ID NO: 183189

SEQ ID NO: 541815 - RNA, 64 nt, Homo Sapiens; identical to SEQ ID NO: 183190

SEQ ID NO: 541816 - RNA, 64 nt, Homo Sapiens; identical to SEQ ID NO: 183191

SEQ ID NO: 541817 - RNA, 64 nt, Homo Sapiens; identical to SEQ ID NO: 183192

SEQ ID NO: 541818 - RNA, 64 nt, Homo Sapiens; identical to SEQ ID NO: 183193

SEQ ID NO: 541819 - RNA, 64 nt, Homo Sapiens; identical to SEQ ID NO: 183194

SEQ ID NO: 541820 - RNA, 64 nt, Homo Sapiens; identical to SEQ ID NO: 183195

SEQ ID NO: 541821 - RNA, 64 nt, Homo Sapiens; identical to SEQ ID NO: 183196

SEQ ID NO: 541822 - RNA, 64 nt, Homo Sapiens; identical to SEQ ID NO: 183197

SEQ ID NO: 541823 - RNA, 64 nt, Homo Sapiens; identical to SEQ ID NO: 183198

SEQ ID NO: 541824 - RNA, 64 nt, Homo Sapiens; identical to SEQ ID NO: 183199

SEQ ID NO: 541825 - RNA, 64 nt, Homo Sapiens; identical to SEQ ID NO: 183200

SEQ ID NO: 541826 - RNA, 64 nt, Homo Sapiens; identical to SEQ ID NO: 183201

SEQ ID NO: 541827 - RNA, 64 nt, Homo Sapiens; identical to SEQ ID NO: 183202

SEQ ID NO: 541828 - RNA, 64 nt, Homo Sapiens; identical to SEQ ID NO: 183203

SEQ ID NO: 541829 - RNA, 64 nt, Homo Sapiens; identical to SEQ ID NO: 183204

SEQ ID NO: 541830 - RNA, 64 nt, Homo Sapiens; identical to SEQ ID NO: 183205

SEQ ID NO: 541831 - RNA, 64 nt, Homo Sapiens; identical to SEQ ID NO: 183206

SEQ ID NO: 541832 - RNA, 64 nt, Homo Sapiens; identical to SEQ ID NO: 183207

SEQ ID NO: 541833 - RNA, 64 nt, Homo Sapiens; identical to SEQ ID NO: 183208

SEQ ID NO: 541834 - RNA, 64 nt, Homo Sapiens; identical to SEQ ID NO: 183209

SEQ ID NO: 541835 - RNA, 64 nt, Homo Sapiens; identical to SEQ ID NO: 183210

SEQ ID NO: 541836 - RNA, 64 nt, Homo Sapiens; identical to SEQ ID NO: 183211

SEQ ID NO: 541837 - RNA, 64 nt, Homo Sapiens; identical to SEQ ID NO: 183212

SEQ ID NO: 541838 - RNA, 64 nt, Homo Sapiens; identical to SEQ ID NO: 183213

SEQ ID NO: 541839 - RNA, 64 nt, Homo Sapiens; identical to SEQ ID NO: 183214

SEQ ID NO: 541840 - RNA, 64 nt, Homo Sapiens; identical to SEQ ID NO: 183215

SEQ ID NO: 541841 - RNA, 64 nt, Homo Sapiens; identical to SEQ ID NO: 183216

SEQ ID NO: 541842 - RNA, 64 nt, Homo Sapiens; identical to SEQ ID NO: 183217

SEQ ID NO: 541843 - RNA, 64 nt, Homo Sapiens; identical to SEQ ID NO: 183218

SEQ ID NO: 541844 - RNA, 64 nt, Homo Sapiens; identical to SEQ ID NO: 183219

SEQ ID NO: 541845 - RNA, 64 nt, Homo Sapiens; identical to SEQ ID NO: 183220

SEQ ID NO: 541846 - RNA, 64 nt, Homo Sapiens; identical to SEQ ID NO: 183221

SEQ ID NO: 541847 - RNA, 64 nt, Homo Sapiens; identical to SEQ ID NO: 183222

SEQ ID NO: 541848 - RNA, 64 nt, Homo Sapiens; identical to SEQ ID NO: 183223

SEQ ID NO: 541849 - RNA, 64 nt, Homo Sapiens; identical to SEQ ID NO: 183224

SEQ ID NO: 541850 - RNA, 64 nt, Homo Sapiens; identical to SEQ ID NO: 183225

SEQ ID NO: 541851 - RNA, 64 nt, Homo Sapiens; identical to SEQ ID NO: 183226

SEQ ID NO: 541852 - RNA, 64 nt, Homo Sapiens; identical to SEQ ID NO: 183227

SEQ ID NO: 541853 - RNA, 64 nt, Homo Sapiens; identical to SEQ ID NO: 183228

SEQ ID NO: 541854 - RNA, 64 nt, Homo Sapiens; identical to SEQ ID NO: 183229

SEQ ID NO: 541855 - RNA, 64 nt, Homo Sapiens; identical to SEQ ID NO: 183230

SEQ ID NO: 541856 - RNA, 64 nt, Homo Sapiens; identical to SEQ ID NO: 183231

SEQ ID NO: 541857 - RNA, 64 nt, Homo Sapiens; identical to SEQ ID NO: 183232

SEQ ID NO: 541858 - RNA, 64 nt, Homo Sapiens; identical to SEQ ID NO: 183233

SEQ ID NO: 541859 - RNA, 64 nt, Homo Sapiens; identical to SEQ ID NO: 183234

SEQ ID NO: 541860 - RNA, 64 nt, Homo Sapiens; identical to SEQ ID NO: 183235

SEQ ID NO: 541861 - RNA, 64 nt, Homo Sapiens; identical to SEQ ID NO: 183236

SEQ ID NO: 541862 - RNA, 64 nt, Homo Sapiens; identical to SEQ ID NO: 183237

SEQ ID NO: 541863 - RNA, 64 nt, Homo Sapiens; identical to SEQ ID NO: 183238

SEQ ID NO: 541864 - RNA, 64 nt, Homo Sapiens; identical to SEQ ID NO: 183239

SEQ ID NO: 541865 - RNA, 64 nt, Homo Sapiens; identical to SEQ ID NO: 183240

SEQ ID NO: 541866 - RNA, 64 nt, Homo Sapiens; identical to SEQ ID NO: 183241

SEQ ID NO: 541867 - RNA, 64 nt, Homo Sapiens; identical to SEQ ID NO: 183242

SEQ ID NO: 541868 - RNA, 64 nt, Homo Sapiens; identical to SEQ ID NO: 183243

SEQ ID NO: 541869 - RNA, 64 nt, Homo Sapiens; identical to SEQ ID NO: 183244

SEQ ID NO: 541870 - RNA, 64 nt, Homo Sapiens; identical to SEQ ID NO: 183245

SEQ ID NO: 541871 - RNA, 64 nt, Homo Sapiens; identical to SEQ ID NO: 183246

SEQ ID NO: 541872 - RNA, 64 nt, Homo Sapiens; identical to SEQ ID NO: 183247

SEQ ID NO: 541873 - RNA, 64 nt, Homo Sapiens; identical to SEQ ID NO: 183248

SEQ ID NO: 541874 - RNA, 64 nt, Homo Sapiens; identical to SEQ ID NO: 183249

SEQ ID NO: 541875 - RNA, 64 nt, Homo Sapiens; identical to SEQ ID NO: 183250

SEQ ID NO: 541876 - RNA, 64 nt, Homo Sapiens; identical to SEQ ID NO: 183251

SEQ ID NO: 541877 - RNA, 64 nt, Homo Sapiens; identical to SEQ ID NO: 183252

SEQ ID NO: 541878 - RNA, 64 nt, Homo Sapiens; identical to SEQ ID NO: 183253

SEQ ID NO: 541879 - RNA, 64 nt, Homo Sapiens; identical to SEQ ID NO: 183254

SEQ ID NO: 541880 - RNA, 64 nt, Homo Sapiens; identical to SEQ ID NO: 183255

SEQ ID NO: 541881 - RNA, 64 nt, Homo Sapiens; identical to SEQ ID NO: 183256

SEQ ID NO: 541882 - RNA, 64 nt, Homo Sapiens; identical to SEQ ID NO: 183257

SEQ ID NO: 541883 - RNA, 64 nt, Homo Sapiens; identical to SEQ ID NO: 183258

SEQ ID NO: 541884 - RNA, 64 nt, Homo Sapiens; identical to SEQ ID NO: 183259

SEQ ID NO: 541885 - RNA, 64 nt, Homo Sapiens; identical to SEQ ID NO: 183260

SEQ ID NO: 541886 - RNA, 64 nt, Homo Sapiens; identical to SEQ ID NO: 183261

SEQ ID NO: 541887 - RNA, 64 nt, Homo Sapiens; identical to SEQ ID NO: 183262

SEQ ID NO: 541888 - RNA, 64 nt, Homo Sapiens; identical to SEQ ID NO: 183263

SEQ ID NO: 541889 - RNA, 64 nt, Homo Sapiens; identical to SEQ ID NO: 183264

SEQ ID NO: 541890 - RNA, 64 nt, Homo Sapiens; identical to SEQ ID NO: 183265

SEQ ID NO: 541891 - RNA, 64 nt, Homo Sapiens; identical to SEQ ID NO: 183266

SEQ ID NO: 541892 - RNA, 64 nt, Homo Sapiens; identical to SEQ ID NO: 183267

SEQ ID NO: 541893 - RNA, 64 nt, Homo Sapiens; identical to SEQ ID NO: 183268

SEQ ID NO: 541894 - RNA, 64 nt, Homo Sapiens; identical to SEQ ID NO: 183269

SEQ ID NO: 541895 - RNA, 64 nt, Homo Sapiens; identical to SEQ ID NO: 183270

SEQ ID NO: 541896 - RNA, 64 nt, Homo Sapiens; identical to SEQ ID NO: 183271

SEQ ID NO: 541897 - RNA, 64 nt, Homo Sapiens; identical to SEQ ID NO: 183272

SEQ ID NO: 541898 - RNA, 64 nt, Homo Sapiens; identical to SEQ ID NO: 183273

SEQ ID NO: 541899 - RNA, 64 nt, Homo Sapiens; identical to SEQ ID NO: 183274

SEQ ID NO: 541900 - RNA, 64 nt, Homo Sapiens; identical to SEQ ID NO: 183275

SEQ ID NO: 541901 - RNA, 64 nt, Homo Sapiens; identical to SEQ ID NO: 183276

SEQ ID NO: 541902 - RNA, 64 nt, Homo Sapiens; identical to SEQ ID NO: 183277

SEQ ID NO: 541903 - RNA, 64 nt, Homo Sapiens; identical to SEQ ID NO: 183278

SEQ ID NO: 541904 - RNA, 64 nt, Homo Sapiens; identical to SEQ ID NO: 183279

SEQ ID NO: 541905 - RNA, 64 nt, Homo Sapiens; identical to SEQ ID NO: 183280

SEQ ID NO: 541906 - RNA, 64 nt, Homo Sapiens; identical to SEQ ID NO: 183281

SEQ ID NO: 541907 - RNA, 64 nt, Homo Sapiens; identical to SEQ ID NO: 183282

SEQ ID NO: 541908 - RNA, 64 nt, Homo Sapiens; identical to SEQ ID NO: 183283

SEQ ID NO: 541909 - RNA, 64 nt, Homo Sapiens; identical to SEQ ID NO: 183284

SEQ ID NO: 541910 - RNA, 64 nt, Homo Sapiens; identical to SEQ ID NO: 183285

SEQ ID NO: 541911 - RNA, 64 nt, Homo Sapiens; identical to SEQ ID NO: 183286

SEQ ID NO: 541912 - RNA, 64 nt, Homo Sapiens; identical to SEQ ID NO: 183287

SEQ ID NO: 541913 - RNA, 64 nt, Homo Sapiens; identical to SEQ ID NO: 183288

SEQ ID NO: 541914 - RNA, 64 nt, Homo Sapiens; identical to SEQ ID NO: 183289

SEQ ID NO: 541915 - RNA, 64 nt, Homo Sapiens; identical to SEQ ID NO: 183290

SEQ ID NO: 541916 - RNA, 64 nt, Homo Sapiens; identical to SEQ ID NO: 183291

SEQ ID NO: 541917 - RNA, 64 nt, Homo Sapiens; identical to SEQ ID NO: 183292

SEQ ID NO: 541918 - RNA, 64 nt, Homo Sapiens; identical to SEQ ID NO: 183293

SEQ ID NO: 541919 - RNA, 64 nt, Homo Sapiens; identical to SEQ ID NO: 183294

SEQ ID NO: 541920 - RNA, 64 nt, Homo Sapiens; identical to SEQ ID NO: 183295

SEQ ID NO: 541921 - RNA, 64 nt, Homo Sapiens; identical to SEQ ID NO: 183296

SEQ ID NO: 541922 - RNA, 64 nt, Homo Sapiens; identical to SEQ ID NO: 183297

SEQ ID NO: 541923 - RNA, 64 nt, Homo Sapiens; identical to SEQ ID NO: 183298

SEQ ID NO: 541924 - RNA, 64 nt, Homo Sapiens; identical to SEQ ID NO: 183299

SEQ ID NO: 541925 - RNA, 64 nt, Homo Sapiens; identical to SEQ ID NO: 183300

SEQ ID NO: 541926 - RNA, 64 nt, Homo Sapiens; identical to SEQ ID NO: 183301

SEQ ID NO: 541927 - RNA, 64 nt, Homo Sapiens; identical to SEQ ID NO: 183302

SEQ ID NO: 541928 - RNA, 64 nt, Homo Sapiens; identical to SEQ ID NO: 183303

SEQ ID NO: 541929 - RNA, 64 nt, Homo Sapiens; identical to SEQ ID NO: 183304

SEQ ID NO: 541930 - RNA, 64 nt, Homo Sapiens; identical to SEQ ID NO: 183305

SEQ ID NO: 541931 - RNA, 64 nt, Homo Sapiens; identical to SEQ ID NO: 183306

SEQ ID NO: 541932 - RNA, 64 nt, Homo Sapiens; identical to SEQ ID NO: 183307

SEQ ID NO: 541933 - RNA, 64 nt, Homo Sapiens; identical to SEQ ID NO: 183308

SEQ ID NO: 541934 - RNA, 64 nt, Homo Sapiens; identical to SEQ ID NO: 183309

SEQ ID NO: 541935 - RNA, 64 nt, Homo Sapiens; identical to SEQ ID NO: 183310

SEQ ID NO: 541936 - RNA, 64 nt, Homo Sapiens; identical to SEQ ID NO: 183311

SEQ ID NO: 541937 - RNA, 64 nt, Homo Sapiens; identical to SEQ ID NO: 183312

SEQ ID NO: 541938 - RNA, 64 nt, Homo Sapiens; identical to SEQ ID NO: 183313

SEQ ID NO: 541939 - RNA, 64 nt, Homo Sapiens; identical to SEQ ID NO: 183314

SEQ ID NO: 541940 - RNA, 64 nt, Homo Sapiens; identical to SEQ ID NO: 183315

SEQ ID NO: 541941 - RNA, 64 nt, Homo Sapiens; identical to SEQ ID NO: 183316

SEQ ID NO: 541942 - RNA, 64 nt, Homo Sapiens; identical to SEQ ID NO: 183317

SEQ ID NO: 541943 - RNA, 64 nt, Homo Sapiens; identical to SEQ ID NO: 183318

SEQ ID NO: 541944 - RNA, 64 nt, Homo Sapiens; identical to SEQ ID NO: 183319

SEQ ID NO: 541945 - RNA, 64 nt, Homo Sapiens; identical to SEQ ID NO: 183320

SEQ ID NO: 541946 - RNA, 64 nt, Homo Sapiens; identical to SEQ ID NO: 183321

SEQ ID NO: 541947 - RNA, 64 nt, Homo Sapiens; identical to SEQ ID NO: 183322

SEQ ID NO: 541948 - RNA, 64 nt, Homo Sapiens; identical to SEQ ID NO: 183323

SEQ ID NO: 541949 - RNA, 64 nt, Homo Sapiens; identical to SEQ ID NO: 183324

SEQ ID NO: 541950 - RNA, 64 nt, Homo Sapiens; identical to SEQ ID NO: 183325

SEQ ID NO: 541951 - RNA, 64 nt, Homo Sapiens; identical to SEQ ID NO: 183326

SEQ ID NO: 541952 - RNA, 64 nt, Homo Sapiens; identical to SEQ ID NO: 183327

SEQ ID NO: 541953 - RNA, 64 nt, Homo Sapiens; identical to SEQ ID NO: 183328

SEQ ID NO: 541954 - RNA, 64 nt, Homo Sapiens; identical to SEQ ID NO: 183329

SEQ ID NO: 541955 - RNA, 64 nt, Homo Sapiens; identical to SEQ ID NO: 183330

SEQ ID NO: 541956 - RNA, 64 nt, Homo Sapiens; identical to SEQ ID NO: 183331

SEQ ID NO: 541957 - RNA, 64 nt, Homo Sapiens; identical to SEQ ID NO: 183332

SEQ ID NO: 541958 - RNA, 64 nt, Homo Sapiens; identical to SEQ ID NO: 183333

SEQ ID NO: 541959 - RNA, 64 nt, Homo Sapiens; identical to SEQ ID NO: 183334

SEQ ID NO: 541960 - RNA, 64 nt, Homo Sapiens; identical to SEQ ID NO: 183335

SEQ ID NO: 541961 - RNA, 64 nt, Homo Sapiens; identical to SEQ ID NO: 183336

SEQ ID NO: 541962 - RNA, 64 nt, Homo Sapiens; identical to SEQ ID NO: 183337

SEQ ID NO: 541963 - RNA, 64 nt, Homo Sapiens; identical to SEQ ID NO: 183338

SEQ ID NO: 541964 - RNA, 64 nt, Homo Sapiens; identical to SEQ ID NO: 183339

SEQ ID NO: 541965 - RNA, 64 nt, Homo Sapiens; identical to SEQ ID NO: 183340

SEQ ID NO: 541966 - RNA, 64 nt, Homo Sapiens; identical to SEQ ID NO: 183341

SEQ ID NO: 541967 - RNA, 64 nt, Homo Sapiens; identical to SEQ ID NO: 183342

SEQ ID NO: 541968 - RNA, 64 nt, Homo Sapiens; identical to SEQ ID NO: 183343

SEQ ID NO: 541969 - RNA, 64 nt, Homo Sapiens; identical to SEQ ID NO: 183344

SEQ ID NO: 541970 - RNA, 64 nt, Homo Sapiens; identical to SEQ ID NO: 183345

SEQ ID NO: 541971 - RNA, 64 nt, Homo Sapiens; identical to SEQ ID NO: 183346

SEQ ID NO: 541972 - RNA, 64 nt, Homo Sapiens; identical to SEQ ID NO: 183347

SEQ ID NO: 541973 - RNA, 64 nt, Homo Sapiens; identical to SEQ ID NO: 183348

SEQ ID NO: 541974 - RNA, 64 nt, Homo Sapiens; identical to SEQ ID NO: 183349

SEQ ID NO: 541975 - RNA, 64 nt, Homo Sapiens; identical to SEQ ID NO: 183350

SEQ ID NO: 541976 - RNA, 64 nt, Homo Sapiens; identical to SEQ ID NO: 183351

SEQ ID NO: 541977 - RNA, 64 nt, Homo Sapiens; identical to SEQ ID NO: 183352

SEQ ID NO: 541978 - RNA, 64 nt, Homo Sapiens; identical to SEQ ID NO: 183353

SEQ ID NO: 541979 - RNA, 64 nt, Homo Sapiens; identical to SEQ ID NO: 183354

SEQ ID NO: 541980 - RNA, 64 nt, Homo Sapiens; identical to SEQ ID NO: 183355

SEQ ID NO: 541981 - RNA, 64 nt, Homo Sapiens; identical to SEQ ID NO: 183356

SEQ ID NO: 541982 - RNA, 64 nt, Homo Sapiens; identical to SEQ ID NO: 183357

SEQ ID NO: 541983 - RNA, 64 nt, Homo Sapiens; identical to SEQ ID NO: 183358

SEQ ID NO: 541984 - RNA, 64 nt, Homo Sapiens; identical to SEQ ID NO: 183359

SEQ ID NO: 541985 - RNA, 64 nt, Homo Sapiens; identical to SEQ ID NO: 183360

SEQ ID NO: 541986 - RNA, 64 nt, Homo Sapiens; identical to SEQ ID NO: 183361

SEQ ID NO: 541987 - RNA, 64 nt, Homo Sapiens; identical to SEQ ID NO: 183362

SEQ ID NO: 541988 - RNA, 64 nt, Homo Sapiens; identical to SEQ ID NO: 183363

SEQ ID NO: 541989 - RNA, 64 nt, Homo Sapiens; identical to SEQ ID NO: 183364

SEQ ID NO: 541990 - RNA, 64 nt, Homo Sapiens; identical to SEQ ID NO: 183365

SEQ ID NO: 541991 - RNA, 64 nt, Homo Sapiens; identical to SEQ ID NO: 183366

SEQ ID NO: 541992 - RNA, 64 nt, Homo Sapiens; identical to SEQ ID NO: 183367

SEQ ID NO: 541993 - RNA, 64 nt, Homo Sapiens; identical to SEQ ID NO: 183368

SEQ ID NO: 541994 - RNA, 63 nt, Homo Sapiens; identical to SEQ ID NO: 183369

SEQ ID NO: 541995 - RNA, 64 nt, Homo Sapiens; identical to SEQ ID NO: 183370

SEQ ID NO: 541996 - RNA, 64 nt, Homo Sapiens; identical to SEQ ID NO: 183371

SEQ ID NO: 541997 - RNA, 64 nt, Homo Sapiens; identical to SEQ ID NO: 183372

SEQ ID NO: 541998 - RNA, 64 nt, Homo Sapiens; identical to SEQ ID NO: 183373

SEQ ID NO: 541999 - RNA, 64 nt, Homo Sapiens; identical to SEQ ID NO: 183374

SEQ ID NO: 542000 - RNA, 64 nt, Homo Sapiens; identical to SEQ ID NO: 183375

SEQ ID NO: 542001 - RNA, 64 nt, Homo Sapiens; identical to SEQ ID NO: 183376

SEQ ID NO: 542002 - RNA, 64 nt, Homo Sapiens; identical to SEQ ID NO: 183377

SEQ ID NO: 542003 - RNA, 64 nt, Homo Sapiens; identical to SEQ ID NO: 183378

SEQ ID NO: 542004 - RNA, 64 nt, Homo Sapiens; identical to SEQ ID NO: 183379

SEQ ID NO: 542005 - RNA, 64 nt, Homo Sapiens; identical to SEQ ID NO: 183380

SEQ ID NO: 542006 - RNA, 64 nt, Homo Sapiens; identical to SEQ ID NO: 183381

SEQ ID NO: 542007 - RNA, 64 nt, Homo Sapiens; identical to SEQ ID NO: 183382

SEQ ID NO: 542008 - RNA, 64 nt, Homo Sapiens; identical to SEQ ID NO: 183383

SEQ ID NO: 542009 - RNA, 64 nt, Homo Sapiens; identical to SEQ ID NO: 183384

SEQ ID NO: 542010 - RNA, 64 nt, Homo Sapiens; identical to SEQ ID NO: 183385

SEQ ID NO: 542011 - RNA, 64 nt, Homo Sapiens; identical to SEQ ID NO: 183386

SEQ ID NO: 542012 - RNA, 64 nt, Homo Sapiens; identical to SEQ ID NO: 183387

SEQ ID NO: 542013 - RNA, 64 nt, Homo Sapiens; identical to SEQ ID NO: 183388

SEQ ID NO: 542014 - RNA, 64 nt, Homo Sapiens; identical to SEQ ID NO: 183389

SEQ ID NO: 542015 - RNA, 64 nt, Homo Sapiens; identical to SEQ ID NO: 183390

SEQ ID NO: 542016 - RNA, 64 nt, Homo Sapiens; identical to SEQ ID NO: 183391

SEQ ID NO: 542017 - RNA, 64 nt, Homo Sapiens; identical to SEQ ID NO: 183392

SEQ ID NO: 542018 - RNA, 64 nt, Homo Sapiens; identical to SEQ ID NO: 183393

SEQ ID NO: 542019 - RNA, 64 nt, Homo Sapiens; identical to SEQ ID NO: 183394

SEQ ID NO: 542020 - RNA, 64 nt, Homo Sapiens; identical to SEQ ID NO: 183395

SEQ ID NO: 542021 - RNA, 64 nt, Homo Sapiens; identical to SEQ ID NO: 183396

SEQ ID NO: 542022 - RNA, 64 nt, Homo Sapiens; identical to SEQ ID NO: 183397

SEQ ID NO: 542023 - RNA, 64 nt, Homo Sapiens; identical to SEQ ID NO: 183398

SEQ ID NO: 542024 - RNA, 64 nt, Homo Sapiens; identical to SEQ ID NO: 183399

SEQ ID NO: 542025 - RNA, 64 nt, Homo Sapiens; identical to SEQ ID NO: 183400

SEQ ID NO: 542026 - RNA, 64 nt, Homo Sapiens; identical to SEQ ID NO: 183401

SEQ ID NO: 542027 - RNA, 64 nt, Homo Sapiens; identical to SEQ ID NO: 183402

SEQ ID NO: 542028 - RNA, 64 nt, Homo Sapiens; identical to SEQ ID NO: 183403

SEQ ID NO: 542029 - RNA, 64 nt, Homo Sapiens; identical to SEQ ID NO: 183404

SEQ ID NO: 542030 - RNA, 64 nt, Homo Sapiens; identical to SEQ ID NO: 183405

SEQ ID NO: 542031 - RNA, 64 nt, Homo Sapiens; identical to SEQ ID NO: 183406

SEQ ID NO: 542032 - RNA, 64 nt, Homo Sapiens; identical to SEQ ID NO: 183407

SEQ ID NO: 542033 - RNA, 64 nt, Homo Sapiens; identical to SEQ ID NO: 183408

SEQ ID NO: 542034 - RNA, 64 nt, Homo Sapiens; identical to SEQ ID NO: 183409

SEQ ID NO: 542035 - RNA, 64 nt, Homo Sapiens; identical to SEQ ID NO: 183410

SEQ ID NO: 542036 - RNA, 64 nt, Homo Sapiens; identical to SEQ ID NO: 183411

SEQ ID NO: 542037 - RNA, 64 nt, Homo Sapiens; identical to SEQ ID NO: 183412

SEQ ID NO: 542038 - RNA, 64 nt, Homo Sapiens; identical to SEQ ID NO: 183413

SEQ ID NO: 542039 - RNA, 64 nt, Homo Sapiens; identical to SEQ ID NO: 183414

SEQ ID NO: 542040 - RNA, 64 nt, Homo Sapiens; identical to SEQ ID NO: 183415

SEQ ID NO: 542041 - RNA, 64 nt, Homo Sapiens; identical to SEQ ID NO: 183416

SEQ ID NO: 542042 - RNA, 64 nt, Homo Sapiens; identical to SEQ ID NO: 183417

SEQ ID NO: 542043 - RNA, 64 nt, Homo Sapiens; identical to SEQ ID NO: 183418

SEQ ID NO: 542044 - RNA, 64 nt, Homo Sapiens; identical to SEQ ID NO: 183419

SEQ ID NO: 542045 - RNA, 64 nt, Homo Sapiens; identical to SEQ ID NO: 183420

SEQ ID NO: 542046 - RNA, 64 nt, Homo Sapiens; identical to SEQ ID NO: 183421

SEQ ID NO: 542047 - RNA, 64 nt, Homo Sapiens; identical to SEQ ID NO: 183422

SEQ ID NO: 542048 - RNA, 64 nt, Homo Sapiens; identical to SEQ ID NO: 183423

SEQ ID NO: 542049 - RNA, 64 nt, Homo Sapiens; identical to SEQ ID NO: 183424

SEQ ID NO: 542050 - RNA, 64 nt, Homo Sapiens; identical to SEQ ID NO: 183425

SEQ ID NO: 542051 - RNA, 64 nt, Homo Sapiens; identical to SEQ ID NO: 183426

SEQ ID NO: 542052 - RNA, 64 nt, Homo Sapiens; identical to SEQ ID NO: 183427

SEQ ID NO: 542053 - RNA, 64 nt, Homo Sapiens; identical to SEQ ID NO: 183428

SEQ ID NO: 542054 - RNA, 64 nt, Homo Sapiens; identical to SEQ ID NO: 183429

SEQ ID NO: 542055 - RNA, 64 nt, Homo Sapiens; identical to SEQ ID NO: 183430

SEQ ID NO: 542056 - RNA, 64 nt, Homo Sapiens; identical to SEQ ID NO: 183431

SEQ ID NO: 542057 - RNA, 64 nt, Homo Sapiens; identical to SEQ ID NO: 183432

SEQ ID NO: 542058 - RNA, 64 nt, Homo Sapiens; identical to SEQ ID NO: 183433

SEQ ID NO: 542059 - RNA, 64 nt, Homo Sapiens; identical to SEQ ID NO: 183434

SEQ ID NO: 542060 - RNA, 64 nt, Homo Sapiens; identical to SEQ ID NO: 183435

SEQ ID NO: 542061 - RNA, 64 nt, Homo Sapiens; identical to SEQ ID NO: 183436

SEQ ID NO: 542062 - RNA, 64 nt, Homo Sapiens; identical to SEQ ID NO: 183437

SEQ ID NO: 542063 - RNA, 64 nt, Homo Sapiens; identical to SEQ ID NO: 183438

SEQ ID NO: 542064 - RNA, 64 nt, Homo Sapiens; identical to SEQ ID NO: 183439

SEQ ID NO: 542065 - RNA, 64 nt, Homo Sapiens; identical to SEQ ID NO: 183440

SEQ ID NO: 542066 - RNA, 64 nt, Homo Sapiens; identical to SEQ ID NO: 183441

SEQ ID NO: 542067 - RNA, 64 nt, Homo Sapiens; identical to SEQ ID NO: 183442

SEQ ID NO: 542068 - RNA, 64 nt, Homo Sapiens; identical to SEQ ID NO: 183443

SEQ ID NO: 542069 - RNA, 64 nt, Homo Sapiens; identical to SEQ ID NO: 183444

SEQ ID NO: 542070 - RNA, 64 nt, Homo Sapiens; identical to SEQ ID NO: 183445

SEQ ID NO: 542071 - RNA, 64 nt, Homo Sapiens; identical to SEQ ID NO: 183446

SEQ ID NO: 542072 - RNA, 64 nt, Homo Sapiens; identical to SEQ ID NO: 183447

SEQ ID NO: 542073 - RNA, 64 nt, Homo Sapiens; identical to SEQ ID NO: 183448

SEQ ID NO: 542074 - RNA, 64 nt, Homo Sapiens; identical to SEQ ID NO: 183449

SEQ ID NO: 542075 - RNA, 64 nt, Homo Sapiens; identical to SEQ ID NO: 183450

SEQ ID NO: 542076 - RNA, 64 nt, Homo Sapiens; identical to SEQ ID NO: 183451

SEQ ID NO: 542077 - RNA, 64 nt, Homo Sapiens; identical to SEQ ID NO: 183452

SEQ ID NO: 542078 - RNA, 64 nt, Homo Sapiens; identical to SEQ ID NO: 183453

SEQ ID NO: 542079 - RNA, 64 nt, Homo Sapiens; identical to SEQ ID NO: 183454

SEQ ID NO: 542080 - RNA, 64 nt, Homo Sapiens; identical to SEQ ID NO: 183455

SEQ ID NO: 542081 - RNA, 64 nt, Homo Sapiens; identical to SEQ ID NO: 183456

SEQ ID NO: 542082 - RNA, 64 nt, Homo Sapiens; identical to SEQ ID NO: 183457

SEQ ID NO: 542083 - RNA, 64 nt, Homo Sapiens; identical to SEQ ID NO: 183458

SEQ ID NO: 542084 - RNA, 64 nt, Homo Sapiens; identical to SEQ ID NO: 183459

SEQ ID NO: 542085 - RNA, 64 nt, Homo Sapiens; identical to SEQ ID NO: 183460

SEQ ID NO: 542086 - RNA, 64 nt, Homo Sapiens; identical to SEQ ID NO: 183461

SEQ ID NO: 542087 - RNA, 64 nt, Homo Sapiens; identical to SEQ ID NO: 183462

SEQ ID NO: 542088 - RNA, 64 nt, Homo Sapiens; identical to SEQ ID NO: 183463

SEQ ID NO: 542089 - RNA, 64 nt, Homo Sapiens; identical to SEQ ID NO: 183464

SEQ ID NO: 542090 - RNA, 64 nt, Homo Sapiens; identical to SEQ ID NO: 183465

SEQ ID NO: 542091 - RNA, 64 nt, Homo Sapiens; identical to SEQ ID NO: 183466

SEQ ID NO: 542092 - RNA, 64 nt, Homo Sapiens; identical to SEQ ID NO: 183467

SEQ ID NO: 542093 - RNA, 64 nt, Homo Sapiens; identical to SEQ ID NO: 183468

SEQ ID NO: 542094 - RNA, 64 nt, Homo Sapiens; identical to SEQ ID NO: 183469

SEQ ID NO: 542095 - RNA, 64 nt, Homo Sapiens; identical to SEQ ID NO: 183470

SEQ ID NO: 542096 - RNA, 64 nt, Homo Sapiens; identical to SEQ ID NO: 183471

SEQ ID NO: 542097 - RNA, 64 nt, Homo Sapiens; identical to SEQ ID NO: 183472

SEQ ID NO: 542098 - RNA, 64 nt, Homo Sapiens; identical to SEQ ID NO: 183473

SEQ ID NO: 542099 - RNA, 64 nt, Homo Sapiens; identical to SEQ ID NO: 183474

SEQ ID NO: 542100 - RNA, 64 nt, Homo Sapiens; identical to SEQ ID NO: 183475

SEQ ID NO: 542101 - RNA, 64 nt, Homo Sapiens; identical to SEQ ID NO: 183476

SEQ ID NO: 542102 - RNA, 64 nt, Homo Sapiens; identical to SEQ ID NO: 183477

SEQ ID NO: 542103 - RNA, 64 nt, Homo Sapiens; identical to SEQ ID NO: 183478

SEQ ID NO: 542104 - RNA, 64 nt, Homo Sapiens; identical to SEQ ID NO: 183479

SEQ ID NO: 542105 - RNA, 64 nt, Homo Sapiens; identical to SEQ ID NO: 183480

SEQ ID NO: 542106 - RNA, 64 nt, Homo Sapiens; identical to SEQ ID NO: 183481

SEQ ID NO: 542107 - RNA, 64 nt, Homo Sapiens; identical to SEQ ID NO: 183482

SEQ ID NO: 542108 - RNA, 64 nt, Homo Sapiens; identical to SEQ ID NO: 183483

SEQ ID NO: 542109 - RNA, 64 nt, Homo Sapiens; identical to SEQ ID NO: 183484

SEQ ID NO: 542110 - RNA, 64 nt, Homo Sapiens; identical to SEQ ID NO: 183485

SEQ ID NO: 542111 - RNA, 64 nt, Homo Sapiens; identical to SEQ ID NO: 183486

SEQ ID NO: 542112 - RNA, 64 nt, Homo Sapiens; identical to SEQ ID NO: 183487

SEQ ID NO: 542113 - RNA, 64 nt, Homo Sapiens; identical to SEQ ID NO: 183488

SEQ ID NO: 542114 - RNA, 64 nt, Homo Sapiens; identical to SEQ ID NO: 183489

SEQ ID NO: 542115 - RNA, 64 nt, Homo Sapiens; identical to SEQ ID NO: 183490

SEQ ID NO: 542116 - RNA, 64 nt, Homo Sapiens; identical to SEQ ID NO: 183491

SEQ ID NO: 542117 - RNA, 64 nt, Homo Sapiens; identical to SEQ ID NO: 183492

SEQ ID NO: 542118 - RNA, 64 nt, Homo Sapiens; identical to SEQ ID NO: 183493

SEQ ID NO: 542119 - RNA, 64 nt, Homo Sapiens; identical to SEQ ID NO: 183494

SEQ ID NO: 542120 - RNA, 64 nt, Homo Sapiens; identical to SEQ ID NO: 183495

SEQ ID NO: 542121 - RNA, 64 nt, Homo Sapiens; identical to SEQ ID NO: 183496

SEQ ID NO: 542122 - RNA, 64 nt, Homo Sapiens; identical to SEQ ID NO: 183497

SEQ ID NO: 542123 - RNA, 64 nt, Homo Sapiens; identical to SEQ ID NO: 183498

SEQ ID NO: 542124 - RNA, 64 nt, Homo Sapiens; identical to SEQ ID NO: 183499

SEQ ID NO: 542125 - RNA, 64 nt, Homo Sapiens; identical to SEQ ID NO: 183500

SEQ ID NO: 542126 - RNA, 64 nt, Homo Sapiens; identical to SEQ ID NO: 183501

SEQ ID NO: 542127 - RNA, 64 nt, Homo Sapiens; identical to SEQ ID NO: 183502

SEQ ID NO: 542128 - RNA, 64 nt, Homo Sapiens; identical to SEQ ID NO: 183503

SEQ ID NO: 542129 - RNA, 64 nt, Homo Sapiens; identical to SEQ ID NO: 183504

SEQ ID NO: 542130 - RNA, 64 nt, Homo Sapiens; identical to SEQ ID NO: 183505

SEQ ID NO: 542131 - RNA, 64 nt, Homo Sapiens; identical to SEQ ID NO: 183506

SEQ ID NO: 542132 - RNA, 64 nt, Homo Sapiens; identical to SEQ ID NO: 183507

SEQ ID NO: 542133 - RNA, 64 nt, Homo Sapiens; identical to SEQ ID NO: 183508

SEQ ID NO: 542134 - RNA, 64 nt, Homo Sapiens; identical to SEQ ID NO: 183509

SEQ ID NO: 542135 - RNA, 64 nt, Homo Sapiens; identical to SEQ ID NO: 183510

SEQ ID NO: 542136 - RNA, 64 nt, Homo Sapiens; identical to SEQ ID NO: 183511

SEQ ID NO: 542137 - RNA, 64 nt, Homo Sapiens; identical to SEQ ID NO: 183512

SEQ ID NO: 542138 - RNA, 64 nt, Homo Sapiens; identical to SEQ ID NO: 183513

SEQ ID NO: 542139 - RNA, 64 nt, Homo Sapiens; identical to SEQ ID NO: 183514

SEQ ID NO: 542140 - RNA, 64 nt, Homo Sapiens; identical to SEQ ID NO: 183515

SEQ ID NO: 542141 - RNA, 64 nt, Homo Sapiens; identical to SEQ ID NO: 183516

SEQ ID NO: 542142 - RNA, 64 nt, Homo Sapiens; identical to SEQ ID NO: 183517

SEQ ID NO: 542143 - RNA, 64 nt, Homo Sapiens; identical to SEQ ID NO: 183518

SEQ ID NO: 542144 - RNA, 64 nt, Homo Sapiens; identical to SEQ ID NO: 183519

SEQ ID NO: 542145 - RNA, 64 nt, Homo Sapiens; identical to SEQ ID NO: 183520

SEQ ID NO: 542146 - RNA, 64 nt, Homo Sapiens; identical to SEQ ID NO: 183521

SEQ ID NO: 542147 - RNA, 64 nt, Homo Sapiens; identical to SEQ ID NO: 183522

SEQ ID NO: 542148 - RNA, 64 nt, Homo Sapiens; identical to SEQ ID NO: 183523

SEQ ID NO: 542149 - RNA, 64 nt, Homo Sapiens; identical to SEQ ID NO: 183524

SEQ ID NO: 542150 - RNA, 64 nt, Homo Sapiens; identical to SEQ ID NO: 183525

SEQ ID NO: 542151 - RNA, 64 nt, Homo Sapiens; identical to SEQ ID NO: 183526

SEQ ID NO: 542152 - RNA, 64 nt, Homo Sapiens; identical to SEQ ID NO: 183527

SEQ ID NO: 542153 - RNA, 64 nt, Homo Sapiens; identical to SEQ ID NO: 183528

SEQ ID NO: 542154 - RNA, 64 nt, Homo Sapiens; identical to SEQ ID NO: 183529

SEQ ID NO: 542155 - RNA, 64 nt, Homo Sapiens; identical to SEQ ID NO: 183530

SEQ ID NO: 542156 - RNA, 64 nt, Homo Sapiens; identical to SEQ ID NO: 183531

SEQ ID NO: 542157 - RNA, 64 nt, Homo Sapiens; identical to SEQ ID NO: 183532

SEQ ID NO: 542158 - RNA, 64 nt, Homo Sapiens; identical to SEQ ID NO: 183533

SEQ ID NO: 542159 - RNA, 64 nt, Homo Sapiens; identical to SEQ ID NO: 183534

SEQ ID NO: 542160 - RNA, 64 nt, Homo Sapiens; identical to SEQ ID NO: 183535

SEQ ID NO: 542161 - RNA, 64 nt, Homo Sapiens; identical to SEQ ID NO: 183536

SEQ ID NO: 542162 - RNA, 64 nt, Homo Sapiens; identical to SEQ ID NO: 183537

SEQ ID NO: 542163 - RNA, 64 nt, Homo Sapiens; identical to SEQ ID NO: 183538

SEQ ID NO: 542164 - RNA, 64 nt, Homo Sapiens; identical to SEQ ID NO: 183539

SEQ ID NO: 542165 - RNA, 64 nt, Homo Sapiens; identical to SEQ ID NO: 183540

SEQ ID NO: 542166 - RNA, 64 nt, Homo Sapiens; identical to SEQ ID NO: 183541

SEQ ID NO: 542167 - RNA, 64 nt, Homo Sapiens; identical to SEQ ID NO: 183542

SEQ ID NO: 542168 - RNA, 64 nt, Homo Sapiens; identical to SEQ ID NO: 183543

SEQ ID NO: 542169 - RNA, 64 nt, Homo Sapiens; identical to SEQ ID NO: 183544

SEQ ID NO: 542170 - RNA, 64 nt, Homo Sapiens; identical to SEQ ID NO: 183545

SEQ ID NO: 542171 - RNA, 64 nt, Homo Sapiens; identical to SEQ ID NO: 183546

SEQ ID NO: 542172 - RNA, 64 nt, Homo Sapiens; identical to SEQ ID NO: 183547

SEQ ID NO: 542173 - RNA, 64 nt, Homo Sapiens; identical to SEQ ID NO: 183548

SEQ ID NO: 542174 - RNA, 64 nt, Homo Sapiens; identical to SEQ ID NO: 183549

SEQ ID NO: 542175 - RNA, 64 nt, Homo Sapiens; identical to SEQ ID NO: 183550

SEQ ID NO: 542176 - RNA, 64 nt, Homo Sapiens; identical to SEQ ID NO: 183551

SEQ ID NO: 542177 - RNA, 64 nt, Homo Sapiens; identical to SEQ ID NO: 183552

SEQ ID NO: 542178 - RNA, 64 nt, Homo Sapiens; identical to SEQ ID NO: 183553

SEQ ID NO: 542179 - RNA, 64 nt, Homo Sapiens; identical to SEQ ID NO: 183554

SEQ ID NO: 542180 - RNA, 64 nt, Homo Sapiens; identical to SEQ ID NO: 183555

SEQ ID NO: 542181 - RNA, 64 nt, Homo Sapiens; identical to SEQ ID NO: 183556

SEQ ID NO: 542182 - RNA, 64 nt, Homo Sapiens; identical to SEQ ID NO: 183557

SEQ ID NO: 542183 - RNA, 64 nt, Homo Sapiens; identical to SEQ ID NO: 183558

SEQ ID NO: 542184 - RNA, 64 nt, Homo Sapiens; identical to SEQ ID NO: 183559

SEQ ID NO: 542185 - RNA, 64 nt, Homo Sapiens; identical to SEQ ID NO: 183560

SEQ ID NO: 542186 - RNA, 64 nt, Homo Sapiens; identical to SEQ ID NO: 183561

SEQ ID NO: 542187 - RNA, 64 nt, Homo Sapiens; identical to SEQ ID NO: 183562

SEQ ID NO: 542188 - RNA, 64 nt, Homo Sapiens; identical to SEQ ID NO: 183563

SEQ ID NO: 542189 - RNA, 64 nt, Homo Sapiens; identical to SEQ ID NO: 183564

SEQ ID NO: 542190 - RNA, 64 nt, Homo Sapiens; identical to SEQ ID NO: 183565

SEQ ID NO: 542191 - RNA, 64 nt, Homo Sapiens; identical to SEQ ID NO: 183566

SEQ ID NO: 542192 - RNA, 64 nt, Homo Sapiens; identical to SEQ ID NO: 183567

SEQ ID NO: 542193 - RNA, 64 nt, Homo Sapiens; identical to SEQ ID NO: 183568

SEQ ID NO: 542194 - RNA, 64 nt, Homo Sapiens; identical to SEQ ID NO: 183569

SEQ ID NO: 542195 - RNA, 64 nt, Homo Sapiens; identical to SEQ ID NO: 183570

SEQ ID NO: 542196 - RNA, 64 nt, Homo Sapiens; identical to SEQ ID NO: 183571

SEQ ID NO: 542197 - RNA, 64 nt, Homo Sapiens; identical to SEQ ID NO: 183572

SEQ ID NO: 542198 - RNA, 64 nt, Homo Sapiens; identical to SEQ ID NO: 183573

SEQ ID NO: 542199 - RNA, 64 nt, Homo Sapiens; identical to SEQ ID NO: 183574

SEQ ID NO: 542200 - RNA, 64 nt, Homo Sapiens; identical to SEQ ID NO: 183575

SEQ ID NO: 542201 - RNA, 64 nt, Homo Sapiens; identical to SEQ ID NO: 183576

SEQ ID NO: 542202 - RNA, 64 nt, Homo Sapiens; identical to SEQ ID NO: 183577

SEQ ID NO: 542203 - RNA, 64 nt, Homo Sapiens; identical to SEQ ID NO: 183578

SEQ ID NO: 542204 - RNA, 64 nt, Homo Sapiens; identical to SEQ ID NO: 183579

SEQ ID NO: 542205 - RNA, 64 nt, Homo Sapiens; identical to SEQ ID NO: 183580

SEQ ID NO: 542206 - RNA, 64 nt, Homo Sapiens; identical to SEQ ID NO: 183581

SEQ ID NO: 542207 - RNA, 64 nt, Homo Sapiens; identical to SEQ ID NO: 183582

SEQ ID NO: 542208 - RNA, 64 nt, Homo Sapiens; identical to SEQ ID NO: 183583

SEQ ID NO: 542209 - RNA, 64 nt, Homo Sapiens; identical to SEQ ID NO: 183584

SEQ ID NO: 542210 - RNA, 64 nt, Homo Sapiens; identical to SEQ ID NO: 183585

SEQ ID NO: 542211 - RNA, 64 nt, Homo Sapiens; identical to SEQ ID NO: 183586

SEQ ID NO: 542212 - RNA, 64 nt, Homo Sapiens; identical to SEQ ID NO: 183587

SEQ ID NO: 542213 - RNA, 64 nt, Homo Sapiens; identical to SEQ ID NO: 183588

SEQ ID NO: 542214 - RNA, 64 nt, Homo Sapiens; identical to SEQ ID NO: 183589

SEQ ID NO: 542215 - RNA, 64 nt, Homo Sapiens; identical to SEQ ID NO: 183590

SEQ ID NO: 542216 - RNA, 64 nt, Homo Sapiens; identical to SEQ ID NO: 183591

SEQ ID NO: 542217 - RNA, 64 nt, Homo Sapiens; identical to SEQ ID NO: 183592

SEQ ID NO: 542218 - RNA, 64 nt, Homo Sapiens; identical to SEQ ID NO: 183593

SEQ ID NO: 542219 - RNA, 64 nt, Homo Sapiens; identical to SEQ ID NO: 183594

SEQ ID NO: 542220 - RNA, 64 nt, Homo Sapiens; identical to SEQ ID NO: 183595

SEQ ID NO: 542221 - RNA, 64 nt, Homo Sapiens; identical to SEQ ID NO: 183596

SEQ ID NO: 542222 - RNA, 64 nt, Homo Sapiens; identical to SEQ ID NO: 183597

SEQ ID NO: 542223 - RNA, 64 nt, Homo Sapiens; identical to SEQ ID NO: 183598

SEQ ID NO: 542224 - RNA, 64 nt, Homo Sapiens; identical to SEQ ID NO: 183599

SEQ ID NO: 542225 - RNA, 64 nt, Homo Sapiens; identical to SEQ ID NO: 183600

SEQ ID NO: 542226 - RNA, 64 nt, Homo Sapiens; identical to SEQ ID NO: 183601

SEQ ID NO: 542227 - RNA, 64 nt, Homo Sapiens; identical to SEQ ID NO: 183602

SEQ ID NO: 542228 - RNA, 64 nt, Homo Sapiens; identical to SEQ ID NO: 183603

SEQ ID NO: 542229 - RNA, 64 nt, Homo Sapiens; identical to SEQ ID NO: 541607

SEQ ID NO: 542230 - RNA, 64 nt, Homo Sapiens; identical to SEQ ID NO: 541608

SEQ ID NO: 542231 - RNA, 64 nt, Homo Sapiens; identical to SEQ ID NO: 541609

SEQ ID NO: 542232 - RNA, 64 nt, Homo Sapiens; identical to SEQ ID NO: 541610

SEQ ID NO: 542233 - RNA, 64 nt, Homo Sapiens; identical to SEQ ID NO: 84166

SEQ ID NO: 542234 - RNA, 64 nt, Homo Sapiens; identical to SEQ ID NO: 84167

SEQ ID NO: 542235 - RNA, 64 nt, Homo Sapiens; identical to SEQ ID NO: 84168

SEQ ID NO: 542236 - RNA, 64 nt, Homo Sapiens; identical to SEQ ID NO: 84169

SEQ ID NO: 542237 - RNA, 64 nt, Homo Sapiens; identical to SEQ ID NO: 84170

SEQ ID NO: 542238 - RNA, 64 nt, Homo Sapiens; identical to SEQ ID NO: 84171

SEQ ID NO: 542239 - RNA, 64 nt, Homo Sapiens; identical to SEQ ID NO: 84172

SEQ ID NO: 542240 - RNA, 64 nt, Homo Sapiens; identical to SEQ ID NO: 84173

SEQ ID NO: 542241 - RNA, 64 nt, Homo Sapiens; identical to SEQ ID NO: 84174

SEQ ID NO: 542242 - RNA, 64 nt, Homo Sapiens; identical to SEQ ID NO: 84175

SEQ ID NO: 542243 - RNA, 64 nt, Homo Sapiens; identical to SEQ ID NO: 84176

SEQ ID NO: 542244 - RNA, 64 nt, Homo Sapiens; identical to SEQ ID NO: 84177

SEQ ID NO: 542245 - RNA, 64 nt, Homo Sapiens; identical to SEQ ID NO: 84178

SEQ ID NO: 542246 - RNA, 64 nt, Homo Sapiens; identical to SEQ ID NO: 84179

SEQ ID NO: 542247 - RNA, 64 nt, Homo Sapiens; identical to SEQ ID NO: 84180

SEQ ID NO: 542248 - RNA, 64 nt, Homo Sapiens; identical to SEQ ID NO: 84181

SEQ ID NO: 542249 - RNA, 64 nt, Homo Sapiens; identical to SEQ ID NO: 84182

SEQ ID NO: 542250 - RNA, 64 nt, Homo Sapiens; identical to SEQ ID NO: 84183

SEQ ID NO: 542251 - RNA, 64 nt, Homo Sapiens; identical to SEQ ID NO: 84184

SEQ ID NO: 542252 - RNA, 64 nt, Homo Sapiens; identical to SEQ ID NO: 84185

SEQ ID NO: 542253 - RNA, 64 nt, Homo Sapiens; identical to SEQ ID NO: 84186

SEQ ID NO: 542254 - RNA, 64 nt, Homo Sapiens; identical to SEQ ID NO: 84187

SEQ ID NO: 542255 - RNA, 64 nt, Homo Sapiens; identical to SEQ ID NO: 84188

SEQ ID NO: 542256 - RNA, 64 nt, Homo Sapiens; identical to SEQ ID NO: 84189

SEQ ID NO: 542257 - RNA, 64 nt, Homo Sapiens; identical to SEQ ID NO: 84190

SEQ ID NO: 542258 - RNA, 64 nt, Homo Sapiens; identical to SEQ ID NO: 84191

SEQ ID NO: 542259 - RNA, 64 nt, Homo Sapiens; identical to SEQ ID NO: 84192

SEQ ID NO: 542260 - RNA, 64 nt, Homo Sapiens; identical to SEQ ID NO: 84193

SEQ ID NO: 542261 - RNA, 64 nt, Homo Sapiens; identical to SEQ ID NO: 84194

SEQ ID NO: 542262 - RNA, 64 nt, Homo Sapiens; identical to SEQ ID NO: 84195

SEQ ID NO: 542263 - RNA, 64 nt, Homo Sapiens; identical to SEQ ID NO: 84196

SEQ ID NO: 542264 - RNA, 64 nt, Homo Sapiens; identical to SEQ ID NO: 84197

SEQ ID NO: 542265 - RNA, 64 nt, Homo Sapiens; identical to SEQ ID NO: 84198

SEQ ID NO: 542266 - RNA, 64 nt, Homo Sapiens; identical to SEQ ID NO: 84199

SEQ ID NO: 542267 - RNA, 64 nt, Homo Sapiens; identical to SEQ ID NO: 84200

SEQ ID NO: 542268 - RNA, 64 nt, Homo Sapiens; identical to SEQ ID NO: 84201

SEQ ID NO: 542269 - RNA, 64 nt, Homo Sapiens; identical to SEQ ID NO: 84202

SEQ ID NO: 542270 - RNA, 64 nt, Homo Sapiens; identical to SEQ ID NO: 84203

SEQ ID NO: 542271 - RNA, 64 nt, Homo Sapiens; identical to SEQ ID NO: 84204

SEQ ID NO: 542272 - RNA, 64 nt, Homo Sapiens; identical to SEQ ID NO: 84205

SEQ ID NO: 542273 - RNA, 64 nt, Homo Sapiens; identical to SEQ ID NO: 84206

SEQ ID NO: 542274 - RNA, 64 nt, Homo Sapiens; identical to SEQ ID NO: 84207

SEQ ID NO: 542275 - RNA, 64 nt, Homo Sapiens; identical to SEQ ID NO: 84208

SEQ ID NO: 542276 - RNA, 64 nt, Homo Sapiens; identical to SEQ ID NO: 84209

SEQ ID NO: 542277 - RNA, 64 nt, Homo Sapiens; identical to SEQ ID NO: 84210

SEQ ID NO: 542278 - RNA, 64 nt, Homo Sapiens; identical to SEQ ID NO: 84211

SEQ ID NO: 542279 - RNA, 64 nt, Homo Sapiens; identical to SEQ ID NO: 84212

SEQ ID NO: 542280 - RNA, 64 nt, Homo Sapiens; identical to SEQ ID NO: 84213

SEQ ID NO: 542281 - RNA, 64 nt, Homo Sapiens; identical to SEQ ID NO: 84214

SEQ ID NO: 542282 - RNA, 64 nt, Homo Sapiens; identical to SEQ ID NO: 84215

SEQ ID NO: 542283 - RNA, 64 nt, Homo Sapiens; identical to SEQ ID NO: 84216

SEQ ID NO: 542284 - RNA, 64 nt, Homo Sapiens; identical to SEQ ID NO: 84217

SEQ ID NO: 542285 - RNA, 64 nt, Homo Sapiens; identical to SEQ ID NO: 84218

SEQ ID NO: 542286 - RNA, 64 nt, Homo Sapiens; identical to SEQ ID NO: 84219

SEQ ID NO: 542287 - RNA, 64 nt, Homo Sapiens; identical to SEQ ID NO: 84220

SEQ ID NO: 542288 - RNA, 64 nt, Homo Sapiens; identical to SEQ ID NO: 84221

SEQ ID NO: 542289 - RNA, 64 nt, Homo Sapiens; identical to SEQ ID NO: 84222

SEQ ID NO: 542290 - RNA, 64 nt, Homo Sapiens; identical to SEQ ID NO: 84223

SEQ ID NO: 542291 - RNA, 64 nt, Homo Sapiens; identical to SEQ ID NO: 84224

SEQ ID NO: 542292 - RNA, 64 nt, Homo Sapiens; identical to SEQ ID NO: 84225

SEQ ID NO: 542293 - RNA, 64 nt, Homo Sapiens; identical to SEQ ID NO: 84226

SEQ ID NO: 542294 - RNA, 64 nt, Homo Sapiens; identical to SEQ ID NO: 84227

SEQ ID NO: 542295 - RNA, 64 nt, Homo Sapiens; identical to SEQ ID NO: 84228

SEQ ID NO: 542296 - RNA, 64 nt, Homo Sapiens; identical to SEQ ID NO: 84229

SEQ ID NO: 542297 - RNA, 64 nt, Homo Sapiens; identical to SEQ ID NO: 84230

SEQ ID NO: 542298 - RNA, 64 nt, Homo Sapiens; identical to SEQ ID NO: 84231

SEQ ID NO: 542299 - RNA, 64 nt, Homo Sapiens; identical to SEQ ID NO: 84232

SEQ ID NO: 542300 - RNA, 64 nt, Homo Sapiens; identical to SEQ ID NO: 84233

SEQ ID NO: 542301 - RNA, 64 nt, Homo Sapiens
aaaguggcuccuuuaauuggugacuuggagaaagcuaggucaaggguuuauuauagcacccucu

SEQ ID NO: 542302 - RNA, 64 nt, Homo Sapiens
uucuauaaugccaucaugcagcaauuaugagaggcuaggucauccaaagagaagacccuaucaa

SEQ ID NO: 542303 - RNA, 64 nt, Homo Sapiens
ugucuaaaaguaaaaaaaaauaucagccugucuccuaggucaguccccuccuggacccacccgc

SEQ ID NO: 542304 - RNA, 64 nt, Homo Sapiens
cucuccugaggaaccuacaggauucuaagguuuccuaggucacugaacaacuaaucuugguccc

SEQ ID NO: 542305 - RNA, 64 nt, Homo Sapiens
gagcucagaugaagagaaauccuaaguuaccuuucuaggucaaggccugucccuggccaucucu

SEQ ID NO: 542306 - RNA, 64 nt, Homo Sapiens
aacugugagagucuuuguaaguaaacugcccugucuaggucaguacccaccugagcuuuggacg

SEQ ID NO: 542307 - RNA, 64 nt, Homo Sapiens
uuggguuaaguuuguaugacagaauuugagcuuucuaggucacaaaugugaagaguccaguggu

SEQ ID NO: 542308 - RNA, 64 nt, Homo Sapiens
guuggguuugguuggguuguauuuugugaguuuccuaggucagugagauagguuuggucguauc

SEQ ID NO: 542309 - RNA, 64 nt, Homo Sapiens; identical to SEQ ID NO: 265126

SEQ ID NO: 542310 - RNA, 64 nt, Homo Sapiens; identical to SEQ ID NO: 265127

SEQ ID NO: 542311 - RNA, 64 nt, Homo Sapiens; identical to SEQ ID NO: 265128

SEQ ID NO: 542312 - RNA, 64 nt, Homo Sapiens; identical to SEQ ID NO: 265129

SEQ ID NO: 542313 - RNA, 64 nt, Homo Sapiens; identical to SEQ ID NO: 265130

SEQ ID NO: 542314 - RNA, 64 nt, Homo Sapiens; identical to SEQ ID NO: 265131

SEQ ID NO: 542315 - RNA, 64 nt, Homo Sapiens; identical to SEQ ID NO: 265132

SEQ ID NO: 542316 - RNA, 64 nt, Homo Sapiens; identical to SEQ ID NO: 265133

SEQ ID NO: 542317 - RNA, 64 nt, Homo Sapiens; identical to SEQ ID NO: 265134

SEQ ID NO: 542318 - RNA, 64 nt, Homo Sapiens; identical to SEQ ID NO: 265135

SEQ ID NO: 542319 - RNA, 64 nt, Homo Sapiens; identical to SEQ ID NO: 265136

SEQ ID NO: 542320 - RNA, 64 nt, Homo Sapiens; identical to SEQ ID NO: 265137

SEQ ID NO: 542321 - RNA, 64 nt, Homo Sapiens; identical to SEQ ID NO: 265138

SEQ ID NO: 542322 - RNA, 64 nt, Homo Sapiens; identical to SEQ ID NO: 265139

SEQ ID NO: 542323 - RNA, 64 nt, Homo Sapiens; identical to SEQ ID NO: 265140

SEQ ID NO: 542324 - RNA, 64 nt, Homo Sapiens; identical to SEQ ID NO: 265141

SEQ ID NO: 542325 - RNA, 64 nt, Homo Sapiens; identical to SEQ ID NO: 265142

SEQ ID NO: 542326 - RNA, 64 nt, Homo Sapiens; identical to SEQ ID NO: 265143

SEQ ID NO: 542327 - RNA, 64 nt, Homo Sapiens; identical to SEQ ID NO: 265144

SEQ ID NO: 542328 - RNA, 64 nt, Homo Sapiens; identical to SEQ ID NO: 265145

SEQ ID NO: 542329 - RNA, 64 nt, Homo Sapiens; identical to SEQ ID NO: 265146

SEQ ID NO: 542330 - RNA, 64 nt, Homo Sapiens; identical to SEQ ID NO: 265147

SEQ ID NO: 542331 - RNA, 64 nt, Homo Sapiens; identical to SEQ ID NO: 265148

SEQ ID NO: 542332 - RNA, 64 nt, Homo Sapiens; identical to SEQ ID NO: 265149

SEQ ID NO: 542333 - RNA, 63 nt, Homo Sapiens; identical to SEQ ID NO: 265150

SEQ ID NO: 542334 - RNA, 64 nt, Homo Sapiens; identical to SEQ ID NO: 265151

SEQ ID NO: 542335 - RNA, 64 nt, Homo Sapiens; identical to SEQ ID NO: 265152

SEQ ID NO: 542336 - RNA, 64 nt, Homo Sapiens; identical to SEQ ID NO: 265153

SEQ ID NO: 542337 - RNA, 64 nt, Homo Sapiens; identical to SEQ ID NO: 265154

SEQ ID NO: 542338 - RNA, 64 nt, Homo Sapiens; identical to SEQ ID NO: 265155

SEQ ID NO: 542339 - RNA, 64 nt, Homo Sapiens; identical to SEQ ID NO: 265156

SEQ ID NO: 542340 - RNA, 64 nt, Homo Sapiens; identical to SEQ ID NO: 265157

SEQ ID NO: 542341 - RNA, 64 nt, Homo Sapiens; identical to SEQ ID NO: 265158

SEQ ID NO: 542342 - RNA, 64 nt, Homo Sapiens; identical to SEQ ID NO: 265159

SEQ ID NO: 542343 - RNA, 64 nt, Homo Sapiens; identical to SEQ ID NO: 265160

SEQ ID NO: 542344 - RNA, 64 nt, Homo Sapiens; identical to SEQ ID NO: 265161

SEQ ID NO: 542345 - RNA, 64 nt, Homo Sapiens; identical to SEQ ID NO: 265162

SEQ ID NO: 542346 - RNA, 64 nt, Homo Sapiens; identical to SEQ ID NO: 265163

SEQ ID NO: 542347 - RNA, 64 nt, Homo Sapiens; identical to SEQ ID NO: 265164

SEQ ID NO: 542348 - RNA, 64 nt, Homo Sapiens; identical to SEQ ID NO: 265165

SEQ ID NO: 542349 - RNA, 64 nt, Homo Sapiens; identical to SEQ ID NO: 265166

SEQ ID NO: 542350 - RNA, 64 nt, Homo Sapiens; identical to SEQ ID NO: 265167

SEQ ID NO: 542351 - RNA, 64 nt, Homo Sapiens; identical to SEQ ID NO: 265168

SEQ ID NO: 542352 - RNA, 64 nt, Homo Sapiens; identical to SEQ ID NO: 265169

SEQ ID NO: 542353 - RNA, 64 nt, Homo Sapiens; identical to SEQ ID NO: 265170

SEQ ID NO: 542354 - RNA, 64 nt, Homo Sapiens; identical to SEQ ID NO: 265171

SEQ ID NO: 542355 - RNA, 64 nt, Homo Sapiens; identical to SEQ ID NO: 265172

SEQ ID NO: 542356 - RNA, 64 nt, Homo Sapiens; identical to SEQ ID NO: 265173

SEQ ID NO: 542357 - RNA, 64 nt, Homo Sapiens; identical to SEQ ID NO: 265174

SEQ ID NO: 542358 - RNA, 64 nt, Homo Sapiens; identical to SEQ ID NO: 265175

SEQ ID NO: 542359 - RNA, 64 nt, Homo Sapiens; identical to SEQ ID NO: 265176

SEQ ID NO: 542360 - RNA, 64 nt, Homo Sapiens; identical to SEQ ID NO: 265177

SEQ ID NO: 542361 - RNA, 64 nt, Homo Sapiens; identical to SEQ ID NO: 265178

SEQ ID NO: 542362 - RNA, 64 nt, Homo Sapiens; identical to SEQ ID NO: 265179

SEQ ID NO: 542363 - RNA, 64 nt, Homo Sapiens; identical to SEQ ID NO: 328787

SEQ ID NO: 542364 - RNA, 64 nt, Homo Sapiens; identical to SEQ ID NO: 328788

SEQ ID NO: 542365 - RNA, 64 nt, Homo Sapiens; identical to SEQ ID NO: 328789

SEQ ID NO: 542366 - RNA, 64 nt, Homo Sapiens; identical to SEQ ID NO: 328790

SEQ ID NO: 542367 - RNA, 64 nt, Homo Sapiens; identical to SEQ ID NO: 328791

SEQ ID NO: 542368 - RNA, 64 nt, Homo Sapiens; identical to SEQ ID NO: 328792

SEQ ID NO: 542369 - RNA, 64 nt, Homo Sapiens; identical to SEQ ID NO: 328793

SEQ ID NO: 542370 - RNA, 64 nt, Homo Sapiens; identical to SEQ ID NO: 328794

SEQ ID NO: 542371 - RNA, 64 nt, Homo Sapiens; identical to SEQ ID NO: 328795

SEQ ID NO: 542372 - RNA, 64 nt, Homo Sapiens; identical to SEQ ID NO: 328796

SEQ ID NO: 542373 - RNA, 64 nt, Homo Sapiens; identical to SEQ ID NO: 328797

SEQ ID NO: 542374 - RNA, 64 nt, Homo Sapiens; identical to SEQ ID NO: 328798

SEQ ID NO: 542375 - RNA, 64 nt, Homo Sapiens; identical to SEQ ID NO: 328799

SEQ ID NO: 542376 - RNA, 64 nt, Homo Sapiens; identical to SEQ ID NO: 328800

SEQ ID NO: 542377 - RNA, 64 nt, Homo Sapiens; identical to SEQ ID NO: 328801

SEQ ID NO: 542378 - RNA, 64 nt, Homo Sapiens; identical to SEQ ID NO: 328802

SEQ ID NO: 542379 - RNA, 64 nt, Homo Sapiens; identical to SEQ ID NO: 328803

SEQ ID NO: 542380 - RNA, 64 nt, Homo Sapiens; identical to SEQ ID NO: 328804

SEQ ID NO: 542381 - RNA, 64 nt, Homo Sapiens; identical to SEQ ID NO: 532305

SEQ ID NO: 542382 - RNA, 64 nt, Homo Sapiens; identical to SEQ ID NO: 532306

SEQ ID NO: 542383 - RNA, 64 nt, Homo Sapiens; identical to SEQ ID NO: 532307

SEQ ID NO: 542384 - RNA, 64 nt, Homo Sapiens; identical to SEQ ID NO: 532308

SEQ ID NO: 542385 - RNA, 64 nt, Homo Sapiens; identical to SEQ ID NO: 532309

SEQ ID NO: 542386 - RNA, 57 nt, Homo Sapiens; identical to SEQ ID NO: 83127

SEQ ID NO: 542387 - RNA, 64 nt, Homo Sapiens; identical to SEQ ID NO: 532311

SEQ ID NO: 542388 - RNA, 64 nt, Homo Sapiens; identical to SEQ ID NO: 532312

SEQ ID NO: 542389 - RNA, 64 nt, Homo Sapiens; identical to SEQ ID NO: 532313

SEQ ID NO: 542390 - RNA, 64 nt, Homo Sapiens; identical to SEQ ID NO: 532314

SEQ ID NO: 542391 - RNA, 64 nt, Homo Sapiens; identical to SEQ ID NO: 532315

SEQ ID NO: 542392 - RNA, 64 nt, Homo Sapiens; identical to SEQ ID NO: 532316

SEQ ID NO: 542393 - RNA, 64 nt, Homo Sapiens; identical to SEQ ID NO: 532317

SEQ ID NO: 542394 - RNA, 64 nt, Homo Sapiens; identical to SEQ ID NO: 532318

SEQ ID NO: 542395 - RNA, 59 nt, Homo Sapiens; identical to SEQ ID NO: 83136

SEQ ID NO: 542396 - RNA, 64 nt, Homo Sapiens; identical to SEQ ID NO: 532320

SEQ ID NO: 542397 - RNA, 64 nt, Homo Sapiens; identical to SEQ ID NO: 532321

SEQ ID NO: 542398 - RNA, 64 nt, Homo Sapiens; identical to SEQ ID NO: 532322

SEQ ID NO: 542399 - RNA, 64 nt, Homo Sapiens; identical to SEQ ID NO: 532323

SEQ ID NO: 542400 - RNA, 64 nt, Homo Sapiens; identical to SEQ ID NO: 532324

SEQ ID NO: 542401 - RNA, 64 nt, Homo Sapiens; identical to SEQ ID NO: 532325

SEQ ID NO: 542402 - RNA, 64 nt, Homo Sapiens; identical to SEQ ID NO: 532326

SEQ ID NO: 542403 - RNA, 64 nt, Homo Sapiens; identical to SEQ ID NO: 532327

SEQ ID NO: 542404 - RNA, 64 nt, Homo Sapiens; identical to SEQ ID NO: 532328

SEQ ID NO: 542405 - RNA, 64 nt, Homo Sapiens; identical to SEQ ID NO: 532329

SEQ ID NO: 542406 - RNA, 64 nt, Homo Sapiens; identical to SEQ ID NO: 532330

SEQ ID NO: 542407 - RNA, 64 nt, Homo Sapiens; identical to SEQ ID NO: 532331

SEQ ID NO: 542408 - RNA, 64 nt, Homo Sapiens; identical to SEQ ID NO: 532332

SEQ ID NO: 542409 - RNA, 64 nt, Homo Sapiens; identical to SEQ ID NO: 532333

SEQ ID NO: 542410 - RNA, 64 nt, Homo Sapiens; identical to SEQ ID NO: 532334

SEQ ID NO: 542411 - RNA, 64 nt, Homo Sapiens; identical to SEQ ID NO: 532335

SEQ ID NO: 542412 - RNA, 64 nt, Homo Sapiens; identical to SEQ ID NO: 532336

SEQ ID NO: 542413 - RNA, 64 nt, Homo Sapiens; identical to SEQ ID NO: 532337

SEQ ID NO: 542414 - RNA, 64 nt, Homo Sapiens; identical to SEQ ID NO: 532338

SEQ ID NO: 542415 - RNA, 64 nt, Homo Sapiens
uaagguagcuuaauaaacuaaguaaaacguaugacuugaguacaaaaggauuguuuuaaucccc

SEQ ID NO: 542416 - RNA, 64 nt, Homo Sapiens
cauccuagucucccagucuauaacaucauaauaccuugaguauaaguccaaauauuagguuaua

SEQ ID NO: 542417 - RNA, 64 nt, Homo Sapiens
ugggauuacaggcaugcgccuccugccucagccucuugaguagccucacagguucaagugguuc

SEQ ID NO: 542418 - RNA, 64 nt, Homo Sapiens
guaguccccuauuuucugcaccgguaguuccacucuugaguaugucuaaaacauuccagaauac

SEQ ID NO: 542419 - RNA, 64 nt, Homo Sapiens
cccguccgggaggugaggggcgccucugcccagcugccccuacugggaagugaggagccccucu

SEQ ID NO: 542420 - RNA, 64 nt, Homo Sapiens
cccguccgggaggcgaggggcgccucugcccggcugccccuacugggaagugaggagccccucu

SEQ ID NO: 542421 - RNA, 64 nt, Homo Sapiens
uucugguuugagguuugacucuggacccuggcugugccccuagguggagacagcccucuuucuc

SEQ ID NO: 542422 - RNA, 64 nt, Homo Sapiens
ugaguugcaagcagggagaaaaccugaaggucggugccccuauggggcugaccaguagagaauu

SEQ ID NO: 542423 - RNA, 64 nt, Homo Sapiens
aaaagugaauuuccuuuaacacuuuaggcucucaugccccuaagcacaggcucacacugcccuu

SEQ ID NO: 542424 - RNA, 64 nt, Homo Sapiens
accccuccuuugccucaugacuugagagcugagcugccccuagguuccccuccaguguucccuc

SEQ ID NO: 542425 - RNA, 64 nt, Homo Sapiens
ccucgauugaggucugagccgacgcccuugccccugccccuaccccugccagcgcccaccccca

SEQ ID NO: 542426 - RNA, 64 nt, Homo Sapiens
auaucccgaugggcacaaauggaaggugcgcacuugccccuacuauugcccuuuuaagggccaa

SEQ ID NO: 542427 - RNA, 59 nt, Homo Sapiens
auucaccaagcaguacuacauacaacaaacuagugcaugauaaaaguuuacaugaauuu

SEQ ID NO: 542428 - RNA, 59 nt, Homo Sapiens
uccaugguccccaauucauaaaauuuguucuagugcauuauaucugccauauuuuuaca

SEQ ID NO: 542429 - RNA, 59 nt, Homo Sapiens
uccuucucuuugacuucuguggcauggugcuagugcauguacccugugguauugccccu

SEQ ID NO: 542430 - RNA, 59 nt, Homo Sapiens
uugaaucauauucugugcuuuuucaaucacuagugcagaauaggcugcauuugacacag

SEQ ID NO: 542431 - RNA, 59 nt, Homo Sapiens
cugauccaaaaauuauaacggcagggaaccuagugcauuuggcacugagauuuaaaugc

SEQ ID NO: 542432 - RNA, 59 nt, Homo Sapiens
gauaacucacuggaauguacaguauuuugcuagugcauuucaaggaauggaaucuucuc

SEQ ID NO: 542433 - RNA, 64 nt, Homo Sapiens; identical to SEQ ID NO: 131478

SEQ ID NO: 542434 - RNA, 64 nt, Homo Sapiens; identical to SEQ ID NO: 131479

SEQ ID NO: 542435 - RNA, 64 nt, Homo Sapiens; identical to SEQ ID NO: 131480

SEQ ID NO: 542436 - RNA, 64 nt, Homo Sapiens; identical to SEQ ID NO: 131481

SEQ ID NO: 542437 - RNA, 64 nt, Homo Sapiens; identical to SEQ ID NO: 131482

SEQ ID NO: 542438 - RNA, 64 nt, Homo Sapiens; identical to SEQ ID NO: 131483

SEQ ID NO: 542439 - RNA, 64 nt, Homo Sapiens; identical to SEQ ID NO: 131484

SEQ ID NO: 542440 - RNA, 64 nt, Homo Sapiens; identical to SEQ ID NO: 131485

SEQ ID NO: 542441 - RNA, 64 nt, Homo Sapiens
aaggacaggcuguccaagguagaaacuguacauagccggugaccgaaugcgaccuuugccagcc

SEQ ID NO: 542442 - RNA, 64 nt, Homo Sapiens
cauuugccaucaccccaaacaacucagcuucggggccggugaggggaggggccucccccagcac

SEQ ID NO: 542443 - RNA, 64 nt, Homo Sapiens
cgggggaggaggcgacccuguuauuuauugccuggccggugacuggaguagggaucuaauuuau

SEQ ID NO: 542444 - RNA, 64 nt, Homo Sapiens
ggaggccuuucuagaccuggagucccucucugcugccggugaugcuguccccuuucagcccacc

SEQ ID NO: 542445 - RNA, 64 nt, Homo Sapiens
acagucuaguacacaggugcuuuccucuugaacugccggugaaaugacgugcagugacaguuga

SEQ ID NO: 542446 - RNA, 64 nt, Homo Sapiens
cacuaccucuuacguguugcgcauauacaucuuagccggugauauguauucagguccccgaugg

SEQ ID NO: 542447 - RNA, 64 nt, Homo Sapiens
gcauauuagccgaggagguagucacgcggcacgcgccggugauugccacgaugugauugcaaua

SEQ ID NO: 542448 - RNA, 64 nt, Homo Sapiens
ugagucguauucugucacauuaugaauuguuguagccggugaauaagaaaacauugaaaaauuc

SEQ ID NO: 542449 - RNA, 64 nt, Homo Sapiens
ugcacaggccgagcagcacguacccuagggaagagccggugacggggagaaagcaagcaaaagc

SEQ ID NO: 542450 - RNA, 64 nt, Homo Sapiens
guaugcugaaguucagccgugaaucccacauggggccggugauggucuuuuacguuguuaugau

SEQ ID NO: 542451 - RNA, 64 nt, Homo Sapiens
cacaaggucaggaguucaaguuugggaggccgaggccggugauucacgccuguaaucccagcac

SEQ ID NO: 542452 - RNA, 64 nt, Homo Sapiens
aagagggagcgaacgagcgaacaacugagcccaagccggugagaaugugaaacaguuucucaaa

SEQ ID NO: 542453 - RNA, 64 nt, Homo Sapiens
ggggcgugcgcuagagggggcacgagggccuggugccggugaggcgugccagagucgggggcca

SEQ ID NO: 542454 - RNA, 64 nt, Homo Sapiens
auuauuaaaaauuaguuuuucugcccccguuacugccggugauuccacacuguacuuuuucccc

SEQ ID NO: 542455 - RNA, 64 nt, Homo Sapiens
ucaggagcccagcucuccaguucaggagguggaggccggugaggauguggauuuggccagagcc

SEQ ID NO: 542456 - RNA, 64 nt, Homo Sapiens
agauuuccccauuuagguuucugaguuccugcaugccggugaucccuagcugugaccucucccc

SEQ ID NO: 542457 - RNA, 64 nt, Homo Sapiens
gggaggagaacaucaucgauaacccuuaucugcggccggugaagaagcccaagauccgcaggaa

SEQ ID NO: 542458 - RNA, 64 nt, Homo Sapiens
ugcaucuucugcguguucucagcagccagaggaggccggugaagcaaagagagaguacgggcuc

SEQ ID NO: 542459 - RNA, 64 nt, Homo Sapiens
acaacuuaacauguaaaugugguggaaaacgugggccggugaaacucaauuaucacgagcacau

SEQ ID NO: 542460 - RNA, 64 nt, Homo Sapiens
guagagucggaggcggagagccccggaccgcauggccggugagagagaggcgagccagggggcu

SEQ ID NO: 542461 - RNA, 64 nt, Homo Sapiens
auaagagagucauaaaccuugauauauggauaaugccggugagagauguuuuagaguuaacaau

SEQ ID NO: 542462 - RNA, 64 nt, Homo Sapiens
cggagccccgaagacucggagggagcugcucagggccggugagcgcagccagaagcccuggcca

SEQ ID NO: 542463 - RNA, 61 nt, Homo Sapiens
ggcggagccucgagcgggccccgaggccgcagccggugagaccucugggcccuggcuguag

SEQ ID NO: 542464 - RNA, 64 nt, Homo Sapiens
ucacacaucgccuucucgccacgaagcucccugggccggugaagggggccgggccaucccugac

SEQ ID NO: 542465 - RNA, 64 nt, Homo Sapiens
cggccacgucccccugccgcaccugcugcuggaagccggugacccagccgcuucgacagcccug

SEQ ID NO: 542466 - RNA, 64 nt, Homo Sapiens
cccagcucuacaaauaaagugugcccaaggcgaggccggugagggcccugccagaggcuggagg

SEQ ID NO: 542467 - RNA, 64 nt, Homo Sapiens
uguguguggauggugacgcagaggacgucucuaugccggugacuggacauaucaccucuacuua

SEQ ID NO: 542468 - RNA, 64 nt, Homo Sapiens
uguuuuaacuuccaaggugguuuuacuucugauagccggugauuuucccuccuagcagacaugc

SEQ ID NO: 542469 - RNA, 64 nt, Homo Sapiens
gcgggcaaggggccccagcccugggcguggacaggccggugaggugugcccucugcgcauagcg

SEQ ID NO: 542470 - RNA, 64 nt, Homo Sapiens
uuaagaccuggucuucuuucucuguuggaucauggccggugaaacaguuuugucuugcagugga

SEQ ID NO: 542471 - RNA, 64 nt, Homo Sapiens
uggaugagugaagggagccagacccuggccuagggccggugaugcauucugugugugugguuca

SEQ ID NO: 542472 - RNA, 64 nt, Homo Sapiens
gcgccuagaaggcgaggacgcagaccugaaggcggccggugagcggggcggguucugcuggguc

SEQ ID NO: 542473 - RNA, 64 nt, Homo Sapiens
cccauggcuguguuggugugcuccaggccaaagugccggugagaucacucggguuucucugugg

SEQ ID NO: 542474 - RNA, 64 nt, Homo Sapiens
uccaggggccccagccccccaggaacuuggggcugccggugagcaggauggugaguagagcucu

SEQ ID NO: 542475 - RNA, 64 nt, Homo Sapiens
cgaguggccugcgcgcugacccugcccuucaucugccggugagugggaagugggugccuugcgg

SEQ ID NO: 542476 - RNA, 64 nt, Homo Sapiens
agcugucugucaggggagaggaggacccauaagugccggugacaggguauugucugaaauccca

SEQ ID NO: 542477 - RNA, 64 nt, Homo Sapiens
cagccacccugaccucccccagggcuccuccccagccggugacuuacuguacagcaggcaggag

SEQ ID NO: 542478 - RNA, 64 nt, Homo Sapiens
guguccacaguugagagguuugagaugagugacugccggugaauugcgcgugcuggugggcaug

SEQ ID NO: 542479 - RNA, 52 nt, Homo Sapiens
ggaguguuugcuucaagugauggccggugagcugcggagagcucauggaagg

SEQ ID NO: 542480 - RNA, 64 nt, Homo Sapiens
agcugggugccaggggcaggggauccucaguauagccggugaacccugauaccaggagccuggg

SEQ ID NO: 542481 - RNA, 64 nt, Homo Sapiens
ggggguggggguggggguggugguggggguaguggccggugagggcccaggcuggucagcgucc

SEQ ID NO: 542482 - RNA, 64 nt, Homo Sapiens
cgcuuguacacugcugcuguggggcuccgcgccugccggugaagagcugcagaugccgagaagc

SEQ ID NO: 542483 - RNA, 64 nt, Homo Sapiens
uaugucaggaggccacagggcgcagcugugaauggccggugauggcgagaggcacccuacccga

SEQ ID NO: 542484 - RNA, 64 nt, Homo Sapiens
gaugcggcaggugcucugugcgagagcaccccuugccggugaaggacagcugccccgguagccu

SEQ ID NO: 542485 - RNA, 64 nt, Homo Sapiens
cggccgcaccugccccaaagggaugaccgugcaggccggugacaucgcucccagccauuugcug

SEQ ID NO: 542486 - RNA, 64 nt, Homo Sapiens; identical to SEQ ID NO: 217679

SEQ ID NO: 542487 - RNA, 64 nt, Homo Sapiens; identical to SEQ ID NO: 217680

SEQ ID NO: 542488 - RNA, 64 nt, Homo Sapiens; identical to SEQ ID NO: 217681

SEQ ID NO: 542489 - RNA, 64 nt, Homo Sapiens; identical to SEQ ID NO: 217682

SEQ ID NO: 542490 - RNA, 64 nt, Homo Sapiens; identical to SEQ ID NO: 217683

SEQ ID NO: 542491 - RNA, 64 nt, Homo Sapiens; identical to SEQ ID NO: 217684

SEQ ID NO: 542492 - RNA, 64 nt, Homo Sapiens; identical to SEQ ID NO: 217685

SEQ ID NO: 542493 - RNA, 64 nt, Homo Sapiens; identical to SEQ ID NO: 217686

SEQ ID NO: 542494 - RNA, 64 nt, Homo Sapiens; identical to SEQ ID NO: 217687

SEQ ID NO: 542495 - RNA, 64 nt, Homo Sapiens; identical to SEQ ID NO: 217688

SEQ ID NO: 542496 - RNA, 64 nt, Homo Sapiens; identical to SEQ ID NO: 217689

SEQ ID NO: 542497 - RNA, 64 nt, Homo Sapiens; identical to SEQ ID NO: 217690

SEQ ID NO: 542498 - RNA, 64 nt, Homo Sapiens; identical to SEQ ID NO: 217691

SEQ ID NO: 542499 - RNA, 64 nt, Homo Sapiens; identical to SEQ ID NO: 217692

SEQ ID NO: 542500 - RNA, 64 nt, Homo Sapiens; identical to SEQ ID NO: 217693

SEQ ID NO: 542501 - RNA, 64 nt, Homo Sapiens; identical to SEQ ID NO: 217694

SEQ ID NO: 542502 - RNA, 64 nt, Homo Sapiens; identical to SEQ ID NO: 217695

SEQ ID NO: 542503 - RNA, 64 nt, Homo Sapiens; identical to SEQ ID NO: 217696

SEQ ID NO: 542504 - RNA, 64 nt, Homo Sapiens; identical to SEQ ID NO: 217697

SEQ ID NO: 542505 - RNA, 64 nt, Homo Sapiens; identical to SEQ ID NO: 217698

SEQ ID NO: 542506 - RNA, 64 nt, Homo Sapiens; identical to SEQ ID NO: 217699

SEQ ID NO: 542507 - RNA, 64 nt, Homo Sapiens; identical to SEQ ID NO: 217700

SEQ ID NO: 542508 - RNA, 64 nt, Homo Sapiens; identical to SEQ ID NO: 217701

SEQ ID NO: 542509 - RNA, 64 nt, Homo Sapiens; identical to SEQ ID NO: 217702

SEQ ID NO: 542510 - RNA, 64 nt, Homo Sapiens; identical to SEQ ID NO: 217703

SEQ ID NO: 542511 - RNA, 64 nt, Homo Sapiens; identical to SEQ ID NO: 217704

SEQ ID NO: 542512 - RNA, 64 nt, Homo Sapiens; identical to SEQ ID NO: 217705

SEQ ID NO: 542513 - RNA, 64 nt, Homo Sapiens; identical to SEQ ID NO: 217706

SEQ ID NO: 542514 - RNA, 64 nt, Homo Sapiens; identical to SEQ ID NO: 217707

SEQ ID NO: 542515 - RNA, 64 nt, Homo Sapiens; identical to SEQ ID NO: 217708

SEQ ID NO: 542516 - RNA, 64 nt, Homo Sapiens; identical to SEQ ID NO: 217709

SEQ ID NO: 542517 - RNA, 64 nt, Homo Sapiens; identical to SEQ ID NO: 217710

SEQ ID NO: 542518 - RNA, 64 nt, Homo Sapiens; identical to SEQ ID NO: 217711

SEQ ID NO: 542519 - RNA, 64 nt, Homo Sapiens; identical to SEQ ID NO: 217712

SEQ ID NO: 542520 - RNA, 64 nt, Homo Sapiens; identical to SEQ ID NO: 217713

SEQ ID NO: 542521 - RNA, 58 nt, Homo Sapiens; identical to SEQ ID NO: 217714

SEQ ID NO: 542522 - RNA, 64 nt, Homo Sapiens; identical to SEQ ID NO: 217715

SEQ ID NO: 542523 - RNA, 64 nt, Homo Sapiens; identical to SEQ ID NO: 217716

SEQ ID NO: 542524 - RNA, 64 nt, Homo Sapiens; identical to SEQ ID NO: 217717

SEQ ID NO: 542525 - RNA, 64 nt, Homo Sapiens; identical to SEQ ID NO: 217718

SEQ ID NO: 542526 - RNA, 64 nt, Homo Sapiens; identical to SEQ ID NO: 217719

SEQ ID NO: 542527 - RNA, 64 nt, Homo Sapiens; identical to SEQ ID NO: 217720

SEQ ID NO: 542528 - RNA, 64 nt, Homo Sapiens; identical to SEQ ID NO: 217721

SEQ ID NO: 542529 - RNA, 64 nt, Homo Sapiens; identical to SEQ ID NO: 217722

SEQ ID NO: 542530 - RNA, 64 nt, Homo Sapiens; identical to SEQ ID NO: 217723

SEQ ID NO: 542531 - RNA, 64 nt, Homo Sapiens; identical to SEQ ID NO: 217724

SEQ ID NO: 542532 - RNA, 64 nt, Homo Sapiens; identical to SEQ ID NO: 217725

SEQ ID NO: 542533 - RNA, 64 nt, Homo Sapiens; identical to SEQ ID NO: 217726

SEQ ID NO: 542534 - RNA, 64 nt, Homo Sapiens; identical to SEQ ID NO: 217727

SEQ ID NO: 542535 - RNA, 64 nt, Homo Sapiens; identical to SEQ ID NO: 217728

SEQ ID NO: 542536 - RNA, 64 nt, Homo Sapiens; identical to SEQ ID NO: 217729

SEQ ID NO: 542537 - RNA, 64 nt, Homo Sapiens; identical to SEQ ID NO: 217730

SEQ ID NO: 542538 - RNA, 64 nt, Homo Sapiens; identical to SEQ ID NO: 217731

SEQ ID NO: 542539 - RNA, 64 nt, Homo Sapiens; identical to SEQ ID NO: 217732

SEQ ID NO: 542540 - RNA, 64 nt, Homo Sapiens; identical to SEQ ID NO: 217733

SEQ ID NO: 542541 - RNA, 64 nt, Homo Sapiens; identical to SEQ ID NO: 217734

SEQ ID NO: 542542 - RNA, 64 nt, Homo Sapiens; identical to SEQ ID NO: 217735

SEQ ID NO: 542543 - RNA, 64 nt, Homo Sapiens; identical to SEQ ID NO: 217736

SEQ ID NO: 542544 - RNA, 64 nt, Homo Sapiens; identical to SEQ ID NO: 217737

SEQ ID NO: 542545 - RNA, 64 nt, Homo Sapiens; identical to SEQ ID NO: 217738

SEQ ID NO: 542546 - RNA, 64 nt, Homo Sapiens; identical to SEQ ID NO: 217739

SEQ ID NO: 542547 - RNA, 64 nt, Homo Sapiens; identical to SEQ ID NO: 217740

SEQ ID NO: 542548 - RNA, 64 nt, Homo Sapiens; identical to SEQ ID NO: 217741

SEQ ID NO: 542549 - RNA, 64 nt, Homo Sapiens; identical to SEQ ID NO: 217742

SEQ ID NO: 542550 - RNA, 64 nt, Homo Sapiens; identical to SEQ ID NO: 217743

SEQ ID NO: 542551 - RNA, 64 nt, Homo Sapiens; identical to SEQ ID NO: 217744

SEQ ID NO: 542552 - RNA, 64 nt, Homo Sapiens; identical to SEQ ID NO: 217745

SEQ ID NO: 542553 - RNA, 64 nt, Homo Sapiens; identical to SEQ ID NO: 217746

SEQ ID NO: 542554 - RNA, 64 nt, Homo Sapiens; identical to SEQ ID NO: 217747

SEQ ID NO: 542555 - RNA, 64 nt, Homo Sapiens; identical to SEQ ID NO: 217748

SEQ ID NO: 542556 - RNA, 64 nt, Homo Sapiens; identical to SEQ ID NO: 217749

SEQ ID NO: 542557 - RNA, 64 nt, Homo Sapiens; identical to SEQ ID NO: 217750

SEQ ID NO: 542558 - RNA, 64 nt, Homo Sapiens; identical to SEQ ID NO: 217751

SEQ ID NO: 542559 - RNA, 64 nt, Homo Sapiens; identical to SEQ ID NO: 217752

SEQ ID NO: 542560 - RNA, 64 nt, Homo Sapiens; identical to SEQ ID NO: 217753

SEQ ID NO: 542561 - RNA, 64 nt, Homo Sapiens; identical to SEQ ID NO: 217754

SEQ ID NO: 542562 - RNA, 64 nt, Homo Sapiens; identical to SEQ ID NO: 217755

SEQ ID NO: 542563 - RNA, 64 nt, Homo Sapiens; identical to SEQ ID NO: 217756

SEQ ID NO: 542564 - RNA, 64 nt, Homo Sapiens; identical to SEQ ID NO: 217757

SEQ ID NO: 542565 - RNA, 64 nt, Homo Sapiens; identical to SEQ ID NO: 217758

SEQ ID NO: 542566 - RNA, 64 nt, Homo Sapiens; identical to SEQ ID NO: 217759

SEQ ID NO: 542567 - RNA, 64 nt, Homo Sapiens; identical to SEQ ID NO: 217760

SEQ ID NO: 542568 - RNA, 64 nt, Homo Sapiens; identical to SEQ ID NO: 217761

SEQ ID NO: 542569 - RNA, 64 nt, Homo Sapiens; identical to SEQ ID NO: 217762

SEQ ID NO: 542570 - RNA, 64 nt, Homo Sapiens; identical to SEQ ID NO: 217763

SEQ ID NO: 542571 - RNA, 64 nt, Homo Sapiens; identical to SEQ ID NO: 217764

SEQ ID NO: 542572 - RNA, 64 nt, Homo Sapiens; identical to SEQ ID NO: 217765

SEQ ID NO: 542573 - RNA, 64 nt, Homo Sapiens; identical to SEQ ID NO: 217766

SEQ ID NO: 542574 - RNA, 64 nt, Homo Sapiens; identical to SEQ ID NO: 217767

SEQ ID NO: 542575 - RNA, 64 nt, Homo Sapiens; identical to SEQ ID NO: 217768

SEQ ID NO: 542576 - RNA, 64 nt, Homo Sapiens; identical to SEQ ID NO: 217769

SEQ ID NO: 542577 - RNA, 64 nt, Homo Sapiens; identical to SEQ ID NO: 217770

SEQ ID NO: 542578 - RNA, 64 nt, Homo Sapiens; identical to SEQ ID NO: 217771

SEQ ID NO: 542579 - RNA, 64 nt, Homo Sapiens; identical to SEQ ID NO: 217772

SEQ ID NO: 542580 - RNA, 64 nt, Homo Sapiens; identical to SEQ ID NO: 217773

SEQ ID NO: 542581 - RNA, 64 nt, Homo Sapiens; identical to SEQ ID NO: 217774

SEQ ID NO: 542582 - RNA, 64 nt, Homo Sapiens; identical to SEQ ID NO: 217775

SEQ ID NO: 542583 - RNA, 64 nt, Homo Sapiens; identical to SEQ ID NO: 217776

SEQ ID NO: 542584 - RNA, 64 nt, Homo Sapiens; identical to SEQ ID NO: 217777

SEQ ID NO: 542585 - RNA, 64 nt, Homo Sapiens; identical to SEQ ID NO: 217778

SEQ ID NO: 542586 - RNA, 64 nt, Homo Sapiens; identical to SEQ ID NO: 217779

SEQ ID NO: 542587 - RNA, 64 nt, Homo Sapiens; identical to SEQ ID NO: 217780

SEQ ID NO: 542588 - RNA, 64 nt, Homo Sapiens; identical to SEQ ID NO: 217781

SEQ ID NO: 542589 - RNA, 64 nt, Homo Sapiens; identical to SEQ ID NO: 217782

SEQ ID NO: 542590 - RNA, 64 nt, Homo Sapiens; identical to SEQ ID NO: 217783

SEQ ID NO: 542591 - RNA, 64 nt, Homo Sapiens; identical to SEQ ID NO: 217784

SEQ ID NO: 542592 - RNA, 64 nt, Homo Sapiens; identical to SEQ ID NO: 217785

SEQ ID NO: 542593 - RNA, 64 nt, Homo Sapiens; identical to SEQ ID NO: 217786

SEQ ID NO: 542594 - RNA, 64 nt, Homo Sapiens; identical to SEQ ID NO: 217787

SEQ ID NO: 542595 - RNA, 64 nt, Homo Sapiens; identical to SEQ ID NO: 217788

SEQ ID NO: 542596 - RNA, 64 nt, Homo Sapiens; identical to SEQ ID NO: 217789

SEQ ID NO: 542597 - RNA, 64 nt, Homo Sapiens; identical to SEQ ID NO: 217790

SEQ ID NO: 542598 - RNA, 64 nt, Homo Sapiens; identical to SEQ ID NO: 217791

SEQ ID NO: 542599 - RNA, 64 nt, Homo Sapiens; identical to SEQ ID NO: 217792

SEQ ID NO: 542600 - RNA, 64 nt, Homo Sapiens; identical to SEQ ID NO: 217793

SEQ ID NO: 542601 - RNA, 64 nt, Homo Sapiens; identical to SEQ ID NO: 217794

SEQ ID NO: 542602 - RNA, 64 nt, Homo Sapiens; identical to SEQ ID NO: 50725

SEQ ID NO: 542603 - RNA, 64 nt, Homo Sapiens; identical to SEQ ID NO: 50726

SEQ ID NO: 542604 - RNA, 64 nt, Homo Sapiens; identical to SEQ ID NO: 50727

SEQ ID NO: 542605 - RNA, 64 nt, Homo Sapiens; identical to SEQ ID NO: 50728

SEQ ID NO: 542606 - RNA, 64 nt, Homo Sapiens; identical to SEQ ID NO: 50729

SEQ ID NO: 542607 - RNA, 64 nt, Homo Sapiens; identical to SEQ ID NO: 50730

SEQ ID NO: 542608 - RNA, 64 nt, Homo Sapiens; identical to SEQ ID NO: 50731

SEQ ID NO: 542609 - RNA, 64 nt, Homo Sapiens; identical to SEQ ID NO: 50732

SEQ ID NO: 542610 - RNA, 64 nt, Homo Sapiens; identical to SEQ ID NO: 50733

SEQ ID NO: 542611 - RNA, 64 nt, Homo Sapiens; identical to SEQ ID NO: 50734

SEQ ID NO: 542612 - RNA, 51 nt, Homo Sapiens; identical to SEQ ID NO: 50735

SEQ ID NO: 542613 - RNA, 64 nt, Homo Sapiens; identical to SEQ ID NO: 50736

SEQ ID NO: 542614 - RNA, 64 nt, Homo Sapiens; identical to SEQ ID NO: 50737

SEQ ID NO: 542615 - RNA, 64 nt, Homo Sapiens; identical to SEQ ID NO: 50738

SEQ ID NO: 542616 - RNA, 64 nt, Homo Sapiens
ccagccucagaacugaaggacccaaguaaucauuaacccccagaugaugaagugauccuuaacc

SEQ ID NO: 542617 - RNA, 64 nt, Homo Sapiens
uaaucauuaacccccagaccaugaagugauccuuaacccccaagcuagauccccugaggacuug

SEQ ID NO: 542618 - RNA, 64 nt, Homo Sapiens
auacaguuuuguuuguuauacucuuugcaccuuaaacccccaccacuccccgacacuauugccu

SEQ ID NO: 542619 - RNA, 64 nt, Homo Sapiens
agugggcuguaggcaggguccuccauggguuuccaacccccaucacuggcaccaggaucuccca

SEQ ID NO: 542620 - RNA, 64 nt, Homo Sapiens
agacuuguuggugcuaccccuuacuccccucugcaacccccauuuugggaguugaccccagcaa

SEQ ID NO: 542621 - RNA, 64 nt, Homo Sapiens
cugauaugcuggugauucccaaauacauagcuccaacccccaacuucccccagacuuuagaucu

SEQ ID NO: 542622 - RNA, 64 nt, Homo Sapiens
ccuucaggaucagucaagggcccucccuuacaguaacccccaccguuaugaguagccuaccacc

SEQ ID NO: 542623 - RNA, 64 nt, Homo Sapiens
ugaggaguugagagagugcagccccccaaccccgaacccccagucccuacugcaacuaacuguu

SEQ ID NO: 542624 - RNA, 64 nt, Homo Sapiens
ugggucuaauccuucucauuucagguagcugucuaacccccagcaacagacaaaacaaucccca

SEQ ID NO: 542625 - RNA, 64 nt, Homo Sapiens
agacaucacccuuugccuuaccuuucggcagaggaacccccaccaccacaugccacugccugca

SEQ ID NO: 542626 - RNA, 64 nt, Homo Sapiens
cuuaccugcacccaggccucagaguuucagggcuaacccccagaauacugguaggggccaaggc

SEQ ID NO: 542627 - RNA, 64 nt, Homo Sapiens
aggggguugaauaugcaaaagcaguuccgcugggaacccccauccaaucaacugcuguacccau

SEQ ID NO: 542628 - RNA, 64 nt, Homo Sapiens
ccugaagaaauucagauacaaaaaacaccaaaaaaacccccaaagucucaaaaaaacaaaacaa

SEQ ID NO: 542629 - RNA, 64 nt, Homo Sapiens
accuggggauugggcaguguuccuccccucagucaacccccauaugccugguuugcgggagauu

SEQ ID NO: 542630 - RNA, 64 nt, Homo Sapiens
ucuacuaaaaauaccaaaaaguccaacauggugaaacccccauccaggaguucaagaccagccu

SEQ ID NO: 542631 - RNA, 64 nt, Homo Sapiens
ucccuagcccaccccccuccgaucacugugaaccaacccccaucggguugugagacuucuguuu

SEQ ID NO: 542632 - RNA, 64 nt, Homo Sapiens
accaauuucccagggacuccgaugaggcuuguacaacccccaccuggggccuaggcagggcugg

SEQ ID NO: 542633 - RNA, 64 nt, Homo Sapiens
ccguuucccuggugcccagagcccucccaaugccaacccccaccucugaggccaguauccucca

SEQ ID NO: 542634 - RNA, 64 nt, Homo Sapiens
gccuuguaugaagcccaccccugcacccucaagaaacccccagucccccaagucuuccuacccu

SEQ ID NO: 542635 - RNA, 64 nt, Homo Sapiens
uacagaccccaugucacccagauacucccauaauaacccccaaauugaggccccauuauuaaca

SEQ ID NO: 542636 - RNA, 64 nt, Homo Sapiens
ccuuccccaccuccagcaguccaacucacccccaaacccccauccgcuccuccuccguccuauc

SEQ ID NO: 542637 - RNA, 64 nt, Homo Sapiens
cccacgacucacuuccacacgaacuuuucuccccaacccccaaagggacccccggcccggcccg

SEQ ID NO: 542638 - RNA, 64 nt, Homo Sapiens
ccccugggcuucggaggggggugcuugugccccuaacccccaugcucuugugccuucccccucu

SEQ ID NO: 542639 - RNA, 64 nt, Homo Sapiens
ccugcuccuuuucugggcccuagcacagguggguaacccccacccaacccagcuccugcugcug

SEQ ID NO: 542640 - RNA, 64 nt, Homo Sapiens
aggaagaaagccccagacgcuugguuuuucucagaacccccaaaagaugugcaauagcuguugu

SEQ ID NO: 542641 - RNA, 64 nt, Homo Sapiens
aagacaguaagacaguaaacuauuuuaggaagucaacccccauugcacucuguggcaguuauuc

SEQ ID NO: 542642 - RNA, 64 nt, Homo Sapiens
ugagagccugguucugugaucacagccagcaguaaucagggagcacugaaggagguggagcucc

SEQ ID NO: 542643 - RNA, 64 nt, Homo Sapiens
gaaccauuaggaguggaacuaacuaaacuacagaaucagggaaaucaguugcccuuucugaggc

SEQ ID NO: 542644 - RNA, 64 nt, Homo Sapiens
guggauucuaggaaaagggaggcaggagugggggaucagggaaguuagggagguuggugucaga

SEQ ID NO: 542645 - RNA, 64 nt, Homo Sapiens
cugaacccuuccccugggagucaaagcacuugacaucagggaccuacucugccagucucagccu

SEQ ID NO: 542646 - RNA, 64 nt, Homo Sapiens
cugaggcuuaggagagcugccuucgcugcaggaaaucagggauuaucccuuaacagaagugucu

SEQ ID NO: 542647 - RNA, 64 nt, Homo Sapiens
ggagcccuaccccagaaguguaucccacgagggcaucagggacgcagugaguguugcucaaggg

SEQ ID NO: 542648 - RNA, 64 nt, Homo Sapiens
aaacccucaggcaguuguuaaaauuuuguugaacaucagggaguuuaagaaaacccugcaagua

SEQ ID NO: 542649 - RNA, 64 nt, Homo Sapiens
aagauauucaauccaaaauuaagucuauguaaauaucagggaauaauucacaguagaaauaucu

SEQ ID NO: 542650 - RNA, 64 nt, Homo Sapiens
cuguccugccucgaaggagcagccugggcagccaucacaccacgaggacaggaagcaccagcac

SEQ ID NO: 542651 - RNA, 64 nt, Homo Sapiens
gugcuaaugagcauugagacugaugcuuuguaagucacaccacaacaaauauugauugagggcg

SEQ ID NO: 542652 - RNA, 64 nt, Homo Sapiens
gcaggggcguggaggaacugucugagcucuggagucacaccagcugacggcuccgugcugacau

SEQ ID NO: 542653 - RNA, 64 nt, Homo Sapiens
agagccaggaacgggucaccuccagcagcccugaucacaccauggugugccccuccacccuccc

SEQ ID NO: 542654 - RNA, 64 nt, Homo Sapiens
uucccaccgguagagaaacuuccagaccagccccucacaccacagccaagagaagccuuuccag

SEQ ID NO: 542655 - RNA, 64 nt, Homo Sapiens
uuaccaccuggagagaagcuuccagaccagccccucacaccacagccaggagaggccuuuccca

SEQ ID NO: 542656 - RNA, 64 nt, Homo Sapiens
uucucaccuggagagaaacuuccagaccagccccucacaccaccgccaggagaggccuuuccca

SEQ ID NO: 542657 - RNA, 64 nt, Homo Sapiens
uucccaccgggagagaaacuuccagaccagccccucacaccacagccaggagaggccuuuccca

SEQ ID NO: 542658 - RNA, 64 nt, Homo Sapiens
uucccaccgggagaggaacuuccagaccagccccucacaccacagccaggagaggccuuucccg

SEQ ID NO: 542659 - RNA, 64 nt, Homo Sapiens
uuucccgccuggagagaagcuucaggccagcuccucacaccacagccaggagagaccuuuucug

SEQ ID NO: 542660 - RNA, 64 nt, Homo Sapiens
uuccugccuggagagaagcuuccagaccagcccuucacaccacagccaggagaggccuuuccca

SEQ ID NO: 542661 - RNA, 64 nt, Homo Sapiens
auccgugacgccagcuucccuccguggaggcccaucacaccagcgcacguuccucccggccuag

SEQ ID NO: 542662 - RNA, 64 nt, Homo Sapiens
agccucugggggcaggggcuccggcaggugcuucucacaccagggcccuuaauccacgucggag

SEQ ID NO: 542663 - RNA, 64 nt, Homo Sapiens
ccuccagguccugagcccuuccucuguaaaagugucacaccaccucccucagcacuuccccauc

SEQ ID NO: 542664 - RNA, 64 nt, Homo Sapiens
augauuagaucgggucucggaagggaaguagccaucacaccauuaaaaagccuguggaccuuuu

SEQ ID NO: 542665 - RNA, 64 nt, Homo Sapiens
guccaagcucaggcauaauucagcauaagaaaauucacaccagagccaaaucuuacaaauguag

SEQ ID NO: 542666 - RNA, 64 nt, Homo Sapiens
uaucaaauucaggcuucauucagcaucugagaguucacaccagggagaaaucauguauguacug

SEQ ID NO: 542667 - RNA, 64 nt, Homo Sapiens
gucauagcucagccauugcucagcaucagauaauucacaccagagagaaacccucugaauguga

SEQ ID NO: 542668 - RNA, 64 nt, Homo Sapiens
gaagauugaaagggacuuuuuuauaucucacacuucacaccagugcauuacacuaacuuguuca

SEQ ID NO: 542669 - RNA, 64 nt, Homo Sapiens
gaacccgggaagugaagguugccgugagcugagaucacaccacugccauaaacaugacaggcuu

SEQ ID NO: 542670 - RNA, 64 nt, Homo Sapiens
cacaugcacaccacaacacacaacacaccucaccucacaccacagcacaccucaccacaccaca

SEQ ID NO: 542671 - RNA, 64 nt, Homo Sapiens
gagcccaggaguuugaggcugcaaugaacuaugaucacaccacugcacuccagccucggcgaca

SEQ ID NO: 542672 - RNA, 64 nt, Homo Sapiens
gcacuccagccuggcgacaggcagugagcugagaucacaccacugaacccgggaggcaaagguu

SEQ ID NO: 542673 - RNA, 64 nt, Homo Sapiens
ucaucuggauuuuggauuuccucaucccauugacucacaccacguaaagaaaauaccaguguuu

SEQ ID NO: 542674 - RNA, 64 nt, Homo Sapiens
ugacaagcacaggaacggucagaaacugggcucaucacaccaaggcaaagcaacgggcgagucu

SEQ ID NO: 542675 - RNA, 64 nt, Homo Sapiens
uaauacugccaaaucucaaaaguuaagcugaauuucacaccagauccuaccccuuucccugagc

SEQ ID NO: 542676 - RNA, 64 nt, Homo Sapiens
cuaugagcccacgcccggccacuccuggccccacucacaccauccccaccauccugugagcccc

SEQ ID NO: 542677 - RNA, 64 nt, Homo Sapiens
cugugagccccacucccggcacucccagccccacucacaccaaccacuccauccugugagcccc

SEQ ID NO: 542678 - RNA, 64 nt, Homo Sapiens
cugugagccccacucccggcaugcccggccccacucacaccaacucccaccauccugugagccc

SEQ ID NO: 542679 - RNA, 64 nt, Homo Sapiens
cugugagaccacgcccggccgcacccggccccucucacaccaucugcaccauccugugagcccc

SEQ ID NO: 542680 - RNA, 64 nt, Homo Sapiens
augcagaaaaguuucuaaucgucuucuuucgucuucacaccaacuaaacuauuuuauaaacacu

SEQ ID NO: 542681 - RNA, 64 nt, Homo Sapiens
aucuggauuucuuaauuuuuaaggacuagaauguucacaccacguucauaccgacaacaucuga

SEQ ID NO: 542682 - RNA, 64 nt, Homo Sapiens
aagcgaaauacuugaaaagaggugaccauaaagaucacaccaauuuagaaugaauauuaaaguc

SEQ ID NO: 542683 - RNA, 64 nt, Homo Sapiens
gccauucuuuagucauuccaaguguauauuuguaucacaccaguuacuuguguucauugacacc

SEQ ID NO: 542684 - RNA, 64 nt, Homo Sapiens
cugccuuucccucauaugauuuuuuuccgccucaucacaccauguuaacuucuccccauuuugu

SEQ ID NO: 542685 - RNA, 64 nt, Homo Sapiens
gcacuccagccugggugacagcagugagccaagaucacaccauugaaccugggagguggugguu

SEQ ID NO: 542686 - RNA, 61 nt, Homo Sapiens
aaccgauccagaauaccgaagguauggacaggacagaaaagcgagucgcaggaggaaggga

SEQ ID NO: 542687 - RNA, 61 nt, Homo Sapiens
cacaccaaggcuggaggcuggucugucauaagacagaaagaaagacgcugggcccaauuuu

SEQ ID NO: 542688 - RNA, 61 nt, Homo Sapiens
aaaccagggaguuuguagaguugacuucacugacagaaaagcagggccguuguguagauau

SEQ ID NO: 542689 - RNA, 61 nt, Homo Sapiens
ugauuaagguaauguguccucugagaagugggacagaaagaccccucucgggccuuugugg

SEQ ID NO: 542690 - RNA, 61 nt, Homo Sapiens
caaauagcaauugacuugaaaaauuaauuuagacagaaaagacaauacuccaaucacaguu

SEQ ID NO: 542691 - RNA, 61 nt, Homo Sapiens
agucucuucuaaaaauuguugagcauuggucgacagaaagaauaucuaggagucucuugau

SEQ ID NO: 542692 - RNA, 61 nt, Homo Sapiens
cuuccauaauugaacuagauuuuagagucaggacagaaaagguauccaauaaaggagacag

SEQ ID NO: 542693 - RNA, 61 nt, Homo Sapiens
aaaaagagagacaaacucuaagagaaugaaugacagaaaaagacgugacguccugccagaa

SEQ ID NO: 542694 - RNA, 61 nt, Homo Sapiens
uacuauggguuugccauuaauuucugagugggacagaaauuauaauugugcuuuuucgugu

SEQ ID NO: 542695 - RNA, 61 nt, Homo Sapiens
cuauuggaauauaguauguagggugaaaguugacagaaaucuguacuucuucaggaaaucc

SEQ ID NO: 542696 - RNA, 61 nt, Homo Sapiens
gcugcuaguaucagaggggcaguagagcuuggacagaaagaaaagaaacuugguguuaggu

SEQ ID NO: 542697 - RNA, 61 nt, Homo Sapiens
guugcauggauccuguguuugcaacuggggagacagaaacugugguugauagccagucacu

SEQ ID NO: 542698 - RNA, 61 nt, Homo Sapiens
cagugacgaaggugcguuguugccgaaaugagacagaaauucaggguugguucucauuucg

SEQ ID NO: 542699 - RNA, 61 nt, Homo Sapiens
gacaaaagguccagucucaugucaguuuggagacagaaaaagcaguuucaaaaaugacaaa

SEQ ID NO: 542700 - RNA, 61 nt, Homo Sapiens
ucgucaaaagauuuuugcuuggaauaagcaugacagaaagauuuaaccuaaguguuagaca

SEQ ID NO: 542701 - RNA, 61 nt, Homo Sapiens
uguuacagcaauccuaggaagcuaauacucugacagaaaaaaaucuuggauaauaugcaug

SEQ ID NO: 542702 - RNA, 61 nt, Homo Sapiens
aagcaguguuaagaauaccauagugaggauugacagaaauuuaaagaugucuuaacauuua

SEQ ID NO: 542703 - RNA, 61 nt, Homo Sapiens
aauggaaugucuucagucauaagugguuugggacagaaagaauuuccccauggaaaggaga

SEQ ID NO: 542704 - RNA, 61 nt, Homo Sapiens
gcauacauuccugucagacaacuaguugucugacagaaauguuaggcuucauguauguuac

SEQ ID NO: 542705 - RNA, 61 nt, Homo Sapiens
auuuuaaauuuaacuuugacauccagcuauagacagaaauaauaagccacccuggguguaa

SEQ ID NO: 542706 - RNA, 61 nt, Homo Sapiens
guucugauauccuccuacaguaguuuaaauugacagaaaaauuugaauguuuucuucuuaa

SEQ ID NO: 542707 - RNA, 61 nt, Homo Sapiens
uaccugaacuguagugguuugaucggauggagacagaaaacccgauuuuuauucucauaaa

SEQ ID NO: 542708 - RNA, 61 nt, Homo Sapiens
aauugaaagaaucgauaaaaguucaucuuuggacagaaagccuuuaaaaaaaaaaucacuc

SEQ ID NO: 542709 - RNA, 61 nt, Homo Sapiens
aaaacaugucaagugucacauuagugucacagacagaaagcacacaccuaugcaauauggc

SEQ ID NO: 542710 - RNA, 61 nt, Homo Sapiens
augggugcugugguccucugggggaagcugugacagaaacgccugacuccugcggggguau

SEQ ID NO: 542711 - RNA, 61 nt, Homo Sapiens
agaagccucuggacacugccgcaacacugaagacagaaagauaggguaaaaggcaugugcu

SEQ ID NO: 542712 - RNA, 61 nt, Homo Sapiens
aaacaccccacugucaacauuagaucaaugagacagaaaguuaacaaggauauccaggaau

SEQ ID NO: 542713 - RNA, 61 nt, Homo Sapiens
aaauguaauccagcauauaaacagaaccaaagacagaaaccacaugauuaucucaauagau

SEQ ID NO: 542714 - RNA, 64 nt, Homo Sapiens
uccuaaauccaguagccuccuucuacccucaagauacucccagacaggacacaagacuucugau

SEQ ID NO: 542715 - RNA, 64 nt, Homo Sapiens
ggcaugggagaagguuggcgccaaaggccaacuguacucccaaaccugcccuuccacccggagg

SEQ ID NO: 542716 - RNA, 64 nt, Homo Sapiens
uccuucuugaggggcugccuggcccgcuccauccuacucccacuaacuacaccucagggcgggu

SEQ ID NO: 542717 - RNA, 64 nt, Homo Sapiens
gccugcgcucugcccugcccugccuagccucugcuacucccacuucccaacuccagggaaugca

SEQ ID NO: 542718 - RNA, 64 nt, Homo Sapiens
ucugcuuucucuguacuguauaggcaacauguuguacucccaguagcaacuagaucucuuuuac

SEQ ID NO: 542719 - RNA, 64 nt, Homo Sapiens
uauacagucuaucaaauuugcccccuggcuuuauuacucccaauugaauuaucuaccucauuuu

SEQ ID NO: 542720 - RNA, 64 nt, Homo Sapiens
cuuguccaguggagcccaacaugcuugacccccauacucccaacuuaaaauugaauucauucug

SEQ ID NO: 542721 - RNA, 64 nt, Homo Sapiens
auugauugacuauaagaaagucacaucuaccuauuacucccagcucuucaaugcucaagugaag

SEQ ID NO: 542722 - RNA, 64 nt, Homo Sapiens
ucaggccucauggaaggugagacaguaaagacauuacucccauaaaaaugugaggagagagacu

SEQ ID NO: 542723 - RNA, 64 nt, Homo Sapiens
gguuauagcugcuuucagauuguuccauuaucuguacucccaacaacccugccggauauauuug

SEQ ID NO: 542724 - RNA, 64 nt, Homo Sapiens
acaggcuguccaagguagaaacuguacauagccggugaccgaaugcgaccuuugccagccagag

SEQ ID NO: 542725 - RNA, 64 nt, Homo Sapiens
gagaaguuguauagcacuauggugcgcuuccucagugaccgaaagaacccggugugccgggaga

SEQ ID NO: 542726 - RNA, 64 nt, Homo Sapiens
acuuuuaagaggauagaauaugcuauauugcacugugaccgagaacuguuggagcuacugcaaa

SEQ ID NO: 542727 - RNA, 64 nt, Homo Sapiens
gagggggugcuggagcgcgagaggcuggcugauugugaccgaaaccagaggguuguccaccccg

SEQ ID NO: 542728 - RNA, 64 nt, Homo Sapiens
acguuugugagaagaaaugacauuuugcuaggaagugaccgagucuaggaaugcuuuuauucaa

SEQ ID NO: 542729 - RNA, 64 nt, Homo Sapiens
guuccucuuguucuaaucuugucaaccagugcaagugaccgacaaaauuccaguuauuuauuuc

SEQ ID NO: 542730 - RNA, 64 nt, Homo Sapiens
aaaucauuacaguagcuuagcuacuuuaguugaugugaccgaggaaucccuucuagaaucauag

SEQ ID NO: 542731 - RNA, 64 nt, Homo Sapiens
ggaggugaucugccaggugcugcaccuggggacugugaccgacuuuaagcaaaccgucaacaaa

SEQ ID NO: 542732 - RNA, 64 nt, Homo Sapiens
cugcugcugccccugccaccacagcugcuuaugugugaccgaugggguugagaggggcaagagu

SEQ ID NO: 542733 - RNA, 64 nt, Homo Sapiens
aaucaguacguguugaacccgcaacuuucccagggugaccgaggaagcccuuuaauuagagaua

SEQ ID NO: 542734 - RNA, 64 nt, Homo Sapiens
uacuagugacuaguuuacuagcuugauuugcuuggugaccgaauauuggcuuccuuucuugcag

SEQ ID NO: 542735 - RNA, 64 nt, Homo Sapiens
cugcucucuuuuccuuuuaauucgauuucuuuuggugaccgaaguauuuuuuaaaaaccauccu

SEQ ID NO: 542736 - RNA, 64 nt, Homo Sapiens
gagacuguuucuaaaaauaaggccuccagccugggugaccgaguguaagcugugaucgugacau

SEQ ID NO: 542737 - RNA, 64 nt, Homo Sapiens
uauaugcccugaccaccauaggaugcuagucuuugugaccgauugcuaaucuucugcacuuuaa

SEQ ID NO: 542738 - RNA, 64 nt, Homo Sapiens
agaccucagcucagcccucagggcccagggugcugugaccgaugggccaccugcaccagcguca

SEQ ID NO: 542739 - RNA, 64 nt, Homo Sapiens
cuauuuuaaaucucagaauuauacauuaugaaaggugaccgacuccuuuuuauagucuuauaag

SEQ ID NO: 542740 - RNA, 64 nt, Homo Sapiens
cuuccgcauccuagucucuaucauuaaaguucuagugaccgagacccgggcugcguucucuggg

SEQ ID NO: 542741 - RNA, 64 nt, Homo Sapiens
ugcugccacaggaccugagauuuccuugugguaagugaccgagaaaguaguuugaaacucauug

SEQ ID NO: 542742 - RNA, 64 nt, Homo Sapiens
aauuaauaucuccuggaacacuauagagaaccaagugaccgacucauuuacaacugaaaccuag

SEQ ID NO: 542743 - RNA, 64 nt, Homo Sapiens
uguggggaagaggggcuggggcauggcaggcugggugaccgacuaccccagucccagggaaggu

SEQ ID NO: 542744 - RNA, 64 nt, Homo Sapiens
gcccauccuuccaaaauguaaauccagucgcggugugaccgagcuggcuaacaggcuugucugc

SEQ ID NO: 542745 - RNA, 64 nt, Homo Sapiens
ccaaaccagacuguugguggaaacuccaaucccggugaccgaccuaaauggcaucuaggaaggu

SEQ ID NO: 542746 - RNA, 64 nt, Homo Sapiens
accgucacaggccccucugguuagacuagcaugagugaccgaagccauccaucaacauuuucua

SEQ ID NO: 542747 - RNA, 64 nt, Homo Sapiens
aucccucucagauaggugggguaggauuuuccuggugaccgaguaaagugagaggcaggugaga

SEQ ID NO: 542748 - RNA, 64 nt, Homo Sapiens
agcaggguccccagggggcauaaaggggcccccugugaccgaggcaggauggggaugggaaaac

SEQ ID NO: 542749 - RNA, 64 nt, Homo Sapiens
aggaagaagggauucagaaagcuuuuuucagagagugaccgaauuacaugggaaaaacaaacca

SEQ ID NO: 542750 - RNA, 64 nt, Homo Sapiens
acugcagcugucugaccuucgacaccaucuccaugugaccgaacugcggccucugagacaugaa

SEQ ID NO: 542751 - RNA, 64 nt, Homo Sapiens
agaggggggcuucgagguggucccugguacuggggugaccgaguggacagcccagggugcagcu

SEQ ID NO: 542752 - RNA, 64 nt, Homo Sapiens
ucggcaauaaguacuggcucagcagggcaaggaggugaccgaguagccaugaaggcugugaacg

SEQ ID NO: 542753 - RNA, 64 nt, Homo Sapiens
gcgccacggaagccuggggaggccuagagcuccugugaccgagaaacagucaagaggaaccauu

SEQ ID NO: 542754 - RNA, 64 nt, Homo Sapiens
gauuuuuggccagugguugguggauuaggaauucgugaccgaguccuuccuacugaugugauug

SEQ ID NO: 542755 - RNA, 64 nt, Homo Sapiens
aaguuaacaugucaccuccacgaggccauccucugugaccgaaggcagcugcugcggacccgcc

SEQ ID NO: 542756 - RNA, 64 nt, Homo Sapiens
cuacuauuggcccuaaauagcagaaagaagagaagugaccgagagaaccucagauucuucauug

SEQ ID NO: 542757 - RNA, 64 nt, Homo Sapiens
gagggagggcugccugauccgccgccccgugacugugaccgaggcuccuccugucuggcccgag

SEQ ID NO: 542758 - RNA, 64 nt, Homo Sapiens
ucagcuccguaagguggcggugcugaagcgucaggugaccgagucuucaggacaagccccugcu

SEQ ID NO: 542759 - RNA, 64 nt, Homo Sapiens
augcuuucuuuggccuacauacuguucuauacgagugaccgauucuucaaauuauagaaacaau

SEQ ID NO: 542760 - RNA, 64 nt, Homo Sapiens
uagagaugccugaacaauauuauuuaaguaguaugugaccgagcuauaaauuuuuguuuuuguu

SEQ ID NO: 542761 - RNA, 62 nt, Homo Sapiens
gggagggggagugggacugagcguccgcagaggugaccgaaaagccguaugaugauguuccc

SEQ ID NO: 542762 - RNA, 64 nt, Homo Sapiens
uccucgauuacuggggacccucaaucuggagcgggugaccgagacucccagauggccaccaucc

SEQ ID NO: 542763 - RNA, 64 nt, Homo Sapiens
guaguuuaguuuuccuccuugccuucccuucugugugaccgaccccuuggccaaaaaaaaacaa

SEQ ID NO: 542764 - RNA, 64 nt, Homo Sapiens
ccaguccccucccacuuugcuucuuguaugcauugugaccgaccccacuuccucagaauguaac

SEQ ID NO: 542765 - RNA, 64 nt, Homo Sapiens
gccccucugugaagugaaaccucacuccuguccagugaccgagccacugcaaagcacagcugau

SEQ ID NO: 542766 - RNA, 64 nt, Homo Sapiens
ccuccccagugccucuccugccgcguggcauccugugaccgaccuagcuguggcuucuaggugc

SEQ ID NO: 542767 - RNA, 64 nt, Homo Sapiens
ggccaucauggugucaggaaggcugaggcggugugugaccgaguaccacccacuacauggcaga

SEQ ID NO: 542768 - RNA, 64 nt, Homo Sapiens
ccucgcacagccggccgccccgcggcggcgcccggugaccgaggagguggagaccccgcaggga

SEQ ID NO: 542769 - RNA, 64 nt, Homo Sapiens
ucugaauauugauuucuaacaccuggaugaggcugugaccgaucaacuuggaacacuguaaagg

SEQ ID NO: 542770 - RNA, 64 nt, Homo Sapiens
ugagccaugaucgcaccacugcacucuagccugggugaccgagggaggcucugucucaaaagca

SEQ ID NO: 542771 - RNA, 64 nt, Homo Sapiens
uaggucaucagcccagggcuccuugccuugcagcgugaccgagauuccaccaacccuccugcau

SEQ ID NO: 542772 - RNA, 64 nt, Homo Sapiens
ggguggggacugagccgcccaucggaagguggcggugaccgaggggacggcugauggacucagc

SEQ ID NO: 542773 - RNA, 64 nt, Homo Sapiens
guaagugaggauuccuaggagaggccauuacccagugaccgaugacaaauguaauaugcauccu

SEQ ID NO: 542774 - RNA, 64 nt, Homo Sapiens
cugggugccucagggagcucgagggggcucacaagugaccgauccguccccuagugcacccuga

SEQ ID NO: 542775 - RNA, 64 nt, Homo Sapiens
gucacuucgggccuugugauucaauagaauaaaagugaccgacuuuauaaacacaggagaauaa

SEQ ID NO: 542776 - RNA, 64 nt, Homo Sapiens
cggacaacugacccgccaggaccuggccccgcuggugaccgacgcgggauccggcacucggacu

SEQ ID NO: 542777 - RNA, 64 nt, Homo Sapiens
acagaccuuccuagaguguuuggucggguucacagugaccgagagucagguccagcacacaccu

SEQ ID NO: 542778 - RNA, 64 nt, Homo Sapiens
agggccacgcggccccacauugcacuucuggggggugaccgacuucguacacggguuuaaaguu

SEQ ID NO: 542779 - RNA, 64 nt, Homo Sapiens
ucaagaacgagcaucaaagcuuuugguagcaagagugaccgaugcccuccacccugugucccug

SEQ ID NO: 542780 - RNA, 64 nt, Homo Sapiens
cugaaacuuugggaauuugcacuucaguaugaaugugaccgaaugcuuugagauauaauauuga

SEQ ID NO: 542781 - RNA, 64 nt, Homo Sapiens; identical to SEQ ID NO: 123549

SEQ ID NO: 542782 - RNA, 64 nt, Homo Sapiens; identical to SEQ ID NO: 123550

SEQ ID NO: 542783 - RNA, 64 nt, Homo Sapiens; identical to SEQ ID NO: 123551

SEQ ID NO: 542784 - RNA, 64 nt, Homo Sapiens; identical to SEQ ID NO: 123552

SEQ ID NO: 542785 - RNA, 64 nt, Homo Sapiens; identical to SEQ ID NO: 123553

SEQ ID NO: 542786 - RNA, 64 nt, Homo Sapiens; identical to SEQ ID NO: 123554

SEQ ID NO: 542787 - RNA, 64 nt, Homo Sapiens; identical to SEQ ID NO: 123555

SEQ ID NO: 542788 - RNA, 64 nt, Homo Sapiens; identical to SEQ ID NO: 123556

SEQ ID NO: 542789 - RNA, 64 nt, Homo Sapiens; identical to SEQ ID NO: 123557

SEQ ID NO: 542790 - RNA, 64 nt, Homo Sapiens; identical to SEQ ID NO: 123558

SEQ ID NO: 542791 - RNA, 64 nt, Homo Sapiens; identical to SEQ ID NO: 123559

SEQ ID NO: 542792 - RNA, 64 nt, Homo Sapiens; identical to SEQ ID NO: 123560

SEQ ID NO: 542793 - RNA, 64 nt, Homo Sapiens; identical to SEQ ID NO: 123561

SEQ ID NO: 542794 - RNA, 64 nt, Homo Sapiens; identical to SEQ ID NO: 123562

SEQ ID NO: 542795 - RNA, 64 nt, Homo Sapiens; identical to SEQ ID NO: 123563

SEQ ID NO: 542796 - RNA, 64 nt, Homo Sapiens; identical to SEQ ID NO: 123564

SEQ ID NO: 542797 - RNA, 64 nt, Homo Sapiens; identical to SEQ ID NO: 123565

SEQ ID NO: 542798 - RNA, 64 nt, Homo Sapiens; identical to SEQ ID NO: 123566

SEQ ID NO: 542799 - RNA, 64 nt, Homo Sapiens; identical to SEQ ID NO: 123567

SEQ ID NO: 542800 - RNA, 64 nt, Homo Sapiens; identical to SEQ ID NO: 123568

SEQ ID NO: 542801 - RNA, 64 nt, Homo Sapiens; identical to SEQ ID NO: 123569

SEQ ID NO: 542802 - RNA, 64 nt, Homo Sapiens; identical to SEQ ID NO: 123570

SEQ ID NO: 542803 - RNA, 64 nt, Homo Sapiens; identical to SEQ ID NO: 123571

SEQ ID NO: 542804 - RNA, 64 nt, Homo Sapiens; identical to SEQ ID NO: 123572

SEQ ID NO: 542805 - RNA, 64 nt, Homo Sapiens; identical to SEQ ID NO: 123573

SEQ ID NO: 542806 - RNA, 64 nt, Homo Sapiens; identical to SEQ ID NO: 123574

SEQ ID NO: 542807 - RNA, 64 nt, Homo Sapiens; identical to SEQ ID NO: 123575

SEQ ID NO: 542808 - RNA, 64 nt, Homo Sapiens; identical to SEQ ID NO: 123576

SEQ ID NO: 542809 - RNA, 64 nt, Homo Sapiens; identical to SEQ ID NO: 123577

SEQ ID NO: 542810 - RNA, 64 nt, Homo Sapiens; identical to SEQ ID NO: 123578

SEQ ID NO: 542811 - RNA, 64 nt, Homo Sapiens; identical to SEQ ID NO: 123579

SEQ ID NO: 542812 - RNA, 64 nt, Homo Sapiens; identical to SEQ ID NO: 123580

SEQ ID NO: 542813 - RNA, 64 nt, Homo Sapiens; identical to SEQ ID NO: 123581

SEQ ID NO: 542814 - RNA, 64 nt, Homo Sapiens; identical to SEQ ID NO: 123582

SEQ ID NO: 542815 - RNA, 64 nt, Homo Sapiens; identical to SEQ ID NO: 123583

SEQ ID NO: 542816 - RNA, 64 nt, Homo Sapiens; identical to SEQ ID NO: 123584

SEQ ID NO: 542817 - RNA, 64 nt, Homo Sapiens; identical to SEQ ID NO: 123585

SEQ ID NO: 542818 - RNA, 64 nt, Homo Sapiens; identical to SEQ ID NO: 123586

SEQ ID NO: 542819 - RNA, 64 nt, Homo Sapiens; identical to SEQ ID NO: 123587

SEQ ID NO: 542820 - RNA, 64 nt, Homo Sapiens; identical to SEQ ID NO: 123588

SEQ ID NO: 542821 - RNA, 64 nt, Homo Sapiens; identical to SEQ ID NO: 123589

SEQ ID NO: 542822 - RNA, 64 nt, Homo Sapiens; identical to SEQ ID NO: 123590

SEQ ID NO: 542823 - RNA, 64 nt, Homo Sapiens; identical to SEQ ID NO: 123591

SEQ ID NO: 542824 - RNA, 64 nt, Homo Sapiens; identical to SEQ ID NO: 123592

SEQ ID NO: 542825 - RNA, 64 nt, Homo Sapiens; identical to SEQ ID NO: 123593

SEQ ID NO: 542826 - RNA, 64 nt, Homo Sapiens; identical to SEQ ID NO: 123594

SEQ ID NO: 542827 - RNA, 64 nt, Homo Sapiens; identical to SEQ ID NO: 123595

SEQ ID NO: 542828 - RNA, 64 nt, Homo Sapiens; identical to SEQ ID NO: 123596

SEQ ID NO: 542829 - RNA, 64 nt, Homo Sapiens; identical to SEQ ID NO: 123597

SEQ ID NO: 542830 - RNA, 64 nt, Homo Sapiens; identical to SEQ ID NO: 123598

SEQ ID NO: 542831 - RNA, 64 nt, Homo Sapiens; identical to SEQ ID NO: 123599

SEQ ID NO: 542832 - RNA, 64 nt, Homo Sapiens; identical to SEQ ID NO: 123600

SEQ ID NO: 542833 - RNA, 64 nt, Homo Sapiens; identical to SEQ ID NO: 123601

SEQ ID NO: 542834 - RNA, 64 nt, Homo Sapiens; identical to SEQ ID NO: 76484

SEQ ID NO: 542835 - RNA, 64 nt, Homo Sapiens; identical to SEQ ID NO: 76485

SEQ ID NO: 542836 - RNA, 64 nt, Homo Sapiens
cagagucagcacaggccccgcucggauccccaccugacacuaacuggccaaugugcauaaccua

SEQ ID NO: 542837 - RNA, 64 nt, Homo Sapiens
cagaaaauuggcaguggcaggugcucccgagagaugacacuaguuacccacuaggcugccccac

SEQ ID NO: 542838 - RNA, 62 nt, Homo Sapiens
gcagguuuccacugugggcgguuggcacucugccaucugaguccucugccuaaagcauuccu

SEQ ID NO: 542839 - RNA, 62 nt, Homo Sapiens
caagcaaaccugggguauuuauccacugacuuccaucugacacugguugaggaccacugcca

SEQ ID NO: 542840 - RNA, 62 nt, Homo Sapiens
cacgcaggaaauugugagcauuaagaaaacaaccaucugagauuaaaguauggcccgaccau

SEQ ID NO: 542841 - RNA, 62 nt, Homo Sapiens
auuuugggaggagcccccagaaauggaaacccccaucugaguaacuuugauuuauagaagga

SEQ ID NO: 542842 - RNA, 62 nt, Homo Sapiens
guggugacuggggcccauguguuucaaauaagccaucugauuaggguuuuuuuuguuuguuu

SEQ ID NO: 542843 - RNA, 62 nt, Homo Sapiens
cugugacaggcauagcucauacuccaggaaggccaucugacccuccugauugacccgacucc

SEQ ID NO: 542844 - RNA, 62 nt, Homo Sapiens
cuuaaagauccauucugaauuucaauuugagcccaucugagccauuuuauaaaacacaaggu

SEQ ID NO: 542845 - RNA, 62 nt, Homo Sapiens
cucugaguaaagaucccaauagaaucaaggguccaucugagcuucaauguaugacuccuggg

SEQ ID NO: 542846 - RNA, 62 nt, Homo Sapiens
ccagcgcuaauucaggcuccauaaaccaggguccaucugacccacaugcuuuucuuuuucua

SEQ ID NO: 542847 - RNA, 62 nt, Homo Sapiens
aagaggcaucuucgagcccagaaucccuagacccaucugaugucagcagugacguagcaucu

SEQ ID NO: 542848 - RNA, 62 nt, Homo Sapiens
cucccaaauugcuccccaccaagaccaagucuccaucugagagguggggauuucugaguucu

SEQ ID NO: 542849 - RNA, 62 nt, Homo Sapiens
aauggguacaggaaaggauugccucaguuuccccaucugaagggcguccuaacgccuccaug

SEQ ID NO: 542850 - RNA, 62 nt, Homo Sapiens
ugagccagcuuuauauuucaaccauggcuggcccaucugagagcaucuccccacucucgcca

SEQ ID NO: 542851 - RNA, 62 nt, Homo Sapiens
uuuucucuuauuuuguuuucucuggaucuuuuccaucugaggguacaggaaguaccaggacc

SEQ ID NO: 542852 - RNA, 62 nt, Homo Sapiens
uacaggcacuaaaguuaguaaagaaaaguuuaccaucugaaaaagcuggauuuucuuuaaga

SEQ ID NO: 542853 - RNA, 62 nt, Homo Sapiens
cuuacuugcauaccaaguugauacuugaauaaccaucugaaagugguacuugaucauuuuua

SEQ ID NO: 542854 - RNA, 62 nt, Homo Sapiens
aacuguagucaucuuaaauuucaaaccauuuaccaucugaaaguuuugauuugaauguaaaa

SEQ ID NO: 542855 - RNA, 62 nt, Homo Sapiens
ucauagcugucugaccucuacggaccucacauccaucugaggcuucauggacaaagauucuc

SEQ ID NO: 542856 - RNA, 62 nt, Homo Sapiens
gguuagaauagagggcagaguaaaaggaagcuccaucugagcaaguacaccaaaugaucuca

SEQ ID NO: 542857 - RNA, 60 nt, Homo Sapiens
aucagauaggccggucucagacauuaauccuaccaucugauauuuuuggugaaggaaaaa

SEQ ID NO: 542858 - RNA, 64 nt, Homo Sapiens
ucuccucuuucagagcacuggcucuccagccccaggaggagaacaggagggaggaggagaugaa

SEQ ID NO: 542859 - RNA, 64 nt, Homo Sapiens
uggcucuccagccccaggaggagaacaggagggaggaggagaugaaagaggagggacagguucu

SEQ ID NO: 542860 - RNA, 64 nt, Homo Sapiens
ggagccucagcccuguccugugugacugggcuuuggaggagacugggaagcaaaaaccaaaaug

SEQ ID NO: 542861 - RNA, 64 nt, Homo Sapiens
aaacaaaaacagaaagcacauuuccugaagucguggaggagauuauaaagucuuuugugaauua

SEQ ID NO: 542862 - RNA, 64 nt, Homo Sapiens
uagcugcugccuugccuucccgccuguccaguucggaggagaacggacaacagaagccccaugc

SEQ ID NO: 542863 - RNA, 64 nt, Homo Sapiens
cugagcacgugugacauugcaugaaccgaggggaggaggagaagggugcgaguuccuccugcau

SEQ ID NO: 542864 - RNA, 64 nt, Homo Sapiens
uagcccaaguauaggcucuggggcaaggacuguuggaggagaguaaagccaucugggcagucag

SEQ ID NO: 542865 - RNA, 64 nt, Homo Sapiens
gccaaccucaggcuuagauccaugaccugaugugggaggagacaaccagcaugaugauaauauu

SEQ ID NO: 542866 - RNA, 64 nt, Homo Sapiens
gggguggggggacauucagacgggcaguguuagaggaggagaugggagcggugacuacacacac

SEQ ID NO: 542867 - RNA, 64 nt, Homo Sapiens
gcuaggagaucugagggcaggcgggcagcugcagggaggagaggugagaaaggaagcgucuucu

SEQ ID NO: 542868 - RNA, 64 nt, Homo Sapiens
ccugcuccaggguagaccugagaugaaccucccuggaggagacuuauuucaaugaguccaccau

SEQ ID NO: 542869 - RNA, 62 nt, Homo Sapiens
ugcaggagucacacggucauaggccaucaaagcuggaggagaccucagaaucauucauucac

SEQ ID NO: 542870 - RNA, 64 nt, Homo Sapiens
aacuuggauuccccuggguaagagagagaaagauggaggagaagagagagagagagagagagag

SEQ ID NO: 542871 - RNA, 64 nt, Homo Sapiens
agaaagugcaacguggggaguuugggccaauuucggaggagagacuugaacccagaaggaggac

SEQ ID NO: 542872 - RNA, 64 nt, Homo Sapiens
ucugucccccuccagguucggcacccaggucuccggaggagacacaguuacccgaacccuucgc

SEQ ID NO: 542873 - RNA, 64 nt, Homo Sapiens
gagcuccuggcccuggccagaagcaggagugugaggaggagacagccucagcggacaagcagcu

SEQ ID NO: 542874 - RNA, 64 nt, Homo Sapiens
aggaagagaggagauggauuucaguugggaguuaggaggagaguaggugagaugaucagacacc

SEQ ID NO: 542875 - RNA, 64 nt, Homo Sapiens
aauccuagagccagcugauaauauuuaauaaucuggaggagagaauaaugauguaccaauaagu

SEQ ID NO: 542876 - RNA, 64 nt, Homo Sapiens
cuaacuguaaccuuuagguuccucuucugugcugggaggagaguaguaugucagcuuuucucac

SEQ ID NO: 542877 - RNA, 64 nt, Homo Sapiens
ggagcccccucuggcuguguguggccggacggcaggaggagaggaguggacagcguggugagcc

SEQ ID NO: 542878 - RNA, 64 nt, Homo Sapiens
cccaugcuuccugucugccugauucggagaggaaggaggagagcacuggccuuggccacacugg

SEQ ID NO: 542879 - RNA, 64 nt, Homo Sapiens
ccaccuucuuaggugccuguagcccuggaagcucggaggagaggugcuucagccuggccugggc

SEQ ID NO: 542880 - RNA, 64 nt, Homo Sapiens
gugcagagcuccaggaaaggggggauuaaagaggggaggagagacagaagggaggggagacaga

SEQ ID NO: 542881 - RNA, 64 nt, Homo Sapiens
aggaaaggaugggggcugaacuggucaaggcagaggaggagagggcugucugcugggaggucag

SEQ ID NO: 542882 - RNA, 64 nt, Homo Sapiens
gccaggcuguccuggguguguuaggguggccuugggaggagaggacaaauccagacaccagccu

SEQ ID NO: 542883 - RNA, 64 nt, Homo Sapiens
gaaguaggccagaaguccaggagagagucaugcuggaggagaaguuugaaauguuggguuucca

SEQ ID NO: 542884 - RNA, 64 nt, Homo Sapiens
gacuuugagcuaaggcugaaguacaggaggaggaggaggagagggccggauguggguguggaca

SEQ ID NO: 542885 - RNA, 64 nt, Homo Sapiens
agggccggauguggguguggacagcaguaguggcggaggagagcucggggcugggcugccuggc

SEQ ID NO: 542886 - RNA, 51 nt, Homo Sapiens
aagauggaacagaaguuuaauggaggagaccuauguguauuuuuuucuaaa

SEQ ID NO: 542887 - RNA, 64 nt, Homo Sapiens
gggaagugagagaguaugguggcaauaucacaagggaggagagaggaaaacaauuaucuucucu

SEQ ID NO: 542888 - RNA, 64 nt, Homo Sapiens
gcgagugagcaggggccaaggaggagaaggaggaggaggagagcggagcucaagcagugaggag

SEQ ID NO: 542889 - RNA, 53 nt, Homo Sapiens
gaggaggaggagagcgcgagggaggaggagaagcccuggagcucaagcaguga

SEQ ID NO: 542890 - RNA, 64 nt, Homo Sapiens
aaugacagaaugcuuuuaggcacauucaauggaaggaggagauguaggucuguauauguuaccc

SEQ ID NO: 542891 - RNA, 64 nt, Homo Sapiens
uaaauaauuccaaacucucaucgggucauaaagaggaggagaaacagggugagucaagguaaag

SEQ ID NO: 542892 - RNA, 64 nt, Homo Sapiens
ucccucuuuuccccuugcccccucugcagccggaggaggagauguugaggggaggaggccagcc

SEQ ID NO: 542893 - RNA, 64 nt, Homo Sapiens
cagugaggugagacuucccagaccccggaggcguggaggagaggagacuguuugaugugguaca

SEQ ID NO: 542894 - RNA, 64 nt, Homo Sapiens
guguccacccuccggcccccgucuuguaaaaaggggaggagaauuagccaaacacuguaagcuu

SEQ ID NO: 542895 - RNA, 64 nt, Homo Sapiens
acuggcuuggcccugcuccgugaugugcaucagcggaggagaacgcucuguccuuacauguauu

SEQ ID NO: 542896 - RNA, 64 nt, Homo Sapiens
ccugguucugcccaaaauaacacuguggcguccaggaggagauggggcuggaugacgggguugg

SEQ ID NO: 542897 - RNA, 64 nt, Homo Sapiens
gggaggagggggaggaagacaagaaggaagaggaggaggagaaggaagacgaggagcuggacug

SEQ ID NO: 542898 - RNA, 64 nt, Homo Sapiens
ggccugcucagcugcccggagagccgccgccgcuggaggagaccgacuggucgcacucgcagcu

SEQ ID NO: 542899 - RNA, 64 nt, Homo Sapiens
uaccuucccaagcccgcccagugggaugggaggaggaggagaaggggggccuugggccgcugca

SEQ ID NO: 542900 - RNA, 64 nt, Homo Sapiens
gccucucacugugaauuuguggugggcgggggcuggaggagagggugggggacuggcuccgucc

SEQ ID NO: 542901 - RNA, 64 nt, Homo Sapiens
ucugagacucacgucccccagggcaagugcuuguggaggagagcaagucucaagagcgcaguau

SEQ ID NO: 542902 - RNA, 64 nt, Homo Sapiens
cggccagagggaauguucuggagcugccaaggagggaggagacucggguuggcuaauccccgga

SEQ ID NO: 542903 - RNA, 64 nt, Homo Sapiens
acaguucuacaagacugcaggaauucuccuuaagggaggagagcaagcagguguggccccagcu

SEQ ID NO: 542904 - RNA, 64 nt, Homo Sapiens
aucagucccuucauuucuugagacucaacuccugggaggagagggucucaagaguugucccugg

SEQ ID NO: 542905 - RNA, 64 nt, Homo Sapiens
ggggaaucucccaaaauuuaguaugcuuccagguggaggagaaauaaucaaggccccagagugu

SEQ ID NO: 542906 - RNA, 64 nt, Homo Sapiens
caugaagagaaaaccuguuugcugcccacaggcaggaggagaagaacaccauucuggaaguuug

SEQ ID NO: 542907 - RNA, 64 nt, Homo Sapiens
gggcaccccugccuccugccgagccugcccaguuggaggagacuuuacuguugcagcuugugcu

SEQ ID NO: 542908 - RNA, 64 nt, Homo Sapiens
gggucuccaguguuccccccagguaucaacuaggggaggagagacagacagggagaaguugagc

SEQ ID NO: 542909 - RNA, 62 nt, Homo Sapiens
aggacuuccugggcccauaggugaagccuucuggaggagaaggugacguggcccagcgucca

SEQ ID NO: 542910 - RNA, 64 nt, Homo Sapiens
agacucagcuccaggcugcuuggcagcccagccuggaggagaaggcuaaugacggaggggcccc

SEQ ID NO: 542911 - RNA, 64 nt, Homo Sapiens
ggauagucuacagcuaaugagaaacauuguggugggaggagaggucuguuuguaacucaucaua

SEQ ID NO: 542912 - RNA, 64 nt, Homo Sapiens
ccaggucagaaugugaggucaaggcuggggaaggggaggagacugccuaggccaaagcuagccc

SEQ ID NO: 542913 - RNA, 64 nt, Homo Sapiens
gguaggagcuggagaugaagcugagggaugagggggaggagagagguugggcaugcugugguug

SEQ ID NO: 542914 - RNA, 64 nt, Homo Sapiens
caguagccuccgacacagaagcagcuccacuaauggaggagaggcaugcuuccuggggccucca

SEQ ID NO: 542915 - RNA, 64 nt, Homo Sapiens
ugcaaguaggcuuugaggggugaaggagauugguggaggagaguaaauaaucuagaggcaagag

SEQ ID NO: 542916 - RNA, 64 nt, Homo Sapiens
cucacugccuauaagaggaaauaagagagaaaguggaggagagggacaaaaggaguaauuauuu

SEQ ID NO: 542917 - RNA, 64 nt, Homo Sapiens
cugugccacccucagagaagaagaaaggagcugaggaggagaagccaaagaggaggaggcagga

SEQ ID NO: 542918 - RNA, 64 nt, Homo Sapiens
gucugcggggauccuguuacaaaggugaaacccaggaggagaguguggaguccagagugcugcc

SEQ ID NO: 542919 - RNA, 64 nt, Homo Sapiens
caaggucccuacucuuguggaguuuacuucugguggaggagacagaugauaaguaaacaaauaa

SEQ ID NO: 542920 - RNA, 64 nt, Homo Sapiens
aggccuuuccgcggugggauguugagcugaggccggaggagaaguagcagucgcuggcagagca

SEQ ID NO: 542921 - RNA, 64 nt, Homo Sapiens
gaggagacccugcugcuuuggacagccugacuugggaggagacuaugauuuugaggacgacugu

SEQ ID NO: 542922 - RNA, 64 nt, Homo Sapiens
acagcccucagcaucaacgacccgauggggaugaggaggagagcagagugaggggccccgccag

SEQ ID NO: 542923 - RNA, 64 nt, Homo Sapiens
acacucgacccagucuaaagugggugccauucacggaggagagggagguuggagacuucaaccg

SEQ ID NO: 542924 - RNA, 64 nt, Homo Sapiens
ucagacaggccuccacggcuauggagagaaggcuggaggagacacaauggaugguucauguucu

SEQ ID NO: 542925 - RNA, 64 nt, Homo Sapiens
aggcuggggagggcugggcaaagugggaaagguaggaggagagacaagccuggaaggaggcaau

SEQ ID NO: 542926 - RNA, 64 nt, Homo Sapiens
gcuuuugcucugggucuccagaaggaggaugaagggaggagagaugucugaaaucacaugguga

SEQ ID NO: 542927 - RNA, 64 nt, Homo Sapiens
gcauggugcagagggggcugaggcgcuaggcccgggaggagaguguggaggccacaguuguagc

SEQ ID NO: 542928 - RNA, 64 nt, Homo Sapiens
ggcacugaggaugcuguucucaguuugacuguggggaggagagagaaugggguacuagcacccc

SEQ ID NO: 542929 - RNA, 64 nt, Homo Sapiens
cagagagaggagacgaagaguuugggacagugggggaggagaugggaagggaugggauuucugg

SEQ ID NO: 542930 - RNA, 64 nt, Homo Sapiens
gugugcggcuccagcccagcugcuauuuaacaugggaggagagccuugugaauuuuucuaaagg

SEQ ID NO: 542931 - RNA, 64 nt, Homo Sapiens
caggaagggccacgacaaagcccucacuggguucggaggagaguaugccgggggagccaccagc

SEQ ID NO: 542932 - RNA, 64 nt, Homo Sapiens
acaugggggagagagacuuggaagaggaggaggaggaggagaaggaggagagagaggggaagag

SEQ ID NO: 542933 - RNA, 64 nt, Homo Sapiens
agagagacuuggaagaggaggaggaggaggagaaggaggagagagaggggaagagacaaagugg

SEQ ID NO: 542934 - RNA, 64 nt, Homo Sapiens
ccccgaugcuccgaagccugaucuuccaggguggggaggagaaaaucccaccuccccugaccuc

SEQ ID NO: 542935 - RNA, 64 nt, Homo Sapiens
cccaucccuaggcuaaagagccaugaguccuggaggaggagaggaccccucccaaaggacugga

SEQ ID NO: 542936 - RNA, 64 nt, Homo Sapiens
caggcccacauugcccacacagugacgugaguggggaggagacugccgcuguguccccgcgggc

SEQ ID NO: 542937 - RNA, 64 nt, Homo Sapiens
gucaggaagccuccugcugagugacaucgguucaggaggagacaggcguguccccugccuguga

SEQ ID NO: 542938 - RNA, 64 nt, Homo Sapiens
cgggaggggaccauuugggaugggcaacgguggaggaggagagagacaucgccgggggagguug

SEQ ID NO: 542939 - RNA, 64 nt, Homo Sapiens
cacagccagggcgugugguucccaagucccgcccggaggagaggugagcugugggucugaucac

SEQ ID NO: 542940 - RNA, 64 nt, Homo Sapiens
uaauaaaucuguaucagaugacuccggaaaugugggaggagagaauuacugcuugguacgcaga

SEQ ID NO: 542941 - RNA, 64 nt, Homo Sapiens
cuuuggaaguucagcagaugaaagcccaggccagggaggagaaggcuagaaagcaggugagcac

SEQ ID NO: 542942 - RNA, 64 nt, Homo Sapiens
ugcagcgcaucaaggccacagcgauucgcacggaggaggagaagcgccugauggagcagaaggu

SEQ ID NO: 542943 - RNA, 64 nt, Homo Sapiens
gaggcugcagaugccugggacauugcucccaagaggaggagagggacuggggggaucagcugcc

SEQ ID NO: 542944 - RNA, 64 nt, Homo Sapiens
ccuggaaagcuuugguagguggaagacacugggaggaggagagggccaccuucaggccugggaa

SEQ ID NO: 542945 - RNA, 64 nt, Homo Sapiens
aaacuaaugaaaacaaucucuguaauggcagauaggaggagaugaaaaguucuguugcauggau

SEQ ID NO: 542946 - RNA, 64 nt, Homo Sapiens
cugugccuacuaaagguaucuucuggaguuuuugggaggagagaaacuggaaaauuaaauugua

SEQ ID NO: 542947 - RNA, 64 nt, Homo Sapiens
gucaggcuggucucaaacuccugaccucaggugauccgcccaccucagccucccaaagugcugg

SEQ ID NO: 542948 - RNA, 64 nt, Homo Sapiens
cgaccugacuuacuugcacugugaucccccuugcuccgcccacugugaccuugaaccccaugca

SEQ ID NO: 542949 - RNA, 64 nt, Homo Sapiens
uuggcuacucuagcguggugcgcccuaguacgacuccgcccaguguguggaccaaccaaauagc

SEQ ID NO: 542950 - RNA, 64 nt, Homo Sapiens
ggcuggaauggaacuccucacuagcugcuggggcuccgcccacccugcucccuuccggacaaug

SEQ ID NO: 542951 - RNA, 64 nt, Homo Sapiens
gggcagggacugccuccucccggaauuccuaagauccgcccagcugccaccauuuucauugcuu

SEQ ID NO: 542952 - RNA, 64 nt, Homo Sapiens
ccccucuccugcccucugcagagacccucagagauccgcccagaugaacagaugaguccuggga

SEQ ID NO: 542953 - RNA, 64 nt, Homo Sapiens
ucagcucucaaagugcugggccaaccucaggugauccgcccaccguuaggcuggucucgaacuc

SEQ ID NO: 542954 - RNA, 64 nt, Homo Sapiens
cucccucuuuguguccauuccccaaauuaaccucuccgcccaggcccagaggaggggcugccug

SEQ ID NO: 542955 - RNA, 64 nt, Homo Sapiens
gggguccccuccagcaugggacuggccugccuccuccgcccagcucggcgagcuccuccagacc

SEQ ID NO: 542956 - RNA, 64 nt, Homo Sapiens
gccaggcuggucucgaacugcuggauucaagugauccgcccaucuccgucucccaaagugcugg

SEQ ID NO: 542957 - RNA, 64 nt, Homo Sapiens
accaccccuccugcuuccccgagccugacccuguuccgcccacuggcaaucagggcugcgcacu

SEQ ID NO: 542958 - RNA, 64 nt, Homo Sapiens
ccaaagagggcucucccucccuggguggcuucacuccgcccauuuaugaggugugcagggggag

SEQ ID NO: 542959 - RNA, 64 nt, Homo Sapiens
gaccuccagggacaggagcacugugcccacagcuuccgcccacacgucugacagccauguccac

SEQ ID NO: 542960 - RNA, 64 nt, Homo Sapiens
gccaggcugguuucaaacuccugaccucaggugauccgcccaccucagccucccaaaauggugg

SEQ ID NO: 542961 - RNA, 64 nt, Homo Sapiens
guugauuccagugcuaaaagggaaaaaccugugguccgcccagaagagauuccuccagugccug

SEQ ID NO: 542962 - RNA, 64 nt, Homo Sapiens
gucaggcuggucucgaacuccagaccucaggugauccgcccaccucggccucccaaacugcugg

SEQ ID NO: 542963 - RNA, 64 nt, Homo Sapiens
gaaaugaaauauguugcugggugcguuaaucaccuccgcccaggauuuagucacuugcaggacc

SEQ ID NO: 542964 - RNA, 64 nt, Homo Sapiens
augucccccugcugggucaggaagggcugguacauccgcccaccugggacugucauguuaucca

SEQ ID NO: 542965 - RNA, 64 nt, Homo Sapiens
gccaggcuggucuugaacuccugaccucaacugauccgcccaccuuggccucccaagugcuggg

SEQ ID NO: 542966 - RNA, 64 nt, Homo Sapiens
cggcugcugcuucucccuggggccuccuagccucuccgcccacgcaaguccucgccccccgccc

SEQ ID NO: 542967 - RNA, 64 nt, Homo Sapiens
cagagcuggcugcugugcccaggaccacguggacuccgcccacauguccccagggaagagaaug

SEQ ID NO: 542968 - RNA, 64 nt, Homo Sapiens
cccacugaccuaguagaauuccacuccaggugaauccgcccacuuaaaauaaaccuucacugcu

SEQ ID NO: 542969 - RNA, 64 nt, Homo Sapiens
gucaggcuggucuugaacucccgaccucaggugauccgcccaccuaggccucucaaaguguugg

SEQ ID NO: 542970 - RNA, 64 nt, Homo Sapiens
cauuaucugcacuauaagcucaaagaaugucacauccgcccagacagcucuuugaugaggguga

SEQ ID NO: 542971 - RNA, 64 nt, Homo Sapiens
gccgccgccgcugucccagauccccgcgccacgguccgcccacccgccgcuaaccggccgcucg

SEQ ID NO: 542972 - RNA, 50 nt, Homo Sapiens
ucuccaagaggaagcccuaauccgcccacaggaagccugcaguccuggaa

SEQ ID NO: 542973 - RNA, 64 nt, Homo Sapiens
uuuggcacuugaggcacggagaagggaagggaaguccgcccagccagaacucccagacccgcuc

SEQ ID NO: 542974 - RNA, 64 nt, Homo Sapiens
cuuaggcuggucuugaacuccugaacucaagugauccgcccaccucagccucccaaaguguugg

SEQ ID NO: 542975 - RNA, 64 nt, Homo Sapiens
cugcagugcaguggcaugaucggagucucacucuuccgcccagguuuuuuuuuuuuuuuugaga

SEQ ID NO: 542976 - RNA, 56 nt, Homo Sapiens
gacccacauggacuaaaggccccagguccgcccaggaugcccucagccagcucuga

SEQ ID NO: 542977 - RNA, 64 nt, Homo Sapiens
uuggccucccagagugcugguccugaccucgugauccgcccaccuagccaggauggucucgauc

SEQ ID NO: 542978 - RNA, 64 nt, Homo Sapiens
agucuguucugauggcacuggaagccuacagccauccgcccaaagaguggcacugauaacuggu

SEQ ID NO: 542979 - RNA, 64 nt, Homo Sapiens
cauuccuucucgugcacugcuggaggccguugguuccgcccacuggcugcuggaaggcagcuug

SEQ ID NO: 542980 - RNA, 64 nt, Homo Sapiens
guuggccaggauggucucaaucucgaccucgugauccgcccaccuuggccucccaaaguguugg

SEQ ID NO: 542981 - RNA, 64 nt, Homo Sapiens
aggccagccugcucccuggcugaggcucaggcuauccgcccaagcucuuugcucauucuagggc

SEQ ID NO: 542982 - RNA, 64 nt, Homo Sapiens
ccugaggaccaucuuagcggcccuguccucuuuuuccgcccauucucccucgggucuccccaga

SEQ ID NO: 542983 - RNA, 64 nt, Homo Sapiens
ucggccucccaaaguguuggucucgaccucgugauccgcccaccguuggccaggauggucucaa

SEQ ID NO: 542984 - RNA, 64 nt, Homo Sapiens
gggguucgugggcacagggcccccgccucucuccuccgcccacaucucaggaagcucccggagu

SEQ ID NO: 542985 - RNA, 64 nt, Homo Sapiens
cugcccccugggagcccucgcccgacagcagcccuccgcccacugggucucuggugugaacacc

SEQ ID NO: 542986 - RNA, 64 nt, Homo Sapiens
cucuccccgcucuggauccuuccaggcccccaacuccgcccagccaaguaaccaggccccagcc

SEQ ID NO: 542987 - RNA, 64 nt, Homo Sapiens
ucggccuccugaggugcugaccaccuucaggugauccgcccaccgucaggcuggucucaaacuc

SEQ ID NO: 542988 - RNA, 64 nt, Homo Sapiens
agccucuggaggugaggcggugcagcucucggcuuccgcccaaccccacgcuggccccaacugc

SEQ ID NO: 542989 - RNA, 64 nt, Homo Sapiens
ucggccucccaaaucgcuaguccugaccucgugauccgcccaccuggccaggauggucucgauc

SEQ ID NO: 542990 - RNA, 64 nt, Homo Sapiens
gaagcgcuuccgagcugugcccagucccgggaauuccgcccagucugcccacacuucccucggu

SEQ ID NO: 542991 - RNA, 64 nt, Homo Sapiens
cgcuaggccagggaccaucugaggagaagcagccuccgcccagcgugggaccucaggaggguca

SEQ ID NO: 542992 - RNA, 62 nt, Homo Sapiens
caccaucaggccacucccucggggcagaggccuccgcccaguacuuugacgacguccuguga

SEQ ID NO: 542993 - RNA, 64 nt, Homo Sapiens
caugguagccugagcgcgccgccagccccgcggcuccgcccaggcccguccucuguuaaaggga

SEQ ID NO: 542994 - RNA, 64 nt, Homo Sapiens
cagugccaaacuugggccgcugcaccgcggcgccuccgcccaaaucaauaaacugugucugucc

SEQ ID NO: 542995 - RNA, 64 nt, Homo Sapiens
ggcauggcguucaagauuuuggagaugaacugauuccgcccaaauagaaucauguuuauuuuuu

SEQ ID NO: 542996 - RNA, 64 nt, Homo Sapiens
ucggcuucccaaagugcugacugaccucagguaauccgcccaucgccgggcuggucuugaacuc

SEQ ID NO: 542997 - RNA, 64 nt, Homo Sapiens
gccaggcuggucucaaacuccugacucgaagugauccgcccaccuuggccucccaaagcguugg

SEQ ID NO: 542998 - RNA, 64 nt, Homo Sapiens
guuuuguuuuguuuugagacaaagacucacucuguccgcccaggcugggugcagucacggcuca

SEQ ID NO: 542999 - RNA, 64 nt, Homo Sapiens
cccaggcuggucgcgaacuccugagcucaggcaauccgcccaccucagccucccaaaguguugg

SEQ ID NO: 543000 - RNA, 64 nt, Homo Sapiens
gcuggccuuaaugcuaaagcucucugcagggccuuccgcccagccccucucaggggcacuggcc

SEQ ID NO: 543001 - RNA, 64 nt, Homo Sapiens
cccuccaagcucuacucaccgauccugauccaccuccgcccaggccuccugcaggucagcagcu

SEQ ID NO: 543002 - RNA, 64 nt, Homo Sapiens
uccaccucccgcagugcuggaucugaccucgugauccgcccaucuggucucgaucuucugacag

SEQ ID NO: 543003 - RNA, 64 nt, Homo Sapiens
gccgccggaaguggcuccgugaaguuuuggguuuuccgcccacacggaaggcuuggucccaucg

SEQ ID NO: 543004 - RNA, 64 nt, Homo Sapiens
cugacaauaaaguugcucuggugccucccaacgcuccgcccacggcgccuguaucaugacugag

SEQ ID NO: 543005 - RNA, 64 nt, Homo Sapiens
gcaggcagcgcgagggaggagcugcgccgccggcuccgcccaaccagguggugcugagcuuccg

SEQ ID NO: 543006 - RNA, 64 nt, Homo Sapiens
uagccaggauggucucgaucuccugaccucgugauccgcccaccucggccucccaaagugcugg

SEQ ID NO: 543007 - RNA, 64 nt, Homo Sapiens
cugacccagggccuaggacggcauggaaggcuucuccgcccauuggguaagagcacagguuagg

SEQ ID NO: 543008 - RNA, 64 nt, Homo Sapiens
cugaccacgccccucggcggucggcccccaaggcuccgcccacaggucccgcccaccagcggac

SEQ ID NO: 543009 - RNA, 64 nt, Homo Sapiens
ccggccggacuuugauccccgcugcccgagggucuccgcccaccagcacaagaugcccugugca

SEQ ID NO: 543010 - RNA, 64 nt, Homo Sapiens
uuggccucccaaagugcuggcugaccucagaugauccgcccacagccaggcuagucucgaacuc

SEQ ID NO: 543011 - RNA, 64 nt, Homo Sapiens
uucccuccacuacagaaccucugggugagaccuguccgcccaccuucucccccuccaguaguag

SEQ ID NO: 543012 - RNA, 64 nt, Homo Sapiens
agugcgccauguuucagcggagguguccugcccuuccgcccacgcugcaggaacugcaugcugc

SEQ ID NO: 543013 - RNA, 64 nt, Homo Sapiens
uuggccucccaaagugcugguccugaccucaugauccgcccaccuagccaggauggucuugauc

SEQ ID NO: 543014 - RNA, 64 nt, Homo Sapiens
aggcggcugcacgguucucucugggugggguggcuccgcccaggaccuugugguguaguggggg

SEQ ID NO: 543015 - RNA, 64 nt, Homo Sapiens
gauagccugugggcaccagcauucaguagcugaauccgcccaguuuuauacgucuaaagaaaau

SEQ ID NO: 543016 - RNA, 64 nt, Homo Sapiens
ucggaaaaacagaaagauccauaaagaugcagaguccgcccagucaugcacagacuccagugga

SEQ ID NO: 543017 - RNA, 64 nt, Homo Sapiens
uguccauccauuccuccauccacccaucuguccauccgcccaucugcccguccauccauccauc

SEQ ID NO: 543018 - RNA, 64 nt, Homo Sapiens
ucagccucccaaagugcuagucuugaccucgugauccgcccaccuggccaggauggccucgauc

SEQ ID NO: 543019 - RNA, 64 nt, Homo Sapiens
gccaggcuagucucgaacucaugaccucaagugauccgcccacuucggucucccaaagugcugg

SEQ ID NO: 543020 - RNA, 64 nt, Homo Sapiens
gccaggcuggucucgaacuccuguccucagguaauccgcccaccucagccucccaaagugcugg

SEQ ID NO: 543021 - RNA, 64 nt, Homo Sapiens
cgccugcccugggagcaccggcucugcuuaccuguccgcccaccugucuggaacaagggccagg

SEQ ID NO: 543022 - RNA, 64 nt, Homo Sapiens
caggggccaaccucaggcuccuaaagagacauuuuccgcccacuccugggacacuccgucugcu

SEQ ID NO: 543023 - RNA, 64 nt, Homo Sapiens
ccccgcugggucugcagggaacggugcggcucuguccgcccaugggaaauaacaggcgggcuuc

SEQ ID NO: 543024 - RNA, 64 nt, Homo Sapiens
acccagccguguugagugaagugcugugcccacguccgcccaggcugccaggggcgccuggcaa

SEQ ID NO: 543025 - RNA, 64 nt, Homo Sapiens
ugucugucuuugccuggugucuuccuuucccguguccgcccaccccagcgucuguugguacuua

SEQ ID NO: 543026 - RNA, 64 nt, Homo Sapiens
ucugucacguucuccacacgggggagagacgcaguccgcccagguccccgcuuucuuuggaggc

SEQ ID NO: 543027 - RNA, 64 nt, Homo Sapiens
cuguaauguuuauauaagcagcccuacuuccaccuccgcccagccggugcccuguggcuucacc

SEQ ID NO: 543028 - RNA, 64 nt, Homo Sapiens
ucggccucccaaagugcuggcugaccucaggugauccgcccaccgccaggcuggucucgaacuc

SEQ ID NO: 543029 - RNA, 64 nt, Homo Sapiens
gcccuugcuguucugggaucccccagagcaccuguccgcccacucuguaaauaaacgcugggcu

SEQ ID NO: 543030 - RNA, 64 nt, Homo Sapiens
ugggggccucuucugcuuucuccgggauugggaauccgcccaucgccucgaccugccgcagggg

SEQ ID NO: 543031 - RNA, 64 nt, Homo Sapiens
gcagggaaagugcuuaguaugucccccuuuguccuccgcccagggugcugcacggcgagguggu

SEQ ID NO: 543032 - RNA, 64 nt, Homo Sapiens
ucagccuccgaaagugcugguccugaccuugugauccgcccaccuggccaggcuggucucaaac

SEQ ID NO: 543033 - RNA, 64 nt, Homo Sapiens
uuggccucccaaagugcuggcugaccucaggugauccgcccaccgccaggcucgucucgaacuc

SEQ ID NO: 543034 - RNA, 64 nt, Homo Sapiens
gugaugggcaccucucacugaccucacagcgcaguccgcccaucugagcacagggucuguccuu

SEQ ID NO: 543035 - RNA, 64 nt, Homo Sapiens
gcguccaccugcccuggcuacccccaccggugcauccgcccaguugcugagccuccuggccugg

SEQ ID NO: 543036 - RNA, 64 nt, Homo Sapiens
cagauaaugccaaaaauaugcaagcaugaaagauuccgcccauuuuucacuuauucuuagaaaa

SEQ ID NO: 543037 - RNA, 64 nt, Homo Sapiens
caaagccaugccauugcgcugccccggccgccaguccgcccagaagccauagacgagacguagg

SEQ ID NO: 543038 - RNA, 64 nt, Homo Sapiens
gacgccgggacccccugcccgaucgcgcgcggccuccgcccaccgccuccugccgcaaggggcc

SEQ ID NO: 543039 - RNA, 64 nt, Homo Sapiens
uauuuaacuuuauuuucuguuuuaugaguguguguccgcccacccccacccccuucaguguuaa

SEQ ID NO: 543040 - RNA, 64 nt, Homo Sapiens
gugaauaucgagaacugccauugucgucuuuauguccgcccaccuagugcuuccacuucuaugc

SEQ ID NO: 543041 - RNA, 64 nt, Homo Sapiens
ccugacagucccagccgccacccaaggagccccauccgcccacccacccugggacccacgcggc

SEQ ID NO: 543042 - RNA, 64 nt, Homo Sapiens
caaggggcuggaaucucaugauuccaugcccgaguccgcccaucccugaccaugguuuuggcuc

SEQ ID NO: 543043 - RNA, 64 nt, Homo Sapiens
gaaugucaccgucucccucuucuaccgcaaugacuccgcccaccugccccugccucucagccuc

SEQ ID NO: 543044 - RNA, 64 nt, Homo Sapiens
ggacaggacagugaccuugggaggaaggggcuacuccgcccacgucagggagagaugugagcau

SEQ ID NO: 543045 - RNA, 64 nt, Homo Sapiens
cgccagcuuuaggccccgcccuccucccaauggcuccgcccacagacucccuuauuucaauggc

SEQ ID NO: 543046 - RNA, 64 nt, Homo Sapiens
gcacggucugguucauuucuguaucuaccccccuuccgcccacgcccccgacccuuugcucaau

SEQ ID NO: 543047 - RNA, 64 nt, Homo Sapiens
ccuuucccccaucacuucucgggggguggggcauuccgcccaccccccuuccaaagaccccugg

SEQ ID NO: 543048 - RNA, 64 nt, Homo Sapiens
ucggccucccaaagugcugguccugaccucgggauccgcccaccuggccaggccgcucucaaac

SEQ ID NO: 543049 - RNA, 64 nt, Homo Sapiens
cagaugucccgagugcgccaaaagccgaucugacuccgcccagccuccucaggcucccucuauu

SEQ ID NO: 543050 - RNA, 64 nt, Homo Sapiens
uuggccucccgaagugcuggccgaccucaggugauccgcccacccaaaggcuggucuugaacuc

SEQ ID NO: 543051 - RNA, 64 nt, Homo Sapiens
uccaguccugugauccgggcuccgagcgugggucuccgcccagcgccugccaguucacaaccgc

SEQ ID NO: 543052 - RNA, 64 nt, Homo Sapiens
acuccuugucgugcggucaagucgcggguucagguccgcccauuaucuuggcccccagccccuc

SEQ ID NO: 543053 - RNA, 50 nt, Homo Sapiens
agcggcagccaaucggagcguccgcccaaaugcuacaauccagcuucuaa

SEQ ID NO: 543054 - RNA, 64 nt, Homo Sapiens
uggagcucgggcgguguagaaggggcgcaguagcuccgcccacgaucucgccccucgugauguc

SEQ ID NO: 543055 - RNA, 64 nt, Homo Sapiens
ucagccucccaaaguguugguccugaccucaugauccgcccaccuggccaggcuggucuugaac

SEQ ID NO: 543056 - RNA, 64 nt, Homo Sapiens
gcuuggcuacuguaggugucuaaguauaagcagguccgcccagguugugaggcuggcgauuaca

SEQ ID NO: 543057 - RNA, 64 nt, Homo Sapiens
cccagaaccaagcucucggugucucgggccaccauccgcccaccucgggcugaccccaccuccu

SEQ ID NO: 543058 - RNA, 64 nt, Homo Sapiens
cuguaccggaugcuggcaggaaccuucuccacauuccgcccaauccuggcucuggacuguggcc

SEQ ID NO: 543059 - RNA, 64 nt, Homo Sapiens
uugacuucccaaagugcuggcuggacucaagcaauccgcccacccccaggcuggucucgaacuc

SEQ ID NO: 543060 - RNA, 64 nt, Homo Sapiens
ucacugcaucccaaguggagccuccagagcuuucuccgcccacccugccaccugaagccgagcu

SEQ ID NO: 543061 - RNA, 64 nt, Homo Sapiens
ccgcuacuccggggacagugacuccucagccuccuccgcccagagcggcccccuugguacccgc

SEQ ID NO: 543062 - RNA, 64 nt, Homo Sapiens
ccccacucuccgggcaccgucuccugccugugcguccgcccaccgcugcccugucuguugcgac

SEQ ID NO: 543063 - RNA, 64 nt, Homo Sapiens
agcuggcccaugaaguuagcaagccugaagaggcuccgcccacagcucuugcugccauggucuc

SEQ ID NO: 543064 - RNA, 64 nt, Homo Sapiens
ggugcucaugcagacucuggagagggaggcggccuccgcccauugguggccugcccuucucccc

SEQ ID NO: 543065 - RNA, 64 nt, Homo Sapiens
uagccaggauggucuccaucuccugaccucaugauccgcccaccuuggccucccaaaaugcugg

SEQ ID NO: 543066 - RNA, 64 nt, Homo Sapiens
uacuucaagggccaagcugccccuuucccuccucuccgcccaugaaaaugccuccaaacugaga

SEQ ID NO: 543067 - RNA, 64 nt, Homo Sapiens
ucggccuugcaaaaugcuggcugaccucaggugauccgcccaccgucaggcuggucucaaacuc

SEQ ID NO: 543068 - RNA, 64 nt, Homo Sapiens; identical to SEQ ID NO: 423381

SEQ ID NO: 543069 - RNA, 64 nt, Homo Sapiens; identical to SEQ ID NO: 423382

SEQ ID NO: 543070 - RNA, 64 nt, Homo Sapiens; identical to SEQ ID NO: 423383

SEQ ID NO: 543071 - RNA, 64 nt, Homo Sapiens; identical to SEQ ID NO: 423384

SEQ ID NO: 543072 - RNA, 64 nt, Homo Sapiens; identical to SEQ ID NO: 423385

SEQ ID NO: 543073 - RNA, 64 nt, Homo Sapiens; identical to SEQ ID NO: 423386

SEQ ID NO: 543074 - RNA, 64 nt, Homo Sapiens; identical to SEQ ID NO: 423387

SEQ ID NO: 543075 - RNA, 64 nt, Homo Sapiens; identical to SEQ ID NO: 423388

SEQ ID NO: 543076 - RNA, 64 nt, Homo Sapiens; identical to SEQ ID NO: 423389

SEQ ID NO: 543077 - RNA, 64 nt, Homo Sapiens; identical to SEQ ID NO: 423390

SEQ ID NO: 543078 - RNA, 64 nt, Homo Sapiens; identical to SEQ ID NO: 423391

SEQ ID NO: 543079 - RNA, 64 nt, Homo Sapiens; identical to SEQ ID NO: 423392

SEQ ID NO: 543080 - RNA, 64 nt, Homo Sapiens; identical to SEQ ID NO: 423393

SEQ ID NO: 543081 - RNA, 64 nt, Homo Sapiens; identical to SEQ ID NO: 423394

SEQ ID NO: 543082 - RNA, 64 nt, Homo Sapiens; identical to SEQ ID NO: 423395

SEQ ID NO: 543083 - RNA, 64 nt, Homo Sapiens; identical to SEQ ID NO: 423396

SEQ ID NO: 543084 - RNA, 64 nt, Homo Sapiens; identical to SEQ ID NO: 423397

SEQ ID NO: 543085 - RNA, 64 nt, Homo Sapiens; identical to SEQ ID NO: 423398

SEQ ID NO: 543086 - RNA, 64 nt, Homo Sapiens; identical to SEQ ID NO: 423399

SEQ ID NO: 543087 - RNA, 64 nt, Homo Sapiens; identical to SEQ ID NO: 423400

SEQ ID NO: 543088 - RNA, 64 nt, Homo Sapiens; identical to SEQ ID NO: 423401

SEQ ID NO: 543089 - RNA, 64 nt, Homo Sapiens; identical to SEQ ID NO: 423402

SEQ ID NO: 543090 - RNA, 64 nt, Homo Sapiens; identical to SEQ ID NO: 245345

SEQ ID NO: 543091 - RNA, 64 nt, Homo Sapiens; identical to SEQ ID NO: 245346

SEQ ID NO: 543092 - RNA, 64 nt, Homo Sapiens; identical to SEQ ID NO: 245347

SEQ ID NO: 543093 - RNA, 64 nt, Homo Sapiens; identical to SEQ ID NO: 245348

SEQ ID NO: 543094 - RNA, 64 nt, Homo Sapiens; identical to SEQ ID NO: 245349

SEQ ID NO: 543095 - RNA, 64 nt, Homo Sapiens; identical to SEQ ID NO: 245350

SEQ ID NO: 543096 - RNA, 64 nt, Homo Sapiens; identical to SEQ ID NO: 245351

SEQ ID NO: 543097 - RNA, 64 nt, Homo Sapiens; identical to SEQ ID NO: 245352

SEQ ID NO: 543098 - RNA, 64 nt, Homo Sapiens; identical to SEQ ID NO: 245353

SEQ ID NO: 543099 - RNA, 64 nt, Homo Sapiens; identical to SEQ ID NO: 245354

SEQ ID NO: 543100 - RNA, 64 nt, Homo Sapiens; identical to SEQ ID NO: 245355

SEQ ID NO: 543101 - RNA, 64 nt, Homo Sapiens; identical to SEQ ID NO: 245356

SEQ ID NO: 543102 - RNA, 64 nt, Homo Sapiens; identical to SEQ ID NO: 245357

SEQ ID NO: 543103 - RNA, 64 nt, Homo Sapiens; identical to SEQ ID NO: 245358

SEQ ID NO: 543104 - RNA, 64 nt, Homo Sapiens; identical to SEQ ID NO: 245359

SEQ ID NO: 543105 - RNA, 64 nt, Homo Sapiens; identical to SEQ ID NO: 245360

SEQ ID NO: 543106 - RNA, 64 nt, Homo Sapiens; identical to SEQ ID NO: 245361

SEQ ID NO: 543107 - RNA, 64 nt, Homo Sapiens; identical to SEQ ID NO: 245362

SEQ ID NO: 543108 - RNA, 64 nt, Homo Sapiens; identical to SEQ ID NO: 245363

SEQ ID NO: 543109 - RNA, 64 nt, Homo Sapiens; identical to SEQ ID NO: 245364

SEQ ID NO: 543110 - RNA, 64 nt, Homo Sapiens; identical to SEQ ID NO: 245365

SEQ ID NO: 543111 - RNA, 64 nt, Homo Sapiens; identical to SEQ ID NO: 245366

SEQ ID NO: 543112 - RNA, 64 nt, Homo Sapiens; identical to SEQ ID NO: 245367

SEQ ID NO: 543113 - RNA, 64 nt, Homo Sapiens; identical to SEQ ID NO: 245368

SEQ ID NO: 543114 - RNA, 64 nt, Homo Sapiens; identical to SEQ ID NO: 245369

SEQ ID NO: 543115 - RNA, 64 nt, Homo Sapiens; identical to SEQ ID NO: 245370

SEQ ID NO: 543116 - RNA, 64 nt, Homo Sapiens; identical to SEQ ID NO: 245371

SEQ ID NO: 543117 - RNA, 64 nt, Homo Sapiens; identical to SEQ ID NO: 245372

SEQ ID NO: 543118 - RNA, 64 nt, Homo Sapiens; identical to SEQ ID NO: 245373

SEQ ID NO: 543119 - RNA, 64 nt, Homo Sapiens; identical to SEQ ID NO: 245374

SEQ ID NO: 543120 - RNA, 64 nt, Homo Sapiens; identical to SEQ ID NO: 245375

SEQ ID NO: 543121 - RNA, 64 nt, Homo Sapiens; identical to SEQ ID NO: 245376

SEQ ID NO: 543122 - RNA, 64 nt, Homo Sapiens; identical to SEQ ID NO: 245377

SEQ ID NO: 543123 - RNA, 64 nt, Homo Sapiens; identical to SEQ ID NO: 245378

SEQ ID NO: 543124 - RNA, 64 nt, Homo Sapiens; identical to SEQ ID NO: 245379

SEQ ID NO: 543125 - RNA, 64 nt, Homo Sapiens; identical to SEQ ID NO: 245380

SEQ ID NO: 543126 - RNA, 64 nt, Homo Sapiens; identical to SEQ ID NO: 245381

SEQ ID NO: 543127 - RNA, 64 nt, Homo Sapiens; identical to SEQ ID NO: 245382

SEQ ID NO: 543128 - RNA, 64 nt, Homo Sapiens; identical to SEQ ID NO: 245383

SEQ ID NO: 543129 - RNA, 64 nt, Homo Sapiens; identical to SEQ ID NO: 245384

SEQ ID NO: 543130 - RNA, 64 nt, Homo Sapiens; identical to SEQ ID NO: 245385

SEQ ID NO: 543131 - RNA, 51 nt, Homo Sapiens; identical to SEQ ID NO: 245386

SEQ ID NO: 543132 - RNA, 64 nt, Homo Sapiens; identical to SEQ ID NO: 245387

SEQ ID NO: 543133 - RNA, 64 nt, Homo Sapiens; identical to SEQ ID NO: 245388

SEQ ID NO: 543134 - RNA, 64 nt, Homo Sapiens; identical to SEQ ID NO: 245389

SEQ ID NO: 543135 - RNA, 64 nt, Homo Sapiens; identical to SEQ ID NO: 245390

SEQ ID NO: 543136 - RNA, 64 nt, Homo Sapiens; identical to SEQ ID NO: 245391

SEQ ID NO: 543137 - RNA, 64 nt, Homo Sapiens; identical to SEQ ID NO: 245392

SEQ ID NO: 543138 - RNA, 57 nt, Homo Sapiens; identical to SEQ ID NO: 245393

SEQ ID NO: 543139 - RNA, 64 nt, Homo Sapiens; identical to SEQ ID NO: 245394

SEQ ID NO: 543140 - RNA, 64 nt, Homo Sapiens; identical to SEQ ID NO: 245395

SEQ ID NO: 543141 - RNA, 64 nt, Homo Sapiens; identical to SEQ ID NO: 245396

SEQ ID NO: 543142 - RNA, 64 nt, Homo Sapiens; identical to SEQ ID NO: 245397

SEQ ID NO: 543143 - RNA, 64 nt, Homo Sapiens; identical to SEQ ID NO: 245398

SEQ ID NO: 543144 - RNA, 64 nt, Homo Sapiens; identical to SEQ ID NO: 245399

SEQ ID NO: 543145 - RNA, 64 nt, Homo Sapiens; identical to SEQ ID NO: 245400

SEQ ID NO: 543146 - RNA, 64 nt, Homo Sapiens; identical to SEQ ID NO: 245401

SEQ ID NO: 543147 - RNA, 64 nt, Homo Sapiens; identical to SEQ ID NO: 245402

SEQ ID NO: 543148 - RNA, 64 nt, Homo Sapiens; identical to SEQ ID NO: 245403

SEQ ID NO: 543149 - RNA, 64 nt, Homo Sapiens; identical to SEQ ID NO: 245404

SEQ ID NO: 543150 - RNA, 64 nt, Homo Sapiens; identical to SEQ ID NO: 245405

SEQ ID NO: 543151 - RNA, 64 nt, Homo Sapiens; identical to SEQ ID NO: 219840

SEQ ID NO: 543152 - RNA, 64 nt, Homo Sapiens; identical to SEQ ID NO: 219841

SEQ ID NO: 543153 - RNA, 64 nt, Homo Sapiens; identical to SEQ ID NO: 219842

SEQ ID NO: 543154 - RNA, 64 nt, Homo Sapiens; identical to SEQ ID NO: 219843

SEQ ID NO: 543155 - RNA, 64 nt, Homo Sapiens; identical to SEQ ID NO: 219844

SEQ ID NO: 543156 - RNA, 64 nt, Homo Sapiens; identical to SEQ ID NO: 219845

SEQ ID NO: 543157 - RNA, 64 nt, Homo Sapiens; identical to SEQ ID NO: 219846

SEQ ID NO: 543158 - RNA, 64 nt, Homo Sapiens; identical to SEQ ID NO: 219847

SEQ ID NO: 543159 - RNA, 64 nt, Homo Sapiens; identical to SEQ ID NO: 219848

SEQ ID NO: 543160 - RNA, 64 nt, Homo Sapiens; identical to SEQ ID NO: 219849

SEQ ID NO: 543161 - RNA, 64 nt, Homo Sapiens; identical to SEQ ID NO: 219850

SEQ ID NO: 543162 - RNA, 64 nt, Homo Sapiens; identical to SEQ ID NO: 219851

SEQ ID NO: 543163 - RNA, 64 nt, Homo Sapiens; identical to SEQ ID NO: 219852

SEQ ID NO: 543164 - RNA, 64 nt, Homo Sapiens; identical to SEQ ID NO: 219853

SEQ ID NO: 543165 - RNA, 64 nt, Homo Sapiens; identical to SEQ ID NO: 219854

SEQ ID NO: 543166 - RNA, 64 nt, Homo Sapiens; identical to SEQ ID NO: 219855

SEQ ID NO: 543167 - RNA, 64 nt, Homo Sapiens; identical to SEQ ID NO: 219856

SEQ ID NO: 543168 - RNA, 64 nt, Homo Sapiens; identical to SEQ ID NO: 219857

SEQ ID NO: 543169 - RNA, 64 nt, Homo Sapiens; identical to SEQ ID NO: 219858

SEQ ID NO: 543170 - RNA, 64 nt, Homo Sapiens; identical to SEQ ID NO: 219859

SEQ ID NO: 543171 - RNA, 64 nt, Homo Sapiens; identical to SEQ ID NO: 219860

SEQ ID NO: 543172 - RNA, 64 nt, Homo Sapiens; identical to SEQ ID NO: 219861

SEQ ID NO: 543173 - RNA, 64 nt, Homo Sapiens; identical to SEQ ID NO: 219862

SEQ ID NO: 543174 - RNA, 64 nt, Homo Sapiens; identical to SEQ ID NO: 219863

SEQ ID NO: 543175 - RNA, 64 nt, Homo Sapiens; identical to SEQ ID NO: 219864

SEQ ID NO: 543176 - RNA, 64 nt, Homo Sapiens; identical to SEQ ID NO: 219865

SEQ ID NO: 543177 - RNA, 64 nt, Homo Sapiens; identical to SEQ ID NO: 219866

SEQ ID NO: 543178 - RNA, 64 nt, Homo Sapiens; identical to SEQ ID NO: 219867

SEQ ID NO: 543179 - RNA, 64 nt, Homo Sapiens; identical to SEQ ID NO: 219868

SEQ ID NO: 543180 - RNA, 64 nt, Homo Sapiens; identical to SEQ ID NO: 219869

SEQ ID NO: 543181 - RNA, 64 nt, Homo Sapiens; identical to SEQ ID NO: 219870

SEQ ID NO: 543182 - RNA, 64 nt, Homo Sapiens; identical to SEQ ID NO: 219871

SEQ ID NO: 543183 - RNA, 64 nt, Homo Sapiens; identical to SEQ ID NO: 219872

SEQ ID NO: 543184 - RNA, 64 nt, Homo Sapiens; identical to SEQ ID NO: 219873

SEQ ID NO: 543185 - RNA, 64 nt, Homo Sapiens; identical to SEQ ID NO: 219874

SEQ ID NO: 543186 - RNA, 64 nt, Homo Sapiens; identical to SEQ ID NO: 219875

SEQ ID NO: 543187 - RNA, 64 nt, Homo Sapiens; identical to SEQ ID NO: 219876

SEQ ID NO: 543188 - RNA, 64 nt, Homo Sapiens; identical to SEQ ID NO: 219877

SEQ ID NO: 543189 - RNA, 64 nt, Homo Sapiens; identical to SEQ ID NO: 219878

SEQ ID NO: 543190 - RNA, 64 nt, Homo Sapiens; identical to SEQ ID NO: 219879

SEQ ID NO: 543191 - RNA, 64 nt, Homo Sapiens; identical to SEQ ID NO: 219880

SEQ ID NO: 543192 - RNA, 64 nt, Homo Sapiens; identical to SEQ ID NO: 219881

SEQ ID NO: 543193 - RNA, 64 nt, Homo Sapiens; identical to SEQ ID NO: 219882

SEQ ID NO: 543194 - RNA, 64 nt, Homo Sapiens; identical to SEQ ID NO: 219883

SEQ ID NO: 543195 - RNA, 64 nt, Homo Sapiens
aagaaaaaaugaugauagagucccaaaaagaagagaaaaaaaaugcccaaguugcccuuuaaaa

SEQ ID NO: 543196 - RNA, 64 nt, Homo Sapiens
ucuuuucugucacugauccguauuaccacuuuuggaaaaaaauaaauaaauaaauaaauaaaag

SEQ ID NO: 543197 - RNA, 64 nt, Homo Sapiens
ggaggagacaucuggccuuuuuagaaccugagaggaaaaaaagagucuuuuuuuccccucuguc

SEQ ID NO: 543198 - RNA, 64 nt, Homo Sapiens
uccagccugggugacagagcaagacucugccucagaaaaaaaaaaaaauaauaaugcuggguag

SEQ ID NO: 543199 - RNA, 64 nt, Homo Sapiens
agccugggcgacagagcgagagucugucucaaaagaaaaaaaaaagcaccgccuccaaaugcca

SEQ ID NO: 543200 - RNA, 64 nt, Homo Sapiens
gccugagcaacagagugagacccugucucuuaaagaaaaaaaaagucagacugcugggacuggc

SEQ ID NO: 543201 - RNA, 64 nt, Homo Sapiens
uuagugucugagcuucucaaauuagcugcaauaggaaaaaaacaaauugggaaaugaaaaaaaa

SEQ ID NO: 543202 - RNA, 64 nt, Homo Sapiens
uuagcugcaauaggaaaaaaacaaauugggaaaugaaaaaaaaaugggaagauuaaaaagcaca

SEQ ID NO: 543203 - RNA, 64 nt, Homo Sapiens
aaccaaaguuacuguuguuuacagugaguuuggggaaaaaaaauaaaauaaaaauggcuuuccc

SEQ ID NO: 543204 - RNA, 64 nt, Homo Sapiens
guuuuuaaaaauguuuuuaguuaaacguugaggagaaaaaaaaaaaaggcuuuucccccaaagu

SEQ ID NO: 543205 - RNA, 64 nt, Homo Sapiens
guuagcauaguagauaaauuguuaugaaauaccagaaaaaaaaaucuguaucuuuuacugagaa

SEQ ID NO: 543206 - RNA, 64 nt, Homo Sapiens
aaauuguguaaaauuacauuuuuuuuccaggggagaaaaaaacaucaaacaaaaacaucuaaau

SEQ ID NO: 543207 - RNA, 64 nt, Homo Sapiens
aagcugccucaaggaauuuuuuuaacuuaagggagaaaaaaagggaucuggggauggggugggc

SEQ ID NO: 543208 - RNA, 64 nt, Homo Sapiens
uguucagcuacucccacucccggccugucauucagaaaaaaauaaauguucuaauaagcuccau

SEQ ID NO: 543209 - RNA, 64 nt, Homo Sapiens
aaagcuaucuaccuauccugagucuaucuuaaaggaaaaaaagaaaaaaaccuuaucucuugcc

SEQ ID NO: 543210 - RNA, 64 nt, Homo Sapiens
cuaccuauccugagucuaucuuaaaggaaaaaaagaaaaaaaccuuaucucuugcccuuauuuu

SEQ ID NO: 543211 - RNA, 64 nt, Homo Sapiens
auuucacugguccaucuauauuuaaaacgugcaagaaaaaaauaaaauacucugcucuagcaag

SEQ ID NO: 543212 - RNA, 64 nt, Homo Sapiens
ugcccauuggccugaaaauacucauuguaagccugaaaaaaaaaaucuuucccacuguuuuuuc

SEQ ID NO: 543213 - RNA, 64 nt, Homo Sapiens
guuuuuguccuaauguugcuacucccauggcaaagaaaaaaaaaagaaugaaaaaaagaaaaaa

SEQ ID NO: 543214 - RNA, 64 nt, Homo Sapiens
uugcuacucccauggcaaagaaaaaaaaaagaaugaaaaaaagaaaaaaauuuggaaaaaaaaa

SEQ ID NO: 543215 - RNA, 64 nt, Homo Sapiens
cccauggcaaagaaaaaaaaaagaaugaaaaaaagaaaaaaauuuggaaaaaaaaaucaggcuc

SEQ ID NO: 543216 - RNA, 64 nt, Homo Sapiens
aaaaaaaaaagaaugaaaaaaagaaaaaaauuuggaaaaaaaaaucaggcucauagcagcuacu

SEQ ID NO: 543217 - RNA, 64 nt, Homo Sapiens
gaaaauucccccuacuucuaauuugcugaaugaagaaaaaaaaaaaucuuuuauuugugauauu

SEQ ID NO: 543218 - RNA, 64 nt, Homo Sapiens
aaaaauuguucaucaacuucuuuauguuuuauuagaaaaaaacuguuuuaaugugcuuuaucau

SEQ ID NO: 543219 - RNA, 64 nt, Homo Sapiens
uuuaucauaaauaaauauccugacaaaugguauugaaaaaaaucugagaucaugugaacauaua

SEQ ID NO: 543220 - RNA, 64 nt, Homo Sapiens
uagaucuuauauugguuugcacaaguucccuggagaaaaaaauugcucuguguauaucucuugg

SEQ ID NO: 543221 - RNA, 64 nt, Homo Sapiens
ugcauaaugcuuuggaaaaaugggucuuuuauaggaaaaaaacugggauaacugauuucuaugg

SEQ ID NO: 543222 - RNA, 64 nt, Homo Sapiens
ugaaggaucuaacacugcucucucuuccaaaggggaaaaaaagauucauuuguuuugagcaaua

SEQ ID NO: 543223 - RNA, 64 nt, Homo Sapiens
uuacuuuaugauguuuacauacacguuucacuuugaaaaaaaaugcaaaucgacuuuuuaacaa

SEQ ID NO: 543224 - RNA, 64 nt, Homo Sapiens
ggcuuuauuaucuugucagucacuaccuccuaaagaaaaaaaaaaaggcuagaagaaaaaacau

SEQ ID NO: 543225 - RNA, 64 nt, Homo Sapiens
uaaucuuugacauuuuggaaaaauaagaauugaggaaaaaaaguguaucuuucaaguagaugca

SEQ ID NO: 543226 - RNA, 64 nt, Homo Sapiens
acuaacuccaguuuuacuauuauuauuuugguuggaaaaaaaauucacucuuuacgugcuaauu

SEQ ID NO: 543227 - RNA, 64 nt, Homo Sapiens
ccucucguaucucaccccaaaccccaaacugggggaaaaaaaguuaacucuuugugaauggaac

SEQ ID NO: 543228 - RNA, 64 nt, Homo Sapiens
cuguuuaucucacuugcuuugaaagccaaugggggaaaaaaauccaugaaaaaaaaaagauuga

SEQ ID NO: 543229 - RNA, 64 nt, Homo Sapiens
uugcuuugaaagccaaugggggaaaaaaauccaugaaaaaaaaaagauugauaaaguagaugau

SEQ ID NO: 543230 - RNA, 64 nt, Homo Sapiens
gacccacugcuaacuguagcaacaaaauuuaaaagaaaaaaaacauacuuuaucuggcuauuau

SEQ ID NO: 543231 - RNA, 64 nt, Homo Sapiens
aguuuuuuuuuugccuuagcaaagggugguguuugaaaaaaaaaauguguagccccuuuuuaac

SEQ ID NO: 543232 - RNA, 64 nt, Homo Sapiens
aaugcaugauuucucugugaccaaaauuaagcaugaaaaaaauguuuccauugccauauuugau

SEQ ID NO: 543233 - RNA, 64 nt, Homo Sapiens
uuuuuuuuucuaucgaaauuacuaaucaguuggggaaaaaaauacuauagcagacagcacuaau

SEQ ID NO: 543234 - RNA, 64 nt, Homo Sapiens
aacuagucccagauuugaaacauuucaguuaaaagaaaaaaagaaaacccugggcugaaguugg

SEQ ID NO: 543235 - RNA, 64 nt, Homo Sapiens
caauuguugcugugagugacgcuaccaaggcugggaaaaaaaugaggcuagacaacugaaaggg

SEQ ID NO: 543236 - RNA, 64 nt, Homo Sapiens
gcuugguuuuauuugucaucuuaauguuuaaaaagaaaaaaauaauguucuuuauacagccuag

SEQ ID NO: 543237 - RNA, 64 nt, Homo Sapiens
uccaacucugcuuuuggucuauuauuuagcaugagaaaaaaaaaacauugaaagguaaaaucug

SEQ ID NO: 543238 - RNA, 64 nt, Homo Sapiens
aaaagguuuuuagcucauuucuuuaaaaaaaaaagaaaaaaagggguuuaacaaaaaaaaaaag

SEQ ID NO: 543239 - RNA, 64 nt, Homo Sapiens
aagguguaaauuuuuuuuucacaguaccaaaaaagaaaaaaaaauuuuauuauacaaaguuugu

SEQ ID NO: 543240 - RNA, 64 nt, Homo Sapiens
aaaguaaaacaaagacaaaacaccaucccaugaggaaaaaaaaacaucuacgccauauacccau

SEQ ID NO: 543241 - RNA, 64 nt, Homo Sapiens
gggagcuauuucacagagcuaaguagggucccaagaaaaaaaaccaaugggagcccacggaacu

SEQ ID NO: 543242 - RNA, 64 nt, Homo Sapiens
caaaagcugaacagaggcggcaaagaaccuccuggaaaaaaaaauagagcgaccuuuucaauua

SEQ ID NO: 543243 - RNA, 64 nt, Homo Sapiens
aaaacuuuauaccaaugauucuuuaaacuaucaggaaaaaaaccuguuuuuguacuuuacuaau

SEQ ID NO: 543244 - RNA, 64 nt, Homo Sapiens
auuaaaaaaaaaaugcaagcuggaauacggugaggaaaaaaaaacuuccccagccacagguaug

SEQ ID NO: 543245 - RNA, 64 nt, Homo Sapiens
ccaaagacugauauuuuguguuuuaaauaguugggaaaaaaauuucagcugccaguuuuuacuu

SEQ ID NO: 543246 - RNA, 64 nt, Homo Sapiens
acauuuuguuaaccuauggauuuuguuagccuaugaaaaaaaaauggguacuuucuacucucau

SEQ ID NO: 543247 - RNA, 64 nt, Homo Sapiens
aguaagaacuggcagaaguuuguauaaaaaaccugaaaaaaauguguauguguuguuuaagaaa

SEQ ID NO: 543248 - RNA, 64 nt, Homo Sapiens
ugcagugcuucuaggauauaaagucucuacaauagaaaaaaaagaugaauuuuaucuacuccag

SEQ ID NO: 543249 - RNA, 64 nt, Homo Sapiens
acaucugcuauccaaagauuuuuuagagacaagggaaaaaaacccucuuaaaacaaggagugua

SEQ ID NO: 543250 - RNA, 64 nt, Homo Sapiens
auucagaacuacuuuccucuuccuaaaaaaaaaagaaaaaaagauuuagcaaauuaaguuauuu

SEQ ID NO: 543251 - RNA, 64 nt, Homo Sapiens
gaugggguaagaaaacuacccguuaauuauugaggaaaaaaaaauucaaacaaugguuucucug

SEQ ID NO: 543252 - RNA, 64 nt, Homo Sapiens
aaccgaagccaguauuuuaaaggaaauuugaaaggaaaaaaagacaaauauguaaagcaauugu

SEQ ID NO: 543253 - RNA, 64 nt, Homo Sapiens
cccacugaacucucucuuccuaaaaaugaaaauggaaaaaaaguguggucuuaacacuuuuaua

SEQ ID NO: 543254 - RNA, 64 nt, Homo Sapiens
uauuugugggcaaauguuaaaaaauuaagaaaaagaaaaaaaauguguuugguauuuuucugac

SEQ ID NO: 543255 - RNA, 64 nt, Homo Sapiens
uaucuuugggaaaacaauuaugauggauguguaugaaaaaaaugcuuuuuuugguuacagugua

SEQ ID NO: 543256 - RNA, 64 nt, Homo Sapiens
aaacacagaacuguuucaaguucuaaacgcuaaggaaaaaaaacuugcaggacaaugauggcua

SEQ ID NO: 543257 - RNA, 64 nt, Homo Sapiens
uaagauuagcccagguaguuguucucacucuugagaaaaaaaccaauggaaauaggagaauaug

SEQ ID NO: 543258 - RNA, 64 nt, Homo Sapiens
caguguuacuaguaauuuccacuuagaaaagagggaaaaaaaucacuucugaaaguuuuuggaa

SEQ ID NO: 543259 - RNA, 64 nt, Homo Sapiens
uuucagagaaguucuggcugacuuagcauguguugaaaaaaaagacucuccuacacuuccauua

SEQ ID NO: 543260 - RNA, 64 nt, Homo Sapiens
acuaaaaauauuauaacuuauccagaguuuagaggaaaaaaaugauaagaaugaauaauaauua

SEQ ID NO: 543261 - RNA, 64 nt, Homo Sapiens
cccaaccaaucugcaauucacuuacuacuacaaagaaaaaaaaauuuuuuucuaauuuacugau

SEQ ID NO: 543262 - RNA, 64 nt, Homo Sapiens
uuuuuaaaauuucagccaaacucuaacgucuagugaaaaaaauauuauuuaaaaucuaagauug

SEQ ID NO: 543263 - RNA, 64 nt, Homo Sapiens
cgacacuguggauugacuuugucugcaacuucaagaaaaaaaauuugaggguuugccuucuaaa

SEQ ID NO: 543264 - RNA, 64 nt, Homo Sapiens
gggcuugucauuuuuucccuaaaauauuucccuugaaaaaaacuuacugaccuuucacagagaa

SEQ ID NO: 543265 - RNA, 64 nt, Homo Sapiens
uucuuuugggaagagggagauuauauaaauaauugaaaaaaauucugauuacagauaauaguau

SEQ ID NO: 543266 - RNA, 64 nt, Homo Sapiens
ggcccuuuuaaaaauaguauagaagauuaaaagagaaaaaaaaacugcuauuuagcuccucuua

SEQ ID NO: 543267 - RNA, 64 nt, Homo Sapiens
agcagacgaaagagaaaaacaaaaucuguuagaagaaaaaaagcuccuucuuuuuaccuuuuua

SEQ ID NO: 543268 - RNA, 64 nt, Homo Sapiens
aaaaaagaggccaggcauggggcccugaaaagaggaaaaaaaaaucacuguuacaucaccaaga

SEQ ID NO: 543269 - RNA, 64 nt, Homo Sapiens
gcaguaguaaucuggugaauuauuuucuuagucugaaaaaaacaaaaaaauccaauuuugucag

SEQ ID NO: 543270 - RNA, 64 nt, Homo Sapiens
caauuuugucaguauuuucuugcaauugaaaggagaaaaaaaucuuuaaauaaucagaauaucc

SEQ ID NO: 543271 - RNA, 64 nt, Homo Sapiens
agaauaaguauauauuuuugaacuguugcaaauagaaaaaaaaugguguuuguuugccuuuaua

SEQ ID NO: 543272 - RNA, 64 nt, Homo Sapiens
cgaaacuuucuuuuguugcauuugcaaaaacaaggaaaaaaaucuccugcaauuccagcugcca

SEQ ID NO: 543273 - RNA, 64 nt, Homo Sapiens
uauuuaugaauccugucgguauuccuugguaucugaaaaaaauaccaaauaguaccauacauga

SEQ ID NO: 543274 - RNA, 64 nt, Homo Sapiens
guuuaacuggaguugucaaguaugagucccucaggaaaaaaaaaaaauucuguuuuaaaaagca

SEQ ID NO: 543275 - RNA, 64 nt, Homo Sapiens
cugcaccguuacgcugugauggcaacuggggauagaaaaaaaauggggaaagacaggaauccua

SEQ ID NO: 543276 - RNA, 64 nt, Homo Sapiens
cccaggcaacaagagugaaacccugucucaaaaagaaaaaaaaaguugaccuugagaauuuaua

SEQ ID NO: 543277 - RNA, 64 nt, Homo Sapiens
ccugggcaacauggcuaaacucugucucuauuaagaaaaaaaauguuaacauuaugauuuaaaa

SEQ ID NO: 543278 - RNA, 64 nt, Homo Sapiens
cagaacugugaaaaauaaauuuguuauuuaaaaagaaaaaaaaaaaaacaaaaaccugaguuuc

SEQ ID NO: 543279 - RNA, 64 nt, Homo Sapiens
guucuaaaaaaaaaaaaaaaaaaaaaaaaaaaaggaaaaaaaaaaagaaaaagaaaacgugugc

SEQ ID NO: 543280 - RNA, 64 nt, Homo Sapiens
aaaguuuuaccacagucugcacuugcagaagaaagaaaaaaauucaaaccacauguuuauuuuu

SEQ ID NO: 543281 - RNA, 64 nt, Homo Sapiens
gccuccacaacaccuccugauaguaguaaaauuagaaaaaaacaaacucuacuaauuuuuagau

SEQ ID NO: 543282 - RNA, 64 nt, Homo Sapiens
aauugucccaacaaccacacuuaaauccaguggggaaaaaaagguuaacaguaaaaauuucuuc

SEQ ID NO: 543283 - RNA, 64 nt, Homo Sapiens
augucaguguuaaaaugcuucucccugaaaaagagaaaaaaaaaaggaaaaaaagaaaagaaaa

SEQ ID NO: 543284 - RNA, 64 nt, Homo Sapiens
aaaugcuucucccugaaaaagagaaaaaaaaaaggaaaaaaagaaaagaaaagugaaaagaaaa

SEQ ID NO: 543285 - RNA, 64 nt, Homo Sapiens
ugcccagcacacauuaauguuagcuucuuucugagaaaaaaauaccucuuccaggcccugaaac

SEQ ID NO: 543286 - RNA, 64 nt, Homo Sapiens
cauuugcugugaagauugaaaaugaacaaaguuagaaaaaaaaacagcaaaaucagugauuuag

SEQ ID NO: 543287 - RNA, 64 nt, Homo Sapiens
uuuaagugaaaaucugaauuguucuaaauggaaagaaaaaaaguugcaaucugugcccuucauu

SEQ ID NO: 543288 - RNA, 64 nt, Homo Sapiens
auuuaguugcaugauuagucagaaacugccauuugaaaaaaaguuauuuuuauagcagcaaaaa

SEQ ID NO: 543289 - RNA, 64 nt, Homo Sapiens
uguguugauuggagaauuuuucuguauguaauuagaaaaaaauguaaaacaugauuuaugugaa

SEQ ID NO: 543290 - RNA, 64 nt, Homo Sapiens
uaaucacuacuauuucugcucgguuuccuaaaaggaaaaaaaaggcgcaguggugaugacccuc

SEQ ID NO: 543291 - RNA, 64 nt, Homo Sapiens
cucaucagcgucaaaauaguucaaauaauuuuacgaaaaaaaacucagcuucuguuguuuauca

SEQ ID NO: 543292 - RNA, 64 nt, Homo Sapiens
ccagaaucuacaaugaacucaaacaaauuuacaagaaaaaaacaaacaaccccaucaaaaagug

SEQ ID NO: 543293 - RNA, 64 nt, Homo Sapiens
uaaagcugaucauguuuugcuacaguuugcaggugaaaaaaaauaaauauuauaaaauaugcua

SEQ ID NO: 543294 - RNA, 64 nt, Homo Sapiens
cuggggauagagugagaucccaucucuaaaaaaugaaaaaaagaagagagguagcuuuaaagug

SEQ ID NO: 543295 - RNA, 64 nt, Homo Sapiens
caugaauucuuuuucuggaacuuagcaaugagaagaaaaaaaaagcccaacuuuucuaagugag

SEQ ID NO: 543296 - RNA, 64 nt, Homo Sapiens
uagagacccuuuuugcaaacuaaugugccaaaaagaaaaaaagccagaaguauuuuaaagggcu

SEQ ID NO: 543297 - RNA, 64 nt, Homo Sapiens
aaaaaggagcugugccccauuuuuuuaaaaaaaagaaaaaaaaacacugcaagcucugaaucag

SEQ ID NO: 543298 - RNA, 64 nt, Homo Sapiens
aaagguacuuagaggucgcaucuugucucuuaaagaaaaaaaaaaccugggcaacauaguaaga

SEQ ID NO: 543299 - RNA, 64 nt, Homo Sapiens
aauugaaaaacaagcagauuucagcaucugucaugaaaaaaaucggaaaaaaaugggucagaac

SEQ ID NO: 543300 - RNA, 64 nt, Homo Sapiens
ggucagaacucagcaucuguugauacugucaggggaaaaaaaugcauguagucgggcagccuau

SEQ ID NO: 543301 - RNA, 64 nt, Homo Sapiens
aaaaaaccaauguuuugcagaaagaaaaaaaaaggaaaaaaaaaucauaugcaguaaaagaaag

SEQ ID NO: 543302 - RNA, 64 nt, Homo Sapiens
ggaaaaaaaaaaaaaaaccaguaaaagaaagaaagaaaaaaaaagcaucuuaccuucauaugca

SEQ ID NO: 543303 - RNA, 64 nt, Homo Sapiens
agacaggcugccacaguauacuuuuuugguaguggaaaaaaaaacuuaaaagguaucaauguac

SEQ ID NO: 543304 - RNA, 64 nt, Homo Sapiens
ugaacacaaucucauugaggguugcaagaaugcugaaaaaaaauggucuauacuuaagggaaaa

SEQ ID NO: 543305 - RNA, 64 nt, Homo Sapiens
cucuaugagcuaaaugucuggaauagauagcacugaaaaaaaauggauuaacccucuauagaca

SEQ ID NO: 543306 - RNA, 64 nt, Homo Sapiens
ggcccacgaggacugugaugcaagaagaggaagagaaaaaaaggaaggaaaaaaaggagacaga

SEQ ID NO: 543307 - RNA, 64 nt, Homo Sapiens
agacagacaagaagaggaaguccucccagagaaggaaaaaaaggccuggccuggauugacaaca

SEQ ID NO: 543308 - RNA, 64 nt, Homo Sapiens
aaaagucucugaaauuugauguuucuugcuuuuggaaaaaaaaacuagcuugccuggagaugau

SEQ ID NO: 543309 - RNA, 64 nt, Homo Sapiens
aaugccuguaccuacaauguuuucauuguuuaaggaaaaaaaaaacauguugagaucauuguug

SEQ ID NO: 543310 - RNA, 64 nt, Homo Sapiens
uauuuauaauugccuugucauauauauuacuaaggaaaaaaaguaauguacuucaaaaagcaaa

SEQ ID NO: 543311 - RNA, 64 nt, Homo Sapiens
guuuugauuauaugcuucuucaccuuagcuauaagaaaaaaaggucauauauuuaugcauuaca

SEQ ID NO: 543312 - RNA, 64 nt, Homo Sapiens
uacaaaggaagaaaagaaagagaguaacaauaaagaaaaaaaaaagaaagcaguagugagagug

SEQ ID NO: 543313 - RNA, 64 nt, Homo Sapiens
aaaaaagauagaaaaaagaagaucgacuggagaagaaaaaaaaguucccaauuacaggaaauua

SEQ ID NO: 543314 - RNA, 64 nt, Homo Sapiens
uuguauauauuuuaaaaaauugagaagaauagaagaaaaaaaguguaucccuuucaaaugccuu

SEQ ID NO: 543315 - RNA, 64 nt, Homo Sapiens
uggaaaagaaaaacucaguuuauguugaggcauggaaaaaaaauauuaacugauuaauuucccu

SEQ ID NO: 543316 - RNA, 64 nt, Homo Sapiens
aauuguguuuuauugcgguauuuuuuugugaaaugaaaaaaacacacaauuucccgccuuuuuu

SEQ ID NO: 543317 - RNA, 64 nt, Homo Sapiens
aaagugaagugaaaacaaucuaaacgacacugccgaaaaaaaaagagguauguauuuaacaaaa

SEQ ID NO: 543318 - RNA, 64 nt, Homo Sapiens
agauucugaaccauuuauugcagggaaaaaugaggaaaaaaaauuauaagcuauaacaucaaau

SEQ ID NO: 543319 - RNA, 64 nt, Homo Sapiens
uccuaggagaaagcgacguguucauaccaugggggaaaaaaaagcuguggcuuuuagggcuugg

SEQ ID NO: 543320 - RNA, 64 nt, Homo Sapiens
aacaauaucugcagcguugcgaaauuaaagaaaugaaaaaaaaauuacuucgucuucgcccucu

SEQ ID NO: 543321 - RNA, 64 nt, Homo Sapiens
uuauuugccuuuuaaauucucuuuuacuuuuuaugaaaaaaaaaaaaaaaauguuuuaugguag

SEQ ID NO: 543322 - RNA, 64 nt, Homo Sapiens
uguuuuaugguagcuuuuacuaaucagugugacagaaaaaaaaagcggcuuuucagaagaaauu

SEQ ID NO: 543323 - RNA, 64 nt, Homo Sapiens
auucaauaagagauuaggagaaguagcaauuauggaaaaaaaauacuuuggcaacccuuuugaa

SEQ ID NO: 543324 - RNA, 64 nt, Homo Sapiens
aauucacacugccagcguuauuuuuuuuaaagaagaaaaaaaaaaccaugacgcaaagagagau

SEQ ID NO: 543325 - RNA, 64 nt, Homo Sapiens
gauuccauuuguguaaaaacuagggugguaaccggaaaaaaauauugucaguauuucaagcugu

SEQ ID NO: 543326 - RNA, 64 nt, Homo Sapiens
gcaaaaaaaaaaucagcaaaauaauaaaaugaacgaaaaaaaaugacacccagggaguucccaa

SEQ ID NO: 543327 - RNA, 64 nt, Homo Sapiens
ccccuuugacugaucagugugauaaggacuuuaggaaaaaaagcauguauguuuuuuacuguuu

SEQ ID NO: 543328 - RNA, 64 nt, Homo Sapiens
ucguuaaucuugcugcuuaugugccaauuuaguggaaaaaaacaacccuugcugaaaaauuccc

SEQ ID NO: 543329 - RNA, 64 nt, Homo Sapiens
acuggguuugcuuuucuuaaaacauaccaaaaaagaaaaaaauagaaaaaaaaaaaaaaaaagc

SEQ ID NO: 543330 - RNA, 64 nt, Homo Sapiens
cuuuucuuaaaacauaccaaaaaagaaaaaaauagaaaaaaaaaaaaaaaaagcuugaucucua

SEQ ID NO: 543331 - RNA, 64 nt, Homo Sapiens
aagugguaacuuuaaaggauucuguaugccaagugaaaaaaaaagaugucugaccuccuuacau

SEQ ID NO: 543332 - RNA, 64 nt, Homo Sapiens
aaauaaaauaaaauauauugguauguaacuacaggaaaaaaauaaaaaauauauaguggacagu

SEQ ID NO: 543333 - RNA, 64 nt, Homo Sapiens
ucugaagauacaugucuuucuccagggacauguggaaaaaaaaaagauguuauacaaccaucaa

SEQ ID NO: 543334 - RNA, 64 nt, Homo Sapiens
aaaaggguaucccaaaaauaaaacuauccuuuuggaaaaaaaaagauuuaaaauaauuccuggu

SEQ ID NO: 543335 - RNA, 64 nt, Homo Sapiens
uacuugccacaaaaucaauaaaagauguuuuugagaaaaaaaggaagaaaccaacucauucaga

SEQ ID NO: 543336 - RNA, 64 nt, Homo Sapiens
aagacacucuggccaccauaaaaaacgcagaaaagaaaaaaagguuaagcauaaaaagaaaggg

SEQ ID NO: 543337 - RNA, 64 nt, Homo Sapiens
agagacugguagcucaucauccuaccauaaaagagaaaaaaauucggaaagugaucagagcacu

SEQ ID NO: 543338 - RNA, 64 nt, Homo Sapiens
gaaggcgagcuaagaggagacuuagauccagugggaaaaaaaauagcguuucacauaaaaagca

SEQ ID NO: 543339 - RNA, 64 nt, Homo Sapiens
gcagggccaaauggaaagaacacauaauaaacaagaaaaaaacagaggugaagaaaaauccaag

SEQ ID NO: 543340 - RNA, 64 nt, Homo Sapiens
cccacucagggcuggggccaagaggaaaaacagggaaaaaaagaaaaaaaaaagaaaaaggaaa

SEQ ID NO: 543341 - RNA, 64 nt, Homo Sapiens
gggcuggggccaagaggaaaaacagggaaaaaaagaaaaaaaaaagaaaaaggaaaaggaagcg

SEQ ID NO: 543342 - RNA, 64 nt, Homo Sapiens
auucucguagcuuuuuaaaaaaaugaaaguaaaggaaaaaaaaaaaacugcaaaucuagaaaac

SEQ ID NO: 543343 - RNA, 64 nt, Homo Sapiens
uguucaccugguuugaaauaauaaaauguagaaagaaaaaaaauaccgagaacugauggguauu

SEQ ID NO: 543344 - RNA, 64 nt, Homo Sapiens
cggcuuuuacagcaacaauacgauuaucuuauaggaaaaaaaaaaucauuguaaaguaucaaga

SEQ ID NO: 543345 - RNA, 64 nt, Homo Sapiens
ucuauuuaccuugcacauuuuuuguuguuacagugaaaaaaaugguccaagaaaauguuugcca

SEQ ID NO: 543346 - RNA, 64 nt, Homo Sapiens
aaguuuaauugaaagaauguaaagcaaccaaaaagaaaaaaaaaaagaaagaaagaggaaaaga

SEQ ID NO: 543347 - RNA, 64 nt, Homo Sapiens
gcaaacuauuuaaagaaauauguauucuguaaaagaaaaaaaaaaugcggccuuuucaugagga

SEQ ID NO: 543348 - RNA, 64 nt, Homo Sapiens
acacaauauaugaaauaguacccucuaaaaaagagaaaaaaaaaaucaggcggucaaacuuaga

SEQ ID NO: 543349 - RNA, 64 nt, Homo Sapiens
uuuguaucuacugauaacagaaucugggucacaugaaaaaaaaucauuuuauccgucuuuuaag

SEQ ID NO: 543350 - RNA, 64 nt, Homo Sapiens
aaaucaugaguaaaauuggaaaacacuuuuaacugaaaaaaacaaaagcacaacaaaccaaaac

SEQ ID NO: 543351 - RNA, 64 nt, Homo Sapiens
aaauaaaugaaauagagaauagaaaagcaauacagaaaaaaaauuaugaaaucaaaagcugguu

SEQ ID NO: 543352 - RNA, 64 nt, Homo Sapiens
uucugcaaaaaggaaaaagaaaccacaaauuggggaaaaaaaaagaagaaaaaccuguuuccgu

SEQ ID NO: 543353 - RNA, 64 nt, Homo Sapiens
ggaagagaggagagggagaaaaauaaaaugaaaggaaaaaaaaaaguuugcaaauucagacagg

SEQ ID NO: 543354 - RNA, 64 nt, Homo Sapiens
agcuugacacccaccaagcaaaaguuucagccuggaaaaaaaaugggggggaaggguggaugaa

SEQ ID NO: 543355 - RNA, 64 nt, Homo Sapiens
guggggugccagaaagugucugcugauauuuguggaaaaaaaaucuauuuuguuuaccuacugu

SEQ ID NO: 543356 - RNA, 64 nt, Homo Sapiens
gagaaugguaguauuuuuuuuuuuuaucagcugugaaaaaaauguuacagaucugcacauuuuc

SEQ ID NO: 543357 - RNA, 64 nt, Homo Sapiens
cuauaugaaucaauuauuacaucuguuuuacuaugaaaaaaaaauuaauacuacuagcuuccag

SEQ ID NO: 543358 - RNA, 64 nt, Homo Sapiens
caguugaauggaaaauuacucaguguauagaaaggaaaaaaaccagaaauuuaaaauagauaca

SEQ ID NO: 543359 - RNA, 64 nt, Homo Sapiens
uugauuuauauacucuguuuuacagauuuagcuagaaaaaaaaugucaguguuuuggugcaccu

SEQ ID NO: 543360 - RNA, 64 nt, Homo Sapiens
aaagguuaaacuggauuuuuuuuuuuaaaaaaaagaaaaaaaaagaagaaaaguauaccagaua

SEQ ID NO: 543361 - RNA, 64 nt, Homo Sapiens
ugugaauauacauaucaagaacuuuggggguuuugaaaaaaaugaauuguauauauacaaauca

SEQ ID NO: 543362 - RNA, 64 nt, Homo Sapiens
guauaguggugaauacucgcugauaugaaucccagaaaaaaauuuccuguuuuuaauguucuuu

SEQ ID NO: 543363 - RNA, 64 nt, Homo Sapiens
uauugcuguuuugucuuucuuuuuucuaaaaaaagaaaaaaaagaaaaaaaggaaaagaagaac

SEQ ID NO: 543364 - RNA, 64 nt, Homo Sapiens
uuugucuuucuuuuuucuaaaaaaagaaaaaaaagaaaaaaaggaaaagaagaacaaagaaaca

SEQ ID NO: 543365 - RNA, 64 nt, Homo Sapiens
auggagaaaacccgguacgcucaaaaagaaaaaggaaaaaaaaaaaucccaucacccacagcaa

SEQ ID NO: 543366 - RNA, 64 nt, Homo Sapiens
uaccaauaauauuuagagcuagucuccaagcgacgaaaaaaauguuuuaauauuugcaagcaac

SEQ ID NO: 543367 - RNA, 64 nt, Homo Sapiens
uuacgcuucuuaaccauuuucucaaaaaaaaaaagaaaaaaaaucaacaagagugaaacugcau

SEQ ID NO: 543368 - RNA, 64 nt, Homo Sapiens
gcaguggccaguccaccgggaccuggagagccucgaaaaaaacauccuggcuggccucuaaauc

SEQ ID NO: 543369 - RNA, 64 nt, Homo Sapiens
gguuuggcaggccaucuuuuuuuuccuggaagaagaaaaaaaaauaccauucucuguggccugu

SEQ ID NO: 543370 - RNA, 64 nt, Homo Sapiens
guugaucuuuuuuuuugucguuuuuuguuguucggaaaaaaaaauccuauuguaaucauucauu

SEQ ID NO: 543371 - RNA, 64 nt, Homo Sapiens
aacagaaaaaucuaccgguacauaguggaaaaccgaaaaaaaaauuacauaucuagagaaacaa

SEQ ID NO: 543372 - RNA, 64 nt, Homo Sapiens
uacaugucgauuagguacuuacauauuuaaggcagaaaaaaaguuaagggcucuguccuguuau

SEQ ID NO: 543373 - RNA, 64 nt, Homo Sapiens
uacacaauuucaggcaagcuuauacaaucaagaggaaaaaaaauuuuuccaguucaaaaugccu

SEQ ID NO: 543374 - RNA, 64 nt, Homo Sapiens
aguccccacauuuuauuuuucugagcauugcagagaaaaaaaaauuaugucucaaguaaaaugg

SEQ ID NO: 543375 - RNA, 64 nt, Homo Sapiens
uguuguuuaaaaaauguuuucauacauuugaaaagaaaaaaaaacuggcuaucuuaaacaaguu

SEQ ID NO: 543376 - RNA, 64 nt, Homo Sapiens
uacuguauguaacggaauugaaaaaauagcuuuggaaaaaaaacuuuauauuaacgauacuaaa

SEQ ID NO: 543377 - RNA, 64 nt, Homo Sapiens
uucucaggcuuuacagcaagcagaagaaccaacugaaaaaaaaauugcagguaucacagccuug

SEQ ID NO: 543378 - RNA, 64 nt, Homo Sapiens
aaaaagcucauauuaauuagacauaggcagcacugaaaaaaaaacauucuaccagcacaaggaa

SEQ ID NO: 543379 - RNA, 64 nt, Homo Sapiens
agagagacaaacucuaggaagagaaugaaugacagaaaaaaaaaacgugacguccugccagaaa

SEQ ID NO: 543380 - RNA, 64 nt, Homo Sapiens
aaaacacgucaaaaguuagcaagauuggaaaaaggaaaaaaaaagcgggccaaccccgagaaug

SEQ ID NO: 543381 - RNA, 64 nt, Homo Sapiens
uacauuuauucauagauagauggugcuauuugaagaaaaaaaugaauaucauugauuuuauaau

SEQ ID NO: 543382 - RNA, 64 nt, Homo Sapiens
gguuuaaguuuguuguggccuuccuggacuuaaagaaaaaaagagaaccaaaugguucuuacuu

SEQ ID NO: 543383 - RNA, 64 nt, Homo Sapiens
auguugagaagcguuuuuaauuuuuugucuuauugaaaaaaaaaaaccauuguaacuauuaacc

SEQ ID NO: 543384 - RNA, 64 nt, Homo Sapiens
aagcauuuguacuaagcuccaaauuucucuuuuugaaaaaaagauugaagaccagcuuucucau

SEQ ID NO: 543385 - RNA, 64 nt, Homo Sapiens
auauguauacacaaauauauagacagcucuucuugaaaaaaaaagaaaacugagcauacuagca

SEQ ID NO: 543386 - RNA, 64 nt, Homo Sapiens
augcugauacagcuggcuauuuuuaugauguacggaaaaaaaccagcauagagaaacaaaaauc

SEQ ID NO: 543387 - RNA, 64 nt, Homo Sapiens
uugcagacaccugcccuaaauuuggcacuuuuuggaaaaaaaguaagagccaaaauaaauauac

SEQ ID NO: 543388 - RNA, 64 nt, Homo Sapiens
uuuugaugaauacaauguauuaaugagaaacucagaaaaaaaugaaaacacagcuuaucuaauc

SEQ ID NO: 543389 - RNA, 64 nt, Homo Sapiens
aauucaugcauagcuucuguggaacuguaaaagagaaaaaaagauuuuuuuuuuaaguaagaag

SEQ ID NO: 543390 - RNA, 64 nt, Homo Sapiens
cucaaaaugaguuauaguuccugugaaaugcacugaaaaaaaucgauucccuuguucauuuuug

SEQ ID NO: 543391 - RNA, 64 nt, Homo Sapiens
ucaggaaguuguauucagguugaaaagguaucaggaaaaaaagaaugcuaaagaaacaacgaaa

SEQ ID NO: 543392 - RNA, 64 nt, Homo Sapiens
aacuuaauauauuuuggauuaaaauauugugaaagaaaaaaaacaaaagaggaaaaaaaggcaa

SEQ ID NO: 543393 - RNA, 64 nt, Homo Sapiens
caaaaaauauugugaaagaaaaaagaaaaaagaggaaaaaaaggugugcauuguuuacaaagca

SEQ ID NO: 543394 - RNA, 64 nt, Homo Sapiens
aaaaacaaauguccccggauucucccuaucugaagaaaaaaauccaauuggggaaguuucaccc

SEQ ID NO: 543395 - RNA, 64 nt, Homo Sapiens
ucaccgggcaaccggggaagaaaaaaaaaaaaaggaaaaaaaauaacuuuuuaagagaguauuu

SEQ ID NO: 543396 - RNA, 64 nt, Homo Sapiens
acgcccaacucuugaaguccgauaugugcugaaagaaaaaaaaauuuugugccccuuaaaugua

SEQ ID NO: 543397 - RNA, 64 nt, Homo Sapiens
uuggaacaaaugcucucuuaucaaauuuaaccaagaaaaaaagauuccguagauaauguggaaa

SEQ ID NO: 543398 - RNA, 64 nt, Homo Sapiens
gaaaaaacagaaauauauccaaaaaaaaaaaaaagaaaaaaaaacaguguucugugacaaaaaa

SEQ ID NO: 543399 - RNA, 64 nt, Homo Sapiens
aagauaucaacugccagccuauaaaaaugaguuggaaaaaaaauagcauuuuuuuauuuuuuua

SEQ ID NO: 543400 - RNA, 64 nt, Homo Sapiens
guuuuauuaugacacuagauacaguaaauuuuuagaaaaaaauaccauuuacaguauuauugug

SEQ ID NO: 543401 - RNA, 64 nt, Homo Sapiens
cucaaaaaaaaaccccacgaaauuuaaagauggggaaaaaaagaugguauaaaaauggcucugg

SEQ ID NO: 543402 - RNA, 64 nt, Homo Sapiens
caauauggccuaaacugccauaguuuuagaaugugaaaaaaaugcauguuuacuuaccuguaua

SEQ ID NO: 543403 - RNA, 64 nt, Homo Sapiens
auucauauugcugcccaaaaguaugacuguggaggaaaaaaaaauacuuuaaaaauccacacuu

SEQ ID NO: 543404 - RNA, 64 nt, Homo Sapiens
aauuuuugcuccaauauccauucuguagacuuuugaaaaaaaaguuuuuaauuugaugcccaau

SEQ ID NO: 543405 - RNA, 64 nt, Homo Sapiens
uauuauuaauuuuuauuuauuuuucuugggaauugaaaaaaauugaaauaaauaaaaaugcauu

SEQ ID NO: 543406 - RNA, 64 nt, Homo Sapiens
uacaaccugccaacccacacacuggaguaauucugaaaaaaauuauuccuaaacucucuaagug

SEQ ID NO: 543407 - RNA, 64 nt, Homo Sapiens
uugaaaacaacaacuaaaaaaguggaccuucucagaaaaaaagggcagcaaaugaccaagggcg

SEQ ID NO: 543408 - RNA, 64 nt, Homo Sapiens
cuagacaacauagugagacuuggucucuaaaaaagaaaaaaaaaaauaaaacugauguaaugaa

SEQ ID NO: 543409 - RNA, 64 nt, Homo Sapiens
uuauguuuuuggcaugaacaaaagaaacaagagagaaaaaaaucaaaauaauuaaaauaaauug

SEQ ID NO: 543410 - RNA, 64 nt, Homo Sapiens
ugugacaaccacaagcacuuuuuuuuuuuuuaaagaaaaaaagguagugaauuuuuaaucaucu

SEQ ID NO: 543411 - RNA, 64 nt, Homo Sapiens
agcugaaauucagaggacccauaagaguucacaugaaaaaaaucaauuuauuugaaaaggcaag

SEQ ID NO: 543412 - RNA, 64 nt, Homo Sapiens
aagcacuccucgguacucccauaauccucucggagaaaaaaaucacaaggcaacugugaguccg

SEQ ID NO: 543413 - RNA, 64 nt, Homo Sapiens
aacaugauuauuugaacuuauuuacacauaguuugaaaaaaaaaagacaaaaauaguauucagg

SEQ ID NO: 543414 - RNA, 64 nt, Homo Sapiens
gucuuuuuuucaagaugcuuuguuucuuucauaugaaaaaaaugcauuuuauaaauucagaaag

SEQ ID NO: 543415 - RNA, 64 nt, Homo Sapiens
acaaauuaaaggaggggcuauuaaaaaacauaaggaaaaaaaagagccaacaacccagaaaggu

SEQ ID NO: 543416 - RNA, 64 nt, Homo Sapiens
acaaaaaaguaaaaauaaaauagugacuuguuuagaaaaaaaagauggggggccucaaccaacu

SEQ ID NO: 543417 - RNA, 64 nt, Homo Sapiens
agcuuugauuuucucacuggcguucuauguaaaagaaaaaaaauuagcuuuuccuucugaacca

SEQ ID NO: 543418 - RNA, 64 nt, Homo Sapiens
agcaugaaucaaaugguaaucucauaaacuucuggaaaaaaauaucuauuuuuuuuuucacuug

SEQ ID NO: 543419 - RNA, 64 nt, Homo Sapiens
aaauaaauuuugugugauaaucuuuuugcauugugaaaaaaacauaaaauauacuuauuugucu

SEQ ID NO: 543420 - RNA, 64 nt, Homo Sapiens
ccgaaauuuuuauucagaugaaugucugaauucagaaaaaaauggaauauauucaguaucauuu

SEQ ID NO: 543421 - RNA, 64 nt, Homo Sapiens
guagauaugaaaagaaaaauccaagucuuacauagaaaaaaaagugaaauguauaagagaagaa

SEQ ID NO: 543422 - RNA, 64 nt, Homo Sapiens
cacuaaaaaugaagaaaugcuguuuaacccacuugaaaaaaaaaucucaagguacucacagauc

SEQ ID NO: 543423 - RNA, 64 nt, Homo Sapiens
auggcuguaucggccuguauugcauguuuuuuaagaaaaaaaaaaaaaaaaaaaaaucugccua

SEQ ID NO: 543424 - RNA, 64 nt, Homo Sapiens
aacguugcaaauuuguuaaaaaaaaacagaaaaagaaaaaaaaguaggcagucuuaaaaaaaaa

SEQ ID NO: 543425 - RNA, 64 nt, Homo Sapiens
uuuaaaaagaaagcuaaugcaaaaugcuuauagagaaaaaaaauucuuuuggguaugccuuuua

SEQ ID NO: 543426 - RNA, 64 nt, Homo Sapiens
agcacaccaugguuauuuuuauaugguauaccuugaaaaaaauuuguucagccuauacuuuucc

SEQ ID NO: 543427 - RNA, 64 nt, Homo Sapiens
auuucucacagcuuuuuguuuuuaaggagccaaagaaaaaaaagaauauaaauuauuccaaguc

SEQ ID NO: 543428 - RNA, 64 nt, Homo Sapiens
ccuuguucucaguggugcagaaagaaaagaaaaagaaaaaaaucuucccccugcaaaaagaaaa

SEQ ID NO: 543429 - RNA, 64 nt, Homo Sapiens
aaagaaaaagaaaaaaauccucccccugcaaaaagaaaaaaagagacgauauacucccugcccu

SEQ ID NO: 543430 - RNA, 64 nt, Homo Sapiens
aagcuuuuuacuuaaauaauuucagacacugagggaaaaaaauacugguaaacaauaaagaaga

SEQ ID NO: 543431 - RNA, 64 nt, Homo Sapiens
guuugcacuaauugagguacccaaaaaauagaaagaaaaaaaaagaccccauccuccacccccc

SEQ ID NO: 543432 - RNA, 64 nt, Homo Sapiens
ccaucagcaaagugggccucuauugcuugucucagaaaaaaacaccugcuugcauaacugauca

SEQ ID NO: 543433 - RNA, 64 nt, Homo Sapiens
gcaccuguaguucuguuuauuggucaguggaaaugaaaaaaaaaaaaaaaaaaagucugcguuc

SEQ ID NO: 543434 - RNA, 64 nt, Homo Sapiens
ucacagacaccaacacaccacucauuggaaaauggaaaaaaaaaacaaaaaaaaaacaaaaaaa

SEQ ID NO: 543435 - RNA, 64 nt, Homo Sapiens
aaucaguaugaagacacugucaaugagguuaugagaaaaaaacagcaggggcauuaguuucagg

SEQ ID NO: 543436 - RNA, 64 nt, Homo Sapiens
ggaagcauuacuuuguagauguauuuucaauaaagaaaaaaauaguuuuacauuaacaucuuug

SEQ ID NO: 543437 - RNA, 64 nt, Homo Sapiens
guauuauaguuuaacaaaaauuguuuauaucuuggaaaaaaaacuuucuguuuaaaaaaaauaa

SEQ ID NO: 543438 - RNA, 64 nt, Homo Sapiens
ggcagaaucuccuggauauauaauuuauucuguugaaaaaaaaaaaagcaugcaguaucuauga

SEQ ID NO: 543439 - RNA, 64 nt, Homo Sapiens
ccaguauaugcuauucaaugaucuuagaaguacugaaaaaaaaagacguuuuuaaaacguagag

SEQ ID NO: 543440 - RNA, 64 nt, Homo Sapiens
aaugacuguuuucucucucuauggaaauaaaaaggaaaaaaaaaaaggaaacuuuuuuuguuug

SEQ ID NO: 543441 - RNA, 64 nt, Homo Sapiens
uucaugucauuugacauuuuuuguuugcugaagugaaaaaaaaagauaaagguuguacgguggu

SEQ ID NO: 543442 - RNA, 64 nt, Homo Sapiens
acccacagauuaaaccaaccacagaucaaaaauagaaaaaaaaaaaaaaagaaaaaaagaaugu

SEQ ID NO: 543443 - RNA, 64 nt, Homo Sapiens
aaccacagaucaaaaauagaaaaaaaaaaaaaaagaaaaaaagaauguaaaauuuuaaaaauac

SEQ ID NO: 543444 - RNA, 64 nt, Homo Sapiens
uuaauuaugacaugagaaugaagaaauuauuuuggaaaaaaaaaaugaccuaauuuaccuauca

SEQ ID NO: 543445 - RNA, 64 nt, Homo Sapiens
ugacuuuccacuuuguccuuucugcucuugugaagaaaaaaaaaagcauuuucgaggaaagaau

SEQ ID NO: 543446 - RNA, 64 nt, Homo Sapiens
uaacaucuccacgucccuagcauaaaaagaaaaagaaaaaaauuuaaacugcuuuuucggaaga

SEQ ID NO: 543447 - RNA, 64 nt, Homo Sapiens
gagacugggaucccccaccccaacagugauuuuggaaaaaaaaaugaaaguucuguucguuuau

SEQ ID NO: 543448 - RNA, 64 nt, Homo Sapiens
uaucaucuauaagggagggcugggggcgggaaaagaaaaaaaaaagucauuuugaaauuaaccu

SEQ ID NO: 543449 - RNA, 64 nt, Homo Sapiens
aauuaaccuccuaaaaggaauucauauuuuaaaggaaaaaaauacaacuaaugaugcacauuuc

SEQ ID NO: 543450 - RNA, 64 nt, Homo Sapiens
gggggaagaugguucaaagauacaagaaaaaguagaaaaaaaaauaacacuuaacuaaaacccc

SEQ ID NO: 543451 - RNA, 64 nt, Homo Sapiens
uuuccaaagcugaagauccccauucuuucucuuugaaaaaaaaaaaggccuaaugcauuauuuu

SEQ ID NO: 543452 - RNA, 64 nt, Homo Sapiens
uuaagaaauagucuauguaaagucacaaauuaaugaaaaaaauucgcaugaaaaugacagauaa

SEQ ID NO: 543453 - RNA, 64 nt, Homo Sapiens
ucagagaugucugcucuuuuaaauuauauauaaggaaaaaaaauagccugccuugggacaggug

SEQ ID NO: 543454 - RNA, 64 nt, Homo Sapiens
uuuucacuuuguagcacauuucaguuucuuguaagaaaaaaacaagauauuucaacucaucuca

SEQ ID NO: 543455 - RNA, 64 nt, Homo Sapiens
acacgacugaaaaaguucauguugaauaauuauugaaaaaaagauacauaaccuauggcaguug

SEQ ID NO: 543456 - RNA, 64 nt, Homo Sapiens
uauaauuuucucacaaacaacacagaggucccuggaaaaaaauaaagagugugcuaacaccauu

SEQ ID NO: 543457 - RNA, 64 nt, Homo Sapiens
uccaaguuuguguaaaaccaggguacuguauggggaaaaaaaugcauaagaaaaugcaauaucu

SEQ ID NO: 543458 - RNA, 64 nt, Homo Sapiens
aagacguauguuugaccaagaaucuuucaaauaagaaaaaaauacucuguaaagaucagauggu

SEQ ID NO: 543459 - RNA, 64 nt, Homo Sapiens
acauguauguguugugauauguuccucugucaaugaaaaaaaguaaaauauuuuugaaaggcau

SEQ ID NO: 543460 - RNA, 64 nt, Homo Sapiens
aacuuacacuugggacuuggauaccacuuucccagaaaaaaaaaaauguugggagaaaugauau

SEQ ID NO: 543461 - RNA, 64 nt, Homo Sapiens
gcuucagugucgauugagauaaaauguucagcaugaaaaaaaggaaauacauugcccacuucca

SEQ ID NO: 543462 - RNA, 64 nt, Homo Sapiens
ucuuugguaccaaagauuacguaaaauaggccgggaaaaaaaaaguuccaugucaucagagaug

SEQ ID NO: 543463 - RNA, 64 nt, Homo Sapiens
caaaacacuggcaucugaguauaaacucccccuggaaaaaaaccaaagagcaaaaccguuuuaa

SEQ ID NO: 543464 - RNA, 64 nt, Homo Sapiens
gcaaaaccguuuuaaauaaaaaaggauauuugucgaaaaaaagacuuuggguucuuucuguuug

SEQ ID NO: 543465 - RNA, 64 nt, Homo Sapiens
uacaugcuuacucaggcuuuacuuaaagucacaggaaaaaaauaauuuuuaaugcugucauuac

SEQ ID NO: 543466 - RNA, 64 nt, Homo Sapiens
ggccccaggagaucugaucaucucaaaggacacagaaaaaaaauuuuuauucucugaauuuuga

SEQ ID NO: 543467 - RNA, 64 nt, Homo Sapiens
aaaauuuuuugccuuccauucauacuuuccaguugaaaaaaauccauagccaaggcuagcgagg

SEQ ID NO: 543468 - RNA, 64 nt, Homo Sapiens
acuuuccaacuauuauauaauacaaaggaaccaugaaaaaaaacaacacugauucuuauuguau

SEQ ID NO: 543469 - RNA, 64 nt, Homo Sapiens
aguuaaaaacugaauguacucuucuguuugugaagaaaaaaacaagucuacuauuguaagaguu

SEQ ID NO: 543470 - RNA, 64 nt, Homo Sapiens
cacauucagccaaccacuuacagaaggagugguagaaaaaaacaauggauguucuugaacauuu

SEQ ID NO: 543471 - RNA, 64 nt, Homo Sapiens
ucuguuuguuuuuagcagucgguuuccuuuaaaagaaaaaaacuuuuuuucaggacugcucuau

SEQ ID NO: 543472 - RNA, 64 nt, Homo Sapiens
agcauacauaugugauuaugauauuuuuguccaagaaaaaaaaaucaguuuuuuauaaaaauau

SEQ ID NO: 543473 - RNA, 64 nt, Homo Sapiens
aaagcuuguaugggacagaaaaaaagaaaaaaaggaaaaaaaaaacaaaaaaguaaaaaaaaaa

SEQ ID NO: 543474 - RNA, 64 nt, Homo Sapiens
aaaaaaaaaaaagcuuguauaaaaaaaaaaaaaagaaaaaaagggugauauuuacaaaaaagua

SEQ ID NO: 543475 - RNA, 64 nt, Homo Sapiens
auccuuaagauuuaaaaaaaaaaaaaaaaaaaaggaaaaaaaagugauggaagccguaagugcu

SEQ ID NO: 543476 - RNA, 64 nt, Homo Sapiens
uuuuucucuucauguuguaacaaaaaggaaaaaagaaaaaaaaaucccaucccuuuuguacaua

SEQ ID NO: 543477 - RNA, 64 nt, Homo Sapiens
ccauggggaagauuguguuacugcccuucacagugaaaaaaagaaaaaucuuucauuuuuaaaa

SEQ ID NO: 543478 - RNA, 64 nt, Homo Sapiens
guauuugcaccgagauuuugauucccaaaguuuggaaaaaaaugacaaaacaacgagggaagaa

SEQ ID NO: 543479 - RNA, 64 nt, Homo Sapiens
ccuuccgauuuuacccaaguauauauauaggauagaaaaaaaugcauuauauuugagagcuacu

SEQ ID NO: 543480 - RNA, 64 nt, Homo Sapiens
cacuagagagggagggggaagagcagaaguuagagaaaaaaagccaccggaggaaaggaaaaaa

SEQ ID NO: 543481 - RNA, 64 nt, Homo Sapiens
aaggaguuuacgaaaucugcuguuuuaucaaagugaaaaaaaauugcuuauuacucuucauuuu

SEQ ID NO: 543482 - RNA, 64 nt, Homo Sapiens
ucaugucuguacagauuauuuaaaucauggaaaugaaaaaaauguucucugcuugcuaccaaag

SEQ ID NO: 543483 - RNA, 64 nt, Homo Sapiens
ccuuccuccaaagaauuaauaggcaacagugggagaaaaaaaaggcauaauggcaaauccuuca

SEQ ID NO: 543484 - RNA, 64 nt, Homo Sapiens
ggcagggagaagggccgggggggguaggagaggagaaaaaaaaagugaaaaaaagaaacgaaaa

SEQ ID NO: 543485 - RNA, 64 nt, Homo Sapiens
ggccgggggggguaggagaggagaaaaaaaaagugaaaaaaagaaacgaaaaggacagacgaag

SEQ ID NO: 543486 - RNA, 64 nt, Homo Sapiens
uacaggggcagucaguggagggcgagugguuucggaaaaaaaaaaagaaaaaaagaaaaaaaaa

SEQ ID NO: 543487 - RNA, 64 nt, Homo Sapiens
caguggagggcgagugguuucggaaaaaaaaaaagaaaaaaagaaaaaaaaagaaaaaaaaaag

SEQ ID NO: 543488 - RNA, 64 nt, Homo Sapiens
ggcgagugguuucggaaaaaaaaaaagaaaaaaagaaaaaaaaagaaaaaaaaaagauuuuuuu

SEQ ID NO: 543489 - RNA, 64 nt, Homo Sapiens
uucggaaaaaaaaaaagaaaaaaagaaaaaaaaagaaaaaaaaaagauuuuuuucuucucuuaa

SEQ ID NO: 543490 - RNA, 64 nt, Homo Sapiens
uuaaaauucaaggccacaaaaacaauguuugggggaaaaaaaagaaaaaaucaugccagcuaau

SEQ ID NO: 543491 - RNA, 64 nt, Homo Sapiens
ucaggacccuugcccccacccccauuuuuuuaaugaaaaaaaaaaacaaaaaaaacggauccaa

SEQ ID NO: 543492 - RNA, 64 nt, Homo Sapiens
uuuauuuccuucuccacucucuccaugcccuggagaaaaaaaaguccagaagaaaucauaaaua

SEQ ID NO: 543493 - RNA, 64 nt, Homo Sapiens
uaggauuguguguauauuugggauaucuauugaagaaaaaaagaaaaccccuuaaagauaaugu

SEQ ID NO: 543494 - RNA, 64 nt, Homo Sapiens
uuguuauaccauacugguuagugaauaauuacaugaaaaaaaagagucuguacaucuucagagu

SEQ ID NO: 543495 - RNA, 64 nt, Homo Sapiens
aauaccuggcaaaacuaaauaaauuaccaaaaaggaaaaaaaauccaccaaaccaugauaaaca

SEQ ID NO: 543496 - RNA, 64 nt, Homo Sapiens
ugcccccucuuucacuaaggaaggcaaaugaagugaaaaaaaaaaaugccauuuucaauccuuc

SEQ ID NO: 543497 - RNA, 64 nt, Homo Sapiens
gacaguuguggaguaucccauucugaugaguacagaaaaaaaaagaaaaagaaaagaagagaaa

SEQ ID NO: 543498 - RNA, 64 nt, Homo Sapiens
aaaaaaagaaaaagaaaagaagagaaaaaauuaagaaaaaaaucaaaaaaggaagaaaacuaaa

SEQ ID NO: 543499 - RNA, 64 nt, Homo Sapiens
ugucagauucaucaaacaaaaaauaaaucucgaagaaaaaaaaugcacuuacaugugcuuauuu

SEQ ID NO: 543500 - RNA, 64 nt, Homo Sapiens
aggaagcauauaccggggaauguguagccuucaggaaaaaaaugccaauugacacaaagcauuc

SEQ ID NO: 543501 - RNA, 64 nt, Homo Sapiens
uucacauuuugauuuauuagguacuagcacugaggaaaaaaaauucagcacuuggacuaucaua

SEQ ID NO: 543502 - RNA, 64 nt, Homo Sapiens
ugggaaggaggguaauaaugaacaaaaaguuugagaaaaaaaugcuuuaauggguuuuacaggc

SEQ ID NO: 543503 - RNA, 64 nt, Homo Sapiens
gcagaauuuggcauaucgaugcaugcaauggaaagaaaaaaaauuuguuaaaauuuguaaaugu

SEQ ID NO: 543504 - RNA, 64 nt, Homo Sapiens
uugugaaccuagacuuagaacaaauccugcuuuugaaaaaaaauguuuugcuucuuacaaaauc

SEQ ID NO: 543505 - RNA, 64 nt, Homo Sapiens
ccaauugucuugguuucuugauucauuuauuugagaaaaaaacaauacaaagaaaugcauucau

SEQ ID NO: 543506 - RNA, 64 nt, Homo Sapiens
acaccaucugcaaccauaugcuauuaauaaaauggaaaaaaacaaaauggucauuuugcauaua

SEQ ID NO: 543507 - RNA, 64 nt, Homo Sapiens
gugcuuugugguugcugucauauuugcucuagaagaaaaaaaaaaaaggaggggaaaugcauuu

SEQ ID NO: 543508 - RNA, 64 nt, Homo Sapiens
auuuuguguugaucauuauuuccauucuuaaugugaaaaaaaguaauuauuuauacuuauuaua

SEQ ID NO: 543509 - RNA, 64 nt, Homo Sapiens
uuuguucaaaaguuagaacaucuggcugcaccaggaaaaaaaaaaaaaaaaaguccuguucuuc

SEQ ID NO: 543510 - RNA, 64 nt, Homo Sapiens
ucacugcugccauguguguacuguauuauuuucagaaaaaaauauaauagucugaguccaaguu

SEQ ID NO: 543511 - RNA, 64 nt, Homo Sapiens
uccagccugggcgacagagugaaacuacaucucagaaaaaaaaaaaaaaaaaaaaaaaaaaagu

SEQ ID NO: 543512 - RNA, 64 nt, Homo Sapiens
aagggucaaaacuagauuggaucuugguuugaaugaaaaaaagcauaaaauauucuugcaauaa

SEQ ID NO: 543513 - RNA, 64 nt, Homo Sapiens
auccauuuccuaugcguuuuacuccucagagaaugaaaaaaacugcaucccaucacccaaaguu

SEQ ID NO: 543514 - RNA, 64 nt, Homo Sapiens
aaaugguuaccaguacagucaaaaaagagaaaaugaaaaaaauacaacuaaaaggaagaaacac

SEQ ID NO: 543515 - RNA, 64 nt, Homo Sapiens
auuucaagauaauguaguuuaaaaaaaaaaaaaagaaaaaaacuugauguaaauuccuccuuuu

SEQ ID NO: 543516 - RNA, 64 nt, Homo Sapiens
gauuuagaauaauaaauggaauaacauguuaauggaaaaaaaugugguuaguaaacacuaaugu

SEQ ID NO: 543517 - RNA, 64 nt, Homo Sapiens
cacacauaaaguuccauguguauuuguuaaaaaagaaaaaaaaauuguucaguguuuuaaccug

SEQ ID NO: 543518 - RNA, 64 nt, Homo Sapiens
aauuucaagauucucaacuuuguuuuauucuacugaaaaaaauguacguuuucaugcugcuuau

SEQ ID NO: 543519 - RNA, 64 nt, Homo Sapiens
uacguaaucuguuucaccugaaaauagcaugcuugaaaaaaaaagaugagauaucaagguaauu

SEQ ID NO: 543520 - RNA, 64 nt, Homo Sapiens
aagagauuaaacaagauaauugaaagucaagugugaaaaaaaaaaugagauucaaaaguugacc

SEQ ID NO: 543521 - RNA, 64 nt, Homo Sapiens
ucaagcaguuuucacuugucaaacaaaauuagaagaaaaaaagguuucuuuuuggaacugcuac

SEQ ID NO: 543522 - RNA, 64 nt, Homo Sapiens
uuuacuuugaucucuguuuuuagacgcagagacugaaaaaaaaaagaaaacauugauuugagca

SEQ ID NO: 543523 - RNA, 64 nt, Homo Sapiens
uuaugauuucuggauugauagaacagguuuuggggaaaaaaaucagucuacuuuauguaaauaa

SEQ ID NO: 543524 - RNA, 64 nt, Homo Sapiens
aagucuuuacaaugcuuguuucaaagaaccaacagaaaaaaaagcuaagaaaacugagaacuaa

SEQ ID NO: 543525 - RNA, 64 nt, Homo Sapiens
guaaaugucacgagaucauuuuuacauuaaacgugaaaaaaaaucaacuuugccggaucacuua

SEQ ID NO: 543526 - RNA, 64 nt, Homo Sapiens
agcauugcaugugaauaagaaaauaauguuuaaagaaaaaaaaaaaaaagcaaaccuccaaaac

SEQ ID NO: 543527 - RNA, 64 nt, Homo Sapiens
uuucucucacuauaguauaagaaucuauuuuggagaaaaaaagaaaauaugagggucucgaagc

SEQ ID NO: 543528 - RNA, 64 nt, Homo Sapiens
caaaagcaaaaaaaaaaagcaaaaaaagaaaagagaaaaaaagaaaaaaugcaaauggaauaau

SEQ ID NO: 543529 - RNA, 64 nt, Homo Sapiens
auuuauaauuacauucaaaguauacuuuuuucuugaaaaaaauuacagauuuuuugaaaagcaa

SEQ ID NO: 543530 - RNA, 64 nt, Homo Sapiens
auguucagacuaacauucuuuugcaguauagugagaaaaaaacauuuuaaaauuaauuaucauu

SEQ ID NO: 543531 - RNA, 64 nt, Homo Sapiens
uccuuccaggauuaaguugucaucauucugggaagaaaaaaaaaacauuaaugaagaggccaau

SEQ ID NO: 543532 - RNA, 64 nt, Homo Sapiens
uuguugacuuaaaaauaugagauacauaggaugugaaaaaaaauguuugcaguacucagcaaaa

SEQ ID NO: 543533 - RNA, 64 nt, Homo Sapiens
gucauuugaccaagacacagaagaugaugaaugggaaaaaaaacauagagaucacaccgcaaag

SEQ ID NO: 543534 - RNA, 64 nt, Homo Sapiens
uguauaaauguuuuuacugcuuuuagaaaauaaagaaaaaaaacuugguucauguuuacaugcc

SEQ ID NO: 543535 - RNA, 64 nt, Homo Sapiens
gcaacagagcaagagucugucucaaaaaaaaaaagaaaaaaagaaaaaaagaaaaaagaaaaau

SEQ ID NO: 543536 - RNA, 64 nt, Homo Sapiens
gcaagagucugucucaaaaaaaaaaagaaaaaaagaaaaaaagaaaaaagaaaaaucucauuau

SEQ ID NO: 543537 - RNA, 64 nt, Homo Sapiens
uaauauguaaauuaaaauauuucuacauuuuauugaaaaaaaaaccuuuuuuuuugccuaaaua

SEQ ID NO: 543538 - RNA, 64 nt, Homo Sapiens
cacauuaauguugaauuuuacagacaguauauuugaaaaaaauugauuccauguagucuucaau

SEQ ID NO: 543539 - RNA, 64 nt, Homo Sapiens
augaacauuggcuaugaugaagauuauuacauaugaaaaaaaaacucacacaacauauuuguau

SEQ ID NO: 543540 - RNA, 64 nt, Homo Sapiens
aguagcuugucaucaauccccuugucgaaaacuagaaaaaaaggaguugacccauauaaauuau

SEQ ID NO: 543541 - RNA, 64 nt, Homo Sapiens
ccaaaauuauuaauuuuauuaggcuuuuggaaaagaaaaaaaacuuuuugauguuuuaggugau

SEQ ID NO: 543542 - RNA, 64 nt, Homo Sapiens
uuucaaaggauagcauaauaucugcauuaugcuggaaaaaaauagaccuuuggagaauacuuaa

SEQ ID NO: 543543 - RNA, 64 nt, Homo Sapiens
ugaaauaaacuauaucauauaggaaguaugaguugaaaaaaaauuuuggucagugcuauuuuaa

SEQ ID NO: 543544 - RNA, 64 nt, Homo Sapiens
gggaggauuguucacucacuguauuaagugguaugaaaaaaaggaaauaagaaaauuaauaauu

SEQ ID NO: 543545 - RNA, 64 nt, Homo Sapiens
aagaaauuugauuuuagggaccaaucucaaaugugaaaaaaaaaccccucaauaucaugaucau

SEQ ID NO: 543546 - RNA, 64 nt, Homo Sapiens
aaaaaaaaaacagaaucucagagacuccaucucagaaaaaaaaauccagccugggcgacagagu

SEQ ID NO: 543547 - RNA, 64 nt, Homo Sapiens
aucuguaaacgcgaaaaauacauccggcaaaacugaaaaaaaaaacagugauuuagguuuguaa

SEQ ID NO: 543548 - RNA, 64 nt, Homo Sapiens
caaaggcgcuuugaaacaggcuuguaaagagugagaaaaaaaauuuuuuuuuuuaauugcacuu

SEQ ID NO: 543549 - RNA, 64 nt, Homo Sapiens
cacacaaaaagucccccuucaaaaaaagaaaagagaaaaaaaaauuacuugaaguaacuauaac

SEQ ID NO: 543550 - RNA, 64 nt, Homo Sapiens
agauguuuuaacuuauuuauaauggcuuugucuugaaaaaaaaucuguucaucucuuuguccug

SEQ ID NO: 543551 - RNA, 64 nt, Homo Sapiens
auaaauacaaaucuguauaauagaugcagaaaaagaaaaaaacugcauaaaagggucaaaccug

SEQ ID NO: 543552 - RNA, 64 nt, Homo Sapiens
gaauuaccaagagaaggggacccagcuuuaaaaagaaaaaaaaauuccuuccucuguaagauau

SEQ ID NO: 543553 - RNA, 64 nt, Homo Sapiens
uugagauuacacuggcauaaauguauuacaaaaggaaaaaaaaaauccucugacuuuauuuucc

SEQ ID NO: 543554 - RNA, 64 nt, Homo Sapiens
guuuuaaaaauuguauccuacauuuucagugguagaaaaaaaaggaucaaaucauauuucugua

SEQ ID NO: 543555 - RNA, 64 nt, Homo Sapiens
uauuccuccccacugcaugauagcuuuaguuuaagaaaaaaaaacacagagagacagugcagug

SEQ ID NO: 543556 - RNA, 64 nt, Homo Sapiens
gagaauaaaauuccuaucucucuguacagaucaagaaaaaaagggauggaauaucagaaguaua

SEQ ID NO: 543557 - RNA, 64 nt, Homo Sapiens
ugucucaaaggagcuuucuccaguuggccaagcagaaaaaaaaggacguuucuucuuucuagag

SEQ ID NO: 543558 - RNA, 64 nt, Homo Sapiens
uucuacuauucaguuccucaaacugaagcuuauugaaaaaaaaauguauaauguuauuuguuuu

SEQ ID NO: 543559 - RNA, 64 nt, Homo Sapiens
uuaauuauaguuuuguuauaaauauaacuuaugagaaaaaaauuugauaggaauaauacuguau

SEQ ID NO: 543560 - RNA, 64 nt, Homo Sapiens
guuuuuuuuaaaugugcaaauacuguauucaagugaaaaaaauacaguauuuguagauaaccau

SEQ ID NO: 543561 - RNA, 64 nt, Homo Sapiens
uaaucuuaagugaaaugggugcagcauuccuuuggaaaaaaaaaucuuuuuauuuucaagugau

SEQ ID NO: 543562 - RNA, 64 nt, Homo Sapiens
auccuguuccaaugaaaaaauuaaaaccugauacgaaaaaaaaaaaauuccaguuaaccuauuu

SEQ ID NO: 543563 - RNA, 64 nt, Homo Sapiens
ugacauacuuuugcuuucaguaguuucauguaaagaaaaaaacuugaaaauaguaauaccugag

SEQ ID NO: 543564 - RNA, 64 nt, Homo Sapiens
ggccaaaaaaaaaaagaaaaagaaaaagaaaaaagaaaaaaaaagaaaaaacugggaccuaagu

SEQ ID NO: 543565 - RNA, 64 nt, Homo Sapiens
agcuugaaucugggaaacaagcucaaaaaacagugaaaaaaaaaguacugguuuaggaguucaa

SEQ ID NO: 543566 - RNA, 64 nt, Homo Sapiens
acaaagaucacuacagaccaaaacagaagaagaagaaaaaaaagaaaaagaaaucuaagcaaca

SEQ ID NO: 543567 - RNA, 64 nt, Homo Sapiens
gaaaagaccaagaucaaauaauagcugggguggagaaaaaaauagcucaagacacaguuaaucg

SEQ ID NO: 543568 - RNA, 64 nt, Homo Sapiens
guuugauccugaguaugcuugguguuugccuucagaaaaaaaaaaauacauuguaaauaaccuc

SEQ ID NO: 543569 - RNA, 64 nt, Homo Sapiens
uuaaaacuacuuuguugaaacaucaaccugggcagaaaaaaaaaaaaaaagacauguaaaauuu

SEQ ID NO: 543570 - RNA, 64 nt, Homo Sapiens
ccagucuguauaugaaaaaauaggucaucaaaaggaaaaaaaauaacuuugauuaacuaguguu

SEQ ID NO: 543571 - RNA, 64 nt, Homo Sapiens
agaaagaaagagggaaaaagaaaauagaaaaaaagaaaaaaaaacaucucuguaggaucguaaa

SEQ ID NO: 543572 - RNA, 64 nt, Homo Sapiens
aaaaaaaaagaaagaaagagaucguaaaaaaauagaaaaaaagaagcuggaccaucucuguagg

SEQ ID NO: 543573 - RNA, 64 nt, Homo Sapiens
gaacaaaacaggguaccagcauuuaguuuaugcagaaaaaaauuaugaagccuuucagauacca

SEQ ID NO: 543574 - RNA, 64 nt, Homo Sapiens
uugaaaguuucuauuuucuaguuuuucuuuguaggaaaaaaaaguaauauuuuggauacuauuu

SEQ ID NO: 543575 - RNA, 64 nt, Homo Sapiens
agccccuucacucuacagggaaaaaaacuaaaaagaaaaaaagauuuuuuaagacucugucuua

SEQ ID NO: 543576 - RNA, 57 nt, Homo Sapiens
accgagacguuucugugacuaucagcagaaaaaaaacaaaaagcaggaaagauguaa

SEQ ID NO: 543577 - RNA, 64 nt, Homo Sapiens
uuuguaaaaucaccggaacaagacuuuacaccuggaaaaaaagauaauuuuuuggaauuuuugu

SEQ ID NO: 543578 - RNA, 64 nt, Homo Sapiens
uuuuagcuuagacuaagcuauuauugcuaugaaugaaaaaaauaaagggcauuugaggggagga

SEQ ID NO: 543579 - RNA, 64 nt, Homo Sapiens
auuaaaaccguggccagccauauagaaauaacuugaaaaaaaaagacuucaaaaauaugucugc

SEQ ID NO: 543580 - RNA, 64 nt, Homo Sapiens
auuguugaaagguccaguucugaaacuuucuauagaaaaaaaaaagacuuugcuuacagcuaga

SEQ ID NO: 543581 - RNA, 64 nt, Homo Sapiens
auuuaauuuggaucuggaucaauaguuugaaauagaaaaaaaguuuaucaccuuagcaacuuag

SEQ ID NO: 543582 - RNA, 64 nt, Homo Sapiens
ugaauuuagaaauauucaaaugaggauggauuuagaaaaaaacagaaagaaguauuaaaaagag

SEQ ID NO: 543583 - RNA, 64 nt, Homo Sapiens
gaggaaauuauuucauccccccuacacugauaaagaaaaaaaaugcuauggaaagacagcuuuu

SEQ ID NO: 543584 - RNA, 64 nt, Homo Sapiens
uauauuagcuauuuugauuuucucaaaagugccagaaaaaaauguuuauguucaaugccuaauu

SEQ ID NO: 543585 - RNA, 64 nt, Homo Sapiens
cccgcacuuggcaacuucuuuuccaaacaugauugaaaaaaaacuucuguaaguuggaacuuau

SEQ ID NO: 543586 - RNA, 64 nt, Homo Sapiens
gacaaccucuugacuagguuguaaccaugcaauggaaaaaaauguaguuucuggggaaagaaua

SEQ ID NO: 543587 - RNA, 64 nt, Homo Sapiens
aaauaaauucccaauuccauaacaagauaauugagaaaaaaauaaauaauugagaaaaauaaau

SEQ ID NO: 543588 - RNA, 64 nt, Homo Sapiens
cucuuuuugguuguccucaaaaaaaaaaaaaaaggaaaaaaagagugauauuucucuaguaguu

SEQ ID NO: 543589 - RNA, 64 nt, Homo Sapiens
auuuuaaaaaugguggcuucauucauuuuauauugaaaaaaauacauugggucuauuccagcuc

SEQ ID NO: 543590 - RNA, 64 nt, Homo Sapiens
ugccauaauacaaaaggcucgaauacagcagcaagaaaaaaaaaugauuugcaaugggauguau

SEQ ID NO: 543591 - RNA, 64 nt, Homo Sapiens
aaagaggaaaacccucaagguauauacaauaauggaaaaaaaaauuaaaagucacaauguucuu

SEQ ID NO: 543592 - RNA, 64 nt, Homo Sapiens
uaguguguuccauuuaaaauggggggauugauuagaaaaaaauguccuauuuuuucugggagag

SEQ ID NO: 543593 - RNA, 64 nt, Homo Sapiens
aguuccuauuuuuucugggauuccuccccacccugaaaaaaaugaugucccaugauccccucuc

SEQ ID NO: 543594 - RNA, 64 nt, Homo Sapiens
aagaguguguuuacaacuguaucuugcagauaaagaaaaaaauuuguaaucuuuuaaaaauauu

SEQ ID NO: 543595 - RNA, 64 nt, Homo Sapiens
uguacaguguauauuccuuuacaucagaaugaaagaaaaaaaauaacugauaauaucuguaaug

SEQ ID NO: 543596 - RNA, 64 nt, Homo Sapiens
guagcacuuauucauuccaauuaugccuacuuaggaaaaaaaggagaaggaaaugaaaauauuu

SEQ ID NO: 543597 - RNA, 64 nt, Homo Sapiens
acuuauuuuucuaguaaauagggagaacaaauaggaaaaaaaaacuuauuucauuaaagaaguu

SEQ ID NO: 543598 - RNA, 64 nt, Homo Sapiens
ucacuuuugaaacucagacuugaaacuuuugugggaaaaaaaaagaaaguucuagcuuaagugu

SEQ ID NO: 543599 - RNA, 64 nt, Homo Sapiens
caaacaaacacuucuuuccauaagucuuugacaagaaaaaaaaauuuaauuuaaaacuauggug

SEQ ID NO: 543600 - RNA, 64 nt, Homo Sapiens
aauuccagucauuuugggaauuccugcuuaacuugaaaaaaauaugggaaagacaugcagcuuu

SEQ ID NO: 543601 - RNA, 64 nt, Homo Sapiens
aaacaugugggaaaaaauauuacauuuuaagggggaaaaaaaaacccaccauucucuucucccc

SEQ ID NO: 543602 - RNA, 64 nt, Homo Sapiens
caucccuuccuauaaccucuagguaaaaagaaaagaaaaaaagaaauuucgagauauuuucaac

SEQ ID NO: 543603 - RNA, 64 nt, Homo Sapiens
acauuguuagaguuugggcuaaaaugagcaaggagaaaaaaaccaccaagaacauuuccugggg

SEQ ID NO: 543604 - RNA, 64 nt, Homo Sapiens
gucuaucucaaaccgcagaaaggcuuuaauacuggaaaaaaagaauucaagacuacaggcagcu

SEQ ID NO: 543605 - RNA, 64 nt, Homo Sapiens
cuuucaaguaaauauagcauuccuuuggcaaaaagaaaaaaaaaguaaaagaaaagaaaaaaaa

SEQ ID NO: 543606 - RNA, 64 nt, Homo Sapiens
ccuuuggcaaaaagaaaaaaaaaguaaaagaaaagaaaaaaaauguauuaccacccgaugagcc

SEQ ID NO: 543607 - RNA, 64 nt, Homo Sapiens
agauggugggggcauuuuuagagcggcaauaauugaaaaaaaaggcgaacucugccuuggagag

SEQ ID NO: 543608 - RNA, 64 nt, Homo Sapiens
ggaugagaaaauuuucaauucuggccaugagaaagaaaaaaaaauaaacagccuucuuuuuuuu

SEQ ID NO: 543609 - RNA, 64 nt, Homo Sapiens
caacuaaagaauggauuuaauuaaacuauguauugaaaaaaaaguagccuaaguguuagagaug

SEQ ID NO: 543610 - RNA, 64 nt, Homo Sapiens
cuaaaauuaucagacuuccuuuuuccaauauaaagaaaaaaaguaaguuuucagaauucucuca

SEQ ID NO: 543611 - RNA, 64 nt, Homo Sapiens
uuguacuuuuugugcaugaccuggaccugcuaaggaaaaaaaaaucuuguggauugauugcuuu

SEQ ID NO: 543612 - RNA, 64 nt, Homo Sapiens
auaaacuauuuuaaucaaccauacuauucuuauggaaaaaaauaucuauuuuggcagguuucug

SEQ ID NO: 543613 - RNA, 64 nt, Homo Sapiens
uuggcagguuucugugccuuuauuucccucuucugaaaaaaagucuguguuuucauaguuuggu

SEQ ID NO: 543614 - RNA, 64 nt, Homo Sapiens
guuugaacacaaaggcucuaaaaaaagaaaaaaggaaaaaaacaaaaaaaugaaaaaaaaagga

SEQ ID NO: 543615 - RNA, 64 nt, Homo Sapiens
aaaaaggaaaaaaacaguuuaaugaaaaaaaaaggaaaaaaagagaaaucuuaaaaaaagaaaa

SEQ ID NO: 543616 - RNA, 64 nt, Homo Sapiens
ggaaaaaaagaaaaaaggaaaaaaaagaaaaaaugaaaaaaaaauaacccaguuugaaaucuua

SEQ ID NO: 543617 - RNA, 64 nt, Homo Sapiens
uggucuuguuuuuacuaccucauuuuuaaaaaaagaaaaaaacauuuauguuagcauuaaugca

SEQ ID NO: 543618 - RNA, 64 nt, Homo Sapiens
aaaaaagaaacaaaaaggaagcaaaaauaaaagggaaaaaaaaguguacccaugacuguugccu

SEQ ID NO: 543619 - RNA, 64 nt, Homo Sapiens
uuauauauacauugugugugauugucuaccugaagaaaaaaaauagagguacuuuccuggaaua

SEQ ID NO: 543620 - RNA, 64 nt, Homo Sapiens
uucugaacaaagcuauagggaugaaaaaagcaaagaaaaaaauauuuuuggucaguaaaacuua

SEQ ID NO: 543621 - RNA, 64 nt, Homo Sapiens
cguagaaaaauguuuagaugcuguuuuaacaaaugaaaaaaagaugaaaauguauuuaacauag

SEQ ID NO: 543622 - RNA, 64 nt, Homo Sapiens
aaaauuauuccagugcacaagacuuuuugccaaggaaaaaaauauuuuuaaaaauguagcacuu

SEQ ID NO: 543623 - RNA, 64 nt, Homo Sapiens
uauauauauauucuccuuuuaagaagggaaauuggaaaaaaaauucccccucuucucugggugu

SEQ ID NO: 543624 - RNA, 64 nt, Homo Sapiens
cauguuuaaaauggcaaaaguaaucuuuuuuaaugaaaaaaaaucauacaaaucacauauaguu

SEQ ID NO: 543625 - RNA, 64 nt, Homo Sapiens
uguaacaaauucucgcuccaagugggucacuuaagaaaaaaaagucucuuuauuggugguccua

SEQ ID NO: 543626 - RNA, 64 nt, Homo Sapiens
agcgcuuucuagggucagaauuacacccagggaggaaaaaaagguuaaugauaccccaaaauga

SEQ ID NO: 543627 - RNA, 64 nt, Homo Sapiens
gugaacuaacuuauuuaauucuuaagugcugggggaaaaaaaauacauuagagacuaacuguaa

SEQ ID NO: 543628 - RNA, 64 nt, Homo Sapiens
gauaaauuauugaaugaguaaguaauaggcacuugaaaaaaaaaaccuuugcucugguuaaaac

SEQ ID NO: 543629 - RNA, 64 nt, Homo Sapiens
uuuaauguugagcaugcugcguuuuuaaugggaggaaaaaaagcuucaaaauagcauuccccag

SEQ ID NO: 543630 - RNA, 64 nt, Homo Sapiens
uuuguaugucaauaacuuuauuaaaaggaaaaaagaaaaaaaauucuaaguuaaaucauuuuca

SEQ ID NO: 543631 - RNA, 64 nt, Homo Sapiens
auuguuuuagaaguuaaaguccacugcugaaaaagaaaaaaauguuuacagaauauuauauaac

SEQ ID NO: 543632 - RNA, 64 nt, Homo Sapiens
aaucucaaggguuuuuuguaaaggucuucuuuuagaaaaaaauuuuuuaaaaguuauuuuuggu

SEQ ID NO: 543633 - RNA, 64 nt, Homo Sapiens
uuacagucuuaaggaaaauauauaauuguuuucagaaaaaaagucuacuuauaaacuacuuuuu

SEQ ID NO: 543634 - RNA, 64 nt, Homo Sapiens
uuuuuucaauaaucuuauucaaaaagaaaaucaggaaaaaaauucuacaaaaauaaccuucagg

SEQ ID NO: 543635 - RNA, 64 nt, Homo Sapiens
cauauccccuauuuaacagggucucuagugcugugaaaaaaaaaaugcugaacauugcauauaa

SEQ ID NO: 543636 - RNA, 64 nt, Homo Sapiens
uuaaaagaaaauaaaaaaaagaaaaaagagaaaagaaaaaaaaagaaaaaaguuguaggcgaau

SEQ ID NO: 543637 - RNA, 64 nt, Homo Sapiens
gguuucuaacagacuacuuccaaaaacaguuugagaaaaaaacugucugauuuuaagucucuag

SEQ ID NO: 543638 - RNA, 64 nt, Homo Sapiens
aaaguuguuugcuuaaaaaaaauuucaugugagggaaaaaaaaaaaaccuauuccagaauaagu

SEQ ID NO: 543639 - RNA, 64 nt, Homo Sapiens
uguucagcaaaaugugauguuuuuuucuuuuaaagaaaaaaagugaaaauauauagugccaaau

SEQ ID NO: 543640 - RNA, 64 nt, Homo Sapiens
cucaaaaaauaaauaaauagaaagagagagagaggaaaaaaaaagaaaagaacacuucuuuauu

SEQ ID NO: 543641 - RNA, 64 nt, Homo Sapiens
aaaacgauuuaccaauguuguuuuuuuuuaacaagaaaaaaaauaaaagcacauugucauuuuu

SEQ ID NO: 543642 - RNA, 64 nt, Homo Sapiens
uaaagaaguaccugaucaggaucugggagaauuugaaaaaaaaagaaaaacuagaaaaauaaac

SEQ ID NO: 543643 - RNA, 64 nt, Homo Sapiens
aaagaaaaacuagaaaaauaaacaaaauuaaaaagaaaaaaaaauaccugagacugaguaacuu

SEQ ID NO: 543644 - RNA, 64 nt, Homo Sapiens
gaccagaaaccagaagaacaaucaagacugcaaugaaaaaaauggauacauuaggagcuucaaa

SEQ ID NO: 543645 - RNA, 64 nt, Homo Sapiens
agucucauagauuuagaugcaaaauccuaaaauugaaaaaaacaucuagccauauccauaaacu

SEQ ID NO: 543646 - RNA, 64 nt, Homo Sapiens
ggaagacagagugagaccccaucucaggaaaaaagaaaaaaaaaaagaugucauucagcagguu

SEQ ID NO: 543647 - RNA, 64 nt, Homo Sapiens
uuuauagcauugacuuuuacacacauucacacaagaaaaaaauccuuucaaaauucuuaaaucu

SEQ ID NO: 543648 - RNA, 64 nt, Homo Sapiens
ucauuuuguuuuuuuaagaaaaagaaaaugaaaggaaaaaaauaaaagauccagugucuuucuu

SEQ ID NO: 543649 - RNA, 64 nt, Homo Sapiens
agcagcaguggccucuacguuuuacuccuuugcugaaaaaaaaucaucuugcccacaggccugu

SEQ ID NO: 543650 - RNA, 64 nt, Homo Sapiens
cccaaucuauucuaauuaccuuaaaucuaaaggggaaaaaaaaaaucacaaacaggacugggua

SEQ ID NO: 543651 - RNA, 64 nt, Homo Sapiens
ccuucaauuccauauauccuuuucuucuauguaggaaaaaaauagucuaguguaguauucuucc

SEQ ID NO: 543652 - RNA, 64 nt, Homo Sapiens
uaggcuuucagcuuacacaaaucuauuuaauuaggaaaaaaacuauuaaggauguagcuuuuca

SEQ ID NO: 543653 - RNA, 64 nt, Homo Sapiens
ccagcugccugucguuuggcccagaccacccucagaaaaaaaccagcugccucucccauucucc

SEQ ID NO: 543654 - RNA, 64 nt, Homo Sapiens
augaucccauuaccagauaagauugacugacggggaaaaaaaaaaaaaaagaauggggugugaa

SEQ ID NO: 543655 - RNA, 64 nt, Homo Sapiens
aaugugugggagcugcacguagaggaggaaagaagaaaaaaauuauuugugugcagauaccaaa

SEQ ID NO: 543656 - RNA, 64 nt, Homo Sapiens
ucagcucccaaagggcccauggcagagcaggguugaaaaaaauacgugugucuacuagccaaca

SEQ ID NO: 543657 - RNA, 64 nt, Homo Sapiens
caauagcagcaaggcccuggcugaauuuuaauuagaaaaaaauaacucaacuguguuuaauacu

SEQ ID NO: 543658 - RNA, 64 nt, Homo Sapiens
uucaaaugagagagcuuucuagcaggauauaaaagaaaaaaaugccccccaggcaucuucacuc

SEQ ID NO: 543659 - RNA, 64 nt, Homo Sapiens
agaguaaaaaucagugaaauuccaaaguaaccuggaaaaaaauuaaaaagaagagcaaauuaaa

SEQ ID NO: 543660 - RNA, 64 nt, Homo Sapiens
cuauccuguacgugugaagaauaacagauuaucugaaaaaaaauuuuaaaaguuauaaaucaaa

SEQ ID NO: 543661 - RNA, 64 nt, Homo Sapiens
uuuuaaaaaacccagccaaauauuaacaucuuaugaaaaaaauauuuuauuuucuacuuuugau

SEQ ID NO: 543662 - RNA, 64 nt, Homo Sapiens
guaauuauuucacgcaucaauauaacuuuuaugagaaaaaaaugugguugggguccauuuugua

SEQ ID NO: 543663 - RNA, 64 nt, Homo Sapiens
ucagcuuucauguuucugauucuuuuuauacaaagaaaaaaaaucuuuagucuguuauuuuguu

SEQ ID NO: 543664 - RNA, 59 nt, Homo Sapiens
aaaaaacagaaaccaaucggagaggaagagaaaaaaaaccaucuccagcaguggccuga

SEQ ID NO: 543665 - RNA, 64 nt, Homo Sapiens
ggauuuuuuuuuuuucuaaugucuugaauuacaagaaaaaaaggcgcaaaugaaacaccaaaca

SEQ ID NO: 543666 - RNA, 64 nt, Homo Sapiens
uaugcauuugcuuaguuuauugcuuuuauaauaggaaaaaaaaauccuacucucuuauacuggc

SEQ ID NO: 543667 - RNA, 64 nt, Homo Sapiens
uuguuuaaaaaaaaaaggaaagaaaaaaaaaaaagaaaaaaagacgagguguuuuuuacauuua

SEQ ID NO: 543668 - RNA, 64 nt, Homo Sapiens
aaagaaaaaaagauuguuuauuuuuuacauuuaagaaaaaaaaagucucugcuguaccgaggug

SEQ ID NO: 543669 - RNA, 64 nt, Homo Sapiens
acuugggcucccuguuuggaaguagagugucccagaaaaaaaccacuaauuaaacaauaauuca

SEQ ID NO: 543670 - RNA, 64 nt, Homo Sapiens
aguauuuuuauaucauaaaauagaaauaauaaaugaaaaaaacuacucaaacagugaaugccua

SEQ ID NO: 543671 - RNA, 64 nt, Homo Sapiens
aaacauauuuacauauuuuuagauuuuuugcuaagaaaaaaauuuuucauuguuauuuuuagaa

SEQ ID NO: 543672 - RNA, 64 nt, Homo Sapiens
agaaaagaaaaaaggcauaauuguauaaaaaauagaaaaaaaaaugcaauacuguuuguacugu

SEQ ID NO: 543673 - RNA, 64 nt, Homo Sapiens
ucaucuccccccaccucaucuuuuauugcaaggggaaaaaaauguccguuucaagaccuuuuuc

SEQ ID NO: 543674 - RNA, 64 nt, Homo Sapiens
aauuuaugacuauuuaaaaucauauuuauuaagagaaaaaaaguuuucucauuuuuaaacagca

SEQ ID NO: 543675 - RNA, 64 nt, Homo Sapiens
cauauauugggauuuucaccaaaauaaugcuuuugaaaaaaagaaaaaaaaaacggauauauug

SEQ ID NO: 543676 - RNA, 64 nt, Homo Sapiens
gggauuuucaccaaaauaaugcuuuugaaaaaaagaaaaaaaaaacggauauauugagaaucaa

SEQ ID NO: 543677 - RNA, 64 nt, Homo Sapiens
uaguuaauaugaacacagcacagauuuguuagaagaaaaaaaauuugcuguaauaccaaaacua

SEQ ID NO: 543678 - RNA, 64 nt, Homo Sapiens
cuguaauaccaaaacuaaccucaucaaagauacagaaaaaaagaaauauagugagcccuaaagg

SEQ ID NO: 543679 - RNA, 64 nt, Homo Sapiens
aucaucgccguugaaaugaaaagagagacagagagaaaaaaaaaaagagaacccacaugaagcu

SEQ ID NO: 543680 - RNA, 64 nt, Homo Sapiens
acucauuuguguggaugcgugaccaugggaaaaagaaaaaaaaaaagauccauuuuuuagguuc

SEQ ID NO: 543681 - RNA, 64 nt, Homo Sapiens
uauuacaacuuuguacugguuguaacuugcauuagaaaaaaaagagauauauacaccacaaaga

SEQ ID NO: 543682 - RNA, 64 nt, Homo Sapiens
uguuuaaaaaaaugcaaaucauucuuuaccuuaagaaaaaaaaaauacccuuugcuuugugccu

SEQ ID NO: 543683 - RNA, 64 nt, Homo Sapiens
aaucugaacaauccuacagggaaaucagaauuaggaaaaaaaucuggagaacaauaugguugaa

SEQ ID NO: 543684 - RNA, 64 nt, Homo Sapiens
guuacagcaauccuaggaagcuaauacucugacagaaaaaaaucuuggauaauaugcaugagaa

SEQ ID NO: 543685 - RNA, 64 nt, Homo Sapiens
ccugaccccagauucaacuuugcaaacaacaggggaaaaaaauggggaaaagaaaaaccacgag

SEQ ID NO: 543686 - RNA, 64 nt, Homo Sapiens
aaaaaaauggggaaaagaaaaaccacgagagagggaaaaaaaauuauucugcaccuguaaaaaa

SEQ ID NO: 543687 - RNA, 64 nt, Homo Sapiens
ggacuugauauucauaauucagugcuguggaaaugaaaaaaaugauugaagagguggaacggaa

SEQ ID NO: 543688 - RNA, 64 nt, Homo Sapiens
gauugaagagguggaacggaaaugaccuuagggggaaaaaaaaggaccaaagaagucugauuaa

SEQ ID NO: 543689 - RNA, 64 nt, Homo Sapiens
gauuuaacuguuugauuauaacugugcaaauacagaaaaaaagaaggcuggcugaaaguugagu

SEQ ID NO: 543690 - RNA, 64 nt, Homo Sapiens
uuuagccuaaguauaagaguccuacagauggacugaaaaaaaucagucugagaguauuagucac

SEQ ID NO: 543691 - RNA, 64 nt, Homo Sapiens
auuacccaaaaacugucuuuaaaagagagagagagaaaaaaaaaauaguauuugcauaacccug

SEQ ID NO: 543692 - RNA, 64 nt, Homo Sapiens
guuuauuuuuaaagauagauccuuuuauaggugagaaaaaaacaaucuggaagaaaaaaaccac

SEQ ID NO: 543693 - RNA, 64 nt, Homo Sapiens
auccuuuuauaggugagaaaaaaacaaucuggaagaaaaaaaccacacaaagacauugauucag

SEQ ID NO: 543694 - RNA, 64 nt, Homo Sapiens
guaaguucuucaaacacccauuuuugcucuaugggaaaaaaacgauuuaccaauuaauauuacu

SEQ ID NO: 543695 - RNA, 64 nt, Homo Sapiens
agguauugcacuacauuauggaaucaugcaaaaggaaaaaaaguuucaugauaucuguuguugg

SEQ ID NO: 543696 - RNA, 64 nt, Homo Sapiens
uggcggaaucuuaaagugauacaugcuaacuguagaaaaaaauagaaaaugcacauaagcaaaa

SEQ ID NO: 543697 - RNA, 64 nt, Homo Sapiens
aauuguauaaaauuagguacuucgauuaguaaaagaaaaaaauuugaauguuuuuuuuuuuuau

SEQ ID NO: 543698 - RNA, 64 nt, Homo Sapiens
uaauauaacaauauaugauauauaaaccuuaaaugaaaaaaaugaucuauugcagauauuugau

SEQ ID NO: 543699 - RNA, 64 nt, Homo Sapiens
ucagccucauucacuguccuggcuuuuauuuaaagaaaaaaaaggcaguauucccuuuuuaaau

SEQ ID NO: 543700 - RNA, 64 nt, Homo Sapiens
uuacaauuauacuagauggaagaguauuucuucugaaaaaaaugauaagucuccagagcacaca

SEQ ID NO: 543701 - RNA, 50 nt, Homo Sapiens
aacaaauauaaaaauaggcagaaaaaaauaaugaaagcauucauacuuga

SEQ ID NO: 543702 - RNA, 64 nt, Homo Sapiens
guuaagucuuuuaaauuuuguggcucauuuaaaagaaaaaaaagauuauaaaagagcacuucug

SEQ ID NO: 543703 - RNA, 64 nt, Homo Sapiens
guugucucuugauuucuguaugcuacuuugaaaggaaaaaaaagccaaucuuuuauuguuccuu

SEQ ID NO: 543704 - RNA, 64 nt, Homo Sapiens
ggcauuaaaacuuaaccgcaauaauuauguuauugaaaaaaauuuuguauuuuaguauauuuau

SEQ ID NO: 543705 - RNA, 64 nt, Homo Sapiens
acacacacacacaacaaaaaucuuucagaaaacagaaaaaaaacgaauugauaauaaacugucc

SEQ ID NO: 543706 - RNA, 64 nt, Homo Sapiens
auuuuaugaacugcauguauaauuauucaguuaagaaaaaaauauauauauacauaacagggua

SEQ ID NO: 543707 - RNA, 64 nt, Homo Sapiens
uuuuuuuuaaauuaaaaaggucuuuguaucuggggaaaaaaaacuuuuuaugcaagggcaaaaa

SEQ ID NO: 543708 - RNA, 64 nt, Homo Sapiens
uggaucagugauuuuacuugguguguccaggaaggaaaaaaaggaaggcagggaagaaggaugu

SEQ ID NO: 543709 - RNA, 64 nt, Homo Sapiens
acuuugggagaaaauaaaauaacauuuauaggaggaaaaaaaucuacccucaguuaagcauguu

SEQ ID NO: 543710 - RNA, 64 nt, Homo Sapiens
aaauaagauaaagggucagcucaagaggcuaccugaaaaaaaaugccucugagccuacucuagu

SEQ ID NO: 543711 - RNA, 64 nt, Homo Sapiens
uguauuuuccugaagcuacaacuuaaccagaagggaaaaaaaguuugcuccaaauucuuauuuu

SEQ ID NO: 543712 - RNA, 64 nt, Homo Sapiens
accauacaaaauuuuuccacaaaaaaaaaaacaggaaaaaaagaaaaugaagaaaaacugaaga

SEQ ID NO: 543713 - RNA, 64 nt, Homo Sapiens
aaacaggaaaaaaagaaccagaagaaaaacugaagaaaaaaaaaauuuugcagcgaagagaaau

SEQ ID NO: 543714 - RNA, 64 nt, Homo Sapiens
cuuuugugauuuaauaauacgcuagaaaguuaaagaaaaaaaaaagccuuugugccacuucagu

SEQ ID NO: 543715 - RNA, 64 nt, Homo Sapiens
uggcuggucuacuaggcagcgcacaauauuuuaagaaaaaaaagguuguacagauaguuuauaa

SEQ ID NO: 543716 - RNA, 64 nt, Homo Sapiens
ugaacugagaaaggagcucuaaccuuuuauuacagaaaaaaaucuagaauugugucauuuauca

SEQ ID NO: 543717 - RNA, 64 nt, Homo Sapiens
aagacagguaaauguuauauauagcaugguaaaagaaaaaaaaaucuguaucucguaauugugu

SEQ ID NO: 543718 - RNA, 64 nt, Homo Sapiens
agcaaaaagacuaaagcccuaucagcucuuaaaagaaaaaaaaaaaguacuaggaauucagaug

SEQ ID NO: 543719 - RNA, 64 nt, Homo Sapiens
aaaauuuacuugcaaguacugguggacagaaaaggaaaaaaaaacuaggaaccaccuaauggua

SEQ ID NO: 543720 - RNA, 64 nt, Homo Sapiens
uugauguaacaauuuuuuaaacacagauuugaaggaaaaaaauuaacuguuguuugguuaaagg

SEQ ID NO: 543721 - RNA, 64 nt, Homo Sapiens
cuagugugaaguuuacaguuuuaauacuaacugggaaaaaaaaaaauuaaaaauuuucuaaaua

SEQ ID NO: 543722 - RNA, 64 nt, Homo Sapiens
aaauugaugacuuuauaaugcaaccaggaguauugaaaaaaaaguaagcaaugagcucaaauaa

SEQ ID NO: 543723 - RNA, 64 nt, Homo Sapiens
aaugcugaaaagaagagaaauaccccaaguucuugaaaaaaaauuuuuugauaugacuacucua

SEQ ID NO: 543724 - RNA, 64 nt, Homo Sapiens
ucauuauuuguuuuggauaaugaagucagcagaggaaaaaaaaauaugaccaucucaaaagaug

SEQ ID NO: 543725 - RNA, 64 nt, Homo Sapiens
uaaacaaacaaaaaaaaauuuuaaacaaagaaaggaaaaaaauugacaauaaaagucacucuuc

SEQ ID NO: 543726 - RNA, 64 nt, Homo Sapiens
aagauucuuucuucugaaagccaagcaccacaaggaaaaaaaaaauuauuaauagcucagguua

SEQ ID NO: 543727 - RNA, 64 nt, Homo Sapiens
aaagcagaaacaugacugaauugaauugguagaugaaaaaaaccugguucaaguuuuuuuuaaa

SEQ ID NO: 543728 - RNA, 64 nt, Homo Sapiens
aauuuaaaugggaagggaagaaaacaccaaauaagaaaaaaauuugccuuuaagaguuacuuuu

SEQ ID NO: 543729 - RNA, 64 nt, Homo Sapiens
agcaugugccucacuuuaagaaaguccuguaggggaaaaaaaaaacugucagagcgaauucaug

SEQ ID NO: 543730 - RNA, 64 nt, Homo Sapiens
aaacacaggaaaggggaauucugugauggcaaaugaaaaaaauguuaacauuugguagacaugu

SEQ ID NO: 543731 - RNA, 64 nt, Homo Sapiens
uuuacacguaaugagggaaguccuaggauggauagaaaaaaagcacuuacauuggggcacacag

SEQ ID NO: 543732 - RNA, 64 nt, Homo Sapiens
ggaacauauucugucuggguuuuuaaugucuguggaaaaaaacuaaacaagucucugucucagu

SEQ ID NO: 543733 - RNA, 64 nt, Homo Sapiens
gcaaaguuaagaucgaauccauccgcuuguaggggaaaaaaaggaaaaaaauuaaccagagagg

SEQ ID NO: 543734 - RNA, 64 nt, Homo Sapiens
agaucgaauccauccgcuuguaggggaaaaaaaggaaaaaaauuaaccagagagggucuguaau

SEQ ID NO: 543735 - RNA, 64 nt, Homo Sapiens
uguuguaucuuuugcauguagcuuccuuaauggagaaaaaaaaaccuaauaaauuuccagaauc

SEQ ID NO: 543736 - RNA, 64 nt, Homo Sapiens
uacuagauguacuuuuucuaaaaaggaaaggacagaaaaaaaugaagaaaggaaaggaagacaa

SEQ ID NO: 543737 - RNA, 64 nt, Homo Sapiens
aaaaagagaaaaauuuuaaaauccugcuauaggagaaaaaaagagaaaaaaauaaaaaucaaaa

SEQ ID NO: 543738 - RNA, 64 nt, Homo Sapiens
aaauuuuaaaauccugcuauaggagaaaaaaagagaaaaaaauaaaaaucaaaaaaaaaaaaaa

SEQ ID NO: 543739 - RNA, 64 nt, Homo Sapiens
ucuugaauucucuguuuaugcaaugugcucgaaagaaaaaaauguuaaaaauauaucuauaaua

SEQ ID NO: 543740 - RNA, 64 nt, Homo Sapiens
gcaccgucaguguuccuauccaauuucaaaaaaggaaaaaaaagagggaaaauuacaaaaagag

SEQ ID NO: 543741 - RNA, 64 nt, Homo Sapiens
aaggaaaaaaaagagggaaaauuacaaaaagagagaaaaaaagugaaugacguuuguuuagcca

SEQ ID NO: 543742 - RNA, 64 nt, Homo Sapiens
acuuauuacaugcugcuauacacaagcaaugcaagaaaaaaacuuacuggguaggugauucuaa

SEQ ID NO: 543743 - RNA, 64 nt, Homo Sapiens
cucuuaagucccaguauaccucauuuuucauacugaaaaaaaaagcuuguggccaauggaacag

SEQ ID NO: 543744 - RNA, 64 nt, Homo Sapiens
ccacauuuguucuuccuuccucaggguuagugaugaaaaaaaguaaauaucuuuuucauauguc

SEQ ID NO: 543745 - RNA, 64 nt, Homo Sapiens
uaaauaucuuuuucauauguccauuagaauguaugaaaaaaaucauuuuaacuaaaagcaaaag

SEQ ID NO: 543746 - RNA, 64 nt, Homo Sapiens
ugucaguggcguugggagggggagaaaaggaaaagaaaaaaaaaagaagaagaagaagaaaaga

SEQ ID NO: 543747 - RNA, 64 nt, Homo Sapiens
aaaaaaaaagaagaagaagaagaaaagagaagaagaaaaaaacgaaaacagucaaccaacccca

SEQ ID NO: 543748 - RNA, 64 nt, Homo Sapiens
auguauuaacucauacugccugucuuuuauaggggaaaaaaauaaccuuuuuuauuuuaaaguu

SEQ ID NO: 543749 - RNA, 64 nt, Homo Sapiens
ucaccagcagguuccaaauugauguguaugauaggaaaaaaaccuuaauuuuaaauauaauaua

SEQ ID NO: 543750 - RNA, 64 nt, Homo Sapiens
gccgacggaggaggaggagccuuccaaacagagagaaaaaaaugaggccgaaaauuuagaggaa

SEQ ID NO: 543751 - RNA, 64 nt, Homo Sapiens
gcuacacuguccuggcagaaaacaaaagugacgagaaaaaaaaaucaggagucagcucugacaa

SEQ ID NO: 543752 - RNA, 64 nt, Homo Sapiens
aaucaaggccaaagaaaaugaucugcuuccccuggaaaaaaaucguguuaagcuagaugaugac

SEQ ID NO: 543753 - RNA, 64 nt, Homo Sapiens
aagaaauuccaggaaaaucucaaacagaacuauggaaaaaaagggugucuugggaauuuucuuc

SEQ ID NO: 543754 - RNA, 64 nt, Homo Sapiens
uuuauagugucuugggaauucauagagacuuugugaaaaaaaaucucugugguccgaagucuuc

SEQ ID NO: 543755 - RNA, 64 nt, Homo Sapiens
acaaggcaauggaaacuauuaaaagaaaaaaauggaaaaaaauuaauauuauauuuuuucuaua

SEQ ID NO: 543756 - RNA, 64 nt, Homo Sapiens
gaaaaaaauuacaaggcaauuuuuucuauaaaaagaaaaaaaugcucuccccaaaauauuauau

SEQ ID NO: 543757 - RNA, 64 nt, Homo Sapiens
aacauugagaagugcaaaugaacuacaucuaugggaaaaaaaaaagccugaaggaaauaaguga

SEQ ID NO: 543758 - RNA, 64 nt, Homo Sapiens
gauaaaaaaacccaaacugacuuauuuuaaaaaagaaaaaaaagacaaauaagcagaaaacaua

SEQ ID NO: 543759 - RNA, 64 nt, Homo Sapiens
gucuagcgaaaaaacuccugaauaagguuaaaaagaaaaaaaaauuaggaccaaucucauuuuu

SEQ ID NO: 543760 - RNA, 64 nt, Homo Sapiens
uguucagaggucccugucuuuuuucccuucaaaggaaaaaaaaacuuuucucuucucccaaauc

SEQ ID NO: 543761 - RNA, 64 nt, Homo Sapiens
auuuuucuuuucuguuuuaugccaaaaaaagaaagaaaaaaauagagguccuucuggacuaaaa

SEQ ID NO: 543762 - RNA, 64 nt, Homo Sapiens
auagcaacucuggugagcagcacuaaacagaaaagaaaaaaaaaauaagaauuaagggguaaag

SEQ ID NO: 543763 - RNA, 64 nt, Homo Sapiens
uuaccauuaggacucaauuuaccuuuuuuuaucagaaaaaaauuuccuaacagcacuacaaagu

SEQ ID NO: 543764 - RNA, 64 nt, Homo Sapiens
ggcuucauuucugugaaauuugauuuguuuauaagaaaaaaacuaguuuugaaccaagaauugg

SEQ ID NO: 543765 - RNA, 64 nt, Homo Sapiens
caagcaagcuguuaaagaucgcauuauguagguagaaaaaaauguucuaccagaaauuuccaga

SEQ ID NO: 543766 - RNA, 64 nt, Homo Sapiens
aaacaaaacaaaaaaacauguuguuuaaaaaaacgaaaaaaacaaaauagauaacacuaaugcu

SEQ ID NO: 543767 - RNA, 64 nt, Homo Sapiens
aaaagggguguuucuauugaugcuguauuuucaggaaaaaaaaaaaaauuaguccuucaaauac

SEQ ID NO: 543768 - RNA, 64 nt, Homo Sapiens
aaagcauagacauauuuuuuaaaaaagaaaaaaagaaaaaaaagaagaaaguacuugacuaaaa

SEQ ID NO: 543769 - RNA, 64 nt, Homo Sapiens
aaaaaaagaaagcauagacagacuaaaaaaaaaagaaaaaaagaguuucuuuaagaaaguacuu

SEQ ID NO: 543770 - RNA, 64 nt, Homo Sapiens
aaaaagacucccuggaucucggaucagaggccaggaaaaaaaaacucccacugggucaccucaa

SEQ ID NO: 543771 - RNA, 64 nt, Homo Sapiens
auauauauauauauauaucuuguucuauagaaaagaaaaaaaaauguugaucuuuuaucaauaa

SEQ ID NO: 543772 - RNA, 64 nt, Homo Sapiens
gagaaacuugacugcacauuuaucauuccuagaagaaaaaaagaguagggauuuacuggcaugg

SEQ ID NO: 543773 - RNA, 64 nt, Homo Sapiens
auucuguagauagcaaauuguagagguuaaaagggaaaaaaaaaaccuccuuccugaacucuaa

SEQ ID NO: 543774 - RNA, 64 nt, Homo Sapiens
caccuuacagugcuaagaaauucuagggagaugagaaaaaaauugaaaaaccaacaaacaauag

SEQ ID NO: 543775 - RNA, 64 nt, Homo Sapiens
cacgugaccuuaugaggcucaaaaagaaaaaaaagaaaaaaaagaaaagcgaaacucugucuca

SEQ ID NO: 543776 - RNA, 64 nt, Homo Sapiens
aaaaaaaagcacgugaccuuucugucucaaaaaagaaaaaaaagcugggcaacaaaagcgaaac

SEQ ID NO: 543777 - RNA, 64 nt, Homo Sapiens
gguuucacaccucuuguuauaaagguuuugaagggaaaaaaaguugaaccuuaaaaaaaaaaaa

SEQ ID NO: 543778 - RNA, 64 nt, Homo Sapiens
aauuaaugaaccuuaaaaaagcuuuuguaaucaggaaaaaaaaaagaccaaaaaaugagguuuu

SEQ ID NO: 543779 - RNA, 64 nt, Homo Sapiens
aguccccuuuuaaaacaagcuuuuuuuccauuaagaaaaaaaaagcuuuuggcucucuguuuca

SEQ ID NO: 543780 - RNA, 64 nt, Homo Sapiens
acaguuaaaagcuuuuggcuuucauugaagaaaagaaaaaaacaucuuuucaaaaugagaggcu

SEQ ID NO: 543781 - RNA, 64 nt, Homo Sapiens
aaggcuuuacuucuuuugcacaauaaaaaaugaugaaaaaaaaaucaaacuguguauuuucuua

SEQ ID NO: 543782 - RNA, 64 nt, Homo Sapiens
cagacccugcaaaaccacauaaaaaaagaaaacagaaaaaaauugccauuuacaaaaaaaaaaa

SEQ ID NO: 543783 - RNA, 64 nt, Homo Sapiens
aguucugucuuuguggguugaccccugauuaugggaaaaaaaucaaacaaguuguauauuuuuc

SEQ ID NO: 543784 - RNA, 64 nt, Homo Sapiens
uacauaauuucuaccagggcuuuuuuuuaaagaagaaaaaaaacuaggaaauuuuuuuaauuuu

SEQ ID NO: 543785 - RNA, 64 nt, Homo Sapiens
aaggaaaaaagcaacacaauccucacuccuuuaagaaaaaaaaagugcuguauauuuuccaugc

SEQ ID NO: 543786 - RNA, 64 nt, Homo Sapiens
agcaaaccgaaguuucuucaaacacuaaaaggaugaaaaaaauugagucuuucuagaacuuuug

SEQ ID NO: 543787 - RNA, 64 nt, Homo Sapiens
uaauacauacacaugaacaauuaaaacaccuugagaaaaaaagacacugauaaacagaauacuu

SEQ ID NO: 543788 - RNA, 64 nt, Homo Sapiens
cuuagagaagaggaagagaagugauauacagagagaaaaaaagauaagaauaaaaacuaccaaa

SEQ ID NO: 543789 - RNA, 64 nt, Homo Sapiens
guguuuguauuuguauucucugcaauuuuacugugaaaaaaaauuuguuuucaacaauuggugu

SEQ ID NO: 543790 - RNA, 64 nt, Homo Sapiens
guguuuuguauuuuauagugaguugcauguuuuugaaaaaaagugcugaaaaugggaugugcug

SEQ ID NO: 543791 - RNA, 64 nt, Homo Sapiens
uaugcaauuuuaaguauacacucagcaauaauuagaaaaaaaggagagagaaaagugauuuaaa

SEQ ID NO: 543792 - RNA, 64 nt, Homo Sapiens
aaccaaagaaacaaugaucuacucaaacauuggagaaaaaaacugccagaggaggaguugccaa

SEQ ID NO: 543793 - RNA, 64 nt, Homo Sapiens
cccuaaauuacaaaugagaaaauugaagcacaaggaaaaaaauaacuaguuugaaauauuuuga

SEQ ID NO: 543794 - RNA, 64 nt, Homo Sapiens
caccaaacauugaugcuuaaggaccacacugaaggaaaaaaaaagaggggacuucgaaaaaaaa

SEQ ID NO: 543795 - RNA, 64 nt, Homo Sapiens
gaccacacugaaggaaaaaaaaagaggggacuucgaaaaaaaaaaaagcccugcaaaauauucu

SEQ ID NO: 543796 - RNA, 64 nt, Homo Sapiens
aauaauaauaauaauaauaaugaugauacucuaagaaaaaaaucucaacauacuucauuuaaua

SEQ ID NO: 543797 - RNA, 64 nt, Homo Sapiens
ccugggugaaaaagacaggcugugucuccaaaaagaaaaaaaaaagucaaauucaaauaucauc

SEQ ID NO: 543798 - RNA, 64 nt, Homo Sapiens
gaaacgacccuguggcugugagaaagugaaaaaagaaaaaaaaaaaggcauuggcauuuucuug

SEQ ID NO: 543799 - RNA, 64 nt, Homo Sapiens
auuaggacagaauuaaugaugcuuaaagagaaaagaaaaaaagagagaagaaaaaggagagaug

SEQ ID NO: 543800 - RNA, 64 nt, Homo Sapiens
acuuucaaugugaggaaugaaugauaaauuaagagaaaaaaauaucaggaaggucaauauaugc

SEQ ID NO: 543801 - RNA, 64 nt, Homo Sapiens
uaucagugucaaaagcccaagaaaagacaaaaaagaaaaaaacaauccccagggguucuaugac

SEQ ID NO: 543802 - RNA, 64 nt, Homo Sapiens
guuggauuaaaggguuguaacugacuacagcauggaaaaaaauaguucuuuuaauucuuucacc

SEQ ID NO: 543803 - RNA, 64 nt, Homo Sapiens
cuagaugcaccaaccguaucauuauuuguuugaggaaaaaaagaaaucugcauuuuaauucaug

SEQ ID NO: 543804 - RNA, 64 nt, Homo Sapiens
ccuccuacccagcaaaccaguagacccaaaaguugaaaaaaacugaugacagacaacaagcaug

SEQ ID NO: 543805 - RNA, 64 nt, Homo Sapiens
auauuuggagcuuuauagccuguauuccuugggagaaaaaaaugggaauuggaguaaaaagugu

SEQ ID NO: 543806 - RNA, 64 nt, Homo Sapiens
uguacugcuuguucaagagguuuugucuuuuggagaaaaaaaacucacugaggaugaaacugac

SEQ ID NO: 543807 - RNA, 64 nt, Homo Sapiens
uuaagucuguagucuuuaugauuauauggaaaaagaaaaaaagcgauauuuagaaauuuugugu

SEQ ID NO: 543808 - RNA, 64 nt, Homo Sapiens
agaaaaaacgaugcaucaagaaacaaggaaaagggaaaaaaaggcaacacagugcaucuuuuua

SEQ ID NO: 543809 - RNA, 64 nt, Homo Sapiens
aaagcaaaugaguguuuucacaacugguguuggagaaaaaaagauagagauugauaagauuuag

SEQ ID NO: 543810 - RNA, 64 nt, Homo Sapiens
auuauguuuagaggucuaauaaauuuuuguagaugaaaaaaauccaaauuuucuaguauaacag

SEQ ID NO: 543811 - RNA, 64 nt, Homo Sapiens
ucuucugcaaauuuucuaguauuuaaugucacaagaaaaaaauguucaacuguaaauaauguac

SEQ ID NO: 543812 - RNA, 64 nt, Homo Sapiens
cauauguguauuagggugacggaaaaaaaaaaaagaaaaaaaacaaaaaaaaaaaaaaaaaaaa

SEQ ID NO: 543813 - RNA, 64 nt, Homo Sapiens
aaagaaaaaaaaccauauguaaaaaaaaaaaaaggaaaaaaaaagacuccgucucaaaaaaaaa

SEQ ID NO: 543814 - RNA, 64 nt, Homo Sapiens
caggcugggcgcgguggcucuuuucuucuaugaagaaaaaaauguuugggaaguuuuacuuuug

SEQ ID NO: 543815 - RNA, 64 nt, Homo Sapiens
gccacuaaggucaguguuauauauuuugaaaggagaaaaaaaaauuuaaaacuuacuaugguau

SEQ ID NO: 543816 - RNA, 64 nt, Homo Sapiens
aauaugagauuggaaaaaauuuuucaccuaucuggaaaaaaaaauggaaggcacacugagcaag

SEQ ID NO: 543817 - RNA, 64 nt, Homo Sapiens
aaugcaagagugauuuucugcauagaggauucuugaaaaaaaaaacgaaugaacuuguaggggg

SEQ ID NO: 543818 - RNA, 64 nt, Homo Sapiens
aaguccuuuuaagggaacuucaugggaaaguucagaaaaaaauacuuugcagucagacauucgu

SEQ ID NO: 543819 - RNA, 64 nt, Homo Sapiens
uacuaaaaaaaguguguauuaggaggagagagaggaaaaaaagaggaaagaaggaaaaaaaaaa

SEQ ID NO: 543820 - RNA, 64 nt, Homo Sapiens
uaggaggagagagaggaaaaaaagaggaaagaaggaaaaaaaaaagaauuaaaaaaaaaaaaaa

SEQ ID NO: 543821 - RNA, 64 nt, Homo Sapiens
aaaaaaaaaagaaaaacagaagaugaccuugauggaaaaaaaauauuuuuuaaaaaaaagauau

SEQ ID NO: 543822 - RNA, 52 nt, Homo Sapiens
ccaugaggacagugaucugauugaaaaaaaacgacagucuggggaagcgauc

SEQ ID NO: 543823 - RNA, 64 nt, Homo Sapiens
ccaugcaacuaugagucucuaaaucucucuguaagaaaaaaauuucaaaguaaagauuuuacuc

SEQ ID NO: 543824 - RNA, 64 nt, Homo Sapiens
uauagcuuacucuaccugcagacagaaaaugaaagaaaaaaauggacuugccuagaauaauaua

SEQ ID NO: 543825 - RNA, 64 nt, Homo Sapiens
cuugcauccagaaaggccagauuuuaccuaccaagaaaaaaagauauuuuuccagagaguuagg

SEQ ID NO: 543826 - RNA, 64 nt, Homo Sapiens
uuaauaccagaccaaagacauuuucuguuuccuggaaaaaaaaaaugaaucauguuaggcuuua

SEQ ID NO: 543827 - RNA, 64 nt, Homo Sapiens
aauuaguaggcuccugcugccaaaaugcaaaggggaaaaaaaggcagggauugggggggauggg

SEQ ID NO: 543828 - RNA, 64 nt, Homo Sapiens
uguuaaaacaugaaaaugcuggugagcugagguagaaaaaaaacaagaaaaaaauuuuaaaaau

SEQ ID NO: 543829 - RNA, 64 nt, Homo Sapiens
aaaaugcuggugagcugagguagaaaaaaaacaagaaaaaaauuuuaaaaauagcguuaaaaug

SEQ ID NO: 543830 - RNA, 64 nt, Homo Sapiens
acuacaacaacaaaaaaagaaaaaaguuaaaaaagaaaaaaacaccaaaaaacaaaaacaaaca

SEQ ID NO: 543831 - RNA, 64 nt, Homo Sapiens
uuauuuuuuugauaaugacuggacaucagaagaggaaaaaaacucaaaacaaaagcgagagaga

SEQ ID NO: 543832 - RNA, 64 nt, Homo Sapiens
agaaugaagucaaacugugccacacauggugaaugaaaaaaaaaaaaagaggcuguguuuuguc

SEQ ID NO: 543833 - RNA, 64 nt, Homo Sapiens
gucuccaagcuuuugugauuguauauuccuauaggaaaaaaagaauugauuaugcauacccagu

SEQ ID NO: 543834 - RNA, 64 nt, Homo Sapiens
agagcuauagaaauccuuguaaaaaugaaaaaaagaaaaaaaaaugaacucuggaaaaaaaaaa

SEQ ID NO: 543835 - RNA, 64 nt, Homo Sapiens
aaaaaaaaagagcuauagaaaaaaaaaaaaaaaugaaaaaaagacaucugguugaacucuggaa

SEQ ID NO: 543836 - RNA, 64 nt, Homo Sapiens
aaaaaaugaaaaaaagaaaacugguugaacucuggaaaaaaaaauaaaaagauuacagcgucau

SEQ ID NO: 543837 - RNA, 64 nt, Homo Sapiens
aaugugucaugugaggcaaugucuuucucugagggaaaaaaaaaaaauuuauccuaaacagaug

SEQ ID NO: 543838 - RNA, 64 nt, Homo Sapiens
cucaaauaaaacaugagauaaaaaaagaaaaaacgaaaaaaaauuuuguacagugucaauuugu

SEQ ID NO: 543839 - RNA, 64 nt, Homo Sapiens
caaaaaaaacaaaaucuaggaccaaauuguuuaagaaaaaaaaauauaucaaaggugcaucgug

SEQ ID NO: 543840 - RNA, 64 nt, Homo Sapiens
uggaaauuccuaauguccugcuacaaaugcuacugaaaaaaaucauuuguuaccaaaagugguu

SEQ ID NO: 543841 - RNA, 64 nt, Homo Sapiens
cugucauuuccuuauaaguuuuauaguaaaggaagaaaaaaagaugcuaagcuguuaaauguau

SEQ ID NO: 543842 - RNA, 64 nt, Homo Sapiens
cuuuuuguaacgacuauuuggaauuuauuuaaaagaaaaaaaaacuauuucucuuucuuugugu

SEQ ID NO: 543843 - RNA, 64 nt, Homo Sapiens
aaaagagaaacccuuugacuagcuucuaaaaggggaaaaaaaaagaaaacaacuuuuuauguau

SEQ ID NO: 543844 - RNA, 64 nt, Homo Sapiens
ggaaagauuaacuauuugcaccaccagacaaauggaaaaaaagaauagaaaaaguauuuuuucu

SEQ ID NO: 543845 - RNA, 64 nt, Homo Sapiens
uuacguuaaaaaccaaaaaauuuucugcaaaaaagaaaaaaaagagugacaguuuacaaaauua

SEQ ID NO: 543846 - RNA, 64 nt, Homo Sapiens
aaaguugaaaauacauucuuaaauaaaauggauagaaaaaaacuuuaauaacugaauaaaaaau

SEQ ID NO: 543847 - RNA, 64 nt, Homo Sapiens
uacuuaaauauuuguaauugaggggugauugaaagaaaaaaaaauaugcuccuagagaggagaa

SEQ ID NO: 543848 - RNA, 64 nt, Homo Sapiens
acaaaaacaaacuuuuuuuaaaaaaagaaaaagagaaaaaaaucgcauggauuccuuugaagaa

SEQ ID NO: 543849 - RNA, 64 nt, Homo Sapiens
aaaaagagaaaaaaaucacauggauuccuuugaagaaaaaaaagaauuucugauccacaaugca

SEQ ID NO: 543850 - RNA, 64 nt, Homo Sapiens
aaaaaacuagaaagcuacgguauuugauccaagugaaaaaaaaacuuuuucugucuaucaaaac

SEQ ID NO: 543851 - RNA, 64 nt, Homo Sapiens
aaaagcauauauauauauaauaagguugcucucagaaaaaaaaaagauaaaugugaagucugag

SEQ ID NO: 543852 - RNA, 64 nt, Homo Sapiens
guuuucaguuaaacacuacaccaacagaaaaaaggaaaaaaauuuaaugcauaaugcuuucuca

SEQ ID NO: 543853 - RNA, 64 nt, Homo Sapiens
aaagggcuucagucucauggcuugcucucuaugggaaaaaaacaugcuugcugccuuuaauugu

SEQ ID NO: 543854 - RNA, 64 nt, Homo Sapiens
ugguuuggccuugcugcuguugcuuaacagagaggaaaaaaauguaccucauuucaagaaaaua

SEQ ID NO: 543855 - RNA, 64 nt, Homo Sapiens
aucacucuauguugccccacaucugucaauuaaggaaaaaaaaaagcuuguugaaauguuuugc

SEQ ID NO: 543856 - RNA, 64 nt, Homo Sapiens
aaaacuucuuuaggcauuugcaucuuuggaaaaggaaaaaaaaaauaaacuagcucauuauuuc

SEQ ID NO: 543857 - RNA, 64 nt, Homo Sapiens
aguuuuuguaaagaugucagauuuguguugaguggaaaaaaaucagcagaccagaugggaaauu

SEQ ID NO: 543858 - RNA, 64 nt, Homo Sapiens
acaaaaacaaacaggcugccuuuggaaauaaaaagaaaaaaaaauguaccuuuuuguuagugaa

SEQ ID NO: 543859 - RNA, 64 nt, Homo Sapiens
aaaucacauuucugaccuguguuauugcuuugcagaaaaaaaaagaaaaaaagugcuuaauauu

SEQ ID NO: 543860 - RNA, 64 nt, Homo Sapiens
gcuuaauauuguuauugcuuagaaaaaguauguagaaaaaaaguaggggauugcuacaccaugu

SEQ ID NO: 543861 - RNA, 64 nt, Homo Sapiens
acccuuuucuuuuccuugaaauuuuacaaaacaagaaaaaaaauauaaucgagaaugccugggc

SEQ ID NO: 543862 - RNA, 64 nt, Homo Sapiens
guauccagaaaagcuuuaagcaguuaaagaaacagaaaaaaaccgacacuuugucgacacugaa

SEQ ID NO: 543863 - RNA, 64 nt, Homo Sapiens
guuauuagaagaaaaguacuguacugaaaauucagaaaaaaaaucucaaccuuaugccaaaaug

SEQ ID NO: 543864 - RNA, 64 nt, Homo Sapiens
uggugacagagcaagacuccgucuccaaaaaaaagaaaaaaaaauuucuugaaguggaaugaug

SEQ ID NO: 543865 - RNA, 64 nt, Homo Sapiens
ugaauugguacuugggagacuucuguucuuuguugaaaaaaauugccuuuguuuugaaauuaua

SEQ ID NO: 543866 - RNA, 64 nt, Homo Sapiens
uaaaccuaaaacuguucuaaaauagaaagucugugaaaaaaaacaaaaguaaaguuauaaaagg

SEQ ID NO: 543867 - RNA, 64 nt, Homo Sapiens
auuuuauaaaaugaauuuuguaauuuuuuucugagaaaaaaaaguucuuaaauacaauaaaauu

SEQ ID NO: 543868 - RNA, 64 nt, Homo Sapiens
caguuauuggugagucuaaggauccaaggcuacagaaaaaaaagaaauauaacaggaauuaaug

SEQ ID NO: 543869 - RNA, 64 nt, Homo Sapiens
cacugaagaugaaaagauaggacggaugugauaugaaaaaaacccaaacauuuuggcauugaau

SEQ ID NO: 543870 - RNA, 64 nt, Homo Sapiens
augcuuacuguauacuuguuucauacuauucuuugaaaaaaaaguacuugaaauauuuucauua

SEQ ID NO: 543871 - RNA, 64 nt, Homo Sapiens
guguuuuuguaggcaaaaagaaguuccucaguaagaaaaaaaauaauugaauaguacccaauua

SEQ ID NO: 543872 - RNA, 64 nt, Homo Sapiens
agaauguuuuugcuaguaucuguuuaccucaauugaaaaaaaaauucauguuagauauucuaug

SEQ ID NO: 543873 - RNA, 64 nt, Homo Sapiens
uauauccuuguuuuccacacauaguuuuagaagagaaaaaaaaaacgccguuauguugccucaa

SEQ ID NO: 543874 - RNA, 64 nt, Homo Sapiens
aauguacagauuguaaaguuauauagaaaugcaagaaaaaaacauuucugucucaaaauguaua

SEQ ID NO: 543875 - RNA, 64 nt, Homo Sapiens
aaaaaggcuuuggcuuaucaaucacagaaaucuggaaaaaaaaaagcaacauggggcuaguggg

SEQ ID NO: 543876 - RNA, 64 nt, Homo Sapiens
gcuuuuguauguagaacaggaaaugauucuuacggaaaaaaauuuggacuuauuucuccccagg

SEQ ID NO: 543877 - RNA, 64 nt, Homo Sapiens
aaaacaaaaccccuuuacucgaugaaagugaccagaaaaaaacagguauuucucccacagaaau

SEQ ID NO: 543878 - RNA, 64 nt, Homo Sapiens
cagguucuagaugggugaauuauguugagaaguggaaaaaaaccaauguuuccauguucccaac

SEQ ID NO: 543879 - RNA, 64 nt, Homo Sapiens
aaagcaaggauacuaagaaacgucugagaaaucugaaaaaaaagcaaaaaagaagagaaaagau

SEQ ID NO: 543880 - RNA, 64 nt, Homo Sapiens
aaaccuugcagcauuuuuauuuaaaagaaaagaagaaaaaaaacacccaaccacacaaagaaca

SEQ ID NO: 543881 - RNA, 64 nt, Homo Sapiens
acauuuggaaucaguagcagagcaaagccucuuugaaaaaaaccacguagcugauuggguuuua

SEQ ID NO: 543882 - RNA, 64 nt, Homo Sapiens
caacucuaaaaaaaaaaaaaauacaaauaaaaaggaaaaaaaauuacauuuuuuaucuuauacc

SEQ ID NO: 543883 - RNA, 64 nt, Homo Sapiens
ggcuuaggggauuggaacugggguuuggcugaaagaaaaaaaaaaaaauguaacugaugaaucu

SEQ ID NO: 543884 - RNA, 64 nt, Homo Sapiens
gcaguauucagcuucuuaaccagucgcuauuuaggaaaaaaaacccacuaguuaggccaucaac

SEQ ID NO: 543885 - RNA, 64 nt, Homo Sapiens
uuuuguuucuguuguuguucaaaugcaaaaaaaagaaaaaaaaagaaaaaaaaaggugacucac

SEQ ID NO: 543886 - RNA, 64 nt, Homo Sapiens
guuguuguucaaaugcaaaaaaaagaaaaaaaaagaaaaaaaaaggugacucacauuguuacac

SEQ ID NO: 543887 - RNA, 64 nt, Homo Sapiens
uucuuguuuacagauuuuuuuguuuguuuuuugagaaaaaaaaauguuuacucuuccaucauuu

SEQ ID NO: 543888 - RNA, 64 nt, Homo Sapiens
aaaaaaaaaaaaaauuccuuguaguuucuuagaggaaaaaaagaaaaaccccaacuuuuagcac

SEQ ID NO: 543889 - RNA, 64 nt, Homo Sapiens
uuucagcucccuucccuugagaugaguuucuggggaaaaaaaagagacugguuagugaugcagu

SEQ ID NO: 543890 - RNA, 64 nt, Homo Sapiens
ugaaauagcuuuacuguuucucaaguguuuuggagaaaaaaaucaacccugcaaucacuuuuug

SEQ ID NO: 543891 - RNA, 64 nt, Homo Sapiens
uuuuuuaaaggaaacaaacagacaacaaaaagaagaaaaaaaaaaagaaccuccuuggaaaaau

SEQ ID NO: 543892 - RNA, 64 nt, Homo Sapiens
acccccccacuaugcccucauuuuuuuaaaaaaggaaaaaaaaaagaaacuggguuccagucuu

SEQ ID NO: 543893 - RNA, 64 nt, Homo Sapiens
aaaaaaauaaauaaaaauaaaaaaaauaaaaaaggaaaaaaaaaaaagaagaaacaagacaugc

SEQ ID NO: 543894 - RNA, 64 nt, Homo Sapiens
cagcucuucuagaauuguuuaaacccuuaccaaggaaaaaaaagggauguuaccaacugagauc

SEQ ID NO: 543895 - RNA, 64 nt, Homo Sapiens
caguaagauuccuguaagaaauacugcuuuuuaagaaaaaaaauaacaugcugaggggugaccu

SEQ ID NO: 543896 - RNA, 64 nt, Homo Sapiens
accccaucguucccuacuccuucugaaaugaagggaaaaaaaccacuacaguagaagaacuuac

SEQ ID NO: 543897 - RNA, 64 nt, Homo Sapiens
aaccccacucagaaacagaguguguacaauccaggaaaaaaacacuccauuccaccugacccug

SEQ ID NO: 543898 - RNA, 64 nt, Homo Sapiens
aaaaaaaauucccuggcuauuguauuuuaaagaagaaaaaaaacuuuucucuuuacacuucgua

SEQ ID NO: 543899 - RNA, 64 nt, Homo Sapiens
uguacauuuaguuaaacaagcaaucauggaauuggaaaaaaagacgucgcauaagcacucuugu

SEQ ID NO: 543900 - RNA, 64 nt, Homo Sapiens
uuauuuuguauugaaacuuuuaaacaauacugaagaaaaaaaaacuuuuccgacaucuguucuu

SEQ ID NO: 543901 - RNA, 64 nt, Homo Sapiens
uuauacaaaaaucuagaaauaauagauuuguacagaaaaaaaugauaauaaaugagaacacaaa

SEQ ID NO: 543902 - RNA, 64 nt, Homo Sapiens
uuuucuuuuagaaauaauguauugugucugugcagaaaaaaaaaaaaccaaaaaggauugcuuu

SEQ ID NO: 543903 - RNA, 64 nt, Homo Sapiens
ucuguauauuuuuuuaaaaaucugguaguuucuggaaaaaaaagagaaggggguuuguaguacu

SEQ ID NO: 543904 - RNA, 64 nt, Homo Sapiens
aaauugauguuacuguauauaacuauggaauuuugaaaaaaaauuucaaaaagaaaaaaauaua

SEQ ID NO: 543905 - RNA, 64 nt, Homo Sapiens
auaacuauggaauuuugaaaaaaaauuucaaaaagaaaaaaauauauauaauuuaaaacuacuu

SEQ ID NO: 543906 - RNA, 64 nt, Homo Sapiens
auuuacacuaauuuuuuuaucuuuauugcuaccagaaaaaaaugcgaacgaaugcauugcuuug

SEQ ID NO: 543907 - RNA, 64 nt, Homo Sapiens
ugcuuugauaucugguucagacuaucaucaggaagaaaaaaaaaucccacaguaccugaaaugu

SEQ ID NO: 543908 - RNA, 64 nt, Homo Sapiens
cuugaaauaauugacuugucuaaaaggacaaagagaaaaaaaaaauaccucaugacugcauucu

SEQ ID NO: 543909 - RNA, 64 nt, Homo Sapiens
gaguagaguguugguuuuuccauaacuacagggggaaaaaaagucauuaggcuuucccuuugug

SEQ ID NO: 543910 - RNA, 64 nt, Homo Sapiens
aguaacccagcugcaauaccugucuguaauaugagaaaaaaaaaaugaaucuauuuaaucauuu

SEQ ID NO: 543911 - RNA, 64 nt, Homo Sapiens
cauuucaucauugucccgggccugcauugcacuggaaaaaaaaaucgccaccuguucuuacacc

SEQ ID NO: 543912 - RNA, 64 nt, Homo Sapiens
uuccuuauauuuuuuuccucaacaguuuuaaaaagaaaaaaaggucuauuuuuuuuucuccuau

SEQ ID NO: 543913 - RNA, 64 nt, Homo Sapiens
aaaaagcauuauacuguggguaaugaaaagggaggaaaaaaaaagaaggaaaaggaauuauaga

SEQ ID NO: 543914 - RNA, 64 nt, Homo Sapiens
gaauuugucagcuggaacucagaaacaacaacuugaaaaaaaaauaauaauuagaacauauuug

SEQ ID NO: 543915 - RNA, 64 nt, Homo Sapiens
cuauuguggcagaagcgagaaaacuuuguuuauugaaaaaaaaagaaaaagaaagcaagaaaaa

SEQ ID NO: 543916 - RNA, 64 nt, Homo Sapiens
uuuguuuauugaaaaaaaaagaaaaagaaagcaagaaaaaaagauacuauggggucaaguguaa

SEQ ID NO: 543917 - RNA, 64 nt, Homo Sapiens
ugucaguuuugagggggacauguguuaaaucacagaaaaaaauggugccuucuucugcguuugu

SEQ ID NO: 543918 - RNA, 64 nt, Homo Sapiens
aaggaaggacagaggguuuugauuuuaaaaagaagaaaaaaaaaccuuauuuuuucuuucuugg

SEQ ID NO: 543919 - RNA, 64 nt, Homo Sapiens
ggagggaaaucuuucaacuuauuucugaaaaagagaaaaaaauauaaaauuucuggugcacagg

SEQ ID NO: 543920 - RNA, 64 nt, Homo Sapiens
cuuuuucacucugugucuaauaauguuaaggugggaaaaaaaaaaguguggcauagcuaccugc

SEQ ID NO: 543921 - RNA, 64 nt, Homo Sapiens
agacccaauauuggcaaagaagcaaaccauaacagaaaaaaauagcuggaagcauuuuucccuu

SEQ ID NO: 543922 - RNA, 64 nt, Homo Sapiens
augcuucauuaguaauuaaaauggauaaaaccaugaaaaaaaguaauucauaaaagaaaucuga

SEQ ID NO: 543923 - RNA, 64 nt, Homo Sapiens
aaaacccuggaaaauagaaaaaaaaucccuccuggaaaaaaaaaaaauaacaaaagaggaaaaa

SEQ ID NO: 543924 - RNA, 64 nt, Homo Sapiens
aucccuccuggaaaaaaaaaaaauaacaaaagaggaaaaaaaaaggcgagcaagccuuuuugaa

SEQ ID NO: 543925 - RNA, 64 nt, Homo Sapiens
uacaaccaaaugccagucagagugaagagauaaagaaaaaaaagaaauugauaguuguucuagc

SEQ ID NO: 543926 - RNA, 64 nt, Homo Sapiens
uagaucugaaugcugaucccggacucccagcacagaaaaaaaggggaaacauguaaugauaggc

SEQ ID NO: 543927 - RNA, 64 nt, Homo Sapiens
aaaaaaaaaguuacagaaugaagaaggaaaaauugaaaaaaauaacuagugcuuaaaaaaaaaa

SEQ ID NO: 543928 - RNA, 64 nt, Homo Sapiens
accuuguauuuuguaaauauaaaaacaaaaaauggaaaaaaaaauuagcauugaaaaaaaaaac

SEQ ID NO: 543929 - RNA, 64 nt, Homo Sapiens
acaaaaacaaaaaauggaaaacccuuuuagcauugaaaaaaaaaaagguugaaaauucugaaua

SEQ ID NO: 543930 - RNA, 64 nt, Homo Sapiens
uaagcugucugccacauugaguugggugagaggggaaaaaaaucaguuuucuuuuaacaugcau

SEQ ID NO: 543931 - RNA, 64 nt, Homo Sapiens
accccuaaauaaaacuauuucagaaagccugaaagaaaaaaaauuuuuuaaaaaauucauuuug

SEQ ID NO: 543932 - RNA, 64 nt, Homo Sapiens
cccuuucuuguaaacuuacgaaaagaaaaaaaaagaaaaaaaauaaacuuugcuaguuaaaaaa

SEQ ID NO: 543933 - RNA, 64 nt, Homo Sapiens
gaaaaaaaaucccuuucuugaguuaaaaaaaaaagaaaaaaaaaaguauaauagaaacuuugcu

SEQ ID NO: 543934 - RNA, 64 nt, Homo Sapiens
aagcaagaagaccauuugacaaaacugucuuuuagaaaaaaaacaagagcugcagaguauuuau

SEQ ID NO: 543935 - RNA, 64 nt, Homo Sapiens
gcacaugacuuuacauaaugacuuucuagacucugaaaaaaaugcuuuuaucauuuuugcaauu

SEQ ID NO: 543936 - RNA, 64 nt, Homo Sapiens
uagagggaacuaacauuuuaggaaugcuuauucagaaaaaaauccuagaguugauucauuguuu

SEQ ID NO: 543937 - RNA, 64 nt, Homo Sapiens
auacaguauaaacuaccucacuugccuuucuugggaaaaaaaaaaugaauggacuuuaacaauu

SEQ ID NO: 543938 - RNA, 64 nt, Homo Sapiens
auguauguugcauuuuauccauaagaaauaaagagaaaaaaacuaaaaacauuguaugagaauu

SEQ ID NO: 543939 - RNA, 64 nt, Homo Sapiens
uuuuuucaucucacaguaaagccuauuuccccaggaaaaaaauaaaugccuuugaaugaaaauu

SEQ ID NO: 543940 - RNA, 64 nt, Homo Sapiens
gguauuaaagauauucugaagcucugaaaugcuagaaaaaaauuuggaauggaguauaugccug

SEQ ID NO: 543941 - RNA, 64 nt, Homo Sapiens
cugguggacucccaauugacaagauugagcaauagaaaaaaauuccuuuccuuugaaugauagc

SEQ ID NO: 543942 - RNA, 64 nt, Homo Sapiens
uugugacucguuggccauuauuugauuuuuguacgaaaaaaagcuuuguuauagaaaucagcau

SEQ ID NO: 543943 - RNA, 64 nt, Homo Sapiens
agauuuguagugcauagguguguguuucaagaaggaaaaaaaaagacuucuguucaaaguuaac

SEQ ID NO: 543944 - RNA, 64 nt, Homo Sapiens
uauuauacacuguacauuuuuuucacagcaauuggaaaaaaacaaccacuugcaaucauucaau

SEQ ID NO: 543945 - RNA, 64 nt, Homo Sapiens
aagaaagggcauuuuuacuuuugaaccaaaaagagaaaaaaaaaucagaaguguugcaucuuga

SEQ ID NO: 543946 - RNA, 64 nt, Homo Sapiens
cagaaauauucugagaccaaauuuacaaaaaaacgaaaaaaauaaggauugacugggcuaccuc

SEQ ID NO: 543947 - RNA, 64 nt, Homo Sapiens
cuccgaaaaucaugguaaagaauacugagacaaugaaaaaaaaucaacaaaauaugcuuucugg

SEQ ID NO: 543948 - RNA, 64 nt, Homo Sapiens
gcuuuuauuuuccuuggggugcugaaauugagcugaaaaaaaaaggcucuuugaauauaguuuu

SEQ ID NO: 543949 - RNA, 64 nt, Homo Sapiens
augagagaaaaggaaaaaggaaucaaagguggaagaaaaaaaaagccaaauucuguuuacggug

SEQ ID NO: 543950 - RNA, 64 nt, Homo Sapiens
cuagagcgauuucagcugauagaaaaacaaaaaugaaaaaaaaaacacaaaaaacaaaaaacau

SEQ ID NO: 543951 - RNA, 64 nt, Homo Sapiens
uuccauuuugaggaauggggaaggcuauucuaaagaaaaaaaugggauuuguuuucucggcaga

SEQ ID NO: 543952 - RNA, 64 nt, Homo Sapiens
cuaagaauaucaaguauuucucuggcucuugacagaaaaaaaucaguugacuuaacccuuugcu

SEQ ID NO: 543953 - RNA, 64 nt, Homo Sapiens
gaggacuguaauugcauuucugugccuuucacuugaaaaaaaaaaaagaagaaaaaaaggcuua

SEQ ID NO: 543954 - RNA, 64 nt, Homo Sapiens
uuucugugccuuucacuugaaaaaaaaaaaagaagaaaaaaaggcuuaaaggcauuucauucag

SEQ ID NO: 543955 - RNA, 64 nt, Homo Sapiens
gcugaccuuucuauagcgugcugcauugguaaaugaaaaaaaauggggcaaacguuggaguccu

SEQ ID NO: 543956 - RNA, 64 nt, Homo Sapiens
aucuaaagaaucauugucuuucagagacucauaggaaaaaaaaacuaggaaaagugucaccgca

SEQ ID NO: 543957 - RNA, 64 nt, Homo Sapiens
acaaagcaagcguaagauugaggcaugaaguucagaaaaaaaaguguuacaacacacagggaag

SEQ ID NO: 543958 - RNA, 64 nt, Homo Sapiens
auuugcagucuacauuuuaaagccaauuuauuuagaaaaaaaaauuugagcuuuaauucuuuaa

SEQ ID NO: 543959 - RNA, 64 nt, Homo Sapiens
uuugccuugaauggaaccuacuaaaaagagagaugaaaaaaaaucagcgagguugauguagaua

SEQ ID NO: 543960 - RNA, 64 nt, Homo Sapiens
ugacagcuaguguuuuuuacgaaaaccaauuacugaaaaaaaauauugaaaaaaaaaaagcacu

SEQ ID NO: 543961 - RNA, 64 nt, Homo Sapiens
aagcacugaaaaccaauuaccuucucaucagauugaaaaaaaaacuccuuucuaauugcaucac

SEQ ID NO: 543962 - RNA, 64 nt, Homo Sapiens
uauuuuauguuauauauaaaugagauuuauuaaagaaaaaaaugaggacuccugaaaaaaaacc

SEQ ID NO: 543963 - RNA, 64 nt, Homo Sapiens
cugagauuuauuaaagaaaagagaaaggacuccugaaaaaaaacagcauuguagugcuuugaga

SEQ ID NO: 543964 - RNA, 64 nt, Homo Sapiens
caaggcugauuuugaagagaaguuugcucauuaagaaaaaaagaaaaggcugaugaugguauaa

SEQ ID NO: 543965 - RNA, 64 nt, Homo Sapiens
accagcuaaaauuuucgacuaaaaaaaaaaaaaggaaaaaaaagcugcuguaauauuuuuguaa

SEQ ID NO: 543966 - RNA, 64 nt, Homo Sapiens
guaaagcucagugugaaugcaaagaccuuaauaggaaaaaaagauugaucauuaccuguaaaug

SEQ ID NO: 543967 - RNA, 64 nt, Homo Sapiens
cuugugauugacuuucgcaagccuagauaauggggaaaaaaaguaucauaaaauuuucauauau

SEQ ID NO: 543968 - RNA, 64 nt, Homo Sapiens
guuuuguuuuguuuucauuuuuccaaaaaaaaaagaaaaaaaaauagaaaaaaaaggaguaaaa

SEQ ID NO: 543969 - RNA, 64 nt, Homo Sapiens
uuucauuuuuccaaaaaaaaaagaaaaaaaaauagaaaaaaaaggaguaaaaggggcggguuug

SEQ ID NO: 543970 - RNA, 64 nt, Homo Sapiens
cuggcgugaguuucauguaugaaaacauaaaauugaaaaaaaaaaaaaaaccuacacgagcacc

SEQ ID NO: 543971 - RNA, 64 nt, Homo Sapiens
agggcaacaggagauguggggacguguuaggagagaaaaaaaaaaaaacaaaaauauauauggg

SEQ ID NO: 543972 - RNA, 64 nt, Homo Sapiens
agaguuuuccuaucuuuguauguuaagagauuaagaaaaaaaaauucuauuuuuguuguaaugu

SEQ ID NO: 543973 - RNA, 64 nt, Homo Sapiens
ccagccugggcaacaagaguggcacuccaucucagaaaaaaaaaaaaaagauaauucauacuga

SEQ ID NO: 543974 - RNA, 64 nt, Homo Sapiens
ucacaccuuauugcacaggagagcauuuauacuugaaaaaaauuguacaaauauaaagaccaug

SEQ ID NO: 543975 - RNA, 64 nt, Homo Sapiens
ucacagguuagucagucuaagaauauuuauacaggaaaaaaaucaccccaaauaaaauaaauau

SEQ ID NO: 543976 - RNA, 64 nt, Homo Sapiens
uuuuggaaaauucuuacuugugaauguuaaaaaugaaaaaaaaaucauuuauuauauuuugccu

SEQ ID NO: 543977 - RNA, 64 nt, Homo Sapiens
aaacagcuuucccucaucauaauguagauaaaaagaaaaaaaggauaugguuaccuguaaucuu

SEQ ID NO: 543978 - RNA, 64 nt, Homo Sapiens
uugggcucugucucuuucuacccugcguuaagcggaaaaaaaaaauucugacaguguuuuucuu

SEQ ID NO: 543979 - RNA, 64 nt, Homo Sapiens
auuuguaaggcuuagaugagauaguguuuuuuuagaaaaaaacuuuaucuuaccauuaaguaaa

SEQ ID NO: 543980 - RNA, 64 nt, Homo Sapiens
ucaaaagaauacauacauguggcaauaagcauaugaaaaaaaugguuaauaucgcuaaucauua

SEQ ID NO: 543981 - RNA, 64 nt, Homo Sapiens
uguacacauacuccuugaaccuaaaauaaaacaugaaaaaaagcaaauuucacaccuuguaaaa

SEQ ID NO: 543982 - RNA, 64 nt, Homo Sapiens
gaaaaggugaaaguucucaacuuaaaaaagaaaagaaaaaaaucauauacugagguugcuaaga

SEQ ID NO: 543983 - RNA, 64 nt, Homo Sapiens
aaaauguaguauauaguaucguauauauguacaggaaaaaaacguacuaucugugguuucaggu

SEQ ID NO: 543984 - RNA, 64 nt, Homo Sapiens
acucucauagaaaauauaaagaaucccucaaguugaaaaaaaaaucaauuuaaaggggagaaaa

SEQ ID NO: 543985 - RNA, 64 nt, Homo Sapiens
aaggcaaccaaccacauuagaaaaugaaaggaaggaaaaaaaaaagaaaaaaaaaagguuuuac

SEQ ID NO: 543986 - RNA, 64 nt, Homo Sapiens
agguuuuacaaaaugaaaggaauaaaacaaacuagaaaaaaaaaaauuccaaugucacaaaagc

SEQ ID NO: 543987 - RNA, 64 nt, Homo Sapiens
cacccaccacccccccaaaagagacagagagagagaaaaaaaauacagaaacccgagaaagaga

SEQ ID NO: 543988 - RNA, 64 nt, Homo Sapiens
aaagacauaaacuggcaccauaaaaaaaaaaaaggaaaaaaaaagaaaacacacagaagagauu

SEQ ID NO: 543989 - RNA, 64 nt, Homo Sapiens
caacaaaaaaagaaaacacacacaaacagaagaggaaaaaaaagucaaaaaagcgacaaaaaaa

SEQ ID NO: 543990 - RNA, 64 nt, Homo Sapiens
aaaaaagcgacaaaaaaacacaaggaacaaaaaagaaaaaaauccgucuguggagcuucugcug

SEQ ID NO: 543991 - RNA, 64 nt, Homo Sapiens
aacacaaaaaaagacaaaaaggauucuugaacuugaaaaaaaaaucguggagaauuuuuacugg

SEQ ID NO: 543992 - RNA, 64 nt, Homo Sapiens
ggggggugggaggggaagaaagcagaaacaaaaugaaaaaaaaagagcaggcaguggggcugga

SEQ ID NO: 543993 - RNA, 64 nt, Homo Sapiens
aaaaguuuuaaaaaaauuguacaagaacguuucagaaaaaaacaaaaacaaaaggcucauaaca

SEQ ID NO: 543994 - RNA, 64 nt, Homo Sapiens
cucaucacuugaagccaccgaaaaaaaaagaaaagaaaaaaaaugaaaaaaaaaagacaaaaaa

SEQ ID NO: 543995 - RNA, 64 nt, Homo Sapiens
agacaaaaaaaaaaaaaaagaacgaaauggaaaagaaaaaaaaacccauugcuguaaauauuuc

SEQ ID NO: 543996 - RNA, 64 nt, Homo Sapiens
ucgaaagcauuauaacuguagcaucacagaaguagaaaaaaauggggaagcuuaucuugaaaaa

SEQ ID NO: 543997 - RNA, 64 nt, Homo Sapiens
gggagggggaagcuuaucuugcacagguggaggggaaaaaaaggguauaucgcgauaagacagu

SEQ ID NO: 543998 - RNA, 64 nt, Homo Sapiens
agauacuguagugauucaaauaaguuuucuauuugaaaaaaaaaaucacuugauuguauccuug

SEQ ID NO: 543999 - RNA, 64 nt, Homo Sapiens
uggauuggacguugugacucuugccuuuuaagaagaaaaaaaagauaggacaaaguauuugaag

SEQ ID NO: 544000 - RNA, 64 nt, Homo Sapiens
ucuuuauuucugucauucaaaugggugauauccugaaaaaaaaaaaaaaaaaaaaacugggaca

SEQ ID NO: 544001 - RNA, 64 nt, Homo Sapiens
uuuucuggggcuccucacauagcuacccaaaagagaaaaaaaauuaagacaagccuggcaacac

SEQ ID NO: 544002 - RNA, 64 nt, Homo Sapiens
agacaaauugaagaacuggugggauuuuuuucaagaaaaaaaauuauauaauaacuauaauccc

SEQ ID NO: 544003 - RNA, 64 nt, Homo Sapiens
agcagcaagacacgcacagucaaccauuuuccgagaaaaaaagaaaauuccccacuuggaaaga

SEQ ID NO: 544004 - RNA, 64 nt, Homo Sapiens
uggaaucuacuuucauuguuaacacugagcuaaagaaaaaaagccguguguuuuaugaaugacc

SEQ ID NO: 544005 - RNA, 64 nt, Homo Sapiens
uuuaugcacugauuuaaaacaaaccaaaaaaaaagaaaaaaacaaaaaaaaaaaucccuccuuu

SEQ ID NO: 544006 - RNA, 64 nt, Homo Sapiens
aaaucuugggcaagaugaccuacuaguuuuccuugaaaaaaaguugcuuuguuauuaauauugu

SEQ ID NO: 544007 - RNA, 64 nt, Homo Sapiens
cauaauugcaauauuucccccuuacuacuucuuggaaaaaaauuacaaaaugaaguuuuauaga

SEQ ID NO: 544008 - RNA, 64 nt, Homo Sapiens
uaauaggaagucaauauaauauagauuauccccagaaaaaaaucaacaaucuucaaacacugcc

SEQ ID NO: 544009 - RNA, 64 nt, Homo Sapiens
uguuuuguuuuuguugacagguugaaagcauguugaaaaaaauaaauauuuaagaaaagcacac

SEQ ID NO: 544010 - RNA, 64 nt, Homo Sapiens
ugaacagacucagcuuugggguaagaaaaaaauagaaaaaaauaagggagaagagaaggcauua

SEQ ID NO: 544011 - RNA, 64 nt, Homo Sapiens
gaaaaaaauaugaacagacugaaggcauuaguaagaaaaaaauaccacaggggcagggagaaga

SEQ ID NO: 544012 - RNA, 64 nt, Homo Sapiens
gcauucccaaucuugacacgaugaccaagaaaaagaaaaaaaaaaauguaagggucuguuguaa

SEQ ID NO: 544013 - RNA, 64 nt, Homo Sapiens
aauguaagggucuguuguaauuguuuaaaaacaggaaaaaaaauagaaccagaggguuguacua

SEQ ID NO: 544014 - RNA, 64 nt, Homo Sapiens
gauguccccuuucccugccacaaugagggaccaggaaaaaaaguccauggcauaugacaaagac

SEQ ID NO: 544015 - RNA, 64 nt, Homo Sapiens
gccuuaguggccugguuguugggucggggggaaagaaaaaaaaacucccuuccuaaaaucuggg

SEQ ID NO: 544016 - RNA, 64 nt, Homo Sapiens
uguauuugcccuaaauccuucuuuuuaucaaguagaaaaaaaaaaccuuuuaaguacuaauuuu

SEQ ID NO: 544017 - RNA, 64 nt, Homo Sapiens
aaucagauguaucuucaaaaguuaaaucaugacugaaaaaaaucugagcaucucaaagaagucu

SEQ ID NO: 544018 - RNA, 64 nt, Homo Sapiens
acaaagcagggguuuagaguuauuaccuuguaaagaaaaaaauugugccaagucagaaagugug

SEQ ID NO: 544019 - RNA, 64 nt, Homo Sapiens
gcaauuuuugagugccaagucugaacuagaagaggaaaaaaauguuaaaaaaaaaaguuguuuu

SEQ ID NO: 544020 - RNA, 64 nt, Homo Sapiens
uucuacaguagucuuucuugucuugaaggcaaaagaaaaaaaaucguuucuuuguugagcugug

SEQ ID NO: 544021 - RNA, 64 nt, Homo Sapiens
aaccacguuucuuuguugagaaaaaaagaaaaaagaaaaaaaaaagcuaagagagcuugcaaaa

SEQ ID NO: 544022 - RNA, 64 nt, Homo Sapiens
agcuacugggaauauuuuuguagagcugcauugugaaaaaaagauggucuuaccugaaucuuag

SEQ ID NO: 544023 - RNA, 64 nt, Homo Sapiens
ugcauguggacacucagucacauuaacaacuugggaaaaaaauggcaauguuacggugaauucu

SEQ ID NO: 544024 - RNA, 64 nt, Homo Sapiens
ccaaggguagauguaguugcuuaguagcauuuuggaaaaaaaagaaaaaaagguuugguuuggu

SEQ ID NO: 544025 - RNA, 64 nt, Homo Sapiens
gauguaguugcuuaguagcauuuuggaaaaaaaagaaaaaaagguuugguuugguuuugugacg

SEQ ID NO: 544026 - RNA, 64 nt, Homo Sapiens
agguguuuauuuuuaacucuacuuuugcuaaaaagaaaaaaaaaaauauaugcuuacauuuuuc

SEQ ID NO: 544027 - RNA, 64 nt, Homo Sapiens
augguauaauugaaacuuuuuaagagcaugauuugaaaaaaagcgaacuugagaucuguauaaa

SEQ ID NO: 544028 - RNA, 64 nt, Homo Sapiens
auuguaucaaguuccacaggucuaacuguggggagaaaaaaaaauggaucagaauaaagguuau

SEQ ID NO: 544029 - RNA, 64 nt, Homo Sapiens
agaucuaaguaggaugggagcaguauugauccuggaaaaaaagagggcuaggugaagaaaguuu

SEQ ID NO: 544030 - RNA, 64 nt, Homo Sapiens
uuuaaauuauaucgcuuuugcauuuauuucuaaugaaaaaaacuauaacauauuuauuuuuaua

SEQ ID NO: 544031 - RNA, 64 nt, Homo Sapiens
agugaagcauuagaugcugguaaagucuacaauggaaaaaaagcauguauuuauucaagugcau

SEQ ID NO: 544032 - RNA, 64 nt, Homo Sapiens
aauaaucccagugccauuugaguuaaauaggugagaaaaaaaaucaagggcagaaagcaaaccu

SEQ ID NO: 544033 - RNA, 64 nt, Homo Sapiens
guauuucacuguguuuucaauggaaauuuaaaaggaaaaaaaucaaaaacuaguuuccuugugu

SEQ ID NO: 544034 - RNA, 64 nt, Homo Sapiens
aacuuucaaauugaaaugacuauaaaaaucaauggaaaaaaauauauuuguguuauucuggaug

SEQ ID NO: 544035 - RNA, 64 nt, Homo Sapiens
cuucuuucuacuuuguuuaucuaaauacuguagggaaaaaaaugaggacuuuuucuuagguuug

SEQ ID NO: 544036 - RNA, 64 nt, Homo Sapiens
augaguaaugugaucgcuugauugaagaaggcuagaaaaaaagagccaaaguuaaauguaucac

SEQ ID NO: 544037 - RNA, 64 nt, Homo Sapiens
guaagaaggcagggcaggggggcuuuuuacaggagaaaaaaaaaugacuuauaagagaaagagc

SEQ ID NO: 544038 - RNA, 64 nt, Homo Sapiens
ugacuuauaagagaaagagccuggaguauuuuuggaaaaaaaaauaauauuuuuauguuaaaac

SEQ ID NO: 544039 - RNA, 64 nt, Homo Sapiens
guuuuuuaaccuuuuguuccgccauuuaaaaaaagaaaaaaaaaaagcuuauguuucuugucaa

SEQ ID NO: 544040 - RNA, 64 nt, Homo Sapiens
cccgccaccuguacucacccucacgcucuuugaagaaaaaaaaaaaaaucaccuuguguguugu

SEQ ID NO: 544041 - RNA, 64 nt, Homo Sapiens
agggucauggggguggguuuccuggcaccuacaugaaaaaaaagacaaguuauaugggugauga

SEQ ID NO: 544042 - RNA, 64 nt, Homo Sapiens
cgugguuugaauucuggcuacauguuuuaaguaagaaaaaaaaagacguauuuuugcuuacuca

SEQ ID NO: 544043 - RNA, 64 nt, Homo Sapiens
cuugaaauuacuugaauuuucuugucuuaaaacugaaaaaaaaauguaguuacacguuaaaauc

SEQ ID NO: 544044 - RNA, 64 nt, Homo Sapiens
uaaucugauugcuguuguuuuguuuguuuggaaagaaaaaaaaugucuggcuucuucuacuauu

SEQ ID NO: 544045 - RNA, 64 nt, Homo Sapiens
caggacucucacaaagcugaugagcuguacuucagaaaaaaauaauaauuuccauguuuuguau

SEQ ID NO: 544046 - RNA, 64 nt, Homo Sapiens
ucaucugucuuuucccccuucagaauuuuccuuggaaaaaaaauacuagccuagcuggucauuu

SEQ ID NO: 544047 - RNA, 64 nt, Homo Sapiens
ucuguugccauuuguguaaauacuagucuuuuuggaaaaaaaauaauguaaagauguuuuguau

SEQ ID NO: 544048 - RNA, 64 nt, Homo Sapiens
aacucugaauuauuuucuuguugcuuuuuucuuagaaaaaaaugagaacuaaaaaaaaaaaauu

SEQ ID NO: 544049 - RNA, 64 nt, Homo Sapiens
gacaguuuccuucuggaguuccaaaugcaauauagaaaaaaaaacccugugacucuggauuuua

SEQ ID NO: 544050 - RNA, 64 nt, Homo Sapiens
aagacuccuaccuugagaucuuagucuagguaaagaaaaaaaaaaaaaggucaugaaacacaaa

SEQ ID NO: 544051 - RNA, 64 nt, Homo Sapiens
agccugggugacagagugagauccugucucugaagaaaaaaaaaaccugccuggcaagguccuu

SEQ ID NO: 544052 - RNA, 64 nt, Homo Sapiens
aacaccuccaccagggggaaggcuggcacaaggagaaaaaaaaagcaagcaucagcgaauagua

SEQ ID NO: 544053 - RNA, 64 nt, Homo Sapiens
aauccuguccuaggcuuuuaugagaaaaaaguaagaaaaaaaaaaagagaaaaaagaaaaaaaa

SEQ ID NO: 544054 - RNA, 64 nt, Homo Sapiens
gagaaaaaaguaagaaaaaaaaaaagagaaaaaagaaaaaaaauaaauauacuugcuaucuaua

SEQ ID NO: 544055 - RNA, 64 nt, Homo Sapiens
uuuuauugguguuuucacuuaaacagacaaacaagaaaaaaagcugaguuuaaacaaaaaccac

SEQ ID NO: 544056 - RNA, 64 nt, Homo Sapiens
uauuaaauguuucucacauaauuuucuuaaaaaagaaaaaaaauuccucaaguuacuuuccuuc

SEQ ID NO: 544057 - RNA, 64 nt, Homo Sapiens
uugguuuuauaaaauucaugcuucaaaguugaaggaaaaaaaguucaacuuuuuaguuuuguuc

SEQ ID NO: 544058 - RNA, 64 nt, Homo Sapiens
gcccaaacuuaaccucugagugaauuaaaagaaggaaaaaaaaauuuuguauaaaaauuuaaau

SEQ ID NO: 544059 - RNA, 64 nt, Homo Sapiens
aacagucaauauggauuuagcccaagguugaauugaaaaaaaaaugaauguuuaguuuuguuua

SEQ ID NO: 544060 - RNA, 64 nt, Homo Sapiens
caugauguacccuccgagaaaagcaucgaaaaaagaaaaaaagcaggucaguucaggaaagcuu

SEQ ID NO: 544061 - RNA, 64 nt, Homo Sapiens
aaauugcucaaauaaaaauggcauggauuucuuugaaaaaaaaucuuucuaucguucucucuuu

SEQ ID NO: 544062 - RNA, 64 nt, Homo Sapiens
caucaaguugugccaaauuacuuuugcaaagaaagaaaaaaaacgugguagcauauagauuguc

SEQ ID NO: 544063 - RNA, 64 nt, Homo Sapiens
uaauaagaucaucuaccuaugugacagagaaagggaaaaaaauaucaauguaaucacccuauuu

SEQ ID NO: 544064 - RNA, 64 nt, Homo Sapiens
guuuauuuuuuauucuucuguuuuugugggaauagaaaaaaauuaaaguguuaacuuacgggua

SEQ ID NO: 544065 - RNA, 64 nt, Homo Sapiens
gauuuagauacuucucccugagguggggauaaaagaaaaaaaaaaacaacuucuuuuuuucuuc

SEQ ID NO: 544066 - RNA, 64 nt, Homo Sapiens
ucccucuguuauugucggcaggcggugagggguagaaaaaaaacaaacaaacaaacagaaaaaa

SEQ ID NO: 544067 - RNA, 64 nt, Homo Sapiens
ggugagggguagaaaaaaaacaaacaaacaaacagaaaaaaaaaccaaaaaaaaccacccugag

SEQ ID NO: 544068 - RNA, 64 nt, Homo Sapiens
uucuccuccuccucaugcccgccuuccuggccacaggcaucacuugacagaugagaggucugaa

SEQ ID NO: 544069 - RNA, 64 nt, Homo Sapiens
cuggcccauugacagaugagucuagcggugccugaggcaucacucuccuguccggcccuggguu

SEQ ID NO: 544070 - RNA, 64 nt, Homo Sapiens
ugcagcugugaugguuucagagcucagacugaucaggcaucaagcuacccucaagaguuucugg

SEQ ID NO: 544071 - RNA, 64 nt, Homo Sapiens
ugaguauaaauccugugcauagauuccucuagaaaggcaucaaaaggcucaacagacugaaugg

SEQ ID NO: 544072 - RNA, 64 nt, Homo Sapiens
ccaccaaaaaccuucuuagcaggacagcugugagaggcaucagaaccucacguucggacugccu

SEQ ID NO: 544073 - RNA, 64 nt, Homo Sapiens
cuguccccugagaucugaaggcuaccuugggaagaggcaucagccaucuugcuugagaaccacc

SEQ ID NO: 544074 - RNA, 64 nt, Homo Sapiens
accggaacaucacaggguuuuuaagcuuuuacccaggcaucaaauacaaauguaacgugcaugc

SEQ ID NO: 544075 - RNA, 64 nt, Homo Sapiens
aacuuuuuugaugaaaccaugccaaagucucacuaggcaucaaagugauagagauuuuccgcag

SEQ ID NO: 544076 - RNA, 61 nt, Homo Sapiens
gaacaaauugaaaaucugaagaccgaugcugcaagcagaccauaugcagaugugcgaguua

SEQ ID NO: 544077 - RNA, 61 nt, Homo Sapiens
uuugaagcaggauauggcaacggaacauccucaagcagagguaguaaaacaggaaagcagc

SEQ ID NO: 544078 - RNA, 61 nt, Homo Sapiens
gaaugaagagaaugguggcagaaugagugagcaagcagauugccccagaggggccgguaau

SEQ ID NO: 544079 - RNA, 61 nt, Homo Sapiens
uuuauuuugauuuuauuaaaugggaagaaagcaagcagaaauaguaaaauucaguagguuu

SEQ ID NO: 544080 - RNA, 61 nt, Homo Sapiens
gagaaguuaaaauacccuuauuaaggagguucaagcagaguagugagaaguuaaaauaccc

SEQ ID NO: 544081 - RNA, 61 nt, Homo Sapiens
gagaaguuaaaauacccuuaggacggagguucaagcagagucugaauccuugcgucccgaa

SEQ ID NO: 544082 - RNA, 61 nt, Homo Sapiens
uggggcucugggggaaugcugggaaaaugggcaagcagagugcacagcccucguucugcca

SEQ ID NO: 544083 - RNA, 61 nt, Homo Sapiens
uggacuuucaacuggcuuuccuuaggucaggcaagcagacagcuccccacugaagaggucu

SEQ ID NO: 544084 - RNA, 61 nt, Homo Sapiens
ggagacugagugccucagccgugcaagcacccaagcagaagcugcucuggccaaugggacu

SEQ ID NO: 544085 - RNA, 61 nt, Homo Sapiens
gucccaaccgccugcuguacuugcugaagagcaagcagaggcccuuucucucccaagcucu

SEQ ID NO: 544086 - RNA, 61 nt, Homo Sapiens
cugaacaccugcggaaggagagcagcagcuacaagcagaggagcagggcccuccgaggugg

SEQ ID NO: 544087 - RNA, 61 nt, Homo Sapiens
cugaacaccugcggaaggagaacagcagcuacaagcagaggagcagggcccuccgaggugg

SEQ ID NO: 544088 - RNA, 61 nt, Homo Sapiens
ccaugagaaggagaguucagagccugcuggacaagcagagacccgggagaaagcccaggcc

SEQ ID NO: 544089 - RNA, 61 nt, Homo Sapiens
caugaccagggacacagcuguuagggaagagcaagcagaguauuuuccuauuuuaauugcu

SEQ ID NO: 544090 - RNA, 61 nt, Homo Sapiens
aacaggaucagugggucuaacacaccagagacaagcagaguuccagcaaagugauucccug

SEQ ID NO: 544091 - RNA, 61 nt, Homo Sapiens
aacuaauuucauuucaaggcccacacggaagcaagcagaugagccgcgggccaggaggcug

SEQ ID NO: 544092 - RNA, 61 nt, Homo Sapiens
ugaggccccacguuuccaacgccugguuuaucaagcagagcuccacccucagcucuuccuu

SEQ ID NO: 544093 - RNA, 61 nt, Homo Sapiens
gaauuuggacucaguuacagcuaugacgcagcaagcagaaucuugucucucaacguauugg

SEQ ID NO: 544094 - RNA, 61 nt, Homo Sapiens
cacucaguggaugacuauggagaagagccugcaagcagagaccaacuacccuuaggucuac

SEQ ID NO: 544095 - RNA, 61 nt, Homo Sapiens
guuggccaaugggacauuaacaaguaugauacaagcagaggcuugagaagugccugcacaa

SEQ ID NO: 544096 - RNA, 64 nt, Homo Sapiens
cucuuguaccaauuuuagucaggcagaaaaugguaaacaugagggugcucuugugacuuaauuu

SEQ ID NO: 544097 - RNA, 64 nt, Homo Sapiens
guggugguaguggaaggggauaauuguaaauaggaaacaugaauguucauuuuuuucuuuaaag

SEQ ID NO: 544098 - RNA, 63 nt, Homo Sapiens
uguuuucuucaaacagaugaaaacuuuauucucaaacaugacagagcguuccuuuuaucaaug

SEQ ID NO: 544099 - RNA, 64 nt, Homo Sapiens
aacugagaaauccagugaagaggaccuuucagguaaacaugauacagugacuguuucaucagau

SEQ ID NO: 544100 - RNA, 64 nt, Homo Sapiens
aucacaaggauugaaacuaugcaguguguucuccaaacaugauggaacgaaauuagaaaucaau

SEQ ID NO: 544101 - RNA, 64 nt, Homo Sapiens
uccuccucucccuuccuucugccaugggaggaugaaacaugaaggcccuggccagguguggccc

SEQ ID NO: 544102 - RNA, 64 nt, Homo Sapiens
cagaauuacuugaauuucuugaaucccaacaagaaaacaugauuaaaaaaguauguuauuguuu

SEQ ID NO: 544103 - RNA, 64 nt, Homo Sapiens
ccguucuucagucuggagugccuucaaagaucagaaacaugauuuguucauuucugagucacaa

SEQ ID NO: 544104 - RNA, 64 nt, Homo Sapiens
uaaucuggauaaugacuauuaguccaaugcuaagaaacaugaucuuugcucauuaaagagcuaa

SEQ ID NO: 544105 - RNA, 64 nt, Homo Sapiens
gaaaaaaaagaaaaaaaggaaaagaagaacaaagaaacaugacugucucaaagaguaauuuuuc

SEQ ID NO: 544106 - RNA, 64 nt, Homo Sapiens
auccacauugucauaugugaacuucagagucuuuaaacaugacagauaacucauagucuacgua

SEQ ID NO: 544107 - RNA, 64 nt, Homo Sapiens
acucauagucuacguaacuuaucaugcuaaaagaaaacaugauaauuaaagcuagguguauaga

SEQ ID NO: 544108 - RNA, 64 nt, Homo Sapiens
cuucuuugauuguagaaaagcagacacuucucugaaacaugaccuuauucuuccaaacaguauc

SEQ ID NO: 544109 - RNA, 64 nt, Homo Sapiens
acacuuuucaaaagaagaccuacaauuggccaacaaacaugaaaaaaugcucaguaucacuaau

SEQ ID NO: 544110 - RNA, 64 nt, Homo Sapiens
uucaguucuuguguuuuggaguccuagucauauuaaacaugagagauacucuuaauuucaguag

SEQ ID NO: 544111 - RNA, 64 nt, Homo Sapiens
uaauuucauuucuugcuuugccaccuaagcaguaaaacaugauauugaccacuuggagaacuca

SEQ ID NO: 544112 - RNA, 64 nt, Homo Sapiens
uuuucuuuauaauaaaauauuugagccacuguauaaacaugagggugcacaugucaaguacuua

SEQ ID NO: 544113 - RNA, 64 nt, Homo Sapiens
cuuuauugucuguaaaucuaauguuucaagcgggaaacaugacuuggauucaaauuuauuucca

SEQ ID NO: 544114 - RNA, 64 nt, Homo Sapiens
ccuacaaggccccaagguuuuucuuauacagauaaaacaugacucaaauuuuaauuauaaucuc

SEQ ID NO: 544115 - RNA, 64 nt, Homo Sapiens
guccauaaccauuuugaaauuacuuugacauuuuaaacaugauaaaagugcaauauguauagca

SEQ ID NO: 544116 - RNA, 64 nt, Homo Sapiens
cauaauuuguuuaaaauucuuuuauuaagccaggaaacaugaaggauaauaaaaauuguagcuu

SEQ ID NO: 544117 - RNA, 64 nt, Homo Sapiens
gccuagguuuccaaaucuugugauucuuuaggagaaacaugaaaccuggauuucgugugaaaug

SEQ ID NO: 544118 - RNA, 64 nt, Homo Sapiens
gucugugggcugccaguuuauuacuuuugucuuaaaacaugaucauuguucucucacgguaucc

SEQ ID NO: 544119 - RNA, 64 nt, Homo Sapiens
uuauccaauugcaggucaacuuuagaggccuauuaaacaugacguacugauguagccacaacuu

SEQ ID NO: 544120 - RNA, 64 nt, Homo Sapiens
aucauuuccugacaauggggaaguaugcgaucuaaaacaugacuauaccacugauguucaucaa

SEQ ID NO: 544121 - RNA, 64 nt, Homo Sapiens
acuugauccucaacauauacuauaauugcaaaggaaacaugaggccaucuucccuuguucacug

SEQ ID NO: 544122 - RNA, 64 nt, Homo Sapiens
ucaacaguauugccagguuccuaaaauugucuaaaaacaugauuuggcuuccauuuuugcagcu

SEQ ID NO: 544123 - RNA, 64 nt, Homo Sapiens
cccauugcuuucuccuuuccccgacgcacagaauaaacaugaagcucagcaguagaagcguaau

SEQ ID NO: 544124 - RNA, 64 nt, Homo Sapiens
auauauuacaccaugauuuaggccucuauaauuuaaacaugaacaacaguuugcggugcuuaga

SEQ ID NO: 544125 - RNA, 64 nt, Homo Sapiens
cuguaagaaacaguuugcgguuguaaaaaugaacaaacaugagagguuccaaauauucacugcu

SEQ ID NO: 544126 - RNA, 64 nt, Homo Sapiens
ggaaucacacugcacagaaaacuguacugcucaaaaacaugagaugggaaagccuucaguuacc

SEQ ID NO: 544127 - RNA, 64 nt, Homo Sapiens
aggcucauacuggagagaaaaccaaucugcucaaaaacaugaaauggaaaagcauuccgauacc

SEQ ID NO: 544128 - RNA, 64 nt, Homo Sapiens
guccaggcugucugagucagcaaaauuuuccuaaaaacaugagacagguagaucccagaacaga

SEQ ID NO: 544129 - RNA, 64 nt, Homo Sapiens
aagcagguagaucccagaacauauacucacacugaaacaugaggagccagucaugcuaaaugcc

SEQ ID NO: 544130 - RNA, 64 nt, Homo Sapiens
accccacuccuaggcugccuuggaggguacaagauccacugaggguggccaccacagccuuggc

SEQ ID NO: 544131 - RNA, 64 nt, Homo Sapiens
uaugugccgaguuaccccacuugccuugggcguguccacugagccuuccccagccagucuuguu

SEQ ID NO: 544132 - RNA, 64 nt, Homo Sapiens
aaaaccuacgcacauaccuuucuaccagucuauuuccacugaacugguucagugccuuccucuc

SEQ ID NO: 544133 - RNA, 64 nt, Homo Sapiens
aaaaccuacacacauaccuuucuaccagucuauuuccacugaacugauucacugccuuccucuc

SEQ ID NO: 544134 - RNA, 64 nt, Homo Sapiens
gcuccaaguauucuaaaugugucccaucaugcuuuccacugacccaaaauucaccacagcauuu

SEQ ID NO: 544135 - RNA, 64 nt, Homo Sapiens
auuaaguuccacauagcaauuacaguaugccaguuccacugaagacaugaaaucuuuagagguu

SEQ ID NO: 544136 - RNA, 64 nt, Homo Sapiens
uccugggcagccagugaauucaggagaucaggauuccacugacgucuccagcugucaccucccc

SEQ ID NO: 544137 - RNA, 64 nt, Homo Sapiens
ggaggauagagccagcugucauaguccugggugcuccacugauuucuguuccaccucuccugcg

SEQ ID NO: 544138 - RNA, 64 nt, Homo Sapiens
acauuuuugucauauucuuggucuacugccuguuuccacugaaaguggcuagugcgauuucaca

SEQ ID NO: 544139 - RNA, 64 nt, Homo Sapiens
gagacucaucuugcucuucuucucuccuguuuucuccacugaacaaaguuauuaggagagauac

SEQ ID NO: 544140 - RNA, 64 nt, Homo Sapiens
gaccgggaguccaaaccaccuuggugcucugaaguccacugacucaucacaccuuucuuagccu

SEQ ID NO: 544141 - RNA, 64 nt, Homo Sapiens
guagaaggggcuggucugcugggcagggcuuacauccacugaguucuaagauuccuuuccugau

SEQ ID NO: 544142 - RNA, 64 nt, Homo Sapiens
acgugggcaguguccaaauuucugauggcugcuguccacugagaacuuccccuccugggucacc

SEQ ID NO: 544143 - RNA, 64 nt, Homo Sapiens
gugccgaggggcgggggcagcgaggcugacgugcuccacugacucuuuucagagaacuguaaac

SEQ ID NO: 544144 - RNA, 64 nt, Homo Sapiens; identical to SEQ ID NO: 270536

SEQ ID NO: 544145 - RNA, 64 nt, Homo Sapiens; identical to SEQ ID NO: 270537

SEQ ID NO: 544146 - RNA, 64 nt, Homo Sapiens; identical to SEQ ID NO: 270538

SEQ ID NO: 544147 - RNA, 64 nt, Homo Sapiens; identical to SEQ ID NO: 270539

SEQ ID NO: 544148 - RNA, 64 nt, Homo Sapiens; identical to SEQ ID NO: 270540

SEQ ID NO: 544149 - RNA, 64 nt, Homo Sapiens; identical to SEQ ID NO: 270541

SEQ ID NO: 544150 - RNA, 64 nt, Homo Sapiens; identical to SEQ ID NO: 270542

SEQ ID NO: 544151 - RNA, 64 nt, Homo Sapiens; identical to SEQ ID NO: 270543

SEQ ID NO: 544152 - RNA, 64 nt, Homo Sapiens; identical to SEQ ID NO: 270544

SEQ ID NO: 544153 - RNA, 64 nt, Homo Sapiens; identical to SEQ ID NO: 270545

SEQ ID NO: 544154 - RNA, 64 nt, Homo Sapiens; identical to SEQ ID NO: 270546

SEQ ID NO: 544155 - RNA, 64 nt, Homo Sapiens; identical to SEQ ID NO: 270547

SEQ ID NO: 544156 - RNA, 64 nt, Homo Sapiens; identical to SEQ ID NO: 270548

SEQ ID NO: 544157 - RNA, 64 nt, Homo Sapiens; identical to SEQ ID NO: 270549

SEQ ID NO: 544158 - RNA, 64 nt, Homo Sapiens
accagccaguagauugucugucagugaccuucuguaguaauaaaguuuuugccacuguaaauaa

SEQ ID NO: 544159 - RNA, 64 nt, Homo Sapiens
auuuguaauuaacucugaauuuguuuuuaaucauuaguaauauuucaguuggguaucuuuuuaa

SEQ ID NO: 544160 - RNA, 64 nt, Homo Sapiens
uauuauuggguuacuacuaacccugucccaagaauaguaauaucaccucuaguuauaagccagc

SEQ ID NO: 544161 - RNA, 64 nt, Homo Sapiens
ugaaauguaaaaugugaaaacuuuagaucauuuguaguaauaaauauuuuuaacuucauucaua

SEQ ID NO: 544162 - RNA, 64 nt, Homo Sapiens
aauaaauguaggcucagcucuguuguuguuuugauaguaauaauauguuucuucaugaaaagua

SEQ ID NO: 544163 - RNA, 64 nt, Homo Sapiens
uguauacuaacuagggcuuugauggguaccaguauaguaauaucuggugauauuuuccuuacaa

SEQ ID NO: 544164 - RNA, 64 nt, Homo Sapiens
gccugaaaacaaaugggagcauauagcaaaggauuaguaauauaugcacuuuuuugagaugcag

SEQ ID NO: 544165 - RNA, 64 nt, Homo Sapiens
augaccugcuaauauauuuuacuaaaaugaggauuaguaauauauuugggauauuuuaaaaucu

SEQ ID NO: 544166 - RNA, 64 nt, Homo Sapiens
uguguauaucuaaauacaaaugcaaaugaagcauuaguaauacuuaaauaauuuuacugugcua

SEQ ID NO: 544167 - RNA, 64 nt, Homo Sapiens
aaaacaguccuuaaaauaguuugacucuuccuguuaguaauauauuaaucuuucauuuaaccag

SEQ ID NO: 544168 - RNA, 64 nt, Homo Sapiens
gaauaaaauacuuuacuaaaaauaaaaaauaaaguaguaauaaaugagcauucauuuaaggaua

SEQ ID NO: 544169 - RNA, 64 nt, Homo Sapiens
cagaaaacaguuuuaggccucauuguuuuuagacuaguaauaugucuuaaauaugugcuauuag

SEQ ID NO: 544170 - RNA, 64 nt, Homo Sapiens
cacauaaagacaaaagcaucuguuaugaaaugaguaguaauauugggugguugauuuguucuua

SEQ ID NO: 544171 - RNA, 64 nt, Homo Sapiens
ucuccuccccuaaaauaaaaauaguggucaacuuuaguaauauaaaaggcugcuggaugcugag

SEQ ID NO: 544172 - RNA, 64 nt, Homo Sapiens
aguugaaguuuggccaacucagacccuguaguaauaguaauaauauuggaacuuugcuagaaca

SEQ ID NO: 544173 - RNA, 64 nt, Homo Sapiens
aauaauaguugaaguuuggcagaacaagacccuguaguaauaguauaaauauuggaacuuugcu

SEQ ID NO: 544174 - RNA, 64 nt, Homo Sapiens
aaagugcauuauuauggaagaauguauuugcagguaguaauagcauuaaaaaauauacucgugu

SEQ ID NO: 544175 - RNA, 64 nt, Homo Sapiens
uaugucuauagaguaaguauaagagauaauucauuaguaauaggaauuaacugaccccuuuugg

SEQ ID NO: 544176 - RNA, 64 nt, Homo Sapiens
uuuucccugggaaaaccuucagcugcuuuauuuuuaguaauaaauuucucuugucaauucuguu

SEQ ID NO: 544177 - RNA, 64 nt, Homo Sapiens
aauugaggacaacacaaaugggauugguacuuuauaguaauaaaucugaccagcagagggaggg

SEQ ID NO: 544178 - RNA, 64 nt, Homo Sapiens
cccaggcacugugggacugagaguccuauuccccuaguaauaggucauauuccccuaguaauau

SEQ ID NO: 544179 - RNA, 64 nt, Homo Sapiens
aguccuauuccccuaguaauaggucauauuccccuaguaauaugaguucucaaagccuacauuc

SEQ ID NO: 544180 - RNA, 64 nt, Homo Sapiens
gaagaaaaaauagaaagguuuugacaauuauaaauaguaauaguaaugcaaaagaaacuggaac

SEQ ID NO: 544181 - RNA, 64 nt, Homo Sapiens
ucauauacugaaaagugucuucauucaaggauuauaguaauauuaauaaauccuugcauguaaa

SEQ ID NO: 544182 - RNA, 64 nt, Homo Sapiens
uaguaagcauuuucucaauguaguaauaauuaauuaguaauaaugaugaagccaucuuaauaau

SEQ ID NO: 544183 - RNA, 64 nt, Homo Sapiens
uaauuaguaauaauuaguaagccaucuuaauaauuaguaauaauuuagaccauuuggggaugaa

SEQ ID NO: 544184 - RNA, 64 nt, Homo Sapiens
auuaaauguguauauaucucuacacuuuauggauuaguaauaaugugauucucuauggcuucua

SEQ ID NO: 544185 - RNA, 64 nt, Homo Sapiens
ugccuauuaagaggcuuuuuacaaauuacuuacuuaguaauaucuguuaaauuaagcauuaucu

SEQ ID NO: 544186 - RNA, 64 nt, Homo Sapiens
uuuaaagggaaauugagcugcaccaaaaaauaucuaguaauauagaauagaacaacauauacaa

SEQ ID NO: 544187 - RNA, 64 nt, Homo Sapiens
auacacaaaaucaaauaauaaaggaaaaauucaauaguaauauaucuuccaaccauuuaucuug

SEQ ID NO: 544188 - RNA, 64 nt, Homo Sapiens
uaccacucugguguagacagaggacuuuguccaagucucacacuaaacaugcccgggcuucgau

SEQ ID NO: 544189 - RNA, 64 nt, Homo Sapiens
ccuguaacagccaccuggagaacuucauaaagaugucucacagcccuggggacaccugcccagu

SEQ ID NO: 544190 - RNA, 64 nt, Homo Sapiens
acaccugauacuguaaacauacuguaauaauaaugucucacauggaaacagaaaacgcuggguc

SEQ ID NO: 544191 - RNA, 64 nt, Homo Sapiens
gaauguucagguggucaguguucuacucagaaaugucucacagcccagcuggguugcaauucca

SEQ ID NO: 544192 - RNA, 64 nt, Homo Sapiens
caaccauuuuaagccucuaaaagaccucgggcaagucucacagaaacugagcugcagacgggga

SEQ ID NO: 544193 - RNA, 64 nt, Homo Sapiens
gccccuucucugggugugggcccuuauugcagcugucucacagccugagcugugguacagagaa

SEQ ID NO: 544194 - RNA, 64 nt, Homo Sapiens
agcacuggugugaaugaaagagagacccagccgcgucucacacagguggaauugcacuucuuaa

SEQ ID NO: 544195 - RNA, 64 nt, Homo Sapiens
uuuaaaagaaaguuagguuauaagaaacagaggcgucucacauuuuuacuugguguaauuaaua

SEQ ID NO: 544196 - RNA, 64 nt, Homo Sapiens
gguauuguuuggaauuguuuuaaagucaguuugagucucacaagaagguaaguagaguuucuua

SEQ ID NO: 544197 - RNA, 64 nt, Homo Sapiens
cuccccaguuuccuggcgaugagccauuuauugugucucacaccagccucauuuccaacuccga

SEQ ID NO: 544198 - RNA, 64 nt, Homo Sapiens
ccuuggccuuugggaacuuugcuccaacuggugugucucacacaaugccucccaaaacacugcu

SEQ ID NO: 544199 - RNA, 64 nt, Homo Sapiens
gauuccuguacauuuuacagucgcacagcaagcagucucacagaaggcaggcuaguccauucac

SEQ ID NO: 544200 - RNA, 64 nt, Homo Sapiens
uuuccucugaauuauaauaacauagccagauguagucucacacuguuuuucauacucuuaagug

SEQ ID NO: 544201 - RNA, 63 nt, Homo Sapiens
acuucuggaggccgccugcccacaauaaaggacagucucacagcugacgcuggaaccuguaua

SEQ ID NO: 544202 - RNA, 64 nt, Homo Sapiens
ccuccugccagcucugucacgcugacccaccaaggucucacacuacauggcugggggagggacu

SEQ ID NO: 544203 - RNA, 64 nt, Homo Sapiens
gaugauaccucacauguugacagaccgggaccuugucucacacugucagcuaggccaauaggaa

SEQ ID NO: 544204 - RNA, 64 nt, Homo Sapiens
gaagcuccugcuacuuccccuguugcugucuucagucucacagacccuggaggagaaguauucc

SEQ ID NO: 544205 - RNA, 64 nt, Homo Sapiens
uucaucagcaggaguggaggccucuaguuggcaagucucacauaugauuugcucucuaaacuuc

SEQ ID NO: 544206 - RNA, 64 nt, Homo Sapiens
guuuacuuugguaugguucucgguaucccuuggagucucacaagccuuuccccuccugucuucc

SEQ ID NO: 544207 - RNA, 64 nt, Homo Sapiens
ccuggguauuguuaauucaaucacguugauuuaugucucacaauacucagauggagcuuccuac

SEQ ID NO: 544208 - RNA, 64 nt, Homo Sapiens
acccuuuacauugugaaauauagaauacaguugggucucacauauuggcuucuaaugcuucaga

SEQ ID NO: 544209 - RNA, 64 nt, Homo Sapiens
gauaauugaaacuagaagggauagaccauauauagucucacauugaucucugucuagaaauacc

SEQ ID NO: 544210 - RNA, 64 nt, Homo Sapiens
gucuuuaacucaucuuugcaguauguaacgcuuagucucacaguugcuaauuucauuuuacagu

SEQ ID NO: 544211 - RNA, 64 nt, Homo Sapiens
ccugcuuaccagauaaugcucucucccauccagugucucacagccccacuuccuguuugggccc

SEQ ID NO: 544212 - RNA, 64 nt, Homo Sapiens
cugaaaacucuaugcuggccacugauuccuuugagucucacaaaacccuacuuaggucaucagg

SEQ ID NO: 544213 - RNA, 64 nt, Homo Sapiens
cuuaauacuaggagaagacugaaucauuaaugaugucucacaaauuacuguguaccuaaguggu

SEQ ID NO: 544214 - RNA, 64 nt, Homo Sapiens
cuugugucuccuuucccccgaaguagaugaaacagucucacauacccaacugcucaucaacaga

SEQ ID NO: 544215 - RNA, 64 nt, Homo Sapiens
gauacaauaucuuuaaaugaacacacgaguguaugucucacaauauauauacacaagugugcau

SEQ ID NO: 544216 - RNA, 64 nt, Homo Sapiens
auauauagcaguguagcuguucucucuagauggugucucacaauggauuucuguugcuugacua

SEQ ID NO: 544217 - RNA, 64 nt, Homo Sapiens
agaccuuuuuccuccguuuuuuuuuugagauggagucucacacagucacccgggauuggaaugc

SEQ ID NO: 544218 - RNA, 64 nt, Homo Sapiens
caggucauacugaugcaagauccuuugacuccaggucucacaucuuuaaaguuccagaauaauc

SEQ ID NO: 544219 - RNA, 64 nt, Homo Sapiens
uuguuuuuuguauauuguagaaagcccagccacugucucacagaugaacuaaucaggcaggaaa

SEQ ID NO: 544220 - RNA, 64 nt, Homo Sapiens
uccguguccgggugcgcuccagcagacucauggggucucacaaaugaccuguuaaaagccacgc

SEQ ID NO: 544221 - RNA, 64 nt, Homo Sapiens
cguagcugauuauccucuuuuuauggaaacuuuggucucacaucguagaaugcuccaugcuauu

SEQ ID NO: 544222 - RNA, 64 nt, Homo Sapiens
aagcaauccauccuguaguacaguggaagaaggggucucacaaauaaauaaugcaaaaauugca

SEQ ID NO: 544223 - RNA, 64 nt, Homo Sapiens
cauuuugugaaugguguucagccuauaagacgaagucucacaagaccuauaggaaaguuuacca

SEQ ID NO: 544224 - RNA, 64 nt, Homo Sapiens
uauugcauauugcccaauaagcagaagccauaaggucucacacuuuucuuauaaugcaauagaa

SEQ ID NO: 544225 - RNA, 64 nt, Homo Sapiens
cuccucuucugauaguuggggaaacugaggccuugucucacaguuggaugcuuuucccaguugu

SEQ ID NO: 544226 - RNA, 64 nt, Homo Sapiens
augcugauacacagcacacagggaaaggaagacagucucacagaggaagggcagguguccuacg

SEQ ID NO: 544227 - RNA, 64 nt, Homo Sapiens
uucaacaaguagcuaaagucuggcuaugcucacagucucacaucugguuggggugggcuccuua

SEQ ID NO: 544228 - RNA, 64 nt, Homo Sapiens
gcugggagguagaugauucuuuuuacuugguucugucucacaaaacguuuucuagcauguuucc

SEQ ID NO: 544229 - RNA, 64 nt, Homo Sapiens
cucucuuuauacacaaaaguaaugggaauguagagucucacauuucuuuauggauauacaagca

SEQ ID NO: 544230 - RNA, 64 nt, Homo Sapiens
cuggaggaauguuaaguaaguuuccuugaccagggucucacaccuaagacacaggaaucacugu

SEQ ID NO: 544231 - RNA, 64 nt, Homo Sapiens
ggcguagaaguuuuuguacuucuugcuaaucagugucucacacuagucugcaacuuuaagcagc

SEQ ID NO: 544232 - RNA, 64 nt, Homo Sapiens
gcuaguagacccauuuuacaggugagagaaccaagucucacagaggccuggguucaagucccac

SEQ ID NO: 544233 - RNA, 64 nt, Homo Sapiens
gccaaaugucugaguaaacagauaucccuuccaagucucacaccucccuuagucccacucuugc

SEQ ID NO: 544234 - RNA, 64 nt, Homo Sapiens
ggacgucccaucaacaaagcaucgaugauggacagucucacacuauuuuuaucauauguuucuu

SEQ ID NO: 544235 - RNA, 64 nt, Homo Sapiens
ggaggacaagaagucuauuguuuggacuguguuugucucacaaucaccacaaaauaaaagugua

SEQ ID NO: 544236 - RNA, 64 nt, Homo Sapiens
uuacccaauuguugaauaaauuuuuuucuuuggugucucacaaauguaacucauaggugcauuc

SEQ ID NO: 544237 - RNA, 64 nt, Homo Sapiens
uacaagcauaaguagaagaugaaaucauguaucugucucacaaauugugagaguucccucaucu

SEQ ID NO: 544238 - RNA, 64 nt, Homo Sapiens
caaaagaauaauuuggaaucagcuaugcaaaucagucucacaauagcgugagcuaacugagaga

SEQ ID NO: 544239 - RNA, 64 nt, Homo Sapiens
gucauuuuuagaaaggggcaguuuaaagcacaaugucucacaugggacaaaguuccaaaaugcc

SEQ ID NO: 544240 - RNA, 64 nt, Homo Sapiens
uauaagcuaugaguugaaauguucugucaaaugugucucacaucuacacguggcuuggaggcuu

SEQ ID NO: 544241 - RNA, 64 nt, Homo Sapiens
ggaguuggggugaugggcuucuuucugcacuggagucucacaucuguuagcuuugacacucaag

SEQ ID NO: 544242 - RNA, 64 nt, Homo Sapiens
uggugauuucuccgcucuguuuucaguagaugaagucucacaguaaacuuuacugccgagaaac

SEQ ID NO: 544243 - RNA, 64 nt, Homo Sapiens
aacuucacucaaccccgugcccagggccccaccugucucacaagcaucugccuaauaggguccc

SEQ ID NO: 544244 - RNA, 64 nt, Homo Sapiens
aaagaugccaggccucuaaaguguccuuaagcuugucucacaagcacaaaguuguguuucuuuu

SEQ ID NO: 544245 - RNA, 64 nt, Homo Sapiens
augaaagaugcuaguccaaugaguaaaugagaaagucucacaccaaaugaauaaauggacaaau

SEQ ID NO: 544246 - RNA, 64 nt, Homo Sapiens
gcuaacaugacauuagcuguuucacuuucuuuaagucucacauuagauauacugagguuugagu

SEQ ID NO: 544247 - RNA, 64 nt, Homo Sapiens
uaagugccauacauuuuaucaauuguuaguauuagucucacacacauucccagcuuaaauuaac

SEQ ID NO: 544248 - RNA, 64 nt, Homo Sapiens
guccauuccccuagcuccugacucuuuggaguuagucucacaauuaagacuuacuuuuaaauau

SEQ ID NO: 544249 - RNA, 64 nt, Homo Sapiens
cuucucagccacucuucuuaaugaggcucccccugucucacauugaguugggcccauugguuau

SEQ ID NO: 544250 - RNA, 64 nt, Homo Sapiens
gggacccaccagagccuauagaaucaauuccuuggucucacagccauguagacaagcccugguc

SEQ ID NO: 544251 - RNA, 64 nt, Homo Sapiens
guauuuaccuuccuucccuuccugcucccagacagucucacaaguaaacaccagcagcucauag

SEQ ID NO: 544252 - RNA, 64 nt, Homo Sapiens
guuuuuauccauagccauugcucccuugucaagugucucacaaggacauggaagaauguguuau

SEQ ID NO: 544253 - RNA, 64 nt, Homo Sapiens
aagagcuuuaauauugaauuucagagccacucaagucucacauauuaaaacucaaaggcucuuu

SEQ ID NO: 544254 - RNA, 64 nt, Homo Sapiens
cuuccccauaaguauaaaugcauccuuguguauagucucacaccacuucagacaucuccaaacu

SEQ ID NO: 544255 - RNA, 64 nt, Homo Sapiens
gcaaauugcagcacuacuuuaaauauuagauuaugucucacauagcacugcucauuuuacuuuu

SEQ ID NO: 544256 - RNA, 64 nt, Homo Sapiens
aagucaagaugggcaacucagauggagcagcuuagucucacaguuugcuugucuauuuauuuua

SEQ ID NO: 544257 - RNA, 64 nt, Homo Sapiens
ccagccuuguccacacacacaucucacgccccuggucucacagccucacaccuuguccuuccac

SEQ ID NO: 544258 - RNA, 64 nt, Homo Sapiens
agaggaguggccaugugagggcauggagucauuagucucacaaacacacuuuggacugaagagg

SEQ ID NO: 544259 - RNA, 64 nt, Homo Sapiens
uucggguaugcaagccuaaaucuuuguacacuuugucucacagaauaguucugaggcuccauga

SEQ ID NO: 544260 - RNA, 64 nt, Homo Sapiens
cuagcaacauaccagguaacagaugcaaucucuugucucacauguggaucuucuuggagcgagc

SEQ ID NO: 544261 - RNA, 64 nt, Homo Sapiens
uuaauauuugguaaugaauacagacauagugcuggucucacagcuguugccauuuauuuaguac

SEQ ID NO: 544262 - RNA, 64 nt, Homo Sapiens
auaacagauauucuaauucuuucccuuuguuguagucucacagugaaagagaagagcucugcac

SEQ ID NO: 544263 - RNA, 64 nt, Homo Sapiens
uuuaaucccagcacuuugggaggccagacauggugucucacacguuuguuuacauaagagaaag

SEQ ID NO: 544264 - RNA, 64 nt, Homo Sapiens
gaaaagugaguucugccuuucaggucuacucaaagucucacauggaauccacagcauucaaggu

SEQ ID NO: 544265 - RNA, 64 nt, Homo Sapiens
uugggguugucagguucccgauugcgcccucagggucucacacccucccuaucuucagguuacc

SEQ ID NO: 544266 - RNA, 64 nt, Homo Sapiens
ucuuggauauuucauucuaucaccuuuuacaguugucucacaggauucuuauuauacauguuaa

SEQ ID NO: 544267 - RNA, 64 nt, Homo Sapiens
guggugcuaacuguaugugucuuuaucagugauggucucacagagccaacucacucuuaugaaa

SEQ ID NO: 544268 - RNA, 64 nt, Homo Sapiens
agccugccagggaggcagcuaccucgggaggaaggucucacaucugucucugggcacccaugcu

SEQ ID NO: 544269 - RNA, 64 nt, Homo Sapiens
uuuucuaggcccuuuucuaugucuuuacaucucugucucacacacacacacguauacacacaca

SEQ ID NO: 544270 - RNA, 64 nt, Homo Sapiens
caaccaguucagaaugauacggaagagggagggugucucacaacaggcagcggguagggcacag

SEQ ID NO: 544271 - RNA, 64 nt, Homo Sapiens
gccauauaguuuuuccuggaaugguugcuuauuugucucacacauaggcaaaagucacuaucaa

SEQ ID NO: 544272 - RNA, 64 nt, Homo Sapiens
ucccuguuccucuuccccugugccuuccugccuagucucacaugggugcugugguuuugucccu

SEQ ID NO: 544273 - RNA, 64 nt, Homo Sapiens
ucccugucccucucgcccugugccuuccugccuagucucacaugggugcugugauuuugucccu

SEQ ID NO: 544274 - RNA, 64 nt, Homo Sapiens
ucaugcccguuccccucugccuggcagaaucacagucucacauacugucuuguacugacacauc

SEQ ID NO: 544275 - RNA, 64 nt, Homo Sapiens
gaaaccacucagagauggaucccauucccuaaaggucucacagcaaaggagcaggacucccagg

SEQ ID NO: 544276 - RNA, 64 nt, Homo Sapiens
gcaguacccugaccugcuguuaccuggaccuuuugucucacacaugcauccggagaauugccuc

SEQ ID NO: 544277 - RNA, 64 nt, Homo Sapiens
caaaauuugauuuggcuaaaguggcuauuggugugucucacaggcauuuauauugagauucuuu

SEQ ID NO: 544278 - RNA, 64 nt, Homo Sapiens
aaaaaaauuuuuuuagaugauucuauauaacuucgucucacaaauaguguagguaucuggguuu

SEQ ID NO: 544279 - RNA, 64 nt, Homo Sapiens
uuuaaaccuccaaaaugaucaccuuugacuccacgucucacaaucaucucucucaaguucgaag

SEQ ID NO: 544280 - RNA, 64 nt, Homo Sapiens
agagcacuuagcgcagaaucugacaaccugugaugucucacagugagauucuugccucuagcaa

SEQ ID NO: 544281 - RNA, 64 nt, Homo Sapiens
cgcuccugaaguuaggucauucgucuccugacaugucucacagauaaugacgaugccguguguc

SEQ ID NO: 544282 - RNA, 64 nt, Homo Sapiens
aaucuguuagaucguuuauuuuaucugauaaugugucucacaagucaugugucacuggauuaau

SEQ ID NO: 544283 - RNA, 64 nt, Homo Sapiens
aucugaugguuuuaucaggggugguagugaauaagucucacaagguuucccccauauuguucuu

SEQ ID NO: 544284 - RNA, 64 nt, Homo Sapiens
uuucuagcgcauuugauuucuccagguuugcugugucucacagaggcaguaggaacccagcucu

SEQ ID NO: 544285 - RNA, 64 nt, Homo Sapiens
cucugucccucuucaggaagaaagagcucauucugucucacaagccaccggcauccuguaucag

SEQ ID NO: 544286 - RNA, 64 nt, Homo Sapiens
cccagcccugggacccuccgaggugggugugcgggucucacaggugcuuccugggacuuccugu

SEQ ID NO: 544287 - RNA, 64 nt, Homo Sapiens
cucugcggaaggggucaggcucaacugcugaugugucucacacguagcagacaaggggugucug

SEQ ID NO: 544288 - RNA, 64 nt, Homo Sapiens
ccacugcaccagccuggcaacagagcaagacuccgucucacaaaaaugaauaaauaaaauaaaa

SEQ ID NO: 544289 - RNA, 64 nt, Homo Sapiens
uucucuccaugcccugggucacuuccuuuuuugggucucacagaccccuccaggggcugacacc

SEQ ID NO: 544290 - RNA, 64 nt, Homo Sapiens
auuccagccaucaccuuagacuggauuuuuaccagucucacauggaaggugaaacauuuucucc

SEQ ID NO: 544291 - RNA, 64 nt, Homo Sapiens
uccuuaccucaaagucccuuggugaagagugagggucucacaguucuucuuuuacaaugaaagg

SEQ ID NO: 544292 - RNA, 64 nt, Homo Sapiens
uggacacagccccauguacacggccucaagggaugucucacauccucugucuauuugagacuua

SEQ ID NO: 544293 - RNA, 64 nt, Homo Sapiens
uuugcauugcugcauccugggaaggggguauauggucucacaaguuguugucauuguuuuuuug

SEQ ID NO: 544294 - RNA, 64 nt, Homo Sapiens
uguaauugaugcauuguggccccugaucuucccugucucacacuucuuuucucccaucccgguu

SEQ ID NO: 544295 - RNA, 64 nt, Homo Sapiens
gauucagaaaccaaggcuaagggacuggucuaaagucucacagguaguauaugguggagccaac

SEQ ID NO: 544296 - RNA, 64 nt, Homo Sapiens
cuguugguucaaggacaacaccagaaugaagagggucucacaagacaccuguuauccucuucuu

SEQ ID NO: 544297 - RNA, 64 nt, Homo Sapiens
ggagaggccgguagggcaggggcugcuaguggcugucucacauacaccaguaauccuguuaaag

SEQ ID NO: 544298 - RNA, 64 nt, Homo Sapiens
aggagggugaauguuucuucuuucucaucuacucgucucacacugagugguguuagucacugag

SEQ ID NO: 544299 - RNA, 64 nt, Homo Sapiens
agcugcuuugcucuguaucuggcuggacugaucugucucacaagaagccaugaggccauaggga

SEQ ID NO: 544300 - RNA, 64 nt, Homo Sapiens
uuuuuuuguuuauguguuuguuuuuugagacagagucucacacuguggcccaggcuggacucca

SEQ ID NO: 544301 - RNA, 64 nt, Homo Sapiens
uuccagguauaaauguuucucuuuuuuuaaacaugucucacauagaguaucuccgaaugcagcu

SEQ ID NO: 544302 - RNA, 64 nt, Homo Sapiens
cguuguacaauugagaucaagugaauuggccccggucucacauuuucagugaagucagacucag

SEQ ID NO: 544303 - RNA, 64 nt, Homo Sapiens
accauguagaagaaugggcgucugccucuacugugucucacaucgggcaaaauuagaccucaag

SEQ ID NO: 544304 - RNA, 64 nt, Homo Sapiens
uaaaaaacauaacaacaaugguuugucuaaaauagucucacaggcauacucuucauugaauuua

SEQ ID NO: 544305 - RNA, 64 nt, Homo Sapiens
ugugcuguaucccaggcauaguuuagccuuucuugucucacagauuagaagaagcagagcucua

SEQ ID NO: 544306 - RNA, 64 nt, Homo Sapiens
cgacgcuccuguaaucauucucugucuucaugaggucucacaguguggugacaguuugugacau

SEQ ID NO: 544307 - RNA, 64 nt, Homo Sapiens
uugaaaauuacgacaguuaagggcugggugcggugucucacaccuguaaucccagcacuuuggg

SEQ ID NO: 544308 - RNA, 64 nt, Homo Sapiens
ucccugucucagcaccuccucccccaauucccaggucucacaucccaccccuccugcccuccaa

SEQ ID NO: 544309 - RNA, 64 nt, Homo Sapiens
accuuuuuuucugaaucugcuguucuacccaugugucucacauucauuuguauuauuucaagaa

SEQ ID NO: 544310 - RNA, 64 nt, Homo Sapiens
ucucugugaaaaacuuguauacacaagcguccaugucucacacaaauauugaugugauuauucu

SEQ ID NO: 544311 - RNA, 64 nt, Homo Sapiens
ccuugagccugcagcacacacuaggccaccugcagucucacaggccaugcccuggguagacagg

SEQ ID NO: 544312 - RNA, 64 nt, Homo Sapiens
cugugcuaauaaguccuuugauguauugauuuaagucucacacaauaaagauaauuauaguuac

SEQ ID NO: 544313 - RNA, 64 nt, Homo Sapiens
gugcuacgccugcauguaaaacccuggaccaguggucucacaugaccugagcaggaccucugaa

SEQ ID NO: 544314 - RNA, 63 nt, Homo Sapiens
gggcuuugcucuuucagugagcuaggcaaucaagucucacagauugcugccucagagcaaugg

SEQ ID NO: 544315 - RNA, 64 nt, Homo Sapiens
uuuuauuuagcaagcccagaccuuccggucuaacgucucacaccacgacggacuccccuuccua

SEQ ID NO: 544316 - RNA, 64 nt, Homo Sapiens
ggaaaagagcauuugccuucuuuaaugaaugauggucucacaauucaguugacuuugaccuaau

SEQ ID NO: 544317 - RNA, 64 nt, Homo Sapiens
aaaugaaauaauacuucagccaccagguuuuucugucucacauacauaagcagcauuucauugc

SEQ ID NO: 544318 - RNA, 64 nt, Homo Sapiens
aaaauaagagccugaagcaaugcuuacaauagaugucucacacagaacaauacaaauauguaaa

SEQ ID NO: 544319 - RNA, 64 nt, Homo Sapiens
gguuuuguugaguuuucacucuucuaaugcaagggucucacacugugaaccacuuaggauguga

SEQ ID NO: 544320 - RNA, 64 nt, Homo Sapiens
cucgaggccuacaacuuaggggcuggaaucacaggucucacauagagaaauagccagcuugaau

SEQ ID NO: 544321 - RNA, 64 nt, Homo Sapiens
uucucauuacaccuauauuagcuugcuugaaguugucucacagcucacuuguauucuguugacu

SEQ ID NO: 544322 - RNA, 64 nt, Homo Sapiens
uuggcugagcucugucucugcugcuuuccucugugucucacagcgugcacacuggaucaaaaug

SEQ ID NO: 544323 - RNA, 64 nt, Homo Sapiens
aagccuuaucauaaauuccauuuaauuuuguguugucucacagaauucaaacagcuuccugaau

SEQ ID NO: 544324 - RNA, 64 nt, Homo Sapiens
ugcuuaaccgaggugcuucuuccuaugcaagagugucucacauguccuuuaaaaacuacaucuu

SEQ ID NO: 544325 - RNA, 64 nt, Homo Sapiens
cagagccggcuggcccgggacagggcacuagaacgucucacacuugccucaggcuucugcagcc

SEQ ID NO: 544326 - RNA, 64 nt, Homo Sapiens
agaaggcauuuacucuaugucggggggucccugugucucacagcgguaaucguguguugcaucg

SEQ ID NO: 544327 - RNA, 64 nt, Homo Sapiens
ugugcacauggccacucuuggccuaauaaaggaggucucacagucuucugucugggaugugcgc

SEQ ID NO: 544328 - RNA, 64 nt, Homo Sapiens
auaccagggcuagaagacauccagggcgaaguuagucucacagaugccuagccauggugaauga

SEQ ID NO: 544329 - RNA, 64 nt, Homo Sapiens
auagaggaccccuccuccucgauggcggcaggaagucucacaucccaguccuggcagugccgug

SEQ ID NO: 544330 - RNA, 64 nt, Homo Sapiens
acaguugcauuuguugagacuuuaauggagauuugucucacaagugggaaagacugaagaaaca

SEQ ID NO: 544331 - RNA, 64 nt, Homo Sapiens
guagagacagggucucaccauguuggccaggcuggucucacacugaccucaggugauccacccg

SEQ ID NO: 544332 - RNA, 64 nt, Homo Sapiens
guaggccgaccuucucggaaaauucacccuaaaagucucacaaaagaaugaguucauggggaga

SEQ ID NO: 544333 - RNA, 64 nt, Homo Sapiens
cacgucugcucuucagugaagaagcugguuuagagucucacagaaaacuuuugacuguauuuau

SEQ ID NO: 544334 - RNA, 64 nt, Homo Sapiens
auugcaccugugacauccugugcaauaagggagugucucacagguugccuuacucauuucuaag

SEQ ID NO: 544335 - RNA, 64 nt, Homo Sapiens
acgacccggagguccccuucuacccugggugacagucucacaucuucccucagcucccacaagc

SEQ ID NO: 544336 - RNA, 64 nt, Homo Sapiens
guugcccaggcuggucucaauuuguagagauggggucucacagugccagccaacuuuugcaugu

SEQ ID NO: 544337 - RNA, 64 nt, Homo Sapiens
gaucaggcucagggccagaguaaugcugaguucugucucacacucugcagggcaugguggacag

SEQ ID NO: 544338 - RNA, 64 nt, Homo Sapiens
ucacaagaaacuuucuggguuuuaaaguucuuccgucucacaacccauuuugcuugccuggaau

SEQ ID NO: 544339 - RNA, 64 nt, Homo Sapiens
ccccaucuauuacccuagguaauaaaguucaguagucucacauuuuaauucuuggucuaugaua

SEQ ID NO: 544340 - RNA, 64 nt, Homo Sapiens
uguauccuucugcccucgaguugguggcccuggugucucacacuggcucaguaaccccaucaac

SEQ ID NO: 544341 - RNA, 64 nt, Homo Sapiens
ucggcguucuuggccaauggggcuggugaagcaagucucacauggauuguaaggaagcgguggc

SEQ ID NO: 544342 - RNA, 64 nt, Homo Sapiens
gaggccuuacgaagguuaagagaacuuuccccgugucucacagguagguagaggcagagcugga

SEQ ID NO: 544343 - RNA, 64 nt, Homo Sapiens
gugaaugaguuaaauaucauugauagucuugugugucucacauaucagcuuuuucauaaggaaa

SEQ ID NO: 544344 - RNA, 64 nt, Homo Sapiens
aacaaggaaaaauacugaauuaguaauuuuaaaagucucacaaagaaaaucccaggccuagaug

SEQ ID NO: 544345 - RNA, 64 nt, Homo Sapiens
gucacugucacauagacagcccugcaugcccccugucucacacaguuuguaaugaagacagcuc

SEQ ID NO: 544346 - RNA, 64 nt, Homo Sapiens
uauauauuugaugucuguaacaccagaagaacaggucucacaaggcccuuaauuucuuaguccu

SEQ ID NO: 544347 - RNA, 64 nt, Homo Sapiens
cagaggcacauucgugcacauucucacagacaccgucucacacguuggcuuuggacaaccaggc

SEQ ID NO: 544348 - RNA, 64 nt, Homo Sapiens
ccugccaggagcccccuuucaggacacagcgggggucucacacuugcuguccccauccauggcc

SEQ ID NO: 544349 - RNA, 64 nt, Homo Sapiens
ucuuacagguuuucuugcagcugguaccauccaugucucacagcccuggccacugacagaucag

SEQ ID NO: 544350 - RNA, 64 nt, Homo Sapiens
uauauauauauauguucuuguuuuuugagacagagucucacacuguugcccaggcuggagugca

SEQ ID NO: 544351 - RNA, 64 nt, Homo Sapiens
ggaugagucacugaaaggccuucauggucucucggucucacaaggaccucuuaaccccucaaua

SEQ ID NO: 544352 - RNA, 64 nt, Homo Sapiens
uuaugugcaaggauucccuucauguaaauucuuggucucacaugacacuuggucauucuuccag

SEQ ID NO: 544353 - RNA, 64 nt, Homo Sapiens
uacaaaaaguuuacuuucuucauggauauucuuggucucacauacuuguaaucaaguuuuucca

SEQ ID NO: 544354 - RNA, 64 nt, Homo Sapiens
uuucuaaggauuacuuuuuuaaggaacauugucggucucacaugaugcuuguaaugaauuuuuc

SEQ ID NO: 544355 - RNA, 64 nt, Homo Sapiens
cacgcagcacacuggaguggucccagaacaggcagucucacaaguggaagagcccaggggcugg

SEQ ID NO: 544356 - RNA, 64 nt, Homo Sapiens
cuuuuucuuucaaaauugggcucgccuguucugugucucacauggcaugccgggcccucacucu

SEQ ID NO: 544357 - RNA, 64 nt, Homo Sapiens
acaccaauccugauacaauguuccuauuguguuggucucacaacacugcuaagcuuucacuuau

SEQ ID NO: 544358 - RNA, 64 nt, Homo Sapiens
uuuaucauguuuuuaugacuuggguaaugugugugucucacauucaaaguucucuuggcagauc

SEQ ID NO: 544359 - RNA, 64 nt, Homo Sapiens
uuguccccaggggccaggcaaguggcuucccaaggucucacagcccugagucucagagcagggg

SEQ ID NO: 544360 - RNA, 64 nt, Homo Sapiens
aacagauaaauauuugcacagaagauuuuaaauggucucacaaaauauuuucaaggagcuaaaa

SEQ ID NO: 544361 - RNA, 64 nt, Homo Sapiens
uguaaucccagcacuuugaggggccaggcguggugucucacacccuguuuauguuaagaggauu

SEQ ID NO: 544362 - RNA, 64 nt, Homo Sapiens
ucacuagacaucaaaauguggaggcuucauuuaggucucacaacauacaccuaacuguguggca

SEQ ID NO: 544363 - RNA, 64 nt, Homo Sapiens
ggcuuuccuuggccacagugacccugaaguagucgucucacaaagugcuccucugauggggaac

SEQ ID NO: 544364 - RNA, 64 nt, Homo Sapiens
acucuugauagaguuugccaucaggauauuguuggucucacauggaaaagagggacuacauauu

SEQ ID NO: 544365 - RNA, 64 nt, Homo Sapiens
gucacccaggcuggagugcauuuuuugagacagggucucacacucaguuuucuuuucuuuuuuc

SEQ ID NO: 544366 - RNA, 64 nt, Homo Sapiens
guccaauuccagagcugucuggugaucacuuuaugucucacagggacccacauccaaacaugua

SEQ ID NO: 544367 - RNA, 64 nt, Homo Sapiens
cccggacagggccacauuugcaugagacauggcugucucacaggucacagagccauuacaacag

SEQ ID NO: 544368 - RNA, 64 nt, Homo Sapiens
ggcucauuccccaccuucaacucccaccuuacaugucucacacuaucccaugguuggcauuaca

SEQ ID NO: 544369 - RNA, 64 nt, Homo Sapiens
caguggggagaauugagaauagucaggccuaucagucucacagaaucaccccucuaccuuugau

SEQ ID NO: 544370 - RNA, 64 nt, Homo Sapiens
cccaacaucuucagacuggcaacccuucucaagggucucacaacagcuuagggaugugcuugca

SEQ ID NO: 544371 - RNA, 64 nt, Homo Sapiens
aguguucccgauuuacuaaaauagguaaccaggcgucucacagucgccguccugucaagagcgc

SEQ ID NO: 544372 - RNA, 64 nt, Homo Sapiens
cagcacccccucuaguucuaauaaagccgccucugucucacaccaaccucuguccugucugugg

SEQ ID NO: 544373 - RNA, 64 nt, Homo Sapiens
aacagagcuugucucaccaugccucugcuuuugugucucacaaaccuugcugcuguaucuccug

SEQ ID NO: 544374 - RNA, 64 nt, Homo Sapiens
aggcugccagagaaaguuggugcugcucauacuggucucacagucuaaguaagugucugugaug

SEQ ID NO: 544375 - RNA, 64 nt, Homo Sapiens
cuuucuucuucccauggugcuuuccuguuucucagucucacauuucucaacaaggcaaaaacaa

SEQ ID NO: 544376 - RNA, 64 nt, Homo Sapiens
aguucagaaaacacuagaccuugaucuuuagccugucucacaccgacgggguguguguguggcg

SEQ ID NO: 544377 - RNA, 64 nt, Homo Sapiens
cgcuaauaauuucugccaucuuuauaauuucuuugucucacagaagacuaggagaaagaucuuu

SEQ ID NO: 544378 - RNA, 64 nt, Homo Sapiens
auucauuaauuucaccuuuuuggagguguacagggucucacacauaaauuauugugcauggcau

SEQ ID NO: 544379 - RNA, 64 nt, Homo Sapiens
aaagaauacaagaaauguuucuggagcuaguuaugucucacaauuuuguagaaucuuacagcau

SEQ ID NO: 544380 - RNA, 64 nt, Homo Sapiens
uaucaacggguuuccuaccuguagaauucuggcagucucacaaucuucuuucauuuuuuucugu

SEQ ID NO: 544381 - RNA, 64 nt, Homo Sapiens
gcagcagacaagagaagaaaaaggugaaaggcaugucucacaugaggccucacaauuguggugg

SEQ ID NO: 544382 - RNA, 64 nt, Homo Sapiens
cuguucagggauaaucuaaaaaaguguguauuuggucucacagguguauuagaguauauuaggg

SEQ ID NO: 544383 - RNA, 64 nt, Homo Sapiens
ccaugcugaauuuucugcauacugaggguaaagugucucacagcgaucucagaggaccagagug

SEQ ID NO: 544384 - RNA, 64 nt, Homo Sapiens
caaaaagaauuaaggauuuuuuuaaugaacacgugucucacacacuuuuugcuuauauguacuu

SEQ ID NO: 544385 - RNA, 64 nt, Homo Sapiens
agagaggacauauuuaauuaaugcuuauccuagggucucacagagcauaaaguacuaagggauc

SEQ ID NO: 544386 - RNA, 64 nt, Homo Sapiens
gccccucucccuucuguucaagucaguguccucugucucacagggagggccacucaccgaccug

SEQ ID NO: 544387 - RNA, 64 nt, Homo Sapiens; identical to SEQ ID NO: 196032

SEQ ID NO: 544388 - RNA, 64 nt, Homo Sapiens; identical to SEQ ID NO: 196033

SEQ ID NO: 544389 - RNA, 64 nt, Homo Sapiens; identical to SEQ ID NO: 196034

SEQ ID NO: 544390 - RNA, 64 nt, Homo Sapiens; identical to SEQ ID NO: 196035

SEQ ID NO: 544391 - RNA, 64 nt, Homo Sapiens; identical to SEQ ID NO: 196036

SEQ ID NO: 544392 - RNA, 64 nt, Homo Sapiens; identical to SEQ ID NO: 196037

SEQ ID NO: 544393 - RNA, 64 nt, Homo Sapiens; identical to SEQ ID NO: 196038

SEQ ID NO: 544394 - RNA, 64 nt, Homo Sapiens; identical to SEQ ID NO: 196039

SEQ ID NO: 544395 - RNA, 64 nt, Homo Sapiens; identical to SEQ ID NO: 196040

SEQ ID NO: 544396 - RNA, 64 nt, Homo Sapiens; identical to SEQ ID NO: 196041

SEQ ID NO: 544397 - RNA, 64 nt, Homo Sapiens; identical to SEQ ID NO: 196042

SEQ ID NO: 544398 - RNA, 64 nt, Homo Sapiens; identical to SEQ ID NO: 196043

SEQ ID NO: 544399 - RNA, 64 nt, Homo Sapiens; identical to SEQ ID NO: 196044

SEQ ID NO: 544400 - RNA, 64 nt, Homo Sapiens; identical to SEQ ID NO: 196045

SEQ ID NO: 544401 - RNA, 64 nt, Homo Sapiens; identical to SEQ ID NO: 196046

SEQ ID NO: 544402 - RNA, 64 nt, Homo Sapiens; identical to SEQ ID NO: 196047

SEQ ID NO: 544403 - RNA, 64 nt, Homo Sapiens; identical to SEQ ID NO: 196048

SEQ ID NO: 544404 - RNA, 64 nt, Homo Sapiens; identical to SEQ ID NO: 196049

SEQ ID NO: 544405 - RNA, 64 nt, Homo Sapiens; identical to SEQ ID NO: 196050

SEQ ID NO: 544406 - RNA, 64 nt, Homo Sapiens; identical to SEQ ID NO: 196051

SEQ ID NO: 544407 - RNA, 64 nt, Homo Sapiens; identical to SEQ ID NO: 196052

SEQ ID NO: 544408 - RNA, 64 nt, Homo Sapiens; identical to SEQ ID NO: 196053

SEQ ID NO: 544409 - RNA, 64 nt, Homo Sapiens; identical to SEQ ID NO: 196054

SEQ ID NO: 544410 - RNA, 64 nt, Homo Sapiens; identical to SEQ ID NO: 196055

SEQ ID NO: 544411 - RNA, 64 nt, Homo Sapiens
aucagcucucugcugggucucccuuuccauggcaaaugggcagcuccauccucuugacucuucu

SEQ ID NO: 544412 - RNA, 64 nt, Homo Sapiens
acgucauguauuuuaugauacuugaauuuuuugaaaugggcauuuauuuuauaacauguuaaaa

SEQ ID NO: 544413 - RNA, 64 nt, Homo Sapiens
uucucucucucuuccagcaucauuauucacagaaaaugggcaccauaauauaaagauugaugaa

SEQ ID NO: 544414 - RNA, 64 nt, Homo Sapiens
uagucagaucuucucagcuuauaggcagggaugaaaugggcaccccacuggacguuuauauauu

SEQ ID NO: 544415 - RNA, 64 nt, Homo Sapiens
gucaguauccguccugaacguuggccccgugaggaaugggcauuagucgaccaagggaaaccau

SEQ ID NO: 544416 - RNA, 64 nt, Homo Sapiens
uauucagaagaucuuuugcaguguggcuuuccgaaaugggcaaauugaaguuuauguggugaug

SEQ ID NO: 544417 - RNA, 64 nt, Homo Sapiens
aacaacuagauauuaaugucaaucauuuaagauuaaugggcaugcaauuaagucuccauuuaag

SEQ ID NO: 544418 - RNA, 64 nt, Homo Sapiens
uaaugggcaugcaauuaagucuccauuuaagauuaaugggcaugcaaugaagucuccagcagac

SEQ ID NO: 544419 - RNA, 64 nt, Homo Sapiens
ccugcuuucccuccccaaacccaucagacagguaaaugggcagugccuccugggaccauggaca

SEQ ID NO: 544420 - RNA, 64 nt, Homo Sapiens
cuuuucuuuauugcugugaauagucugugugcacaaugggcaauucugacuucucccaucuagu

SEQ ID NO: 544421 - RNA, 64 nt, Homo Sapiens
cgagaaagccucauugucagaaguaucuucauucaaugggcacaauaugcuguguaucucacca

SEQ ID NO: 544422 - RNA, 64 nt, Homo Sapiens
guagcugucaggggccaccgagagugucguuaaaaaugggcaugguuguaauaaaggaggaaag

SEQ ID NO: 544423 - RNA, 64 nt, Homo Sapiens; identical to SEQ ID NO: 144505

SEQ ID NO: 544424 - RNA, 64 nt, Homo Sapiens; identical to SEQ ID NO: 144505

SEQ ID NO: 544425 - RNA, 64 nt, Homo Sapiens; identical to SEQ ID NO: 144507

SEQ ID NO: 544426 - RNA, 64 nt, Homo Sapiens; identical to SEQ ID NO: 144508

SEQ ID NO: 544427 - RNA, 64 nt, Homo Sapiens
aggaggcaucauugaggccaggagcucugcccgugaccuguaucccacguacucuaucuuccau

SEQ ID NO: 544428 - RNA, 64 nt, Homo Sapiens
cgcccugcccccagaggccaggagcucugcccuugaccuguauuccacuuacuccaccuuccau

SEQ ID NO: 544429 - RNA, 64 nt, Homo Sapiens
uagucauuuaaacuguuggucuuggagaccuaaugcucuguaaacucuaguggggagauauuaa

SEQ ID NO: 544430 - RNA, 64 nt, Homo Sapiens
ggauccaaaguaucuuugagcauaauuuuggcaagcucuguagucuuaguaaaaaauuucauuu

SEQ ID NO: 544431 - RNA, 64 nt, Homo Sapiens
uguaccuguauuuauaguuuaugguuaucaggaagcucuguaagaaagaaaaggucagccuccc

SEQ ID NO: 544432 - RNA, 64 nt, Homo Sapiens
uucaguaaucuuugucauuauauguaacuuuguugcucuguauggcauaauauuguauccauaa

SEQ ID NO: 544433 - RNA, 64 nt, Homo Sapiens
ccacgcuuaucgcgugaaccguucacauguucuggcucuguacuuccaucacuguguagcuacc

SEQ ID NO: 544434 - RNA, 64 nt, Homo Sapiens
uuauuuuggauuaaugacaugaaauggcaggugggcucuguaaguacagagaugacacaguauu

SEQ ID NO: 544435 - RNA, 64 nt, Homo Sapiens
gcagaacaguaaauucuguguguugguacagagugcucuguaccagugcucaucaucccuucuu

SEQ ID NO: 544436 - RNA, 64 nt, Homo Sapiens
ccuuuauauaaugacuaauuugggaguaaugugugcucuguaaguuuguuuuaaauugcacugu

SEQ ID NO: 544437 - RNA, 64 nt, Homo Sapiens
ugugguaucaguuuggaaaaaaagagagauuucagcucuguauuauuuugcauauagaggagcc

SEQ ID NO: 544438 - RNA, 64 nt, Homo Sapiens
cauguguacagccuacccaucaggcaguagguuugcucuguacccaggacaugcuguauagaua

SEQ ID NO: 544439 - RNA, 64 nt, Homo Sapiens
ucuuacaagaggauuguaaaaugcacccaucagugcucuguaaaacacaccaaucagcgcucug

SEQ ID NO: 544440 - RNA, 64 nt, Homo Sapiens
acccaucagugcucuguaaaacacaccaaucagcgcucuguagcuagcaauagguuuguaaaau

SEQ ID NO: 544441 - RNA, 64 nt, Homo Sapiens
caugcaguccuccccucccuggucuccugcuucagcucuguacaacgagggcaaagaugcuaaa

SEQ ID NO: 544442 - RNA, 64 nt, Homo Sapiens
uucuuaaguggaaggaaaagagugcugagaaauggcucuguauaaucuauggcuauccgaauuc

SEQ ID NO: 544443 - RNA, 64 nt, Homo Sapiens; identical to SEQ ID NO: 506536

SEQ ID NO: 544444 - RNA, 64 nt, Homo Sapiens; identical to SEQ ID NO: 506537

SEQ ID NO: 544445 - RNA, 64 nt, Homo Sapiens; identical to SEQ ID NO: 506538

SEQ ID NO: 544446 - RNA, 64 nt, Homo Sapiens; identical to SEQ ID NO: 506539

SEQ ID NO: 544447 - RNA, 64 nt, Homo Sapiens; identical to SEQ ID NO: 506540

SEQ ID NO: 544448 - RNA, 64 nt, Homo Sapiens; identical to SEQ ID NO: 506541

SEQ ID NO: 544449 - RNA, 64 nt, Homo Sapiens; identical to SEQ ID NO: 506542

SEQ ID NO: 544450 - RNA, 52 nt, Homo Sapiens; identical to SEQ ID NO: 506543

SEQ ID NO: 544451 - RNA, 64 nt, Homo Sapiens; identical to SEQ ID NO: 506544

SEQ ID NO: 544452 - RNA, 64 nt, Homo Sapiens; identical to SEQ ID NO: 506545

SEQ ID NO: 544453 - RNA, 64 nt, Homo Sapiens; identical to SEQ ID NO: 506546

SEQ ID NO: 544454 - RNA, 64 nt, Homo Sapiens; identical to SEQ ID NO: 506547

SEQ ID NO: 544455 - RNA, 64 nt, Homo Sapiens; identical to SEQ ID NO: 506548

SEQ ID NO: 544456 - RNA, 64 nt, Homo Sapiens; identical to SEQ ID NO: 506549

SEQ ID NO: 544457 - RNA, 64 nt, Homo Sapiens; identical to SEQ ID NO: 506550

SEQ ID NO: 544458 - RNA, 64 nt, Homo Sapiens; identical to SEQ ID NO: 506551

SEQ ID NO: 544459 - RNA, 64 nt, Homo Sapiens; identical to SEQ ID NO: 506552

SEQ ID NO: 544460 - RNA, 64 nt, Homo Sapiens; identical to SEQ ID NO: 506553

SEQ ID NO: 544461 - RNA, 64 nt, Homo Sapiens; identical to SEQ ID NO: 506554

SEQ ID NO: 544462 - RNA, 64 nt, Homo Sapiens; identical to SEQ ID NO: 506555

SEQ ID NO: 544463 - RNA, 64 nt, Homo Sapiens; identical to SEQ ID NO: 506556

SEQ ID NO: 544464 - RNA, 64 nt, Homo Sapiens; identical to SEQ ID NO: 506557

SEQ ID NO: 544465 - RNA, 64 nt, Homo Sapiens; identical to SEQ ID NO: 506558

SEQ ID NO: 544466 - RNA, 64 nt, Homo Sapiens; identical to SEQ ID NO: 506559

SEQ ID NO: 544467 - RNA, 64 nt, Homo Sapiens; identical to SEQ ID NO: 506560

SEQ ID NO: 544468 - RNA, 64 nt, Homo Sapiens; identical to SEQ ID NO: 506561

SEQ ID NO: 544469 - RNA, 64 nt, Homo Sapiens; identical to SEQ ID NO: 506562

SEQ ID NO: 544470 - RNA, 64 nt, Homo Sapiens; identical to SEQ ID NO: 506563

SEQ ID NO: 544471 - RNA, 64 nt, Homo Sapiens; identical to SEQ ID NO: 506564

SEQ ID NO: 544472 - RNA, 64 nt, Homo Sapiens; identical to SEQ ID NO: 506565

SEQ ID NO: 544473 - RNA, 64 nt, Homo Sapiens; identical to SEQ ID NO: 506566

SEQ ID NO: 544474 - RNA, 59 nt, Homo Sapiens; identical to SEQ ID NO: 506567

SEQ ID NO: 544475 - RNA, 64 nt, Homo Sapiens; identical to SEQ ID NO: 506568

SEQ ID NO: 544476 - RNA, 64 nt, Homo Sapiens; identical to SEQ ID NO: 506569

SEQ ID NO: 544477 - RNA, 64 nt, Homo Sapiens; identical to SEQ ID NO: 506570

SEQ ID NO: 544478 - RNA, 64 nt, Homo Sapiens; identical to SEQ ID NO: 506571

SEQ ID NO: 544479 - RNA, 64 nt, Homo Sapiens; identical to SEQ ID NO: 506572

SEQ ID NO: 544480 - RNA, 64 nt, Homo Sapiens; identical to SEQ ID NO: 506573

SEQ ID NO: 544481 - RNA, 64 nt, Homo Sapiens; identical to SEQ ID NO: 506574

SEQ ID NO: 544482 - RNA, 64 nt, Homo Sapiens; identical to SEQ ID NO: 506575

SEQ ID NO: 544483 - RNA, 64 nt, Homo Sapiens; identical to SEQ ID NO: 506576

SEQ ID NO: 544484 - RNA, 64 nt, Homo Sapiens; identical to SEQ ID NO: 506577

SEQ ID NO: 544485 - RNA, 64 nt, Homo Sapiens; identical to SEQ ID NO: 506578

SEQ ID NO: 544486 - RNA, 64 nt, Homo Sapiens; identical to SEQ ID NO: 506579

SEQ ID NO: 544487 - RNA, 64 nt, Homo Sapiens; identical to SEQ ID NO: 506580

SEQ ID NO: 544488 - RNA, 64 nt, Homo Sapiens; identical to SEQ ID NO: 506581

SEQ ID NO: 544489 - RNA, 64 nt, Homo Sapiens; identical to SEQ ID NO: 506582

SEQ ID NO: 544490 - RNA, 64 nt, Homo Sapiens; identical to SEQ ID NO: 506583

SEQ ID NO: 544491 - RNA, 64 nt, Homo Sapiens; identical to SEQ ID NO: 506584

SEQ ID NO: 544492 - RNA, 64 nt, Homo Sapiens; identical to SEQ ID NO: 506585

SEQ ID NO: 544493 - RNA, 64 nt, Homo Sapiens; identical to SEQ ID NO: 506586

SEQ ID NO: 544494 - RNA, 64 nt, Homo Sapiens; identical to SEQ ID NO: 506587

SEQ ID NO: 544495 - RNA, 64 nt, Homo Sapiens; identical to SEQ ID NO: 506588

SEQ ID NO: 544496 - RNA, 64 nt, Homo Sapiens; identical to SEQ ID NO: 506589

SEQ ID NO: 544497 - RNA, 64 nt, Homo Sapiens; identical to SEQ ID NO: 506590

SEQ ID NO: 544498 - RNA, 64 nt, Homo Sapiens; identical to SEQ ID NO: 506591

SEQ ID NO: 544499 - RNA, 64 nt, Homo Sapiens; identical to SEQ ID NO: 506592

SEQ ID NO: 544500 - RNA, 64 nt, Homo Sapiens; identical to SEQ ID NO: 506593

SEQ ID NO: 544501 - RNA, 64 nt, Homo Sapiens; identical to SEQ ID NO: 506594

SEQ ID NO: 544502 - RNA, 64 nt, Homo Sapiens; identical to SEQ ID NO: 506595

SEQ ID NO: 544503 - RNA, 64 nt, Homo Sapiens; identical to SEQ ID NO: 506596

SEQ ID NO: 544504 - RNA, 64 nt, Homo Sapiens; identical to SEQ ID NO: 506597

SEQ ID NO: 544505 - RNA, 64 nt, Homo Sapiens; identical to SEQ ID NO: 506598

SEQ ID NO: 544506 - RNA, 64 nt, Homo Sapiens; identical to SEQ ID NO: 506599

SEQ ID NO: 544507 - RNA, 64 nt, Homo Sapiens; identical to SEQ ID NO: 506600

SEQ ID NO: 544508 - RNA, 64 nt, Homo Sapiens; identical to SEQ ID NO: 506601

SEQ ID NO: 544509 - RNA, 64 nt, Homo Sapiens; identical to SEQ ID NO: 506602

SEQ ID NO: 544510 - RNA, 64 nt, Homo Sapiens; identical to SEQ ID NO: 506603

SEQ ID NO: 544511 - RNA, 64 nt, Homo Sapiens; identical to SEQ ID NO: 506604

SEQ ID NO: 544512 - RNA, 64 nt, Homo Sapiens; identical to SEQ ID NO: 506605

SEQ ID NO: 544513 - RNA, 64 nt, Homo Sapiens; identical to SEQ ID NO: 506606

SEQ ID NO: 544514 - RNA, 64 nt, Homo Sapiens; identical to SEQ ID NO: 506607

SEQ ID NO: 544515 - RNA, 64 nt, Homo Sapiens; identical to SEQ ID NO: 506608

SEQ ID NO: 544516 - RNA, 64 nt, Homo Sapiens; identical to SEQ ID NO: 506609

SEQ ID NO: 544517 - RNA, 64 nt, Homo Sapiens; identical to SEQ ID NO: 506610

SEQ ID NO: 544518 - RNA, 64 nt, Homo Sapiens; identical to SEQ ID NO: 506611

SEQ ID NO: 544519 - RNA, 64 nt, Homo Sapiens; identical to SEQ ID NO: 506612

SEQ ID NO: 544520 - RNA, 64 nt, Homo Sapiens; identical to SEQ ID NO: 506613

SEQ ID NO: 544521 - RNA, 64 nt, Homo Sapiens; identical to SEQ ID NO: 506614

SEQ ID NO: 544522 - RNA, 64 nt, Homo Sapiens; identical to SEQ ID NO: 506615

SEQ ID NO: 544523 - RNA, 64 nt, Homo Sapiens; identical to SEQ ID NO: 506616

SEQ ID NO: 544524 - RNA, 64 nt, Homo Sapiens; identical to SEQ ID NO: 506617

SEQ ID NO: 544525 - RNA, 64 nt, Homo Sapiens; identical to SEQ ID NO: 506618

SEQ ID NO: 544526 - RNA, 64 nt, Homo Sapiens; identical to SEQ ID NO: 506619

SEQ ID NO: 544527 - RNA, 64 nt, Homo Sapiens; identical to SEQ ID NO: 506620

SEQ ID NO: 544528 - RNA, 64 nt, Homo Sapiens; identical to SEQ ID NO: 506621

SEQ ID NO: 544529 - RNA, 64 nt, Homo Sapiens; identical to SEQ ID NO: 506622

SEQ ID NO: 544530 - RNA, 64 nt, Homo Sapiens; identical to SEQ ID NO: 506623

SEQ ID NO: 544531 - RNA, 64 nt, Homo Sapiens; identical to SEQ ID NO: 506624

SEQ ID NO: 544532 - RNA, 64 nt, Homo Sapiens; identical to SEQ ID NO: 506625

SEQ ID NO: 544533 - RNA, 64 nt, Homo Sapiens; identical to SEQ ID NO: 506626

SEQ ID NO: 544534 - RNA, 64 nt, Homo Sapiens; identical to SEQ ID NO: 506627

SEQ ID NO: 544535 - RNA, 64 nt, Homo Sapiens; identical to SEQ ID NO: 506628

SEQ ID NO: 544536 - RNA, 64 nt, Homo Sapiens; identical to SEQ ID NO: 506629

SEQ ID NO: 544537 - RNA, 64 nt, Homo Sapiens; identical to SEQ ID NO: 506630

SEQ ID NO: 544538 - RNA, 64 nt, Homo Sapiens; identical to SEQ ID NO: 506631

SEQ ID NO: 544539 - RNA, 64 nt, Homo Sapiens; identical to SEQ ID NO: 506632

SEQ ID NO: 544540 - RNA, 64 nt, Homo Sapiens; identical to SEQ ID NO: 506633

SEQ ID NO: 544541 - RNA, 64 nt, Homo Sapiens; identical to SEQ ID NO: 506634

SEQ ID NO: 544542 - RNA, 64 nt, Homo Sapiens; identical to SEQ ID NO: 506635

SEQ ID NO: 544543 - RNA, 64 nt, Homo Sapiens; identical to SEQ ID NO: 506636

SEQ ID NO: 544544 - RNA, 64 nt, Homo Sapiens; identical to SEQ ID NO: 506637

SEQ ID NO: 544545 - RNA, 64 nt, Homo Sapiens; identical to SEQ ID NO: 506638

SEQ ID NO: 544546 - RNA, 64 nt, Homo Sapiens; identical to SEQ ID NO: 506639

SEQ ID NO: 544547 - RNA, 64 nt, Homo Sapiens; identical to SEQ ID NO: 506640

SEQ ID NO: 544548 - RNA, 64 nt, Homo Sapiens; identical to SEQ ID NO: 506641

SEQ ID NO: 544549 - RNA, 64 nt, Homo Sapiens; identical to SEQ ID NO: 506642

SEQ ID NO: 544550 - RNA, 64 nt, Homo Sapiens; identical to SEQ ID NO: 506643

SEQ ID NO: 544551 - RNA, 64 nt, Homo Sapiens; identical to SEQ ID NO: 506644

SEQ ID NO: 544552 - RNA, 64 nt, Homo Sapiens; identical to SEQ ID NO: 506645

SEQ ID NO: 544553 - RNA, 64 nt, Homo Sapiens; identical to SEQ ID NO: 506646

SEQ ID NO: 544554 - RNA, 64 nt, Homo Sapiens; identical to SEQ ID NO: 506647

SEQ ID NO: 544555 - RNA, 64 nt, Homo Sapiens; identical to SEQ ID NO: 506648

SEQ ID NO: 544556 - RNA, 64 nt, Homo Sapiens; identical to SEQ ID NO: 506649

SEQ ID NO: 544557 - RNA, 64 nt, Homo Sapiens; identical to SEQ ID NO: 506650

SEQ ID NO: 544558 - RNA, 64 nt, Homo Sapiens; identical to SEQ ID NO: 506651

SEQ ID NO: 544559 - RNA, 64 nt, Homo Sapiens; identical to SEQ ID NO: 506652

SEQ ID NO: 544560 - RNA, 64 nt, Homo Sapiens; identical to SEQ ID NO: 506653

SEQ ID NO: 544561 - RNA, 64 nt, Homo Sapiens; identical to SEQ ID NO: 506654

SEQ ID NO: 544562 - RNA, 64 nt, Homo Sapiens; identical to SEQ ID NO: 506655

SEQ ID NO: 544563 - RNA, 64 nt, Homo Sapiens; identical to SEQ ID NO: 506656

SEQ ID NO: 544564 - RNA, 64 nt, Homo Sapiens; identical to SEQ ID NO: 506657

SEQ ID NO: 544565 - RNA, 64 nt, Homo Sapiens; identical to SEQ ID NO: 506658

SEQ ID NO: 544566 - RNA, 64 nt, Homo Sapiens; identical to SEQ ID NO: 506659

SEQ ID NO: 544567 - RNA, 64 nt, Homo Sapiens; identical to SEQ ID NO: 506660

SEQ ID NO: 544568 - RNA, 64 nt, Homo Sapiens; identical to SEQ ID NO: 506661

SEQ ID NO: 544569 - RNA, 64 nt, Homo Sapiens; identical to SEQ ID NO: 506662

SEQ ID NO: 544570 - RNA, 64 nt, Homo Sapiens; identical to SEQ ID NO: 506663

SEQ ID NO: 544571 - RNA, 64 nt, Homo Sapiens; identical to SEQ ID NO: 506664

SEQ ID NO: 544572 - RNA, 64 nt, Homo Sapiens; identical to SEQ ID NO: 506665

SEQ ID NO: 544573 - RNA, 64 nt, Homo Sapiens; identical to SEQ ID NO: 506666

SEQ ID NO: 544574 - RNA, 64 nt, Homo Sapiens; identical to SEQ ID NO: 506667

SEQ ID NO: 544575 - RNA, 64 nt, Homo Sapiens; identical to SEQ ID NO: 506668

SEQ ID NO: 544576 - RNA, 64 nt, Homo Sapiens; identical to SEQ ID NO: 506669

SEQ ID NO: 544577 - RNA, 64 nt, Homo Sapiens; identical to SEQ ID NO: 506670

SEQ ID NO: 544578 - RNA, 64 nt, Homo Sapiens; identical to SEQ ID NO: 506671

SEQ ID NO: 544579 - RNA, 64 nt, Homo Sapiens; identical to SEQ ID NO: 506672

SEQ ID NO: 544580 - RNA, 64 nt, Homo Sapiens; identical to SEQ ID NO: 506673

SEQ ID NO: 544581 - RNA, 64 nt, Homo Sapiens; identical to SEQ ID NO: 506674

SEQ ID NO: 544582 - RNA, 64 nt, Homo Sapiens; identical to SEQ ID NO: 506675

SEQ ID NO: 544583 - RNA, 64 nt, Homo Sapiens; identical to SEQ ID NO: 506676

SEQ ID NO: 544584 - RNA, 64 nt, Homo Sapiens; identical to SEQ ID NO: 506677

SEQ ID NO: 544585 - RNA, 64 nt, Homo Sapiens; identical to SEQ ID NO: 506678

SEQ ID NO: 544586 - RNA, 64 nt, Homo Sapiens; identical to SEQ ID NO: 506679

SEQ ID NO: 544587 - RNA, 64 nt, Homo Sapiens; identical to SEQ ID NO: 506680

SEQ ID NO: 544588 - RNA, 52 nt, Homo Sapiens; identical to SEQ ID NO: 506681

SEQ ID NO: 544589 - RNA, 64 nt, Homo Sapiens; identical to SEQ ID NO: 506682

SEQ ID NO: 544590 - RNA, 64 nt, Homo Sapiens; identical to SEQ ID NO: 506683

SEQ ID NO: 544591 - RNA, 64 nt, Homo Sapiens; identical to SEQ ID NO: 506684

SEQ ID NO: 544592 - RNA, 64 nt, Homo Sapiens; identical to SEQ ID NO: 506685

SEQ ID NO: 544593 - RNA, 64 nt, Homo Sapiens; identical to SEQ ID NO: 506686

SEQ ID NO: 544594 - RNA, 64 nt, Homo Sapiens; identical to SEQ ID NO: 506687

SEQ ID NO: 544595 - RNA, 64 nt, Homo Sapiens; identical to SEQ ID NO: 506688

SEQ ID NO: 544596 - RNA, 64 nt, Homo Sapiens; identical to SEQ ID NO: 506689

SEQ ID NO: 544597 - RNA, 64 nt, Homo Sapiens; identical to SEQ ID NO: 506690

SEQ ID NO: 544598 - RNA, 64 nt, Homo Sapiens; identical to SEQ ID NO: 506691

SEQ ID NO: 544599 - RNA, 64 nt, Homo Sapiens; identical to SEQ ID NO: 506692

SEQ ID NO: 544600 - RNA, 64 nt, Homo Sapiens; identical to SEQ ID NO: 506693

SEQ ID NO: 544601 - RNA, 64 nt, Homo Sapiens; identical to SEQ ID NO: 506694

SEQ ID NO: 544602 - RNA, 64 nt, Homo Sapiens; identical to SEQ ID NO: 506695

SEQ ID NO: 544603 - RNA, 64 nt, Homo Sapiens; identical to SEQ ID NO: 506696

SEQ ID NO: 544604 - RNA, 64 nt, Homo Sapiens; identical to SEQ ID NO: 506697

SEQ ID NO: 544605 - RNA, 64 nt, Homo Sapiens; identical to SEQ ID NO: 506698

SEQ ID NO: 544606 - RNA, 64 nt, Homo Sapiens; identical to SEQ ID NO: 506699

SEQ ID NO: 544607 - RNA, 64 nt, Homo Sapiens; identical to SEQ ID NO: 506700

SEQ ID NO: 544608 - RNA, 64 nt, Homo Sapiens; identical to SEQ ID NO: 506701

SEQ ID NO: 544609 - RNA, 64 nt, Homo Sapiens; identical to SEQ ID NO: 506702

SEQ ID NO: 544610 - RNA, 64 nt, Homo Sapiens; identical to SEQ ID NO: 506703

SEQ ID NO: 544611 - RNA, 64 nt, Homo Sapiens; identical to SEQ ID NO: 506704

SEQ ID NO: 544612 - RNA, 64 nt, Homo Sapiens; identical to SEQ ID NO: 506705

SEQ ID NO: 544613 - RNA, 64 nt, Homo Sapiens; identical to SEQ ID NO: 506706

SEQ ID NO: 544614 - RNA, 64 nt, Homo Sapiens; identical to SEQ ID NO: 506707

SEQ ID NO: 544615 - RNA, 64 nt, Homo Sapiens; identical to SEQ ID NO: 506708

SEQ ID NO: 544616 - RNA, 64 nt, Homo Sapiens; identical to SEQ ID NO: 506709

SEQ ID NO: 544617 - RNA, 64 nt, Homo Sapiens; identical to SEQ ID NO: 506710

SEQ ID NO: 544618 - RNA, 64 nt, Homo Sapiens; identical to SEQ ID NO: 506711

SEQ ID NO: 544619 - RNA, 64 nt, Homo Sapiens; identical to SEQ ID NO: 506712

SEQ ID NO: 544620 - RNA, 64 nt, Homo Sapiens; identical to SEQ ID NO: 506713

SEQ ID NO: 544621 - RNA, 64 nt, Homo Sapiens; identical to SEQ ID NO: 506714

SEQ ID NO: 544622 - RNA, 64 nt, Homo Sapiens; identical to SEQ ID NO: 506715

SEQ ID NO: 544623 - RNA, 64 nt, Homo Sapiens; identical to SEQ ID NO: 506716

SEQ ID NO: 544624 - RNA, 64 nt, Homo Sapiens; identical to SEQ ID NO: 506717

SEQ ID NO: 544625 - RNA, 64 nt, Homo Sapiens; identical to SEQ ID NO: 506718

SEQ ID NO: 544626 - RNA, 64 nt, Homo Sapiens; identical to SEQ ID NO: 506719

SEQ ID NO: 544627 - RNA, 64 nt, Homo Sapiens; identical to SEQ ID NO: 506720

SEQ ID NO: 544628 - RNA, 64 nt, Homo Sapiens; identical to SEQ ID NO: 506721

SEQ ID NO: 544629 - RNA, 64 nt, Homo Sapiens; identical to SEQ ID NO: 506722

SEQ ID NO: 544630 - RNA, 64 nt, Homo Sapiens; identical to SEQ ID NO: 506723

SEQ ID NO: 544631 - RNA, 64 nt, Homo Sapiens; identical to SEQ ID NO: 506724

SEQ ID NO: 544632 - RNA, 64 nt, Homo Sapiens; identical to SEQ ID NO: 506725

SEQ ID NO: 544633 - RNA, 64 nt, Homo Sapiens; identical to SEQ ID NO: 506726

SEQ ID NO: 544634 - RNA, 64 nt, Homo Sapiens; identical to SEQ ID NO: 506727

SEQ ID NO: 544635 - RNA, 64 nt, Homo Sapiens; identical to SEQ ID NO: 506728

SEQ ID NO: 544636 - RNA, 64 nt, Homo Sapiens; identical to SEQ ID NO: 506729

SEQ ID NO: 544637 - RNA, 64 nt, Homo Sapiens; identical to SEQ ID NO: 506730

SEQ ID NO: 544638 - RNA, 64 nt, Homo Sapiens; identical to SEQ ID NO: 506731

SEQ ID NO: 544639 - RNA, 64 nt, Homo Sapiens; identical to SEQ ID NO: 506732

SEQ ID NO: 544640 - RNA, 64 nt, Homo Sapiens; identical to SEQ ID NO: 506733

SEQ ID NO: 544641 - RNA, 64 nt, Homo Sapiens; identical to SEQ ID NO: 506734

SEQ ID NO: 544642 - RNA, 64 nt, Homo Sapiens; identical to SEQ ID NO: 506735

SEQ ID NO: 544643 - RNA, 64 nt, Homo Sapiens; identical to SEQ ID NO: 506736

SEQ ID NO: 544644 - RNA, 64 nt, Homo Sapiens; identical to SEQ ID NO: 506737

SEQ ID NO: 544645 - RNA, 64 nt, Homo Sapiens; identical to SEQ ID NO: 506738

SEQ ID NO: 544646 - RNA, 64 nt, Homo Sapiens; identical to SEQ ID NO: 506739

SEQ ID NO: 544647 - RNA, 64 nt, Homo Sapiens; identical to SEQ ID NO: 506740

SEQ ID NO: 544648 - RNA, 64 nt, Homo Sapiens; identical to SEQ ID NO: 506741

SEQ ID NO: 544649 - RNA, 64 nt, Homo Sapiens; identical to SEQ ID NO: 506742

SEQ ID NO: 544650 - RNA, 64 nt, Homo Sapiens; identical to SEQ ID NO: 506743

SEQ ID NO: 544651 - RNA, 64 nt, Homo Sapiens; identical to SEQ ID NO: 506744

SEQ ID NO: 544652 - RNA, 64 nt, Homo Sapiens; identical to SEQ ID NO: 506745

SEQ ID NO: 544653 - RNA, 64 nt, Homo Sapiens; identical to SEQ ID NO: 506746

SEQ ID NO: 544654 - RNA, 64 nt, Homo Sapiens; identical to SEQ ID NO: 506747

SEQ ID NO: 544655 - RNA, 64 nt, Homo Sapiens; identical to SEQ ID NO: 506748

SEQ ID NO: 544656 - RNA, 64 nt, Homo Sapiens; identical to SEQ ID NO: 506749

SEQ ID NO: 544657 - RNA, 64 nt, Homo Sapiens; identical to SEQ ID NO: 506750

SEQ ID NO: 544658 - RNA, 64 nt, Homo Sapiens; identical to SEQ ID NO: 506751

SEQ ID NO: 544659 - RNA, 64 nt, Homo Sapiens; identical to SEQ ID NO: 506752

SEQ ID NO: 544660 - RNA, 64 nt, Homo Sapiens; identical to SEQ ID NO: 506753

SEQ ID NO: 544661 - RNA, 64 nt, Homo Sapiens; identical to SEQ ID NO: 506754

SEQ ID NO: 544662 - RNA, 64 nt, Homo Sapiens; identical to SEQ ID NO: 506755

SEQ ID NO: 544663 - RNA, 64 nt, Homo Sapiens; identical to SEQ ID NO: 506756

SEQ ID NO: 544664 - RNA, 64 nt, Homo Sapiens; identical to SEQ ID NO: 506757

SEQ ID NO: 544665 - RNA, 64 nt, Homo Sapiens; identical to SEQ ID NO: 506758

SEQ ID NO: 544666 - RNA, 64 nt, Homo Sapiens; identical to SEQ ID NO: 506759

SEQ ID NO: 544667 - RNA, 64 nt, Homo Sapiens; identical to SEQ ID NO: 506760

SEQ ID NO: 544668 - RNA, 64 nt, Homo Sapiens; identical to SEQ ID NO: 506761

SEQ ID NO: 544669 - RNA, 64 nt, Homo Sapiens; identical to SEQ ID NO: 506762

SEQ ID NO: 544670 - RNA, 64 nt, Homo Sapiens; identical to SEQ ID NO: 506763

SEQ ID NO: 544671 - RNA, 64 nt, Homo Sapiens; identical to SEQ ID NO: 506764

SEQ ID NO: 544672 - RNA, 64 nt, Homo Sapiens; identical to SEQ ID NO: 506765

SEQ ID NO: 544673 - RNA, 64 nt, Homo Sapiens; identical to SEQ ID NO: 506766

SEQ ID NO: 544674 - RNA, 64 nt, Homo Sapiens; identical to SEQ ID NO: 506767

SEQ ID NO: 544675 - RNA, 64 nt, Homo Sapiens; identical to SEQ ID NO: 506768

SEQ ID NO: 544676 - RNA, 64 nt, Homo Sapiens; identical to SEQ ID NO: 506769

SEQ ID NO: 544677 - RNA, 64 nt, Homo Sapiens; identical to SEQ ID NO: 506770

SEQ ID NO: 544678 - RNA, 64 nt, Homo Sapiens; identical to SEQ ID NO: 506771

SEQ ID NO: 544679 - RNA, 64 nt, Homo Sapiens; identical to SEQ ID NO: 506772

SEQ ID NO: 544680 - RNA, 64 nt, Homo Sapiens; identical to SEQ ID NO: 506773

SEQ ID NO: 544681 - RNA, 64 nt, Homo Sapiens; identical to SEQ ID NO: 506774

SEQ ID NO: 544682 - RNA, 62 nt, Homo Sapiens; identical to SEQ ID NO: 506775

SEQ ID NO: 544683 - RNA, 64 nt, Homo Sapiens; identical to SEQ ID NO: 506776

SEQ ID NO: 544684 - RNA, 64 nt, Homo Sapiens; identical to SEQ ID NO: 506777

SEQ ID NO: 544685 - RNA, 64 nt, Homo Sapiens; identical to SEQ ID NO: 506778

SEQ ID NO: 544686 - RNA, 64 nt, Homo Sapiens; identical to SEQ ID NO: 506779

SEQ ID NO: 544687 - RNA, 64 nt, Homo Sapiens; identical to SEQ ID NO: 506780

SEQ ID NO: 544688 - RNA, 64 nt, Homo Sapiens; identical to SEQ ID NO: 506781

SEQ ID NO: 544689 - RNA, 64 nt, Homo Sapiens; identical to SEQ ID NO: 506782

SEQ ID NO: 544690 - RNA, 64 nt, Homo Sapiens; identical to SEQ ID NO: 506783

SEQ ID NO: 544691 - RNA, 64 nt, Homo Sapiens; identical to SEQ ID NO: 506784

SEQ ID NO: 544692 - RNA, 64 nt, Homo Sapiens; identical to SEQ ID NO: 506785

SEQ ID NO: 544693 - RNA, 64 nt, Homo Sapiens; identical to SEQ ID NO: 506786

SEQ ID NO: 544694 - RNA, 64 nt, Homo Sapiens; identical to SEQ ID NO: 506787

SEQ ID NO: 544695 - RNA, 64 nt, Homo Sapiens; identical to SEQ ID NO: 506788

SEQ ID NO: 544696 - RNA, 64 nt, Homo Sapiens; identical to SEQ ID NO: 506789

SEQ ID NO: 544697 - RNA, 64 nt, Homo Sapiens; identical to SEQ ID NO: 506790

SEQ ID NO: 544698 - RNA, 64 nt, Homo Sapiens; identical to SEQ ID NO: 506791

SEQ ID NO: 544699 - RNA, 64 nt, Homo Sapiens; identical to SEQ ID NO: 506792

SEQ ID NO: 544700 - RNA, 64 nt, Homo Sapiens; identical to SEQ ID NO: 506793

SEQ ID NO: 544701 - RNA, 64 nt, Homo Sapiens; identical to SEQ ID NO: 506794

SEQ ID NO: 544702 - RNA, 63 nt, Homo Sapiens
uagagcuccuaaaaaugagaaauauuuauugaaauaagaaaaaagcccucagacauguugaau

SEQ ID NO: 544703 - RNA, 63 nt, Homo Sapiens
uuguuuguauaaaacaauuauaaugaaguguuuauaagaaauuguaaacaaauguaaaacuaa

SEQ ID NO: 544704 - RNA, 63 nt, Homo Sapiens
ccaccgcugccagcccagaguuacccucuaaagauaagaaaaaggcuauuaauaucauacuaa

SEQ ID NO: 544705 - RNA, 63 nt, Homo Sapiens
ugauuaauuaugaagaugaaacacuagagucauauaagaaauaaaaauugggcaauaaaauaa

SEQ ID NO: 544706 - RNA, 63 nt, Homo Sapiens
uugcucccuugggacaguuagaaaugacucauaauaagaaagcuucaggggagaaaagugaau

SEQ ID NO: 544707 - RNA, 63 nt, Homo Sapiens
uucuagaaucauguuugaauguuugacuuuaagauaagaaauuuuuauugaguaaagguuaua

SEQ ID NO: 544708 - RNA, 63 nt, Homo Sapiens
uuguauagaaaugaagguuuauggauauaaaaaauaagaaauuggaagagucuaauaguaauu

SEQ ID NO: 544709 - RNA, 63 nt, Homo Sapiens
aaggucuauuccauucuccagcuaaaaaauaggauaagaaauuuuuaacuuuuuuggucuuca

SEQ ID NO: 544710 - RNA, 63 nt, Homo Sapiens
agggaaaaaagagaaaaacuccaaauuuaaauuauaagaaagacaaacuuuuagaguaaaaag

SEQ ID NO: 544711 - RNA, 63 nt, Homo Sapiens
aguucuucaggagggccgaccaaaguaggcagaauaagaaaauuuuugggaauuuuacagagu

SEQ ID NO: 544712 - RNA, 63 nt, Homo Sapiens
cagaaugcagaacaccuacaauguuucagcauuauaagaaagguuuuaacuucuaaagaaaau

SEQ ID NO: 544713 - RNA, 63 nt, Homo Sapiens
agucuccuacauagcaguguuauuuauguacagauaagaaaaccauaugucagccaaagauuu

SEQ ID NO: 544714 - RNA, 63 nt, Homo Sapiens
uaauaauagcccugagauguuucuaacauuuaaauaagaaaaaaaucaaaucgaagucagccu

SEQ ID NO: 544715 - RNA, 63 nt, Homo Sapiens
aaaaaucaaucuuucuuacccauguaucacaagauaagaaaugagugguguuuacugcugcag

SEQ ID NO: 544716 - RNA, 63 nt, Homo Sapiens
uggauuuuugccuuuuuaccauacugauuauuaauaagaaauugauuguuauuguuggauguu

SEQ ID NO: 544717 - RNA, 63 nt, Homo Sapiens
gcaaaacacaagcugcauuuuuauuuauuuugcauaagaaagguaaaucuuuuuacaaaaaaa

SEQ ID NO: 544718 - RNA, 63 nt, Homo Sapiens
aacuguagaugauauuuuauguuuaaucuguaaauaagaaauguauuuaaauuaaaagggauc

SEQ ID NO: 544719 - RNA, 63 nt, Homo Sapiens
aauguuuugguuauucaugaucacuugggcaguauaagaaaauguagcuucugaauauuggcc

SEQ ID NO: 544720 - RNA, 63 nt, Homo Sapiens
acaauguuuggaugcaacgcagaauaaaagaauauaagaaauagcuuuuuguugcauuaaugu

SEQ ID NO: 544721 - RNA, 63 nt, Homo Sapiens
aauugguauggccauuagguucaguccuugaagauaagaaacuuguucucuguuuguugucuu

SEQ ID NO: 544722 - RNA, 63 nt, Homo Sapiens
ggaauucaauguauguuuguuuuauacuguuugauaagaaaaguagguccagccuuaagcagc

SEQ ID NO: 544723 - RNA, 63 nt, Homo Sapiens
uacugcccuaccuugacuguuauaaaacucagcauaagaaaaaaugauaauuugcuuaugucu

SEQ ID NO: 544724 - RNA, 63 nt, Homo Sapiens
uauauugcuagguagaauuuaaaagguauguugauaagaaaccaguuugaaaccagugaggaa

SEQ ID NO: 544725 - RNA, 63 nt, Homo Sapiens
uguguacucuagaaauggaguaauuuuuuucaaauaagaaaauuaacaauaagaaauaagaaa

SEQ ID NO: 544726 - RNA, 63 nt, Homo Sapiens
auuuuuuucaaauaagaaaauuaacaauaagaaauaagaaauauacuguaaagucuauucugu

SEQ ID NO: 544727 - RNA, 63 nt, Homo Sapiens
agaaauaauuuuuuucaaauauucuguuuaacaauaagaaauauuguuguuacuguaaagucu

SEQ ID NO: 544728 - RNA, 63 nt, Homo Sapiens
uggaagauucuuuuaaaaauuuaaaaaaugcuaauaagaaaaugucagagaugguauuaccuu

SEQ ID NO: 544729 - RNA, 63 nt, Homo Sapiens
auugcaaacacauuaaaacaaaaaaggguaaguauaagaaaauauggauagauuuuuggaacg

SEQ ID NO: 544730 - RNA, 63 nt, Homo Sapiens
uuauuaaaauuaucuuugaauuggaacugauucauaagaaaagaugguuggucucuaauauau

SEQ ID NO: 544731 - RNA, 63 nt, Homo Sapiens
ugacauuucacagaugcacuccaaaacaccggcauaagaaauuugaugguaauuucauuaguc

SEQ ID NO: 544732 - RNA, 63 nt, Homo Sapiens
aauuuucuacuucuacacccguaccuuuccaccauaagaaaugauucaaucagauuuuccaaa

SEQ ID NO: 544733 - RNA, 63 nt, Homo Sapiens
aaucagucaauauuuccaaaagagucuugguagauaagaaaaacuacuucugcuguucaauca

SEQ ID NO: 544734 - RNA, 63 nt, Homo Sapiens
ugauaagaauauagaugaucaagaauggcuaaaauaagaaacgaaaauaagguucagaugcag

SEQ ID NO: 544735 - RNA, 63 nt, Homo Sapiens
gccauagaaauguagguccucagaaaguguauaauaagaaacuuauuucucauaucaacuuag

SEQ ID NO: 544736 - RNA, 63 nt, Homo Sapiens
auaagaaacuuauuucucauaucaacuuagucaauaagaaaauauauucuuucaaaggaacau

SEQ ID NO: 544737 - RNA, 63 nt, Homo Sapiens
gaugcauaguauuuuagucuacuuguauuguuuauaagaaacccaagcaaaaauauauagcaa

SEQ ID NO: 544738 - RNA, 63 nt, Homo Sapiens
auuguucagcaaccuucaguaucuauuauuuuaauaagaaagaaacuuccccuaaacuuuaga

SEQ ID NO: 544739 - RNA, 63 nt, Homo Sapiens
gcaauaucuggguacuguauuuccuaaaaugccauaagaaaauuuuuacaaguggcuuuacau

SEQ ID NO: 544740 - RNA, 63 nt, Homo Sapiens
aauaaagacguauguuugacgguaaucuuucaaauaagaaaaauuccucuguaaagaucagau

SEQ ID NO: 544741 - RNA, 63 nt, Homo Sapiens
aacuacuugauauagcaaaguaguuggucuuagauaagaaaugauacaguagcaucauaccua

SEQ ID NO: 544742 - RNA, 63 nt, Homo Sapiens
uguauuaaaguccuuuuuugcaaaauuucuggaauaagaaauucagcuuguccagaccuggaa

SEQ ID NO: 544743 - RNA, 63 nt, Homo Sapiens
aaaucuauucccaugccagaaucuuaucaauacauaagaaauuuaggaagauuaggugccaaa

SEQ ID NO: 544744 - RNA, 63 nt, Homo Sapiens
uaauguugauguaaguaaugcgguuacugaaucauaagaaaaugccaucucuuuuuaguugaa

SEQ ID NO: 544745 - RNA, 63 nt, Homo Sapiens
auuauggaaauguugucuuuuauacuuaguuauauaagaaaaaagggaguuaugcaauuaaua

SEQ ID NO: 544746 - RNA, 63 nt, Homo Sapiens
guuuuauuuuuuucccuuuagcauugcaugugaauaagaaaauaauguuuaaagaaaaaaaaa

SEQ ID NO: 544747 - RNA, 63 nt, Homo Sapiens; identical to SEQ ID NO: 289563

SEQ ID NO: 544748 - RNA, 63 nt, Homo Sapiens
aagcuuuucaccgauacucaauccuuaguacacauaagaaaauucauacuggggagaaacccc

SEQ ID NO: 544749 - RNA, 63 nt, Homo Sapiens
aagcuuuuaaccaguccucacaccuuaugagacauaagaaaauucauaguaaagagaaacccu

SEQ ID NO: 544750 - RNA, 63 nt, Homo Sapiens
guuguuuuaacuaguucucgaacuuuacuaugcauaagaaaauucaaacuggagagaaacucu

SEQ ID NO: 544751 - RNA, 63 nt, Homo Sapiens
ugcuugacccugaaauauuucguuguuuuguggauaagaaaaaaaaaauguauguugguuuag

SEQ ID NO: 544752 - RNA, 63 nt, Homo Sapiens
guuuaacagaaaaaugaaauggcaguauugacaauaagaaacaguuguaauaucaguuacagu

SEQ ID NO: 544753 - RNA, 63 nt, Homo Sapiens
uauccauuuuauuaccauuuaacauauuucuuaauaagaaaaauuugauaaagcauauuuaug

SEQ ID NO: 544754 - RNA, 63 nt, Homo Sapiens
ugucaaugaguuucuucaaagucauaaacaaauauaagaaagcugugacuuugaggccaauga

SEQ ID NO: 544755 - RNA, 63 nt, Homo Sapiens
uguauaauaaaaauguggugccucuuagggaacauaagaaaaaauuuuccccaaagauaauau

SEQ ID NO: 544756 - RNA, 63 nt, Homo Sapiens
uaagauagaaaagcuuuguugcagaagauuaagauaagaaauauuaagaccuucauuuaagag

SEQ ID NO: 544757 - RNA, 63 nt, Homo Sapiens
cucauauuuaguauugaauacuuacauucucuaauaagaaaaccaccccuuagauugaaguaa

SEQ ID NO: 544758 - RNA, 63 nt, Homo Sapiens
cacuucuggucaaucaacacuaccagcguauauauaagaaagacaucuuucucuuuucuaaaa

SEQ ID NO: 544759 - RNA, 63 nt, Homo Sapiens
ccugacagacaagcagaugaccucacaggagugauaagaaacaucugcuccacgccaacuccc

SEQ ID NO: 544760 - RNA, 63 nt, Homo Sapiens
gaagacaucauugguucuguguuuccuacggaaauaagaaacgauaaauauugcacugaaugu

SEQ ID NO: 544761 - RNA, 63 nt, Homo Sapiens
guuguaaauuuguaaagauuaccuugccacuuuauaagaaaguguauuuaacuaaaaagucau

SEQ ID NO: 544762 - RNA, 63 nt, Homo Sapiens
cacaaaauaguacuuuguggaucauuucaagauauaagaaauuuuggaaauuccaccauaaau

SEQ ID NO: 544763 - RNA, 63 nt, Homo Sapiens
guucugguagauauauccugcacuuuagagauaauaagaaauuaggaggcuaugucucuaauu

SEQ ID NO: 544764 - RNA, 63 nt, Homo Sapiens
acauuagcaagcuuaaugguauguaaacugaaaauaagaaaauagcaaacaaaaaaaauuugu

SEQ ID NO: 544765 - RNA, 63 nt, Homo Sapiens
uaaaguaaaccagcuuaucuauuggaaagugggauaagaaaucuucauuaauuacacuuuaaa

SEQ ID NO: 544766 - RNA, 63 nt, Homo Sapiens
aucugacuaaagucaaagaaaauuuuuuuuauaauaagaaaacuuaugugaauaucccuugcc

SEQ ID NO: 544767 - RNA, 63 nt, Homo Sapiens
gugucaggcugucacuguucacacaaauuuuuaauaagaaacauuuaccaagggagcaucuuu

SEQ ID NO: 544768 - RNA, 63 nt, Homo Sapiens
gaacuggcauccugcuuuagccugagacuugccauaagaaacugcugaguacuuggcaaaccc

SEQ ID NO: 544769 - RNA, 63 nt, Homo Sapiens
uaguauuccugagaacuuuauuuuggaaaauuuauaagaaaguaauccaaauaagaaacacga

SEQ ID NO: 544770 - RNA, 63 nt, Homo Sapiens
uuauuuuggaaaauuuauaagaaaguaauccaaauaagaaacacgauaguugaaaauaauuuu

SEQ ID NO: 544771 - RNA, 63 nt, Homo Sapiens
cagacuugcucuugauagaacaguuugcaaacgauaagaaaugcuguaagguggaaauuucau

SEQ ID NO: 544772 - RNA, 63 nt, Homo Sapiens
aaggagcucuuacgaaaaaccuuuccuuaaaauauaagaaauaacacaaguuuuugccuaucc

SEQ ID NO: 544773 - RNA, 63 nt, Homo Sapiens
ucaugcuggagagaaacacuaucuuuauuacacauaagaaaauaagcuuuuaaacaguccuca

SEQ ID NO: 544774 - RNA, 63 nt, Homo Sapiens
ucauacuggagagaaaaucucagucuaguaaacauaagaaaauuaaauccuucagcugauucu

SEQ ID NO: 544775 - RNA, 63 nt, Homo Sapiens
aaauuacaggagcaauuaagauuaguaauaaaaauaagaaauaugacagauuuuagagcaaaa

SEQ ID NO: 544776 - RNA, 63 nt, Homo Sapiens
gcuacagugacagauuuuaguuuguuaauaaaaauaagaaauaccuaaaaggaugucuaaaug

SEQ ID NO: 544777 - RNA, 63 nt, Homo Sapiens
ucuuagagguuugucuacccuuuauuauaaaugauaagaaaaaauuuaacacuugggacaaca

SEQ ID NO: 544778 - RNA, 63 nt, Homo Sapiens
gggauaauuuucugaacuuuaguuuugauuuugauaagaaacuuguuggaauugggacuuagg

SEQ ID NO: 544779 - RNA, 63 nt, Homo Sapiens
ggaggcaaagaacuuaaguuggaaauuggguuuauaagaaaauaguagagcugcaccuaaaga

SEQ ID NO: 544780 - RNA, 63 nt, Homo Sapiens
gucauguuuugugggaaaauuucuaguccaaauauaagaaacuaauguaucuuuauuagugac

SEQ ID NO: 544781 - RNA, 64 nt, Homo Sapiens; identical to SEQ ID NO: 519022

SEQ ID NO: 544782 - RNA, 64 nt, Homo Sapiens; identical to SEQ ID NO: 519023

SEQ ID NO: 544783 - RNA, 64 nt, Homo Sapiens; identical to SEQ ID NO: 519024

SEQ ID NO: 544784 - RNA, 64 nt, Homo Sapiens; identical to SEQ ID NO: 519025

SEQ ID NO: 544785 - RNA, 64 nt, Homo Sapiens; identical to SEQ ID NO: 519026

SEQ ID NO: 544786 - RNA, 64 nt, Homo Sapiens; identical to SEQ ID NO: 519027

SEQ ID NO: 544787 - RNA, 64 nt, Homo Sapiens; identical to SEQ ID NO: 519028

SEQ ID NO: 544788 - RNA, 64 nt, Homo Sapiens; identical to SEQ ID NO: 519029

SEQ ID NO: 544789 - RNA, 64 nt, Homo Sapiens; identical to SEQ ID NO: 519030

SEQ ID NO: 544790 - RNA, 64 nt, Homo Sapiens; identical to SEQ ID NO: 519031

SEQ ID NO: 544791 - RNA, 64 nt, Homo Sapiens; identical to SEQ ID NO: 519032

SEQ ID NO: 544792 - RNA, 64 nt, Homo Sapiens; identical to SEQ ID NO: 519033

SEQ ID NO: 544793 - RNA, 64 nt, Homo Sapiens; identical to SEQ ID NO: 512337

SEQ ID NO: 544794 - RNA, 64 nt, Homo Sapiens; identical to SEQ ID NO: 512338

SEQ ID NO: 544795 - RNA, 64 nt, Homo Sapiens; identical to SEQ ID NO: 512339

SEQ ID NO: 544796 - RNA, 64 nt, Homo Sapiens; identical to SEQ ID NO: 512340

SEQ ID NO: 544797 - RNA, 64 nt, Homo Sapiens; identical to SEQ ID NO: 512341

SEQ ID NO: 544798 - RNA, 64 nt, Homo Sapiens; identical to SEQ ID NO: 512342

SEQ ID NO: 544799 - RNA, 64 nt, Homo Sapiens; identical to SEQ ID NO: 512343

SEQ ID NO: 544800 - RNA, 64 nt, Homo Sapiens; identical to SEQ ID NO: 512344

SEQ ID NO: 544801 - RNA, 64 nt, Homo Sapiens; identical to SEQ ID NO: 512345

SEQ ID NO: 544802 - RNA, 64 nt, Homo Sapiens; identical to SEQ ID NO: 512346

SEQ ID NO: 544803 - RNA, 64 nt, Homo Sapiens; identical to SEQ ID NO: 512347

SEQ ID NO: 544804 - RNA, 64 nt, Homo Sapiens; identical to SEQ ID NO: 512348

SEQ ID NO: 544805 - RNA, 64 nt, Homo Sapiens; identical to SEQ ID NO: 512349

SEQ ID NO: 544806 - RNA, 64 nt, Homo Sapiens; identical to SEQ ID NO: 512350

SEQ ID NO: 544807 - RNA, 64 nt, Homo Sapiens; identical to SEQ ID NO: 512351

SEQ ID NO: 544808 - RNA, 64 nt, Homo Sapiens; identical to SEQ ID NO: 512352

SEQ ID NO: 544809 - RNA, 64 nt, Homo Sapiens; identical to SEQ ID NO: 512353

SEQ ID NO: 544810 - RNA, 64 nt, Homo Sapiens; identical to SEQ ID NO: 512354

SEQ ID NO: 544811 - RNA, 64 nt, Homo Sapiens; identical to SEQ ID NO: 512355

SEQ ID NO: 544812 - RNA, 64 nt, Homo Sapiens; identical to SEQ ID NO: 512356

SEQ ID NO: 544813 - RNA, 64 nt, Homo Sapiens; identical to SEQ ID NO: 512357

SEQ ID NO: 544814 - RNA, 64 nt, Homo Sapiens; identical to SEQ ID NO: 377795

SEQ ID NO: 544815 - RNA, 64 nt, Homo Sapiens; identical to SEQ ID NO: 377796

SEQ ID NO: 544816 - RNA, 64 nt, Homo Sapiens; identical to SEQ ID NO: 377797

SEQ ID NO: 544817 - RNA, 64 nt, Homo Sapiens; identical to SEQ ID NO: 377798

SEQ ID NO: 544818 - RNA, 64 nt, Homo Sapiens; identical to SEQ ID NO: 377799

SEQ ID NO: 544819 - RNA, 64 nt, Homo Sapiens; identical to SEQ ID NO: 377800

SEQ ID NO: 544820 - RNA, 64 nt, Homo Sapiens; identical to SEQ ID NO: 377801

SEQ ID NO: 544821 - RNA, 62 nt, Homo Sapiens; identical to SEQ ID NO: 377802

SEQ ID NO: 544822 - RNA, 64 nt, Homo Sapiens; identical to SEQ ID NO: 377803

SEQ ID NO: 544823 - RNA, 64 nt, Homo Sapiens; identical to SEQ ID NO: 377804

SEQ ID NO: 544824 - RNA, 64 nt, Homo Sapiens; identical to SEQ ID NO: 377805

SEQ ID NO: 544825 - RNA, 64 nt, Homo Sapiens; identical to SEQ ID NO: 377806

SEQ ID NO: 544826 - RNA, 64 nt, Homo Sapiens; identical to SEQ ID NO: 377807

SEQ ID NO: 544827 - RNA, 64 nt, Homo Sapiens; identical to SEQ ID NO: 377808

SEQ ID NO: 544828 - RNA, 64 nt, Homo Sapiens; identical to SEQ ID NO: 377809

SEQ ID NO: 544829 - RNA, 64 nt, Homo Sapiens; identical to SEQ ID NO: 377810

SEQ ID NO: 544830 - RNA, 64 nt, Homo Sapiens; identical to SEQ ID NO: 377811

SEQ ID NO: 544831 - RNA, 64 nt, Homo Sapiens; identical to SEQ ID NO: 377812

SEQ ID NO: 544832 - RNA, 64 nt, Homo Sapiens; identical to SEQ ID NO: 377813

SEQ ID NO: 544833 - RNA, 64 nt, Homo Sapiens; identical to SEQ ID NO: 377814

SEQ ID NO: 544834 - RNA, 64 nt, Homo Sapiens; identical to SEQ ID NO: 377815

SEQ ID NO: 544835 - RNA, 64 nt, Homo Sapiens; identical to SEQ ID NO: 377816

SEQ ID NO: 544836 - RNA, 64 nt, Homo Sapiens; identical to SEQ ID NO: 377817

SEQ ID NO: 544837 - RNA, 64 nt, Homo Sapiens; identical to SEQ ID NO: 377818

SEQ ID NO: 544838 - RNA, 64 nt, Homo Sapiens; identical to SEQ ID NO: 377819

SEQ ID NO: 544839 - RNA, 64 nt, Homo Sapiens; identical to SEQ ID NO: 377820

SEQ ID NO: 544840 - RNA, 64 nt, Homo Sapiens
cuuaggaauaaucacuucaacuccugauuggucccgggccaagcugaauagcccuuaugaauca

SEQ ID NO: 544841 - RNA, 64 nt, Homo Sapiens
cuuaugaaucaucacuucgguuccugauuggucccgggccaaggucccagaccaagcugaauca

SEQ ID NO: 544842 - RNA, 64 nt, Homo Sapiens
auuggccaggccugacccucuuggaccuuucuucuuugccgacaaccacugcccagcagccucu

SEQ ID NO: 544843 - RNA, 64 nt, Homo Sapiens
gagcagcauuucauguucuuuugcuguuuugugcuuugccgauuuuggauuuuauuuuucacaa

SEQ ID NO: 544844 - RNA, 64 nt, Homo Sapiens
ugguuuuauuuauaauaauuuguuucugaagaaauuugccgagaguuacaggucaaaaagccuu

SEQ ID NO: 544845 - RNA, 64 nt, Homo Sapiens
aucaucuccccaccucuccuccccucuccucaguuuugccgacugcuuuucaucugagucacca

SEQ ID NO: 544846 - RNA, 64 nt, Homo Sapiens
cuguagcagagaaaacguaucuagggccguggccuuugccgagaaucggaggcggcgccccguu

SEQ ID NO: 544847 - RNA, 64 nt, Homo Sapiens
ccaagaguuuugggaguugucacccauuuuuccuuuugccgaccaaauccuugaugauugacaa

SEQ ID NO: 544848 - RNA, 64 nt, Homo Sapiens
ucuuuucuuuucuugccuuuuuuuuuuuuugaaauuugccgagcaguggagcccucugacaauu

SEQ ID NO: 544849 - RNA, 64 nt, Homo Sapiens
gaccugaugcccugagagcccacugcaguuggacuuugccgaugcugcaagaaggggugcagag

SEQ ID NO: 544850 - RNA, 64 nt, Homo Sapiens
guuuuuuccgacuguaagagauauuugauguccuuuugccgagguggauguguuagucucaggc

SEQ ID NO: 544851 - RNA, 64 nt, Homo Sapiens
caauaaauugccuuuagcaggcaauuuuuuuuuuuuugccgaaaaaagcuuacacagcuucuua

SEQ ID NO: 544852 - RNA, 64 nt, Homo Sapiens
ggaaaaggcucuuuagagauccuauuagauuugcuuugccgauugucacucuucaucacaggca

SEQ ID NO: 544853 - RNA, 64 nt, Homo Sapiens
ggagggagaacucauuuuacagaacuugguuuccuuugccgaucuuauguacauacccauuuua

SEQ ID NO: 544854 - RNA, 64 nt, Homo Sapiens
ucccuccucacaucccucccuggcuggccaggguuuugccgauuugugugucaccuuggcuggc

SEQ ID NO: 544855 - RNA, 64 nt, Homo Sapiens
uagaagguggagaugaugauugcuagaagcuaaauuugccgagugcuggaaaagaagauccagu

SEQ ID NO: 544856 - RNA, 64 nt, Homo Sapiens
cauguaguuuauagaaaguauacucuaaagggaauuugccgaagaccuuuuacugauugaacag

SEQ ID NO: 544857 - RNA, 64 nt, Homo Sapiens
gcuaugccccggacaaaacgcuguggacccugcguuugccgagcuaccagccgcccgcccuggg

SEQ ID NO: 544858 - RNA, 64 nt, Homo Sapiens
gauuuuaugcacagccuaguuaucaaggggaugauuugccgacauguuugagaacccccuaacc

SEQ ID NO: 544859 - RNA, 64 nt, Homo Sapiens
gguuuggagaucuuuagggggagagaggauuugauuugccgagugcuucacggaggauguuggg

SEQ ID NO: 544860 - RNA, 64 nt, Homo Sapiens
aguauuuuuuauguagccauaauuuuuuuuuuuuuuugccgaaaucugaauaaacuacauauau

SEQ ID NO: 544861 - RNA, 61 nt, Homo Sapiens
gcagcuuggcuugguagcucccacuggaugcuuugccgaaacgauucccagacuggcuuga

SEQ ID NO: 544862 - RNA, 64 nt, Homo Sapiens
auucaaaugcaugauauuguauguaccugggaaauuugccgauuuccuaagcuguuggaagggg

SEQ ID NO: 544863 - RNA, 64 nt, Homo Sapiens
aggagcacuacagauugagcagagaauguugucuuuugccgaccaaauaucucccaccuaaaau

SEQ ID NO: 544864 - RNA, 64 nt, Homo Sapiens
gaaacucaacucaauaaaaaucauguggcuaguguuugccgaauauugaggcccaguaagacac

SEQ ID NO: 544865 - RNA, 64 nt, Homo Sapiens
agggcaggcuggcugcacggggagagggaaguauuuugccgaaauaugagaacuggggccuccu

SEQ ID NO: 544866 - RNA, 64 nt, Homo Sapiens
cucaguauccagagcuuacaaggagcugcaaggguuugccgagggcugcccagcucugcuucug

SEQ ID NO: 544867 - RNA, 64 nt, Homo Sapiens
uguuaguugggaaagauugaguuaucagauuuaauuugccgaugggagccuuuaucugucauua

SEQ ID NO: 544868 - RNA, 64 nt, Homo Sapiens
cugcaauaaaguguuguaauucagaaaucugaccuuugccgaugcugcccaaucuucaccagcu

SEQ ID NO: 544869 - RNA, 64 nt, Homo Sapiens
auuuugguuagaucuuuuaguguuugauuuuuguuuugccgagggaucuuuuauuuuuccuuca

SEQ ID NO: 544870 - RNA, 64 nt, Homo Sapiens
uauuuuuauaggaagccaauauugaaaucucucauuugccgacuuuccaggaauccaacugagc

SEQ ID NO: 544871 - RNA, 64 nt, Homo Sapiens
uccccucccgucuacucauuccccggggcguuucuuugccgauuuuugaaugugauuuuaaaga

SEQ ID NO: 544872 - RNA, 64 nt, Homo Sapiens
accacgcuugccgccaucucagggagagcaacccuuugccgauggugggggccagccucgcugg

SEQ ID NO: 544873 - RNA, 64 nt, Homo Sapiens
uccagcggaaccccccagggguugugcacugaccuuugccgacccucagcuggccacccugcac

SEQ ID NO: 544874 - RNA, 64 nt, Homo Sapiens
gaugguugcaucucucggaccaccgcuguuuucuuuugccgaacagaccugucuucucaucagc

SEQ ID NO: 544875 - RNA, 64 nt, Homo Sapiens
uuggccuccucaaaagcagcucauaaccuuuauauuugccgaauucuauacccaccaccucccu

SEQ ID NO: 544876 - RNA, 64 nt, Homo Sapiens
aaauacgacauuaacaggagagcagcaguacgauuuugccgauggaauaacagauuugccggca

SEQ ID NO: 544877 - RNA, 64 nt, Homo Sapiens
uaaguuauucgacggaggacagaguaugugagccuuugccgaacaaacaaacguaaguuauugu

SEQ ID NO: 544878 - RNA, 64 nt, Homo Sapiens
aacccaggggacuggcaacuauaacaucgaagacuuugccgaccugggcauguuuccaccguuu

SEQ ID NO: 544879 - RNA, 64 nt, Homo Sapiens
gguauuugaaguguccagcaguugcuugaaaugcuuugccgaaucugacuccaguaagaaugug

SEQ ID NO: 544880 - RNA, 64 nt, Homo Sapiens
gaauaacagauuugccggcaagcagcaguacgauuuugccgaugaaauacgacauuaacaggag

SEQ ID NO: 544881 - RNA, 64 nt, Homo Sapiens
cuguauauuuaucagacucccuauggucaucucuuuugccgagaggguuaguuggcaguuaguu

SEQ ID NO: 544882 - RNA, 64 nt, Homo Sapiens
gagcuggcagcauggagcccucggcuccccagacuuugccgaggggcugcuccggaccccguug

SEQ ID NO: 544883 - RNA, 64 nt, Homo Sapiens
gugucaccugcuugccuuagaagucucaccucaauuugccgacaguaucggggugggucagaaa

SEQ ID NO: 544884 - RNA, 64 nt, Homo Sapiens
caaccaaauaaaacugaacuuggcaaaaaagaacuuugccgagaaaauuguguaccugccagaa

SEQ ID NO: 544885 - RNA, 64 nt, Homo Sapiens
cuuugacauucacauccucagugucucagucuuuuuugccgagaaagcacaguagucugggacu

SEQ ID NO: 544886 - RNA, 64 nt, Homo Sapiens
cgccuuggcuggcacccucuugucugggucaacauuugccgagaucaacuccuugguccccugu

SEQ ID NO: 544887 - RNA, 64 nt, Homo Sapiens
ugguguccgacagcucccugaggcaguguuugcuuuugccgagcgaagauaaaaagcacuguug

SEQ ID NO: 544888 - RNA, 64 nt, Homo Sapiens
uuacaguugagggagcugagcucagauucaguucuuugccgaagcccucauagcugguaagugg

SEQ ID NO: 544889 - RNA, 64 nt, Homo Sapiens
auuucuuuuuuacuuagagaaucguucuaguguuuuugccgaagauuaccgcuggccuacugug

SEQ ID NO: 544890 - RNA, 64 nt, Homo Sapiens
gccuugcaggcugggcucaggaguuggucugugauuugccgacaaggagcaaagcuguauccug

SEQ ID NO: 544891 - RNA, 64 nt, Homo Sapiens
ccagcugggucguggagaccucuccuuuugcauuuuugccgagaaauuucuucugcaauucagg

SEQ ID NO: 544892 - RNA, 64 nt, Homo Sapiens
caugguuaugccuaauuuauuuguuucuuuaaguuuugccgagaaaggaacgacaauguucucu

SEQ ID NO: 544893 - RNA, 64 nt, Homo Sapiens
cucuacuguauaccaggggcgaggcuguagaauauuugccgagcacugggaaaucauuagaaag

SEQ ID NO: 544894 - RNA, 64 nt, Homo Sapiens
ggagcugcguagucuccucagacauagucaaagcuuugccgagaaaagaaauguaugaacuaua

SEQ ID NO: 544895 - RNA, 64 nt, Homo Sapiens
cauaguuuuuuuuuagcagacuuauaaaauagcuuuugccgaaaccuuucugaagcugcuuccu

SEQ ID NO: 544896 - RNA, 64 nt, Homo Sapiens
gaagagugugggauuuccgaguucuuguucgcaguuugccgacuugcugcguggcagauuuccu

SEQ ID NO: 544897 - RNA, 64 nt, Homo Sapiens
agcugggagucuggcaggcccuuuuuuuuuuuucuuugccgaaaccugcaggcguucucucucu

SEQ ID NO: 544898 - RNA, 64 nt, Homo Sapiens
ccuuguacacuuagcggauaucaguuagaaaacuuuugccgauaaaaggagaaaggacuauuuc

SEQ ID NO: 544899 - RNA, 64 nt, Homo Sapiens
gaguauccuuugcuuaucuuuguaguacugaaaauuugccgaaguaacuggcugugcagaaugu

SEQ ID NO: 544900 - RNA, 64 nt, Homo Sapiens; identical to SEQ ID NO: 106200

SEQ ID NO: 544901 - RNA, 64 nt, Homo Sapiens; identical to SEQ ID NO: 106201

SEQ ID NO: 544902 - RNA, 64 nt, Homo Sapiens; identical to SEQ ID NO: 106202

SEQ ID NO: 544903 - RNA, 64 nt, Homo Sapiens; identical to SEQ ID NO: 106203

SEQ ID NO: 544904 - RNA, 64 nt, Homo Sapiens; identical to SEQ ID NO: 106204

SEQ ID NO: 544905 - RNA, 64 nt, Homo Sapiens; identical to SEQ ID NO: 106205

SEQ ID NO: 544906 - RNA, 64 nt, Homo Sapiens; identical to SEQ ID NO: 106206

SEQ ID NO: 544907 - RNA, 64 nt, Homo Sapiens; identical to SEQ ID NO: 106207

SEQ ID NO: 544908 - RNA, 64 nt, Homo Sapiens; identical to SEQ ID NO: 193524

SEQ ID NO: 544909 - RNA, 64 nt, Homo Sapiens; identical to SEQ ID NO: 193525

SEQ ID NO: 544910 - RNA, 64 nt, Homo Sapiens; identical to SEQ ID NO: 193526

SEQ ID NO: 544911 - RNA, 64 nt, Homo Sapiens; identical to SEQ ID NO: 193527

SEQ ID NO: 544912 - RNA, 64 nt, Homo Sapiens; identical to SEQ ID NO: 193528

SEQ ID NO: 544913 - RNA, 64 nt, Homo Sapiens; identical to SEQ ID NO: 193529

SEQ ID NO: 544914 - RNA, 64 nt, Homo Sapiens; identical to SEQ ID NO: 193530

SEQ ID NO: 544915 - RNA, 64 nt, Homo Sapiens; identical to SEQ ID NO: 193531

SEQ ID NO: 544916 - RNA, 64 nt, Homo Sapiens; identical to SEQ ID NO: 193532

SEQ ID NO: 544917 - RNA, 64 nt, Homo Sapiens; identical to SEQ ID NO: 193533

SEQ ID NO: 544918 - RNA, 64 nt, Homo Sapiens; identical to SEQ ID NO: 193534

SEQ ID NO: 544919 - RNA, 64 nt, Homo Sapiens; identical to SEQ ID NO: 193535

SEQ ID NO: 544920 - RNA, 64 nt, Homo Sapiens; identical to SEQ ID NO: 193536

SEQ ID NO: 544921 - RNA, 64 nt, Homo Sapiens; identical to SEQ ID NO: 193537

SEQ ID NO: 544922 - RNA, 64 nt, Homo Sapiens; identical to SEQ ID NO: 193538

SEQ ID NO: 544923 - RNA, 64 nt, Homo Sapiens; identical to SEQ ID NO: 193539

SEQ ID NO: 544924 - RNA, 64 nt, Homo Sapiens; identical to SEQ ID NO: 193540

SEQ ID NO: 544925 - RNA, 64 nt, Homo Sapiens; identical to SEQ ID NO: 193541

SEQ ID NO: 544926 - RNA, 64 nt, Homo Sapiens; identical to SEQ ID NO: 193542

SEQ ID NO: 544927 - RNA, 64 nt, Homo Sapiens; identical to SEQ ID NO: 193543

SEQ ID NO: 544928 - RNA, 64 nt, Homo Sapiens; identical to SEQ ID NO: 193544

SEQ ID NO: 544929 - RNA, 64 nt, Homo Sapiens; identical to SEQ ID NO: 193545

SEQ ID NO: 544930 - RNA, 64 nt, Homo Sapiens; identical to SEQ ID NO: 193546

SEQ ID NO: 544931 - RNA, 64 nt, Homo Sapiens; identical to SEQ ID NO: 193547

SEQ ID NO: 544932 - RNA, 64 nt, Homo Sapiens; identical to SEQ ID NO: 193548

SEQ ID NO: 544933 - RNA, 64 nt, Homo Sapiens; identical to SEQ ID NO: 193549

SEQ ID NO: 544934 - RNA, 64 nt, Homo Sapiens; identical to SEQ ID NO: 193550

SEQ ID NO: 544935 - RNA, 64 nt, Homo Sapiens; identical to SEQ ID NO: 193551

SEQ ID NO: 544936 - RNA, 64 nt, Homo Sapiens; identical to SEQ ID NO: 193552

SEQ ID NO: 544937 - RNA, 64 nt, Homo Sapiens; identical to SEQ ID NO: 193553

SEQ ID NO: 544938 - RNA, 64 nt, Homo Sapiens; identical to SEQ ID NO: 193554

SEQ ID NO: 544939 - RNA, 64 nt, Homo Sapiens; identical to SEQ ID NO: 193555

SEQ ID NO: 544940 - RNA, 64 nt, Homo Sapiens; identical to SEQ ID NO: 193556

SEQ ID NO: 544941 - RNA, 64 nt, Homo Sapiens; identical to SEQ ID NO: 193557

SEQ ID NO: 544942 - RNA, 64 nt, Homo Sapiens; identical to SEQ ID NO: 193558

SEQ ID NO: 544943 - RNA, 64 nt, Homo Sapiens; identical to SEQ ID NO: 193559

SEQ ID NO: 544944 - RNA, 64 nt, Homo Sapiens; identical to SEQ ID NO: 193560

SEQ ID NO: 544945 - RNA, 64 nt, Homo Sapiens; identical to SEQ ID NO: 193561

SEQ ID NO: 544946 - RNA, 64 nt, Homo Sapiens; identical to SEQ ID NO: 193562

SEQ ID NO: 544947 - RNA, 64 nt, Homo Sapiens; identical to SEQ ID NO: 193563

SEQ ID NO: 544948 - RNA, 64 nt, Homo Sapiens; identical to SEQ ID NO: 193564

SEQ ID NO: 544949 - RNA, 64 nt, Homo Sapiens; identical to SEQ ID NO: 193565

SEQ ID NO: 544950 - RNA, 64 nt, Homo Sapiens; identical to SEQ ID NO: 193566

SEQ ID NO: 544951 - RNA, 64 nt, Homo Sapiens; identical to SEQ ID NO: 193567

SEQ ID NO: 544952 - RNA, 64 nt, Homo Sapiens; identical to SEQ ID NO: 193568

SEQ ID NO: 544953 - RNA, 64 nt, Homo Sapiens; identical to SEQ ID NO: 193569

SEQ ID NO: 544954 - RNA, 64 nt, Homo Sapiens; identical to SEQ ID NO: 193570

SEQ ID NO: 544955 - RNA, 64 nt, Homo Sapiens; identical to SEQ ID NO: 193571

SEQ ID NO: 544956 - RNA, 64 nt, Homo Sapiens; identical to SEQ ID NO: 193572

SEQ ID NO: 544957 - RNA, 64 nt, Homo Sapiens; identical to SEQ ID NO: 193573

SEQ ID NO: 544958 - RNA, 64 nt, Homo Sapiens; identical to SEQ ID NO: 193574

SEQ ID NO: 544959 - RNA, 64 nt, Homo Sapiens; identical to SEQ ID NO: 193575

SEQ ID NO: 544960 - RNA, 64 nt, Homo Sapiens; identical to SEQ ID NO: 193576

SEQ ID NO: 544961 - RNA, 64 nt, Homo Sapiens; identical to SEQ ID NO: 193577

SEQ ID NO: 544962 - RNA, 64 nt, Homo Sapiens; identical to SEQ ID NO: 193578

SEQ ID NO: 544963 - RNA, 64 nt, Homo Sapiens; identical to SEQ ID NO: 193579

SEQ ID NO: 544964 - RNA, 64 nt, Homo Sapiens; identical to SEQ ID NO: 193580

SEQ ID NO: 544965 - RNA, 64 nt, Homo Sapiens; identical to SEQ ID NO: 193581

SEQ ID NO: 544966 - RNA, 64 nt, Homo Sapiens; identical to SEQ ID NO: 193582

SEQ ID NO: 544967 - RNA, 64 nt, Homo Sapiens; identical to SEQ ID NO: 193583

SEQ ID NO: 544968 - RNA, 64 nt, Homo Sapiens; identical to SEQ ID NO: 193584

SEQ ID NO: 544969 - RNA, 64 nt, Homo Sapiens; identical to SEQ ID NO: 193585

SEQ ID NO: 544970 - RNA, 64 nt, Homo Sapiens; identical to SEQ ID NO: 193586

SEQ ID NO: 544971 - RNA, 64 nt, Homo Sapiens; identical to SEQ ID NO: 193587

SEQ ID NO: 544972 - RNA, 64 nt, Homo Sapiens; identical to SEQ ID NO: 193588

SEQ ID NO: 544973 - RNA, 64 nt, Homo Sapiens; identical to SEQ ID NO: 193589

SEQ ID NO: 544974 - RNA, 64 nt, Homo Sapiens; identical to SEQ ID NO: 193590

SEQ ID NO: 544975 - RNA, 64 nt, Homo Sapiens; identical to SEQ ID NO: 193591

SEQ ID NO: 544976 - RNA, 64 nt, Homo Sapiens; identical to SEQ ID NO: 193592

SEQ ID NO: 544977 - RNA, 64 nt, Homo Sapiens; identical to SEQ ID NO: 193593

SEQ ID NO: 544978 - RNA, 64 nt, Homo Sapiens; identical to SEQ ID NO: 193594

SEQ ID NO: 544979 - RNA, 64 nt, Homo Sapiens; identical to SEQ ID NO: 193595

SEQ ID NO: 544980 - RNA, 64 nt, Homo Sapiens; identical to SEQ ID NO: 193596

SEQ ID NO: 544981 - RNA, 64 nt, Homo Sapiens
uaaaaaugauuuuaauaauucauuucuuaaaacacugaaugaauuuugaagcuuaauguuuuua

SEQ ID NO: 544982 - RNA, 64 nt, Homo Sapiens
auauguuucacugcuucauaucucuguccacuuucugaaugagaacuuauuuugugccuagagc

SEQ ID NO: 544983 - RNA, 64 nt, Homo Sapiens
uauuauauacauuugcuaucucuuuccaagaagucugaaugaaucaucccagauugcuaaaugu

SEQ ID NO: 544984 - RNA, 64 nt, Homo Sapiens
cugcuuuugaauuuuguuauuuagauacguguuccugaaugaagccccgcuguuacacaggugu

SEQ ID NO: 544985 - RNA, 64 nt, Homo Sapiens
cacaugaaaaaucauaaucugacuaauuuugggacugaaugaauaaguacaagagguuggauuu

SEQ ID NO: 544986 - RNA, 64 nt, Homo Sapiens
uugaagucaugaccaacaacacuguaacucaugccugaaugaagcuuaucugacacauaagcuu

SEQ ID NO: 544987 - RNA, 64 nt, Homo Sapiens
ugcucacagucacacagcaggagacccagagaggcugaaugacaaaacccauaggucugaaacu

SEQ ID NO: 544988 - RNA, 64 nt, Homo Sapiens
gggugucacccuccucccccacagucaguaugcccugaaugaauaggaugaggacgugucuauc

SEQ ID NO: 544989 - RNA, 64 nt, Homo Sapiens
uggacuuagugaauucuaagggguuuuguaaccucugaaugauaauguagcuuuggugaaacug

SEQ ID NO: 544990 - RNA, 64 nt, Homo Sapiens
uuuucauucucucuuucuuucacauuuuaaauuccugaaugaccccuggugaaacuuugcgguu

SEQ ID NO: 544991 - RNA, 64 nt, Homo Sapiens
uuguaauuaugcauccuagcuaaggcacagaagacugaaugaaugcaaggauucauuaacucuu

SEQ ID NO: 544992 - RNA, 64 nt, Homo Sapiens
uuggucugucauuauauugcaaaauauuuuuccucugaaugaaauuaucacagguugucucaag

SEQ ID NO: 544993 - RNA, 64 nt, Homo Sapiens
acacgcagcaaaauucuccuaaagaagucugugccugaaugaauaauguggcaugguacaagau

SEQ ID NO: 544994 - RNA, 64 nt, Homo Sapiens
ucauacccuauuagauagcuuacuauggauaggccugaaugaagacaggcuucuguuuucagag

SEQ ID NO: 544995 - RNA, 64 nt, Homo Sapiens
ccaaguggcccucagauuacacuucuccagauagcugaaugagucugcuuucacugugacuggg

SEQ ID NO: 544996 - RNA, 64 nt, Homo Sapiens
agcugaaugagucugcuuucacugugacugggaccugaaugaccugcagucagggcccagaguu

SEQ ID NO: 544997 - RNA, 64 nt, Homo Sapiens
uuuuuuuccucugugaugagcagauuaaucucuucugaaugauggcacaaagaacguugaaguu

SEQ ID NO: 544998 - RNA, 64 nt, Homo Sapiens
gaaugaauggcucagcugaggggugaaugaaugacugaaugaauuuaggcagcuuucaguaagu

SEQ ID NO: 544999 - RNA, 64 nt, Homo Sapiens
gaaaauuguauaaccauccuacagauuuucaaaacugaaugagacuuaagaauuugcagguacu

SEQ ID NO: 545000 - RNA, 64 nt, Homo Sapiens
cauuaauuacugacuguccuacagccauaauccucugaaugauggaacuugcacuucuuaagga

SEQ ID NO: 545001 - RNA, 64 nt, Homo Sapiens
ugcucagugaggaaaucucuuccaauuucugcuucugaaugauucaauguugggagcaauagaa

SEQ ID NO: 545002 - RNA, 64 nt, Homo Sapiens
agaaaucugucaccuuucugccugcccuuguuuccugaaugaaaugcuucugggguuauuuaug

SEQ ID NO: 545003 - RNA, 64 nt, Homo Sapiens
gaauagcagcaacuagucuuucaauaaauguuagcugaaugaaucuuauguguucauuaagggc

SEQ ID NO: 545004 - RNA, 64 nt, Homo Sapiens
aacagaaucuuggugcuuugcucaugggugguugcugaaugaaggauuggaauaaagcaggagg

SEQ ID NO: 545005 - RNA, 64 nt, Homo Sapiens; identical to SEQ ID NO: 199877

SEQ ID NO: 545006 - RNA, 64 nt, Homo Sapiens; identical to SEQ ID NO: 199878

SEQ ID NO: 545007 - RNA, 64 nt, Homo Sapiens; identical to SEQ ID NO: 199879

SEQ ID NO: 545008 - RNA, 64 nt, Homo Sapiens; identical to SEQ ID NO: 199880

SEQ ID NO: 545009 - RNA, 64 nt, Homo Sapiens; identical to SEQ ID NO: 199881

SEQ ID NO: 545010 - RNA, 64 nt, Homo Sapiens; identical to SEQ ID NO: 199882

SEQ ID NO: 545011 - RNA, 64 nt, Homo Sapiens; identical to SEQ ID NO: 199883

SEQ ID NO: 545012 - RNA, 64 nt, Homo Sapiens; identical to SEQ ID NO: 199884

SEQ ID NO: 545013 - RNA, 64 nt, Homo Sapiens; identical to SEQ ID NO: 199885

SEQ ID NO: 545014 - RNA, 64 nt, Homo Sapiens; identical to SEQ ID NO: 199886

SEQ ID NO: 545015 - RNA, 64 nt, Homo Sapiens; identical to SEQ ID NO: 199887

SEQ ID NO: 545016 - RNA, 64 nt, Homo Sapiens; identical to SEQ ID NO: 199888

SEQ ID NO: 545017 - RNA, 64 nt, Homo Sapiens; identical to SEQ ID NO: 199889

SEQ ID NO: 545018 - RNA, 64 nt, Homo Sapiens; identical to SEQ ID NO: 199890

SEQ ID NO: 545019 - RNA, 64 nt, Homo Sapiens; identical to SEQ ID NO: 199891

SEQ ID NO: 545020 - RNA, 64 nt, Homo Sapiens; identical to SEQ ID NO: 199892

SEQ ID NO: 545021 - RNA, 64 nt, Homo Sapiens; identical to SEQ ID NO: 199893

SEQ ID NO: 545022 - RNA, 64 nt, Homo Sapiens; identical to SEQ ID NO: 199894

SEQ ID NO: 545023 - RNA, 64 nt, Homo Sapiens; identical to SEQ ID NO: 199895

SEQ ID NO: 545024 - RNA, 64 nt, Homo Sapiens; identical to SEQ ID NO: 199896

SEQ ID NO: 545025 - RNA, 64 nt, Homo Sapiens; identical to SEQ ID NO: 199897

SEQ ID NO: 545026 - RNA, 64 nt, Homo Sapiens; identical to SEQ ID NO: 76340

SEQ ID NO: 545027 - RNA, 64 nt, Homo Sapiens; identical to SEQ ID NO: 76341

SEQ ID NO: 545028 - RNA, 64 nt, Homo Sapiens; identical to SEQ ID NO: 76342

SEQ ID NO: 545029 - RNA, 64 nt, Homo Sapiens; identical to SEQ ID NO: 76343

SEQ ID NO: 545030 - RNA, 64 nt, Homo Sapiens; identical to SEQ ID NO: 76344

SEQ ID NO: 545031 - RNA, 64 nt, Homo Sapiens; identical to SEQ ID NO: 76345

SEQ ID NO: 545032 - RNA, 64 nt, Homo Sapiens; identical to SEQ ID NO: 76346

SEQ ID NO: 545033 - RNA, 64 nt, Homo Sapiens; identical to SEQ ID NO: 76347

SEQ ID NO: 545034 - RNA, 64 nt, Homo Sapiens; identical to SEQ ID NO: 76348

SEQ ID NO: 545035 - RNA, 64 nt, Homo Sapiens; identical to SEQ ID NO: 76349

SEQ ID NO: 545036 - RNA, 64 nt, Homo Sapiens; identical to SEQ ID NO: 76350

SEQ ID NO: 545037 - RNA, 64 nt, Homo Sapiens; identical to SEQ ID NO: 76351

SEQ ID NO: 545038 - RNA, 64 nt, Homo Sapiens; identical to SEQ ID NO: 76352

SEQ ID NO: 545039 - RNA, 64 nt, Homo Sapiens; identical to SEQ ID NO: 76353

SEQ ID NO: 545040 - RNA, 64 nt, Homo Sapiens; identical to SEQ ID NO: 76354

SEQ ID NO: 545041 - RNA, 64 nt, Homo Sapiens; identical to SEQ ID NO: 76355

SEQ ID NO: 545042 - RNA, 64 nt, Homo Sapiens; identical to SEQ ID NO: 76356

SEQ ID NO: 545043 - RNA, 64 nt, Homo Sapiens; identical to SEQ ID NO: 76357

SEQ ID NO: 545044 - RNA, 64 nt, Homo Sapiens; identical to SEQ ID NO: 76358

SEQ ID NO: 545045 - RNA, 64 nt, Homo Sapiens; identical to SEQ ID NO: 76359

SEQ ID NO: 545046 - RNA, 64 nt, Homo Sapiens; identical to SEQ ID NO: 76360

SEQ ID NO: 545047 - RNA, 64 nt, Homo Sapiens; identical to SEQ ID NO: 76361

SEQ ID NO: 545048 - RNA, 64 nt, Homo Sapiens; identical to SEQ ID NO: 76362

SEQ ID NO: 545049 - RNA, 64 nt, Homo Sapiens; identical to SEQ ID NO: 76363

SEQ ID NO: 545050 - RNA, 64 nt, Homo Sapiens; identical to SEQ ID NO: 76364

SEQ ID NO: 545051 - RNA, 64 nt, Homo Sapiens; identical to SEQ ID NO: 76365

SEQ ID NO: 545052 - RNA, 64 nt, Homo Sapiens; identical to SEQ ID NO: 76366

SEQ ID NO: 545053 - RNA, 64 nt, Homo Sapiens; identical to SEQ ID NO: 76367

SEQ ID NO: 545054 - RNA, 64 nt, Homo Sapiens; identical to SEQ ID NO: 76368

SEQ ID NO: 545055 - RNA, 64 nt, Homo Sapiens; identical to SEQ ID NO: 76369

SEQ ID NO: 545056 - RNA, 64 nt, Homo Sapiens; identical to SEQ ID NO: 76370

SEQ ID NO: 545057 - RNA, 64 nt, Homo Sapiens; identical to SEQ ID NO: 76371

SEQ ID NO: 545058 - RNA, 64 nt, Homo Sapiens; identical to SEQ ID NO: 76372

SEQ ID NO: 545059 - RNA, 64 nt, Homo Sapiens; identical to SEQ ID NO: 76373

SEQ ID NO: 545060 - RNA, 64 nt, Homo Sapiens; identical to SEQ ID NO: 76374

SEQ ID NO: 545061 - RNA, 64 nt, Homo Sapiens; identical to SEQ ID NO: 76375

SEQ ID NO: 545062 - RNA, 64 nt, Homo Sapiens; identical to SEQ ID NO: 76376

SEQ ID NO: 545063 - RNA, 64 nt, Homo Sapiens; identical to SEQ ID NO: 76377

SEQ ID NO: 545064 - RNA, 64 nt, Homo Sapiens; identical to SEQ ID NO: 76378

SEQ ID NO: 545065 - RNA, 64 nt, Homo Sapiens; identical to SEQ ID NO: 76379

SEQ ID NO: 545066 - RNA, 64 nt, Homo Sapiens; identical to SEQ ID NO: 76380

SEQ ID NO: 545067 - RNA, 64 nt, Homo Sapiens; identical to SEQ ID NO: 76381

SEQ ID NO: 545068 - RNA, 64 nt, Homo Sapiens
uuggacaucuguuuucacucuuaggcuuuuaaacaauaguuauugcuuuuaucccucucagauu

SEQ ID NO: 545069 - RNA, 64 nt, Homo Sapiens
guaauaagaccauuuggaauuacuggacuaauugaauaguuaagguuucuauucgggacaauaa

SEQ ID NO: 545070 - RNA, 64 nt, Homo Sapiens
uuaccucgugcauuguauaauuugauguaaaagaaauaguuaccaaugcuagcuuguguggucu

SEQ ID NO: 545071 - RNA, 64 nt, Homo Sapiens
cccuagcuucaugaugugacucuuaaaaaacuauaauaguuaacaacuguuaguaagauagacc

SEQ ID NO: 545072 - RNA, 64 nt, Homo Sapiens
auacauauucaccacuugagauucauaacauaucaauaguuauuucauaaauauagaaaugaaa

SEQ ID NO: 545073 - RNA, 64 nt, Homo Sapiens
cuggaacaggccuuagaaacaauugauuuauuccaauaguuaaccacuggcuggcucccaacuc

SEQ ID NO: 545074 - RNA, 64 nt, Homo Sapiens
ggaaaguugucuuugaccuucuguuuaaauuuucaauaguuaauauauaacacauccauucuug

SEQ ID NO: 545075 - RNA, 64 nt, Homo Sapiens
cauuaguuuuuaauuuuuaauuuaauggcucagaaauaguuauuauagcaacagugucucauga

SEQ ID NO: 545076 - RNA, 64 nt, Homo Sapiens
agcugccuguuucuuaaugcauugauuaaaguuuaauaguuaucaaaaucaccuaauuuuuaaa

SEQ ID NO: 545077 - RNA, 64 nt, Homo Sapiens
uugaacccaccaugacagaaaguaaauuuuaggaaauaguuaugagauuaagggaaaaucuaua

SEQ ID NO: 545078 - RNA, 64 nt, Homo Sapiens
ugaaaucugcauauucuggagcuucauugcuauuaauaguuaaauuacauguuugugugcaacu

SEQ ID NO: 545079 - RNA, 64 nt, Homo Sapiens
cacugugucaaagaguguuuaaaaaaaaucuaaaaauaguuaagucccuuccuuuacaguuuaa

SEQ ID NO: 545080 - RNA, 64 nt, Homo Sapiens
auguuuacauugagcacuagauuaauaaaucauuaauaguuaaaccuaaguaccuuuaaggaaa

SEQ ID NO: 545081 - RNA, 64 nt, Homo Sapiens
cccuugcauacagaagugguuucuuucaguccaaaauaguuagaggccauccaauuaccauuuu

SEQ ID NO: 545082 - RNA, 56 nt, Homo Sapiens
uggaagaacaucccuuguaaagcuaaaauaguuacuucaaauuuucagaaaagaug

SEQ ID NO: 545083 - RNA, 64 nt, Homo Sapiens
auaccagaauaaaucuacagcuagacccuuagucaauaguuaaccaaaaaauugcaauuuguuu

SEQ ID NO: 545084 - RNA, 56 nt, Homo Sapiens
uggaaacacaucccuuguaaagcuaaaauaguuacuucaaauuuucagaaaagaug

SEQ ID NO: 545085 - RNA, 64 nt, Homo Sapiens; identical to SEQ ID NO: 545083

SEQ ID NO: 545086 - RNA, 64 nt, Homo Sapiens
aaauaaugcugauguucaaccccaucaccaucuucaauucuaauuccccccacacucucccucc

SEQ ID NO: 545087 - RNA, 64 nt, Homo Sapiens
agcccugugauuugaaaaaugauaacauuaugaacaauucuaaaaacauuuucagaaacuuagu

SEQ ID NO: 545088 - RNA, 64 nt, Homo Sapiens
gauagauggcuuaauaaaauaaguauaaaaacaacaauucuauaagcauagacauauuuuuuua

SEQ ID NO: 545089 - RNA, 64 nt, Homo Sapiens
ccacaagauuccaucugugggucaagaagcacaccaauucuaaccucaaaagcagcagcaaguc

SEQ ID NO: 545090 - RNA, 64 nt, Homo Sapiens
uauucuucacggcagccagaaaguuguaaggggccaauucuaagauauauguuggaccucugaa

SEQ ID NO: 545091 - RNA, 64 nt, Homo Sapiens
auaauuuacauauguucacgaaaucguucaagagcaauucuaaucaaacaaauguaagacuaca

SEQ ID NO: 545092 - RNA, 64 nt, Homo Sapiens; identical to SEQ ID NO: 94750

SEQ ID NO: 545093 - RNA, 64 nt, Homo Sapiens; identical to SEQ ID NO: 94751

SEQ ID NO: 545094 - RNA, 64 nt, Homo Sapiens; identical to SEQ ID NO: 94752

SEQ ID NO: 545095 - RNA, 64 nt, Homo Sapiens; identical to SEQ ID NO: 94753

SEQ ID NO: 545096 - RNA, 64 nt, Homo Sapiens; identical to SEQ ID NO: 94754

SEQ ID NO: 545097 - RNA, 64 nt, Homo Sapiens; identical to SEQ ID NO: 94755

SEQ ID NO: 545098 - RNA, 64 nt, Homo Sapiens; identical to SEQ ID NO: 94756

SEQ ID NO: 545099 - RNA, 64 nt, Homo Sapiens; identical to SEQ ID NO: 94757

SEQ ID NO: 545100 - RNA, 64 nt, Homo Sapiens; identical to SEQ ID NO: 94758

SEQ ID NO: 545101 - RNA, 64 nt, Homo Sapiens; identical to SEQ ID NO: 94759

SEQ ID NO: 545102 - RNA, 64 nt, Homo Sapiens; identical to SEQ ID NO: 94760

SEQ ID NO: 545103 - RNA, 64 nt, Homo Sapiens; identical to SEQ ID NO: 94761

SEQ ID NO: 545104 - RNA, 64 nt, Homo Sapiens; identical to SEQ ID NO: 94762

SEQ ID NO: 545105 - RNA, 64 nt, Homo Sapiens; identical to SEQ ID NO: 94763

SEQ ID NO: 545106 - RNA, 64 nt, Homo Sapiens; identical to SEQ ID NO: 94764

SEQ ID NO: 545107 - RNA, 64 nt, Homo Sapiens; identical to SEQ ID NO: 94765

SEQ ID NO: 545108 - RNA, 64 nt, Homo Sapiens; identical to SEQ ID NO: 94766

SEQ ID NO: 545109 - RNA, 64 nt, Homo Sapiens; identical to SEQ ID NO: 94767

SEQ ID NO: 545110 - RNA, 64 nt, Homo Sapiens; identical to SEQ ID NO: 94768

SEQ ID NO: 545111 - RNA, 64 nt, Homo Sapiens; identical to SEQ ID NO: 94769

SEQ ID NO: 545112 - RNA, 64 nt, Homo Sapiens; identical to SEQ ID NO: 94770

SEQ ID NO: 545113 - RNA, 64 nt, Homo Sapiens; identical to SEQ ID NO: 94771

SEQ ID NO: 545114 - RNA, 64 nt, Homo Sapiens; identical to SEQ ID NO: 94772

SEQ ID NO: 545115 - RNA, 64 nt, Homo Sapiens; identical to SEQ ID NO: 94773

SEQ ID NO: 545116 - RNA, 64 nt, Homo Sapiens; identical to SEQ ID NO: 94774

SEQ ID NO: 545117 - RNA, 64 nt, Homo Sapiens; identical to SEQ ID NO: 94775

SEQ ID NO: 545118 - RNA, 64 nt, Homo Sapiens; identical to SEQ ID NO: 94776

SEQ ID NO: 545119 - RNA, 64 nt, Homo Sapiens; identical to SEQ ID NO: 94777

SEQ ID NO: 545120 - RNA, 64 nt, Homo Sapiens; identical to SEQ ID NO: 94778

SEQ ID NO: 545121 - RNA, 64 nt, Homo Sapiens; identical to SEQ ID NO: 94779

SEQ ID NO: 545122 - RNA, 64 nt, Homo Sapiens; identical to SEQ ID NO: 94780

SEQ ID NO: 545123 - RNA, 64 nt, Homo Sapiens; identical to SEQ ID NO: 94781

SEQ ID NO: 545124 - RNA, 64 nt, Homo Sapiens; identical to SEQ ID NO: 94782

SEQ ID NO: 545125 - RNA, 64 nt, Homo Sapiens; identical to SEQ ID NO: 94783

SEQ ID NO: 545126 - RNA, 64 nt, Homo Sapiens; identical to SEQ ID NO: 94784

SEQ ID NO: 545127 - RNA, 64 nt, Homo Sapiens; identical to SEQ ID NO: 94785

SEQ ID NO: 545128 - RNA, 64 nt, Homo Sapiens; identical to SEQ ID NO: 94786

SEQ ID NO: 545129 - RNA, 64 nt, Homo Sapiens; identical to SEQ ID NO: 94787

SEQ ID NO: 545130 - RNA, 64 nt, Homo Sapiens; identical to SEQ ID NO: 94788

SEQ ID NO: 545131 - RNA, 64 nt, Homo Sapiens; identical to SEQ ID NO: 94789

SEQ ID NO: 545132 - RNA, 64 nt, Homo Sapiens; identical to SEQ ID NO: 94790

SEQ ID NO: 545133 - RNA, 64 nt, Homo Sapiens; identical to SEQ ID NO: 94791

SEQ ID NO: 545134 - RNA, 64 nt, Homo Sapiens; identical to SEQ ID NO: 94792

SEQ ID NO: 545135 - RNA, 64 nt, Homo Sapiens; identical to SEQ ID NO: 94793

SEQ ID NO: 545136 - RNA, 64 nt, Homo Sapiens; identical to SEQ ID NO: 94794

SEQ ID NO: 545137 - RNA, 64 nt, Homo Sapiens; identical to SEQ ID NO: 94795

SEQ ID NO: 545138 - RNA, 64 nt, Homo Sapiens; identical to SEQ ID NO: 94796

SEQ ID NO: 545139 - RNA, 64 nt, Homo Sapiens; identical to SEQ ID NO: 94797

SEQ ID NO: 545140 - RNA, 64 nt, Homo Sapiens; identical to SEQ ID NO: 94798

SEQ ID NO: 545141 - RNA, 64 nt, Homo Sapiens; identical to SEQ ID NO: 94799

SEQ ID NO: 545142 - RNA, 64 nt, Homo Sapiens; identical to SEQ ID NO: 94800

SEQ ID NO: 545143 - RNA, 64 nt, Homo Sapiens; identical to SEQ ID NO: 94801

SEQ ID NO: 545144 - RNA, 64 nt, Homo Sapiens; identical to SEQ ID NO: 94802

SEQ ID NO: 545145 - RNA, 64 nt, Homo Sapiens; identical to SEQ ID NO: 94803

SEQ ID NO: 545146 - RNA, 64 nt, Homo Sapiens; identical to SEQ ID NO: 94804

SEQ ID NO: 545147 - RNA, 64 nt, Homo Sapiens; identical to SEQ ID NO: 94805

SEQ ID NO: 545148 - RNA, 64 nt, Homo Sapiens; identical to SEQ ID NO: 94806

SEQ ID NO: 545149 - RNA, 64 nt, Homo Sapiens; identical to SEQ ID NO: 94807

SEQ ID NO: 545150 - RNA, 64 nt, Homo Sapiens; identical to SEQ ID NO: 94808

SEQ ID NO: 545151 - RNA, 64 nt, Homo Sapiens; identical to SEQ ID NO: 94809

SEQ ID NO: 545152 - RNA, 64 nt, Homo Sapiens; identical to SEQ ID NO: 94810

SEQ ID NO: 545153 - RNA, 64 nt, Homo Sapiens; identical to SEQ ID NO: 94811

SEQ ID NO: 545154 - RNA, 64 nt, Homo Sapiens; identical to SEQ ID NO: 94812

SEQ ID NO: 545155 - RNA, 64 nt, Homo Sapiens; identical to SEQ ID NO: 94813

SEQ ID NO: 545156 - RNA, 64 nt, Homo Sapiens; identical to SEQ ID NO: 94814

SEQ ID NO: 545157 - RNA, 64 nt, Homo Sapiens; identical to SEQ ID NO: 94815

SEQ ID NO: 545158 - RNA, 64 nt, Homo Sapiens; identical to SEQ ID NO: 94816

SEQ ID NO: 545159 - RNA, 64 nt, Homo Sapiens; identical to SEQ ID NO: 94817

SEQ ID NO: 545160 - RNA, 64 nt, Homo Sapiens; identical to SEQ ID NO: 94818

SEQ ID NO: 545161 - RNA, 64 nt, Homo Sapiens; identical to SEQ ID NO: 94819

SEQ ID NO: 545162 - RNA, 64 nt, Homo Sapiens; identical to SEQ ID NO: 94820

SEQ ID NO: 545163 - RNA, 64 nt, Homo Sapiens; identical to SEQ ID NO: 94821

SEQ ID NO: 545164 - RNA, 64 nt, Homo Sapiens; identical to SEQ ID NO: 94822

SEQ ID NO: 545165 - RNA, 64 nt, Homo Sapiens; identical to SEQ ID NO: 94823

SEQ ID NO: 545166 - RNA, 64 nt, Homo Sapiens; identical to SEQ ID NO: 94824

SEQ ID NO: 545167 - RNA, 64 nt, Homo Sapiens; identical to SEQ ID NO: 94825

SEQ ID NO: 545168 - RNA, 64 nt, Homo Sapiens; identical to SEQ ID NO: 94826

SEQ ID NO: 545169 - RNA, 64 nt, Homo Sapiens; identical to SEQ ID NO: 94827

SEQ ID NO: 545170 - RNA, 64 nt, Homo Sapiens; identical to SEQ ID NO: 94828

SEQ ID NO: 545171 - RNA, 64 nt, Homo Sapiens; identical to SEQ ID NO: 94829

SEQ ID NO: 545172 - RNA, 64 nt, Homo Sapiens; identical to SEQ ID NO: 94830

SEQ ID NO: 545173 - RNA, 64 nt, Homo Sapiens; identical to SEQ ID NO: 94831

SEQ ID NO: 545174 - RNA, 64 nt, Homo Sapiens; identical to SEQ ID NO: 94832

SEQ ID NO: 545175 - RNA, 64 nt, Homo Sapiens; identical to SEQ ID NO: 94833

SEQ ID NO: 545176 - RNA, 64 nt, Homo Sapiens; identical to SEQ ID NO: 94834

SEQ ID NO: 545177 - RNA, 64 nt, Homo Sapiens; identical to SEQ ID NO: 94835

SEQ ID NO: 545178 - RNA, 64 nt, Homo Sapiens; identical to SEQ ID NO: 102085

SEQ ID NO: 545179 - RNA, 64 nt, Homo Sapiens; identical to SEQ ID NO: 102086

SEQ ID NO: 545180 - RNA, 64 nt, Homo Sapiens; identical to SEQ ID NO: 102087

SEQ ID NO: 545181 - RNA, 64 nt, Homo Sapiens; identical to SEQ ID NO: 102088

SEQ ID NO: 545182 - RNA, 64 nt, Homo Sapiens; identical to SEQ ID NO: 109461

SEQ ID NO: 545183 - RNA, 64 nt, Homo Sapiens; identical to SEQ ID NO: 109462

SEQ ID NO: 545184 - RNA, 64 nt, Homo Sapiens; identical to SEQ ID NO: 109463

SEQ ID NO: 545185 - RNA, 64 nt, Homo Sapiens; identical to SEQ ID NO: 109464

SEQ ID NO: 545186 - RNA, 64 nt, Homo Sapiens; identical to SEQ ID NO: 109465

SEQ ID NO: 545187 - RNA, 64 nt, Homo Sapiens; identical to SEQ ID NO: 109466

SEQ ID NO: 545188 - RNA, 64 nt, Homo Sapiens
uagacuugcucacguucaguacucaacucuaauuacaucuaaguuaugaacuuuuuauccaaug

SEQ ID NO: 545189 - RNA, 64 nt, Homo Sapiens
augcccuuucuuuaucugaggacugugauccaugacaucuaauaauugauuucauacagaagau

SEQ ID NO: 545190 - RNA, 64 nt, Homo Sapiens
aaaagaaauggguuucugcuaaugaauugagcagacaucuaauauuuuauaugccuuuugagcu

SEQ ID NO: 545191 - RNA, 64 nt, Homo Sapiens
caccagcuuguaaaaacuuagugcgagagcugaaacaucuaaauaaauaaugacaugcauuuau

SEQ ID NO: 545192 - RNA, 64 nt, Homo Sapiens
aguauauaauccugugaaaaauuucuagaaacaaacaucuaauaaguaacacauauguaguaua

SEQ ID NO: 545193 - RNA, 64 nt, Homo Sapiens
cacuagaggaaaccaguuuggaacucagagaugaacaucuaaccucagaggauaaauaucaaug

SEQ ID NO: 545194 - RNA, 59 nt, Homo Sapiens
gccgaguauggucacugugacguguuagaacaucuaauccacaaagguaugugaaaagg

SEQ ID NO: 545195 - RNA, 64 nt, Homo Sapiens
uucuuuuagugcacugaaauaucuuaucccaguaacaucuaaaaaugcaauucggaaaaguggg

SEQ ID NO: 545196 - RNA, 64 nt, Homo Sapiens
uauuuuuuuauaucccgauuugcacuuugagaauacaucuaaggucaucuuucaaaagagaaaa

SEQ ID NO: 545197 - RNA, 64 nt, Homo Sapiens
gguuucuaauucugcagagacacccguuucagccacaucuaaaagagcacaguuuauguggugc

SEQ ID NO: 545198 - RNA, 64 nt, Homo Sapiens
uauauauauuauaggccagcgucuacuguauauaacaucuaauauuaaacuauugacuugguaa

SEQ ID NO: 545199 - RNA, 64 nt, Homo Sapiens
uauauauuacaggccaaauggucuacuguauauaacaucuaauauuaaacuauugacuugguaa

SEQ ID NO: 545200 - RNA, 64 nt, Homo Sapiens
guggaauuuaucccaggaauucaagguugguucaacaucuaaaaaucaaauaagcuaauauaca

SEQ ID NO: 545201 - RNA, 64 nt, Homo Sapiens
acagcaguuagguuaggaauucaagguuuguucaacaucuaaaaaucaaauaagcuaauaaaga

SEQ ID NO: 545202 - RNA, 64 nt, Homo Sapiens; identical to SEQ ID NO: 300148

SEQ ID NO: 545203 - RNA, 64 nt, Homo Sapiens; identical to SEQ ID NO: 300149

SEQ ID NO: 545204 - RNA, 64 nt, Homo Sapiens; identical to SEQ ID NO: 300150

SEQ ID NO: 545205 - RNA, 64 nt, Homo Sapiens; identical to SEQ ID NO: 300151

SEQ ID NO: 545206 - RNA, 64 nt, Homo Sapiens; identical to SEQ ID NO: 300152

SEQ ID NO: 545207 - RNA, 64 nt, Homo Sapiens; identical to SEQ ID NO: 300153

SEQ ID NO: 545208 - RNA, 64 nt, Homo Sapiens; identical to SEQ ID NO: 300154

SEQ ID NO: 545209 - RNA, 64 nt, Homo Sapiens; identical to SEQ ID NO: 300155

SEQ ID NO: 545210 - RNA, 64 nt, Homo Sapiens; identical to SEQ ID NO: 300156

SEQ ID NO: 545211 - RNA, 64 nt, Homo Sapiens; identical to SEQ ID NO: 300157

SEQ ID NO: 545212 - RNA, 64 nt, Homo Sapiens; identical to SEQ ID NO: 300158

SEQ ID NO: 545213 - RNA, 64 nt, Homo Sapiens; identical to SEQ ID NO: 300159

SEQ ID NO: 545214 - RNA, 64 nt, Homo Sapiens; identical to SEQ ID NO: 300160

SEQ ID NO: 545215 - RNA, 64 nt, Homo Sapiens; identical to SEQ ID NO: 300161

SEQ ID NO: 545216 - RNA, 64 nt, Homo Sapiens; identical to SEQ ID NO: 300162

SEQ ID NO: 545217 - RNA, 64 nt, Homo Sapiens; identical to SEQ ID NO: 300163

SEQ ID NO: 545218 - RNA, 64 nt, Homo Sapiens; identical to SEQ ID NO: 300164

SEQ ID NO: 545219 - RNA, 64 nt, Homo Sapiens; identical to SEQ ID NO: 300165

SEQ ID NO: 545220 - RNA, 64 nt, Homo Sapiens; identical to SEQ ID NO: 300166

SEQ ID NO: 545221 - RNA, 64 nt, Homo Sapiens; identical to SEQ ID NO: 300167

SEQ ID NO: 545222 - RNA, 64 nt, Homo Sapiens; identical to SEQ ID NO: 300168

SEQ ID NO: 545223 - RNA, 64 nt, Homo Sapiens; identical to SEQ ID NO: 300169

SEQ ID NO: 545224 - RNA, 64 nt, Homo Sapiens; identical to SEQ ID NO: 300170

SEQ ID NO: 545225 - RNA, 64 nt, Homo Sapiens; identical to SEQ ID NO: 300171

SEQ ID NO: 545226 - RNA, 64 nt, Homo Sapiens; identical to SEQ ID NO: 300172

SEQ ID NO: 545227 - RNA, 64 nt, Homo Sapiens; identical to SEQ ID NO: 300173

SEQ ID NO: 545228 - RNA, 64 nt, Homo Sapiens; identical to SEQ ID NO: 300174

SEQ ID NO: 545229 - RNA, 64 nt, Homo Sapiens; identical to SEQ ID NO: 300175

SEQ ID NO: 545230 - RNA, 64 nt, Homo Sapiens; identical to SEQ ID NO: 300176

SEQ ID NO: 545231 - RNA, 64 nt, Homo Sapiens; identical to SEQ ID NO: 300177

SEQ ID NO: 545232 - RNA, 64 nt, Homo Sapiens; identical to SEQ ID NO: 300178

SEQ ID NO: 545233 - RNA, 64 nt, Homo Sapiens; identical to SEQ ID NO: 300179

SEQ ID NO: 545234 - RNA, 64 nt, Homo Sapiens; identical to SEQ ID NO: 300180

SEQ ID NO: 545235 - RNA, 64 nt, Homo Sapiens; identical to SEQ ID NO: 300181

SEQ ID NO: 545236 - RNA, 64 nt, Homo Sapiens; identical to SEQ ID NO: 300182

SEQ ID NO: 545237 - RNA, 64 nt, Homo Sapiens; identical to SEQ ID NO: 300183

SEQ ID NO: 545238 - RNA, 64 nt, Homo Sapiens; identical to SEQ ID NO: 300184

SEQ ID NO: 545239 - RNA, 64 nt, Homo Sapiens; identical to SEQ ID NO: 300185

SEQ ID NO: 545240 - RNA, 64 nt, Homo Sapiens; identical to SEQ ID NO: 300186

SEQ ID NO: 545241 - RNA, 64 nt, Homo Sapiens; identical to SEQ ID NO: 300187

SEQ ID NO: 545242 - RNA, 64 nt, Homo Sapiens; identical to SEQ ID NO: 300188

SEQ ID NO: 545243 - RNA, 64 nt, Homo Sapiens; identical to SEQ ID NO: 300189

SEQ ID NO: 545244 - RNA, 64 nt, Homo Sapiens; identical to SEQ ID NO: 300190

SEQ ID NO: 545245 - RNA, 64 nt, Homo Sapiens; identical to SEQ ID NO: 300191

SEQ ID NO: 545246 - RNA, 64 nt, Homo Sapiens
gguguguuuggaacauucauaaauuuaccuguagcccagugaagcaucugcuuccaucccagug

SEQ ID NO: 545247 - RNA, 64 nt, Homo Sapiens
uuuaccuguagcccagugaaucaucugcuuccaucccagugaaaguacuguuugauuggguggu

SEQ ID NO: 545248 - RNA, 64 nt, Homo Sapiens
uccugccaggcacacacagcucccuccuagcucucccagugaaccgacuggacugucacggggu

SEQ ID NO: 545249 - RNA, 64 nt, Homo Sapiens
cugccccacggagacagagguuugaguuuuuccucccagugagauuccaccaggccgugccuug

SEQ ID NO: 545250 - RNA, 64 nt, Homo Sapiens
gugauacauacuaaaguuuguuuuaacaagcccucccagugauuacagugggcccagccaccua

SEQ ID NO: 545251 - RNA, 64 nt, Homo Sapiens
ucaugugugcucucugaccuuuauuuaggaugaucccagugauuacauuagggugagaguuuga

SEQ ID NO: 545252 - RNA, 64 nt, Homo Sapiens
uaggccagcugccgagcugggcuauguucuggaacccagugaaucuugggggccaggcacugug

SEQ ID NO: 545253 - RNA, 64 nt, Homo Sapiens
ggugagcuauggagacccaggccaacaaauuauccccagugauauggggggaggaggggcuaga

SEQ ID NO: 545254 - RNA, 64 nt, Homo Sapiens
acuagagcucuaagcccauuuggaaaaauggauccccagugaaagagccugaaauagugguucu

SEQ ID NO: 545255 - RNA, 64 nt, Homo Sapiens
gccacagcaaccuucugcccacaaaauuuugcuccccagugaagaagaggccaggacagagcug

SEQ ID NO: 545256 - RNA, 64 nt, Homo Sapiens
uacauucugcugccaccagucaccaaaggcccuucccagugagggguggaagggaucucugggg

SEQ ID NO: 545257 - RNA, 64 nt, Homo Sapiens
gggaggcuuccccagccuuaagagacccucucagcccagugacuguccccaaacccaagucucc

SEQ ID NO: 545258 - RNA, 64 nt, Homo Sapiens
uggaggacgcuagagaaagucgggcuguccucugcccagugagagaaaaagugaaaaaggcuuc

SEQ ID NO: 545259 - RNA, 64 nt, Homo Sapiens
ugauucuucuguuuuuuaauuacuacuaagaauccccagugaucgcagcucccaacggcgaugc

SEQ ID NO: 545260 - RNA, 64 nt, Homo Sapiens
acggagggaaggucagaggagaaggcaggcagggcccagugagaggggagcaugccuuccccca

SEQ ID NO: 545261 - RNA, 64 nt, Homo Sapiens
ucgggugaaggagggcccaggucaguucuggggucccagugaccugcuuugccauucuccuggu

SEQ ID NO: 545262 - RNA, 64 nt, Homo Sapiens
auguagcauuuuguucauccggcuaucgaggagacccagugagacccaucccuggauccacagg

SEQ ID NO: 545263 - RNA, 64 nt, Homo Sapiens
acuucuuuuugagggacuugaaggagcaugcuaccccagugagccggugacuguccuggacagc

SEQ ID NO: 545264 - RNA, 64 nt, Homo Sapiens
ucccucagcccccaggggaggaaaaagaucaccucccagugacccucuugcucaauccgaggug

SEQ ID NO: 545265 - RNA, 64 nt, Homo Sapiens
ccuugaugggggcugugaguggggcagugugauacccagugacuagacgcacucugcguuuucc

SEQ ID NO: 545266 - RNA, 64 nt, Homo Sapiens
cccggauccgguggggugaaagcagccagcucaucccagugacucacaggacacagccauccag

SEQ ID NO: 545267 - RNA, 64 nt, Homo Sapiens
aaauguagucccuggacuggagguucccugcacucccagugagccagccaccaccacaaccugu

SEQ ID NO: 545268 - RNA, 64 nt, Homo Sapiens
aauaaaaaggacaaauggauacagccuugacccucccagugaggagaccccaauucagcaauaa

SEQ ID NO: 545269 - RNA, 64 nt, Homo Sapiens
uguuaccauuugguuaugacagaaaccaaggagucccagugaucggaaggagcuugccucuuug

SEQ ID NO: 545270 - RNA, 64 nt, Homo Sapiens
aaauuauuucucagcguggacaggguggaacaaucccagugaguagucuuuuuagagaaggggc

SEQ ID NO: 545271 - RNA, 64 nt, Homo Sapiens
agcucaggcccucaggaaguaagcauucuggcaucccagugaagucccucuuuguuccaagcag

SEQ ID NO: 545272 - RNA, 64 nt, Homo Sapiens
acuuucgauuacacugaagaagcuaacauuaucccccagugauuccauucauucccaugggcac

SEQ ID NO: 545273 - RNA, 64 nt, Homo Sapiens
ggcggugggcugacugggaauccgcaaccuggaccccagugagauggggaggacuugguggcga

SEQ ID NO: 545274 - RNA, 64 nt, Homo Sapiens
cagagagagcaagacugcagggggcaccuguuuccccagugacuugggaacggggagccucugg

SEQ ID NO: 545275 - RNA, 64 nt, Homo Sapiens
aaacuaaaagggugauugacaugaaagcuaaaagcaaauuuauguuaagaaaauaugccuguug

SEQ ID NO: 545276 - RNA, 64 nt, Homo Sapiens
ugauagaugcuuuaauugaguaacugagccaauccaaauuuaaauuuuaucaucugcagucaaa

SEQ ID NO: 545277 - RNA, 64 nt, Homo Sapiens
uuuaaacuuuugaagcaaacaccaaauuauuguucaaauuuaggaagcaauaacaaagaagaaa

SEQ ID NO: 545278 - RNA, 64 nt, Homo Sapiens
aaggugguggagccacugcauuaaaucaaaaugccaaauuuauugugacuguuaaaacuuccuu

SEQ ID NO: 545279 - RNA, 64 nt, Homo Sapiens
cuuaaaauguuucauuuucauuaaaaaugaaagccaaauuuauaugccaccgauugcaggacac

SEQ ID NO: 545280 - RNA, 64 nt, Homo Sapiens
augucacgucuugaaaagccuauuagauguuuuacaaauuuaauuuugcagauuauuuuagucu

SEQ ID NO: 545281 - RNA, 64 nt, Homo Sapiens
ugcuuucaguuuuagccuauuaauuuuagguggacaaauuuaacaaguuuucuguuacuuuuua

SEQ ID NO: 545282 - RNA, 64 nt, Homo Sapiens
acaggaugcaaacuaaaaaccuaaucccugccaucaaauuuauuagaagagaccuauauaugaa

SEQ ID NO: 545283 - RNA, 64 nt, Homo Sapiens
ugaagggcauuaauuagauguucuuauuuuccaccaaauuuaauguaguuauuccuagcuccau

SEQ ID NO: 545284 - RNA, 64 nt, Homo Sapiens
auaccuuccacucacuaauaaccauugugggguccaaauuuaaguacacaauaugcacauuuuu

SEQ ID NO: 545285 - RNA, 64 nt, Homo Sapiens
auucaggcuccacaauaaauuuuaaugagcacuacaaauuuagaauauauaaaaauaucaguaa

SEQ ID NO: 545286 - RNA, 64 nt, Homo Sapiens
auacucuauuuggaguugugcaagugagaagccccaaauuuauaagucaauauccucauucaga

SEQ ID NO: 545287 - RNA, 64 nt, Homo Sapiens
auauuauuguuuuuaaaaaaaguuccacaaaauccaaauuuaccguuugacaugagauaguuua

SEQ ID NO: 545288 - RNA, 64 nt, Homo Sapiens
uugugcccuacaaguuaaaaagaugggacaauaucaaauuuacuuagaugcagggacagggauc

SEQ ID NO: 545289 - RNA, 64 nt, Homo Sapiens
aaugucagcaaugucaauuuaguuccuggucacucaaauuuaaggccuaaacuaauuuuuagau

SEQ ID NO: 545290 - RNA, 64 nt, Homo Sapiens
cacuaaaagcaugaauuggaacugcaaugaaagucaaauuuacuuuaaaaagaaauuaauaugg

SEQ ID NO: 545291 - RNA, 64 nt, Homo Sapiens
uucuugagaaguaacuguccgcuagaagucuguccaaauuuaaaaugugugccauauucugguu

SEQ ID NO: 545292 - RNA, 64 nt, Homo Sapiens
ugacaguaacuuucaugacauaggauucugccgccaaauuuauaucauuaacaaugugugccuu

SEQ ID NO: 545293 - RNA, 64 nt, Homo Sapiens
uuauuguaaauacugcccuagugucuccauggaccaaauuuauauuuauaauuguagauuuuua

SEQ ID NO: 545294 - RNA, 64 nt, Homo Sapiens
augauugucauguccuccuuuaaggcuuuucccucaaauuuauuacaaauuuaguauuuuuagu

SEQ ID NO: 545295 - RNA, 64 nt, Homo Sapiens
guccuccuuuaaggcuuuucccucaaauuuauuacaaauuuaguauuuuuaguacuugaugacu

SEQ ID NO: 545296 - RNA, 64 nt, Homo Sapiens
uuuaucuauuaaaauugccaugguauuacacagucaaauuuacaugguucagcuacuuuccauu

SEQ ID NO: 545297 - RNA, 64 nt, Homo Sapiens
gggagcucuucaacauuaagugcuagcuaaaagacaaauuuaagcacuuacaccaguuugacug

SEQ ID NO: 545298 - RNA, 64 nt, Homo Sapiens
uugaggaaguuccaaauuuguagccaguuccaaacaaauuuaaauauugaguugagaccuguau

SEQ ID NO: 545299 - RNA, 64 nt, Homo Sapiens
uugguauaauggagaagaugguuuagguguacagcaaauuuaaaauagucaguggauugugucu

SEQ ID NO: 545300 - RNA, 64 nt, Homo Sapiens
uuucacagcaugguuuuguuuguaacuacuaaaccaaauuuagucuuugcaguaaaaugacggu

SEQ ID NO: 545301 - RNA, 64 nt, Homo Sapiens
uugcuuaccacaguguuauagagagcaauaagaacaaauuuauugauuaagcuggaauuauaau

SEQ ID NO: 545302 - RNA, 64 nt, Homo Sapiens
ucgucaguacgagcugcucuaagaagggaacccccaaauuuaauuaaagccuuaagcacaauua

SEQ ID NO: 545303 - RNA, 64 nt, Homo Sapiens
aacccccuuuucccuucagcuugcuuagauguuccaaauuuagaaagcuuaaggcggccuacag

SEQ ID NO: 545304 - RNA, 64 nt, Homo Sapiens
guucuugugaauuuccacuuuccagguagaugaccaaauuuagguggucaagauauaaaggugu

SEQ ID NO: 545305 - RNA, 64 nt, Homo Sapiens
ucacuuucacacugccuucaggccagaagcaaaccaaauuuaccagguuuggcuggaggaguuu

SEQ ID NO: 545306 - RNA, 64 nt, Homo Sapiens
aaguuaggguuaggacauccuuuuuuaaaaauuacaaauuuaguccguuuugguuuuuguaauc

SEQ ID NO: 545307 - RNA, 64 nt, Homo Sapiens
cccgcucccucuggcagcgaauguaggaagucgccaaauuuacccacucuucaacaagucauug

SEQ ID NO: 545308 - RNA, 64 nt, Homo Sapiens
uuacuacuuuaagugauauucauuuaaaacauugcaaauuuauuuuauuuauuuaauuuucuuu

SEQ ID NO: 545309 - RNA, 64 nt, Homo Sapiens
caggcuugagccaccacgcccggcuaaaacauugcaaauuuaaaugagaguuuuaaaaauuaaa

SEQ ID NO: 545310 - RNA, 64 nt, Homo Sapiens; identical to SEQ ID NO: 80933

SEQ ID NO: 545311 - RNA, 64 nt, Homo Sapiens; identical to SEQ ID NO: 80934

SEQ ID NO: 545312 - RNA, 64 nt, Homo Sapiens; identical to SEQ ID NO: 80935

SEQ ID NO: 545313 - RNA, 64 nt, Homo Sapiens; identical to SEQ ID NO: 80936

SEQ ID NO: 545314 - RNA, 64 nt, Homo Sapiens; identical to SEQ ID NO: 80937

SEQ ID NO: 545315 - RNA, 64 nt, Homo Sapiens; identical to SEQ ID NO: 80938

SEQ ID NO: 545316 - RNA, 64 nt, Homo Sapiens; identical to SEQ ID NO: 80939

SEQ ID NO: 545317 - RNA, 64 nt, Homo Sapiens; identical to SEQ ID NO: 80940

SEQ ID NO: 545318 - RNA, 64 nt, Homo Sapiens; identical to SEQ ID NO: 80941

SEQ ID NO: 545319 - RNA, 64 nt, Homo Sapiens; identical to SEQ ID NO: 80942

SEQ ID NO: 545320 - RNA, 64 nt, Homo Sapiens; identical to SEQ ID NO: 80943

SEQ ID NO: 545321 - RNA, 64 nt, Homo Sapiens; identical to SEQ ID NO: 80944

SEQ ID NO: 545322 - RNA, 64 nt, Homo Sapiens; identical to SEQ ID NO: 80945

SEQ ID NO: 545323 - RNA, 64 nt, Homo Sapiens; identical to SEQ ID NO: 80946

SEQ ID NO: 545324 - RNA, 64 nt, Homo Sapiens; identical to SEQ ID NO: 80947

SEQ ID NO: 545325 - RNA, 64 nt, Homo Sapiens; identical to SEQ ID NO: 80948

SEQ ID NO: 545326 - RNA, 64 nt, Homo Sapiens; identical to SEQ ID NO: 80949

SEQ ID NO: 545327 - RNA, 64 nt, Homo Sapiens; identical to SEQ ID NO: 80950

SEQ ID NO: 545328 - RNA, 64 nt, Homo Sapiens; identical to SEQ ID NO: 80951

SEQ ID NO: 545329 - RNA, 64 nt, Homo Sapiens; identical to SEQ ID NO: 80952

SEQ ID NO: 545330 - RNA, 64 nt, Homo Sapiens; identical to SEQ ID NO: 80953

SEQ ID NO: 545331 - RNA, 64 nt, Homo Sapiens; identical to SEQ ID NO: 80954

SEQ ID NO: 545332 - RNA, 63 nt, Homo Sapiens; identical to SEQ ID NO: 80955

SEQ ID NO: 545333 - RNA, 64 nt, Homo Sapiens; identical to SEQ ID NO: 80956

SEQ ID NO: 545334 - RNA, 64 nt, Homo Sapiens; identical to SEQ ID NO: 80957

SEQ ID NO: 545335 - RNA, 64 nt, Homo Sapiens; identical to SEQ ID NO: 80958

SEQ ID NO: 545336 - RNA, 64 nt, Homo Sapiens; identical to SEQ ID NO: 80959

SEQ ID NO: 545337 - RNA, 64 nt, Homo Sapiens; identical to SEQ ID NO: 80960

SEQ ID NO: 545338 - RNA, 64 nt, Homo Sapiens; identical to SEQ ID NO: 80961

SEQ ID NO: 545339 - RNA, 64 nt, Homo Sapiens; identical to SEQ ID NO: 80962

SEQ ID NO: 545340 - RNA, 64 nt, Homo Sapiens; identical to SEQ ID NO: 80963

SEQ ID NO: 545341 - RNA, 64 nt, Homo Sapiens; identical to SEQ ID NO: 80964

SEQ ID NO: 545342 - RNA, 64 nt, Homo Sapiens; identical to SEQ ID NO: 80965

SEQ ID NO: 545343 - RNA, 64 nt, Homo Sapiens; identical to SEQ ID NO: 80966

SEQ ID NO: 545344 - RNA, 64 nt, Homo Sapiens; identical to SEQ ID NO: 80967

SEQ ID NO: 545345 - RNA, 64 nt, Homo Sapiens; identical to SEQ ID NO: 80968

SEQ ID NO: 545346 - RNA, 64 nt, Homo Sapiens; identical to SEQ ID NO: 80969

SEQ ID NO: 545347 - RNA, 64 nt, Homo Sapiens; identical to SEQ ID NO: 80970

SEQ ID NO: 545348 - RNA, 64 nt, Homo Sapiens; identical to SEQ ID NO: 80971

SEQ ID NO: 545349 - RNA, 64 nt, Homo Sapiens; identical to SEQ ID NO: 80972

SEQ ID NO: 545350 - RNA, 64 nt, Homo Sapiens; identical to SEQ ID NO: 80973

SEQ ID NO: 545351 - RNA, 64 nt, Homo Sapiens; identical to SEQ ID NO: 80974

SEQ ID NO: 545352 - RNA, 64 nt, Homo Sapiens; identical to SEQ ID NO: 80975

SEQ ID NO: 545353 - RNA, 64 nt, Homo Sapiens; identical to SEQ ID NO: 80976

SEQ ID NO: 545354 - RNA, 64 nt, Homo Sapiens; identical to SEQ ID NO: 80977

SEQ ID NO: 545355 - RNA, 64 nt, Homo Sapiens; identical to SEQ ID NO: 80978

SEQ ID NO: 545356 - RNA, 64 nt, Homo Sapiens; identical to SEQ ID NO: 80979

SEQ ID NO: 545357 - RNA, 64 nt, Homo Sapiens; identical to SEQ ID NO: 80980

SEQ ID NO: 545358 - RNA, 64 nt, Homo Sapiens; identical to SEQ ID NO: 80981

SEQ ID NO: 545359 - RNA, 64 nt, Homo Sapiens; identical to SEQ ID NO: 80982

SEQ ID NO: 545360 - RNA, 64 nt, Homo Sapiens; identical to SEQ ID NO: 80983

SEQ ID NO: 545361 - RNA, 64 nt, Homo Sapiens; identical to SEQ ID NO: 80984

SEQ ID NO: 545362 - RNA, 64 nt, Homo Sapiens; identical to SEQ ID NO: 80985

SEQ ID NO: 545363 - RNA, 64 nt, Homo Sapiens; identical to SEQ ID NO: 80986

SEQ ID NO: 545364 - RNA, 64 nt, Homo Sapiens; identical to SEQ ID NO: 80987

SEQ ID NO: 545365 - RNA, 64 nt, Homo Sapiens; identical to SEQ ID NO: 80988

SEQ ID NO: 545366 - RNA, 64 nt, Homo Sapiens; identical to SEQ ID NO: 80989

SEQ ID NO: 545367 - RNA, 64 nt, Homo Sapiens; identical to SEQ ID NO: 80990

SEQ ID NO: 545368 - RNA, 64 nt, Homo Sapiens; identical to SEQ ID NO: 80991

SEQ ID NO: 545369 - RNA, 64 nt, Homo Sapiens; identical to SEQ ID NO: 80992

SEQ ID NO: 545370 - RNA, 64 nt, Homo Sapiens; identical to SEQ ID NO: 80993

SEQ ID NO: 545371 - RNA, 64 nt, Homo Sapiens; identical to SEQ ID NO: 80994

SEQ ID NO: 545372 - RNA, 64 nt, Homo Sapiens; identical to SEQ ID NO: 80995

SEQ ID NO: 545373 - RNA, 64 nt, Homo Sapiens; identical to SEQ ID NO: 80996

SEQ ID NO: 545374 - RNA, 64 nt, Homo Sapiens; identical to SEQ ID NO: 80997

SEQ ID NO: 545375 - RNA, 64 nt, Homo Sapiens; identical to SEQ ID NO: 80998

SEQ ID NO: 545376 - RNA, 64 nt, Homo Sapiens; identical to SEQ ID NO: 80999

SEQ ID NO: 545377 - RNA, 64 nt, Homo Sapiens; identical to SEQ ID NO: 81000

SEQ ID NO: 545378 - RNA, 64 nt, Homo Sapiens; identical to SEQ ID NO: 81001

SEQ ID NO: 545379 - RNA, 64 nt, Homo Sapiens; identical to SEQ ID NO: 81002

SEQ ID NO: 545380 - RNA, 64 nt, Homo Sapiens; identical to SEQ ID NO: 81003

SEQ ID NO: 545381 - RNA, 64 nt, Homo Sapiens; identical to SEQ ID NO: 81004

SEQ ID NO: 545382 - RNA, 64 nt, Homo Sapiens; identical to SEQ ID NO: 81005

SEQ ID NO: 545383 - RNA, 64 nt, Homo Sapiens; identical to SEQ ID NO: 81006

SEQ ID NO: 545384 - RNA, 64 nt, Homo Sapiens; identical to SEQ ID NO: 81007

SEQ ID NO: 545385 - RNA, 64 nt, Homo Sapiens; identical to SEQ ID NO: 81008

SEQ ID NO: 545386 - RNA, 64 nt, Homo Sapiens; identical to SEQ ID NO: 81009

SEQ ID NO: 545387 - RNA, 64 nt, Homo Sapiens; identical to SEQ ID NO: 81010

SEQ ID NO: 545388 - RNA, 64 nt, Homo Sapiens; identical to SEQ ID NO: 81011

SEQ ID NO: 545389 - RNA, 64 nt, Homo Sapiens; identical to SEQ ID NO: 81012

SEQ ID NO: 545390 - RNA, 64 nt, Homo Sapiens; identical to SEQ ID NO: 81013

SEQ ID NO: 545391 - RNA, 64 nt, Homo Sapiens; identical to SEQ ID NO: 81014

SEQ ID NO: 545392 - RNA, 64 nt, Homo Sapiens; identical to SEQ ID NO: 81015

SEQ ID NO: 545393 - RNA, 64 nt, Homo Sapiens; identical to SEQ ID NO: 81016

SEQ ID NO: 545394 - RNA, 64 nt, Homo Sapiens; identical to SEQ ID NO: 81017

SEQ ID NO: 545395 - RNA, 64 nt, Homo Sapiens; identical to SEQ ID NO: 81018

SEQ ID NO: 545396 - RNA, 64 nt, Homo Sapiens; identical to SEQ ID NO: 81019

SEQ ID NO: 545397 - RNA, 64 nt, Homo Sapiens; identical to SEQ ID NO: 81020

SEQ ID NO: 545398 - RNA, 64 nt, Homo Sapiens; identical to SEQ ID NO: 81021

SEQ ID NO: 545399 - RNA, 64 nt, Homo Sapiens; identical to SEQ ID NO: 81022

SEQ ID NO: 545400 - RNA, 64 nt, Homo Sapiens; identical to SEQ ID NO: 81023

SEQ ID NO: 545401 - RNA, 64 nt, Homo Sapiens; identical to SEQ ID NO: 81024

SEQ ID NO: 545402 - RNA, 64 nt, Homo Sapiens; identical to SEQ ID NO: 81025

SEQ ID NO: 545403 - RNA, 64 nt, Homo Sapiens; identical to SEQ ID NO: 81026

SEQ ID NO: 545404 - RNA, 64 nt, Homo Sapiens; identical to SEQ ID NO: 81027

SEQ ID NO: 545405 - RNA, 64 nt, Homo Sapiens; identical to SEQ ID NO: 81028

SEQ ID NO: 545406 - RNA, 64 nt, Homo Sapiens; identical to SEQ ID NO: 81029

SEQ ID NO: 545407 - RNA, 64 nt, Homo Sapiens; identical to SEQ ID NO: 81030

SEQ ID NO: 545408 - RNA, 64 nt, Homo Sapiens; identical to SEQ ID NO: 81031

SEQ ID NO: 545409 - RNA, 64 nt, Homo Sapiens; identical to SEQ ID NO: 81032

SEQ ID NO: 545410 - RNA, 64 nt, Homo Sapiens; identical to SEQ ID NO: 81033

SEQ ID NO: 545411 - RNA, 64 nt, Homo Sapiens; identical to SEQ ID NO: 81034

SEQ ID NO: 545412 - RNA, 64 nt, Homo Sapiens; identical to SEQ ID NO: 81035

SEQ ID NO: 545413 - RNA, 64 nt, Homo Sapiens; identical to SEQ ID NO: 81036

SEQ ID NO: 545414 - RNA, 64 nt, Homo Sapiens; identical to SEQ ID NO: 81037

SEQ ID NO: 545415 - RNA, 64 nt, Homo Sapiens; identical to SEQ ID NO: 81038

SEQ ID NO: 545416 - RNA, 64 nt, Homo Sapiens; identical to SEQ ID NO: 81039

SEQ ID NO: 545417 - RNA, 64 nt, Homo Sapiens; identical to SEQ ID NO: 81040

SEQ ID NO: 545418 - RNA, 64 nt, Homo Sapiens; identical to SEQ ID NO: 81041

SEQ ID NO: 545419 - RNA, 64 nt, Homo Sapiens; identical to SEQ ID NO: 81042

SEQ ID NO: 545420 - RNA, 64 nt, Homo Sapiens; identical to SEQ ID NO: 82841

SEQ ID NO: 545421 - RNA, 64 nt, Homo Sapiens; identical to SEQ ID NO: 82842

SEQ ID NO: 545422 - RNA, 64 nt, Homo Sapiens; identical to SEQ ID NO: 82843

SEQ ID NO: 545423 - RNA, 64 nt, Homo Sapiens; identical to SEQ ID NO: 82844

SEQ ID NO: 545424 - RNA, 64 nt, Homo Sapiens; identical to SEQ ID NO: 82845

SEQ ID NO: 545425 - RNA, 64 nt, Homo Sapiens; identical to SEQ ID NO: 82846

SEQ ID NO: 545426 - RNA, 64 nt, Homo Sapiens; identical to SEQ ID NO: 82847

SEQ ID NO: 545427 - RNA, 64 nt, Homo Sapiens; identical to SEQ ID NO: 82848

SEQ ID NO: 545428 - RNA, 64 nt, Homo Sapiens; identical to SEQ ID NO: 82849

SEQ ID NO: 545429 - RNA, 64 nt, Homo Sapiens; identical to SEQ ID NO: 82850

SEQ ID NO: 545430 - RNA, 64 nt, Homo Sapiens; identical to SEQ ID NO: 215681

SEQ ID NO: 545431 - RNA, 64 nt, Homo Sapiens; identical to SEQ ID NO: 215682

SEQ ID NO: 545432 - RNA, 64 nt, Homo Sapiens; identical to SEQ ID NO: 215683

SEQ ID NO: 545433 - RNA, 64 nt, Homo Sapiens; identical to SEQ ID NO: 215684

SEQ ID NO: 545434 - RNA, 64 nt, Homo Sapiens; identical to SEQ ID NO: 215685

SEQ ID NO: 545435 - RNA, 64 nt, Homo Sapiens; identical to SEQ ID NO: 215686

SEQ ID NO: 545436 - RNA, 64 nt, Homo Sapiens; identical to SEQ ID NO: 215687

SEQ ID NO: 545437 - RNA, 64 nt, Homo Sapiens; identical to SEQ ID NO: 215688

SEQ ID NO: 545438 - RNA, 64 nt, Homo Sapiens; identical to SEQ ID NO: 215689

SEQ ID NO: 545439 - RNA, 64 nt, Homo Sapiens; identical to SEQ ID NO: 215690

SEQ ID NO: 545440 - RNA, 64 nt, Homo Sapiens; identical to SEQ ID NO: 215691

SEQ ID NO: 545441 - RNA, 64 nt, Homo Sapiens; identical to SEQ ID NO: 215692

SEQ ID NO: 545442 - RNA, 64 nt, Homo Sapiens; identical to SEQ ID NO: 215693

SEQ ID NO: 545443 - RNA, 64 nt, Homo Sapiens; identical to SEQ ID NO: 215694

SEQ ID NO: 545444 - RNA, 64 nt, Homo Sapiens; identical to SEQ ID NO: 215695

SEQ ID NO: 545445 - RNA, 64 nt, Homo Sapiens; identical to SEQ ID NO: 215696

SEQ ID NO: 545446 - RNA, 64 nt, Homo Sapiens; identical to SEQ ID NO: 215697

SEQ ID NO: 545447 - RNA, 64 nt, Homo Sapiens; identical to SEQ ID NO: 215698

SEQ ID NO: 545448 - RNA, 64 nt, Homo Sapiens; identical to SEQ ID NO: 215699

SEQ ID NO: 545449 - RNA, 64 nt, Homo Sapiens; identical to SEQ ID NO: 215700

SEQ ID NO: 545450 - RNA, 64 nt, Homo Sapiens; identical to SEQ ID NO: 215701

SEQ ID NO: 545451 - RNA, 64 nt, Homo Sapiens; identical to SEQ ID NO: 215702

SEQ ID NO: 545452 - RNA, 64 nt, Homo Sapiens
agcaaguacugagaacucauuuucuacccugccucgucuuaagacauauuuauguaauaccaug

SEQ ID NO: 545453 - RNA, 64 nt, Homo Sapiens
gcccucuccaugucuucguccuggcaaacagggucgucuuaaaauuaugcgcuaauucuguaug

SEQ ID NO: 545454 - RNA, 64 nt, Homo Sapiens
uaccgacuuuuuuugguuuggaaacauauuaccacgucuuaauaggauggugcccauauaggug

SEQ ID NO: 545455 - RNA, 64 nt, Homo Sapiens
aagcccauggcaggcugggccaagagugaaacuccgucuuaaaacugcacuccagccugggcga

SEQ ID NO: 545456 - RNA, 64 nt, Homo Sapiens
uccagcaugcucagggacccucuuaucagacgcccgucuuaaaguacccaaauacucacaaggg

SEQ ID NO: 545457 - RNA, 64 nt, Homo Sapiens
aagugaugggagaauugguauacugguaugacuacgucuuaagucagauuuuuauuuaugaguc

SEQ ID NO: 545458 - RNA, 64 nt, Homo Sapiens
cuugagugaaucuucaaaggcugcauuccagaaacgucuuaacauugacuaugggggagagacg

SEQ ID NO: 545459 - RNA, 64 nt, Homo Sapiens
cauucuuaacuauagagaagaguuacuccccuggcgucuuaaccuauggaaaacaugcacggau

SEQ ID NO: 545460 - RNA, 64 nt, Homo Sapiens
ccuaaccccaaaggcucuuuacauuccaaguaagcgucuuaacaaguacaccagcuccaaguaa

SEQ ID NO: 545461 - RNA, 64 nt, Homo Sapiens
gaaaauuuaauuuuuacuccaauaauuguaaaaucgucuuaaaggugaaauuauggacaagaga

SEQ ID NO: 545462 - RNA, 64 nt, Homo Sapiens
guauuacaguggggaaugaagauacugaaauaaacgucuuaaauauucauuuacugguuaucau

SEQ ID NO: 545463 - RNA, 64 nt, Homo Sapiens
cacugcacuccggccugaugacagagcgagauuccgucuuaaaaaaaaaaaaaaaaaaguuugu

SEQ ID NO: 545464 - RNA, 64 nt, Homo Sapiens
caugucccugucuaaagagacuuucucuuucauacgucuuaaaucucaucaaugaaauccagug

SEQ ID NO: 545465 - RNA, 64 nt, Homo Sapiens
gcagauaagugacuaagacuagaacauuuauuuacgucuuaagaauaauugguuuuccccccua

SEQ ID NO: 545466 - RNA, 64 nt, Homo Sapiens
gugggaagccuggcauuuggggugcuccuugcaacgucuuaagcaagcgaccccccgacauagc

SEQ ID NO: 545467 - RNA, 64 nt, Homo Sapiens
ugaagaaaaaccuuuaacugagaaauauggaaaccgucuuaauuuuccauuggcuaugauggaa

SEQ ID NO: 545468 - RNA, 64 nt, Homo Sapiens
uccaccucagggcacgggcaaacacauaggcuugcgucuuaaagccagcuccucugccagaccc

SEQ ID NO: 545469 - RNA, 64 nt, Homo Sapiens
cuaguggacaauucuagcauuuccucaguuuucucgucuuaacagauaguaagacagcugaguu

SEQ ID NO: 545470 - RNA, 64 nt, Homo Sapiens
ggguaaauaauuaucuuaucuguuuuuauuaauccgucuuaaauguguauauagcucagauuua

SEQ ID NO: 545471 - RNA, 64 nt, Homo Sapiens
cugcugcuucccaaggaugggggcaguggggagacgucuuaacuuguugguguguaugucacua

SEQ ID NO: 545472 - RNA, 64 nt, Homo Sapiens
ucuaagguggucucaguauuuuuuucuuaaaaaucgucuuaagcuaaauuuugugccaguauuu

SEQ ID NO: 545473 - RNA, 64 nt, Homo Sapiens
acuucugcagggcugcugguuccgagcugacacccgucuuaacaaaaggcccaggagugccucu

SEQ ID NO: 545474 - RNA, 64 nt, Homo Sapiens
uuuuuaugccuuuauauacuuaaguucauacaaucgucuuaaguaaauguaaaauauuugagaa

SEQ ID NO: 545475 - RNA, 64 nt, Homo Sapiens
ucaagaggaggagcugacacauuucacuuggcugcgucuuaauaaacaugaaugcaagcauugg

SEQ ID NO: 545476 - RNA, 64 nt, Homo Sapiens
cuuuauuguaacgaugaugguuacccuucauggacgucuuaaucuuccacacacauccccuuuu

SEQ ID NO: 545477 - RNA, 64 nt, Homo Sapiens
acacugcaggcaucacagcuaacaauugugaagucgucuuaacucaccauaaaaaggaauccac

SEQ ID NO: 545478 - RNA, 64 nt, Homo Sapiens
agacaguuuaguuuuggggaacagaagcucucuucgucuuaagccagauucucugauucuuuua

SEQ ID NO: 545479 - RNA, 64 nt, Homo Sapiens
uucaccguccacagcuuuggcgagucaccucuuucgucuuaauguccguguuucagguuccacg

SEQ ID NO: 545480 - RNA, 64 nt, Homo Sapiens
uauauuuucuugagaugaguuaaggaaagcaagacgucuuaaagaaaaaaaaguguugcuuucu

SEQ ID NO: 545481 - RNA, 64 nt, Homo Sapiens
cguauagagagaucacguucagaaccaaaucaaacgucuuaacgacuuuuccauaagcagaaca

SEQ ID NO: 545482 - RNA, 64 nt, Homo Sapiens
ucauuuuucaccuguacaaggaauacuaauggaucgucuuaaaauuggucuaggaaaaaaccuu

SEQ ID NO: 545483 - RNA, 64 nt, Homo Sapiens
cuuggguguagacaugaaaccaucuuacuaaaagcgucuuaaaaugaccaauuccagaaucaag

SEQ ID NO: 545484 - RNA, 64 nt, Homo Sapiens
aaaaaguugcaguaggguugaaaauauauguaaucgucuuaauuugcuuuaaagcaauuggucu

SEQ ID NO: 545485 - RNA, 64 nt, Homo Sapiens
uccuguuacguguuucaggugagaagcagcaaagcgucuuaauguucaaaacgccucucuuugg

SEQ ID NO: 545486 - RNA, 64 nt, Homo Sapiens
acuggaucccacacaaaucaauccuggaccucuacgucuuaaccuucccugugcccccuacugg

SEQ ID NO: 545487 - RNA, 64 nt, Homo Sapiens
ccaaaaguuaaccgggcgugacagagcaagacaccgucuuaaaaauugcacccuagccugggca

SEQ ID NO: 545488 - RNA, 64 nt, Homo Sapiens
uuuuauaccaauaaugcugaaagaauucuaaugccgucuuaaguuaaauuuuacaccuuuucuu

SEQ ID NO: 545489 - RNA, 64 nt, Homo Sapiens
acugcacuccagccugggugacagcacgagaugccgucuuaaaaaaacaaaaaagaggugugcu

SEQ ID NO: 545490 - RNA, 64 nt, Homo Sapiens
agcaguauuacuauaagcagcauuucagcaguagcgucuuaaacugcuuuuuggagguucuaau

SEQ ID NO: 545491 - RNA, 64 nt, Homo Sapiens
guuuuccauuuuuacccugucaaacaugugauuccgucuuaaaagaagagguaccaaugacuuc

SEQ ID NO: 545492 - RNA, 64 nt, Homo Sapiens
caaguggcucaguaguuggcagacugcacaagacaaagcucagguagcauaacuuugugugacg

SEQ ID NO: 545493 - RNA, 64 nt, Homo Sapiens
ucuuuuugaagugaugagguauugaaugucaaaaaaagcucauuugagacuugaaucguagaaa

SEQ ID NO: 545494 - RNA, 64 nt, Homo Sapiens
uacugauuuuugugauuuagccugaugguacaggaaagcucagcucaccaauugguuaaucuuu

SEQ ID NO: 545495 - RNA, 64 nt, Homo Sapiens
uuuuguauauaucugcuucaaaaaaaaaaaaaaaaaagcucauaaaucuccaguauucuuguca

SEQ ID NO: 545496 - RNA, 64 nt, Homo Sapiens
gagaugcauuuuaaagcuaauguuaauggggagaaaagcucagaagaggauguaaggcagcugg

SEQ ID NO: 545497 - RNA, 64 nt, Homo Sapiens
gcaucagcugguugcccaggaggagaugaugagaaaagcucaccgacagaucugaagugaagac

SEQ ID NO: 545498 - RNA, 64 nt, Homo Sapiens
cacuuguuauuggccuaugaacuaaaagcaaaucaaagcucauaaaucaaagcucaucaguucc

SEQ ID NO: 545499 - RNA, 64 nt, Homo Sapiens
cuaugaacuaaaagcaaaucaaagcucauaaaucaaagcucaucaguucccauaaaugcaguug

SEQ ID NO: 545500 - RNA, 64 nt, Homo Sapiens
auagaaauuagguuaaaaugaggaaauguauuugaaagcucaaaaaauugaucauaaaaccuuu

SEQ ID NO: 545501 - RNA, 64 nt, Homo Sapiens
aggggagcaauaaaccgagauguuuauggaacugaaagcucaacuguaauuagagcuugcuacg

SEQ ID NO: 545502 - RNA, 64 nt, Homo Sapiens; identical to SEQ ID NO: 112259

SEQ ID NO: 545503 - RNA, 64 nt, Homo Sapiens; identical to SEQ ID NO: 112260

SEQ ID NO: 545504 - RNA, 64 nt, Homo Sapiens; identical to SEQ ID NO: 112261

SEQ ID NO: 545505 - RNA, 64 nt, Homo Sapiens; identical to SEQ ID NO: 112262

SEQ ID NO: 545506 - RNA, 64 nt, Homo Sapiens; identical to SEQ ID NO: 112263

SEQ ID NO: 545507 - RNA, 64 nt, Homo Sapiens; identical to SEQ ID NO: 112264

SEQ ID NO: 545508 - RNA, 64 nt, Homo Sapiens; identical to SEQ ID NO: 112265

SEQ ID NO: 545509 - RNA, 64 nt, Homo Sapiens; identical to SEQ ID NO: 112266

SEQ ID NO: 545510 - RNA, 64 nt, Homo Sapiens; identical to SEQ ID NO: 112267

SEQ ID NO: 545511 - RNA, 64 nt, Homo Sapiens; identical to SEQ ID NO: 112268

SEQ ID NO: 545512 - RNA, 64 nt, Homo Sapiens; identical to SEQ ID NO: 112269

SEQ ID NO: 545513 - RNA, 64 nt, Homo Sapiens; identical to SEQ ID NO: 112270

SEQ ID NO: 545514 - RNA, 64 nt, Homo Sapiens; identical to SEQ ID NO: 112271

SEQ ID NO: 545515 - RNA, 64 nt, Homo Sapiens; identical to SEQ ID NO: 112272

SEQ ID NO: 545516 - RNA, 64 nt, Homo Sapiens; identical to SEQ ID NO: 112273

SEQ ID NO: 545517 - RNA, 64 nt, Homo Sapiens; identical to SEQ ID NO: 112274

SEQ ID NO: 545518 - RNA, 64 nt, Homo Sapiens; identical to SEQ ID NO: 112275

SEQ ID NO: 545519 - RNA, 64 nt, Homo Sapiens; identical to SEQ ID NO: 112276

SEQ ID NO: 545520 - RNA, 64 nt, Homo Sapiens; identical to SEQ ID NO: 112277

SEQ ID NO: 545521 - RNA, 64 nt, Homo Sapiens; identical to SEQ ID NO: 112278

SEQ ID NO: 545522 - RNA, 64 nt, Homo Sapiens; identical to SEQ ID NO: 112279

SEQ ID NO: 545523 - RNA, 64 nt, Homo Sapiens; identical to SEQ ID NO: 112280

SEQ ID NO: 545524 - RNA, 64 nt, Homo Sapiens; identical to SEQ ID NO: 112281

SEQ ID NO: 545525 - RNA, 64 nt, Homo Sapiens; identical to SEQ ID NO: 112282

SEQ ID NO: 545526 - RNA, 64 nt, Homo Sapiens; identical to SEQ ID NO: 112283

SEQ ID NO: 545527 - RNA, 64 nt, Homo Sapiens; identical to SEQ ID NO: 112284

SEQ ID NO: 545528 - RNA, 64 nt, Homo Sapiens; identical to SEQ ID NO: 112285

SEQ ID NO: 545529 - RNA, 64 nt, Homo Sapiens; identical to SEQ ID NO: 112286

SEQ ID NO: 545530 - RNA, 64 nt, Homo Sapiens; identical to SEQ ID NO: 112287

SEQ ID NO: 545531 - RNA, 64 nt, Homo Sapiens; identical to SEQ ID NO: 112288

SEQ ID NO: 545532 - RNA, 64 nt, Homo Sapiens; identical to SEQ ID NO: 112289

SEQ ID NO: 545533 - RNA, 64 nt, Homo Sapiens; identical to SEQ ID NO: 112290

SEQ ID NO: 545534 - RNA, 64 nt, Homo Sapiens; identical to SEQ ID NO: 112291

SEQ ID NO: 545535 - RNA, 64 nt, Homo Sapiens; identical to SEQ ID NO: 112292

SEQ ID NO: 545536 - RNA, 64 nt, Homo Sapiens; identical to SEQ ID NO: 112293

SEQ ID NO: 545537 - RNA, 64 nt, Homo Sapiens; identical to SEQ ID NO: 112294

SEQ ID NO: 545538 - RNA, 64 nt, Homo Sapiens; identical to SEQ ID NO: 112295

SEQ ID NO: 545539 - RNA, 64 nt, Homo Sapiens; identical to SEQ ID NO: 112296

SEQ ID NO: 545540 - RNA, 64 nt, Homo Sapiens; identical to SEQ ID NO: 112297

SEQ ID NO: 545541 - RNA, 64 nt, Homo Sapiens; identical to SEQ ID NO: 112298

SEQ ID NO: 545542 - RNA, 64 nt, Homo Sapiens; identical to SEQ ID NO: 112299

SEQ ID NO: 545543 - RNA, 64 nt, Homo Sapiens; identical to SEQ ID NO: 112300

SEQ ID NO: 545544 - RNA, 64 nt, Homo Sapiens; identical to SEQ ID NO: 112301

SEQ ID NO: 545545 - RNA, 64 nt, Homo Sapiens; identical to SEQ ID NO: 112302

SEQ ID NO: 545546 - RNA, 64 nt, Homo Sapiens; identical to SEQ ID NO: 112303

SEQ ID NO: 545547 - RNA, 64 nt, Homo Sapiens; identical to SEQ ID NO: 112304

SEQ ID NO: 545548 - RNA, 64 nt, Homo Sapiens; identical to SEQ ID NO: 112305

SEQ ID NO: 545549 - RNA, 64 nt, Homo Sapiens; identical to SEQ ID NO: 112306

SEQ ID NO: 545550 - RNA, 64 nt, Homo Sapiens; identical to SEQ ID NO: 112307

SEQ ID NO: 545551 - RNA, 64 nt, Homo Sapiens; identical to SEQ ID NO: 112308

SEQ ID NO: 545552 - RNA, 64 nt, Homo Sapiens; identical to SEQ ID NO: 112309

SEQ ID NO: 545553 - RNA, 59 nt, Homo Sapiens; identical to SEQ ID NO: 112310

SEQ ID NO: 545554 - RNA, 64 nt, Homo Sapiens; identical to SEQ ID NO: 112311

SEQ ID NO: 545555 - RNA, 64 nt, Homo Sapiens; identical to SEQ ID NO: 112312

SEQ ID NO: 545556 - RNA, 64 nt, Homo Sapiens; identical to SEQ ID NO: 112313

SEQ ID NO: 545557 - RNA, 64 nt, Homo Sapiens; identical to SEQ ID NO: 112314

SEQ ID NO: 545558 - RNA, 64 nt, Homo Sapiens; identical to SEQ ID NO: 112315

SEQ ID NO: 545559 - RNA, 64 nt, Homo Sapiens; identical to SEQ ID NO: 112316

SEQ ID NO: 545560 - RNA, 64 nt, Homo Sapiens; identical to SEQ ID NO: 112317

SEQ ID NO: 545561 - RNA, 64 nt, Homo Sapiens; identical to SEQ ID NO: 112318

SEQ ID NO: 545562 - RNA, 64 nt, Homo Sapiens; identical to SEQ ID NO: 112319

SEQ ID NO: 545563 - RNA, 64 nt, Homo Sapiens; identical to SEQ ID NO: 112320

SEQ ID NO: 545564 - RNA, 64 nt, Homo Sapiens; identical to SEQ ID NO: 112321

SEQ ID NO: 545565 - RNA, 64 nt, Homo Sapiens; identical to SEQ ID NO: 112322

SEQ ID NO: 545566 - RNA, 64 nt, Homo Sapiens; identical to SEQ ID NO: 112323

SEQ ID NO: 545567 - RNA, 64 nt, Homo Sapiens; identical to SEQ ID NO: 112324

SEQ ID NO: 545568 - RNA, 64 nt, Homo Sapiens; identical to SEQ ID NO: 112325

SEQ ID NO: 545569 - RNA, 64 nt, Homo Sapiens; identical to SEQ ID NO: 112326

SEQ ID NO: 545570 - RNA, 64 nt, Homo Sapiens; identical to SEQ ID NO: 112327

SEQ ID NO: 545571 - RNA, 64 nt, Homo Sapiens; identical to SEQ ID NO: 112328

SEQ ID NO: 545572 - RNA, 64 nt, Homo Sapiens; identical to SEQ ID NO: 112329

SEQ ID NO: 545573 - RNA, 64 nt, Homo Sapiens; identical to SEQ ID NO: 112330

SEQ ID NO: 545574 - RNA, 64 nt, Homo Sapiens; identical to SEQ ID NO: 112331

SEQ ID NO: 545575 - RNA, 64 nt, Homo Sapiens; identical to SEQ ID NO: 112332

SEQ ID NO: 545576 - RNA, 64 nt, Homo Sapiens; identical to SEQ ID NO: 112333

SEQ ID NO: 545577 - RNA, 64 nt, Homo Sapiens; identical to SEQ ID NO: 112334

SEQ ID NO: 545578 - RNA, 64 nt, Homo Sapiens; identical to SEQ ID NO: 112335

SEQ ID NO: 545579 - RNA, 64 nt, Homo Sapiens; identical to SEQ ID NO: 112336

SEQ ID NO: 545580 - RNA, 64 nt, Homo Sapiens; identical to SEQ ID NO: 112337

SEQ ID NO: 545581 - RNA, 64 nt, Homo Sapiens; identical to SEQ ID NO: 112338

SEQ ID NO: 545582 - RNA, 64 nt, Homo Sapiens; identical to SEQ ID NO: 112339

SEQ ID NO: 545583 - RNA, 64 nt, Homo Sapiens; identical to SEQ ID NO: 112340

SEQ ID NO: 545584 - RNA, 64 nt, Homo Sapiens; identical to SEQ ID NO: 112341

SEQ ID NO: 545585 - RNA, 64 nt, Homo Sapiens; identical to SEQ ID NO: 112342

SEQ ID NO: 545586 - RNA, 64 nt, Homo Sapiens; identical to SEQ ID NO: 112343

SEQ ID NO: 545587 - RNA, 64 nt, Homo Sapiens; identical to SEQ ID NO: 112344

SEQ ID NO: 545588 - RNA, 64 nt, Homo Sapiens; identical to SEQ ID NO: 112345

SEQ ID NO: 545589 - RNA, 64 nt, Homo Sapiens; identical to SEQ ID NO: 112346

SEQ ID NO: 545590 - RNA, 64 nt, Homo Sapiens; identical to SEQ ID NO: 112347

SEQ ID NO: 545591 - RNA, 64 nt, Homo Sapiens; identical to SEQ ID NO: 112348

SEQ ID NO: 545592 - RNA, 64 nt, Homo Sapiens; identical to SEQ ID NO: 112349

SEQ ID NO: 545593 - RNA, 64 nt, Homo Sapiens; identical to SEQ ID NO: 112350

SEQ ID NO: 545594 - RNA, 64 nt, Homo Sapiens; identical to SEQ ID NO: 112351

SEQ ID NO: 545595 - RNA, 64 nt, Homo Sapiens; identical to SEQ ID NO: 112352

SEQ ID NO: 545596 - RNA, 64 nt, Homo Sapiens; identical to SEQ ID NO: 112353

SEQ ID NO: 545597 - RNA, 64 nt, Homo Sapiens; identical to SEQ ID NO: 112354

SEQ ID NO: 545598 - RNA, 64 nt, Homo Sapiens; identical to SEQ ID NO: 112355

SEQ ID NO: 545599 - RNA, 64 nt, Homo Sapiens; identical to SEQ ID NO: 112356

SEQ ID NO: 545600 - RNA, 64 nt, Homo Sapiens; identical to SEQ ID NO: 112357

SEQ ID NO: 545601 - RNA, 64 nt, Homo Sapiens; identical to SEQ ID NO: 112358

SEQ ID NO: 545602 - RNA, 64 nt, Homo Sapiens; identical to SEQ ID NO: 112359

SEQ ID NO: 545603 - RNA, 64 nt, Homo Sapiens; identical to SEQ ID NO: 112360

SEQ ID NO: 545604 - RNA, 64 nt, Homo Sapiens; identical to SEQ ID NO: 112361

SEQ ID NO: 545605 - RNA, 64 nt, Homo Sapiens; identical to SEQ ID NO: 112362

SEQ ID NO: 545606 - RNA, 64 nt, Homo Sapiens; identical to SEQ ID NO: 112363

SEQ ID NO: 545607 - RNA, 64 nt, Homo Sapiens; identical to SEQ ID NO: 112364

SEQ ID NO: 545608 - RNA, 64 nt, Homo Sapiens; identical to SEQ ID NO: 112365

SEQ ID NO: 545609 - RNA, 64 nt, Homo Sapiens; identical to SEQ ID NO: 112366

SEQ ID NO: 545610 - RNA, 64 nt, Homo Sapiens; identical to SEQ ID NO: 112367

SEQ ID NO: 545611 - RNA, 64 nt, Homo Sapiens; identical to SEQ ID NO: 112368

SEQ ID NO: 545612 - RNA, 64 nt, Homo Sapiens; identical to SEQ ID NO: 112369

SEQ ID NO: 545613 - RNA, 64 nt, Homo Sapiens; identical to SEQ ID NO: 112370

SEQ ID NO: 545614 - RNA, 64 nt, Homo Sapiens; identical to SEQ ID NO: 112371

SEQ ID NO: 545615 - RNA, 64 nt, Homo Sapiens; identical to SEQ ID NO: 112372

SEQ ID NO: 545616 - RNA, 64 nt, Homo Sapiens; identical to SEQ ID NO: 112373

SEQ ID NO: 545617 - RNA, 64 nt, Homo Sapiens; identical to SEQ ID NO: 112374

SEQ ID NO: 545618 - RNA, 64 nt, Homo Sapiens; identical to SEQ ID NO: 112375

SEQ ID NO: 545619 - RNA, 64 nt, Homo Sapiens; identical to SEQ ID NO: 112376

SEQ ID NO: 545620 - RNA, 64 nt, Homo Sapiens; identical to SEQ ID NO: 112377

SEQ ID NO: 545621 - RNA, 64 nt, Homo Sapiens; identical to SEQ ID NO: 112378

SEQ ID NO: 545622 - RNA, 64 nt, Homo Sapiens; identical to SEQ ID NO: 112379

SEQ ID NO: 545623 - RNA, 64 nt, Homo Sapiens; identical to SEQ ID NO: 112380

SEQ ID NO: 545624 - RNA, 64 nt, Homo Sapiens; identical to SEQ ID NO: 112381

SEQ ID NO: 545625 - RNA, 64 nt, Homo Sapiens; identical to SEQ ID NO: 112382

SEQ ID NO: 545626 - RNA, 64 nt, Homo Sapiens; identical to SEQ ID NO: 112383

SEQ ID NO: 545627 - RNA, 64 nt, Homo Sapiens; identical to SEQ ID NO: 112384

SEQ ID NO: 545628 - RNA, 64 nt, Homo Sapiens; identical to SEQ ID NO: 112385

SEQ ID NO: 545629 - RNA, 64 nt, Homo Sapiens; identical to SEQ ID NO: 112386

SEQ ID NO: 545630 - RNA, 64 nt, Homo Sapiens; identical to SEQ ID NO: 112387

SEQ ID NO: 545631 - RNA, 64 nt, Homo Sapiens; identical to SEQ ID NO: 112388

SEQ ID NO: 545632 - RNA, 64 nt, Homo Sapiens; identical to SEQ ID NO: 112389

SEQ ID NO: 545633 - RNA, 64 nt, Homo Sapiens; identical to SEQ ID NO: 112390

SEQ ID NO: 545634 - RNA, 64 nt, Homo Sapiens; identical to SEQ ID NO: 112391

SEQ ID NO: 545635 - RNA, 64 nt, Homo Sapiens; identical to SEQ ID NO: 112392

SEQ ID NO: 545636 - RNA, 64 nt, Homo Sapiens; identical to SEQ ID NO: 112393

SEQ ID NO: 545637 - RNA, 64 nt, Homo Sapiens; identical to SEQ ID NO: 112394

SEQ ID NO: 545638 - RNA, 64 nt, Homo Sapiens; identical to SEQ ID NO: 112395

SEQ ID NO: 545639 - RNA, 64 nt, Homo Sapiens; identical to SEQ ID NO: 112396

SEQ ID NO: 545640 - RNA, 64 nt, Homo Sapiens; identical to SEQ ID NO: 112397

SEQ ID NO: 545641 - RNA, 64 nt, Homo Sapiens; identical to SEQ ID NO: 112398

SEQ ID NO: 545642 - RNA, 64 nt, Homo Sapiens; identical to SEQ ID NO: 112399

SEQ ID NO: 545643 - RNA, 64 nt, Homo Sapiens; identical to SEQ ID NO: 112400

SEQ ID NO: 545644 - RNA, 64 nt, Homo Sapiens; identical to SEQ ID NO: 112401

SEQ ID NO: 545645 - RNA, 64 nt, Homo Sapiens; identical to SEQ ID NO: 112402

SEQ ID NO: 545646 - RNA, 64 nt, Homo Sapiens; identical to SEQ ID NO: 112403

SEQ ID NO: 545647 - RNA, 64 nt, Homo Sapiens; identical to SEQ ID NO: 112404

SEQ ID NO: 545648 - RNA, 64 nt, Homo Sapiens; identical to SEQ ID NO: 112405

SEQ ID NO: 545649 - RNA, 64 nt, Homo Sapiens; identical to SEQ ID NO: 112406

SEQ ID NO: 545650 - RNA, 64 nt, Homo Sapiens; identical to SEQ ID NO: 112407

SEQ ID NO: 545651 - RNA, 64 nt, Homo Sapiens; identical to SEQ ID NO: 112408

SEQ ID NO: 545652 - RNA, 64 nt, Homo Sapiens; identical to SEQ ID NO: 112409

SEQ ID NO: 545653 - RNA, 64 nt, Homo Sapiens; identical to SEQ ID NO: 112410

SEQ ID NO: 545654 - RNA, 64 nt, Homo Sapiens; identical to SEQ ID NO: 112411

SEQ ID NO: 545655 - RNA, 64 nt, Homo Sapiens; identical to SEQ ID NO: 112412

SEQ ID NO: 545656 - RNA, 64 nt, Homo Sapiens; identical to SEQ ID NO: 112413

SEQ ID NO: 545657 - RNA, 64 nt, Homo Sapiens; identical to SEQ ID NO: 112414

SEQ ID NO: 545658 - RNA, 64 nt, Homo Sapiens; identical to SEQ ID NO: 112415

SEQ ID NO: 545659 - RNA, 64 nt, Homo Sapiens; identical to SEQ ID NO: 112416

SEQ ID NO: 545660 - RNA, 64 nt, Homo Sapiens; identical to SEQ ID NO: 112417

SEQ ID NO: 545661 - RNA, 64 nt, Homo Sapiens; identical to SEQ ID NO: 112418

SEQ ID NO: 545662 - RNA, 64 nt, Homo Sapiens; identical to SEQ ID NO: 112419

SEQ ID NO: 545663 - RNA, 64 nt, Homo Sapiens; identical to SEQ ID NO: 112420

SEQ ID NO: 545664 - RNA, 64 nt, Homo Sapiens; identical to SEQ ID NO: 112421

SEQ ID NO: 545665 - RNA, 64 nt, Homo Sapiens; identical to SEQ ID NO: 112422

SEQ ID NO: 545666 - RNA, 64 nt, Homo Sapiens; identical to SEQ ID NO: 112423

SEQ ID NO: 545667 - RNA, 64 nt, Homo Sapiens; identical to SEQ ID NO: 112424

SEQ ID NO: 545668 - RNA, 64 nt, Homo Sapiens; identical to SEQ ID NO: 112425

SEQ ID NO: 545669 - RNA, 64 nt, Homo Sapiens; identical to SEQ ID NO: 112426

SEQ ID NO: 545670 - RNA, 64 nt, Homo Sapiens; identical to SEQ ID NO: 112427

SEQ ID NO: 545671 - RNA, 64 nt, Homo Sapiens; identical to SEQ ID NO: 112428

SEQ ID NO: 545672 - RNA, 64 nt, Homo Sapiens; identical to SEQ ID NO: 112429

SEQ ID NO: 545673 - RNA, 64 nt, Homo Sapiens; identical to SEQ ID NO: 112430

SEQ ID NO: 545674 - RNA, 64 nt, Homo Sapiens; identical to SEQ ID NO: 112431

SEQ ID NO: 545675 - RNA, 64 nt, Homo Sapiens; identical to SEQ ID NO: 112432

SEQ ID NO: 545676 - RNA, 64 nt, Homo Sapiens; identical to SEQ ID NO: 112433

SEQ ID NO: 545677 - RNA, 64 nt, Homo Sapiens; identical to SEQ ID NO: 112434

SEQ ID NO: 545678 - RNA, 64 nt, Homo Sapiens; identical to SEQ ID NO: 112435

SEQ ID NO: 545679 - RNA, 64 nt, Homo Sapiens; identical to SEQ ID NO: 112293

SEQ ID NO: 545680 - RNA, 64 nt, Homo Sapiens; identical to SEQ ID NO: 112294

SEQ ID NO: 545681 - RNA, 64 nt, Homo Sapiens; identical to SEQ ID NO: 112438

SEQ ID NO: 545682 - RNA, 64 nt, Homo Sapiens; identical to SEQ ID NO: 112439

SEQ ID NO: 545683 - RNA, 64 nt, Homo Sapiens; identical to SEQ ID NO: 112440

SEQ ID NO: 545684 - RNA, 64 nt, Homo Sapiens; identical to SEQ ID NO: 112441

SEQ ID NO: 545685 - RNA, 64 nt, Homo Sapiens; identical to SEQ ID NO: 112442

SEQ ID NO: 545686 - RNA, 64 nt, Homo Sapiens; identical to SEQ ID NO: 112443

SEQ ID NO: 545687 - RNA, 64 nt, Homo Sapiens; identical to SEQ ID NO: 112444

SEQ ID NO: 545688 - RNA, 64 nt, Homo Sapiens; identical to SEQ ID NO: 112445

SEQ ID NO: 545689 - RNA, 64 nt, Homo Sapiens; identical to SEQ ID NO: 112446

SEQ ID NO: 545690 - RNA, 64 nt, Homo Sapiens; identical to SEQ ID NO: 112447

SEQ ID NO: 545691 - RNA, 64 nt, Homo Sapiens; identical to SEQ ID NO: 112448

SEQ ID NO: 545692 - RNA, 64 nt, Homo Sapiens; identical to SEQ ID NO: 112449

SEQ ID NO: 545693 - RNA, 64 nt, Homo Sapiens; identical to SEQ ID NO: 112450

SEQ ID NO: 545694 - RNA, 64 nt, Homo Sapiens; identical to SEQ ID NO: 112451

SEQ ID NO: 545695 - RNA, 64 nt, Homo Sapiens; identical to SEQ ID NO: 112452

SEQ ID NO: 545696 - RNA, 64 nt, Homo Sapiens; identical to SEQ ID NO: 112453

SEQ ID NO: 545697 - RNA, 64 nt, Homo Sapiens; identical to SEQ ID NO: 112454

SEQ ID NO: 545698 - RNA, 64 nt, Homo Sapiens; identical to SEQ ID NO: 112455

SEQ ID NO: 545699 - RNA, 64 nt, Homo Sapiens; identical to SEQ ID NO: 112456

SEQ ID NO: 545700 - RNA, 64 nt, Homo Sapiens; identical to SEQ ID NO: 112457

SEQ ID NO: 545701 - RNA, 64 nt, Homo Sapiens; identical to SEQ ID NO: 112458

SEQ ID NO: 545702 - RNA, 64 nt, Homo Sapiens; identical to SEQ ID NO: 112459

SEQ ID NO: 545703 - RNA, 64 nt, Homo Sapiens; identical to SEQ ID NO: 112460

SEQ ID NO: 545704 - RNA, 64 nt, Homo Sapiens; identical to SEQ ID NO: 112461

SEQ ID NO: 545705 - RNA, 64 nt, Homo Sapiens; identical to SEQ ID NO: 112462

SEQ ID NO: 545706 - RNA, 64 nt, Homo Sapiens; identical to SEQ ID NO: 112463

SEQ ID NO: 545707 - RNA, 64 nt, Homo Sapiens; identical to SEQ ID NO: 112464

SEQ ID NO: 545708 - RNA, 64 nt, Homo Sapiens; identical to SEQ ID NO: 112465

SEQ ID NO: 545709 - RNA, 64 nt, Homo Sapiens; identical to SEQ ID NO: 112466

SEQ ID NO: 545710 - RNA, 64 nt, Homo Sapiens; identical to SEQ ID NO: 112467

SEQ ID NO: 545711 - RNA, 64 nt, Homo Sapiens; identical to SEQ ID NO: 112468

SEQ ID NO: 545712 - RNA, 64 nt, Homo Sapiens; identical to SEQ ID NO: 112469

SEQ ID NO: 545713 - RNA, 64 nt, Homo Sapiens; identical to SEQ ID NO: 112470

SEQ ID NO: 545714 - RNA, 64 nt, Homo Sapiens; identical to SEQ ID NO: 112471

SEQ ID NO: 545715 - RNA, 64 nt, Homo Sapiens; identical to SEQ ID NO: 112472

SEQ ID NO: 545716 - RNA, 64 nt, Homo Sapiens; identical to SEQ ID NO: 112473

SEQ ID NO: 545717 - RNA, 64 nt, Homo Sapiens; identical to SEQ ID NO: 112474

SEQ ID NO: 545718 - RNA, 64 nt, Homo Sapiens; identical to SEQ ID NO: 112475

SEQ ID NO: 545719 - RNA, 64 nt, Homo Sapiens; identical to SEQ ID NO: 112476

SEQ ID NO: 545720 - RNA, 64 nt, Homo Sapiens; identical to SEQ ID NO: 112477

SEQ ID NO: 545721 - RNA, 64 nt, Homo Sapiens; identical to SEQ ID NO: 112478

SEQ ID NO: 545722 - RNA, 64 nt, Homo Sapiens; identical to SEQ ID NO: 112479

SEQ ID NO: 545723 - RNA, 64 nt, Homo Sapiens; identical to SEQ ID NO: 112480

SEQ ID NO: 545724 - RNA, 64 nt, Homo Sapiens; identical to SEQ ID NO: 112481

SEQ ID NO: 545725 - RNA, 64 nt, Homo Sapiens; identical to SEQ ID NO: 112482

SEQ ID NO: 545726 - RNA, 64 nt, Homo Sapiens; identical to SEQ ID NO: 112483

SEQ ID NO: 545727 - RNA, 64 nt, Homo Sapiens; identical to SEQ ID NO: 112484

SEQ ID NO: 545728 - RNA, 64 nt, Homo Sapiens; identical to SEQ ID NO: 112485

SEQ ID NO: 545729 - RNA, 64 nt, Homo Sapiens; identical to SEQ ID NO: 112486

SEQ ID NO: 545730 - RNA, 64 nt, Homo Sapiens; identical to SEQ ID NO: 112487

SEQ ID NO: 545731 - RNA, 64 nt, Homo Sapiens; identical to SEQ ID NO: 112488

SEQ ID NO: 545732 - RNA, 64 nt, Homo Sapiens; identical to SEQ ID NO: 112489

SEQ ID NO: 545733 - RNA, 64 nt, Homo Sapiens; identical to SEQ ID NO: 112490

SEQ ID NO: 545734 - RNA, 64 nt, Homo Sapiens; identical to SEQ ID NO: 112491

SEQ ID NO: 545735 - RNA, 64 nt, Homo Sapiens; identical to SEQ ID NO: 112492

SEQ ID NO: 545736 - RNA, 64 nt, Homo Sapiens; identical to SEQ ID NO: 112493

SEQ ID NO: 545737 - RNA, 64 nt, Homo Sapiens; identical to SEQ ID NO: 112494

SEQ ID NO: 545738 - RNA, 64 nt, Homo Sapiens; identical to SEQ ID NO: 112495

SEQ ID NO: 545739 - RNA, 64 nt, Homo Sapiens; identical to SEQ ID NO: 112496

SEQ ID NO: 545740 - RNA, 64 nt, Homo Sapiens; identical to SEQ ID NO: 112497

SEQ ID NO: 545741 - RNA, 64 nt, Homo Sapiens; identical to SEQ ID NO: 112498

SEQ ID NO: 545742 - RNA, 64 nt, Homo Sapiens; identical to SEQ ID NO: 112499

SEQ ID NO: 545743 - RNA, 64 nt, Homo Sapiens; identical to SEQ ID NO: 112500

SEQ ID NO: 545744 - RNA, 64 nt, Homo Sapiens; identical to SEQ ID NO: 112501

SEQ ID NO: 545745 - RNA, 64 nt, Homo Sapiens; identical to SEQ ID NO: 112502

SEQ ID NO: 545746 - RNA, 64 nt, Homo Sapiens; identical to SEQ ID NO: 112503

SEQ ID NO: 545747 - RNA, 64 nt, Homo Sapiens; identical to SEQ ID NO: 112504

SEQ ID NO: 545748 - RNA, 64 nt, Homo Sapiens; identical to SEQ ID NO: 112505

SEQ ID NO: 545749 - RNA, 64 nt, Homo Sapiens; identical to SEQ ID NO: 112506

SEQ ID NO: 545750 - RNA, 64 nt, Homo Sapiens; identical to SEQ ID NO: 112507

SEQ ID NO: 545751 - RNA, 64 nt, Homo Sapiens; identical to SEQ ID NO: 112508

SEQ ID NO: 545752 - RNA, 64 nt, Homo Sapiens; identical to SEQ ID NO: 112509

SEQ ID NO: 545753 - RNA, 64 nt, Homo Sapiens; identical to SEQ ID NO: 112510

SEQ ID NO: 545754 - RNA, 64 nt, Homo Sapiens; identical to SEQ ID NO: 112511

SEQ ID NO: 545755 - RNA, 64 nt, Homo Sapiens; identical to SEQ ID NO: 112512

SEQ ID NO: 545756 - RNA, 64 nt, Homo Sapiens; identical to SEQ ID NO: 112513

SEQ ID NO: 545757 - RNA, 64 nt, Homo Sapiens; identical to SEQ ID NO: 112514

SEQ ID NO: 545758 - RNA, 64 nt, Homo Sapiens; identical to SEQ ID NO: 112515

SEQ ID NO: 545759 - RNA, 64 nt, Homo Sapiens; identical to SEQ ID NO: 112516

SEQ ID NO: 545760 - RNA, 64 nt, Homo Sapiens; identical to SEQ ID NO: 112517

SEQ ID NO: 545761 - RNA, 64 nt, Homo Sapiens; identical to SEQ ID NO: 112518

SEQ ID NO: 545762 - RNA, 64 nt, Homo Sapiens; identical to SEQ ID NO: 112519

SEQ ID NO: 545763 - RNA, 64 nt, Homo Sapiens; identical to SEQ ID NO: 112520

SEQ ID NO: 545764 - RNA, 64 nt, Homo Sapiens; identical to SEQ ID NO: 112521

SEQ ID NO: 545765 - RNA, 64 nt, Homo Sapiens; identical to SEQ ID NO: 112522

SEQ ID NO: 545766 - RNA, 64 nt, Homo Sapiens; identical to SEQ ID NO: 112523

SEQ ID NO: 545767 - RNA, 64 nt, Homo Sapiens; identical to SEQ ID NO: 112524

SEQ ID NO: 545768 - RNA, 64 nt, Homo Sapiens; identical to SEQ ID NO: 112525

SEQ ID NO: 545769 - RNA, 64 nt, Homo Sapiens; identical to SEQ ID NO: 112526

SEQ ID NO: 545770 - RNA, 64 nt, Homo Sapiens; identical to SEQ ID NO: 112527

SEQ ID NO: 545771 - RNA, 64 nt, Homo Sapiens; identical to SEQ ID NO: 112528

SEQ ID NO: 545772 - RNA, 64 nt, Homo Sapiens; identical to SEQ ID NO: 112529

SEQ ID NO: 545773 - RNA, 64 nt, Homo Sapiens; identical to SEQ ID NO: 112530

SEQ ID NO: 545774 - RNA, 64 nt, Homo Sapiens; identical to SEQ ID NO: 112531

SEQ ID NO: 545775 - RNA, 64 nt, Homo Sapiens; identical to SEQ ID NO: 112532

SEQ ID NO: 545776 - RNA, 64 nt, Homo Sapiens; identical to SEQ ID NO: 112533

SEQ ID NO: 545777 - RNA, 64 nt, Homo Sapiens; identical to SEQ ID NO: 112534

SEQ ID NO: 545778 - RNA, 64 nt, Homo Sapiens; identical to SEQ ID NO: 112535

SEQ ID NO: 545779 - RNA, 64 nt, Homo Sapiens; identical to SEQ ID NO: 112536

SEQ ID NO: 545780 - RNA, 64 nt, Homo Sapiens; identical to SEQ ID NO: 112537

SEQ ID NO: 545781 - RNA, 64 nt, Homo Sapiens; identical to SEQ ID NO: 112538

SEQ ID NO: 545782 - RNA, 64 nt, Homo Sapiens; identical to SEQ ID NO: 112539

SEQ ID NO: 545783 - RNA, 64 nt, Homo Sapiens; identical to SEQ ID NO: 112540

SEQ ID NO: 545784 - RNA, 64 nt, Homo Sapiens; identical to SEQ ID NO: 112541

SEQ ID NO: 545785 - RNA, 64 nt, Homo Sapiens; identical to SEQ ID NO: 112542

SEQ ID NO: 545786 - RNA, 64 nt, Homo Sapiens; identical to SEQ ID NO: 112543

SEQ ID NO: 545787 - RNA, 64 nt, Homo Sapiens; identical to SEQ ID NO: 112544

SEQ ID NO: 545788 - RNA, 64 nt, Homo Sapiens; identical to SEQ ID NO: 112545

SEQ ID NO: 545789 - RNA, 64 nt, Homo Sapiens; identical to SEQ ID NO: 112546

SEQ ID NO: 545790 - RNA, 64 nt, Homo Sapiens; identical to SEQ ID NO: 112547

SEQ ID NO: 545791 - RNA, 64 nt, Homo Sapiens; identical to SEQ ID NO: 112548

SEQ ID NO: 545792 - RNA, 64 nt, Homo Sapiens; identical to SEQ ID NO: 112549

SEQ ID NO: 545793 - RNA, 64 nt, Homo Sapiens; identical to SEQ ID NO: 112550

SEQ ID NO: 545794 - RNA, 64 nt, Homo Sapiens; identical to SEQ ID NO: 112551

SEQ ID NO: 545795 - RNA, 64 nt, Homo Sapiens; identical to SEQ ID NO: 112552

SEQ ID NO: 545796 - RNA, 64 nt, Homo Sapiens; identical to SEQ ID NO: 112553

SEQ ID NO: 545797 - RNA, 64 nt, Homo Sapiens; identical to SEQ ID NO: 112554

SEQ ID NO: 545798 - RNA, 64 nt, Homo Sapiens; identical to SEQ ID NO: 112555

SEQ ID NO: 545799 - RNA, 64 nt, Homo Sapiens; identical to SEQ ID NO: 112556

SEQ ID NO: 545800 - RNA, 64 nt, Homo Sapiens; identical to SEQ ID NO: 112557

SEQ ID NO: 545801 - RNA, 64 nt, Homo Sapiens; identical to SEQ ID NO: 112558

SEQ ID NO: 545802 - RNA, 64 nt, Homo Sapiens; identical to SEQ ID NO: 112559

SEQ ID NO: 545803 - RNA, 64 nt, Homo Sapiens; identical to SEQ ID NO: 112560

SEQ ID NO: 545804 - RNA, 64 nt, Homo Sapiens; identical to SEQ ID NO: 112561

SEQ ID NO: 545805 - RNA, 64 nt, Homo Sapiens; identical to SEQ ID NO: 112540

SEQ ID NO: 545806 - RNA, 64 nt, Homo Sapiens; identical to SEQ ID NO: 112563

SEQ ID NO: 545807 - RNA, 64 nt, Homo Sapiens; identical to SEQ ID NO: 112564

SEQ ID NO: 545808 - RNA, 64 nt, Homo Sapiens; identical to SEQ ID NO: 112565

SEQ ID NO: 545809 - RNA, 64 nt, Homo Sapiens
aucuguuuaguauuugugcauuuuacuaaaauggcagcuuaaaguuguguaucugcuauuguga

SEQ ID NO: 545810 - RNA, 64 nt, Homo Sapiens
gaaaaguaaagaaaaacccuuuuuauggcucacacagcuuaagaguagcugucucucaaacgug

SEQ ID NO: 545811 - RNA, 64 nt, Homo Sapiens
aaauuauuuuuuaaaagucuuucucucucugauucagcuuaaauuuuuuuaucgaaaaagccau

SEQ ID NO: 545812 - RNA, 64 nt, Homo Sapiens
agcuggccugggucacagugaccugaccucaaaccagcuuaaggcuuuaaguccucucucagaa

SEQ ID NO: 545813 - RNA, 64 nt, Homo Sapiens
guuucaucauuuuaguuacacuaaacacuuuuggcagcuuaauaugaccuuuuuaaauuuuuuu

SEQ ID NO: 545814 - RNA, 64 nt, Homo Sapiens
cuuggauguggagguuuuacuuuuuaaaaacauucagcuuaauuaccuuaccuuaauuaccuua

SEQ ID NO: 545815 - RNA, 64 nt, Homo Sapiens
ggacaauguuuuguauauagucuugaaaggcaggcagcuuaaguuugcaugggaggagaguuac

SEQ ID NO: 545816 - RNA, 64 nt, Homo Sapiens
ucuucaggauguaaaacucuacuugaaaauagaccagcuuaauguauagggccaugcauuggua

SEQ ID NO: 545817 - RNA, 64 nt, Homo Sapiens
gcacucccuuuucaccaucugucaccuucccuugcagcuuaaggagcccaguaaguuuugaaaa

SEQ ID NO: 545818 - RNA, 64 nt, Homo Sapiens
ugucuaacuaaaaguuucugacuuuuaguaaauucagcuuaaauauaaguugaaauuugggaaa

SEQ ID NO: 545819 - RNA, 64 nt, Homo Sapiens; identical to SEQ ID NO: 104916

SEQ ID NO: 545820 - RNA, 64 nt, Homo Sapiens; identical to SEQ ID NO: 104917

SEQ ID NO: 545821 - RNA, 64 nt, Homo Sapiens; identical to SEQ ID NO: 104918

SEQ ID NO: 545822 - RNA, 64 nt, Homo Sapiens; identical to SEQ ID NO: 104919

SEQ ID NO: 545823 - RNA, 64 nt, Homo Sapiens; identical to SEQ ID NO: 104920

SEQ ID NO: 545824 - RNA, 64 nt, Homo Sapiens; identical to SEQ ID NO: 104921

SEQ ID NO: 545825 - RNA, 64 nt, Homo Sapiens; identical to SEQ ID NO: 104922

SEQ ID NO: 545826 - RNA, 64 nt, Homo Sapiens; identical to SEQ ID NO: 104923

SEQ ID NO: 545827 - RNA, 64 nt, Homo Sapiens; identical to SEQ ID NO: 104924

SEQ ID NO: 545828 - RNA, 64 nt, Homo Sapiens; identical to SEQ ID NO: 104925

SEQ ID NO: 545829 - RNA, 64 nt, Homo Sapiens; identical to SEQ ID NO: 104926

SEQ ID NO: 545830 - RNA, 64 nt, Homo Sapiens; identical to SEQ ID NO: 104927

SEQ ID NO: 545831 - RNA, 64 nt, Homo Sapiens
guggaugaugugucaugaaugaggaggugugugagcagggaacucagugugacaccgccagguc

SEQ ID NO: 545832 - RNA, 64 nt, Homo Sapiens
ggugagaaagccccaucccgggggccguuggcaggcagggaagcaggaaccccaccgugugccc

SEQ ID NO: 545833 - RNA, 64 nt, Homo Sapiens
acuggaugggcugcagugaggugggggcgggugggcagggaaugggagaggggaagucuuggca

SEQ ID NO: 545834 - RNA, 64 nt, Homo Sapiens
cgggugggcagggaaugggagaggggaagucuuggcagggaaaucccuuuuggccacacaguuu

SEQ ID NO: 545835 - RNA, 64 nt, Homo Sapiens
gggcaguaccugggaaaggauggcugaguggaaugcagggaagaggcacagacuucuggaaggc

SEQ ID NO: 545836 - RNA, 64 nt, Homo Sapiens
cuccacggugcguggcugugcccggggcuggcaagcagggaaaguccccugaaaacgaaggggc

SEQ ID NO: 545837 - RNA, 64 nt, Homo Sapiens
auggucgugagugcaggugucccuguuguaauuugcagggaaauugacugcaggugauaguguu

SEQ ID NO: 545838 - RNA, 64 nt, Homo Sapiens
uccggacagaggugggcaggguggauggcuucgggcagggaaggcggguagaggcugcaugugg

SEQ ID NO: 545839 - RNA, 64 nt, Homo Sapiens
auaauaaaaaaaaaagaaaaggaaaaugcuauuggcagggaauaagaauuuaaauguguuagau

SEQ ID NO: 545840 - RNA, 64 nt, Homo Sapiens
cgggugggaccagugugucuuacugggugguucagcagggaagcuugguacagguguuauucag

SEQ ID NO: 545841 - RNA, 64 nt, Homo Sapiens
gguucuugggagggaaugggacagggugaauaaagcagggaauauuuuagaaccacaagagauc

SEQ ID NO: 545842 - RNA, 64 nt, Homo Sapiens
cuucauacccucuaccuggauggauggucuuugggcagggaauuaaugacagaaugagcagucc

SEQ ID NO: 545843 - RNA, 64 nt, Homo Sapiens
caucucaaccauccccuccguggcaucaccuuaggcagggaaguguaagaaacacacugaggca

SEQ ID NO: 545844 - RNA, 64 nt, Homo Sapiens
accuuaggcagggaaguguaagaaacacacugaggcagggaaguccccaggccccaggaagccg

SEQ ID NO: 545845 - RNA, 64 nt, Homo Sapiens
ggggaaguguuccagauagccuagaggacuucuggcagggaaguacaagauccuuaaugcagag

SEQ ID NO: 545846 - RNA, 64 nt, Homo Sapiens
cccacuugaaggaagaagucgaccaguccuguuugcagggaagcgggcucugggagacuuugaa

SEQ ID NO: 545847 - RNA, 64 nt, Homo Sapiens
gaccaggauucugugaguucugcagggaaaggaggcagggaaaaucugcccgacucacucacag

SEQ ID NO: 545848 - RNA, 64 nt, Homo Sapiens
gaggcagggaaaagaccagggacucacucacagugcagggaaaggggagcagcuccuucugccc

SEQ ID NO: 545849 - RNA, 64 nt, Homo Sapiens
agaggagggauggagaagcuuaauugcauuucuggcagggaaggcugagucugggccacuugcu

SEQ ID NO: 545850 - RNA, 64 nt, Homo Sapiens
ugcguggugcugggauguggagaugagagacagggcagggaaucccuugcuuagcgcccaaggu

SEQ ID NO: 545851 - RNA, 64 nt, Homo Sapiens
cagcaggucccacagccgacagugcccagagcaugcagggaacccucgugcagcugagcugggg

SEQ ID NO: 545852 - RNA, 64 nt, Homo Sapiens
cuuccccgagggugcauguugcaggagggagagggcagggaagacucacagcagagcaggaggg

SEQ ID NO: 545853 - RNA, 64 nt, Homo Sapiens
guacaguggggucaccuguuguuucuauacaacagcagggaaggggccauggagcuuuucccug

SEQ ID NO: 545854 - RNA, 64 nt, Homo Sapiens
cagggguccugaccuaccucagguggaacggugagcagggaacaugucggaguccuucagagaa

SEQ ID NO: 545855 - RNA, 64 nt, Homo Sapiens
acugggcgaggucagauuagacaggcuugggacagcagggaaacaucaaccgacgugucacaga

SEQ ID NO: 545856 - RNA, 64 nt, Homo Sapiens
guagcaggagaaaugaaggaagaugaaaaagcaggcagggaaggggguaguaaaggacugagag

SEQ ID NO: 545857 - RNA, 64 nt, Homo Sapiens
gcacgagcuagugaguggcacaccagagccaucugcagggaagggcguggcggggaaauggcug

SEQ ID NO: 545858 - RNA, 64 nt, Homo Sapiens
ggacucaucugucagagugcacaugaaaaaucaggcagggaaucgaaacgacagugcuggagga

SEQ ID NO: 545859 - RNA, 64 nt, Homo Sapiens
cagcuguccccugagugcuugaacuuugcuuuuagcagggaaaguuuuugcugcuuuugcucug

SEQ ID NO: 545860 - RNA, 64 nt, Homo Sapiens
cacauaccaccaaguucaaucuauggccuuauaugcagggaaggcuagcgcucccaaaaaagca

SEQ ID NO: 545861 - RNA, 64 nt, Homo Sapiens
cgaucucuuccuuugugcuggucugggcucccaggcagggaacccccaucccacucccacccau

SEQ ID NO: 545862 - RNA, 64 nt, Homo Sapiens
uccuccuguggcccggacaccaugcuccgacacagcagggaagcaacccugccccugcacccag

SEQ ID NO: 545863 - RNA, 64 nt, Homo Sapiens
ucuauugcuucuuucucccuugagucccuugaaggcagggaauagacuucuagaaaaccugaga

SEQ ID NO: 545864 - RNA, 64 nt, Homo Sapiens
aacaaauuaagaugaugcugccaaaacaagucuagcagggaaaacagguucuacauuuuucuua

SEQ ID NO: 545865 - RNA, 64 nt, Homo Sapiens
gaagccggcuggggugguggacaugugggaauuacagauaaacguguuuuccucacuacauugu

SEQ ID NO: 545866 - RNA, 64 nt, Homo Sapiens
caucagucccaguaaaugaagggcugcaauuaggcagauaaagaguccuaggcuggacagcaau

SEQ ID NO: 545867 - RNA, 64 nt, Homo Sapiens
acauucuuuuaauucugggauuuccaugguaauacagauaaaauaaauccaguguuacuaguaa

SEQ ID NO: 545868 - RNA, 64 nt, Homo Sapiens
uuuccagggugcacuuccagauugacaaggaacucagauaaaaaauugcaugcaauuguguagg

SEQ ID NO: 545869 - RNA, 64 nt, Homo Sapiens
aacuuuaugcuaagugaaauaagccagacaucaacagauaaauaguuuaugauuccaccuacau

SEQ ID NO: 545870 - RNA, 64 nt, Homo Sapiens
caggguuuauguuuaggauguugaaaaaguucugcagauaaacaguagugauaguuguaccgca

SEQ ID NO: 545871 - RNA, 64 nt, Homo Sapiens
uguuaguugauuuaaauccuuucugaauaaagaucagauaaacaguaacugaaggagcauguau

SEQ ID NO: 545872 - RNA, 64 nt, Homo Sapiens
aaggauauaaacuuuccacaccuuccugucgugacagauaaaagcacagaaaggacaacccuug

SEQ ID NO: 545873 - RNA, 64 nt, Homo Sapiens
aagucguauuauucacuuguaaaaaugauuguaacagauaaaaaauguaucugcagcaacucug

SEQ ID NO: 545874 - RNA, 64 nt, Homo Sapiens
aucuacaugauuuucaaguuguaaugcagauggacagauaaaaaagauuuuacguuugucuuuu

SEQ ID NO: 545875 - RNA, 64 nt, Homo Sapiens
guuuucucucuuuuugugguauuagcagcugcugcagauaaaugcauuaauucaugaugcuucu

SEQ ID NO: 545876 - RNA, 64 nt, Homo Sapiens
acaauaauuggaguaguuuaaucuuauucaugugcagauaaaagagguuuaugaaguuuagggu

SEQ ID NO: 545877 - RNA, 64 nt, Homo Sapiens
gugaaaaacaaaaaguagauguacuucuguaaaucagauaaaugcuuggaauuugauugucuac

SEQ ID NO: 545878 - RNA, 64 nt, Homo Sapiens
uugugugguguuuuggauuuuaacaagaugagaacagauaaagauaugacaaauguuucuaagg

SEQ ID NO: 545879 - RNA, 64 nt, Homo Sapiens
auucaaaaagucacaguuaaauauuucagaaauacagauaaaugaguagagguauaauugugug

SEQ ID NO: 545880 - RNA, 64 nt, Homo Sapiens; identical to SEQ ID NO: 300694

SEQ ID NO: 545881 - RNA, 64 nt, Homo Sapiens; identical to SEQ ID NO: 300695

SEQ ID NO: 545882 - RNA, 64 nt, Homo Sapiens; identical to SEQ ID NO: 300696

SEQ ID NO: 545883 - RNA, 64 nt, Homo Sapiens; identical to SEQ ID NO: 300697

SEQ ID NO: 545884 - RNA, 64 nt, Homo Sapiens; identical to SEQ ID NO: 300698

SEQ ID NO: 545885 - RNA, 64 nt, Homo Sapiens; identical to SEQ ID NO: 300699

SEQ ID NO: 545886 - RNA, 64 nt, Homo Sapiens; identical to SEQ ID NO: 300700

SEQ ID NO: 545887 - RNA, 64 nt, Homo Sapiens; identical to SEQ ID NO: 300701

SEQ ID NO: 545888 - RNA, 64 nt, Homo Sapiens; identical to SEQ ID NO: 91418

SEQ ID NO: 545889 - RNA, 64 nt, Homo Sapiens; identical to SEQ ID NO: 91419

SEQ ID NO: 545890 - RNA, 56 nt, Homo Sapiens; identical to SEQ ID NO: 91420

SEQ ID NO: 545891 - RNA, 64 nt, Homo Sapiens; identical to SEQ ID NO: 91421

SEQ ID NO: 545892 - RNA, 64 nt, Homo Sapiens; identical to SEQ ID NO: 91422

SEQ ID NO: 545893 - RNA, 64 nt, Homo Sapiens; identical to SEQ ID NO: 91423

SEQ ID NO: 545894 - RNA, 64 nt, Homo Sapiens; identical to SEQ ID NO: 91424

SEQ ID NO: 545895 - RNA, 64 nt, Homo Sapiens; identical to SEQ ID NO: 91425

SEQ ID NO: 545896 - RNA, 64 nt, Homo Sapiens; identical to SEQ ID NO: 91426

SEQ ID NO: 545897 - RNA, 64 nt, Homo Sapiens; identical to SEQ ID NO: 91427

SEQ ID NO: 545898 - RNA, 64 nt, Homo Sapiens; identical to SEQ ID NO: 91428

SEQ ID NO: 545899 - RNA, 64 nt, Homo Sapiens; identical to SEQ ID NO: 91429

SEQ ID NO: 545900 - RNA, 64 nt, Homo Sapiens; identical to SEQ ID NO: 91430

SEQ ID NO: 545901 - RNA, 64 nt, Homo Sapiens; identical to SEQ ID NO: 91431

SEQ ID NO: 545902 - RNA, 64 nt, Homo Sapiens; identical to SEQ ID NO: 91432

SEQ ID NO: 545903 - RNA, 64 nt, Homo Sapiens; identical to SEQ ID NO: 91433

SEQ ID NO: 545904 - RNA, 64 nt, Homo Sapiens; identical to SEQ ID NO: 91434

SEQ ID NO: 545905 - RNA, 64 nt, Homo Sapiens; identical to SEQ ID NO: 91435

SEQ ID NO: 545906 - RNA, 64 nt, Homo Sapiens; identical to SEQ ID NO: 91436

SEQ ID NO: 545907 - RNA, 64 nt, Homo Sapiens
uggauccaggggaccugggcgagagaguggucuccgcucugaaucagccugggacaccuaggug

SEQ ID NO: 545908 - RNA, 64 nt, Homo Sapiens
uccugcuucaugcuucuucuagcuugcugugcugcgcucugagcccucuuugucccuacaggcc

SEQ ID NO: 545909 - RNA, 64 nt, Homo Sapiens
gacccacuuucagcuggacagagaaucccccacacgcucugaaggcuagcccaucaagccggca

SEQ ID NO: 545910 - RNA, 64 nt, Homo Sapiens
agcuauuaagcacuugcagccuucggaggcucugcgcucugauccgcuguuugagcccaacacu

SEQ ID NO: 545911 - RNA, 64 nt, Homo Sapiens
cucgaugucagcuuuuugugcuggacuuggcacacgcucugaaaacugagauuuugucauugaa

SEQ ID NO: 545912 - RNA, 64 nt, Homo Sapiens
gcagacccccaacccugguuucugugccauguugcgcucugaccgucucuguugcuucucuucu

SEQ ID NO: 545913 - RNA, 64 nt, Homo Sapiens
uaguacucccaugauggcuucagcuaguuacauacgcucugacaggcaacggggaaagaccuga

SEQ ID NO: 545914 - RNA, 64 nt, Homo Sapiens
agugcuuaagaaaaucuucucuggggcucggccucgcucugaaacucaaugacugggacuuaga

SEQ ID NO: 545915 - RNA, 64 nt, Homo Sapiens
cuucuuucuccucgcccgcucgaggcuucccgggcgcucugaggauggaagccucccaggcgcg

SEQ ID NO: 545916 - RNA, 64 nt, Homo Sapiens
uucucuucauguguguaaaucgcugccugcagugcgcucugaccugaaguucuucccagagccg

SEQ ID NO: 545917 - RNA, 64 nt, Homo Sapiens
aacuaacugggagaccuuaggcaaagcaugcaaucgcucugaauggcaguuuccucauuuuuaa

SEQ ID NO: 545918 - RNA, 64 nt, Homo Sapiens
aggaagauggagaaugaggaacugaagaaacugccgcucugagacugcacauccaggaaaaaag

SEQ ID NO: 545919 - RNA, 64 nt, Homo Sapiens
acuccuugcauuuggaaucaagccguccgcgcuccgcucugaggcagacccaggacuccggaaa

SEQ ID NO: 545920 - RNA, 64 nt, Homo Sapiens
cucuuuucagugcacuggguggucaaugcccacucgcucugaaaucaucugacugugaugcccu

SEQ ID NO: 545921 - RNA, 64 nt, Homo Sapiens
caugggucaggccauguauuaacagaugccagugcgcucugacaaguauuccaaaguguucugu

SEQ ID NO: 545922 - RNA, 64 nt, Homo Sapiens
caacccccucggagccugugcgagaucuuccuuccgcucugaggagacuccuucuccccaauca

SEQ ID NO: 545923 - RNA, 64 nt, Homo Sapiens
agaggcuuuuccaccuccagaccagacccacccacgcucugacggccugagcagggggccugcc

SEQ ID NO: 545924 - RNA, 64 nt, Homo Sapiens
ucaggcacugagccacugcgcccagccaacaauccgcucugaggaaagcguaagcaggaagacc

SEQ ID NO: 545925 - RNA, 64 nt, Homo Sapiens
ugucccuaguucgggaggcggaaaaagaugagcgcgcucugaagcaggagauucacgagcugcg

SEQ ID NO: 545926 - RNA, 64 nt, Homo Sapiens
ggaauaugggaggauuaucuccuaucacagggagcgcucugagggcaaggcugugucuccgauu

SEQ ID NO: 545927 - RNA, 64 nt, Homo Sapiens
gggcugcagccucagcaguguacagaguccccggcgcucugagguuggagagaaagaacagacc

SEQ ID NO: 545928 - RNA, 64 nt, Homo Sapiens
gguagaugugaguaaaaagaucgaaggaaauagccgcucugauagccugugugcuacugaacug

SEQ ID NO: 545929 - RNA, 64 nt, Homo Sapiens
uuccaacaucucucaaaauaaaaaucccucuucccgcucugagcgauucagcucugcccgcagc

SEQ ID NO: 545930 - RNA, 64 nt, Homo Sapiens
cucccacauuccuccccgcgggggaggaccucgccgcucugaagagcaccgugcacaugugggu

SEQ ID NO: 545931 - RNA, 64 nt, Homo Sapiens
ucauguuucuuagagaaauggguggucuuccauccgcucugaaaguccgcacguggcuggagga

SEQ ID NO: 545932 - RNA, 64 nt, Homo Sapiens
uguguaaacauagggugccucuaguuuauacuugcgcucugaaaacagggagcuauggugcacu

SEQ ID NO: 545933 - RNA, 64 nt, Homo Sapiens
auauguuccaugccuggcccgcccugacccccaucgcucugagccaucuugcucuguggccuug

SEQ ID NO: 545934 - RNA, 64 nt, Homo Sapiens
ugguggcaucuggcugugcauagucauaucaucgcgcucugauccuggaggcagccaaguaacg

SEQ ID NO: 545935 - RNA, 64 nt, Homo Sapiens
cucuaccgccaccuucuggcgcaacaagaaguugcgcucugacagggcucuagucagggccuug

SEQ ID NO: 545936 - RNA, 64 nt, Homo Sapiens
cuucagggccaccgcccgcuugucccccuggcugcgcucugagcggagugaggcuccccgccug

SEQ ID NO: 545937 - RNA, 64 nt, Homo Sapiens
cuugcuggcugaucaccuuguuaccaaucccguucgcucugacccuguuucacaugaggagaug

SEQ ID NO: 545938 - RNA, 64 nt, Homo Sapiens
aaacccagucucucaauaccagguuacuuaaguccgcucugaugugacaauucuaagaucaacc

SEQ ID NO: 545939 - RNA, 64 nt, Homo Sapiens
uguucuguuucguauugcuggcugaggagcugaccgcucugagcuggcggcccacgcagcuucu

SEQ ID NO: 545940 - RNA, 64 nt, Homo Sapiens
cagggccgaggugggcagucaagacuuggccuuccgcucugacggaggccgcagcaccuucugg

SEQ ID NO: 545941 - RNA, 64 nt, Homo Sapiens
gucaacagcagaacagaggcaggucaggguuguccgcucugauuagcagaacgacagccccuuc

SEQ ID NO: 545942 - RNA, 64 nt, Homo Sapiens
gauacacucccgaugccacauuuuuaacuccucucgcucugaugggacauuuguuacccuuuuu

SEQ ID NO: 545943 - RNA, 64 nt, Homo Sapiens
ggcgacuucucucccccguccccguggacguaagcgcucugagagggaacggggggggugucca

SEQ ID NO: 545944 - RNA, 62 nt, Homo Sapiens
cagaaauguuugaauuuuaaggguuucuaaaacgcucugacagaugcaaguggugguggaag

SEQ ID NO: 545945 - RNA, 64 nt, Homo Sapiens
gaaaugucagagcgaggguuguguggacaccccucgcucugaugccaacugcagauaauacaca

SEQ ID NO: 545946 - RNA, 64 nt, Homo Sapiens
ggaggcaccaggcaggcccuguaucaggcuaggacgcucugagcugugcauguacauauauaca

SEQ ID NO: 545947 - RNA, 64 nt, Homo Sapiens
aggcauggagauccugguugugccgucucagcuccgcucugaaggcacugugugggugcugcgu

SEQ ID NO: 545948 - RNA, 64 nt, Homo Sapiens
cucucugcagucuacaaaaugcccuccuguugcccgcucugaaugaaacaccuguggcuucuug

SEQ ID NO: 545949 - RNA, 64 nt, Homo Sapiens
caaacagaggcuggaacuuucaugcugugcuugccgcucugaaagcugaagacccccugacucc

SEQ ID NO: 545950 - RNA, 64 nt, Homo Sapiens
cucagcgccgacgagaccauagcauugaagcccacgcucugagucuugaaacugagccuuugca

SEQ ID NO: 545951 - RNA, 64 nt, Homo Sapiens
ugagcugcccuccgcucccuggguuugcuuccugcgcucugagauggggagaggucgcggcggc

SEQ ID NO: 545952 - RNA, 64 nt, Homo Sapiens
gccgggggugaguguggcucccaucugcugaccccgcucugaaaagaacauuuucgccugaugc

SEQ ID NO: 545953 - RNA, 64 nt, Homo Sapiens
cacaggcuggagugcagugguugagacggagucucgcucugacgccccccccccccuuuuuuuu

SEQ ID NO: 545954 - RNA, 64 nt, Homo Sapiens
ugccagccgacccuccuggccuuccucguugggccgcucugauuucaggcagcaggggcugcug

SEQ ID NO: 545955 - RNA, 64 nt, Homo Sapiens
ccccacagccuuucucccugcccaacugagcacccgcucugauuccuccucuucuccuucaaga

SEQ ID NO: 545956 - RNA, 64 nt, Homo Sapiens
uuaaagaguuuuaccucugagcaguugggaggggcgcucugagaagugagggguugggggaucg

SEQ ID NO: 545957 - RNA, 64 nt, Homo Sapiens
ccccuauaaaaaaugugcaugagaaugugaugaacgcucugaacaggcggauacagaaacuugu

SEQ ID NO: 545958 - RNA, 64 nt, Homo Sapiens
caccugccaugucccuccuuuccccagcuauccccgcucugaccuugauuuucauucuuauguu

SEQ ID NO: 545959 - RNA, 64 nt, Homo Sapiens
ugggauuguccccgcacuaguagagaauccaugucgcucugacaccccaaggaagccgacgauc

SEQ ID NO: 545960 - RNA, 64 nt, Homo Sapiens
agccuguguuguccccagcgacccugcagcugcucgcucugauguacccugugccauucaagga

SEQ ID NO: 545961 - RNA, 64 nt, Homo Sapiens
cugaaacccccacgccuccgcuucagcaucuccacgcucugaagcugucuuucaaaaugugugc

SEQ ID NO: 545962 - RNA, 64 nt, Homo Sapiens
ucuaggagcacaagagaggaacacgcuugcucggcgcucugacuagcaccccgccgcuuccccc

SEQ ID NO: 545963 - RNA, 64 nt, Homo Sapiens
accagagucuagcagugauaaaauguacaauuuacgcucugaauagaaacaugacaccaaagaa

SEQ ID NO: 545964 - RNA, 64 nt, Homo Sapiens; identical to SEQ ID NO: 165842

SEQ ID NO: 545965 - RNA, 64 nt, Homo Sapiens; identical to SEQ ID NO: 165843

SEQ ID NO: 545966 - RNA, 64 nt, Homo Sapiens
uuccuacauugaggagcugacauagggguaagguaugggagagguagguggauccagggaaaag

SEQ ID NO: 545967 - RNA, 64 nt, Homo Sapiens
agagagagaauaaggagccuuucuuauggaagaaaugggagaagagagacaggguucuuuucag

SEQ ID NO: 545968 - RNA, 64 nt, Homo Sapiens
aguucuuauuguuggccaugccuugcugugcaacaugggagagauggagagaagggcgugccac

SEQ ID NO: 545969 - RNA, 51 nt, Homo Sapiens
caaaucgucauccaagcauguaugggagaacaauaauuguuguuucaguga

SEQ ID NO: 545970 - RNA, 64 nt, Homo Sapiens
uuuugcucuaaucucucugccgaaagucaaagugaugggagaauugguauacugguaugacuac

SEQ ID NO: 545971 - RNA, 64 nt, Homo Sapiens
aauauauucugaccguuaaaaaauucuuguucauaugggagaagggggaguaaugacuuguaca

SEQ ID NO: 545972 - RNA, 64 nt, Homo Sapiens
gaaggcccagccccuucuagccaccuagccauccaugggagagaccuugacaucaccugagccc

SEQ ID NO: 545973 - RNA, 64 nt, Homo Sapiens
cagggaucagaggacgaacacugggacuccugagaugggagagggccccucccuuggucagacu

SEQ ID NO: 545974 - RNA, 64 nt, Homo Sapiens
ucugaagcccaugauguuuuagccugccugguuuaugggagaacacuuaaacaucuugcgaggc

SEQ ID NO: 545975 - RNA, 64 nt, Homo Sapiens
uuuggggcaggguauccaaguccuagugggaaugaugggagaagaaacaagccccguuggaacu

SEQ ID NO: 545976 - RNA, 64 nt, Homo Sapiens
agggcccucucaacgcuccauguugccuucaccaaugggagaaggaguggaucgguggugaacc

SEQ ID NO: 545977 - RNA, 64 nt, Homo Sapiens
ggcauuuggcaucugcugccagcaagcacagcacaugggagaagcuucauauuccuccaaccaa

SEQ ID NO: 545978 - RNA, 64 nt, Homo Sapiens
gccccugugaaagccugugaagagagguggugggaugggagagaccacuccccacuacccucgg

SEQ ID NO: 545979 - RNA, 64 nt, Homo Sapiens
guggauaagaggaugcugcuaccuuugagagagcaugggagaagccagggacuacauaacaggc

SEQ ID NO: 545980 - RNA, 64 nt, Homo Sapiens
ugucaccuaugaccacauugggcccaacgucugcaugggagaccacaaggugacauagacugag

SEQ ID NO: 545981 - RNA, 64 nt, Homo Sapiens
ggugccaaguauccuacguuacaacaauaauaucaugggagaaauagaaauagccuaguuugcu

SEQ ID NO: 545982 - RNA, 64 nt, Homo Sapiens
aaaagcaaacugcauuuuuaaaaaucuuucugagaugggagaaaauguauucuccuuuccuaua

SEQ ID NO: 545983 - RNA, 64 nt, Homo Sapiens
ugccuguuguaaugugcaggacccuucuccuuucaugggagagacagguaguuaccugaauaua

SEQ ID NO: 545984 - RNA, 64 nt, Homo Sapiens
ggaggacccagccaagcuagaaggaauuuuguggaugggagacagcaggauuagcuucagcuug

SEQ ID NO: 545985 - RNA, 64 nt, Homo Sapiens
ugcuaggacugagaggcugcaccauagggaauguaugggagauggugaggggugccagugaggg

SEQ ID NO: 545986 - RNA, 64 nt, Homo Sapiens
gauaccaaugauuuagauggauaccaaagauuagaugggagauauccugcacagccaaccugga

SEQ ID NO: 545987 - RNA, 64 nt, Homo Sapiens
cuccccugggccugaaaacuauugaaggaggagaaugggagagccacccuuccuggacgggacu

SEQ ID NO: 545988 - RNA, 64 nt, Homo Sapiens
cuuacaaagagacuuacacucccacacaauaauaaugggagacuuaaacaccccacugucaaca

SEQ ID NO: 545989 - RNA, 64 nt, Homo Sapiens
aaacuaccaucagagucaacaggcaaccuacaaaaugggagaaaauuuucgcaaccuacucauc

SEQ ID NO: 545990 - RNA, 64 nt, Homo Sapiens
auccagaccaucuuggggcaaagaaguuuuugggaugggagagaaagucuccuguucgcucaua

SEQ ID NO: 545991 - RNA, 64 nt, Homo Sapiens
gguagacacuacuuauuuguguauauguaucuacaugggagacauuuuuuuuaaagcaaauccu

SEQ ID NO: 545992 - RNA, 64 nt, Homo Sapiens
gggcucuucacugagccauaagggacagggagguaugggagagcgcugggggcccaucccccug

SEQ ID NO: 545993 - RNA, 64 nt, Homo Sapiens
agcacgaaagggggaaugccccucccaggaguuuaugggagaagggacugggccggcugccucc

SEQ ID NO: 545994 - RNA, 64 nt, Homo Sapiens
uuagacacuggagguuuuuauuacuuaagacuuuaugggagagaaaaauguaaaccuauuuuua

SEQ ID NO: 545995 - RNA, 64 nt, Homo Sapiens
aaaagcguaucugaaaauggguuagcagaugccuaugggagaggcugaugaaaaugugagcacu

SEQ ID NO: 545996 - RNA, 64 nt, Homo Sapiens
gcuguggucucugcccccuccuccagacuugcucaugggagaagguccaguggacaugccccac

SEQ ID NO: 545997 - RNA, 64 nt, Homo Sapiens
uuuccagcugacuagaacccugaggagcagguaaaugggagaggauccugccugccuucuccac

SEQ ID NO: 545998 - RNA, 64 nt, Homo Sapiens
gucuuccauggagccucagggaugcugcacugcacuacuccaauauugucugacccuagaggca

SEQ ID NO: 545999 - RNA, 64 nt, Homo Sapiens
aggucccaaaugggggccccucacuaguuguacccuacuccauuuuccccgguccaggggagag

SEQ ID NO: 546000 - RNA, 64 nt, Homo Sapiens
ugggccaccagggcccuguguggugucucugcgucuacuccaugggugaccugcucuucagugg

SEQ ID NO: 546001 - RNA, 64 nt, Homo Sapiens
gcauccacguccugcagacgucugguggcagcgucuacuccauugcugugacaaaucaccacau

SEQ ID NO: 546002 - RNA, 64 nt, Homo Sapiens
cuccccaucucccugaagcuccugcagcaccccccuacuccaggcccacugccugccggggguu

SEQ ID NO: 546003 - RNA, 64 nt, Homo Sapiens
agauucugccucccuugugugaaugcaguuuauucuacuccaaguccuuguccacuucuuuaag

SEQ ID NO: 546004 - RNA, 64 nt, Homo Sapiens; identical to SEQ ID NO: 237135

SEQ ID NO: 546005 - RNA, 64 nt, Homo Sapiens; identical to SEQ ID NO: 237136

SEQ ID NO: 546006 - RNA, 64 nt, Homo Sapiens; identical to SEQ ID NO: 237137

SEQ ID NO: 546007 - RNA, 64 nt, Homo Sapiens; identical to SEQ ID NO: 237138

SEQ ID NO: 546008 - RNA, 64 nt, Homo Sapiens; identical to SEQ ID NO: 237139

SEQ ID NO: 546009 - RNA, 64 nt, Homo Sapiens; identical to SEQ ID NO: 237140

SEQ ID NO: 546010 - RNA, 64 nt, Homo Sapiens; identical to SEQ ID NO: 237141

SEQ ID NO: 546011 - RNA, 64 nt, Homo Sapiens; identical to SEQ ID NO: 237142

SEQ ID NO: 546012 - RNA, 64 nt, Homo Sapiens; identical to SEQ ID NO: 237143

SEQ ID NO: 546013 - RNA, 64 nt, Homo Sapiens; identical to SEQ ID NO: 237144

SEQ ID NO: 546014 - RNA, 64 nt, Homo Sapiens; identical to SEQ ID NO: 237145

SEQ ID NO: 546015 - RNA, 64 nt, Homo Sapiens; identical to SEQ ID NO: 237146

SEQ ID NO: 546016 - RNA, 64 nt, Homo Sapiens; identical to SEQ ID NO: 237147

SEQ ID NO: 546017 - RNA, 64 nt, Homo Sapiens; identical to SEQ ID NO: 237148

SEQ ID NO: 546018 - RNA, 64 nt, Homo Sapiens; identical to SEQ ID NO: 237149

SEQ ID NO: 546019 - RNA, 64 nt, Homo Sapiens; identical to SEQ ID NO: 237150

SEQ ID NO: 546020 - RNA, 64 nt, Homo Sapiens; identical to SEQ ID NO: 533518

SEQ ID NO: 546021 - RNA, 64 nt, Homo Sapiens; identical to SEQ ID NO: 533519

SEQ ID NO: 546022 - RNA, 64 nt, Homo Sapiens; identical to SEQ ID NO: 533520

SEQ ID NO: 546023 - RNA, 64 nt, Homo Sapiens; identical to SEQ ID NO: 533521

SEQ ID NO: 546024 - RNA, 64 nt, Homo Sapiens; identical to SEQ ID NO: 533522

SEQ ID NO: 546025 - RNA, 64 nt, Homo Sapiens; identical to SEQ ID NO: 533523

SEQ ID NO: 546026 - RNA, 64 nt, Homo Sapiens; identical to SEQ ID NO: 533524

SEQ ID NO: 546027 - RNA, 64 nt, Homo Sapiens; identical to SEQ ID NO: 533525

SEQ ID NO: 546028 - RNA, 64 nt, Homo Sapiens; identical to SEQ ID NO: 533526

SEQ ID NO: 546029 - RNA, 64 nt, Homo Sapiens; identical to SEQ ID NO: 533527

SEQ ID NO: 546030 - RNA, 64 nt, Homo Sapiens; identical to SEQ ID NO: 533528

SEQ ID NO: 546031 - RNA, 51 nt, Homo Sapiens; identical to SEQ ID NO: 533529

SEQ ID NO: 546032 - RNA, 64 nt, Homo Sapiens; identical to SEQ ID NO: 533530

SEQ ID NO: 546033 - RNA, 64 nt, Homo Sapiens; identical to SEQ ID NO: 533531

SEQ ID NO: 546034 - RNA, 64 nt, Homo Sapiens; identical to SEQ ID NO: 533532

SEQ ID NO: 546035 - RNA, 64 nt, Homo Sapiens; identical to SEQ ID NO: 533533

SEQ ID NO: 546036 - RNA, 64 nt, Homo Sapiens; identical to SEQ ID NO: 533534

SEQ ID NO: 546037 - RNA, 64 nt, Homo Sapiens; identical to SEQ ID NO: 533535

SEQ ID NO: 546038 - RNA, 64 nt, Homo Sapiens; identical to SEQ ID NO: 533536

SEQ ID NO: 546039 - RNA, 64 nt, Homo Sapiens; identical to SEQ ID NO: 533537

SEQ ID NO: 546040 - RNA, 64 nt, Homo Sapiens; identical to SEQ ID NO: 533538

SEQ ID NO: 546041 - RNA, 64 nt, Homo Sapiens; identical to SEQ ID NO: 533539

SEQ ID NO: 546042 - RNA, 64 nt, Homo Sapiens; identical to SEQ ID NO: 533540

SEQ ID NO: 546043 - RNA, 64 nt, Homo Sapiens; identical to SEQ ID NO: 533541

SEQ ID NO: 546044 - RNA, 64 nt, Homo Sapiens; identical to SEQ ID NO: 533542

SEQ ID NO: 546045 - RNA, 64 nt, Homo Sapiens; identical to SEQ ID NO: 533543

SEQ ID NO: 546046 - RNA, 64 nt, Homo Sapiens; identical to SEQ ID NO: 533544

SEQ ID NO: 546047 - RNA, 64 nt, Homo Sapiens; identical to SEQ ID NO: 533545

SEQ ID NO: 546048 - RNA, 64 nt, Homo Sapiens; identical to SEQ ID NO: 533546

SEQ ID NO: 546049 - RNA, 64 nt, Homo Sapiens; identical to SEQ ID NO: 533547

SEQ ID NO: 546050 - RNA, 64 nt, Homo Sapiens; identical to SEQ ID NO: 533548

SEQ ID NO: 546051 - RNA, 64 nt, Homo Sapiens; identical to SEQ ID NO: 533549

SEQ ID NO: 546052 - RNA, 64 nt, Homo Sapiens; identical to SEQ ID NO: 533550

SEQ ID NO: 546053 - RNA, 64 nt, Homo Sapiens; identical to SEQ ID NO: 533551

SEQ ID NO: 546054 - RNA, 64 nt, Homo Sapiens; identical to SEQ ID NO: 533552

SEQ ID NO: 546055 - RNA, 64 nt, Homo Sapiens; identical to SEQ ID NO: 533553

SEQ ID NO: 546056 - RNA, 64 nt, Homo Sapiens; identical to SEQ ID NO: 533554

SEQ ID NO: 546057 - RNA, 64 nt, Homo Sapiens; identical to SEQ ID NO: 533555

SEQ ID NO: 546058 - RNA, 64 nt, Homo Sapiens; identical to SEQ ID NO: 533556

SEQ ID NO: 546059 - RNA, 64 nt, Homo Sapiens; identical to SEQ ID NO: 52866

SEQ ID NO: 546060 - RNA, 64 nt, Homo Sapiens; identical to SEQ ID NO: 52867

SEQ ID NO: 546061 - RNA, 64 nt, Homo Sapiens; identical to SEQ ID NO: 52868

SEQ ID NO: 546062 - RNA, 64 nt, Homo Sapiens; identical to SEQ ID NO: 52869

SEQ ID NO: 546063 - RNA, 64 nt, Homo Sapiens
cuccacagugguggcugucagacccgaagggguggggagccaaggguggacuuuaagcauggug

SEQ ID NO: 546064 - RNA, 64 nt, Homo Sapiens
ggguaagccccacagcgggcagcacaaacagccugggagccacugugccugugcuucucugucc

SEQ ID NO: 546065 - RNA, 64 nt, Homo Sapiens
acccaggagcugcauggcugggagggacggggaggggagccagggagaggaccugaucauguag

SEQ ID NO: 546066 - RNA, 64 nt, Homo Sapiens
cuuucacaugcaacggggcaccgugauacucugagggagccagacacccuagacagagacccac

SEQ ID NO: 546067 - RNA, 64 nt, Homo Sapiens
ggcagccccucuccguccucagggcugugccucugggagccacugggccaggggccccgggucg

SEQ ID NO: 546068 - RNA, 64 nt, Homo Sapiens
gcggugagcggcucccaugggcccugugucugcagggagccagggcugcggcacaugugcugug

SEQ ID NO: 546069 - RNA, 64 nt, Homo Sapiens
gcgccucaucuuuaaacuguccuuaguagcccaggggagccacacccucacucccugccucccc

SEQ ID NO: 546070 - RNA, 64 nt, Homo Sapiens
cgcggcucaggggcuccucacagcccgggcuggugggagccaagaccagacagagugggggucu

SEQ ID NO: 546071 - RNA, 64 nt, Homo Sapiens
ugcagucuggagacaagcucuuccggagugcucugggagccaggccagggugugagggaggugc

SEQ ID NO: 546072 - RNA, 64 nt, Homo Sapiens
ggcauguuucugccgccacuccgcaagauggacagggagccagcaggcaggcgggaagggccaa

SEQ ID NO: 546073 - RNA, 64 nt, Homo Sapiens
ucuccaucucaggaaauucuagcccuugcccucagggagccacgguugagggugaggcccaaca

SEQ ID NO: 546074 - RNA, 64 nt, Homo Sapiens
ucgcugggaccuacugcucgggaggcagcagacagggagccaccagcaguggcuuccuggcccu

SEQ ID NO: 546075 - RNA, 64 nt, Homo Sapiens
gccaguaguuuggggguagggggguaccguguaggggagccaagaggacuaugccagaagcgau

SEQ ID NO: 546076 - RNA, 50 nt, Homo Sapiens
cuggggccccccccccgugggggagccacacgugggcccaggugggcuga

SEQ ID NO: 546077 - RNA, 64 nt, Homo Sapiens
agaccugcucuccggcgcagaggcucucgggugggggagccaggucagagagacccgggaagga

SEQ ID NO: 546078 - RNA, 64 nt, Homo Sapiens
gggagcaagugugcucuccugucccagccgcacugggagccaugggaguuacaaaguuugcaaa

SEQ ID NO: 546079 - RNA, 64 nt, Homo Sapiens
accggcccuuuggagccggcaccgugcugcuguugggagccaagacccagccuccagggacuga

SEQ ID NO: 546080 - RNA, 64 nt, Homo Sapiens
acccuucugauggaaggcgguucugauggaaggugggagccaacgaaggugggagccaacaccc

SEQ ID NO: 546081 - RNA, 64 nt, Homo Sapiens
acccuucugauggaaggugguucugauggaaggugggagccaacgaaggugggagccaacaccc

SEQ ID NO: 546082 - RNA, 64 nt, Homo Sapiens; identical to SEQ ID NO: 546081

SEQ ID NO: 546083 - RNA, 64 nt, Homo Sapiens; identical to SEQ ID NO: 546081

SEQ ID NO: 546084 - RNA, 64 nt, Homo Sapiens
acccuucugauggaaggugguucugauggaaggugggagccaacgguuucccugggccagcauc

SEQ ID NO: 546085 - RNA, 64 nt, Homo Sapiens
aucaugccauuguacuccagaguucgaggcugcagggagccauggaggauggcuugagccuagg

SEQ ID NO: 546086 - RNA, 64 nt, Homo Sapiens
uuucccagccuguauguucuccuggccaacagacgggagccacuggucaugaauuugagaccag

SEQ ID NO: 546087 - RNA, 64 nt, Homo Sapiens
cucuccgagcacugggcccugccugggggcucccgggagccaggggagaugcuaccucggaagc

SEQ ID NO: 546088 - RNA, 64 nt, Homo Sapiens
acgaggcugcagaagcucucccucccuacucccugggagccacgugcuggccauguggccaggg

SEQ ID NO: 546089 - RNA, 64 nt, Homo Sapiens
acuggacaagagaagaggcauugagagcccccuugggagccauuagccuugcucuggucugcug

SEQ ID NO: 546090 - RNA, 64 nt, Homo Sapiens
ggacaucugaaugcugauacgaauggacaggaaagggagccagagcuguauaccugggacaggc

SEQ ID NO: 546091 - RNA, 64 nt, Homo Sapiens
augccugaguccuucuguccucagagcugggguugggagccagaugaggcagagauugaagcca

SEQ ID NO: 546092 - RNA, 64 nt, Homo Sapiens
ggagagggaccuugcacccuaacaggaaagucuggggagccacaauggagagagugagcugggg

SEQ ID NO: 546093 - RNA, 64 nt, Homo Sapiens
ucuuuaagagcuaacaagagaagagaguccaguuuucuggaaauaugucuuuaaguauuuuaga

SEQ ID NO: 546094 - RNA, 64 nt, Homo Sapiens
uggggguaaggguaugaggugaucaggaaguuucuucuggaauuuuaucaaguccuuguauucu

SEQ ID NO: 546095 - RNA, 64 nt, Homo Sapiens
gcagccaacuugcgccucuucgaaaaucagaggauucuggaaagguuccagccccuuggaucaa

SEQ ID NO: 546096 - RNA, 64 nt, Homo Sapiens
ugaaucagauuucauuugggguuaaaucggauuuuucuggaauuuugcugauucagacuuauua

SEQ ID NO: 546097 - RNA, 64 nt, Homo Sapiens
aggcagguacaaauaaaaaaccaccuucaacguuuucuggaacaccuaguuagacuuugggaag

SEQ ID NO: 546098 - RNA, 64 nt, Homo Sapiens
cucugcucagcacagggaaguccguuucuggugcuucuggaaguuugggguccuuucaucuggc

SEQ ID NO: 546099 - RNA, 64 nt, Homo Sapiens
gcaugauuuauauauggcauauuuauauuguauauucuggaaaaaaaauauauauauauauuua

SEQ ID NO: 546100 - RNA, 64 nt, Homo Sapiens
caaacugaguaaauuggaaacauuuucuuucuuuuucuggaaauuuuguccauuuuaaaaacca

SEQ ID NO: 546101 - RNA, 64 nt, Homo Sapiens
ugaagacacugaaaaauaagugauuucaguaaccuucuggaaagcuaucaguuucaaauaauau

SEQ ID NO: 546102 - RNA, 64 nt, Homo Sapiens
uauucauagagcuccuucucugugccagacacuguucuggaagauagcuagaugaaaaucuuug

SEQ ID NO: 546103 - RNA, 64 nt, Homo Sapiens
aaugucuggagagggccagcaggcccucugaggguucuggaaucugugcaccuuauuugaccac

SEQ ID NO: 546104 - RNA, 64 nt, Homo Sapiens
cucccaauguuguuaaugcucugucuuccauuuguucuggaauccuacguguuggucugugguu

SEQ ID NO: 546105 - RNA, 64 nt, Homo Sapiens
uacccagcugggacuccaaaacucaaccaucaccuucuggaauaucacccuggaggaugaaggg

SEQ ID NO: 546106 - RNA, 64 nt, Homo Sapiens
uugcucugccacugcccgcccagcccccauggucuucuggaaggucccucggucagggauugaa

SEQ ID NO: 546107 - RNA, 64 nt, Homo Sapiens
acaucuccaaggugagguccagggcuuaguuuuauucuggaaagcaucaccauuuuuccugagu

SEQ ID NO: 546108 - RNA, 64 nt, Homo Sapiens
uugcugacccaggccguggacaaugcucuuccucuucuggaauguuuggccaaacaaccggcua

SEQ ID NO: 546109 - RNA, 64 nt, Homo Sapiens
guuuucuagaaaacuagucaaggaagacuguaucuucuggaauaguaaagcuguauuuucugga

SEQ ID NO: 546110 - RNA, 64 nt, Homo Sapiens
aagacuguaucuucuggaauaguaaagcuguauuuucuggaaggaugauuaggcacuuaaggac

SEQ ID NO: 546111 - RNA, 64 nt, Homo Sapiens
uagacuccuaacagaccuacuuccuacaaaauuuuucuggaaaauuauuuaaaaucagaacaau

SEQ ID NO: 546112 - RNA, 64 nt, Homo Sapiens
agucgcugggagcagugcggcagcaggcauucucuucuggaaggagggggggaggggaguguug

SEQ ID NO: 546113 - RNA, 64 nt, Homo Sapiens
ucuggaguuuuagugaaaggauuuauugagcagcuucuggaauauaaugugcauguccaaaaug

SEQ ID NO: 546114 - RNA, 64 nt, Homo Sapiens
cuggcagaugaauaauuuucacucauuuauugucuucuggaaaccauuuaacuuuuacuguuuu

SEQ ID NO: 546115 - RNA, 64 nt, Homo Sapiens
agaaggagucccucacccuaggugugagaugggauucuggaagcuuccugaaggauuugagugg

SEQ ID NO: 546116 - RNA, 64 nt, Homo Sapiens
agaguccaugaagggggugugagggggaggguauuucuggaaaguggaccagcaugugcaaaaa

SEQ ID NO: 546117 - RNA, 64 nt, Homo Sapiens
agauaguggucaugguuauagggugaggagaaaguucuggaacuauguauggggcuuccauuug

SEQ ID NO: 546118 - RNA, 64 nt, Homo Sapiens
cugcugagcccugccuuacuugagcaccccugauuucuggaacgggccacuuugcuucucuacc

SEQ ID NO: 546119 - RNA, 64 nt, Homo Sapiens
aauaagggaguugaacuggugauucgugaggggauucuggaaccaucagcaccguuguuccuag

SEQ ID NO: 546120 - RNA, 64 nt, Homo Sapiens
cagguuugaggauacaguguaucacagacacaguuucuggaauaucacuucuuggccacagcac

SEQ ID NO: 546121 - RNA, 64 nt, Homo Sapiens
guggcagugggcuacucccucuggguagcugggcuucuggaagggucuacuuguucuccagcuu

SEQ ID NO: 546122 - RNA, 64 nt, Homo Sapiens
uugaaacacaaaacacaaguuuuuuuguuuuugcuucuggaacuugagccgcuguacccgaacu

SEQ ID NO: 546123 - RNA, 64 nt, Homo Sapiens
uuauuuacucuuucuuuuuaaaggagagcaaagcuucuggaacuaguacaaacgcugcuuggau

SEQ ID NO: 546124 - RNA, 64 nt, Homo Sapiens
uguguuuguuugaugcuggucaucauuaagaaaguucuggaaacucaagguucucuuggcugga

SEQ ID NO: 546125 - RNA, 64 nt, Homo Sapiens
aauaugcaaaaguggguacucuauuucuacugaguucuggaagaugggaaaugucuacaaaugu

SEQ ID NO: 546126 - RNA, 64 nt, Homo Sapiens
cauugcugcacuuuggaaaguaggauuugagcuguucuggaacaagaacuugaacuucaccuuu

SEQ ID NO: 546127 - RNA, 64 nt, Homo Sapiens
uacucaauuuaguggcagggauagggauacugcauucuggaaauuuccugaccugcuguagaac

SEQ ID NO: 546128 - RNA, 64 nt, Homo Sapiens
gugaauugcuuuugaagucuuuaaguacuuuguauucuggaagcaacagguuugaaaauaugua

SEQ ID NO: 546129 - RNA, 64 nt, Homo Sapiens
aucagcagauauagucuacauucauuaaagaugauucuggaaugauaugaccugaugccuuucc

SEQ ID NO: 546130 - RNA, 64 nt, Homo Sapiens
ggggaccaugcugccuucucugggcucacgacuguucuggaaaggaccccauggcagacuuggc

SEQ ID NO: 546131 - RNA, 64 nt, Homo Sapiens
gcccguguuucucagacuuuaaagccaccagggcuucuggaacaccugucauagaagcaauaac

SEQ ID NO: 546132 - RNA, 64 nt, Homo Sapiens
cacagggugcugcugccuccguuguccccugcacuucuggaagguuccaucuggcaucccacgc

SEQ ID NO: 546133 - RNA, 64 nt, Homo Sapiens
agcccaacuggacuccaguccugguuuaccuuuuuucuggaaaauucaggaagucagaccuucc

SEQ ID NO: 546134 - RNA, 64 nt, Homo Sapiens
auacugcaauaggcucucugauuugggacugcauuucuggaaacauacaauauagaguaugcac

SEQ ID NO: 546135 - RNA, 64 nt, Homo Sapiens
gugggaauuaaggcuacugcucuguauuuuucuuuucuggaacacaguaagauguguggguuuu

SEQ ID NO: 546136 - RNA, 64 nt, Homo Sapiens
aaugggagauauuacaauaaaguugccagugauguucuggaaauacccuugcauacaaguuucu

SEQ ID NO: 546137 - RNA, 64 nt, Homo Sapiens
uuuguuuuucaacuugucccuuaguuggcggauuuucuggaacacagcauucgcaaugagaucu

SEQ ID NO: 546138 - RNA, 64 nt, Homo Sapiens
ucaaucuacucaugauguguuaugcauaaaacauuucuggaacauggauuuguguucaccuuaa

SEQ ID NO: 546139 - RNA, 64 nt, Homo Sapiens
aaauccuauuuucuauggaagacugguaccugguuucuggaagaggggucugugacuuggagcu

SEQ ID NO: 546140 - RNA, 64 nt, Homo Sapiens
uguuaaauuucacaaagucagcuucgagucuuccuucuggaaucuagaacuguuaacugagaug

SEQ ID NO: 546141 - RNA, 64 nt, Homo Sapiens
gaaucuuacaugguauacuugaaauguagcuguguucuggaacuuaauuacugugauggacaca

SEQ ID NO: 546142 - RNA, 64 nt, Homo Sapiens
gcuuucccacagcuggguaaaauuuucuuggcuguucuggaaaucaaauggauuucuccugggg

SEQ ID NO: 546143 - RNA, 64 nt, Homo Sapiens
uuuuuacuuagauauaaaaugcagggcaggaguauucuggaaucuucuaaaacacuacuguuuu

SEQ ID NO: 546144 - RNA, 64 nt, Homo Sapiens
uauuuugacuagcugcuuggccaggggcuugcaauucuggaaaacaggucacccugaaaagccc

SEQ ID NO: 546145 - RNA, 64 nt, Homo Sapiens
ucaggccuagacuagguugcaguaaauggguggauucuggaacccugcugguuuuaggggccaa

SEQ ID NO: 546146 - RNA, 64 nt, Homo Sapiens
uucagugugauacagagcugccauuuccaaaguauucuggaagcaagccauugccuuacucuug

SEQ ID NO: 546147 - RNA, 64 nt, Homo Sapiens
uacuccaaagccuagaaccuucacgucaugaagguucuggaagguuuuucagauugcuuaagau

SEQ ID NO: 546148 - RNA, 64 nt, Homo Sapiens
uguuaugcaauuucccuuuuuagcaugaauacaauucuggaaacagcgcacggguugguuguuc

SEQ ID NO: 546149 - RNA, 64 nt, Homo Sapiens
agaucugaauaggcuaccggcaagaaucgucuuauucuggaaguacugacuuaugguuuugauu

SEQ ID NO: 546150 - RNA, 64 nt, Homo Sapiens
ucuggauccuccacuccuggggauuaugaagauauucuggaaagauuugugcuucagagguaga

SEQ ID NO: 546151 - RNA, 64 nt, Homo Sapiens
ccuguugcugcuuugcaaugaauuuccuuuaccuuucuggaacacaagcugcugugaaccaaac

SEQ ID NO: 546152 - RNA, 64 nt, Homo Sapiens
aagacugaucauaaaccaaugcugguauugcaccuucuggaacuaugggcuugagaaaaccccc

SEQ ID NO: 546153 - RNA, 64 nt, Homo Sapiens
ugcuuuacgauguaaaauauuuauuuuuuacuuauucuggaagaucuggcugaaggauuauuca

SEQ ID NO: 546154 - RNA, 64 nt, Homo Sapiens
gcuugaacccaggaggcggacuaagaauucucucuucuggaaucuucuacuccucccucugacu

SEQ ID NO: 546155 - RNA, 64 nt, Homo Sapiens
acaaaccaagccaugcugguugaaguggucugaauucuggaaucgcuguaacugugugagauug

SEQ ID NO: 546156 - RNA, 64 nt, Homo Sapiens
aucccucuccuaaaaaguucaguuuggaaucucauucuggaaaagauggaaucgcauggagauu

SEQ ID NO: 546157 - RNA, 64 nt, Homo Sapiens
ggaguuaccuuuguuuuucuaucguaaauuuagauucuggaauugggguuugguggugcaaugu

SEQ ID NO: 546158 - RNA, 64 nt, Homo Sapiens
ucccuacucuaccuucuaccuuggucuggacacauucuggaacacuggacacccucgccagggc

SEQ ID NO: 546159 - RNA, 64 nt, Homo Sapiens
cccgccuucuugagugauaccuauuacggaugaguucuggaaaagacccagcuaugauucauaa

SEQ ID NO: 546160 - RNA, 64 nt, Homo Sapiens
uguggccugauggagcagcccauggaugcucucuuucuggaagcccaagaggcucuucagagau

SEQ ID NO: 546161 - RNA, 64 nt, Homo Sapiens
gccacaggagguugcggagcgacugagggagauuuucuggaagggcaauaucccaaguucuugu

SEQ ID NO: 546162 - RNA, 64 nt, Homo Sapiens
uuucuuuggggcagagaagaaaaauaaugugaaauucuggaaauagcaagauggguuuuuaagg

SEQ ID NO: 546163 - RNA, 64 nt, Homo Sapiens
guuaguugaugguacauaguuugaaguucuacaauucuggaauaggcggggauaggggagggca

SEQ ID NO: 546164 - RNA, 64 nt, Homo Sapiens
uucagaugccuguuaggccuccucuggcccuuccuucuggaaucgaaaaguuaagccaucuccu

SEQ ID NO: 546165 - RNA, 64 nt, Homo Sapiens
guuaagccaucuccuccucucccguaguuagcaauucuggaaaaugcucccugacucccagggc

SEQ ID NO: 546166 - RNA, 64 nt, Homo Sapiens
gugcagguauaaacacacccgucugggaucuguuuucuggaagucugcaggugggcugcugagg

SEQ ID NO: 546167 - RNA, 64 nt, Homo Sapiens
ccagauaacuaaggugaagauggacaggaugggguucuggaaauagaacccugcagggcccuua

SEQ ID NO: 546168 - RNA, 64 nt, Homo Sapiens
gucugaauauucuagaacuagagaagggggacguuucuggaacuuucuaguugggagaguugga

SEQ ID NO: 546169 - RNA, 64 nt, Homo Sapiens
ugccaguuuuccucccccgccggcuucugcagaauucuggaaaaccucaaauuguagucucugu

SEQ ID NO: 546170 - RNA, 64 nt, Homo Sapiens
auucuuugucaacauuaguaugucccuuuuugguuucuggaaaguggcuucagugauuccucug

SEQ ID NO: 546171 - RNA, 64 nt, Homo Sapiens
ugagagaauacuguaauaauaucaaaagcacuuuuucuggaaacacauuuauggcuuuuauaau

SEQ ID NO: 546172 - RNA, 64 nt, Homo Sapiens
uauauugucauagugguuuuuauuccugcuuuguuucuggaaaggaaauccugaauuacuuaag

SEQ ID NO: 546173 - RNA, 64 nt, Homo Sapiens
cgccucagcggugaggugguuuagggauaaauguuucuggaacccuguggucccccauaauguu

SEQ ID NO: 546174 - RNA, 64 nt, Homo Sapiens
ccuuccccaguguaauguagcuuucucucuuaccuucuggaagagggaauguuucauuuauuac

SEQ ID NO: 546175 - RNA, 64 nt, Homo Sapiens
ucaggauuaucuggaagaccggaagauguggauuuucuggaagcccggaagacauggauugucu

SEQ ID NO: 546176 - RNA, 64 nt, Homo Sapiens
cauggauuagcuggaagaucgaagacacagauuuuucuggaagauggaagacuuggauuuggug

SEQ ID NO: 546177 - RNA, 54 nt, Homo Sapiens
acuagauuuacuggaagacuauuuuucuggaagaugauugacuggaagaucuag

SEQ ID NO: 546178 - RNA, 64 nt, Homo Sapiens
auuguccagagcugcuucccaaauguaauguggcuucuggaaucuuuauguauuauacuuaguc

SEQ ID NO: 546179 - RNA, 64 nt, Homo Sapiens
guuagaagugagggaguuugaccguguuugucucuucuggaaugaaucaguagcuuaagaaaaa

SEQ ID NO: 546180 - RNA, 64 nt, Homo Sapiens; identical to SEQ ID NO: 379135

SEQ ID NO: 546181 - RNA, 64 nt, Homo Sapiens; identical to SEQ ID NO: 379136

SEQ ID NO: 546182 - RNA, 64 nt, Homo Sapiens; identical to SEQ ID NO: 379137

SEQ ID NO: 546183 - RNA, 64 nt, Homo Sapiens; identical to SEQ ID NO: 379138

SEQ ID NO: 546184 - RNA, 64 nt, Homo Sapiens; identical to SEQ ID NO: 379139

SEQ ID NO: 546185 - RNA, 64 nt, Homo Sapiens; identical to SEQ ID NO: 379140

SEQ ID NO: 546186 - RNA, 64 nt, Homo Sapiens; identical to SEQ ID NO: 379141

SEQ ID NO: 546187 - RNA, 64 nt, Homo Sapiens; identical to SEQ ID NO: 379142

SEQ ID NO: 546188 - RNA, 64 nt, Homo Sapiens; identical to SEQ ID NO: 379143

SEQ ID NO: 546189 - RNA, 64 nt, Homo Sapiens; identical to SEQ ID NO: 379144

SEQ ID NO: 546190 - RNA, 64 nt, Homo Sapiens; identical to SEQ ID NO: 379145

SEQ ID NO: 546191 - RNA, 64 nt, Homo Sapiens; identical to SEQ ID NO: 379146

SEQ ID NO: 546192 - RNA, 64 nt, Homo Sapiens; identical to SEQ ID NO: 379147

SEQ ID NO: 546193 - RNA, 64 nt, Homo Sapiens; identical to SEQ ID NO: 379148

SEQ ID NO: 546194 - RNA, 64 nt, Homo Sapiens; identical to SEQ ID NO: 379149

SEQ ID NO: 546195 - RNA, 64 nt, Homo Sapiens; identical to SEQ ID NO: 379150

SEQ ID NO: 546196 - RNA, 64 nt, Homo Sapiens; identical to SEQ ID NO: 379151

SEQ ID NO: 546197 - RNA, 64 nt, Homo Sapiens; identical to SEQ ID NO: 379152

SEQ ID NO: 546198 - RNA, 64 nt, Homo Sapiens; identical to SEQ ID NO: 379153

SEQ ID NO: 546199 - RNA, 64 nt, Homo Sapiens; identical to SEQ ID NO: 379154

SEQ ID NO: 546200 - RNA, 64 nt, Homo Sapiens; identical to SEQ ID NO: 379155

SEQ ID NO: 546201 - RNA, 64 nt, Homo Sapiens; identical to SEQ ID NO: 379156

SEQ ID NO: 546202 - RNA, 64 nt, Homo Sapiens; identical to SEQ ID NO: 379157

SEQ ID NO: 546203 - RNA, 64 nt, Homo Sapiens; identical to SEQ ID NO: 379158

SEQ ID NO: 546204 - RNA, 64 nt, Homo Sapiens; identical to SEQ ID NO: 379159

SEQ ID NO: 546205 - RNA, 64 nt, Homo Sapiens; identical to SEQ ID NO: 379160

SEQ ID NO: 546206 - RNA, 64 nt, Homo Sapiens; identical to SEQ ID NO: 379161

SEQ ID NO: 546207 - RNA, 64 nt, Homo Sapiens; identical to SEQ ID NO: 379162

SEQ ID NO: 546208 - RNA, 64 nt, Homo Sapiens; identical to SEQ ID NO: 379163

SEQ ID NO: 546209 - RNA, 64 nt, Homo Sapiens; identical to SEQ ID NO: 379164

SEQ ID NO: 546210 - RNA, 64 nt, Homo Sapiens; identical to SEQ ID NO: 379165

SEQ ID NO: 546211 - RNA, 64 nt, Homo Sapiens; identical to SEQ ID NO: 379166

SEQ ID NO: 546212 - RNA, 64 nt, Homo Sapiens; identical to SEQ ID NO: 379167

SEQ ID NO: 546213 - RNA, 64 nt, Homo Sapiens; identical to SEQ ID NO: 379168

SEQ ID NO: 546214 - RNA, 64 nt, Homo Sapiens; identical to SEQ ID NO: 379169

SEQ ID NO: 546215 - RNA, 64 nt, Homo Sapiens; identical to SEQ ID NO: 379170

SEQ ID NO: 546216 - RNA, 64 nt, Homo Sapiens; identical to SEQ ID NO: 379171

SEQ ID NO: 546217 - RNA, 64 nt, Homo Sapiens; identical to SEQ ID NO: 379172

SEQ ID NO: 546218 - RNA, 64 nt, Homo Sapiens; identical to SEQ ID NO: 379173

SEQ ID NO: 546219 - RNA, 64 nt, Homo Sapiens; identical to SEQ ID NO: 379174

SEQ ID NO: 546220 - RNA, 64 nt, Homo Sapiens; identical to SEQ ID NO: 379175

SEQ ID NO: 546221 - RNA, 64 nt, Homo Sapiens; identical to SEQ ID NO: 379176

SEQ ID NO: 546222 - RNA, 51 nt, Homo Sapiens; identical to SEQ ID NO: 379177

SEQ ID NO: 546223 - RNA, 64 nt, Homo Sapiens; identical to SEQ ID NO: 379178

SEQ ID NO: 546224 - RNA, 64 nt, Homo Sapiens; identical to SEQ ID NO: 379179

SEQ ID NO: 546225 - RNA, 64 nt, Homo Sapiens; identical to SEQ ID NO: 379180

SEQ ID NO: 546226 - RNA, 64 nt, Homo Sapiens; identical to SEQ ID NO: 379181

SEQ ID NO: 546227 - RNA, 64 nt, Homo Sapiens; identical to SEQ ID NO: 379182

SEQ ID NO: 546228 - RNA, 64 nt, Homo Sapiens; identical to SEQ ID NO: 379183

SEQ ID NO: 546229 - RNA, 64 nt, Homo Sapiens; identical to SEQ ID NO: 379184

SEQ ID NO: 546230 - RNA, 64 nt, Homo Sapiens; identical to SEQ ID NO: 379185

SEQ ID NO: 546231 - RNA, 64 nt, Homo Sapiens; identical to SEQ ID NO: 379186

SEQ ID NO: 546232 - RNA, 64 nt, Homo Sapiens; identical to SEQ ID NO: 379187

SEQ ID NO: 546233 - RNA, 64 nt, Homo Sapiens; identical to SEQ ID NO: 379188

SEQ ID NO: 546234 - RNA, 64 nt, Homo Sapiens; identical to SEQ ID NO: 379189

SEQ ID NO: 546235 - RNA, 64 nt, Homo Sapiens; identical to SEQ ID NO: 379190

SEQ ID NO: 546236 - RNA, 64 nt, Homo Sapiens; identical to SEQ ID NO: 379191

SEQ ID NO: 546237 - RNA, 64 nt, Homo Sapiens; identical to SEQ ID NO: 379192

SEQ ID NO: 546238 - RNA, 64 nt, Homo Sapiens; identical to SEQ ID NO: 379193

SEQ ID NO: 546239 - RNA, 64 nt, Homo Sapiens; identical to SEQ ID NO: 379194

SEQ ID NO: 546240 - RNA, 64 nt, Homo Sapiens; identical to SEQ ID NO: 379195

SEQ ID NO: 546241 - RNA, 64 nt, Homo Sapiens; identical to SEQ ID NO: 379196

SEQ ID NO: 546242 - RNA, 64 nt, Homo Sapiens; identical to SEQ ID NO: 379197

SEQ ID NO: 546243 - RNA, 64 nt, Homo Sapiens; identical to SEQ ID NO: 379198

SEQ ID NO: 546244 - RNA, 64 nt, Homo Sapiens; identical to SEQ ID NO: 379199

SEQ ID NO: 546245 - RNA, 64 nt, Homo Sapiens; identical to SEQ ID NO: 379200

SEQ ID NO: 546246 - RNA, 64 nt, Homo Sapiens; identical to SEQ ID NO: 379201

SEQ ID NO: 546247 - RNA, 64 nt, Homo Sapiens; identical to SEQ ID NO: 411830

SEQ ID NO: 546248 - RNA, 64 nt, Homo Sapiens; identical to SEQ ID NO: 411831

SEQ ID NO: 546249 - RNA, 64 nt, Homo Sapiens; identical to SEQ ID NO: 411832

SEQ ID NO: 546250 - RNA, 64 nt, Homo Sapiens; identical to SEQ ID NO: 411833

SEQ ID NO: 546251 - RNA, 64 nt, Homo Sapiens; identical to SEQ ID NO: 411834

SEQ ID NO: 546252 - RNA, 64 nt, Homo Sapiens; identical to SEQ ID NO: 411835

SEQ ID NO: 546253 - RNA, 64 nt, Homo Sapiens; identical to SEQ ID NO: 411836

SEQ ID NO: 546254 - RNA, 64 nt, Homo Sapiens; identical to SEQ ID NO: 411837

SEQ ID NO: 546255 - RNA, 64 nt, Homo Sapiens; identical to SEQ ID NO: 411838

SEQ ID NO: 546256 - RNA, 64 nt, Homo Sapiens; identical to SEQ ID NO: 411839

SEQ ID NO: 546257 - RNA, 64 nt, Homo Sapiens; identical to SEQ ID NO: 411840

SEQ ID NO: 546258 - RNA, 64 nt, Homo Sapiens; identical to SEQ ID NO: 411841

SEQ ID NO: 546259 - RNA, 64 nt, Homo Sapiens; identical to SEQ ID NO: 411842

SEQ ID NO: 546260 - RNA, 64 nt, Homo Sapiens; identical to SEQ ID NO: 411843

SEQ ID NO: 546261 - RNA, 64 nt, Homo Sapiens; identical to SEQ ID NO: 411844

SEQ ID NO: 546262 - RNA, 64 nt, Homo Sapiens; identical to SEQ ID NO: 411845

SEQ ID NO: 546263 - RNA, 64 nt, Homo Sapiens; identical to SEQ ID NO: 411846

SEQ ID NO: 546264 - RNA, 64 nt, Homo Sapiens; identical to SEQ ID NO: 411847

SEQ ID NO: 546265 - RNA, 64 nt, Homo Sapiens; identical to SEQ ID NO: 411848

SEQ ID NO: 546266 - RNA, 64 nt, Homo Sapiens; identical to SEQ ID NO: 411849

SEQ ID NO: 546267 - RNA, 64 nt, Homo Sapiens; identical to SEQ ID NO: 411850

SEQ ID NO: 546268 - RNA, 64 nt, Homo Sapiens; identical to SEQ ID NO: 411851

SEQ ID NO: 546269 - RNA, 64 nt, Homo Sapiens; identical to SEQ ID NO: 411852

SEQ ID NO: 546270 - RNA, 64 nt, Homo Sapiens; identical to SEQ ID NO: 411853

SEQ ID NO: 546271 - RNA, 64 nt, Homo Sapiens; identical to SEQ ID NO: 411854

SEQ ID NO: 546272 - RNA, 64 nt, Homo Sapiens; identical to SEQ ID NO: 411855

SEQ ID NO: 546273 - RNA, 64 nt, Homo Sapiens; identical to SEQ ID NO: 411856

SEQ ID NO: 546274 - RNA, 64 nt, Homo Sapiens; identical to SEQ ID NO: 266922

SEQ ID NO: 546275 - RNA, 64 nt, Homo Sapiens; identical to SEQ ID NO: 266923

SEQ ID NO: 546276 - RNA, 64 nt, Homo Sapiens; identical to SEQ ID NO: 266924

SEQ ID NO: 546277 - RNA, 64 nt, Homo Sapiens; identical to SEQ ID NO: 266925

SEQ ID NO: 546278 - RNA, 64 nt, Homo Sapiens; identical to SEQ ID NO: 266926

SEQ ID NO: 546279 - RNA, 64 nt, Homo Sapiens; identical to SEQ ID NO: 266927

SEQ ID NO: 546280 - RNA, 64 nt, Homo Sapiens; identical to SEQ ID NO: 266928

SEQ ID NO: 546281 - RNA, 64 nt, Homo Sapiens; identical to SEQ ID NO: 266929

SEQ ID NO: 546282 - RNA, 64 nt, Homo Sapiens; identical to SEQ ID NO: 266930

SEQ ID NO: 546283 - RNA, 64 nt, Homo Sapiens; identical to SEQ ID NO: 266931

SEQ ID NO: 546284 - RNA, 64 nt, Homo Sapiens; identical to SEQ ID NO: 266932

SEQ ID NO: 546285 - RNA, 64 nt, Homo Sapiens; identical to SEQ ID NO: 266933

SEQ ID NO: 546286 - RNA, 64 nt, Homo Sapiens; identical to SEQ ID NO: 266934

SEQ ID NO: 546287 - RNA, 64 nt, Homo Sapiens; identical to SEQ ID NO: 266935

SEQ ID NO: 546288 - RNA, 64 nt, Homo Sapiens; identical to SEQ ID NO: 266936

SEQ ID NO: 546289 - RNA, 64 nt, Homo Sapiens; identical to SEQ ID NO: 266937

SEQ ID NO: 546290 - RNA, 64 nt, Homo Sapiens; identical to SEQ ID NO: 266938

SEQ ID NO: 546291 - RNA, 64 nt, Homo Sapiens; identical to SEQ ID NO: 266939

SEQ ID NO: 546292 - RNA, 64 nt, Homo Sapiens; identical to SEQ ID NO: 266940

SEQ ID NO: 546293 - RNA, 64 nt, Homo Sapiens; identical to SEQ ID NO: 266941

SEQ ID NO: 546294 - RNA, 64 nt, Homo Sapiens; identical to SEQ ID NO: 266942

SEQ ID NO: 546295 - RNA, 64 nt, Homo Sapiens; identical to SEQ ID NO: 266943

SEQ ID NO: 546296 - RNA, 64 nt, Homo Sapiens; identical to SEQ ID NO: 266944

SEQ ID NO: 546297 - RNA, 64 nt, Homo Sapiens; identical to SEQ ID NO: 266945

SEQ ID NO: 546298 - RNA, 64 nt, Homo Sapiens; identical to SEQ ID NO: 266946

SEQ ID NO: 546299 - RNA, 64 nt, Homo Sapiens; identical to SEQ ID NO: 266947

SEQ ID NO: 546300 - RNA, 64 nt, Homo Sapiens; identical to SEQ ID NO: 266948

SEQ ID NO: 546301 - RNA, 64 nt, Homo Sapiens; identical to SEQ ID NO: 266949

SEQ ID NO: 546302 - RNA, 64 nt, Homo Sapiens; identical to SEQ ID NO: 266950

SEQ ID NO: 546303 - RNA, 64 nt, Homo Sapiens; identical to SEQ ID NO: 266951

SEQ ID NO: 546304 - RNA, 64 nt, Homo Sapiens; identical to SEQ ID NO: 266952

SEQ ID NO: 546305 - RNA, 64 nt, Homo Sapiens; identical to SEQ ID NO: 266953

SEQ ID NO: 546306 - RNA, 64 nt, Homo Sapiens; identical to SEQ ID NO: 266954

SEQ ID NO: 546307 - RNA, 64 nt, Homo Sapiens; identical to SEQ ID NO: 266955

SEQ ID NO: 546308 - RNA, 64 nt, Homo Sapiens; identical to SEQ ID NO: 266956

SEQ ID NO: 546309 - RNA, 64 nt, Homo Sapiens; identical to SEQ ID NO: 266957

SEQ ID NO: 546310 - RNA, 64 nt, Homo Sapiens; identical to SEQ ID NO: 266958

SEQ ID NO: 546311 - RNA, 63 nt, Homo Sapiens; identical to SEQ ID NO: 266959

SEQ ID NO: 546312 - RNA, 64 nt, Homo Sapiens; identical to SEQ ID NO: 266960

SEQ ID NO: 546313 - RNA, 64 nt, Homo Sapiens; identical to SEQ ID NO: 266961

SEQ ID NO: 546314 - RNA, 64 nt, Homo Sapiens; identical to SEQ ID NO: 266962

SEQ ID NO: 546315 - RNA, 64 nt, Homo Sapiens; identical to SEQ ID NO: 266963

SEQ ID NO: 546316 - RNA, 64 nt, Homo Sapiens; identical to SEQ ID NO: 266964

SEQ ID NO: 546317 - RNA, 64 nt, Homo Sapiens; identical to SEQ ID NO: 266965

SEQ ID NO: 546318 - RNA, 64 nt, Homo Sapiens; identical to SEQ ID NO: 266966

SEQ ID NO: 546319 - RNA, 64 nt, Homo Sapiens; identical to SEQ ID NO: 266967

SEQ ID NO: 546320 - RNA, 64 nt, Homo Sapiens; identical to SEQ ID NO: 266968

SEQ ID NO: 546321 - RNA, 64 nt, Homo Sapiens; identical to SEQ ID NO: 266969

SEQ ID NO: 546322 - RNA, 64 nt, Homo Sapiens; identical to SEQ ID NO: 266970

SEQ ID NO: 546323 - RNA, 64 nt, Homo Sapiens; identical to SEQ ID NO: 266971

SEQ ID NO: 546324 - RNA, 64 nt, Homo Sapiens; identical to SEQ ID NO: 266972

SEQ ID NO: 546325 - RNA, 64 nt, Homo Sapiens; identical to SEQ ID NO: 266973

SEQ ID NO: 546326 - RNA, 64 nt, Homo Sapiens; identical to SEQ ID NO: 266974

SEQ ID NO: 546327 - RNA, 64 nt, Homo Sapiens; identical to SEQ ID NO: 266975

SEQ ID NO: 546328 - RNA, 64 nt, Homo Sapiens; identical to SEQ ID NO: 266976

SEQ ID NO: 546329 - RNA, 64 nt, Homo Sapiens; identical to SEQ ID NO: 266977

SEQ ID NO: 546330 - RNA, 64 nt, Homo Sapiens; identical to SEQ ID NO: 266978

SEQ ID NO: 546331 - RNA, 64 nt, Homo Sapiens; identical to SEQ ID NO: 266979

SEQ ID NO: 546332 - RNA, 64 nt, Homo Sapiens; identical to SEQ ID NO: 266980

SEQ ID NO: 546333 - RNA, 64 nt, Homo Sapiens; identical to SEQ ID NO: 266981

SEQ ID NO: 546334 - RNA, 64 nt, Homo Sapiens; identical to SEQ ID NO: 266982

SEQ ID NO: 546335 - RNA, 64 nt, Homo Sapiens; identical to SEQ ID NO: 266983

SEQ ID NO: 546336 - RNA, 64 nt, Homo Sapiens
ucuucuucucccuuagggaggcucuugaaggagcaggagguacaguacuggguagcagucuggc

SEQ ID NO: 546337 - RNA, 64 nt, Homo Sapiens
ggcauucaaguugugagcucagaauuacuuuaaaaggagguaacagccagccauuacaccuaaa

SEQ ID NO: 546338 - RNA, 64 nt, Homo Sapiens
ugggucaugggggcggauccgaggugggccuaguaggagguauuaagugugacauucaguguua

SEQ ID NO: 546339 - RNA, 64 nt, Homo Sapiens
cgccaaauaguuccauuuuuuaaguacuuggaaaaggagguaauauauguagcaaaaugguuuu

SEQ ID NO: 546340 - RNA, 64 nt, Homo Sapiens
cggcccaggccccacgcuagaaggcuggcgagaccgaaggcagcaugugaggccucuccuggga

SEQ ID NO: 546341 - RNA, 64 nt, Homo Sapiens
aguggccucagcugcgcccccgcucaggugagcccgaaggcaggagccgggaggcacuccuccc

SEQ ID NO: 546342 - RNA, 64 nt, Homo Sapiens
cuucuguuugccggugggaaacucacagagcaggacgcucuaggccaaaucuauuuuuguaaaa

SEQ ID NO: 546343 - RNA, 64 nt, Homo Sapiens
agagaugccugcuuccuaaagaaugagcuggagcacgcucuaaggaaggaaggcccccguggua

SEQ ID NO: 546344 - RNA, 64 nt, Homo Sapiens
ucucuuucccucuucucuaguguggauucuuuaaacgcucuagguacgaugacaguguuccccg

SEQ ID NO: 546345 - RNA, 64 nt, Homo Sapiens
ugugggcuggggacgccugcccuucugucuccggacgcucuaggcgaguucagcuuggggugug

SEQ ID NO: 546346 - RNA, 64 nt, Homo Sapiens
aacuuugccuaauaagucucguggucacacauacacgcucuauuucucuugcuccuuucuaucu

SEQ ID NO: 546347 - RNA, 64 nt, Homo Sapiens
gccacucagcccauuggcagcugacaacgcagacacgcucuacggaggccugcugauaaagggc

SEQ ID NO: 546348 - RNA, 64 nt, Homo Sapiens
gccguuuuuuccuuagccaguaaguagguucaucacgcucuaagguugagguaccagguagugu

SEQ ID NO: 546349 - RNA, 64 nt, Homo Sapiens
ugcugcuucaugagcgggagacucagagcucuucacgcucuaccccucaugcugcccagcuucu

SEQ ID NO: 546350 - RNA, 64 nt, Homo Sapiens
cauaguaugacuucuauuuuuacucauagugaguacgcucuauguccaaaugcaacuaagaaaa

SEQ ID NO: 546351 - RNA, 64 nt, Homo Sapiens
aaggauggcugcaccuggcccccuggcauuccugacgcucuaggagggaagggggaggcagugc

SEQ ID NO: 546352 - RNA, 64 nt, Homo Sapiens
auauggagcgagguguugggugcucccagcugccacgcucuaucgcccaccacgggcaggggcc

SEQ ID NO: 546353 - RNA, 64 nt, Homo Sapiens
gcaggauguggcuuaugagaccuucuuacgguucacgcucuaagcagccugauggggcaguucc

SEQ ID NO: 546354 - RNA, 64 nt, Homo Sapiens
uccaaauguuaccagaacgaugacaaaaggggagacgcucuauuuuuucacaguuaaaugacag

SEQ ID NO: 546355 - RNA, 64 nt, Homo Sapiens
ucuuccauaguuuuguuuugguuuauuuuuaacaacgcucuagaaacaaagucaaauuaaucac

SEQ ID NO: 546356 - RNA, 64 nt, Homo Sapiens
agaucuggucccucuccuugaacuaccccuccacacgcucuagucccuucaaccuaccggucua

SEQ ID NO: 546357 - RNA, 64 nt, Homo Sapiens
aaaguaauugcuauucacuaauuauuuuuaaaggacgcucuagguucuagguagcuuguuuguu

SEQ ID NO: 546358 - RNA, 64 nt, Homo Sapiens
ugcuugaggggccaaauuguguucugucccaugcacgcucuauuugguguuaaaauggaaccuu

SEQ ID NO: 546359 - RNA, 64 nt, Homo Sapiens
acuguuucaugagcccaaacacccuccuggcacaacgcucuacccugcagcuuggagaacuccg

SEQ ID NO: 546360 - RNA, 64 nt, Homo Sapiens
auuaugcuaagacauuuuaaaguaauuaugagaaacgcucuacuaaugauuuguuuuuauuugu

SEQ ID NO: 546361 - RNA, 64 nt, Homo Sapiens
gcccugauccaggaaaaugugaggggaaucuggaacgcucuaggcagaagaagcugggagggag

SEQ ID NO: 546362 - RNA, 64 nt, Homo Sapiens
gcucgcugcuuggccugcguacauccagccuguuacgcucuagguuagauaauccuuaaaucug

SEQ ID NO: 546363 - RNA, 64 nt, Homo Sapiens
uaguuuaccuagcaaaagcuuugcuguguaauaaacgcucuaucuucuuuuuuuaguguugccc

SEQ ID NO: 546364 - RNA, 64 nt, Homo Sapiens
guuaagaaaauuacuugggugggcagacuuaggaacgcucuacucgguaaaagcguuauacaaa

SEQ ID NO: 546365 - RNA, 64 nt, Homo Sapiens
ucguaaaagcauuauacaaaggguagacuuaggaacgcucuacugguaagaaaauuacuugggu

SEQ ID NO: 546366 - RNA, 64 nt, Homo Sapiens
ugguuuuggguguuuuucauauaccuugaugguaacgcucuaucuuauuuguauuacuagauuc

SEQ ID NO: 546367 - RNA, 64 nt, Homo Sapiens
uaauccauuaguaguuaucuguuuuuaaugacuuacgcucuaagauaccucaguuuuguguccu

SEQ ID NO: 546368 - RNA, 64 nt, Homo Sapiens; identical to SEQ ID NO: 295046

SEQ ID NO: 546369 - RNA, 64 nt, Homo Sapiens; identical to SEQ ID NO: 295047

SEQ ID NO: 546370 - RNA, 64 nt, Homo Sapiens; identical to SEQ ID NO: 295048

SEQ ID NO: 546371 - RNA, 64 nt, Homo Sapiens; identical to SEQ ID NO: 295049

SEQ ID NO: 546372 - RNA, 64 nt, Homo Sapiens; identical to SEQ ID NO: 295050

SEQ ID NO: 546373 - RNA, 64 nt, Homo Sapiens; identical to SEQ ID NO: 295051

SEQ ID NO: 546374 - RNA, 64 nt, Homo Sapiens; identical to SEQ ID NO: 295052

SEQ ID NO: 546375 - RNA, 64 nt, Homo Sapiens; identical to SEQ ID NO: 295053

SEQ ID NO: 546376 - RNA, 64 nt, Homo Sapiens; identical to SEQ ID NO: 295054

SEQ ID NO: 546377 - RNA, 64 nt, Homo Sapiens; identical to SEQ ID NO: 295055

SEQ ID NO: 546378 - RNA, 64 nt, Homo Sapiens; identical to SEQ ID NO: 295056

SEQ ID NO: 546379 - RNA, 64 nt, Homo Sapiens; identical to SEQ ID NO: 295057

SEQ ID NO: 546380 - RNA, 64 nt, Homo Sapiens; identical to SEQ ID NO: 295058

SEQ ID NO: 546381 - RNA, 64 nt, Homo Sapiens; identical to SEQ ID NO: 295059

SEQ ID NO: 546382 - RNA, 64 nt, Homo Sapiens; identical to SEQ ID NO: 295060

SEQ ID NO: 546383 - RNA, 64 nt, Homo Sapiens; identical to SEQ ID NO: 295061

SEQ ID NO: 546384 - RNA, 64 nt, Homo Sapiens; identical to SEQ ID NO: 295062

SEQ ID NO: 546385 - RNA, 64 nt, Homo Sapiens; identical to SEQ ID NO: 295063

SEQ ID NO: 546386 - RNA, 64 nt, Homo Sapiens; identical to SEQ ID NO: 295064

SEQ ID NO: 546387 - RNA, 64 nt, Homo Sapiens; identical to SEQ ID NO: 295065

SEQ ID NO: 546388 - RNA, 64 nt, Homo Sapiens; identical to SEQ ID NO: 295066

SEQ ID NO: 546389 - RNA, 64 nt, Homo Sapiens; identical to SEQ ID NO: 295067

SEQ ID NO: 546390 - RNA, 64 nt, Homo Sapiens; identical to SEQ ID NO: 295068

SEQ ID NO: 546391 - RNA, 64 nt, Homo Sapiens; identical to SEQ ID NO: 295069

SEQ ID NO: 546392 - RNA, 64 nt, Homo Sapiens; identical to SEQ ID NO: 295070

SEQ ID NO: 546393 - RNA, 64 nt, Homo Sapiens; identical to SEQ ID NO: 295071

SEQ ID NO: 546394 - RNA, 64 nt, Homo Sapiens; identical to SEQ ID NO: 295072

SEQ ID NO: 546395 - RNA, 64 nt, Homo Sapiens; identical to SEQ ID NO: 295073

SEQ ID NO: 546396 - RNA, 64 nt, Homo Sapiens; identical to SEQ ID NO: 295074

SEQ ID NO: 546397 - RNA, 64 nt, Homo Sapiens; identical to SEQ ID NO: 295075

SEQ ID NO: 546398 - RNA, 64 nt, Homo Sapiens; identical to SEQ ID NO: 295076

SEQ ID NO: 546399 - RNA, 64 nt, Homo Sapiens; identical to SEQ ID NO: 295077

SEQ ID NO: 546400 - RNA, 64 nt, Homo Sapiens; identical to SEQ ID NO: 295078

SEQ ID NO: 546401 - RNA, 64 nt, Homo Sapiens; identical to SEQ ID NO: 295079

SEQ ID NO: 546402 - RNA, 64 nt, Homo Sapiens; identical to SEQ ID NO: 295080

SEQ ID NO: 546403 - RNA, 64 nt, Homo Sapiens; identical to SEQ ID NO: 295081

SEQ ID NO: 546404 - RNA, 64 nt, Homo Sapiens; identical to SEQ ID NO: 295082

SEQ ID NO: 546405 - RNA, 64 nt, Homo Sapiens; identical to SEQ ID NO: 295083

SEQ ID NO: 546406 - RNA, 64 nt, Homo Sapiens; identical to SEQ ID NO: 295084

SEQ ID NO: 546407 - RNA, 64 nt, Homo Sapiens; identical to SEQ ID NO: 295085

SEQ ID NO: 546408 - RNA, 64 nt, Homo Sapiens
uuuggcauuauugacuggauagaagauagauuucuauccuuagcuauccaaagaacauugggcu

SEQ ID NO: 546409 - RNA, 64 nt, Homo Sapiens
aauacugaucaaucccaguuaagguaaacuauacuauccuuauacuuuagaauugccuaccuaa

SEQ ID NO: 546410 - RNA, 64 nt, Homo Sapiens
caaauuuguccucauugaguuaaguugacaaauuuauccuuacaucacucuccaucaucuguga

SEQ ID NO: 546411 - RNA, 64 nt, Homo Sapiens
uguggcuuugggaucuuuuuagaccacuguaggcuauccuuaucaauuauacaaaggaacauaa

SEQ ID NO: 546412 - RNA, 64 nt, Homo Sapiens
gccuaacuaccagauggagagcuucagaaugggcuauccuuagagucuaguacaucuugaggcc

SEQ ID NO: 546413 - RNA, 64 nt, Homo Sapiens
uugagucuacuuguuaaugaaugacuagcccaauuauccuuauaaauugaauauggugaccaaa

SEQ ID NO: 546414 - RNA, 64 nt, Homo Sapiens
gagacuacuggaauugucgagacuuuuggauuauuauccuuauccuuauccuaaucuuccuagc

SEQ ID NO: 546415 - RNA, 64 nt, Homo Sapiens
acuggaauugucgagacuuuuggauuauuauccuuauccuuauccuaaucuuccuagcccuuca

SEQ ID NO: 546416 - RNA, 64 nt, Homo Sapiens
auuuuauauugauccugcaauuaaaugugcuauauauccuuaaugauugaauauuguuacauag

SEQ ID NO: 546417 - RNA, 64 nt, Homo Sapiens
gguguucucucucucucucuccuuuauuauucuguauccuuaauccauuaagugguaguaauuu

SEQ ID NO: 546418 - RNA, 64 nt, Homo Sapiens
aacuucgggaggccgagacaggcagaucacgaggucaacagauugagaccauccuggcaaacau

SEQ ID NO: 546419 - RNA, 64 nt, Homo Sapiens
aucacuugaagccaggaguuuaaaaccagaaugaucaacagagugagaccccugucuauauauu

SEQ ID NO: 546420 - RNA, 64 nt, Homo Sapiens
uugccuucugccagguggauaaaauaccugccagucaacagagugacaacugccaugucacaag

SEQ ID NO: 546421 - RNA, 64 nt, Homo Sapiens
ugcaaaggacaaccagccagauugacuugcugccucaacagaucuauauugauauucucuuccu

SEQ ID NO: 546422 - RNA, 64 nt, Homo Sapiens
uauagaaauauaguagcuaacaauuuaagccuauucaacagaaaaaacaaagccuacauuaguu

SEQ ID NO: 546423 - RNA, 64 nt, Homo Sapiens
auauuucauauuugauauuauaaagauauuccacucaacagacagauaaauauggcuuugaaau

SEQ ID NO: 546424 - RNA, 64 nt, Homo Sapiens
auaaauguguauuugugaaucuacuaaccacgguucaacagaaauaugcacugccaauuagcuu

SEQ ID NO: 546425 - RNA, 64 nt, Homo Sapiens
agccuccaccugaggauggggucuccgaggccccucaacagagaccgcugagggcuggggggcg

SEQ ID NO: 546426 - RNA, 64 nt, Homo Sapiens
cugcccauagacggggaugacucagcacuaccccucaacagagaugacuuugaugacucugccc

SEQ ID NO: 546427 - RNA, 64 nt, Homo Sapiens
cugccccucagcaaggaugacucagcacugccgcucaacagacaugacucagggauggcuuagu

SEQ ID NO: 546428 - RNA, 64 nt, Homo Sapiens; identical to SEQ ID NO: 546427

SEQ ID NO: 546429 - RNA, 64 nt, Homo Sapiens
cugccccucaccaaggaugacucagcacugccgcucaacagacaugacucagggauggcuuagu

SEQ ID NO: 546430 - RNA, 64 nt, Homo Sapiens
agcagacucagcagggaugacucagcacugccccucaacagacaugacucagcagggaugacuc

SEQ ID NO: 546431 - RNA, 64 nt, Homo Sapiens; identical to SEQ ID NO: 175850

SEQ ID NO: 546432 - RNA, 64 nt, Homo Sapiens; identical to SEQ ID NO: 175851

SEQ ID NO: 546433 - RNA, 64 nt, Homo Sapiens; identical to SEQ ID NO: 175852

SEQ ID NO: 546434 - RNA, 64 nt, Homo Sapiens; identical to SEQ ID NO: 175853

SEQ ID NO: 546435 - RNA, 64 nt, Homo Sapiens; identical to SEQ ID NO: 175854

SEQ ID NO: 546436 - RNA, 64 nt, Homo Sapiens; identical to SEQ ID NO: 175855

SEQ ID NO: 546437 - RNA, 64 nt, Homo Sapiens; identical to SEQ ID NO: 175856

SEQ ID NO: 546438 - RNA, 64 nt, Homo Sapiens; identical to SEQ ID NO: 175857

SEQ ID NO: 546439 - RNA, 64 nt, Homo Sapiens; identical to SEQ ID NO: 175858

SEQ ID NO: 546440 - RNA, 64 nt, Homo Sapiens; identical to SEQ ID NO: 175859

SEQ ID NO: 546441 - RNA, 64 nt, Homo Sapiens; identical to SEQ ID NO: 175860

SEQ ID NO: 546442 - RNA, 64 nt, Homo Sapiens; identical to SEQ ID NO: 175861

SEQ ID NO: 546443 - RNA, 64 nt, Homo Sapiens; identical to SEQ ID NO: 175862

SEQ ID NO: 546444 - RNA, 64 nt, Homo Sapiens; identical to SEQ ID NO: 175863

SEQ ID NO: 546445 - RNA, 64 nt, Homo Sapiens
cgcuugaaggcagaacgcuguuaccucacuggauagaagaaagcuuuccaagccccaggagcug

SEQ ID NO: 546446 - RNA, 64 nt, Homo Sapiens
ggagccuuaaucagaaaaggacuagauuuguuuaagaagaaaaaugaaaccagacccagaucaa

SEQ ID NO: 546447 - RNA, 64 nt, Homo Sapiens
gacaaacauuguauaaaaacuaagagugucuuuaagaagaaaacuauagcaggguacaaugcuu

SEQ ID NO: 546448 - RNA, 64 nt, Homo Sapiens
gcugggaggacaggcauaugccaccacaucacugagaagaaauuuuugauugucugacagauac

SEQ ID NO: 546449 - RNA, 64 nt, Homo Sapiens
cagagaaguggacuccaaaccucauuuuaguuguagaagaaaauuucuuacaaaacaaauucca

SEQ ID NO: 546450 - RNA, 64 nt, Homo Sapiens
ucucuggagaauuucucccacuccccaccucugcagaagaaaauuuugcucuuauaaaaccuca

SEQ ID NO: 546451 - RNA, 64 nt, Homo Sapiens
auaccccaugaaauguaaauacuguaucauaaguagaagaaaauaauuuuuguuuucuaaaaau

SEQ ID NO: 546452 - RNA, 64 nt, Homo Sapiens
ucaacugaggaaaaaaaauaauuaaacaggccuaagaagaaaucaaaaaccauaagacaccuau

SEQ ID NO: 546453 - RNA, 64 nt, Homo Sapiens
ucuuugaaugauuugcugucacagacuauuugguagaagaaauauuuuucaccugagagaggaa

SEQ ID NO: 546454 - RNA, 64 nt, Homo Sapiens
gaucuaauuguaaaaaguaaagcauacaaauacuagaagaaaauggaggaaaacgacauuauau

SEQ ID NO: 546455 - RNA, 64 nt, Homo Sapiens
ggaggaaaacgacauuauaugugacuuaaaaccuagaagaaauaaauaaaacuauugaucaauu

SEQ ID NO: 546456 - RNA, 64 nt, Homo Sapiens
caucuuuugauauucuuauaaauggaacuuacacagaagaaauagggauaugauaaccacuaaa

SEQ ID NO: 546457 - RNA, 64 nt, Homo Sapiens
agagaacaguuaaucccuaaggucuugacaaaacagaagaaaaacaagccuccucguccuaguc

SEQ ID NO: 546458 - RNA, 64 nt, Homo Sapiens
aggacuucaacgccagugacuguguaccuccagcagaagaaaaucaggugucuggucuuggggg

SEQ ID NO: 546459 - RNA, 64 nt, Homo Sapiens
ucuggucuugggggcacugugcucacuucuagagagaagaaaaaggcuggguuuggacuucaug

SEQ ID NO: 546460 - RNA, 64 nt, Homo Sapiens
uuacaaaucuugcauggacuccugccacagugaaagaagaaaaucuucaugucuucaaaaauua

SEQ ID NO: 546461 - RNA, 64 nt, Homo Sapiens
uuaggggcagaaggcuuguuucaagagguuugacagaagaaaggaauauaugaacuuaaugaga

SEQ ID NO: 546462 - RNA, 64 nt, Homo Sapiens
gcucaccuggccacuguuuaaaucagaaagagcuagaagaaaaguuguuccuucacugccacag

SEQ ID NO: 546463 - RNA, 64 nt, Homo Sapiens
gagaaaagaccaugaaauuuggggaaaaaaccugagaagaaagggagaaaauauuaauuuucaa

SEQ ID NO: 546464 - RNA, 64 nt, Homo Sapiens
aguaccaacaggaaggaaugguuuauuaaaaguuagaagaaaugguaauguauuauaccuaaau

SEQ ID NO: 546465 - RNA, 64 nt, Homo Sapiens
acucccugcaacaggaggaaaagugagacaaaggagaagaaauuguugguguucuugauaaggg

SEQ ID NO: 546466 - RNA, 64 nt, Homo Sapiens
auucuuugccugaguuuuaacugcuguugcaaaaagaagaaaacgccuuuguuuuuacuagugu

SEQ ID NO: 546467 - RNA, 64 nt, Homo Sapiens
aagaaggggaagaaaagaaggggaagaagaucaaagaagaaaaggggaaggggaagaaaagaag

SEQ ID NO: 546468 - RNA, 64 nt, Homo Sapiens
acagcagcaucaagaggaggaagcaggaaaagcaagaagaaaagagagcaugcagugauggaag

SEQ ID NO: 546469 - RNA, 64 nt, Homo Sapiens
gcgacaucaagaaggaaaggcagaaaaagcaagaagaagaaaaggaacaugcugagcagaacau

SEQ ID NO: 546470 - RNA, 64 nt, Homo Sapiens
aacagagauaauauauauaugaaagguuuaucuaagaagaaagaaauuaggauaugacauauau

SEQ ID NO: 546471 - RNA, 64 nt, Homo Sapiens
auuuucugacuuacccuuuuuggaugaaacagugagaagaaaacgacucaagccucuagacucu

SEQ ID NO: 546472 - RNA, 64 nt, Homo Sapiens
aaauccaacuagacaaauaaacaauaaauuuuccagaagaaaugcaagggucacaugccaauaa

SEQ ID NO: 546473 - RNA, 64 nt, Homo Sapiens
ugaagaccagaucauggguggugggguggaauucagaagaaauuaguaacugcuacuguauuua

SEQ ID NO: 546474 - RNA, 64 nt, Homo Sapiens
gaacugccaagaaaaggcauggagacagcgaacuagaagaaagggcaagaaggaaauagccacc

SEQ ID NO: 546475 - RNA, 64 nt, Homo Sapiens
cgguccccccucacuccacacuggcacguuugugagaagaaaugacauuuugcuaggaagugac

SEQ ID NO: 546476 - RNA, 64 nt, Homo Sapiens
uacugcaaaaaguacauagugaauuuuaaaauguagaagaaagcaaaaaauaaaauaaguccua

SEQ ID NO: 546477 - RNA, 64 nt, Homo Sapiens
aaucugggaaggcaacaccuguggauaaaacauuagaagaaaacauauauuuuauuuucauacu

SEQ ID NO: 546478 - RNA, 64 nt, Homo Sapiens
aauaucucauuaaaaagcccauaaauaauaggggagaagaaagccuuagguaucaauuccaaaa

SEQ ID NO: 546479 - RNA, 64 nt, Homo Sapiens
ggaaacuguaacugcuaugucuuuaggaaaauguagaagaaagaacauuauuguucuuuaauuc

SEQ ID NO: 546480 - RNA, 64 nt, Homo Sapiens
agcaaagugugguauccacagacauuuuaguugcagaagaaaggcuaggaaaucauuccuuuug

SEQ ID NO: 546481 - RNA, 64 nt, Homo Sapiens
ugagauguuucuuacucacucugcacagaaacaaagaagaaauguuauacagggaaguccguuu

SEQ ID NO: 546482 - RNA, 64 nt, Homo Sapiens
aaagccaggaaagucaaaaaaacgaaagagaaggagaagaaaaaggaaaagggcaaauugaaag

SEQ ID NO: 546483 - RNA, 64 nt, Homo Sapiens
aagaagggcuucggcgccaugcugagauuuggaaagaagaaagaggauaaggguggaaaggcug

SEQ ID NO: 546484 - RNA, 64 nt, Homo Sapiens
ccacuuucuuccaauccaaguaccuuaccuccuaagaagaaaagaucgauugccaaagagcauc

SEQ ID NO: 546485 - RNA, 64 nt, Homo Sapiens
aacaaaaauggaagcaaacagaauucaucaucagagaagaaaauuucacuuuuucuuuuuuacg

SEQ ID NO: 546486 - RNA, 64 nt, Homo Sapiens
cuccccagaaggcauccauccuuagggcccuuaaagaagaaaauaacucagcccuguugcaaug

SEQ ID NO: 546487 - RNA, 64 nt, Homo Sapiens
uauauauauauaucuuauuuauugcaagagguaaagaagaaaaccuauuuuuucuauaaguuuu

SEQ ID NO: 546488 - RNA, 64 nt, Homo Sapiens
agaucugaccuguuuauuguagagauucuuucagagaagaaaccauuuuugaccaguuccuuuu

SEQ ID NO: 546489 - RNA, 64 nt, Homo Sapiens
ucacacucugaauggugcuuugcgaguaccuccaagaagaaaaauagaggaagaugagggggga

SEQ ID NO: 546490 - RNA, 64 nt, Homo Sapiens
cuguaugugacaauuaccugugaagcagaaguagagaagaaagacuaaagugacacaaagagaa

SEQ ID NO: 546491 - RNA, 64 nt, Homo Sapiens
acagcagaagccauggcacagugaagagcaaagcagaagaaaugacgggcacagcgaaauccug

SEQ ID NO: 546492 - RNA, 64 nt, Homo Sapiens
aaagaaaaaagauagaaaaaauuagaucgacuggagaagaaaaauuauuucccaauuacaggaa

SEQ ID NO: 546493 - RNA, 64 nt, Homo Sapiens
aucuacgaaagguaaaaagaaacuauauguuuuaagaagaaaacaauauguaagcuaaacauau

SEQ ID NO: 546494 - RNA, 64 nt, Homo Sapiens
gagcaguugaaaaaugcuaagucuccaagauugaagaagaaacuagguucuaucucuguagaau

SEQ ID NO: 546495 - RNA, 64 nt, Homo Sapiens
uacagauaggcugaugguuauacugaguaggcacagaagaaaagaaaaauuauuuucucaauuu

SEQ ID NO: 546496 - RNA, 64 nt, Homo Sapiens
aggagccugucuuuuaauauccaggaugaggaagagaagaaaugaagcuuuugggcacugugua

SEQ ID NO: 546497 - RNA, 64 nt, Homo Sapiens
cucaauuaaaauuuuguuuacuuaaaaauaauugagaagaaaaauagugcuuuguuuccgugca

SEQ ID NO: 546498 - RNA, 64 nt, Homo Sapiens
aaaaaauucacacugccagcagauuuuuuuuuaaagaagaaaaauaaaaccaugacgcaaagag

SEQ ID NO: 546499 - RNA, 64 nt, Homo Sapiens
gccuguaccacuguuguaacaugggaagacgugaagaagaaauaaucugagcuuuaauuauuua

SEQ ID NO: 546500 - RNA, 64 nt, Homo Sapiens
acgaaugggcucuggacauaugccuguugauuugagaagaaaucuggcugguuugaggguuucc

SEQ ID NO: 546501 - RNA, 64 nt, Homo Sapiens
gaucacaaaauuuguccaggauagacauagagcuagaagaaacagacuucguaaagaucaacuu

SEQ ID NO: 546502 - RNA, 64 nt, Homo Sapiens
aaggcgauucagacucugacacagacaguagucaagaagaaaaugaagugacagaacauacccc

SEQ ID NO: 546503 - RNA, 64 nt, Homo Sapiens
cagccacaagacauccacauauugcauguuaaccagaagaaaagacaacauuuuccggaaaucc

SEQ ID NO: 546504 - RNA, 64 nt, Homo Sapiens
ucacagucacauucaaaauagugacucuaaacaaagaagaaagcagcacugucaucagaugcau

SEQ ID NO: 546505 - RNA, 64 nt, Homo Sapiens
gcgaugacauuucuaagcuacagcguacuccaggagaagaaaagauuaauaccuuaaaagaaga

SEQ ID NO: 546506 - RNA, 64 nt, Homo Sapiens
guacuccaggagaagaaaagauuaauaccuuaaaagaagaaaacacucaagaagcagcaguccu

SEQ ID NO: 546507 - RNA, 64 nt, Homo Sapiens
auuuuguuuuuauuaaauggucaugacuggugagagaagaaaacaaaucuuaaaaguguuguua

SEQ ID NO: 546508 - RNA, 64 nt, Homo Sapiens
uaauguucugacaguugugauuccuauccugguuagaagaaaauaaaguaaacaaaacccacau

SEQ ID NO: 546509 - RNA, 64 nt, Homo Sapiens
agaaaaguaacugguugucaauucacuguuggggagaagaaacauaagcaccauggccuugaug

SEQ ID NO: 546510 - RNA, 64 nt, Homo Sapiens
uguggauaacuaggaaauuaucacaauugcuacaagaagaaaguaaaaacaagucaucuuaagu

SEQ ID NO: 546511 - RNA, 54 nt, Homo Sapiens
ucaucaggugcuucuuuuuaauucagaagaaaaccuggucuucuggagaaauga

SEQ ID NO: 546512 - RNA, 64 nt, Homo Sapiens
cauguauaaaauaguuuuaggauccuuuucuuaaagaagaaaaauaaguuucacagacaucaua

SEQ ID NO: 546513 - RNA, 64 nt, Homo Sapiens
caguuaaauaagacauacccgggaggcagauggaagaagaaaaaaaugagaggaggcagagaga

SEQ ID NO: 546514 - RNA, 64 nt, Homo Sapiens
accaagcuuaggguauuuuuucuaaaagaagaaaagaagaaaaaguuggucaaaaucugcaaac

SEQ ID NO: 546515 - RNA, 64 nt, Homo Sapiens
aagaaaaaaccaagcuuaggcugcaaacucuaaaagaagaaaagccaugucuguuggucaaaau

SEQ ID NO: 546516 - RNA, 64 nt, Homo Sapiens
auguggcuuacugugucugaagauacugacaugcagaagaaauaagugcauucuucugcuuuuc

SEQ ID NO: 546517 - RNA, 64 nt, Homo Sapiens
ucuccuuugcuauaccucaauuuuuggaauuuagagaagaaaucaguaguuuugcaauguuaau

SEQ ID NO: 546518 - RNA, 64 nt, Homo Sapiens
cucuaacccuuagugagggcaaaguguaguugguagaagaaauugcuaaauaccuaucuaaugu

SEQ ID NO: 546519 - RNA, 64 nt, Homo Sapiens
cuugagucuugaucaaacaagugucuuuuacuuaagaagaaacuugguaaucauuguggcaccc

SEQ ID NO: 546520 - RNA, 64 nt, Homo Sapiens
agaaaggaaaagaucuucuuguaccaaaccaaaaagaagaaaaaacuucuguuuuaaacuuugg

SEQ ID NO: 546521 - RNA, 64 nt, Homo Sapiens
uguauuugcagcuagagguuagucaaauguuaagagaagaaacuacgauccaucucccuuugug

SEQ ID NO: 546522 - RNA, 64 nt, Homo Sapiens
uaacauuuucaaauacuuagucacagcaaguguuagaagaaagacuugccugaauuuacuccuu

SEQ ID NO: 546523 - RNA, 64 nt, Homo Sapiens
cagacuguagaaaugagaggcaccaagauucaguagaagaaauaauucugguuuggagucccuc

SEQ ID NO: 546524 - RNA, 64 nt, Homo Sapiens
uaguaucucuaagcgguaaccuuuaagaaagaagagaagaaaacuggaagaguuguaauauaua

SEQ ID NO: 546525 - RNA, 64 nt, Homo Sapiens
aauuuacuuuguuugcauuaugcuuuaagaugugagaagaaaugcauguaaacaaagauaucuu

SEQ ID NO: 546526 - RNA, 64 nt, Homo Sapiens
uugauauggaccuguuggucuaugucaucuuuucagaagaaaagcauuuaauugccaaugggag

SEQ ID NO: 546527 - RNA, 64 nt, Homo Sapiens
cucuuuaaaaauaacuuagauucaaauuuauaguagaagaaaaaaaaucuuucagauaagaggu

SEQ ID NO: 546528 - RNA, 64 nt, Homo Sapiens
acucauuuuucaugauaaugaacagaacauagacagaagaaacaagguuuucaguccccacaga

SEQ ID NO: 546529 - RNA, 64 nt, Homo Sapiens
cucucugaguggacuggccucaaagcaagcauucagaagaaaaagaagcaaccucaguaauuua

SEQ ID NO: 546530 - RNA, 64 nt, Homo Sapiens
uugauauggaccuguugguccauaucaucuuuucagaagaaaagcauuuaauugccaaugggag

SEQ ID NO: 546531 - RNA, 64 nt, Homo Sapiens; identical to SEQ ID NO: 546527

SEQ ID NO: 546532 - RNA, 64 nt, Homo Sapiens
augaaucauacacuauuuucacacuuuuaaucucagaagaaacauaugugacaugguauuuuag

SEQ ID NO: 546533 - RNA, 64 nt, Homo Sapiens
ggauaucaccuggcaaguuucugccuaacuaaagagaagaaaaguuuuuaucguauucauacua

SEQ ID NO: 546534 - RNA, 64 nt, Homo Sapiens
ccuguuucuggaauuccuuguuagggaacuuuaaagaagaaaagaaaaacuugaauuguguuga

SEQ ID NO: 546535 - RNA, 64 nt, Homo Sapiens
gacagaacucaagaaagccacuggggaaaacucgagaagaaagggaguauacuaguagguuaga

SEQ ID NO: 546536 - RNA, 64 nt, Homo Sapiens
ugauaagcaaggaggguguaaguuuaggggacaaagaagaaagaaugaauaauacgagcagaca

SEQ ID NO: 546537 - RNA, 64 nt, Homo Sapiens
uuaaugaaaaaaaaaaacaaaaaaaacggauccaagaagaaaagagaauuuauuuccuucucca

SEQ ID NO: 546538 - RNA, 64 nt, Homo Sapiens
ccacucucuccaugcccuggagaaaaaaaaguccagaagaaaucauaaauaucucucaucuaca

SEQ ID NO: 546539 - RNA, 64 nt, Homo Sapiens
uauggagugccauccugcuaggugaguacagaccagaagaaaauuuaguugggaaaauacuugu

SEQ ID NO: 546540 - RNA, 64 nt, Homo Sapiens
cccuauuaccuuuguagcagccacaucagaaagcagaagaaaacaguauuucugaaggcauugu

SEQ ID NO: 546541 - RNA, 64 nt, Homo Sapiens
uaugugugcaggauuacccaagaauaacuuaaguagaagaaacaagaaagggaaucuuguauau

SEQ ID NO: 546542 - RNA, 64 nt, Homo Sapiens
acuuuugcauccauuguauuaucagaaaaugugaagaagaaaaaaaugccauguuuuaaaacca

SEQ ID NO: 546543 - RNA, 64 nt, Homo Sapiens
cuauaagauguaacaacgaaaugaugacaucuggagaagaaacaucuuuuccuuauaaaaaugu

SEQ ID NO: 546544 - RNA, 64 nt, Homo Sapiens
guaacuuacuuccaaaaacaaaaucauacuuauuagaagaaaauucugauuuuauagaaaaaaa

SEQ ID NO: 546545 - RNA, 64 nt, Homo Sapiens
uacuguguuguaccuuuauuucuguauuucuaaaagaagaaaguucuuuccuagcaggguuuga

SEQ ID NO: 546546 - RNA, 64 nt, Homo Sapiens
uccauccccaaggcaaacaaggaaaggaaaggaaagaagaaaaggugccuuaguccuuuguugc

SEQ ID NO: 546547 - RNA, 64 nt, Homo Sapiens
ucacugaggauguuggggaagggacgaaggguaaagaagaaacugcacguauacacagguucac

SEQ ID NO: 546548 - RNA, 64 nt, Homo Sapiens
aaaaucuuugaaaugaaagcuacaaauacaugugagaagaaaaaaauggauuuuuuuagcaaau

SEQ ID NO: 546549 - RNA, 64 nt, Homo Sapiens
caugcagccacuuuggguuuuguugaggcuaccaagaagaaaucaugcugaaucacaggaaugg

SEQ ID NO: 546550 - RNA, 63 nt, Homo Sapiens
uuaacaaaagacagaaggccacgggugucagcaagaagaaaaaaccccuucggccagucuuaa

SEQ ID NO: 546551 - RNA, 64 nt, Homo Sapiens
aacccugccaacaccuugaugaagagagggccucagaagaaaccgacaacucuuuacaagcuaa

SEQ ID NO: 546552 - RNA, 64 nt, Homo Sapiens
aaaacuacggguagaaaacacaaaucuuuuacgcagaagaaauaauuauaucaaauaaguauca

SEQ ID NO: 546553 - RNA, 64 nt, Homo Sapiens
auucgagcccuggcugugaaaagaaucucaacauagaagaaagaagaaacaauaaauauucugc

SEQ ID NO: 546554 - RNA, 64 nt, Homo Sapiens
cccuggcugugaaaagaaucucaacauagaagaaagaagaaacaauaaauauucugcagauuaa

SEQ ID NO: 546555 - RNA, 64 nt, Homo Sapiens
ucuuguuuuauaaucucuuuguuuaauaauaaguagaagaaauaauuuaaaugaacugcuuagc

SEQ ID NO: 546556 - RNA, 64 nt, Homo Sapiens
aagagucggagggguagacccugcagcccuguugagaagaaagauuccagugaaguugcugaug

SEQ ID NO: 546557 - RNA, 64 nt, Homo Sapiens
caaccagcaggaaaguacagugagaaagaagagaagaagaaaaugacccuaugaaaaaauuagu

SEQ ID NO: 546558 - RNA, 64 nt, Homo Sapiens
gaacugggaaaauuucuucggaagucuugucucaagaagaaaacgugcuccagccugggcgaca

SEQ ID NO: 546559 - RNA, 64 nt, Homo Sapiens
uaacauuaguguauuucuccuggugaaaaaguaaagaagaaagaaacuggaccauccugucuua

SEQ ID NO: 546560 - RNA, 64 nt, Homo Sapiens
cauguggagcaccagccucgaggcggcgggucuuagaagaaaauuugaacaacugcagagagaa

SEQ ID NO: 546561 - RNA, 64 nt, Homo Sapiens
acucugguggcuguuugugcacuuguguuuauaaagaagaaaccauuucaaauaaaccucaugu

SEQ ID NO: 546562 - RNA, 64 nt, Homo Sapiens
caggaagaauuuaaauguuugcucuuaggggagcagaagaaaagcccacccacauaccagucaa

SEQ ID NO: 546563 - RNA, 64 nt, Homo Sapiens
uauaaugaaaagaagaugaaaggagaaauagaaaagaagaaauuaugcccuaacucucuuauua

SEQ ID NO: 546564 - RNA, 64 nt, Homo Sapiens
uugugaaaagcuggggagaagacauuacagccuuagaagaaagacaugccuauuaaggauguaa

SEQ ID NO: 546565 - RNA, 64 nt, Homo Sapiens
agagacaaagaucacuacagaccaaaacagaagaagaagaaaaaaaagaaaaagaaaucuaagc

SEQ ID NO: 546566 - RNA, 64 nt, Homo Sapiens
uggagaaaaaaauagcucaagacacaguuaaucgagaagaaaagaaauauguacagaaccauaa

SEQ ID NO: 546567 - RNA, 64 nt, Homo Sapiens
agucugggaggauagcgcucaugcaguacuugauagaagaaaacggauucagugcuuaccgaug

SEQ ID NO: 546568 - RNA, 64 nt, Homo Sapiens
gcaauaguugcuugaauuauucagccaaagccauagaagaaaaaaaucaaucagcauauacauu

SEQ ID NO: 546569 - RNA, 64 nt, Homo Sapiens
gaggauguuuccuuucacaguguggcaucuagccagaagaaauucuuugggauaauuuauuucc

SEQ ID NO: 546570 - RNA, 64 nt, Homo Sapiens
aaacguguuuaaacuuaaaaggccacggacuaugagaagaaacccaccacgcauuggcauccaa

SEQ ID NO: 546571 - RNA, 64 nt, Homo Sapiens
aaccuuaaucucuuguauuucuaagaauaaauaaagaagaaaaucauuagacugaauuuaacua

SEQ ID NO: 546572 - RNA, 64 nt, Homo Sapiens
cuaugcuuaggccagucaguccauaugauugaaaagaagaaaguguaauauacaguuuuuguaa

SEQ ID NO: 546573 - RNA, 64 nt, Homo Sapiens
ggggacccacaaacaagagugcucuuguauguccagaagaaagagaaagaccaucaaucagggg

SEQ ID NO: 546574 - RNA, 64 nt, Homo Sapiens
uaagaaauaauaccaggcuuuuauaaacuuuucuagaagaaaaaagauggaacuuuuccaauuc

SEQ ID NO: 546575 - RNA, 64 nt, Homo Sapiens
guuaaacaccugcucauggucacauagcccaggcagaagaaaaucucggacuuggaauagaucc

SEQ ID NO: 546576 - RNA, 64 nt, Homo Sapiens
ccugagcaacaagagcgaaacugucucaaaaaaaagaagaaaauaaauaaauaaaaaucagagc

SEQ ID NO: 546577 - RNA, 64 nt, Homo Sapiens
ugcacgccgggauuccucugcugccauuugaauuagaagaaaauaauuuauaugcaugcacagg

SEQ ID NO: 546578 - RNA, 64 nt, Homo Sapiens
ccagcucauguguaccucauaucccauccuuaagagaagaaauguuauaaaguagaacuaaaua

SEQ ID NO: 546579 - RNA, 64 nt, Homo Sapiens
cccuucaaccuuuuuucucugucugcuucaccugagaagaaaguguacgaagagaguguccucc

SEQ ID NO: 546580 - RNA, 64 nt, Homo Sapiens
ucucagcucugggggucauuuaccaguuuguuguagaagaaauaaucagguaaguuaaaaguuc

SEQ ID NO: 546581 - RNA, 64 nt, Homo Sapiens
agcccuuuacauuuccauaacacaaggcaacuccagaagaaagaggguugucucaaauccuguc

SEQ ID NO: 546582 - RNA, 64 nt, Homo Sapiens
uccuguuuagugaugacccaaaucucagaugcucagaagaaagaacagcccugauuuggaccag

SEQ ID NO: 546583 - RNA, 64 nt, Homo Sapiens
aagcuucuuuccauaucaagcugcauccaacuugagaagaaaaauguaucuuuuaaacucaguu

SEQ ID NO: 546584 - RNA, 64 nt, Homo Sapiens
auuugaauuuaccuucauauuguuuuaaagccgaagaagaaaacgugcuuaagaauuuaagcuc

SEQ ID NO: 546585 - RNA, 64 nt, Homo Sapiens
caaaaauaaaauaaaaaaagaaagaaagaaaagaagaagaaaagagaagaaggagaaggagaug

SEQ ID NO: 546586 - RNA, 64 nt, Homo Sapiens
uaagagacuuuuugacucuauauccuugcaguuaagaagaaagcacuuuuuuguaauguuuguu

SEQ ID NO: 546587 - RNA, 64 nt, Homo Sapiens
ccaugaggggaacaagaaacuacuucuaacgggaagaagaaacacuacggucgauuaaaaaaau

SEQ ID NO: 546588 - RNA, 64 nt, Homo Sapiens
uagcuagucaauaugaggauggugguuuauucucagaagaaaaagauauguaaggucuuuuagc

SEQ ID NO: 546589 - RNA, 64 nt, Homo Sapiens
cagaacacugacaaacaaggaaagcggcagagaaagaagaaagaccuagaagguuguagauggg

SEQ ID NO: 546590 - RNA, 64 nt, Homo Sapiens
gggagcuguuuugucagugucuuggggucacaggagaagaaagcgggacuuuggugggaaggag

SEQ ID NO: 546591 - RNA, 64 nt, Homo Sapiens
gacagcaaccaaucagauauauacaaaugaaauuagaagaaacacagccucaugggacagaaau

SEQ ID NO: 546592 - RNA, 64 nt, Homo Sapiens
uuauuucccaccuuugugugaguguguaugaaagagaagaaaaugcaauuuuuagguaaucuuu

SEQ ID NO: 546593 - RNA, 64 nt, Homo Sapiens
gaagguagaguagaggccuagaagaagaaagagaagaagaaaaagaggauccugaacggaaaag

SEQ ID NO: 546594 - RNA, 64 nt, Homo Sapiens
gaagaagaaaaagaagguagugaacggaaaaggaagaagaaagaaagaaaaaagaagaggaucc

SEQ ID NO: 546595 - RNA, 64 nt, Homo Sapiens
gaaaaaagaagaggauccuguucagaucacaagaagaagaaaaaccuacagaaacaccaucuga

SEQ ID NO: 546596 - RNA, 64 nt, Homo Sapiens
aauguacuguggucucuuggcuaaauuccccugaagaagaaaccccguauggagcucuggacuc

SEQ ID NO: 546597 - RNA, 64 nt, Homo Sapiens
aguugcugagguuuuuuaauccaauuugaagcauagaagaaaaugcagguaaaaaaucauucac

SEQ ID NO: 546598 - RNA, 64 nt, Homo Sapiens
ggcugcccauuucaguacccaguugugaggagaaagaagaaaauugcaaggcuucaggaaacag

SEQ ID NO: 546599 - RNA, 64 nt, Homo Sapiens
guuguuugguuaaaggacaccagaauuaagugauagaagaaacuucagacugagguaauaagac

SEQ ID NO: 546600 - RNA, 64 nt, Homo Sapiens
gacccaaaguugccagaaggugaaguuuacaguuagaagaaacacugggaaaaaaaaacuagug

SEQ ID NO: 546601 - RNA, 64 nt, Homo Sapiens
uguuagacuuaggaugauaccuucagccacuugaagaagaaauagaaggcgcucauuccaauau

SEQ ID NO: 546602 - RNA, 64 nt, Homo Sapiens
caucucaagcuagccaggcagucuccucucuaucagaagaaagcacugguaauuggcuagacug

SEQ ID NO: 546603 - RNA, 64 nt, Homo Sapiens
auaauucuucaaaugaagucuucccccaaggagcagaagaaagaauguguuaccaaugugagag

SEQ ID NO: 546604 - RNA, 64 nt, Homo Sapiens
agacuuuugguggugaggaggaagaacaaauaauagaagaaaauaaaaaugagauagaagaaaa

SEQ ID NO: 546605 - RNA, 64 nt, Homo Sapiens
aagaacaaauaauagaagaaaauaaaaaugagauagaagaaaaguaagaaccaagauucauaug

SEQ ID NO: 546606 - RNA, 64 nt, Homo Sapiens
ucaaagagcuaaacuuauucagaaaggaaugacuagaagaaaaaggagacaauaccauguuguu

SEQ ID NO: 546607 - RNA, 64 nt, Homo Sapiens
guucauugauuuuaaacauuuuauuccuacuuucagaagaaaaauauaauacggaaaaaauuau

SEQ ID NO: 546608 - RNA, 64 nt, Homo Sapiens
gggagaaaaggaaaagaaaaaaaaaagaagaagaagaagaaaagagaagaagaaaaaaacgaaa

SEQ ID NO: 546609 - RNA, 64 nt, Homo Sapiens
aagaaaaaaaaaagaagaagaagaagaaaagagaagaagaaaaaaacgaaaacagucaaccaac

SEQ ID NO: 546610 - RNA, 64 nt, Homo Sapiens
auaccugcuucccaauuacucauuuccucagauaagaagaaaucaucucuacaauguagacaac

SEQ ID NO: 546611 - RNA, 64 nt, Homo Sapiens
uuaauuuuuuuuuuccucauuguuggggaugaugagaagaaaugauuugggaaaauuaaguaac

SEQ ID NO: 546612 - RNA, 64 nt, Homo Sapiens
augaugaugaugaugaugaugguuuuuucuaaucagaagaaagcugggguaugcccucuacuua

SEQ ID NO: 546613 - RNA, 64 nt, Homo Sapiens
gauaagggccuuggauuccacucccaagaacggaagaagaaauauucagguuuugcccacgcug

SEQ ID NO: 546614 - RNA, 64 nt, Homo Sapiens
ugcucgugcucguuccaaagccggacucaaaaggagaagaaagcucucccucuucccuagaagg

SEQ ID NO: 546615 - RNA, 64 nt, Homo Sapiens
cccauuauaacaaaugacaaguccacaauggaauagaagaaaauuauccuaggugaggguagca

SEQ ID NO: 546616 - RNA, 64 nt, Homo Sapiens
auguaugggugagaggaagguugaaaaagaggaaagaagaaaaagacccaauggucugugauca

SEQ ID NO: 546617 - RNA, 64 nt, Homo Sapiens
caaccugaguaaaagcagcagaagaaagaagaauagaagaaaauugccuggccccuaaucugcu

SEQ ID NO: 546618 - RNA, 64 nt, Homo Sapiens
ugggaauacagaauauauucaaguaaaaccccauagaagaaacauugaagaaauugcugaaagg

SEQ ID NO: 546619 - RNA, 64 nt, Homo Sapiens
gaaaguguaaugugcgauggcuauguagacauaaagaagaaacuuguaaauaucuuuuuucuuu

SEQ ID NO: 546620 - RNA, 64 nt, Homo Sapiens
aauuuucuggccuuucauggcaaugaaaauuuuaagaagaaagauuuaaaguauuuuaauuuua

SEQ ID NO: 546621 - RNA, 64 nt, Homo Sapiens
auugggugacuaugacuaauuuucugguaguaugagaagaaaucuccgacuuuauagcaggaac

SEQ ID NO: 546622 - RNA, 64 nt, Homo Sapiens
aagagcaaaaaugagaccuguagaggcuauacagagaagaaaaagcauuggcaggaaaaagcuc

SEQ ID NO: 546623 - RNA, 64 nt, Homo Sapiens
gacacauugauaacacaggucaguuauggaggaaagaagaaaauagcaguaagguuucaaggua

SEQ ID NO: 546624 - RNA, 64 nt, Homo Sapiens
gaaguagggcagugcaugacuuaaccugcaauagagaagaaaggaaacugccuacaggccauag

SEQ ID NO: 546625 - RNA, 64 nt, Homo Sapiens
cugccuacaggccauaguuaaaaaaaaaaaaaagagaagaaaaaugacagaacaagacugucuc

SEQ ID NO: 546626 - RNA, 64 nt, Homo Sapiens
uuuucuuuucuuuuguugauuuucuuguucccguagaagaaagaagaaagguguuuggagaauu

SEQ ID NO: 546627 - RNA, 64 nt, Homo Sapiens
uucuuuuguugauuuucuuguucccguagaagaaagaagaaagguguuuggagaauucgagugc

SEQ ID NO: 546628 - RNA, 64 nt, Homo Sapiens
uaaaaagccaacauuugaauugguugcagcauagagaagaaacacugguccuucuuucaaaauu

SEQ ID NO: 546629 - RNA, 64 nt, Homo Sapiens
uggaauauucaugaaacuucauugcagggguaauagaagaaaaaguaaauugggaggacuuaau

SEQ ID NO: 546630 - RNA, 64 nt, Homo Sapiens
ucagguuuguugaacaaugccuuuucagguuggaagaagaaaaauagccucaaucucccacccc

SEQ ID NO: 546631 - RNA, 64 nt, Homo Sapiens
ccaauaaggauaacauuaucuacccagagaguuuagaagaaaaguaggaguccaaaggaagagu

SEQ ID NO: 546632 - RNA, 64 nt, Homo Sapiens
ccuucaggaacccuuuaguuuauuaaucuuauacagaagaaacuaacuuagaaacaaaggauuc

SEQ ID NO: 546633 - RNA, 64 nt, Homo Sapiens
uuugggggggugggggaggguguuguuggggcugagaagaaagagauuuauaugcuguauauaa

SEQ ID NO: 546634 - RNA, 64 nt, Homo Sapiens
aucuacucuguauaacgcaugagaggggaggcaaagaagaaaaagacacacagaagggccuuua

SEQ ID NO: 546635 - RNA, 64 nt, Homo Sapiens
ucuacuguuguguugccauugcuuuuccauugggagaagaaagaauuaaccagucauuaaacca

SEQ ID NO: 546636 - RNA, 64 nt, Homo Sapiens
uucauuccaguguugagaugcuuugcaucucugcagaagaaauuuauuuuaaauuguuuaaaua

SEQ ID NO: 546637 - RNA, 64 nt, Homo Sapiens
aagaaaacacacacccacccacacacacacacacagaagaaaaugaaagcugacacaccucgaa

SEQ ID NO: 546638 - RNA, 64 nt, Homo Sapiens
uuggcagagaugaguggccauaucuggggguaaaagaagaaauccuguccucuuggugggaggu

SEQ ID NO: 546639 - RNA, 64 nt, Homo Sapiens
uuauuuuuuuaaaggaaacaaacagacaacaaaaagaagaaaaaaaaaaagaaccuccuuggaa

SEQ ID NO: 546640 - RNA, 64 nt, Homo Sapiens
aaaaauaaaaaaaauaaaaaaggaaaaaaaaaaaagaagaaacaagacaugccaccuuuccccu

SEQ ID NO: 546641 - RNA, 64 nt, Homo Sapiens
gaaacugcuuucuucucgagguauaaccgucggcagaagaaaaggguuccaccucuccccaacc

SEQ ID NO: 546642 - RNA, 64 nt, Homo Sapiens
uuccggccaauggcagaagugggggaaaauuuuuagaagaaaagcaaacaugugagaccaauca

SEQ ID NO: 546643 - RNA, 64 nt, Homo Sapiens
gccgggcaugguggcucaugaaaauaaaaauagaagaagaaaaggaccguggauuguauuuaaa

SEQ ID NO: 546644 - RNA, 64 nt, Homo Sapiens
ugacccgcaggcuccucccaaguucgcuccugugagaagaaaacgaauccaugaugccggacag

SEQ ID NO: 546645 - RNA, 64 nt, Homo Sapiens
uuuuauuuuuuaaguucaauugugucugugguccagaagaaauuauuuaauaugcaucuuugag

SEQ ID NO: 546646 - RNA, 64 nt, Homo Sapiens
ggacaaggaaggacagaggguuuugauuuuaaaaagaagaaaaaaaaaccuuauuuuuucuuuc

SEQ ID NO: 546647 - RNA, 64 nt, Homo Sapiens
caauugccccagguccucccgagagagagaacacagaagaaaaguggcauccaaagcaacauca

SEQ ID NO: 546648 - RNA, 64 nt, Homo Sapiens
aaaccauacaaaguguuggcuggagcauuuuuugagaagaaacucaauucucugaagucuacga

SEQ ID NO: 546649 - RNA, 64 nt, Homo Sapiens
gaagagaaacuagaaacaguccuagccuuccaagagaagaaaaaaacuuaaagaauuugucaau

SEQ ID NO: 546650 - RNA, 64 nt, Homo Sapiens
gccuucacaguguccuuuaugaaacuucucaaccagaagaaaggauuuauagauuuugcaugcu

SEQ ID NO: 546651 - RNA, 64 nt, Homo Sapiens
uuagaaaaauuucaacuguaagucacagucuaguagaagaaagaucuuuacugggaagcuggag

SEQ ID NO: 546652 - RNA, 64 nt, Homo Sapiens
ggccaguauucauccugucccuucuaaaauaaagagaagaaaaugugagcugaucauccacuuu

SEQ ID NO: 546653 - RNA, 64 nt, Homo Sapiens
agcagcaagaaauaucucuucuuuucaaagaggaagaagaaaaugcaggccagaagaaaaguug

SEQ ID NO: 546654 - RNA, 64 nt, Homo Sapiens
uugcuuuucaaagaggaagaagaauaugcaggccagaagaaaagauugccagcugucuacacaa

SEQ ID NO: 546655 - RNA, 64 nt, Homo Sapiens
uauaaaaguaaaggaaagaugaugugguccuuccagaagaaagaccaaucuagaauauggaacu

SEQ ID NO: 546656 - RNA, 64 nt, Homo Sapiens
gucucaaaacgugauaauauuuaagcccauuuguagaagaaaucuuguauauacuauuauuaca

SEQ ID NO: 546657 - RNA, 64 nt, Homo Sapiens
aaaagagaagaggagaggacacagagacacacagagaagaaagccauguggcggcagaggcaga

SEQ ID NO: 546658 - RNA, 64 nt, Homo Sapiens
cugauuucagggauacccaggacgcgugaaacacagaagaaacgugaucccauuuucuuuuuuu

SEQ ID NO: 546659 - RNA, 64 nt, Homo Sapiens
acaaacaccucuaugcaaauaaacuagaaaaucuagaagaaauggauaaauuccucaacacgua

SEQ ID NO: 546660 - RNA, 64 nt, Homo Sapiens
acuuacauguuagaccuaaaaccauaaaaacccuagaagaaaaccuaggcaauaccauucagga

SEQ ID NO: 546661 - RNA, 64 nt, Homo Sapiens
uccuugaaagauauaaccccccaagauugaaccaagaagaaauugcaucccugaacagaccaau

SEQ ID NO: 546662 - RNA, 64 nt, Homo Sapiens
cuaucaaacuaccaauggcauuuuucacagaaucagaagaaaacauucugaaauuuauuuggaa

SEQ ID NO: 546663 - RNA, 64 nt, Homo Sapiens
acuuaaauauaaaaccuaaaaguauuaaauuccuagaagaaaacccaggaaaugccauucugga

SEQ ID NO: 546664 - RNA, 64 nt, Homo Sapiens
gaaaaacacagcaugagaacuucgugaagcauacagaagaaaaaccuucagccagauugaaugc

SEQ ID NO: 546665 - RNA, 64 nt, Homo Sapiens
guccaaccuuuugucuucccugggccacauuggaagaagaaaaauugucuugugccacacauac

SEQ ID NO: 546666 - RNA, 64 nt, Homo Sapiens
agacuuaaaaccaaauucagggacaaauggauagagaagaaaagggucaaacaucgagauuaca

SEQ ID NO: 546667 - RNA, 64 nt, Homo Sapiens
gugauggauuggacguugugacucuugccuuuuaagaagaaaaaaaagauaggacaaaguauuu

SEQ ID NO: 546668 - RNA, 54 nt, Homo Sapiens
cuuucagaacagcacauuaguuccagaagaaagauggaaauucugaaaacugaa

SEQ ID NO: 546669 - RNA, 64 nt, Homo Sapiens
ucaagaaaaggagucaagaacaauucacaguaugagaagaaaaauggaaaaaaaaaacuuuauu

SEQ ID NO: 546670 - RNA, 64 nt, Homo Sapiens
uccucuagacacaugaaggcuaguuauaugcuggagaagaaaaauaucacauccauucucaagg

SEQ ID NO: 546671 - RNA, 64 nt, Homo Sapiens
uuuaaaaccaaaccucguuuaggagagccagccaagaagaaaauauaaaggcaacuugcaggag

SEQ ID NO: 546672 - RNA, 64 nt, Homo Sapiens
aaagaaagcaucaugaugaaagaagaaaacgaaaagaagaaacagcugaaauugaaaaagaaaa

SEQ ID NO: 546673 - RNA, 64 nt, Homo Sapiens
gaaaagaagaaacaaaagaaauugaaaaagaaaaagaagaaaacuugagaaguauguugcugaa

SEQ ID NO: 546674 - RNA, 64 nt, Homo Sapiens
gcggcuccacuaccgaccugcuuuuggauacagcagaagaaacaagaaagccgaagaguuagaa

SEQ ID NO: 546675 - RNA, 64 nt, Homo Sapiens
uccuuuagacuaacgaauauuguggggaauaggaagaagaaauugaggagaggggacuggagag

SEQ ID NO: 546676 - RNA, 64 nt, Homo Sapiens
cuucucuuucuaaaaaaaaaaaaaaaaaagaaagagaagaaagaagugauuccuacccccuacc

SEQ ID NO: 546677 - RNA, 64 nt, Homo Sapiens
uaaggggccuacaaaaauguuuuauuuuauaaucagaagaaaaggaaaugaacauuggggauug

SEQ ID NO: 546678 - RNA, 64 nt, Homo Sapiens
uuuuuuuacauuaaaacaaacuaaagcaaaauuuagaagaaagaacuacacauauguaaauacc

SEQ ID NO: 546679 - RNA, 64 nt, Homo Sapiens
uucacuguggaaaagaguauugaguuacaaacugagaagaaaaagcaggaaguucccuaauaau

SEQ ID NO: 546680 - RNA, 64 nt, Homo Sapiens
uaaauguguaagucacccccaccaaaaacaaaagagaagaaaaagaauagaaagaauuauccag

SEQ ID NO: 546681 - RNA, 64 nt, Homo Sapiens
ccacucucuuuccaauuucacuuugguggucugaagaagaaaaagaaauuuuauguauguaugu

SEQ ID NO: 546682 - RNA, 64 nt, Homo Sapiens
uuucacccauuuuuaagcugguuuucuccugauaagaagaaaggaagaaagccccagacgcuug

SEQ ID NO: 546683 - RNA, 64 nt, Homo Sapiens
ugauauuucauggucaguuuauuuuguaagagacagaagaaauuauaucuauacauuaccuugu

SEQ ID NO: 546684 - RNA, 64 nt, Homo Sapiens
cuugaguucucaacugagugagcaucauggagggagaagaaagaaagaaguucagccugggugu

SEQ ID NO: 546685 - RNA, 64 nt, Homo Sapiens
aguugcagguugaacccaaacccauuuuagagacagaagaaacuacccucuggagauaaaauaa

SEQ ID NO: 546686 - RNA, 64 nt, Homo Sapiens
cacacgaacaggugucuuaaacuuaacaaaagcaagaagaaaagaacuuaaacggaugggauuc

SEQ ID NO: 546687 - RNA, 64 nt, Homo Sapiens
aagaggggaagauaugggagcuugagacuuuaaaagaagaaacauagugcuucuuaccugguaa

SEQ ID NO: 546688 - RNA, 64 nt, Homo Sapiens
caccacuauuaaaaaagcugagaagcucuggcugagaagaaaaugggucuuuuuaauuccagug

SEQ ID NO: 546689 - RNA, 64 nt, Homo Sapiens
gcaacucccaaauagguuuucuguuaagccuaucagaagaaagaaguacauuuucuugacuuuu

SEQ ID NO: 546690 - RNA, 64 nt, Homo Sapiens
uucuccugauaauucaagggagcucaaagucacaagaagaaaaaugaaaggaaaaaacagcagc

SEQ ID NO: 546691 - RNA, 64 nt, Homo Sapiens
cuaaauuuuauuggggaccauggaaugguaguugagaagaaaacuauuugcacacaacagauuu

SEQ ID NO: 546692 - RNA, 64 nt, Homo Sapiens; identical to SEQ ID NO: 495003

SEQ ID NO: 546693 - RNA, 64 nt, Homo Sapiens; identical to SEQ ID NO: 495004

SEQ ID NO: 546694 - RNA, 64 nt, Homo Sapiens; identical to SEQ ID NO: 495005

SEQ ID NO: 546695 - RNA, 64 nt, Homo Sapiens; identical to SEQ ID NO: 495006

SEQ ID NO: 546696 - RNA, 64 nt, Homo Sapiens; identical to SEQ ID NO: 495007

SEQ ID NO: 546697 - RNA, 64 nt, Homo Sapiens; identical to SEQ ID NO: 495008

SEQ ID NO: 546698 - RNA, 64 nt, Homo Sapiens; identical to SEQ ID NO: 495009

SEQ ID NO: 546699 - RNA, 64 nt, Homo Sapiens; identical to SEQ ID NO: 495010

SEQ ID NO: 546700 - RNA, 64 nt, Homo Sapiens; identical to SEQ ID NO: 495011

SEQ ID NO: 546701 - RNA, 64 nt, Homo Sapiens; identical to SEQ ID NO: 495012

SEQ ID NO: 546702 - RNA, 64 nt, Homo Sapiens
gggugagucaaaggaacuccaaccaugcucuguccaaaugcaagugaggguucugggggcaacc

SEQ ID NO: 546703 - RNA, 64 nt, Homo Sapiens
caccgcaaaccuaccuuacuguguugaaacgggacaaaugcaauagaacgcauuggguggugug

SEQ ID NO: 546704 - RNA, 64 nt, Homo Sapiens
acugaggcacucuagaaucugccacauucauuuucaaaugcaaaugcagaagacuuaccuuagu

SEQ ID NO: 546705 - RNA, 64 nt, Homo Sapiens
gcacucuagaaucugccacauucauuuucaaaugcaaaugcagaagacuuaccuuaguucaagg

SEQ ID NO: 546706 - RNA, 64 nt, Homo Sapiens
caacaaugagugcuugagaugccagcacuuugggcaaaugcaaaggaacuggccuucggagcca

SEQ ID NO: 546707 - RNA, 64 nt, Homo Sapiens
acuggugacuuaaggagcugggaaucucugcacccaaaugcaggaugcuucgaauuuuuaaaac

SEQ ID NO: 546708 - RNA, 64 nt, Homo Sapiens
caucuggugcuuuucaugugucauuugugagccacaaaugcaaaguugccauuugaauucaguc

SEQ ID NO: 546709 - RNA, 64 nt, Homo Sapiens
aggugggggagaaauugguuagggcucccacugccaaaugcaagcagauagcauaaccugacug

SEQ ID NO: 546710 - RNA, 64 nt, Homo Sapiens
caucccugaguucaugcgauccugacccuggccucaaaugcagcccccugauaagugaggacag

SEQ ID NO: 546711 - RNA, 64 nt, Homo Sapiens
gcaugggcucugguucugccuaaaugugccagcccaaaugcaggauuucucuggcugguuccac

SEQ ID NO: 546712 - RNA, 64 nt, Homo Sapiens
agcaaaaagaugcuugauacaaaacaaaauuaagcaaaugcacaauaaauaacugagaauaauu

SEQ ID NO: 546713 - RNA, 64 nt, Homo Sapiens
uaagaaaauacucauagugaaauaacaauguuuccaaaugcaacguggcaauuaauugccauaa

SEQ ID NO: 546714 - RNA, 64 nt, Homo Sapiens
cugaauacuuggaagaggaccauaaagacuauuccaaaugcaauauuucugaauuuuguauaaa

SEQ ID NO: 546715 - RNA, 64 nt, Homo Sapiens
gaguacaucaacuauuuucagcccaaaaaggugccaaaugcauauaaaucuugauaaacaaagu

SEQ ID NO: 546716 - RNA, 64 nt, Homo Sapiens
gaaauguccugagcaaucaccuaugaacuuguuucaaaugcaugaucaaaugcaaccucacaac

SEQ ID NO: 546717 - RNA, 64 nt, Homo Sapiens
gcaaucaccuaugaacuuguuucaaaugcaugaucaaaugcaaccucacaaccuuggcugaguc

SEQ ID NO: 546718 - RNA, 64 nt, Homo Sapiens
ucacccuuuuuagugucuagucugugaauuuugacaaaugcaugguuuuguaaccaaucgauag

SEQ ID NO: 546719 - RNA, 64 nt, Homo Sapiens
aaucuacuuuuugguguacaguucugaguuuuggcaaaugcagucaagucacuaccaccaccac

SEQ ID NO: 546720 - RNA, 64 nt, Homo Sapiens
aauacaauaccccuuccaagucaaaugcauaccacaaaugcaauauuaauguacuuaaacuauu

SEQ ID NO: 546721 - RNA, 64 nt, Homo Sapiens
ccacaaaugcaauaauacaauacuuaaacuauuucaaaugcauauucuuacaaauucauuaaug

SEQ ID NO: 546722 - RNA, 64 nt, Homo Sapiens
cacauaaaggcaguguacugagcagagacuaauacaaaugcagccauacauuuuugguuuucua

SEQ ID NO: 546723 - RNA, 64 nt, Homo Sapiens
gccuuucagagaugcauugugauuacucugccuccaaaugcagguaaaaacuaucaucuuugca

SEQ ID NO: 546724 - RNA, 64 nt, Homo Sapiens
agcuuuucuguucgaugcacgggcaauuccuuaccaaaugcagaguauaaccaagcauccuuuu

SEQ ID NO: 546725 - RNA, 64 nt, Homo Sapiens
acuuuuuuuuugaaaugaaaugagucucuugagacaaaugcaaaugaaaacugaucuuccuauu

SEQ ID NO: 546726 - RNA, 64 nt, Homo Sapiens
ucaucagaacucaaauuuaaacaaaauuguauuacaaaugcauuucucuuauuaaaaauuuuua

SEQ ID NO: 546727 - RNA, 64 nt, Homo Sapiens
cuacugcgggacagucaguaauagaaaagugucucaaaugcauuaacacagccccuuaucccag

SEQ ID NO: 546728 - RNA, 64 nt, Homo Sapiens
cacccacguggggugugccaggcacccccagauacaaaugcagccacgcacagacguaacacac

SEQ ID NO: 546729 - RNA, 64 nt, Homo Sapiens
uaaaagcugaucuguauguagggcagaaguguggcaaaugcaucaggaaccgguuagaacagaa

SEQ ID NO: 546730 - RNA, 64 nt, Homo Sapiens
aauuuggcugaggagcagcuaagcauccagaccacaaaugcagggcccucagcaugacucugcc

SEQ ID NO: 546731 - RNA, 64 nt, Homo Sapiens
gagggaggccagugucagggacuuuaccuucugccaaaugcagagcuggacuggacucuuguuc

SEQ ID NO: 546732 - RNA, 64 nt, Homo Sapiens
ccuuugugacuuccuuuggauggauuuaaauguccaaaugcaaauauuguuucuccugauuuug

SEQ ID NO: 546733 - RNA, 64 nt, Homo Sapiens
uuugugaaaauggggugugaauccuacaaccagccaaaugcacuguuuccccaccuaauaauau

SEQ ID NO: 546734 - RNA, 64 nt, Homo Sapiens
ugcaagaaccuaacuaacgugaugauaugaagaguuuucuuaagaccugucgucaaacuuaaaa

SEQ ID NO: 546735 - RNA, 64 nt, Homo Sapiens
uuuuauuuaaguauagguacugcuaaugaaucuguuuucuuagugaguaaauuugcauaauuuu

SEQ ID NO: 546736 - RNA, 64 nt, Homo Sapiens
uguuagccaugucuauuguuuuuccucuggauucuuuucuuauaacuuggaauacacaaaagug

SEQ ID NO: 546737 - RNA, 64 nt, Homo Sapiens
ugucuuguuucuuguuuuuuuuucuuguaguuucuuuucuuaauugucauuuuugcaacaaaaa

SEQ ID NO: 546738 - RNA, 64 nt, Homo Sapiens
ugugugauuagaacuuagaauauagucaacuaucuuuucuuauuuauuuuacuaaagccauuuu

SEQ ID NO: 546739 - RNA, 64 nt, Homo Sapiens
aauccugcaaaucucugcccaauuauacuuuaucuuuucuuaauguguuuugaaaaggccacac

SEQ ID NO: 546740 - RNA, 64 nt, Homo Sapiens
cuccccucaugguguuccccccuuuuccuucuccuuuucuuacuguguuggucacuggaaagag

SEQ ID NO: 546741 - RNA, 64 nt, Homo Sapiens
cgcuuccguggauggaugaauuuccaucccacccuuuucuuaaucuaauauuguuggguuaauu

SEQ ID NO: 546742 - RNA, 64 nt, Homo Sapiens
uaagacaagaauauguucacauacaaccugagccuuuucuuauauuuaauucaaaguuuguggc

SEQ ID NO: 546743 - RNA, 64 nt, Homo Sapiens
caaguaaagaugucaauagguuauauuaauuuguuuuucuuaucuucaucccuauuuauaguuu

SEQ ID NO: 546744 - RNA, 64 nt, Homo Sapiens
uauucauuuugagacugucaagaugccacuacuuuuuucuuaaaugcaaaacgucuauauuuuu

SEQ ID NO: 546745 - RNA, 64 nt, Homo Sapiens
guguuuucagucacuuccuuauaccugugcuccuuuuucuuacucauugcauuuuucccugccu

SEQ ID NO: 546746 - RNA, 64 nt, Homo Sapiens
cugagacucccuucccuugugcccauuucuccaguuuucuuaaucauccucauccuacugacau

SEQ ID NO: 546747 - RNA, 64 nt, Homo Sapiens
uuggguagaguccagccuaggcucuuguuagauguuuucuuacagagucacuguucagaauuuu

SEQ ID NO: 546748 - RNA, 64 nt, Homo Sapiens
auccuuuuugucccaucucuaggaaagaagacauuuuucuuaauauggcugcuuuugaaugggg

SEQ ID NO: 546749 - RNA, 64 nt, Homo Sapiens
cugaaaaaaacagcaguagucaauuuugucaguauuuucuuaguauugaaaggagaaaaaaauc

SEQ ID NO: 546750 - RNA, 64 nt, Homo Sapiens
uaaaauuacuuuuuacuuuaaucugguacuucauuuuucuuaacuaaaauauauguuacaguuu

SEQ ID NO: 546751 - RNA, 64 nt, Homo Sapiens
ugcccuuaauauuuugacauaaccucauagucauuuuucuuaaucauacuuaaacugggauuaa

SEQ ID NO: 546752 - RNA, 64 nt, Homo Sapiens
ucaucaggcuuuuagcgacaaggaacacacacauuuuucuuaaaggcccaauccuaacagacuc

SEQ ID NO: 546753 - RNA, 64 nt, Homo Sapiens
uuucucacacucaguauugcaugcuuagugcugguuuucuuacaacauuuuggcagguguagcu

SEQ ID NO: 546754 - RNA, 64 nt, Homo Sapiens
aaaaucacuuuaagaucuuuucgaagcuguuaauuuuucuuaguguuguggacacugcagacuu

SEQ ID NO: 546755 - RNA, 64 nt, Homo Sapiens
ggggucgggggguggggcggggaagugcucuaacuuuucuuaagguuuuguugcuagcccuuca

SEQ ID NO: 546756 - RNA, 64 nt, Homo Sapiens
cuucauuccagagcuaugcuugugauacagccccuuuucuuauaaagucaguuagaaggacuuc

SEQ ID NO: 546757 - RNA, 64 nt, Homo Sapiens
uauaucuucuucugcaagaccuggggcuauuuuuuuuucuuaagguaugaaaucaauuucaaua

SEQ ID NO: 546758 - RNA, 64 nt, Homo Sapiens
cuuugacacguaguaauucugugacauacuuuuuuuuucuuauagcaauacacuguaauaucag

SEQ ID NO: 546759 - RNA, 64 nt, Homo Sapiens
guuuagaacauaugaacugaaugaaauggacauuuuuucuuaauuuauguauaaauccauauga

SEQ ID NO: 546760 - RNA, 64 nt, Homo Sapiens
acaugcaacugaaaaugucucaccuuucaucuuuuuuucuuaauucauaaaguuaucuuguaga

SEQ ID NO: 546761 - RNA, 64 nt, Homo Sapiens
uggugucucacaauggauuucuguugcuugacuauuuucuuagugaauauuuauacuaagguag

SEQ ID NO: 546762 - RNA, 64 nt, Homo Sapiens
gcuuaguguuaacggggacuuaaauaugauuuuuuuuucuuacucauuucaccuucccuguacu

SEQ ID NO: 546763 - RNA, 64 nt, Homo Sapiens
uuuauuuuuuauuuucaggaaaguuauacuaguauuuucuuaaguguggaaucaaaugagcaca

SEQ ID NO: 546764 - RNA, 64 nt, Homo Sapiens
uuucuaauuuugcagaucuuuacauuuuuauugcuuuucuuaaaauaagggauagcuuugcaac

SEQ ID NO: 546765 - RNA, 64 nt, Homo Sapiens
uuaauuuuguaaauuuggauuuuuauauaucauauuuucuuaauucauuguacacauuugacuu

SEQ ID NO: 546766 - RNA, 64 nt, Homo Sapiens
uuuuucacuuucuaugccauuauuuuuguauucuuuuucuuagugugagcucuaaaaucaaugu

SEQ ID NO: 546767 - RNA, 64 nt, Homo Sapiens
agagagaggugacgaaggaauuuaagcuuauucuuuuucuuaaagagguuugguaaugugauau

SEQ ID NO: 546768 - RNA, 64 nt, Homo Sapiens
guaugucaaaugacuacaaucaguauuugaaggguuuucuuaaauuaaaaugcaauaaacaucu

SEQ ID NO: 546769 - RNA, 64 nt, Homo Sapiens
ugccuagaaaaagcgcacugaggcauugaaggguuuuucuuagaauugguuuaacaaaccauag

SEQ ID NO: 546770 - RNA, 64 nt, Homo Sapiens
ccuucacuuuaauacaauagacugguuuuguauuuuuucuuaaucuuuuuuagccuaagcaaua

SEQ ID NO: 546771 - RNA, 64 nt, Homo Sapiens
aaaucaaaaaaugcauugauauaucacaguuuuauuuucuuauguuuuuaguaguuccaauuuu

SEQ ID NO: 546772 - RNA, 64 nt, Homo Sapiens
gcaaaaauaauguaaauaaguguugcuuaagaaguuuucuuauguuuuuaacuugagagcugac

SEQ ID NO: 546773 - RNA, 64 nt, Homo Sapiens
gccaauuauuuugaugcaaauguugauacuuuuuuuuucuuaaauuugguuagcagacugcaug

SEQ ID NO: 546774 - RNA, 64 nt, Homo Sapiens
acuaugaaauggauggaauauguaaaauucuuuuuuuucuuauuaaaauuuaccuaaaucucaa

SEQ ID NO: 546775 - RNA, 64 nt, Homo Sapiens
gacuuuaagaccuuuauauuugaaauauccaucuuuuucuuauguggccauuuguaauuauuuc

SEQ ID NO: 546776 - RNA, 64 nt, Homo Sapiens
aggggaacuggagaaaccuuggcuggucuuucaauuuucuuaaguguuucccuuugauucuuuu

SEQ ID NO: 546777 - RNA, 64 nt, Homo Sapiens
aaaauucacuaaucuugaauuucuucuaguauuuuuuucuuaccugaaaagguguccuuuuccu

SEQ ID NO: 546778 - RNA, 64 nt, Homo Sapiens
uaaugauacuguguguuuuccuuccuuaaaugacuuuucuuaaguccacuugaagcacuuaagu

SEQ ID NO: 546779 - RNA, 64 nt, Homo Sapiens
uauaucuuuauguagcacuauauuccaagugcauuuuucuuauuaaaagcagcuaaauguaacu

SEQ ID NO: 546780 - RNA, 64 nt, Homo Sapiens
guaauaugcauaaaguaaaucaaauagcguugaguuuucuuaugcauuuugaugugaaagaugu

SEQ ID NO: 546781 - RNA, 64 nt, Homo Sapiens
cggcccaauaacucuuuguguuuauggaguguuguuuucuuagaauaauggagaugcagauaua

SEQ ID NO: 546782 - RNA, 64 nt, Homo Sapiens
agucaaauuauauuacccaucuacaugguuuucuuuuucuuaguaugggaguguccaugaauaa

SEQ ID NO: 546783 - RNA, 64 nt, Homo Sapiens
aacuguguccaauaucguucaguuuccugggucuuuuucuuauuagcacauuugagaaaaauau

SEQ ID NO: 546784 - RNA, 64 nt, Homo Sapiens
caguaggaggcagugugagcuuuuuauuuuuuauuuuucuuaagguggucuuaguaauauaaca

SEQ ID NO: 546785 - RNA, 64 nt, Homo Sapiens
gcaaaauugagagaaauuaggaacacugcuauuuuuuucuuaaaaauguuuuuaagaauauguu

SEQ ID NO: 546786 - RNA, 64 nt, Homo Sapiens
aucugaaaacucacaaccaagaaaauccauucuauuuucuuaucuuggacuggagucaccuauu

SEQ ID NO: 546787 - RNA, 64 nt, Homo Sapiens
gacuaaauucagugaaggaaaggaauugagagauuuuucuuaguaaauagauuauuguuaagua

SEQ ID NO: 546788 - RNA, 64 nt, Homo Sapiens
uauguuugucucacuuuucaucugguugaauggcuuuucuuagugugguauuugcugucacaua

SEQ ID NO: 546789 - RNA, 64 nt, Homo Sapiens
uauagcuuuuaagagcuuccuuugaccacugucuuuuucuuacccuaguucucuuaucuuugau

SEQ ID NO: 546790 - RNA, 64 nt, Homo Sapiens
cuucgacuuauccugagguccauggaaugauuucuuuucuuaacgcauuuuuuuuucuuugcuu

SEQ ID NO: 546791 - RNA, 64 nt, Homo Sapiens
gaaaauggaccugccuuucagacugauuuuguuuuuuucuuacuuguggauuuuucucugaauu

SEQ ID NO: 546792 - RNA, 64 nt, Homo Sapiens
cauagagaugacuguagaacuucacuaacuggcguuuucuuagcucuguagauguccaucgugu

SEQ ID NO: 546793 - RNA, 64 nt, Homo Sapiens
ucucuguucaucaguggcaaugcuuucagucuacuuuucuuaaaaauagaaggauguggagaaa

SEQ ID NO: 546794 - RNA, 64 nt, Homo Sapiens
ucauucugcagaauggaaaccagcaauguuucucuuuucuuaguuauucaaaacucagaagcau

SEQ ID NO: 546795 - RNA, 64 nt, Homo Sapiens
gauacuugguuaguaaauuaaaaauauccuguuauuuucuuagggguuggcuugaacauaaaug

SEQ ID NO: 546796 - RNA, 64 nt, Homo Sapiens
uuuuguauuaauugguaaguauguauuuaaagcuuuuucuuauucauauaaaauuuuauaaaau

SEQ ID NO: 546797 - RNA, 64 nt, Homo Sapiens
ugaaggaccuuauuuggcauugauauuauuuuccuuuucuuauauaaauaauaguacugaaaau

SEQ ID NO: 546798 - RNA, 64 nt, Homo Sapiens
uucauaauaaucugcacuguuccuaaaaauuauguuuucuuagugagugauaaauaacauuuuu

SEQ ID NO: 546799 - RNA, 64 nt, Homo Sapiens
gcagauacgaugacauaagguuuugaagaaguguuuuucuuaaacaguuuuucauaguguagga

SEQ ID NO: 546800 - RNA, 64 nt, Homo Sapiens
guguaaauuuaaaaaggggaaauacuuuaauuuuuuuucuuaauaguguaaaaauucccugagc

SEQ ID NO: 546801 - RNA, 64 nt, Homo Sapiens
augucuugucccaguucuucaaacacucuuaaauuuuucuuaaguaauguaaaaauggaacugc

SEQ ID NO: 546802 - RNA, 64 nt, Homo Sapiens
uuuaaaaaaccaguuggaaauauagguuggguuuuuuucuuauuguuuucuccccaggguuaga

SEQ ID NO: 546803 - RNA, 64 nt, Homo Sapiens
aaaaaugaugcaguacccauuuuucguauccugcuuuucuuauauuggaguaaaaaggacaggg

SEQ ID NO: 546804 - RNA, 64 nt, Homo Sapiens
aaauauuuuguuaacuuuuguuuuuuuuuguuuguuuucuuaaaaguaccucugcauugagcau

SEQ ID NO: 546805 - RNA, 64 nt, Homo Sapiens
uuguuuucuuaaaaguaccucugcauugagcauauuuucuuacuuuuauuauuuuaauuaauau

SEQ ID NO: 546806 - RNA, 64 nt, Homo Sapiens
uuaaacauguuuaaaguguacuuauaaacuauuuuuuucuuaaagcaaacuaugauuuauuuug

SEQ ID NO: 546807 - RNA, 64 nt, Homo Sapiens
uaucaaaagacagcacuacagaauacuugguuucuuuucuuacucuggauuguugacaugagug

SEQ ID NO: 546808 - RNA, 64 nt, Homo Sapiens
caagaauauucaaauguaaucaaaacugcuaaauuuuucuuaauuguaaaugcagccuucuuuu

SEQ ID NO: 546809 - RNA, 64 nt, Homo Sapiens
gagauauuucuuacagaaagguuaaugagauguauuuucuuauaguaauuuauuuacaggaaau

SEQ ID NO: 546810 - RNA, 64 nt, Homo Sapiens
uccacccuuuuaaaaauuaugguuucugcaauauuuuucuuaugaauuauuauauuuacaauuu

SEQ ID NO: 546811 - RNA, 64 nt, Homo Sapiens
cuuuguaucucuaggaacgacagucacaaucuacuuuucuuaaaaauaacaagagaucguguua

SEQ ID NO: 546812 - RNA, 64 nt, Homo Sapiens
guauaguuacaaaaugggaagagauuuaaaacuauuuucuuauagcacaguaaaccaauaguuu

SEQ ID NO: 546813 - RNA, 64 nt, Homo Sapiens
ucuacaggcauuaccuaggugugagacuaaaagcuuuucuuauugacuuaaauuuggauaacag

SEQ ID NO: 546814 - RNA, 64 nt, Homo Sapiens
guuucucaguuaauacauagcuaauagcucuuauuuuucuuauguuuuuaaccgcuuaggucua

SEQ ID NO: 546815 - RNA, 64 nt, Homo Sapiens
cuuugcguauuaugcuuaacuucacaaguuaacuuuuucuuauuuuguauccugaugaggcauu

SEQ ID NO: 546816 - RNA, 64 nt, Homo Sapiens
acaggcaugagccaccgcacccagccuacaauaauuuucuuaaacuuuaccuuuuauuuuaaag

SEQ ID NO: 546817 - RNA, 64 nt, Homo Sapiens
cuggaaaccaagaggauccaaacuuccugcaacauuuucuuagaggagagagagaaauauuaaa

SEQ ID NO: 546818 - RNA, 64 nt, Homo Sapiens
cauuuuuuaauauaaauaauuuuaauaaauuuuauuuucuuauauucugcuuuuuauacauuuc

SEQ ID NO: 546819 - RNA, 64 nt, Homo Sapiens
ugacuuucagucaccuuuacauaauuuauaaauguuuucuuaacugugccuuuucuuagguaua

SEQ ID NO: 546820 - RNA, 64 nt, Homo Sapiens
uauaauaauuuauaaauguuaggcuuuuugugccuuuucuuaggaaucaauaaaaauaaguaaa

SEQ ID NO: 546821 - RNA, 64 nt, Homo Sapiens
cauagcuuuuaauggggaaagccuccacuauuuuuuuucuuagaauuuagaaguuuuaaauaau

SEQ ID NO: 546822 - RNA, 64 nt, Homo Sapiens
uguacuuccaaagcacuuucgcuagaagugucacuuuucuuauccauucuucccugauucucag

SEQ ID NO: 546823 - RNA, 64 nt, Homo Sapiens
aaauguuugagcuaauauaauuuauggaauucgguuuucuuaauuaacuuaaugucuguguuua

SEQ ID NO: 546824 - RNA, 64 nt, Homo Sapiens
cacaacugugugagaguguauuaucuuauuuucauuuucuuaagauaacgcuuuuauuuuuauu

SEQ ID NO: 546825 - RNA, 64 nt, Homo Sapiens
uuugguaauuauuaaagucuagaucauuucauuauuuucuuaaugcaguuauuuuaaaaacuac

SEQ ID NO: 546826 - RNA, 64 nt, Homo Sapiens
aauuaaagauuaugaaagccagugagcuggcuuuuuuucuuagagcaguugucauuuguuccca

SEQ ID NO: 546827 - RNA, 64 nt, Homo Sapiens
auugugcaggcuggaugagaauuuuuguaauuaauuuucuuagacugaauuuacagguaugaua

SEQ ID NO: 546828 - RNA, 64 nt, Homo Sapiens
cauaaaucugacaggcauaauuaaaaauagucauuuuucuuauuaagacaaauggauuauagac

SEQ ID NO: 546829 - RNA, 64 nt, Homo Sapiens
uuuguuacaaacuuaauuuuaacucaaaacacuguuuucuuaugugcagcaguuggucaacuuc

SEQ ID NO: 546830 - RNA, 64 nt, Homo Sapiens
cuuaacguucugauaguagcauugcauagugacauuuucuuagcuagaggaggagaugguuuuc

SEQ ID NO: 546831 - RNA, 64 nt, Homo Sapiens
ccccacuuguauauccccuauugcuuaauuucuuuuuucuuauugauccuugaguaaagacauu

SEQ ID NO: 546832 - RNA, 64 nt, Homo Sapiens
uagcuaauauuaacaauuuaugacucaugcaugguuuucuuaacuacccauguuuugcaugcaa

SEQ ID NO: 546833 - RNA, 64 nt, Homo Sapiens
gaaugacugaaaauuugaaauucuucuguugccuuuuucuuacaaggaaaaucuucauacugaa

SEQ ID NO: 546834 - RNA, 64 nt, Homo Sapiens
gaaguaguagugugcccugaaaaauguacacguuuuuucuuauuguuaccacauguucaccuuu

SEQ ID NO: 546835 - RNA, 64 nt, Homo Sapiens
aauaucagaugccuuguaaauuaugucuuuaacguuuucuuauagacuaauuuccucuuuucca

SEQ ID NO: 546836 - RNA, 64 nt, Homo Sapiens
agauguucaguaccuuaugauacagggaagauaguuuucuuacaaguaguuugguaauauuuuu

SEQ ID NO: 546837 - RNA, 64 nt, Homo Sapiens
gauaguuuucuuacaaguaguuugguaauauuuuuuuucuuaaguuguacauuugacucagcug

SEQ ID NO: 546838 - RNA, 64 nt, Homo Sapiens
ucugggucuuaggauuuuaaaagugaagggauauuuuucuuauauuugugaguucaguuccgau

SEQ ID NO: 546839 - RNA, 64 nt, Homo Sapiens
gggagagcacaagacuaacuuuggucucuugaccuuuucuuaccuugcaacugucagugccucc

SEQ ID NO: 546840 - RNA, 64 nt, Homo Sapiens
aggaggcaacuuuccgucuguugagauuaagaaauuuucuuacccaugcucccugaaagccuuu

SEQ ID NO: 546841 - RNA, 64 nt, Homo Sapiens
uucggauccaaguuugucuuuuuacuucuuuccuuuuucuuaagugcacucucuuuuacauuuu

SEQ ID NO: 546842 - RNA, 64 nt, Homo Sapiens
aggucauugguuugauuuuuaagugauccucugcuuuucuuaguuucuuggacuguuguuagaa

SEQ ID NO: 546843 - RNA, 64 nt, Homo Sapiens
caacagcauuuuguauauauacugggucccauuauuuucuuaaauaaaauuauuuuauucuaaa

SEQ ID NO: 546844 - RNA, 64 nt, Homo Sapiens
aaaauaagagacccuccaacuguucuuaaggcucuuuucuuacaacaguacaguaacauuuggu

SEQ ID NO: 546845 - RNA, 64 nt, Homo Sapiens
ugaaguuguaacuucgguauuugggucaaaccuauuuucuuaaauuugccacuugcacugaguu

SEQ ID NO: 546846 - RNA, 64 nt, Homo Sapiens
caacacaguuguuaccacaauucuauuuucuuauuuuucuuagggaacugggcagaaugguuug

SEQ ID NO: 546847 - RNA, 64 nt, Homo Sapiens
uuucuuaggcaacacaguugaaugguuuguucuauuuucuuauuauuuugguugaacugggcag

SEQ ID NO: 546848 - RNA, 64 nt, Homo Sapiens
cuagguuuauagagugauguuuaguuaaggugcauuuucuuacuuguccgagaggcuuuggugc

SEQ ID NO: 546849 - RNA, 64 nt, Homo Sapiens
guuaaaguuuuuauauguugucccuacucuuaauuuuucuuauuuaccuuaaaauuaucugcuu

SEQ ID NO: 546850 - RNA, 64 nt, Homo Sapiens
auaagaucacucauaaaacagagguaauguguacuuuucuuaugaugaugcaagggaauuaaga

SEQ ID NO: 546851 - RNA, 64 nt, Homo Sapiens
augaugaaagaaagguugguauuaucaggaaauguuuucuuaagcuuuuccuuucucuuacacc

SEQ ID NO: 546852 - RNA, 64 nt, Homo Sapiens
ugguuguucuguuagucgcuaacuuaguaagugcuuuucuuauagaaccccuucugacugagca

SEQ ID NO: 546853 - RNA, 64 nt, Homo Sapiens
ccagauaaacacacagccuuucccauaccuuuuuuuuucuuacuauaaaauauuauaagaucca

SEQ ID NO: 546854 - RNA, 64 nt, Homo Sapiens
uugcuaaugcccaguuuucuucuccauuuccacuuuuucuuaggcucccuauuuacuauucauu

SEQ ID NO: 546855 - RNA, 64 nt, Homo Sapiens
ucagcugcuaauagccuaagauuuauuuuuuuuuuuuucuuaagccuauggaaccggcuuugcu

SEQ ID NO: 546856 - RNA, 64 nt, Homo Sapiens
gugaacuaaugaaaauaacagcguauuuucaauauuuucuuauuccuuaaauuccacucuuuua

SEQ ID NO: 546857 - RNA, 64 nt, Homo Sapiens
guuuaguugcuuuauuuuaccucuaugugauuauuuuucuuaauuguuauuuuuuauaaucauu

SEQ ID NO: 546858 - RNA, 64 nt, Homo Sapiens
gcucccucaaaaagggaggggacagauggggagcuuuucuuaccuauucaaggaauacgugccu

SEQ ID NO: 546859 - RNA, 64 nt, Homo Sapiens
gagcuuuucuuaccuauucaaggaauacgugccuuuuucuuaaaugcuuucauuuauugaaaaa

SEQ ID NO: 546860 - RNA, 64 nt, Homo Sapiens
auacuuuccaguuaaauauauauauauauauauuuuuucuuacuuuaucuuuuaagaauuaaug

SEQ ID NO: 546861 - RNA, 64 nt, Homo Sapiens
acuauuaaaaaaaaaacacccuuccuaacccuucuuuucuuaaaauuccacauucauccacaau

SEQ ID NO: 546862 - RNA, 64 nt, Homo Sapiens
aaacauuuuggaauugguuauuagaaugucacauuuuucuuagaaaaacugaaauagccucccu

SEQ ID NO: 546863 - RNA, 64 nt, Homo Sapiens
cuuaaauguuguauuucauaucauuaaauacugauuuucuuaaaccaaaaaauaauaagagcau

SEQ ID NO: 546864 - RNA, 64 nt, Homo Sapiens
uuuuuaguugucuagaacauucuaaaauguguuuuuuucuuagcauuuuuaaagauaaagaaua

SEQ ID NO: 546865 - RNA, 64 nt, Homo Sapiens
acagauauuuacugagaggaccccuugacuuugcuuuucuuaaugaugaauucuagugaaauga

SEQ ID NO: 546866 - RNA, 64 nt, Homo Sapiens
ccgugacugagggaaacauuaguuaggaaaguuuuuuucuuacauaaagaagaaugauggguac

SEQ ID NO: 546867 - RNA, 64 nt, Homo Sapiens
caaccuaauuacaucaggaucccguggccuuuaauuuucuuaauuguggaaguuaguuuucugg

SEQ ID NO: 546868 - RNA, 64 nt, Homo Sapiens
gucuuaauuuuauuauauuuuaccauuuacucuguuuucuuauauuuuagucauuauugaauua

SEQ ID NO: 546869 - RNA, 64 nt, Homo Sapiens
gaagaaaaagacauugguuguuaauuuauucuuuuuuucuuaaaauauaauuugccaaagguaa

SEQ ID NO: 546870 - RNA, 64 nt, Homo Sapiens
agauugguggucccaaugucgugaagaguuacauuuuucuuaaaggguuuuugucaaauagcau

SEQ ID NO: 546871 - RNA, 64 nt, Homo Sapiens
aaaaaaucuaguauagcacuuuucuguaccuaaauuuucuuaaaacuauuuucauacccuacuu

SEQ ID NO: 546872 - RNA, 64 nt, Homo Sapiens
ccuaauggaauaagcuauucauuuaugauauauauuuucuuauauuuuguuucauugguuagua

SEQ ID NO: 546873 - RNA, 64 nt, Homo Sapiens
gcugcauaguauuccaugguguauaugugccacauuuucuuaauccagucuauuguuguuggac

SEQ ID NO: 546874 - RNA, 64 nt, Homo Sapiens
gaaauagcuucaaaagcacuuguguaucuugauuuuuucuuauaugcuguugcagauauaugua

SEQ ID NO: 546875 - RNA, 64 nt, Homo Sapiens
uuugcauuuguauguagcuguauguuuccguccauuuucuuaauccugaaccuguauguuaaau

SEQ ID NO: 546876 - RNA, 64 nt, Homo Sapiens
aauuugcuauauugcacagaacauuuuuacaguguuuucuuaucagaugguauuuuaaacaggu

SEQ ID NO: 546877 - RNA, 64 nt, Homo Sapiens
cauuuguggaauauagugauugcuugugcuuuauuuuucuuaguguguauuuuugccuauuugu

SEQ ID NO: 546878 - RNA, 64 nt, Homo Sapiens
agcuucuaaauggauuaauacucaaggguuuaaauuuucuuacuuauaaaaaguuugugaauaa

SEQ ID NO: 546879 - RNA, 64 nt, Homo Sapiens
cugguauaccacaaaugauucuguaucauguguauuuucuuauuuaucuauugguuccauaacu

SEQ ID NO: 546880 - RNA, 64 nt, Homo Sapiens
uauagguuauuuuauagagacagagaaugguauguuuucuuaacgcuuuguuuuauuuugcuuu

SEQ ID NO: 546881 - RNA, 64 nt, Homo Sapiens
uuuuuggcuuaguauguugaaaauaaauuaguuguuuucuuauuacagaauuuguuuuuuuuuc

SEQ ID NO: 546882 - RNA, 64 nt, Homo Sapiens
acuaagcuggccccagccuuuauacaauaauaguuuuucuuacauggguuuugcuguccaauua

SEQ ID NO: 546883 - RNA, 64 nt, Homo Sapiens
aaacugaagagucucaguaucugaggaaauacauuuuucuuaauguauauauauuuuaaaaugc

SEQ ID NO: 546884 - RNA, 64 nt, Homo Sapiens
aaaaagaauaacagaaugcaacaacaauauuuaauuuucuuaguaagagaggagauucccccaa

SEQ ID NO: 546885 - RNA, 64 nt, Homo Sapiens
aaaauggaauccacuguguuuuguuuucuauuuuuuuucuuaauuaagacaauuuaaggacuac

SEQ ID NO: 546886 - RNA, 64 nt, Homo Sapiens
ugagcaaauauuuuauugaacagacaaauuucuauuuucuuaccgaacguaugcuaaaugaaag

SEQ ID NO: 546887 - RNA, 64 nt, Homo Sapiens
guuauuacacuuaaagcaacauuuuuauugggaauuuucuuaggugugacacuuaagaacagug

SEQ ID NO: 546888 - RNA, 64 nt, Homo Sapiens
uuuuuuguuauuucuaagcaaaccucuuuuguacuuuucuuacuucuaauauccaucccuggac

SEQ ID NO: 546889 - RNA, 64 nt, Homo Sapiens
ccacuaccaccaccaccucuugcccccuucccucuuuucuuaaacuucuggcauuucagagcuc

SEQ ID NO: 546890 - RNA, 64 nt, Homo Sapiens
uggccuucugaugauucuuaaagaguuuucaauuuuuucuuaugugaagaguugacacugaaau

SEQ ID NO: 546891 - RNA, 64 nt, Homo Sapiens
aaccauuguuguugaguguaagauguccuucauguuuucuuauaaagucaguguuuagaaaugu

SEQ ID NO: 546892 - RNA, 64 nt, Homo Sapiens
aaaaggauuuuaaaacuugaacugugcauaugucuuuucuuagcgguaugcaaccacugcaauc

SEQ ID NO: 546893 - RNA, 64 nt, Homo Sapiens
cgugaaaauucggagagugcucuuuaaauuaugguuuucuuauugugaaauagguuagaauuuu

SEQ ID NO: 546894 - RNA, 64 nt, Homo Sapiens
ggacagaaucccaucuuuuccaucucguaaucacuuuucuuaggauauauuugucuuugcuggg

SEQ ID NO: 546895 - RNA, 54 nt, Homo Sapiens
agcaccacccaacaacuucugccuuuuucuuacaagcugguccucaucguauga

SEQ ID NO: 546896 - RNA, 64 nt, Homo Sapiens
uguucuugugcaaucgacaaugcuuaccugcugauuuucuuaaccuguuccaucuuugcacugu

SEQ ID NO: 546897 - RNA, 64 nt, Homo Sapiens
gagauuugcuucugucuuaguguguggguggcauuuuucuuaacguuuuggauaaauuuccugu

SEQ ID NO: 546898 - RNA, 64 nt, Homo Sapiens
cagaaauaaaacauacuaccuugaugugacauuuuuuucuuaaccuuguugagcugguuuuguu

SEQ ID NO: 546899 - RNA, 64 nt, Homo Sapiens
caggguugacacagcagggcuaguccugcauauuuuuucuuaaauauuucccaauuguguuuuu

SEQ ID NO: 546900 - RNA, 64 nt, Homo Sapiens
aaucaagugcagcugaacuggaacauaaaagauuuuuucuuaacuuuuuuuuuuuaacacacua

SEQ ID NO: 546901 - RNA, 64 nt, Homo Sapiens
uuggaaaguaguuguuuaacuuuguuuuaagccguuuucuuagugauucuguaucaaguagagg

SEQ ID NO: 546902 - RNA, 64 nt, Homo Sapiens
aggguuuauuuuccacucaugcccuuaugccuuuuuuucuuauaguuuuuuaacuuauugacug

SEQ ID NO: 546903 - RNA, 64 nt, Homo Sapiens
uaguuugaaaauaaaauucuagauaugcaaaugauuuucuuagaaaacuucacaaaauaaaaga

SEQ ID NO: 546904 - RNA, 64 nt, Homo Sapiens
ucauucgggugguaacaauguauguguaauauuuuuuucuuagugauuuugacaguuuaaaugu

SEQ ID NO: 546905 - RNA, 64 nt, Homo Sapiens
aaauuauuugguaggaaauuuuugggagaucugauuuucuuauccaaguuuuguaaauaguugu

SEQ ID NO: 546906 - RNA, 64 nt, Homo Sapiens
auucaugcauaucauugaaaauuucucguuuucauuuucuuagaugacuucuugucugagacag

SEQ ID NO: 546907 - RNA, 64 nt, Homo Sapiens
uuauugcacugguuagcaacaauugcuuuaccuuuuuucuuaccggcaauacuugcuucuuccc

SEQ ID NO: 546908 - RNA, 64 nt, Homo Sapiens
gauuuuuaaguuauuuuuacuaguuagccaauauuuuucuuacuuuuuuguauuuuguuuaaau

SEQ ID NO: 546909 - RNA, 64 nt, Homo Sapiens
ggagaaauaugguauauguuguacaguucucaguuuuucuuauaaaacaaauuuugccuucaug

SEQ ID NO: 546910 - RNA, 64 nt, Homo Sapiens
acgugcaacaucuuaauuuuacacugagucacucuuuucuuaacugguuucacuuugcagugga

SEQ ID NO: 546911 - RNA, 64 nt, Homo Sapiens
aagccaaaauguuuguuuuuuuuuuuaaaagucuuuuucuuagacagugaugagggaauugauu

SEQ ID NO: 546912 - RNA, 64 nt, Homo Sapiens
gcuaauaccuugccucuuauaggaauuuugcuguuuuucuuaguaaugacagaugauuuuguuc

SEQ ID NO: 546913 - RNA, 64 nt, Homo Sapiens
agaagcugugaucgacuuagguuuuauaggucauuuuucuuaauuguuuucccuugcuuuaggg

SEQ ID NO: 546914 - RNA, 64 nt, Homo Sapiens
aagaaaaugaaaucccuuacauauuugacuuuuuuuuucuuauuuuugcguagguuucuauuaa

SEQ ID NO: 546915 - RNA, 64 nt, Homo Sapiens
uaaguaagaguagauacauuguacccauuuuacauuuucuuauuuuaacuacaguaaucuacau

SEQ ID NO: 546916 - RNA, 64 nt, Homo Sapiens
uauuuuuuguuuuguagaauugcacuucaguuuauuuucuuacaaauaaccuuacauuuuguuu

SEQ ID NO: 546917 - RNA, 64 nt, Homo Sapiens
cugcccaccucaaguuuaauaaauaagguuguacuuuucuuacuauaaaauaaaugucuguaac

SEQ ID NO: 546918 - RNA, 64 nt, Homo Sapiens
uggguaaaagguacccuugccuuacuccaucuuauuuucuuagcccccuuugaguguuuuaacu

SEQ ID NO: 546919 - RNA, 64 nt, Homo Sapiens
uguguguaugccucaaaugcagaaacaguugggcuuuucuuaacagguuaacaguuugugcugg

SEQ ID NO: 546920 - RNA, 64 nt, Homo Sapiens
auccugagcuacaguuucaaaaggaaaaucauuuuuuucuuaugcaaagaugguaaaacacugu

SEQ ID NO: 546921 - RNA, 64 nt, Homo Sapiens
ugaaaauugaaagggugcuuaauucaagauugcauuuucuuaaagccugaagcccuaguaccau

SEQ ID NO: 546922 - RNA, 64 nt, Homo Sapiens
agaaaauauuuguggaaucaguauuuuaguaguauuuucuuaguuuacuaaguagccuuaauuu

SEQ ID NO: 546923 - RNA, 64 nt, Homo Sapiens
uuaagcuccaucugguccucauaaccugcaagauuuuucuuaaaaccuuucagcugaaaguggg

SEQ ID NO: 546924 - RNA, 64 nt, Homo Sapiens
cagaaaugugcuuuaacaucaguugaaaccuaaauuuucuuauguuguggugauuguauuaaaa

SEQ ID NO: 546925 - RNA, 64 nt, Homo Sapiens
ccccgaauacccccaaaaugagaaacaaaauuuuuuuucuuacuccauuuguuacucucuguuc

SEQ ID NO: 546926 - RNA, 64 nt, Homo Sapiens
aauaguauuuaaaaguuaaugaacacuucucuaguuuucuuaguuauggccuuaauaauuaguc

SEQ ID NO: 546927 - RNA, 64 nt, Homo Sapiens
ucauguauuugaauauaguuaaaucguauuauuuuuuucuuaacagaaauauuuuuaaaaauga

SEQ ID NO: 546928 - RNA, 64 nt, Homo Sapiens
guuugguuugcagagaacacagccugauacuuaauuuucuuaaaacuauuuuuaaugauccacu

SEQ ID NO: 546929 - RNA, 64 nt, Homo Sapiens
ucaaaucaguuuuagcaugaccuuuccuuguggauuuucuuauucucguugucaaguuuucuag

SEQ ID NO: 546930 - RNA, 64 nt, Homo Sapiens
ugagauaaucaggccuaaucauguugugauucucuuuucuuaguggaguggaauguucuauccc

SEQ ID NO: 546931 - RNA, 64 nt, Homo Sapiens
aauugugaauguuggugugaugauuacuucuuauuuuucuuaccgggcuuuuggugcaugcagu

SEQ ID NO: 546932 - RNA, 64 nt, Homo Sapiens
gcauacuaguacaagugguauacaauuuguacuuuuuucuuaagaaaguguguaauuauguaaa

SEQ ID NO: 546933 - RNA, 62 nt, Homo Sapiens
uucuuggcuuaguuuuuccuauuugucucuguguuuuucuuagaaaaaaaaaagauacauag

SEQ ID NO: 546934 - RNA, 64 nt, Homo Sapiens
uuuuuauuagcucuuccuaaaaauaaugggacuuuuuucuuaacuauugguguuuguuuaauaa

SEQ ID NO: 546935 - RNA, 64 nt, Homo Sapiens
agaucucagcccaccaaugccaagacaaaauuauuuuucuuauacuuauuuuuuauuaaacaaa

SEQ ID NO: 546936 - RNA, 64 nt, Homo Sapiens
uaauguucaaaaaugauaaguaaucuggauaccuuuuucuuauacuuucuccuaggaaaacuuu

SEQ ID NO: 546937 - RNA, 64 nt, Homo Sapiens
ugcauuuuagcuaucugaauggccaacucacuucuuuucuuacacucuuggacaauggaccaug

SEQ ID NO: 546938 - RNA, 64 nt, Homo Sapiens
gagaauucuuacucaaauuuuucguaccaggagauuuucuuaccuucauuugcuuuuaugcugc

SEQ ID NO: 546939 - RNA, 64 nt, Homo Sapiens
uuaccuuuaauuuuccuggagaauuauauaaagguuuucuuagaacaauuuugcccugauuacu

SEQ ID NO: 546940 - RNA, 64 nt, Homo Sapiens
agccagcaucugaucaaaaguauuacauaaaauauuuucuuaaacuauugaaaggugcuuugau

SEQ ID NO: 546941 - RNA, 63 nt, Homo Sapiens
auaucucucaccagaacuaaugcacuucugagcuuuucuuaacaaaugcuuguuguaucgcag

SEQ ID NO: 546942 - RNA, 64 nt, Homo Sapiens
uuucuuaacaaaugcuuguuguaucgcagccugcuuuucuuagauguuuucuugcuguuccuug

SEQ ID NO: 546943 - RNA, 64 nt, Homo Sapiens
guuuuuaaccuguacauuguauugcggcuugccauuuucuuaguugcuauugacuuugauuuca

SEQ ID NO: 546944 - RNA, 64 nt, Homo Sapiens
cuauugacuuugauuucaaugugcaguauuuaauuuuucuuaugauguaauuuuuaugaaaugu

SEQ ID NO: 546945 - RNA, 64 nt, Homo Sapiens
auuacucagagcuuuggaucaaguuaacugagcuuuuucuuaauuucauuccuuuuuuuggaca

SEQ ID NO: 546946 - RNA, 64 nt, Homo Sapiens
cagcaguacgugguagccacaauugcacaauauauuuucuuaaaaaauaccagcaguuacucau

SEQ ID NO: 546947 - RNA, 64 nt, Homo Sapiens
uuggaaguccuuuucauaaaagguaccucuuuccuuuucuuauugaauucuuagaacuuaguua

SEQ ID NO: 546948 - RNA, 64 nt, Homo Sapiens
uugaauucuuagaacuuaguuaacccucccugccuuuucuuaacaaaaaggacuuuucuaagga

SEQ ID NO: 546949 - RNA, 64 nt, Homo Sapiens
ccugggugugagcacuuaaucacucaacgcuuuguuuucuuacacuugaaaaucaagggaaaga

SEQ ID NO: 546950 - RNA, 64 nt, Homo Sapiens
caucugacuccuacacuuucauuacaagucagauuuuucuuaaacuagcaggcaaaaacaguac

SEQ ID NO: 546951 - RNA, 64 nt, Homo Sapiens
auguucaauguauggucauaauuuacuguuguguuuuucuuaaugcauacagggucaauaucua

SEQ ID NO: 546952 - RNA, 64 nt, Homo Sapiens
uguaauggugaauauuuacaucccuaaaaugcguuuuucuuacccaaguggagaauucacugcu

SEQ ID NO: 546953 - RNA, 64 nt, Homo Sapiens
uuauuguuuuaguuuugugaaugcuguuggucuuuuuucuuauggacguucaaguuucuuaaag

SEQ ID NO: 546954 - RNA, 64 nt, Homo Sapiens
cuccaauguaaauauaugagcuaaggacuguuuuuuuucuuacuuuggaagggcaaugugugag

SEQ ID NO: 546955 - RNA, 64 nt, Homo Sapiens
aaauaguucuguguuuauuucacacuaagauguauuuucuuacgaauccaugugcauuggauug

SEQ ID NO: 546956 - RNA, 64 nt, Homo Sapiens
gccaaaugaaaagagguaacuuugcuuuuuuccuuuuucuuaccuaucaaauagcauuuauuac

SEQ ID NO: 546957 - RNA, 64 nt, Homo Sapiens
acagaaaagggcuacauuuaaaauuuguauuuguuuuucuuacuuagugaagguuguguuuuuu

SEQ ID NO: 546958 - RNA, 64 nt, Homo Sapiens
aagaauggauaaauguccuuauuuucuucuaguauuuucuuauuucacuuuuacaccuaucuuu

SEQ ID NO: 546959 - RNA, 64 nt, Homo Sapiens
guggccccuggggaugugugcuucauugugcccuuuuucuuauugguuuagaacucuugauuuu

SEQ ID NO: 546960 - RNA, 64 nt, Homo Sapiens
uaaacauauauugaggaaaaauaaagcgauugguuuuucuuaagguaucccauguguauuuauu

SEQ ID NO: 546961 - RNA, 64 nt, Homo Sapiens
cuuguuucuugacaguacauuuuuagaucuggccuuuucuuaacaaaaucugugcaaaagaugc

SEQ ID NO: 546962 - RNA, 64 nt, Homo Sapiens
gucuuccucucccuucuccucugcugcagcaugauuuucuuaaucuucagacacucacuauuuu

SEQ ID NO: 546963 - RNA, 64 nt, Homo Sapiens
aaaaaacugaaaucuaccaaaagagcauggagauuuuucuuaaauaauaauauugugcucucca

SEQ ID NO: 546964 - RNA, 64 nt, Homo Sapiens
ucuccagggccaggcuauuuacuugggaaaguauuuuucuuacaguucuuggccacaguuuuuu

SEQ ID NO: 546965 - RNA, 64 nt, Homo Sapiens
uuagcaucagaagguucacccagcaccuugcagauuuucuuaaggaauuuugucucacuuuuaa

SEQ ID NO: 546966 - RNA, 64 nt, Homo Sapiens
acagaaaaccgagaauauucaaaauuccaaauuuuuuucuuaggagcaagaagaaaauguggcc

SEQ ID NO: 546967 - RNA, 64 nt, Homo Sapiens
caauuuaucucaauuuuauauggcuugugauucauuuucuuaauccaaauauauauaaacgugu

SEQ ID NO: 546968 - RNA, 64 nt, Homo Sapiens
ggacuacaggcaugcaccaccacgcccagcuaauuuuucuuauuuuuuguagagacagggucuc

SEQ ID NO: 546969 - RNA, 64 nt, Homo Sapiens
aaaaaauugugaaaguaagauauguuuguauuguuuuucuuaaagaggaaccucguauaagcuu

SEQ ID NO: 546970 - RNA, 64 nt, Homo Sapiens
agauugcauuuuuuucuuuucaaauugcuuuaguuuuucuuagggagcuaugagggggaaaaau

SEQ ID NO: 546971 - RNA, 64 nt, Homo Sapiens
ugguugaaagaauuuugauuuuacgauuuugaauuuuucuuauuuaauuuguuuucuuacgggu

SEQ ID NO: 546972 - RNA, 64 nt, Homo Sapiens
gguuuacgauuuugaauuuuccguuuuuaauuuguuuucuuacgggagugacguauuuucauca

SEQ ID NO: 546973 - RNA, 64 nt, Homo Sapiens
cuagcauuugucuuuauacuuauguagcagauguuuuucuuaauugauauuaauccuuugucau

SEQ ID NO: 546974 - RNA, 64 nt, Homo Sapiens
aaccuggaggugcuuuuuauuucauuuaucugucuuuucuuauauguauuugccuauuuuucua

SEQ ID NO: 546975 - RNA, 64 nt, Homo Sapiens
gauguuuguguguguguuggcaacaugccuaauguuuucuuaaugaugacaacaaauauuuuaa

SEQ ID NO: 546976 - RNA, 64 nt, Homo Sapiens
ggauaauuucuuaaaccacauuguuuuaauugauuuuucuuaucuugauuucuuucauuagaaa

SEQ ID NO: 546977 - RNA, 64 nt, Homo Sapiens
uccuccuuuaccuuugcuaauaucauggcagaauuuuucuuaucccuugugaggcaguuguuga

SEQ ID NO: 546978 - RNA, 64 nt, Homo Sapiens
aucuucuaccacuuuagagacauucaaguaauaguuuucuuagagcuuugcacauuccuauuca

SEQ ID NO: 546979 - RNA, 64 nt, Homo Sapiens
ugagaacuuguaaugguguugccucugcccuucuuuuucuuacuuguaggagauacucagugga

SEQ ID NO: 546980 - RNA, 64 nt, Homo Sapiens
cuuuggguaaaggugaacaauuuguaccaggaacuuuucuuaguaaauauuuauuguucaccug

SEQ ID NO: 546981 - RNA, 64 nt, Homo Sapiens
caauuaagauguagauagaaauuaauuuaaggucuuuucuuaaaaaaaaaauccaccucauuuu

SEQ ID NO: 546982 - RNA, 64 nt, Homo Sapiens
augaaaguuugacaguauuaauauuuuuuuuauauuuucuuaaaucauuaaaccauuuuaauau

SEQ ID NO: 546983 - RNA, 64 nt, Homo Sapiens
aauaaaauauacucagauguuuauuucuuccuuuuuuucuuacguucuuaagcaauauuugugg

SEQ ID NO: 546984 - RNA, 64 nt, Homo Sapiens
caauauuugugguuauuucugucagcugaauuuauuuucuuaaggcuccgucucuuguagccaa

SEQ ID NO: 546985 - RNA, 64 nt, Homo Sapiens
uauacauaccuaugauaaaacuaugucuauguuuuuuucuuauaaacccagauaggaccaaacu

SEQ ID NO: 546986 - RNA, 64 nt, Homo Sapiens
aauucuuaaaguacuaaagaauaauauaaaauauuuuucuuauggaaaaauaauaucucccauc

SEQ ID NO: 546987 - RNA, 64 nt, Homo Sapiens
agaaaacuugaucugugguguuuuguuuuguuuuuuuucuuaaaacaacagcaacgugaucuug

SEQ ID NO: 546988 - RNA, 64 nt, Homo Sapiens
gucugagguuuaacaguuuguuguccuggagggauuuucuuacagcgaagacuugaguuccucc

SEQ ID NO: 546989 - RNA, 64 nt, Homo Sapiens
aucggguauuuuuuaaaguaaaauuuuucuguaauuuucuuacccauuuucgacaguguaaugg

SEQ ID NO: 546990 - RNA, 64 nt, Homo Sapiens
uauuucacauacuguaacaagggaaaacagaggcuuuucuuaacaagccauuuguuaccaaacu

SEQ ID NO: 546991 - RNA, 64 nt, Homo Sapiens
gguagcaguauaauguauuuaacaaaaagcacuuuuuucuuaauaaaaaaaagaaagaaaggaa

SEQ ID NO: 546992 - RNA, 64 nt, Homo Sapiens
agucucacuagauugacugaaguuuucuccaccuuuuucuuaugacuauuccaugcuuuuaagu

SEQ ID NO: 546993 - RNA, 64 nt, Homo Sapiens
aaauugcuuuuaaaacaaauugcuguuuucaguauuuucuuaagggccaggaaaauagaugucu

SEQ ID NO: 546994 - RNA, 64 nt, Homo Sapiens
uuugcuaaauacuguagggauguuucuaaggacuuuuucuuagguuuuucaauuuuuuugugug

SEQ ID NO: 546995 - RNA, 64 nt, Homo Sapiens
uauauauugauuauuuguuuaacuuguuuuugaguuuucuuauacagcuggacuuauuuaaaac

SEQ ID NO: 546996 - RNA, 64 nt, Homo Sapiens
gcuguggaaccucuuuuggacggugguuuuuguuuuuucuuauuugacaagcacuuuacuuuca

SEQ ID NO: 546997 - RNA, 64 nt, Homo Sapiens
uuaguugagaaguuucauaaccuggaagacuuuuuuuucuuauuucucuccccugaaaucaaaa

SEQ ID NO: 546998 - RNA, 64 nt, Homo Sapiens
gcguucgcuuguggcaguuacuaacuuucuacaguuuucuuaaucaaaaguggucuagguaacc

SEQ ID NO: 546999 - RNA, 64 nt, Homo Sapiens
aaggagaaaagacugcccuggcgguccugguggcuuuucuuagcauguguggcacuguugccca

SEQ ID NO: 547000 - RNA, 64 nt, Homo Sapiens
aagaugagagaaacauauuuuucuuuucaagauuuuuucuuaaaacguaaaaaacauaauuuuu

SEQ ID NO: 547001 - RNA, 64 nt, Homo Sapiens
uguaguuuucuauauaacauuuuuucuuuuuuuuuuuucuuacaugguuuggguuuuauauuuc

SEQ ID NO: 547002 - RNA, 64 nt, Homo Sapiens
gcaaguguucacaacggugaaacuugagcgucauuuuucuuagugugccaagaguucgauguua

SEQ ID NO: 547003 - RNA, 64 nt, Homo Sapiens
gugccaagaguucgauguuaguguuuccauuguauuuucuuacagugugccauucuguuagaua

SEQ ID NO: 547004 - RNA, 64 nt, Homo Sapiens
caaguguucacaacagugaaaaguugagcgucauuuuucuuagugugccaagaguucgauguua

SEQ ID NO: 547005 - RNA, 64 nt, Homo Sapiens
gugccaagaguucgauguuaguguuuccauuguauuuucuuacacugugccauucuguuagaua

SEQ ID NO: 547006 - RNA, 64 nt, Homo Sapiens; identical to SEQ ID NO: 547004

SEQ ID NO: 547007 - RNA, 64 nt, Homo Sapiens
gugccaagaguucgauguuagcguuuacguuguauuuucuuacacugugucauucuguuagaua

SEQ ID NO: 547008 - RNA, 64 nt, Homo Sapiens
gucuucaagaagucacguuuuucauuuauaacaauuuucuuauaaaaacauguugcuuuuaaaa

SEQ ID NO: 547009 - RNA, 64 nt, Homo Sapiens
uagaaaagauuaaagcaaaauauucauuuuuacuuuuucuuauuuuuaaaauuaggcugaaugu

SEQ ID NO: 547010 - RNA, 64 nt, Homo Sapiens
uauuacacaaguuuaaaaauauuauuaacuuguauuuucuuaauauacaaucuaucuuuuccac

SEQ ID NO: 547011 - RNA, 64 nt, Homo Sapiens
ugcuuggcaaaugagugacaauagaagaaauaauuuuucuuacacauuuuaaaacguuuucucu

SEQ ID NO: 547012 - RNA, 64 nt, Homo Sapiens
aggacaaguaaacaauuugaugauaagcuacaguuuuucuuagaaaguaaauauuuuauuuaug

SEQ ID NO: 547013 - RNA, 64 nt, Homo Sapiens
gugcugauuuuauaauugcgcaguuuguuuaguuuuuucuuacuuuuaaauuccaacuuaaaau

SEQ ID NO: 547014 - RNA, 64 nt, Homo Sapiens
gcauugggugaucauucaccaguacauucucaguuuuucuuaauauauagcauuuaugguaauc

SEQ ID NO: 547015 - RNA, 64 nt, Homo Sapiens
auaugugaaggaccuucacucuaagauguuauauuuuucuuaaaaaguaacuccuaguaggggu

SEQ ID NO: 547016 - RNA, 64 nt, Homo Sapiens
uaaaucuuaguuuccuggaauugguauuucauuuuuuucuuaucuuaaguaauuuaaauuaggg

SEQ ID NO: 547017 - RNA, 64 nt, Homo Sapiens
uauuaagaaguguuaccuuauguuccauaaauguuuuucuuaauaaauaucuuucacagaauuu

SEQ ID NO: 547018 - RNA, 64 nt, Homo Sapiens
auuucaauguguauuuaauccugugugcuaggcauuuucuuaauaaguauuuacugagagcuua

SEQ ID NO: 547019 - RNA, 64 nt, Homo Sapiens
uuuuggguguaauaguccuuuguuuauuuaauuguuuucuuaugaguuaugaaaaugccaaacu

SEQ ID NO: 547020 - RNA, 64 nt, Homo Sapiens
gugugccauucuguuagauaguguuuccauuguauuuucuuacagugacaagaguucgauguua

SEQ ID NO: 547021 - RNA, 64 nt, Homo Sapiens
gugacaagaguucgauguuaaaguugagcgucguuuuucuuagucaaguguucacaacagugaa

SEQ ID NO: 547022 - RNA, 64 nt, Homo Sapiens
uuuagguagauaagucagcucaaaagaggauuuauuuucuuaaggagguuagagcacuagaaug

SEQ ID NO: 547023 - RNA, 64 nt, Homo Sapiens
aaaauaauaaaacuacagacaguugguguuuucuuuuucuuaaagauggcaaaaggcuuuuaaa

SEQ ID NO: 547024 - RNA, 64 nt, Homo Sapiens; identical to SEQ ID NO: 76382

SEQ ID NO: 547025 - RNA, 64 nt, Homo Sapiens; identical to SEQ ID NO: 76383

SEQ ID NO: 547026 - RNA, 64 nt, Homo Sapiens; identical to SEQ ID NO: 76384

SEQ ID NO: 547027 - RNA, 64 nt, Homo Sapiens; identical to SEQ ID NO: 76385

SEQ ID NO: 547028 - RNA, 64 nt, Homo Sapiens; identical to SEQ ID NO: 76386

SEQ ID NO: 547029 - RNA, 64 nt, Homo Sapiens; identical to SEQ ID NO: 76387

SEQ ID NO: 547030 - RNA, 64 nt, Homo Sapiens; identical to SEQ ID NO: 76388

SEQ ID NO: 547031 - RNA, 64 nt, Homo Sapiens; identical to SEQ ID NO: 76389

SEQ ID NO: 547032 - RNA, 64 nt, Homo Sapiens; identical to SEQ ID NO: 76390

SEQ ID NO: 547033 - RNA, 64 nt, Homo Sapiens; identical to SEQ ID NO: 76391

SEQ ID NO: 547034 - RNA, 64 nt, Homo Sapiens; identical to SEQ ID NO: 76392

SEQ ID NO: 547035 - RNA, 64 nt, Homo Sapiens; identical to SEQ ID NO: 76393

SEQ ID NO: 547036 - RNA, 64 nt, Homo Sapiens; identical to SEQ ID NO: 76394

SEQ ID NO: 547037 - RNA, 64 nt, Homo Sapiens; identical to SEQ ID NO: 76395

SEQ ID NO: 547038 - RNA, 64 nt, Homo Sapiens; identical to SEQ ID NO: 76396

SEQ ID NO: 547039 - RNA, 64 nt, Homo Sapiens; identical to SEQ ID NO: 76397

SEQ ID NO: 547040 - RNA, 64 nt, Homo Sapiens; identical to SEQ ID NO: 76398

SEQ ID NO: 547041 - RNA, 64 nt, Homo Sapiens; identical to SEQ ID NO: 76399

SEQ ID NO: 547042 - RNA, 64 nt, Homo Sapiens; identical to SEQ ID NO: 76400

SEQ ID NO: 547043 - RNA, 64 nt, Homo Sapiens; identical to SEQ ID NO: 76401

SEQ ID NO: 547044 - RNA, 64 nt, Homo Sapiens; identical to SEQ ID NO: 76402

SEQ ID NO: 547045 - RNA, 64 nt, Homo Sapiens; identical to SEQ ID NO: 76403

SEQ ID NO: 547046 - RNA, 64 nt, Homo Sapiens; identical to SEQ ID NO: 76404

SEQ ID NO: 547047 - RNA, 64 nt, Homo Sapiens; identical to SEQ ID NO: 76405

SEQ ID NO: 547048 - RNA, 64 nt, Homo Sapiens; identical to SEQ ID NO: 76406

SEQ ID NO: 547049 - RNA, 64 nt, Homo Sapiens; identical to SEQ ID NO: 76407

SEQ ID NO: 547050 - RNA, 64 nt, Homo Sapiens; identical to SEQ ID NO: 76408

SEQ ID NO: 547051 - RNA, 64 nt, Homo Sapiens; identical to SEQ ID NO: 76409

SEQ ID NO: 547052 - RNA, 64 nt, Homo Sapiens; identical to SEQ ID NO: 76410

SEQ ID NO: 547053 - RNA, 64 nt, Homo Sapiens; identical to SEQ ID NO: 76411

SEQ ID NO: 547054 - RNA, 64 nt, Homo Sapiens; identical to SEQ ID NO: 76412

SEQ ID NO: 547055 - RNA, 64 nt, Homo Sapiens; identical to SEQ ID NO: 76413

SEQ ID NO: 547056 - RNA, 64 nt, Homo Sapiens; identical to SEQ ID NO: 76414

SEQ ID NO: 547057 - RNA, 64 nt, Homo Sapiens; identical to SEQ ID NO: 76415

SEQ ID NO: 547058 - RNA, 64 nt, Homo Sapiens; identical to SEQ ID NO: 76416

SEQ ID NO: 547059 - RNA, 64 nt, Homo Sapiens; identical to SEQ ID NO: 76417

SEQ ID NO: 547060 - RNA, 64 nt, Homo Sapiens; identical to SEQ ID NO: 76418

SEQ ID NO: 547061 - RNA, 64 nt, Homo Sapiens; identical to SEQ ID NO: 76419

SEQ ID NO: 547062 - RNA, 64 nt, Homo Sapiens; identical to SEQ ID NO: 76420

SEQ ID NO: 547063 - RNA, 64 nt, Homo Sapiens; identical to SEQ ID NO: 76421

SEQ ID NO: 547064 - RNA, 64 nt, Homo Sapiens; identical to SEQ ID NO: 76422

SEQ ID NO: 547065 - RNA, 64 nt, Homo Sapiens; identical to SEQ ID NO: 76423

SEQ ID NO: 547066 - RNA, 62 nt, Homo Sapiens; identical to SEQ ID NO: 76424

SEQ ID NO: 547067 - RNA, 64 nt, Homo Sapiens; identical to SEQ ID NO: 76425

SEQ ID NO: 547068 - RNA, 64 nt, Homo Sapiens
ccacaucucacuucugcuuccucaucucagcccacucugaaaaugugcagcacccucacugguu

SEQ ID NO: 547069 - RNA, 64 nt, Homo Sapiens
ccccccaacgcaaggaggaugcccaauuguugcccucugaaaaugcacaguucuccuggcccua

SEQ ID NO: 547070 - RNA, 64 nt, Homo Sapiens
acuauaaaagugcaaugacuaagauccuucacuucucugaaaguaaggcccuagaugccucagg

SEQ ID NO: 547071 - RNA, 64 nt, Homo Sapiens
gcuggucuccaggcugacaaggauucaaaguugucucugaaacuccucuuugucauacugcaca

SEQ ID NO: 547072 - RNA, 64 nt, Homo Sapiens
acuuuuagaggauauuaauuuuaagacgugaaagcucugaaauucaguacacauuguccuuuuu

SEQ ID NO: 547073 - RNA, 64 nt, Homo Sapiens
gcugauggcuggauccaaucggcuuuuaaggauucucugaaaguaaauucaaagacccauaaaa

SEQ ID NO: 547074 - RNA, 64 nt, Homo Sapiens
gagucucggucaugacuuauuguucauagagcgucucugaaauuacuguggcuucaagcaccuc

SEQ ID NO: 547075 - RNA, 64 nt, Homo Sapiens
uuuuagagcuagguauaguguuagucugcuguuucucugaaaaacuuuauuuaagauucacuua

SEQ ID NO: 547076 - RNA, 64 nt, Homo Sapiens
auauaacacauuuuuuugcaugcaugcaaaugagcucugaaaucuucccaugcauucuggucaa

SEQ ID NO: 547077 - RNA, 64 nt, Homo Sapiens
ccagcguggcucuaaaagguaauguguggauugccucugaaaaguguguauauauuuuguguga

SEQ ID NO: 547078 - RNA, 64 nt, Homo Sapiens
uuaaaguucugguauauuuuacagagacaaccuccucugaaauaacagccucucaacugcuuug

SEQ ID NO: 547079 - RNA, 64 nt, Homo Sapiens
ugucuuuuaaaauuauucuguucuucaaguuuugcucugaaauuuucauggaucauuuaaugca

SEQ ID NO: 547080 - RNA, 64 nt, Homo Sapiens
uagcugaaucuuugguguauugaaauaggcagcacucugaaagacagaagcuucguccagccac

SEQ ID NO: 547081 - RNA, 64 nt, Homo Sapiens
aauugucuguuaaauuuauuaugcccaaaucaaccucugaaaaaagguuuuuccaggaagauuu

SEQ ID NO: 547082 - RNA, 64 nt, Homo Sapiens
gaaacccaacaacuucauucgccuuuagggguagcucugaaagaucagagaauauaaagugaau

SEQ ID NO: 547083 - RNA, 64 nt, Homo Sapiens
aaaaagcacugaaauaguuaagccaggcucagagcucugaaauuaaaaucaacaaacaaaucaa

SEQ ID NO: 547084 - RNA, 64 nt, Homo Sapiens
cuauaguuuaaaagcacaucuauguucacugccacucugaaaaagggaauuauuucucagucuu

SEQ ID NO: 547085 - RNA, 64 nt, Homo Sapiens
aagaaacccaagguuggagggugggaugaguacccucugaaaaagggaauuugcuggugaaaag

SEQ ID NO: 547086 - RNA, 64 nt, Homo Sapiens
auuucuaacaguaccaguguaaauucagucuuuucucugaaaagcaaaggauguguuuucaguc

SEQ ID NO: 547087 - RNA, 64 nt, Homo Sapiens
cuuucuaucaaauauuaucuuuguucuccuaaugcucugaaaggauguagaaacaauauuuaac

SEQ ID NO: 547088 - RNA, 64 nt, Homo Sapiens
ucuuuaggaaacuugaaauugaaaucacagggaucucugaaauaguguuugaaauuauguccau

SEQ ID NO: 547089 - RNA, 64 nt, Homo Sapiens
aacucuuuaaaaagcccucuguuaaaauugaaaacucugaaaauaaaugguaagguacaagugu

SEQ ID NO: 547090 - RNA, 64 nt, Homo Sapiens
uucugagacccuuuugagacaaaccacagacaaccucugaaagagccaauagguggauuuuaca

SEQ ID NO: 547091 - RNA, 64 nt, Homo Sapiens
cauuuauauguggaacuucuaagaagaauuacaacucugaaaagaaguggaaaaucaaacguuu

SEQ ID NO: 547092 - RNA, 64 nt, Homo Sapiens
uccauguagaucaaagaacaugcuuaugugcacacucugaaaccacaacucagugaauaauuuu

SEQ ID NO: 547093 - RNA, 64 nt, Homo Sapiens
ugcagcaguggacaagacagggcacuaugcuauucucugaaagaaaaguaucuacuguguaaca

SEQ ID NO: 547094 - RNA, 64 nt, Homo Sapiens
ugcauaaaagacuuuuuuuuaacacuuuggacuucucugaaauauuuagaagugcuaauuucug

SEQ ID NO: 547095 - RNA, 64 nt, Homo Sapiens
cagacaggaaaguuccagaaacuuuaagaacaaacucugaaagaccuaugagcaaauggugcug

SEQ ID NO: 547096 - RNA, 64 nt, Homo Sapiens
aaguuucuuuuguaguuuuauuuuccuuaauguucucugaaaacuuugaaaaugauuuaaagug

SEQ ID NO: 547097 - RNA, 64 nt, Homo Sapiens
uaugacacccagcuuuaaaaguauacuuuaugcucucugaaaugacuccugucucugugagaau

SEQ ID NO: 547098 - RNA, 64 nt, Homo Sapiens
ccacuugguagcucuggacaaguaaauuccugugcucugaaauggagggacaucuggguggagg

SEQ ID NO: 547099 - RNA, 64 nt, Homo Sapiens
guacauguauggcuggacgcuauguucacuugaacucugaaaaucauacuuauaaagaaaacug

SEQ ID NO: 547100 - RNA, 64 nt, Homo Sapiens
caaaccaguaccuggggagguuuucuagguggaccucugaaaacgccugaaguuuuaguauuug

SEQ ID NO: 547101 - RNA, 64 nt, Homo Sapiens
uggccaaaaugcauuuuaugaccuguuaaguauucucugaaacacacaacacagaacgauguug

SEQ ID NO: 547102 - RNA, 64 nt, Homo Sapiens
ucuugauggaagguauuaaacuaaacgucuagagcucugaaaugagagauucuugaccuuauuu

SEQ ID NO: 547103 - RNA, 64 nt, Homo Sapiens
gcaugaaaaacaaaggcaaaagggaaguugugcacucugaaaauuaagugauucagaagagagg

SEQ ID NO: 547104 - RNA, 64 nt, Homo Sapiens
agggagaggauauagaccuuuuuccacacaaucccucugaaauaagacucuucuuauugguaau

SEQ ID NO: 547105 - RNA, 64 nt, Homo Sapiens
uccuccaaaaggagagugcaguaaagaucugugacucugaaauaacuuaaagaacuuccuuuau

SEQ ID NO: 547106 - RNA, 64 nt, Homo Sapiens
acaguccuaagaacuccuaaacaguaauaaauagcucugaaauaauaacaagagcucuguaaua

SEQ ID NO: 547107 - RNA, 64 nt, Homo Sapiens
acaagagcucuguaauaacaaagggcuacaguagcucugaaauaucuuucuguugguugugccc

SEQ ID NO: 547108 - RNA, 64 nt, Homo Sapiens
aauauuuugacuaagaauguuuaaaaccuuuagacucugaaaguuuguugaaccaauuuuguuu

SEQ ID NO: 547109 - RNA, 64 nt, Homo Sapiens
cugauuguacaguauauucuaagaucccuuccagcucugaaauggggugcuggauuggaucuua

SEQ ID NO: 547110 - RNA, 64 nt, Homo Sapiens
caaaaaaagugagaaaauaaaguugcucucuagucucugaaaaguaaauuuauguagugaguaa

SEQ ID NO: 547111 - RNA, 64 nt, Homo Sapiens
ucaguauaaauguaaauauaaacuccacuaaaaacucugaaacuguguggcugagaaagugcgg

SEQ ID NO: 547112 - RNA, 64 nt, Homo Sapiens
auccucucucuaaggcuccaugguuccuacgaagcucugaaaggugggaacaccacagaggcca

SEQ ID NO: 547113 - RNA, 64 nt, Homo Sapiens
cccaccaggagggggaauucauccuccgggucuucucugaaaagaggaaccucucugagugagu

SEQ ID NO: 547114 - RNA, 64 nt, Homo Sapiens
cccaaacuacuugaaaagggcauuuggcaccacucucugaaacaacacagucacucuagcaagg

SEQ ID NO: 547115 - RNA, 64 nt, Homo Sapiens
gguuuguuacuggcuucagaaagcuaauuaagugcucugaaaaagacaccguuucuugaaacaa

SEQ ID NO: 547116 - RNA, 64 nt, Homo Sapiens
ggcagccuuccaugaggcagaaggggucgucguucucugaaaacagugacucugaaauguuggg

SEQ ID NO: 547117 - RNA, 64 nt, Homo Sapiens
ggcagaaggggucgucguucucugaaaacagugacucugaaauguugggacaggggaaggggug

SEQ ID NO: 547118 - RNA, 64 nt, Homo Sapiens
acgcuuuccugaaccuucucagugguuuacaugccucugaaacuaugugcaauauuuuugguug

SEQ ID NO: 547119 - RNA, 64 nt, Homo Sapiens
uaaguaaaagaaauauaggaauauuccagucaaucucugaaauguuuaugaaaaacagguuaau

SEQ ID NO: 547120 - RNA, 64 nt, Homo Sapiens
guuaagggcuuuugguauuaaagauauucugaagcucugaaaugcuagaaaaaaauuuggaaug

SEQ ID NO: 547121 - RNA, 64 nt, Homo Sapiens
ccaaucuuccaagggugccagccccuccguucaucucugaaacccagcauccuuuucagcugcu

SEQ ID NO: 547122 - RNA, 64 nt, Homo Sapiens
uuccggguuggaacagcagaggcucagaaacuggcucugaaauaggcagaccuagcaagaggaa

SEQ ID NO: 547123 - RNA, 64 nt, Homo Sapiens
ucuucucacuucuggguguuuaaugauaaaaccacucugaaagcuaugugauuagauauuaauu

SEQ ID NO: 547124 - RNA, 64 nt, Homo Sapiens
ugaaaagccugcacucuucccaccccaccccacccucugaaauggggcccaccccgccccaccc

SEQ ID NO: 547125 - RNA, 64 nt, Homo Sapiens
aaucacuuuaaaccaaugccuucucaaaggaugucucugaaaaguaagccucugcaauuuuaac

SEQ ID NO: 547126 - RNA, 64 nt, Homo Sapiens
uggagcauuccugcaagacucaguuucagauuuacucugaaaugaggauuuggagcuuuuaagc

SEQ ID NO: 547127 - RNA, 64 nt, Homo Sapiens
ucagaagacaggcuggaugagaucucaggccgagcucugaaauagggagguaauccuccagcac

SEQ ID NO: 547128 - RNA, 64 nt, Homo Sapiens
uguccacguuugucaaaagguggugcuggcccaccucugaaagcagaacacuugcucaacaacc

SEQ ID NO: 547129 - RNA, 64 nt, Homo Sapiens
aaauguaugguuuucuuaaaugauggguuguuuacucugaaauauauaccuauguauuuguuuu

SEQ ID NO: 547130 - RNA, 64 nt, Homo Sapiens
gaacagcuccaauagcaacauaccuuauaucccucucugaaacagucuucagcacccucccaug

SEQ ID NO: 547131 - RNA, 64 nt, Homo Sapiens; identical to SEQ ID NO: 283773

SEQ ID NO: 547132 - RNA, 64 nt, Homo Sapiens; identical to SEQ ID NO: 283774

SEQ ID NO: 547133 - RNA, 64 nt, Homo Sapiens; identical to SEQ ID NO: 283775

SEQ ID NO: 547134 - RNA, 64 nt, Homo Sapiens; identical to SEQ ID NO: 283776

SEQ ID NO: 547135 - RNA, 64 nt, Homo Sapiens; identical to SEQ ID NO: 283777

SEQ ID NO: 547136 - RNA, 64 nt, Homo Sapiens; identical to SEQ ID NO: 283778

SEQ ID NO: 547137 - RNA, 64 nt, Homo Sapiens; identical to SEQ ID NO: 283779

SEQ ID NO: 547138 - RNA, 64 nt, Homo Sapiens; identical to SEQ ID NO: 283780

SEQ ID NO: 547139 - RNA, 64 nt, Homo Sapiens; identical to SEQ ID NO: 283781

SEQ ID NO: 547140 - RNA, 64 nt, Homo Sapiens; identical to SEQ ID NO: 283782

SEQ ID NO: 547141 - RNA, 64 nt, Homo Sapiens; identical to SEQ ID NO: 283783

SEQ ID NO: 547142 - RNA, 64 nt, Homo Sapiens; identical to SEQ ID NO: 283784

SEQ ID NO: 547143 - RNA, 64 nt, Homo Sapiens; identical to SEQ ID NO: 283785

SEQ ID NO: 547144 - RNA, 64 nt, Homo Sapiens; identical to SEQ ID NO: 283786

SEQ ID NO: 547145 - RNA, 64 nt, Homo Sapiens; identical to SEQ ID NO: 283787

SEQ ID NO: 547146 - RNA, 64 nt, Homo Sapiens; identical to SEQ ID NO: 283788

SEQ ID NO: 547147 - RNA, 64 nt, Homo Sapiens; identical to SEQ ID NO: 283789

SEQ ID NO: 547148 - RNA, 64 nt, Homo Sapiens; identical to SEQ ID NO: 283790

SEQ ID NO: 547149 - RNA, 64 nt, Homo Sapiens; identical to SEQ ID NO: 283791

SEQ ID NO: 547150 - RNA, 64 nt, Homo Sapiens; identical to SEQ ID NO: 283792

SEQ ID NO: 547151 - RNA, 64 nt, Homo Sapiens; identical to SEQ ID NO: 283793

SEQ ID NO: 547152 - RNA, 64 nt, Homo Sapiens; identical to SEQ ID NO: 283794

SEQ ID NO: 547153 - RNA, 64 nt, Homo Sapiens; identical to SEQ ID NO: 283795

SEQ ID NO: 547154 - RNA, 64 nt, Homo Sapiens; identical to SEQ ID NO: 283796

SEQ ID NO: 547155 - RNA, 64 nt, Homo Sapiens; identical to SEQ ID NO: 283797

SEQ ID NO: 547156 - RNA, 64 nt, Homo Sapiens; identical to SEQ ID NO: 283798

SEQ ID NO: 547157 - RNA, 64 nt, Homo Sapiens; identical to SEQ ID NO: 283799

SEQ ID NO: 547158 - RNA, 64 nt, Homo Sapiens; identical to SEQ ID NO: 283800

SEQ ID NO: 547159 - RNA, 64 nt, Homo Sapiens; identical to SEQ ID NO: 283801

SEQ ID NO: 547160 - RNA, 64 nt, Homo Sapiens; identical to SEQ ID NO: 283802

SEQ ID NO: 547161 - RNA, 64 nt, Homo Sapiens; identical to SEQ ID NO: 283803

SEQ ID NO: 547162 - RNA, 64 nt, Homo Sapiens; identical to SEQ ID NO: 283804

SEQ ID NO: 547163 - RNA, 64 nt, Homo Sapiens; identical to SEQ ID NO: 283805

SEQ ID NO: 547164 - RNA, 64 nt, Homo Sapiens; identical to SEQ ID NO: 283806

SEQ ID NO: 547165 - RNA, 64 nt, Homo Sapiens; identical to SEQ ID NO: 283807

SEQ ID NO: 547166 - RNA, 64 nt, Homo Sapiens; identical to SEQ ID NO: 283808

SEQ ID NO: 547167 - RNA, 64 nt, Homo Sapiens; identical to SEQ ID NO: 168567

SEQ ID NO: 547168 - RNA, 64 nt, Homo Sapiens; identical to SEQ ID NO: 168568

SEQ ID NO: 547169 - RNA, 64 nt, Homo Sapiens; identical to SEQ ID NO: 168569

SEQ ID NO: 547170 - RNA, 64 nt, Homo Sapiens; identical to SEQ ID NO: 168570

SEQ ID NO: 547171 - RNA, 64 nt, Homo Sapiens; identical to SEQ ID NO: 168571

SEQ ID NO: 547172 - RNA, 64 nt, Homo Sapiens; identical to SEQ ID NO: 168572

SEQ ID NO: 547173 - RNA, 64 nt, Homo Sapiens; identical to SEQ ID NO: 168573

SEQ ID NO: 547174 - RNA, 64 nt, Homo Sapiens; identical to SEQ ID NO: 168574

SEQ ID NO: 547175 - RNA, 64 nt, Homo Sapiens; identical to SEQ ID NO: 168575

SEQ ID NO: 547176 - RNA, 64 nt, Homo Sapiens; identical to SEQ ID NO: 168576

SEQ ID NO: 547177 - RNA, 64 nt, Homo Sapiens; identical to SEQ ID NO: 168577

SEQ ID NO: 547178 - RNA, 64 nt, Homo Sapiens; identical to SEQ ID NO: 168578

SEQ ID NO: 547179 - RNA, 64 nt, Homo Sapiens; identical to SEQ ID NO: 168579

SEQ ID NO: 547180 - RNA, 64 nt, Homo Sapiens; identical to SEQ ID NO: 168580

SEQ ID NO: 547181 - RNA, 64 nt, Homo Sapiens; identical to SEQ ID NO: 168581

SEQ ID NO: 547182 - RNA, 64 nt, Homo Sapiens; identical to SEQ ID NO: 168582

SEQ ID NO: 547183 - RNA, 64 nt, Homo Sapiens; identical to SEQ ID NO: 168583

SEQ ID NO: 547184 - RNA, 64 nt, Homo Sapiens; identical to SEQ ID NO: 168584

SEQ ID NO: 547185 - RNA, 64 nt, Homo Sapiens; identical to SEQ ID NO: 168585

SEQ ID NO: 547186 - RNA, 64 nt, Homo Sapiens; identical to SEQ ID NO: 168586

SEQ ID NO: 547187 - RNA, 64 nt, Homo Sapiens; identical to SEQ ID NO: 168587

SEQ ID NO: 547188 - RNA, 64 nt, Homo Sapiens; identical to SEQ ID NO: 168588

SEQ ID NO: 547189 - RNA, 64 nt, Homo Sapiens; identical to SEQ ID NO: 168589

SEQ ID NO: 547190 - RNA, 64 nt, Homo Sapiens; identical to SEQ ID NO: 168590

SEQ ID NO: 547191 - RNA, 64 nt, Homo Sapiens; identical to SEQ ID NO: 168591

SEQ ID NO: 547192 - RNA, 64 nt, Homo Sapiens; identical to SEQ ID NO: 44407

SEQ ID NO: 547193 - RNA, 64 nt, Homo Sapiens; identical to SEQ ID NO: 44408

SEQ ID NO: 547194 - RNA, 64 nt, Homo Sapiens; identical to SEQ ID NO: 44409

SEQ ID NO: 547195 - RNA, 64 nt, Homo Sapiens; identical to SEQ ID NO: 44410

SEQ ID NO: 547196 - RNA, 64 nt, Homo Sapiens; identical to SEQ ID NO: 44411

SEQ ID NO: 547197 - RNA, 64 nt, Homo Sapiens; identical to SEQ ID NO: 44412

SEQ ID NO: 547198 - RNA, 64 nt, Homo Sapiens; identical to SEQ ID NO: 44413

SEQ ID NO: 547199 - RNA, 64 nt, Homo Sapiens; identical to SEQ ID NO: 44414

SEQ ID NO: 547200 - RNA, 64 nt, Homo Sapiens; identical to SEQ ID NO: 44415

SEQ ID NO: 547201 - RNA, 64 nt, Homo Sapiens; identical to SEQ ID NO: 44416

SEQ ID NO: 547202 - RNA, 63 nt, Homo Sapiens
auuacaauuuaguuuucaguaaucaaaaagauuucuaugaauucuaaaaaauauuuuuuucua

SEQ ID NO: 547203 - RNA, 63 nt, Homo Sapiens
aaagauuucuaugaauucuaaaaaauauuuuuuucuaugaaauuacuagugcccagcuguaga

SEQ ID NO: 547204 - RNA, 63 nt, Homo Sapiens
uauaggcucgguguguguaaucccccucuuuaaucuaugaaucggcagucagcucuccaucca

SEQ ID NO: 547205 - RNA, 63 nt, Homo Sapiens
cucugcagggcaaggggaccacaaacccucugaucuaugaaguucugcaggacagacagacag

SEQ ID NO: 547206 - RNA, 63 nt, Homo Sapiens
cuguacaaugcugauaauaaaugcuucauaaaaucuaugaauauggaggauauauuuuggaga

SEQ ID NO: 547207 - RNA, 63 nt, Homo Sapiens
aacagagaagucucagaaaaaaaaaaggaagacucuaugaagagccaucuggaggaaauaaaa

SEQ ID NO: 547208 - RNA, 63 nt, Homo Sapiens
uacauggaaaaccccuaaaaggaaugaccaggcucuaugaaugcaggcucuaugaauguacau

SEQ ID NO: 547209 - RNA, 63 nt, Homo Sapiens
uacauggaaugaccaggcuccugcugaccaggcucuaugaauguacgcaacaaggacuccucg

SEQ ID NO: 547210 - RNA, 63 nt, Homo Sapiens
uuuccacauugaaacacuuugcagacacaaauaucuaugaaaagaugcuuugucagccacugu

SEQ ID NO: 547211 - RNA, 63 nt, Homo Sapiens
aaaaaauaagagacuauuuguuuucuuuuaauuucuaugaauaaaagaaauuuuuaaaaacuu

SEQ ID NO: 547212 - RNA, 63 nt, Homo Sapiens
ugaugggcucaaacuagcuguaauacaugauucucuaugaaauucauucaauuuacuuguuuu

SEQ ID NO: 547213 - RNA, 63 nt, Homo Sapiens
cagggcuuuaaaacauuuuucuccuaaaaccagucuaugaacugucccguguguccuaaaaau

SEQ ID NO: 547214 - RNA, 63 nt, Homo Sapiens
auucuuuuuuauuaggcauuauuuaugaccuuuucuaugaaaagauaaggacauuaaaaugua

SEQ ID NO: 547215 - RNA, 63 nt, Homo Sapiens
aaguuagucauauguuauuuuauuaauuguacuucuaugaaauaauaugcagucuauuuuuaa

SEQ ID NO: 547216 - RNA, 63 nt, Homo Sapiens
uaaaccauguggugaaggcuaaaagaaauaaacucuaugaaugaaaaaaaauaaaaaaaaaga

SEQ ID NO: 547217 - RNA, 63 nt, Homo Sapiens
caagcagugugggaaagcguggagagaagaaacucuaugaauggucaugaaagaacucacacu

SEQ ID NO: 547218 - RNA, 64 nt, Homo Sapiens; identical to SEQ ID NO: 129010

SEQ ID NO: 547219 - RNA, 64 nt, Homo Sapiens; identical to SEQ ID NO: 129011

SEQ ID NO: 547220 - RNA, 64 nt, Homo Sapiens; identical to SEQ ID NO: 290755

SEQ ID NO: 547221 - RNA, 64 nt, Homo Sapiens; identical to SEQ ID NO: 290756

SEQ ID NO: 547222 - RNA, 64 nt, Homo Sapiens; identical to SEQ ID NO: 225462

SEQ ID NO: 547223 - RNA, 64 nt, Homo Sapiens; identical to SEQ ID NO: 225463

SEQ ID NO: 547224 - RNA, 64 nt, Homo Sapiens; identical to SEQ ID NO: 225464

SEQ ID NO: 547225 - RNA, 64 nt, Homo Sapiens; identical to SEQ ID NO: 225465

SEQ ID NO: 547226 - RNA, 64 nt, Homo Sapiens; identical to SEQ ID NO: 225466

SEQ ID NO: 547227 - RNA, 64 nt, Homo Sapiens; identical to SEQ ID NO: 225467

SEQ ID NO: 547228 - RNA, 64 nt, Homo Sapiens; identical to SEQ ID NO: 225468

SEQ ID NO: 547229 - RNA, 64 nt, Homo Sapiens; identical to SEQ ID NO: 225469

SEQ ID NO: 547230 - RNA, 56 nt, Homo Sapiens; identical to SEQ ID NO: 225470

SEQ ID NO: 547231 - RNA, 64 nt, Homo Sapiens; identical to SEQ ID NO: 225471

SEQ ID NO: 547232 - RNA, 64 nt, Homo Sapiens; identical to SEQ ID NO: 225472

SEQ ID NO: 547233 - RNA, 64 nt, Homo Sapiens; identical to SEQ ID NO: 225473

SEQ ID NO: 547234 - RNA, 64 nt, Homo Sapiens; identical to SEQ ID NO: 225474

SEQ ID NO: 547235 - RNA, 64 nt, Homo Sapiens; identical to SEQ ID NO: 225475

SEQ ID NO: 547236 - RNA, 64 nt, Homo Sapiens; identical to SEQ ID NO: 225476

SEQ ID NO: 547237 - RNA, 64 nt, Homo Sapiens; identical to SEQ ID NO: 225477

SEQ ID NO: 547238 - RNA, 64 nt, Homo Sapiens; identical to SEQ ID NO: 225478

SEQ ID NO: 547239 - RNA, 64 nt, Homo Sapiens; identical to SEQ ID NO: 225479

SEQ ID NO: 547240 - RNA, 64 nt, Homo Sapiens; identical to SEQ ID NO: 225480

SEQ ID NO: 547241 - RNA, 64 nt, Homo Sapiens; identical to SEQ ID NO: 225481

SEQ ID NO: 547242 - RNA, 64 nt, Homo Sapiens; identical to SEQ ID NO: 225482

SEQ ID NO: 547243 - RNA, 64 nt, Homo Sapiens; identical to SEQ ID NO: 225483

SEQ ID NO: 547244 - RNA, 64 nt, Homo Sapiens; identical to SEQ ID NO: 225484

SEQ ID NO: 547245 - RNA, 64 nt, Homo Sapiens; identical to SEQ ID NO: 225485

SEQ ID NO: 547246 - RNA, 64 nt, Homo Sapiens; identical to SEQ ID NO: 225486

SEQ ID NO: 547247 - RNA, 64 nt, Homo Sapiens; identical to SEQ ID NO: 225487

SEQ ID NO: 547248 - RNA, 64 nt, Homo Sapiens
ccguauugacugcagagucuauuuaagcaugugguuuuaaaaauagacaguauuuuuuaaaaau

SEQ ID NO: 547249 - RNA, 64 nt, Homo Sapiens
auuuaagcaugugguuuuaaaaauagacaguauuuuuuaaaaaucaaaaaaugacuugcaaauu

SEQ ID NO: 547250 - RNA, 64 nt, Homo Sapiens
uuuuuaaaaaucaaaaaaugacuugcaaauuguuuuuuaaaaguaauuuugcauugcuuugaaa

SEQ ID NO: 547251 - RNA, 64 nt, Homo Sapiens
uuucagggaaaugaagauggaauuugaaggucacuuuuaaaauuaagucauugaugcugcuguu

SEQ ID NO: 547252 - RNA, 64 nt, Homo Sapiens
ugacuuaggucuuucaguuuuccuuucgguucccuuuuaaaaaugugauuguuaaccugccucu

SEQ ID NO: 547253 - RNA, 64 nt, Homo Sapiens
aaacuacuugggcagagcaaaggaaaaccucuuguuuuaaaaaaauuuuuuucagaguguuuug

SEQ ID NO: 547254 - RNA, 64 nt, Homo Sapiens
agagggaggacacaucuggaggaaauggccuucuuuuuaaaagcaaaaaacacaaaaccucaca

SEQ ID NO: 547255 - RNA, 64 nt, Homo Sapiens
guuaucuuaaaauauacacuccuaagcaguauuauuuuaaaauccuuuacccuggcuaccuccc

SEQ ID NO: 547256 - RNA, 64 nt, Homo Sapiens
gugccauucauuuggaacuuuauugcauucuuuauuuuaaaaagcuuguuuuuacguaaucaua

SEQ ID NO: 547257 - RNA, 64 nt, Homo Sapiens
gcugaaaauaaaacuuugcuauguauuuacucuuuuuuaaaagacaaaagcaaaaccagacuuu

SEQ ID NO: 547258 - RNA, 64 nt, Homo Sapiens
gagaggggagcauccauuauugauacaugugggcuuuuaaaaacuccauccuuuauaaauaguc

SEQ ID NO: 547259 - RNA, 64 nt, Homo Sapiens
uaguggugauuuggggaaggaaaguuaaugagguuuuuaaaauaagguuuucuaguuuugagag

SEQ ID NO: 547260 - RNA, 64 nt, Homo Sapiens
uuggugacaaaaaugaaggagcuuuguaaauuuuuuuuaaaauuaugaaucauaucaaguaguu

SEQ ID NO: 547261 - RNA, 64 nt, Homo Sapiens
uggugcucaccaaacgaaggguaucagcuauuuuuuuuaaaauucaaaaagaauaucccuuuua

SEQ ID NO: 547262 - RNA, 64 nt, Homo Sapiens
uggcaucauguugaagcaccgaaagauaaaugauuuuuaaaaggcuauagaguccaaaggaaua

SEQ ID NO: 547263 - RNA, 64 nt, Homo Sapiens
uuuuucuagauuguuaaaauuggcaaaugaacuuuuuuaaaaaucaucuuccauguugcaguua

SEQ ID NO: 547264 - RNA, 64 nt, Homo Sapiens
guugauuacauaaguaaguauuccccauauaaucuuuuaaaaaguuguguaugauuauuuuaaa

SEQ ID NO: 547265 - RNA, 64 nt, Homo Sapiens
cccauauaaucuuuuaaaaaguuguguaugauuauuuuaaaaucucucucucuauauauaccug

SEQ ID NO: 547266 - RNA, 64 nt, Homo Sapiens
cagcaaaggccauaaccuuuugggauuuuuuuuuuuuuaaaauacuuuagggacuguuguaauu

SEQ ID NO: 547267 - RNA, 64 nt, Homo Sapiens
gaaaauggcaaacuacuacuacuacuguucaguuuuuuaaaaguuuugaaaugcugcacuuaca

SEQ ID NO: 547268 - RNA, 64 nt, Homo Sapiens
acacuuggauuuacaccagucuuuuguguuugcuuuuuaaaauaaagugcucguauuuguauuc

SEQ ID NO: 547269 - RNA, 64 nt, Homo Sapiens
ucaaacuuagaggugugaccuuaaauuuaacuuuuuuuaaaaacugggaggucaauaaaauuua

SEQ ID NO: 547270 - RNA, 64 nt, Homo Sapiens
uagacccauuaaauuauuacagugggcuuuuuuguuuuaaaagugguuggggauccacaggaac

SEQ ID NO: 547271 - RNA, 64 nt, Homo Sapiens
ucuucaaagguucaugcucaauauugugaaaagcuuuuaaaaguuguuuugaaaagacaaucau

SEQ ID NO: 547272 - RNA, 64 nt, Homo Sapiens
uuuacuuuaaagcugucagacucuuuuaaggguauuuuaaaaauuaguaaauuugaaugaacua

SEQ ID NO: 547273 - RNA, 64 nt, Homo Sapiens
cauuuuucagccaucaguucaagagccaaugccuuuuuaaaauaaagcuucuguggucuuguuu

SEQ ID NO: 547274 - RNA, 64 nt, Homo Sapiens
aauuguugcaguguuggagaugccauuuucaccuuuuuaaaaagaugcauuuuauuugcagguu

SEQ ID NO: 547275 - RNA, 64 nt, Homo Sapiens
ugaagaaacaacccaucguucuuuuuuuucucuuuuuuaaaaaguccuauaagaucuguuuuug

SEQ ID NO: 547276 - RNA, 64 nt, Homo Sapiens
aauaaggaucaauuguaauauucauucaaaagguuuuuaaaaguaaguuuuaaggaguauuucu

SEQ ID NO: 547277 - RNA, 64 nt, Homo Sapiens
auaauagaguaagauacacuuuuuagcagugaacuuuuaaaaaauucuuuuacuuuuaacuucu

SEQ ID NO: 547278 - RNA, 64 nt, Homo Sapiens
uuaaaggaagagcauauugcaauaauaaaaauauuuuuaaaauuauguucagguuauuuauuga

SEQ ID NO: 547279 - RNA, 64 nt, Homo Sapiens
gaaagaguucaguucuguaguaucugaauuugucuuuuaaaaugaguacauauauaggcaauaa

SEQ ID NO: 547280 - RNA, 64 nt, Homo Sapiens
ugaagugcauuuggaugagauagaagaaauuguuuuuuaaaaaguuuaaguaccaaagguaguc

SEQ ID NO: 547281 - RNA, 64 nt, Homo Sapiens
uauguaaaugccuuauaugcacaggcucaaguuguuuuaaaaaucucauuuauuauaauauuga

SEQ ID NO: 547282 - RNA, 64 nt, Homo Sapiens
caguggcucauuuauaccuaauaaaauaaugguauuuuaaaauaaugcuacuuucaaaguagca

SEQ ID NO: 547283 - RNA, 64 nt, Homo Sapiens
gcugcuaaguaguucucuguauuaaaggagauauuuuuaaaacaggguacaacccccugcugca

SEQ ID NO: 547284 - RNA, 64 nt, Homo Sapiens
ugcuucaucaaaacaucuuguucauguuuuauguuuuuaaaaaaggcauuugaaugaauguuug

SEQ ID NO: 547285 - RNA, 64 nt, Homo Sapiens
ugguacuguacgauccaaaacauuguacccagcuuuuuaaaagagagaaauuaucacuacaacu

SEQ ID NO: 547286 - RNA, 64 nt, Homo Sapiens
cugcuuucauucccacaaaaccaguauuacuuuuuuuuaaaaaaagaaagaaauuggaaaucug

SEQ ID NO: 547287 - RNA, 64 nt, Homo Sapiens
uaucuucacagaaaauaaaagguguuaauuugcuuuuuaaaacaaauuuaauuaucacauuuua

SEQ ID NO: 547288 - RNA, 64 nt, Homo Sapiens
acaaaacucguaucugaguguaacuuugccaauauuuuaaaagccaaaauauucucuggacaac

SEQ ID NO: 547289 - RNA, 64 nt, Homo Sapiens
uauuuugucucucugacuugauuucuauaaaugcuuuuaaaaacaagugaagccccucuuuauu

SEQ ID NO: 547290 - RNA, 64 nt, Homo Sapiens
uuguuuguuuauaaacucagacuugccuauuuuauuuuaaaagcggcuuacacaaucucccuuu

SEQ ID NO: 547291 - RNA, 64 nt, Homo Sapiens
aaaugaagcaccaugaauucuuuuuuaaauuauuuuuuaaaagucuuucucucucugauucagc

SEQ ID NO: 547292 - RNA, 64 nt, Homo Sapiens
auauaauaagugcauguaggaauugcaaaaaauauuuuaaaaauuuauuacugaauuuaaaaau

SEQ ID NO: 547293 - RNA, 64 nt, Homo Sapiens
cagccuaccaggaacauguuguguuuucuuuauuuuuuaaaaucauuauauugaguuguguuuu

SEQ ID NO: 547294 - RNA, 64 nt, Homo Sapiens
aaaugagccuggcaagaauguguuuaaacuugguuuuuaaaaaacugcugacuguuuucucuug

SEQ ID NO: 547295 - RNA, 64 nt, Homo Sapiens
ccugaaagcccugagcuuucugcuaucaaagagguuuuaaaaaaaucccauuuaaaaaaaaucc

SEQ ID NO: 547296 - RNA, 64 nt, Homo Sapiens
agcacaguaucaguaccauuuauuugucugccgcuuuuaaaaaauacccauuggcuaugccacu

SEQ ID NO: 547297 - RNA, 64 nt, Homo Sapiens
cccauuuucugaauuuuuuuuuaaauuuccccccuuuuaaaauuguucgaaagcccacaguuau

SEQ ID NO: 547298 - RNA, 64 nt, Homo Sapiens
gguucagcccacccacccccaugauuguaugaaguuuuaaaaaaaacuacagcagccaaagaaa

SEQ ID NO: 547299 - RNA, 64 nt, Homo Sapiens
acaagcucucaauuuuguucauuuauuaucaaauuuuuaaaauacaaguuugguaugugauuug

SEQ ID NO: 547300 - RNA, 64 nt, Homo Sapiens
ccuuuuuauuucauaagacugcuaggaagugauuuuuuaaaauuaggacuccuuaagaauaaac

SEQ ID NO: 547301 - RNA, 64 nt, Homo Sapiens
ugaauggaaccaaugugcaagauacauacugcauuuuuaaaauagugucucagcuaaauggaaa

SEQ ID NO: 547302 - RNA, 64 nt, Homo Sapiens
guguauuuuauguccauuugaguagguagguagguuuuaaaaauacuaguuaaaaugccacaag

SEQ ID NO: 547303 - RNA, 64 nt, Homo Sapiens
uggaaauaauggaguuuauagagaaaagauauauuuuuaaaagcucuaggucagaaguacuaca

SEQ ID NO: 547304 - RNA, 64 nt, Homo Sapiens
uuaaaagcucuaggucagaaguacuacacagugcuuuuaaaaaguguuuaaugagaguuuacag

SEQ ID NO: 547305 - RNA, 64 nt, Homo Sapiens
uggaagcugcauguaacaaaucauuauuaucuauuuuuaaaagcuucaaaaugaugggauauga

SEQ ID NO: 547306 - RNA, 64 nt, Homo Sapiens
agguauuguaaaugacaagauaccaaauacaagauuuuaaaagcaaccauggggagaaaaagau

SEQ ID NO: 547307 - RNA, 64 nt, Homo Sapiens
aaacauuucucaccaacuuucuuauguguguucuuuuuaaaaauuuuuuuucuuuuaaaauauu

SEQ ID NO: 547308 - RNA, 64 nt, Homo Sapiens
uucuuauguguguucuuuuuaaaaauuuuuuuucuuuuaaaauauuuaacaguucaaucucaau

SEQ ID NO: 547309 - RNA, 64 nt, Homo Sapiens
auagaagcaauuucuguuuacauguccuugcuacuuuuaaaaacuugcauuuauuccucagauu

SEQ ID NO: 547310 - RNA, 64 nt, Homo Sapiens
ugcuacuuuuaaaaacuugcauuuauuccucagauuuuaaaaauaaauaaauaauucauuuaag

SEQ ID NO: 547311 - RNA, 64 nt, Homo Sapiens
aucucaacuauaaccaguuuagcuuuuuccuuacuuuuaaaauaaaauuuuuuacuuuuaacua

SEQ ID NO: 547312 - RNA, 64 nt, Homo Sapiens
auuuuuuacuuuuaacuauuuuuuuaguuaauauuuuuaaaaguauacaugucaauggccucuu

SEQ ID NO: 547313 - RNA, 64 nt, Homo Sapiens
uuuugccagaacaguuuguacagacguaugcuuauuuuaaaauuuuaucucuuauucaguaaaa

SEQ ID NO: 547314 - RNA, 64 nt, Homo Sapiens
uauuagaaguguuaacuuagcuugaaggaucuguuuuuaaaaaucauaaacugugugcagacuc

SEQ ID NO: 547315 - RNA, 64 nt, Homo Sapiens
aauuuuuaaacauguacaaagggcuacauuuuaauuuuaaaauagcuucacauuauuuuacuua

SEQ ID NO: 547316 - RNA, 64 nt, Homo Sapiens
aaagaacuaaugucucauaugauguauuuacuuauuuuaaaaaaaagaauaggaaugagauguc

SEQ ID NO: 547317 - RNA, 64 nt, Homo Sapiens
uuuuuauuauggugcagcuuuuuuuuaauuauguuuuuaaaauuauacaguugaaaaauaugcc

SEQ ID NO: 547318 - RNA, 64 nt, Homo Sapiens
ccugacagguuacccuugagggcuugugucuacuuuuuaaaagucaaugguuuuuuuucuugug

SEQ ID NO: 547319 - RNA, 64 nt, Homo Sapiens
ggcaugacaggugacuuaguauauuuguaauugguuuuaaaaccaauacaccauacuuucuuuc

SEQ ID NO: 547320 - RNA, 64 nt, Homo Sapiens
ggagggaaggaacaggcccaugggaagaaggggguuuuaaaaacaugucuucaacucagcagag

SEQ ID NO: 547321 - RNA, 64 nt, Homo Sapiens
ggcagguuuauguugauguuuacccacuacaauuuuuuaaaaauauaagcucacaugccuuuuc

SEQ ID NO: 547322 - RNA, 64 nt, Homo Sapiens
ggaauuucugguuuguaagguggucacuguucuuuuuuaaaauauuuguaauauggaaugggcu

SEQ ID NO: 547323 - RNA, 64 nt, Homo Sapiens
cuuuuguauggauucagaauauacuaaauuaacuuuuuaaaacacaacuuuuaaaaaauguauc

SEQ ID NO: 547324 - RNA, 64 nt, Homo Sapiens
cagaauauacuaaauuaacuuuuuaaaacacaacuuuuaaaaaauguaucaaaauaauaaacgu

SEQ ID NO: 547325 - RNA, 64 nt, Homo Sapiens
gcuagaaaguguauguguggcauuuguuuucacuuuuuaaaacaucccuaacugaucgaauaua

SEQ ID NO: 547326 - RNA, 64 nt, Homo Sapiens
aagucucacugauagagguucuuuauugcucauuuuuuaaaaaauggacucuugaaaucuguua

SEQ ID NO: 547327 - RNA, 64 nt, Homo Sapiens
cagucauuuuaugaaaaaucaaaauuauaagugauuuuaaaaaccagaauuuuaguugcaauac

SEQ ID NO: 547328 - RNA, 64 nt, Homo Sapiens
auuuucauacaggaauuuuuuuaauauguuauuuuuuuaaaaguucauuuuucauuugccuccg

SEQ ID NO: 547329 - RNA, 64 nt, Homo Sapiens
uuaaguuaaggauguuuggcuuuuuucuuuaauuuuuuaaaaaccauuuuccuauguuaggagu

SEQ ID NO: 547330 - RNA, 64 nt, Homo Sapiens
uuaucauuuuugagaaaucuacaccaaagugguuuuuuaaaauuacauaacuaaaaauaaacca

SEQ ID NO: 547331 - RNA, 64 nt, Homo Sapiens
aauguucuucccuguuauuuacauucugguggguuuuuaaaauucuuaccuccaucaugcaauu

SEQ ID NO: 547332 - RNA, 64 nt, Homo Sapiens
ccuuuacaauuguagcauggaccuuuaaaaauuguuuuaaaaucuuauuuaaauuuaaaccaga

SEQ ID NO: 547333 - RNA, 64 nt, Homo Sapiens
uacugugauguagcuuucuucuguaacaguuauguuuuaaaauuaagugaguuuuuuuuuugcc

SEQ ID NO: 547334 - RNA, 64 nt, Homo Sapiens
uacuguaaggagggaaauggaugaaucuggcucguuuuaaaaucacguuuucugacgaauccuu

SEQ ID NO: 547335 - RNA, 64 nt, Homo Sapiens
aaucaucaggacuaucucacccucccacuccuguuuuuaaaacucagaauucuuuccuaagagc

SEQ ID NO: 547336 - RNA, 64 nt, Homo Sapiens
aaauauaguuugguaauuuuuuuuuccaguugauuuuuaaaaagaacugcuguacagagcuugu

SEQ ID NO: 547337 - RNA, 64 nt, Homo Sapiens
guauguuaauugcaauuacugguuggggggugcauuuuaaaagaugaaacaugcagcuucccua

SEQ ID NO: 547338 - RNA, 64 nt, Homo Sapiens
uacauacugcagcagaaccagcaauacacuugauuuuuaaaagcacauuuagugaaauguuuuc

SEQ ID NO: 547339 - RNA, 64 nt, Homo Sapiens
uuugauuguuugccauauugcuuucuaaguuaaauuuuaaaaauuugaaaauaaugaucucaga

SEQ ID NO: 547340 - RNA, 64 nt, Homo Sapiens
uauuccuuuguguucaacagcauucauauuuccuuuuuaaaauguuguagcaagauuuuggaag

SEQ ID NO: 547341 - RNA, 64 nt, Homo Sapiens
aaauauauaauaaaaauguuuugucuugaaugaauuuuaaaaggcaucgucuuuguuuucuuuu

SEQ ID NO: 547342 - RNA, 64 nt, Homo Sapiens
gcuugccuacagaugguuucucuaaaauucauguuuuuaaaagacugcauuagaauuuacggug

SEQ ID NO: 547343 - RNA, 64 nt, Homo Sapiens
ugugacugucaguuguaucuuagugacuguuugauuuuaaaaagguggaggugugggcugaagg

SEQ ID NO: 547344 - RNA, 64 nt, Homo Sapiens
guuucucugacggccccacgcauucaucuccauuuuuuaaaaagcggguuguccaauucuguaa

SEQ ID NO: 547345 - RNA, 64 nt, Homo Sapiens
ccgcaaaaaaucuuuuccuggccaagaaccagauuuuuaaaaggucgauacagauggauaaacu

SEQ ID NO: 547346 - RNA, 64 nt, Homo Sapiens
ccaacaaaucucaagcccuauccccauuucuuguuuuuaaaagaaaaggucauuuuguugcauu

SEQ ID NO: 547347 - RNA, 64 nt, Homo Sapiens
aagaaaugcauauugaaguaaauugcccccuuuguuuuaaaaagaaguauugcuuucuacaaau

SEQ ID NO: 547348 - RNA, 64 nt, Homo Sapiens
acaacuguguagcugggcguggucuugguuuauauuuuaaaaagaggugugagccauggcaccc

SEQ ID NO: 547349 - RNA, 64 nt, Homo Sapiens
guggcgacaaggucuugcucguaaucucuuucuuuuuuaaaaauaaguucuucugguucaucca

SEQ ID NO: 547350 - RNA, 64 nt, Homo Sapiens
gucuacuggaaucucuuucaccucuaauaaaaucuuuuaaaauaaguuaucuacuagauuauuu

SEQ ID NO: 547351 - RNA, 64 nt, Homo Sapiens
auugugaacagaaacugaagauagaugagaauuguuuuaaaacaggcgugggagagcagacugg

SEQ ID NO: 547352 - RNA, 64 nt, Homo Sapiens
uucaauucuuugaucucauguacaacccaaaucauuuuaaaauuaccugcaguugggagccagc

SEQ ID NO: 547353 - RNA, 64 nt, Homo Sapiens
gguuagaagugaagcaaauauuccucaagaucacuuuuaaaaaaaauucaagaucaacaaagca

SEQ ID NO: 547354 - RNA, 64 nt, Homo Sapiens
caggguagcaguaacaugacugcucccugucacuuuuuaaaagcaaaguccuaaucuaaagucc

SEQ ID NO: 547355 - RNA, 64 nt, Homo Sapiens
guuucauuggauauaggccuacuccucauagagcuuuuaaaauguaauagacaucuaaaauucc

SEQ ID NO: 547356 - RNA, 59 nt, Homo Sapiens
caaguguaauagacaucuaagcauuuuucuuuuaaaagauugcucauucugaaauuuaa

SEQ ID NO: 547357 - RNA, 64 nt, Homo Sapiens
auuggacaucuucaaucuuaaugguaauguccaguuuuaaaaauuagaaauguucuaccuguau

SEQ ID NO: 547358 - RNA, 64 nt, Homo Sapiens
uuuuuaagaauuguuugucaaacagugaaggaauuuuuaaaaaauucugccacauuuauugaua

SEQ ID NO: 547359 - RNA, 64 nt, Homo Sapiens
uaaacuagacaucuuaauuggcuugaguuucccauuuuaaaaucgcuauauuuacuuuuuaaau

SEQ ID NO: 547360 - RNA, 64 nt, Homo Sapiens
gaacuucucccgcuacacagcugaauuuuaucuguuuuaaaaauauaccauucacaccuaaaga

SEQ ID NO: 547361 - RNA, 64 nt, Homo Sapiens
auuuaccuuauuaaaaugaaaaaaaaugucagguuuuuaaaauccuaguuuuuuuuuuucuucu

SEQ ID NO: 547362 - RNA, 64 nt, Homo Sapiens
uaaugucugggcuuugaguaggaaagcaaaccccuuuuaaaaucaauuuuguacaaucuguccu

SEQ ID NO: 547363 - RNA, 64 nt, Homo Sapiens
auaauuauauacuuuagaaaguugaucugggccuuuuuaaaaacuggguuacuguuuaaggaaa

SEQ ID NO: 547364 - RNA, 64 nt, Homo Sapiens
gccuauaugcccagggccuaacucacccgaggaauuuuaaaacauucaaacugguacacauuag

SEQ ID NO: 547365 - RNA, 64 nt, Homo Sapiens
uguguauauuuuaucagauuauauauguauguguuuuuaaaauauccacuuuugaucuauuuau

SEQ ID NO: 547366 - RNA, 64 nt, Homo Sapiens
cuagucuuugaaaagcaguuuguuugcuuagaguuuuuaaaaacguauaaucugaaguggaaau

SEQ ID NO: 547367 - RNA, 64 nt, Homo Sapiens
uguauaaucugaaguggaaagaaucaaugcugauuuuuaaaauaauaguaaaauauaugcucac

SEQ ID NO: 547368 - RNA, 64 nt, Homo Sapiens
uaaagugugaaagaaacagcuccuugagacguacuuuuaaaauccucaaauuggaaagaaagau

SEQ ID NO: 547369 - RNA, 64 nt, Homo Sapiens
acuauugaugauagaagaauuagaauauuauaauuuuuaaaaggagauuuuuauuuuguauaug

SEQ ID NO: 547370 - RNA, 64 nt, Homo Sapiens
uucucuugaaaggaagaauacaguaaucauugcauuuuaaaaucggguguaguuaucauuuaua

SEQ ID NO: 547371 - RNA, 64 nt, Homo Sapiens
acuuuaaugaggaaagcuauuaugcugggauuguuuuuaaaaaaauuuaaugucuuugcaacuu

SEQ ID NO: 547372 - RNA, 64 nt, Homo Sapiens
aauauuuaaugucuuugcaaauaacuguuuauauuuuuaaaagcuugagaccuauaauucacca

SEQ ID NO: 547373 - RNA, 64 nt, Homo Sapiens
uauuuucucuguacuuuucauagccugaugagauuuuuaaaaaacagacacgagccaccucacc

SEQ ID NO: 547374 - RNA, 64 nt, Homo Sapiens
caauguaagcauacuuuguaauuugaugcaugucuuuuaaaaugggcuguaaucauuuguuuac

SEQ ID NO: 547375 - RNA, 64 nt, Homo Sapiens
cucuuuguguauuuggaaucaaguccuuguuuuauuuuaaaauucacgugaaacuauuuaugug

SEQ ID NO: 547376 - RNA, 64 nt, Homo Sapiens
uauauucaucucagcuuucuaaaguauuuaauucuuuuaaaaauuuuaaaggacuaugauugau

SEQ ID NO: 547377 - RNA, 64 nt, Homo Sapiens
uuuuuccaaaaacaauuagguaaauugugauucuuuuuaaaaauugcaggugucuuggucauga

SEQ ID NO: 547378 - RNA, 64 nt, Homo Sapiens
cuaauguucuuuauugcaaguguaucauaauagauuuuaaaaaucuauuuacccuuuacauuuu

SEQ ID NO: 547379 - RNA, 64 nt, Homo Sapiens
acauggaacgguuuuuuuuauguguaaguguuuuuuuuaaaaucagaguacuauucuaucuaga

SEQ ID NO: 547380 - RNA, 64 nt, Homo Sapiens
cauugauuccacauguaagguucuuuaucugaaauuuuaaaagauaugucuccucaaaugaaaa

SEQ ID NO: 547381 - RNA, 64 nt, Homo Sapiens
acuacaauauuuaacuaagguuucaauauacaaauuuuaaaaauuuaacagcucauuuugucuu

SEQ ID NO: 547382 - RNA, 64 nt, Homo Sapiens
gagguaaaugccguauaugaccuacuggcaagguuuuuaaaaauagaagagcagcuuagauuuc

SEQ ID NO: 547383 - RNA, 64 nt, Homo Sapiens
aaaugugagguaaaauaaguacuaaaguguaggauuuuaaaauucacauuuucucuaacccuua

SEQ ID NO: 547384 - RNA, 64 nt, Homo Sapiens
uagguaucucuuugcauauacagguagcucucuuuuuuaaaauauggaugggaugcaugacaua

SEQ ID NO: 547385 - RNA, 64 nt, Homo Sapiens
caccuagaaucauagggccuuuggggaaaaauuuuuuuaaaauuaaaguuuuaagaauuguucc

SEQ ID NO: 547386 - RNA, 64 nt, Homo Sapiens
ugguacuacuacuaaaucuacuguaucaguggacuuuuaaaacuguuuuauuaugcaguuaaau

SEQ ID NO: 547387 - RNA, 64 nt, Homo Sapiens
ucagugcuuccuaaauguuuuugagcugacaaguuuuuaaaacuagauuaagugcuuuugucau

SEQ ID NO: 547388 - RNA, 64 nt, Homo Sapiens
agccugguggcucacgccugucaaaaaacauuauuuuuaaaauucaacauagugagaucccauc

SEQ ID NO: 547389 - RNA, 64 nt, Homo Sapiens
aggaaagaauaaaucagccacaaaauggaaauaauuuuaaaaucaauaucuacuugguuuuucu

SEQ ID NO: 547390 - RNA, 64 nt, Homo Sapiens
aauuugagaagucuacuuccacugacauuucuuuuuuuaaaaaaguacuuuaaauguagcagcc

SEQ ID NO: 547391 - RNA, 64 nt, Homo Sapiens
ggacaaaauccaugaacaauuaagacaacugaguuuuuaaaaauuauaaagaccuauaaaucau

SEQ ID NO: 547392 - RNA, 64 nt, Homo Sapiens
auaacaaucacaaaggaaaguuuauucuuuuacuuuuuaaaauaugccuguggaguagccauuc

SEQ ID NO: 547393 - RNA, 64 nt, Homo Sapiens
guuuuuaaugaauagucuuagacauuaacgaguguuuuaaaaagguggccuuaguuuguuuauu

SEQ ID NO: 547394 - RNA, 64 nt, Homo Sapiens
gaaccuuucacuagcuagcaucauugcuacagguuuuuaaaaaauaucuuucuaaucuguuuua

SEQ ID NO: 547395 - RNA, 64 nt, Homo Sapiens
aaucaugaagagaaggcugucaggcaacauuugcuuuuaaaaaugugcaaaguaaaauucuucu

SEQ ID NO: 547396 - RNA, 64 nt, Homo Sapiens
uuauuuuucauaucauuuauaguugauggccaaauuuuaaaaugauaggcaaaccauuucuuaa

SEQ ID NO: 547397 - RNA, 64 nt, Homo Sapiens
uacaaaaauuuguauaggcauagaauauauuaucuuuuaaaaauuucugaggaccauaugaggg

SEQ ID NO: 547398 - RNA, 64 nt, Homo Sapiens
uauguuuguaugguagagaaucaauaguguuggcuuuuaaaacgccugaagggcauaccuaacc

SEQ ID NO: 547399 - RNA, 64 nt, Homo Sapiens
aaauuaaaucagacaccacacugaaaaugaucucuuuuaaaaagaaggguugaguaacuuagaa

SEQ ID NO: 547400 - RNA, 64 nt, Homo Sapiens
aaaucuauauauugacuuucuacaaaauacuuauuuuuaaaaugcauuacauacuaugccagau

SEQ ID NO: 547401 - RNA, 64 nt, Homo Sapiens
ugaaauucccuguucuaguucauuuuucuucugcuuuuaaaaacuggaauccccaaaaagauaa

SEQ ID NO: 547402 - RNA, 64 nt, Homo Sapiens
gauauaauaauagcauuuaaccuuuaauucccaguuuuaaaacaacucugcaaaguauuucuaa

SEQ ID NO: 547403 - RNA, 64 nt, Homo Sapiens
guuuuccccacaagucaucuaaauuggaagcuuuuuuuaaaaauuugcuuuucucucuuccaca

SEQ ID NO: 547404 - RNA, 64 nt, Homo Sapiens
auauauauauauauaaagauugggucugggauuauuuuaaaauugggagggggguuaauggaac

SEQ ID NO: 547405 - RNA, 64 nt, Homo Sapiens
aacacacacaugaacugcacuuuaaagaaggcacuuuuaaaauuuuuuuaaaauuaaguaauuu

SEQ ID NO: 547406 - RNA, 64 nt, Homo Sapiens
aaguaauuuuuuaaagaagguccccacuuuuauuuuuuaaaauugaaagucaccugaggaaguu

SEQ ID NO: 547407 - RNA, 64 nt, Homo Sapiens
ucuaaucuauccccucuaacucaccccacccugcuuuuaaaaauauucuuuguaaaauucuccc

SEQ ID NO: 547408 - RNA, 64 nt, Homo Sapiens
auucaucauaugaauguucucuaauuuuaaguuauuuuaaaaaauuaagguguacguaucauuu

SEQ ID NO: 547409 - RNA, 64 nt, Homo Sapiens
cagucaagagcaaucaaagcaaaagugaacuugauuuuaaaaacgaugacuuuuuuucugauuc

SEQ ID NO: 547410 - RNA, 64 nt, Homo Sapiens
aaaaaaaaacccaaaaauaauaaauacauaucauuuuuaaaaaucaaaacaugacccauaguau

SEQ ID NO: 547411 - RNA, 64 nt, Homo Sapiens
ucagccaaauaaugcauuuuagugaaaaaaauauuuuuaaaauucuaagauugcucuaacgucu

SEQ ID NO: 547412 - RNA, 64 nt, Homo Sapiens
uauguugacuaaauacaaagccacaaccuaguuauuuuaaaaaucugcagaaaauuauguguau

SEQ ID NO: 547413 - RNA, 64 nt, Homo Sapiens
aauuuuaccguaacuauaaaucuacacagaaaguuuuuaaaaugauuacuuggcacaauuuauu

SEQ ID NO: 547414 - RNA, 64 nt, Homo Sapiens
aaaacuugauuuguuauuaacuguucacuguuuuuuuuaaaaaacaauaugcuuguauaaaaca

SEQ ID NO: 547415 - RNA, 64 nt, Homo Sapiens
uuuugagggaucuguggaugccauaagacugaccuuuuaaaauggucucauuagccugaaugug

SEQ ID NO: 547416 - RNA, 64 nt, Homo Sapiens
aguauacacuuauuuuaaguaaaaaaaaaggcccuuuuaaaaauucuuaagaagauuaaaagag

SEQ ID NO: 547417 - RNA, 64 nt, Homo Sapiens
agcaaugaaacaauaauuugauuucaugucuacuuuuuaaaaucuaaauuagacauuaccagua

SEQ ID NO: 547418 - RNA, 64 nt, Homo Sapiens
aaaggaaaacaaaaaacuuucacuuuuaugaaguuuuuaaaaaugaugaacaauguauacaaug

SEQ ID NO: 547419 - RNA, 64 nt, Homo Sapiens
aacugagauauuauuuuaaacgaaaguauuuacuuuuuaaaaauuuucaucaaugcaguucuca

SEQ ID NO: 547420 - RNA, 64 nt, Homo Sapiens
auuauacuugcacaugaaaaaugaaauguugccuuuuuaaaauaaugcuuauaaaagacuuuua

SEQ ID NO: 547421 - RNA, 64 nt, Homo Sapiens
auuauuuuugacuaugaacauuuuguuucauaaauuuuaaaauaauuuccuauauaacuaaaaa

SEQ ID NO: 547422 - RNA, 64 nt, Homo Sapiens
gacagaagauaauuuauacccacuagaaaaauucuuuuaaaauuuauaucuauauaguaaauuu

SEQ ID NO: 547423 - RNA, 64 nt, Homo Sapiens
uauuaagguuuuaugaaguucucuaugaaagcaauuuuaaaaauuuguuuuauaauaauccaaa

SEQ ID NO: 547424 - RNA, 64 nt, Homo Sapiens
aaaaaguuguuaguuugaauagaauaauggauuuuuuuaaaaaaagaagcacaguugaaguccu

SEQ ID NO: 547425 - RNA, 64 nt, Homo Sapiens
acauaucuuuaugauuuucaucuuucaaauugacuuuuaaaaauagguacuguuagucuguuag

SEQ ID NO: 547426 - RNA, 64 nt, Homo Sapiens
uuucuauuucaguuuuguuuguagaaaauagcaguuuuaaaaguugucauuuguacauaaacua

SEQ ID NO: 547427 - RNA, 64 nt, Homo Sapiens
gaaauuaggaauuugaauuuuacguuauacaaauuuuuaaaauucuuauccuaagauucaauau

SEQ ID NO: 547428 - RNA, 64 nt, Homo Sapiens
aggcugaaacauuuuauuucacauacaggcauucuuuuaaaaccuugaaaaaagccuuuugaca

SEQ ID NO: 547429 - RNA, 64 nt, Homo Sapiens
ugucaggaucccacuguaaacucagcacugucacuuuuaaaaccaguguuaaugaauaucaugc

SEQ ID NO: 547430 - RNA, 64 nt, Homo Sapiens
aaaucuuggcagcuguccuuaccugagaggugucuuuuaaaaacgcuagcauacacuaccucuu

SEQ ID NO: 547431 - RNA, 64 nt, Homo Sapiens
cuguuagaagaaaaaaagcaccuucuuuuuaccuuuuuaaaaaugauuucucccgcaauuuguu

SEQ ID NO: 547432 - RNA, 64 nt, Homo Sapiens
uaacacaaucagaaauuuuugaaaaccagcuuguuuuuaaaacuuauguacaaacauacuggaa

SEQ ID NO: 547433 - RNA, 64 nt, Homo Sapiens
auacacucuaucacauauuuauuuuaagaacauguuuuaaaaagauauaaugaccugcuaauau

SEQ ID NO: 547434 - RNA, 64 nt, Homo Sapiens
uacuaaaaugaggauuaguacccccuuugggauauuuuaaaaucauggauggauuaauauuuau

SEQ ID NO: 547435 - RNA, 64 nt, Homo Sapiens
acaaacagaugaaaaccucauuugcuauaauuauuuuuaaaaaauaagucuuuguacuaaagca

SEQ ID NO: 547436 - RNA, 64 nt, Homo Sapiens
uaaaaaguggaaauuuccuuaguguuugaaucaauuuuaaaacauuuaauaaauccucuauaca

SEQ ID NO: 547437 - RNA, 64 nt, Homo Sapiens
ucaguuuuaagaucucuggucacauggcagcauuuuuuaaaaauauuacaggcgggagccacug

SEQ ID NO: 547438 - RNA, 64 nt, Homo Sapiens
guuuuguuucuucuuacaaauccugaaggaagauuuuuaaaaauaauaaugaaggacaaaugaa

SEQ ID NO: 547439 - RNA, 64 nt, Homo Sapiens
ggucucuaacugaagagagauucugcugcugaacuuuuaaaagauccaucuuucuuuuucuucc

SEQ ID NO: 547440 - RNA, 64 nt, Homo Sapiens
guguuugaaaauuauacauuguuauucaccagcuuuuuaaaaaauuauuuaauccuagcucuuu

SEQ ID NO: 547441 - RNA, 64 nt, Homo Sapiens
guuucuacuccaauuaagaaguuuuucacaguaauuuuaaaaacuuuucuggaaucucacucuu

SEQ ID NO: 547442 - RNA, 64 nt, Homo Sapiens
uggaguaaaagugaggcacaaguuuaaaaacacuuuuuaaaaagucagagugcuucugaaguac

SEQ ID NO: 547443 - RNA, 64 nt, Homo Sapiens
aaauuaagaaguauuuauaguuaacagcacaauuuuuuaaaaaucuuguugccccguaaaaggg

SEQ ID NO: 547444 - RNA, 64 nt, Homo Sapiens
caggcacuaauauauauuucaauguaaaauaaacuuuuaaaaaggagaaaaauacuguauuuaa

SEQ ID NO: 547445 - RNA, 64 nt, Homo Sapiens
ucaaauccuaaaucacuucuugaaguacuuagauuuuuaaaauuuuguuauuguauguuguuac

SEQ ID NO: 547446 - RNA, 64 nt, Homo Sapiens
uaaaaacucaacaccucacaugauuaaaggccauuuuuaaaacuauaucaggugcagcuggcuu

SEQ ID NO: 547447 - RNA, 64 nt, Homo Sapiens
gcacagaacacuaagaccgauuuauuuuguuggguuuuaaaauuuaagacauuuuuaaguuaua

SEQ ID NO: 547448 - RNA, 64 nt, Homo Sapiens
ggaaaucaacuuacacuuccuguauaaguacagauuuuaaaaaagagggugggacacaugagga

SEQ ID NO: 547449 - RNA, 64 nt, Homo Sapiens
ggaaguacaggauuuucuucuagaauugucugcuuuuuaaaacuuuuaaaugguugcuucuuca

SEQ ID NO: 547450 - RNA, 64 nt, Homo Sapiens
uaauaagcaagacacauugguugucuuugucacauuuuaaaaaaugaguuuccagcuguagcuu

SEQ ID NO: 547451 - RNA, 64 nt, Homo Sapiens
cgaauuucaucauuuaucuaugcuacucaucuuuuuuuaaaaacguccccuauuagaauagggu

SEQ ID NO: 547452 - RNA, 64 nt, Homo Sapiens
uuacugccaugaaauacuccacacuaaaauuauauuuuaaaaguguugauuguuuauauaaaac

SEQ ID NO: 547453 - RNA, 64 nt, Homo Sapiens
uaaagcuacauccaaagaaaaguuagauaauguguuuuaaaauacagaauuauuguggggauua

SEQ ID NO: 547454 - RNA, 64 nt, Homo Sapiens
cucauuucuacaucuuagcagcaggauacacaauuuuuaaaaauaaagacuaauucaagaaguu

SEQ ID NO: 547455 - RNA, 64 nt, Homo Sapiens
auaguaaaagucauauuuaauggauuguauugacuuuuaaaaauuacuuaaaguagcaaaguca

SEQ ID NO: 547456 - RNA, 64 nt, Homo Sapiens
aucagauaucgugagacuuagaaaagggaaacccuuuuaaaaccagagagaaugagaacuaagu

SEQ ID NO: 547457 - RNA, 64 nt, Homo Sapiens
aaaaguaauuaccuuuguguucacauuuggauaauuuuaaaaaguuuuucucuuuccaguaagu

SEQ ID NO: 547458 - RNA, 64 nt, Homo Sapiens
cagaacauguauauugguccuagguggaguauauuuuuaaaacuauuaaacuagacagauaguu

SEQ ID NO: 547459 - RNA, 64 nt, Homo Sapiens
uguaacccaaauguccaauauaaauuggcuuauuuuuuaaaauaauuuuaaaaguugggaaaag

SEQ ID NO: 547460 - RNA, 64 nt, Homo Sapiens
uguccaauauaaauuggcuuauuuuuuaaaauaauuuuaaaaguugggaaaaguguuauuauuu

SEQ ID NO: 547461 - RNA, 64 nt, Homo Sapiens
gaaacauuuuugauacauaacagaccucagucuuuuuuaaaaauuaauauauuuucaggcguau

SEQ ID NO: 547462 - RNA, 64 nt, Homo Sapiens
gguacguuauguccugguuuaaaaaggauuaaaauuuuaaaauaauccuugcaucuaaaggccu

SEQ ID NO: 547463 - RNA, 64 nt, Homo Sapiens
gggggcuagggaagagccugccagauuuucacauuuuuaaaauguucuagucauuuugagaaau

SEQ ID NO: 547464 - RNA, 64 nt, Homo Sapiens
aacaggcaaauauuguagcuauauuacagugggauuuuaaaaaucuuguuaaacauucuauaaa

SEQ ID NO: 547465 - RNA, 64 nt, Homo Sapiens
uuuuaucucaguuauuugcccaucacaagcacauuuuuaaaauguugcuuuguguguguuugac

SEQ ID NO: 547466 - RNA, 64 nt, Homo Sapiens
acucgugugcaugagaaugucauuugcuaaugaauuuuaaaagcauauauaaaacaaaacaaac

SEQ ID NO: 547467 - RNA, 64 nt, Homo Sapiens
acaauugauuuucccccuaauucuuauuuuauaauuuuaaaauugcagcaguugcuagcaacaa

SEQ ID NO: 547468 - RNA, 64 nt, Homo Sapiens
gcuuuguaaaaaauaacuguaauugauauuucauuuuuaaaauuuauaaauuccaaucauuguc

SEQ ID NO: 547469 - RNA, 64 nt, Homo Sapiens
ugaagcacucugacauguacauuuaaagugacaguuuuaaaaguaaaaugguguuaaaucucug

SEQ ID NO: 547470 - RNA, 64 nt, Homo Sapiens
auggcaaauacuucuaauuuuuuucccuaaacauuuuuaaaagugaaauaugggaagagcuuua

SEQ ID NO: 547471 - RNA, 64 nt, Homo Sapiens
cauuacauuaaaaaggaauuuuagagauugauuguuuuaaaaaaaaauacgcacauuguccaau

SEQ ID NO: 547472 - RNA, 64 nt, Homo Sapiens
ccagaauuucuaaauaaauccccugguuaggaaauuuuaaaagucaaagcuuguuuucuucaac

SEQ ID NO: 547473 - RNA, 64 nt, Homo Sapiens
uuuacuguccuuuccuccugggauaugagaaacauuuuaaaaaacguauuuaacagaagagagc

SEQ ID NO: 547474 - RNA, 64 nt, Homo Sapiens
uauuuuaaaucuaaauucugucacuucgcugccuuuuuaaaauagugugguauuucaaauauug

SEQ ID NO: 547475 - RNA, 64 nt, Homo Sapiens
ccacaggcucuccacuuugaaacuuuaguuugaauuuuaaaagauaggaaguaauacaguuuaa

SEQ ID NO: 547476 - RNA, 64 nt, Homo Sapiens
guuuuuucuuuuucuuuucuuuuuuuuuuuuuuuuuuuaaaaaagcaccuuuuuuuguuguuuc

SEQ ID NO: 547477 - RNA, 64 nt, Homo Sapiens
uuuuuuuuaagaucauuaugugcaaaacaccaaguuuuaaaaauaacucacagaauggccuuag

SEQ ID NO: 547478 - RNA, 64 nt, Homo Sapiens
guuccuuggcuacuguuuuucuuuuacuucaguuuuuuaaaaaucucaaaugaaaaagucuucg

SEQ ID NO: 547479 - RNA, 64 nt, Homo Sapiens
guauuguaauauguaaaguaagcccaacaaaaauuuuuaaaaauuugaugauccccaauauauc

SEQ ID NO: 547480 - RNA, 64 nt, Homo Sapiens
uuuuuguugaagcucuagcuuaagaagaaacuuuuuuuaaaaagacuguuuggggauucuuuuu

SEQ ID NO: 547481 - RNA, 64 nt, Homo Sapiens
uauacuaauuaacccauuugugcauugaguuuucuuuuaaaaaugcuuguugugaaagacacag

SEQ ID NO: 547482 - RNA, 64 nt, Homo Sapiens
guagccucucugggcccaauaaaacaacacacauuuuuaaaaaauauggguauugauguccggc

SEQ ID NO: 547483 - RNA, 64 nt, Homo Sapiens
aacuuacaaagcuaguugccauauuucuauuuuauuuuaaaaaguaaacaugcggcugggcgug

SEQ ID NO: 547484 - RNA, 64 nt, Homo Sapiens
ggcaugagccaccgugcccagccucaaaaauauuuuuuaaaagaaaagagaaaauaauucuucu

SEQ ID NO: 547485 - RNA, 64 nt, Homo Sapiens
ucccuguggcaauguacuguucucacauuaagccuuuuaaaaauguuccauacuguauuagcau

SEQ ID NO: 547486 - RNA, 64 nt, Homo Sapiens
ggauucuuuguauuguuuauuucauuuugguuuauuuuaaaagauguaaacauauauuaagcua

SEQ ID NO: 547487 - RNA, 64 nt, Homo Sapiens
uaaugaugacauucaguucucuuuuguuuuuauuuuuuaaaaacucagguguaauuauuaucug

SEQ ID NO: 547488 - RNA, 64 nt, Homo Sapiens
acuuauuucuuucaaaacauuuuugguuuuugguuuuuaaaauuuuuauuaaacaauugcuguu

SEQ ID NO: 547489 - RNA, 64 nt, Homo Sapiens
uuauuuuggcaaaacugucaaaugagaaaaaugauuuuaaaaacuuuuuuuucaauugacaaga

SEQ ID NO: 547490 - RNA, 64 nt, Homo Sapiens
uguagguuuccuuaugcuguuuuuacugugcacuuuuuaaaauuagguuuuaauuucaguaugu

SEQ ID NO: 547491 - RNA, 64 nt, Homo Sapiens
uucuuauuauaguugaaggcauucuccagauucuuuuuaaaagauuuguucauauuucucucuc

SEQ ID NO: 547492 - RNA, 64 nt, Homo Sapiens
cuaguuaacauauuuguguauauuaaauaugaauuuuuaaaauuuauaaauacuauuuuccaaa

SEQ ID NO: 547493 - RNA, 64 nt, Homo Sapiens
auuuccuuucagcauuuacagugaaaagugagaauuuuaaaauuuaugaaaucuauauuccagg

SEQ ID NO: 547494 - RNA, 64 nt, Homo Sapiens
aucaaaguauaguugauaauguuauaaaggaugauuuuaaaaauaggguauaaucaugacucac

SEQ ID NO: 547495 - RNA, 64 nt, Homo Sapiens
guuugccugcaguugaacaauacuuuagaguacuuuuuaaaauuauuucucacaaagaaaugaa

SEQ ID NO: 547496 - RNA, 64 nt, Homo Sapiens
augcacaguuugguacaguagagaucauuaauacuuuuaaaaguucugcauuaauugacuugga

SEQ ID NO: 547497 - RNA, 64 nt, Homo Sapiens
augauugguucugaucuuaccggcuaguggucauuuuuaaaaaacuuguacccucuuaucugaa

SEQ ID NO: 547498 - RNA, 64 nt, Homo Sapiens
guaacauauguuaaauaaaacuguuauuuuugaauuuuaaaauuuguuuuuuggggguaugaac

SEQ ID NO: 547499 - RNA, 64 nt, Homo Sapiens
uuccauuacuauguggcuuagggauuuauuuguuuuuuaaaaucaaccauguuagcugggauua

SEQ ID NO: 547500 - RNA, 64 nt, Homo Sapiens
aaaauacaaguucuggaaaaaauauuuuucuucauuuuaaaacuuuuuuuuaacuaauaauagc

SEQ ID NO: 547501 - RNA, 64 nt, Homo Sapiens
gauugacuuggccuucaggcuccuuuggucauaauuuuaaaauaugggaguagaaaacaacaaa

SEQ ID NO: 547502 - RNA, 64 nt, Homo Sapiens
aguaugagucccucaggaaaaaaaaaaaauucuguuuuaaaaagcaaucugauucuuagcucuu

SEQ ID NO: 547503 - RNA, 64 nt, Homo Sapiens
gauuuuaaaguagaaauaaauauguauuccauguuuuuaaaagauuacuuucuacuuuguguuu

SEQ ID NO: 547504 - RNA, 64 nt, Homo Sapiens
gauauaaagaaaacuuuuuugugcuaaaaauacuuuuuaaaaucaauuuuguugauuguaguaa

SEQ ID NO: 547505 - RNA, 64 nt, Homo Sapiens
uggcauucuaguauuaaauccucacuucaggagcuuuuaaaaauacugagacccccccauaacc

SEQ ID NO: 547506 - RNA, 64 nt, Homo Sapiens
ggcaacauggugaaaccccaucucuacaaaaaauuuuuaaaaaguuggccaggcaugguaaugc

SEQ ID NO: 547507 - RNA, 64 nt, Homo Sapiens
ucaccgaaagcucacagauugcagaaauuagcuuuuuuaaaaaacaaaccccaguaaauauaau

SEQ ID NO: 547508 - RNA, 64 nt, Homo Sapiens
ucucucuccucuuuuccuccucaaaauguauauauuuuaaaagccuuaacuguuaguuaugccu

SEQ ID NO: 547509 - RNA, 64 nt, Homo Sapiens
cagggcacuucagaguagagggcuugggaagaucuuuuaaaaaggcaguaggcccgguguggug

SEQ ID NO: 547510 - RNA, 64 nt, Homo Sapiens
auucuaauuuuauauauagagaaagugaccuauuuuuuaaaaaaaucacacucuaaguucuauu

SEQ ID NO: 547511 - RNA, 64 nt, Homo Sapiens
ugaauagcaaaaaacugauaguuacuugcuuguuuuuuaaaaauuacauauuaaaaaugcccuu

SEQ ID NO: 547512 - RNA, 64 nt, Homo Sapiens
guuaaaugucuuaaauguauacauuagauguguguuuuaaaaugcauaaaacacguugaaauac

SEQ ID NO: 547513 - RNA, 64 nt, Homo Sapiens
ucauauaaaauugaauucuacucauuagaguacuuuuuaaaaguacagcagaaagaaaagaagu

SEQ ID NO: 547514 - RNA, 64 nt, Homo Sapiens
gagcaaacuagaaauuggcuucaaagucuaauacuuuuaaaagcauguguuuuguguauaugcu

SEQ ID NO: 547515 - RNA, 64 nt, Homo Sapiens
agacaaauaacuacugcaaaaaguacauagugaauuuuaaaauguagaagaaagcaaaaaauaa

SEQ ID NO: 547516 - RNA, 64 nt, Homo Sapiens
uaucauuaaacaugaauuuaaugucuaggauaauuuuuaaaagaggaaauuaaauaauuuuaca

SEQ ID NO: 547517 - RNA, 64 nt, Homo Sapiens
ucugugaugauuaacaguaugucaccacuucauuuuuuaaaaaggaucacgucuaaugcccauu

SEQ ID NO: 547518 - RNA, 64 nt, Homo Sapiens
ugaaugcuuuuuguuggauuucguaggguauuuuuuuuaaaauagggucuugcuauguugccca

SEQ ID NO: 547519 - RNA, 64 nt, Homo Sapiens
cuuaaaauuuuugaaaacuccaucguuaaacaacuuuuaaaagaaauaacuaaauuuucaaaug

SEQ ID NO: 547520 - RNA, 64 nt, Homo Sapiens
aaguaugccucccguggguauacguuuuuaccuuuuuuaaaaaacauuuuuguagaaaaaauaa

SEQ ID NO: 547521 - RNA, 64 nt, Homo Sapiens
guagagaaacagaugacaaaucucugaaagagguuuuuaaaacuuuugauccaacugcuucacc

SEQ ID NO: 547522 - RNA, 64 nt, Homo Sapiens
gcuaauuaaaauguaaaaucaaguaaagaaaacauuuuaaaauuacaauuagcagagcaguuca

SEQ ID NO: 547523 - RNA, 64 nt, Homo Sapiens
ggcuuccaauaaguaucuuaggaacuuauuuccuuuuuaaaaaauauuuuuuaaauuuuuaaaa

SEQ ID NO: 547524 - RNA, 64 nt, Homo Sapiens
aacuuauuuccuuuuuaaaaaauauuuuuuaaauuuuuaaaauuugauuuuaaauuucaaauaa

SEQ ID NO: 547525 - RNA, 64 nt, Homo Sapiens
caacacugacuacaugcuggaaugacugugaagcuuuuaaaaaauguuagugcccacucuuccc

SEQ ID NO: 547526 - RNA, 64 nt, Homo Sapiens
uaauaaaaaacagaguauuuuauguaauuucuguuuuuaaaaagacauuauuaaaugggucaaa

SEQ ID NO: 547527 - RNA, 64 nt, Homo Sapiens
agauaaaucuaggcaggauacugcauuuuugugguuuuaaaaaaguccuuaggacagacugaau

SEQ ID NO: 547528 - RNA, 64 nt, Homo Sapiens
uagugaacacauuuuuuaacaaaauaaguuguaauuuuaaaaggaaaguuuugccuauuuuauu

SEQ ID NO: 547529 - RNA, 64 nt, Homo Sapiens
cugcucuugugauuuuucucaggcuguuuugucauuuuaaaauccagugguagauguagcuuag

SEQ ID NO: 547530 - RNA, 64 nt, Homo Sapiens
guaucagauuaaacaccgaauucagccacuggacuuuuaaaaguacuuaagaugguuuaucucg

SEQ ID NO: 547531 - RNA, 64 nt, Homo Sapiens
uuuuggugguagcuucuagucccagaaucuguguuuuuaaaauacuacaugacauucugucuau

SEQ ID NO: 547532 - RNA, 64 nt, Homo Sapiens
ugguuauacugaagcauaaaccuugccuguguaauuuuaaaaaauuaauagagcugugcaaacc

SEQ ID NO: 547533 - RNA, 64 nt, Homo Sapiens
cuuucuauuuuuuaccugugaaauaacagugacuuuuuaaaauggugacaguguuggcaaggaa

SEQ ID NO: 547534 - RNA, 64 nt, Homo Sapiens
uuugucaucuuuaaaaauacagcaauaugugacuuuuuaaaaaagcugucaaauaggugugacc

SEQ ID NO: 547535 - RNA, 64 nt, Homo Sapiens
uuuggaguaggagguucccuccucaauuuuguauuuuuaaaaguacaugguaaaaaaaaaaauu

SEQ ID NO: 547536 - RNA, 64 nt, Homo Sapiens
ucuuaagggcucagauuuagcaaacacggaagaauuuuaaaaugagcucuccuuucaacccuug

SEQ ID NO: 547537 - RNA, 64 nt, Homo Sapiens
ccaccuaagccucuggguaauauuguaaauauuguuuuaaaaugcaucagccuaugcuauacaa

SEQ ID NO: 547538 - RNA, 64 nt, Homo Sapiens
uugggggaaaauauuaacuuugcugaauugaaaguuuuaaaaauccuuuuaguauucuaaaaca

SEQ ID NO: 547539 - RNA, 64 nt, Homo Sapiens
guguaacuguaucauacuuuuuuuguauuuuaaauuuuaaaauaaaggcuaauauauuuagaca

SEQ ID NO: 547540 - RNA, 64 nt, Homo Sapiens
uaauaccaaauauuuuagccuuaaauuuuugucauuuuaaaaucugauuuaauguuuucugcug

SEQ ID NO: 547541 - RNA, 64 nt, Homo Sapiens
aguacucaguauagcauugaacauuucuuaugauuuuuaaaaguugcuaguacuggggagaaau

SEQ ID NO: 547542 - RNA, 64 nt, Homo Sapiens
aacauuuucuuucuuuuucuggaaauuuuguccauuuuaaaaaccaaucauuuuaagaagacau

SEQ ID NO: 547543 - RNA, 64 nt, Homo Sapiens
aauaaaaugcuauauggcaccuaauuauuuuuucuuuuaaaaugccuuaaguugcagucucauu

SEQ ID NO: 547544 - RNA, 64 nt, Homo Sapiens
ugaauuccaaauucaccuagcaauaaaaucuaauuuuuaaaaaguauauaaauauaaaauguau

SEQ ID NO: 547545 - RNA, 64 nt, Homo Sapiens
cuguggcauugcacaaauacagucucuguagggauuuuaaaagauuucagacuguuuugauaga

SEQ ID NO: 547546 - RNA, 64 nt, Homo Sapiens
aagauuucagacuguuuugauagaaaaagcuaaauuuuaaaaugcauaucucacaguugccuac

SEQ ID NO: 547547 - RNA, 64 nt, Homo Sapiens
uuauuuugauauuggugaauuagucaccaguaaauuuuaaaaaagcacuugguugaaaauugua

SEQ ID NO: 547548 - RNA, 64 nt, Homo Sapiens
ccauaacuuuuauaagucccauuuauaaacccacuuuuaaaaauaacagguccaaguuagagug

SEQ ID NO: 547549 - RNA, 64 nt, Homo Sapiens
guacaaugugcugugaaaaaucugaugacuuuaauuuuaaaaucuugugacauuuugcuuauac

SEQ ID NO: 547550 - RNA, 64 nt, Homo Sapiens
uuaguugaauauuuucuuuuggagagauuguauauuuuaaaauacuguuuagaguuuaugagca

SEQ ID NO: 547551 - RNA, 64 nt, Homo Sapiens
ggaaucccuagggcuagagccuagaaaucucacuuuuuaaaaugcuuccaagguaagucugaug

SEQ ID NO: 547552 - RNA, 64 nt, Homo Sapiens
ccuucuuuugaaaauaaacugagucaauuuagccuuuuaaaaauauagucaucucuuuuaaaua

SEQ ID NO: 547553 - RNA, 64 nt, Homo Sapiens
uuguauuugacuuuauuuccuuuauucaaaucauuuuuaaaaacuuacauuuugaacaaacacu

SEQ ID NO: 547554 - RNA, 64 nt, Homo Sapiens
uaaagaucauuuggaagacuuuagacucuauuaauuuuaaaaggaauauuuauuagccauaugc

SEQ ID NO: 547555 - RNA, 64 nt, Homo Sapiens
uacaguguacaauguguauuucuucaaccauauauuuuaaaaagacguacauagaaacuuaggc

SEQ ID NO: 547556 - RNA, 64 nt, Homo Sapiens
caguauuuuucauuugauucccuauuagaauuaauuuuaaaacuugaagacuuccagacuuauc

SEQ ID NO: 547557 - RNA, 64 nt, Homo Sapiens
gacuuagaagauaucauugccauguagguuuuauuuuuaaaagucuugagcucuucuuaaauau

SEQ ID NO: 547558 - RNA, 64 nt, Homo Sapiens
ccauggggauaaaucacucugucauuccuaguuauuuuaaaaaaagaacuuuaugauuacgguc

SEQ ID NO: 547559 - RNA, 64 nt, Homo Sapiens
uuuccucaccuucacuauugaucuguaauuuuuauuuuaaaaacagcuuacuguaaaguagauc

SEQ ID NO: 547560 - RNA, 64 nt, Homo Sapiens
gcauuucauuauugaugugcugaugaaccuggacuuuuaaaaauauuuguuuccuauaccuuua

SEQ ID NO: 547561 - RNA, 64 nt, Homo Sapiens
gugcuuaguacuguuuucccugcacguaggggucuuuuaaaaauauaaagcuugugauaaagag

SEQ ID NO: 547562 - RNA, 64 nt, Homo Sapiens
gcggggguaggugaggguuuggagcauguggucuuuuuaaaaaauuguaacccucuagaaaaua

SEQ ID NO: 547563 - RNA, 64 nt, Homo Sapiens
cuuuauaaaagcaauagcuggaauauacucccaguuuuaaaauaaaugccugauugauuuaaag

SEQ ID NO: 547564 - RNA, 64 nt, Homo Sapiens
uguuuaguauagguuuuuguaugcuggguuugccuuuuaaaaugggaaauacuuuuuaaguuau

SEQ ID NO: 547565 - RNA, 64 nt, Homo Sapiens
uaccuguuaacuuuccccaauugagauaaaaguguuuuaaaauucuguuuauaguuuuugauau

SEQ ID NO: 547566 - RNA, 64 nt, Homo Sapiens
gacuacaggggcccgccaccacaccuggcuaauuuuuuaaaaauauuuuuaguagagacagggu

SEQ ID NO: 547567 - RNA, 64 nt, Homo Sapiens
uuuuuuuuuaauaaaacaaaauuuguuugaaaucuuuuaaaaauucaaaugauuuuuacaaguu

SEQ ID NO: 547568 - RNA, 64 nt, Homo Sapiens
cuuuuaguaauaaaaugacuugaaaucauauuauuuuuaaaagcccuuugcuucuuucauuacu

SEQ ID NO: 547569 - RNA, 64 nt, Homo Sapiens
aucauuuuuauaaauuuuaaauuguacaucagacuuuuaaaaucuguaauauacaagcaagcaa

SEQ ID NO: 547570 - RNA, 64 nt, Homo Sapiens
aagauggugaaaccccgucucuauuaaaaauauuuuuuaaaaauuaacugagcguggugguggg

SEQ ID NO: 547571 - RNA, 64 nt, Homo Sapiens
uaaauugaugggagaaaugaggaaaagaaaaucuuuuuaaaaaugauuucaagguuugugcuga

SEQ ID NO: 547572 - RNA, 64 nt, Homo Sapiens
acucuuaaaaaaaaaaaaaaaagacuaagguggauuuuaaaaauuggaaacugacauaauguua

SEQ ID NO: 547573 - RNA, 64 nt, Homo Sapiens
uuccagcuugccuguuuuugaguauguuugauguuuuuaaaauuuugucuucucuguggaagac

SEQ ID NO: 547574 - RNA, 64 nt, Homo Sapiens
cagcaauuaacuuuaagccuccuuuuagagauauuuuuaaaacuuguuuaaaauuuuugugcaa

SEQ ID NO: 547575 - RNA, 64 nt, Homo Sapiens
uaaggaacuucuuguuuaauagcauuuuuguuuauuuuaaaaagugaucagaaguaguaaacua

SEQ ID NO: 547576 - RNA, 64 nt, Homo Sapiens
augacuaaugugaugcuaaguuccacuuggccccuuuuaaaaacguguaugugccuuuugaaga

SEQ ID NO: 547577 - RNA, 64 nt, Homo Sapiens
acaauaguugcugccuugcaaagguaaucucucauuuuaaaauuggacaguauuaaugaagggg

SEQ ID NO: 547578 - RNA, 64 nt, Homo Sapiens
agaauuuuucugaaucauauuggggaagcagugauuuuaaaaccucaaguuuuuaaacaugauu

SEQ ID NO: 547579 - RNA, 64 nt, Homo Sapiens
uuuauauguucuguauaauguucaguuuguaacuuuuuaaaaguuuggauguauagagggauaa

SEQ ID NO: 547580 - RNA, 64 nt, Homo Sapiens
aagucuccuuuuagucuagauaaucauuauuucauuuuaaaauuaguguuuuuccuaguuugca

SEQ ID NO: 547581 - RNA, 64 nt, Homo Sapiens
uaaagagcucuucuauuuauacaugccuaaauucuuuuaaaauguagagggauaccugucugca

SEQ ID NO: 547582 - RNA, 64 nt, Homo Sapiens
agacugcaaaaggccuauuuuaacuauugauuuuuuuuaaaaaaaauugucuuugaauguauug

SEQ ID NO: 547583 - RNA, 64 nt, Homo Sapiens
aaccgaacacaacucagaaacuuggaaucguuuuuuuuaaaaaugccucugagcaacccauaua

SEQ ID NO: 547584 - RNA, 64 nt, Homo Sapiens
aggugaaauugcauacacagauauguaguacauauuuuaaaaguuuuaucuuaaauugauuaaa

SEQ ID NO: 547585 - RNA, 64 nt, Homo Sapiens
auuuuaaaaguuuuaucuuaaauugauuaaaacuuuuuaaaaagcuuugguauuaaaagaggua

SEQ ID NO: 547586 - RNA, 64 nt, Homo Sapiens
uuuuugcaaugaugacugaguuguuaucauaguauuuuaaaaccuguauaguguuuuagacuug

SEQ ID NO: 547587 - RNA, 64 nt, Homo Sapiens
acauuuuaacaguaccugugccugagaauuuaauuuuuaaaagacuuugauguguuuuuguaug

SEQ ID NO: 547588 - RNA, 64 nt, Homo Sapiens
uuaaagaagucucuuaauucugaugcuagguuguuuuuaaaaccacuaugcaaagaacucacca

SEQ ID NO: 547589 - RNA, 64 nt, Homo Sapiens
gcaggauguuauugacauuaaauguuuuaagcaauuuuaaaaagauuuugcaugaucuuuaaca

SEQ ID NO: 547590 - RNA, 64 nt, Homo Sapiens
aaauuuggaaacauguaacaagaaaggaaauacuuuuuaaaaaaaguucuggggaaggaucaua

SEQ ID NO: 547591 - RNA, 64 nt, Homo Sapiens
cacacaaagccgcugucucauguuuguuucauuuuuuuaaaaccgucacugcagcaacgccuug

SEQ ID NO: 547592 - RNA, 64 nt, Homo Sapiens
uuuuuaucuuuauaugguuuaaucgagagugauuuuuuaaaaauaauguaaauuuauuucucca

SEQ ID NO: 547593 - RNA, 64 nt, Homo Sapiens
aguuaaguuguauuuugauaaaauauuauuaauauuuuaaaaagagauuaacaaucaacugcau

SEQ ID NO: 547594 - RNA, 64 nt, Homo Sapiens
aagaaaaaaaaaaaaaaggagcucugaaucaguuuuuuaaaaaauaaguaagcagccacugcaa

SEQ ID NO: 547595 - RNA, 64 nt, Homo Sapiens
cuaucccauaucgauugccauccuguccugugaauuuuaaaaagcuugaaaguauauaaaaucu

SEQ ID NO: 547596 - RNA, 64 nt, Homo Sapiens
ucauagcuguacuucuugaauucauguaauuuuauuuuaaaauugguuuggaauauuaaaaaac

SEQ ID NO: 547597 - RNA, 64 nt, Homo Sapiens
gggaguuuuugauaguugugucuuuguaccaaaauuuuaaaaaauuuuauuaagcuuuuuggaa

SEQ ID NO: 547598 - RNA, 64 nt, Homo Sapiens
uguuccugauuguacauauuuuuaaugauaaugguuuuaaaauagauuuaugaucuucauuuau

SEQ ID NO: 547599 - RNA, 64 nt, Homo Sapiens
guaauggaggcuguaaucauauaaaucuuguaacuuuuaaaauuuguaauuuaguaauaugaau

SEQ ID NO: 547600 - RNA, 64 nt, Homo Sapiens
gaaagguacuauuuuccaaaacauuauuugaacauuuuaaaacaauuacacauuuuuaaaaaau

SEQ ID NO: 547601 - RNA, 64 nt, Homo Sapiens
uacauuauuugaacauuuuagaaugauuacacauuuuuaaaaaaacuuguuuucccguuuccuu

SEQ ID NO: 547602 - RNA, 64 nt, Homo Sapiens
aaacagcaacaacaauaaaauauucaaugugugauuuuaaaaauagaaaucugauuguugugug

SEQ ID NO: 547603 - RNA, 64 nt, Homo Sapiens
gccucugcugagcucucaucuggcucucugcaaguuuuaaaacucccucagguaccaucugugg

SEQ ID NO: 547604 - RNA, 64 nt, Homo Sapiens
cauuuuucauuuuguuucucuaccacuguuuguuuuuuaaaaaaauccaacucaugacaagaga

SEQ ID NO: 547605 - RNA, 64 nt, Homo Sapiens
acugugcauauuauagaguuaugcaaaaagccuauuuuaaaaucuagcaccuuucaugcaaggc

SEQ ID NO: 547606 - RNA, 64 nt, Homo Sapiens
uuaacaguguacuucuuagggaaacauacugacuuuuuaaaauuaucuucaaggucugaaauga

SEQ ID NO: 547607 - RNA, 64 nt, Homo Sapiens
cuuuaaggagacuuuuaacaacuauaggaaucauuuuuaaaaauaaguaacaagacaccuagca

SEQ ID NO: 547608 - RNA, 64 nt, Homo Sapiens
cacuucauuauguuuagggguuaagaaaaauuuuuuuuaaaaaaaacuuuuuuaaauauaaaug

SEQ ID NO: 547609 - RNA, 64 nt, Homo Sapiens
uaaaaaaaaaaaaacuuugccauugaggagcauuuuuuaaaaacaaaaaaauugaacacaaucu

SEQ ID NO: 547610 - RNA, 64 nt, Homo Sapiens
acuggcaccaaaagaaauagcuuuaauaaugucuuuuuaaaaauucauuuuaugaagauauuug

SEQ ID NO: 547611 - RNA, 64 nt, Homo Sapiens
ugagugccuuggaucuauuaauucuaucauuugguuuuaaaauacagaaaaacagaacaaguuu

SEQ ID NO: 547612 - RNA, 64 nt, Homo Sapiens
ugaucauuuggguucacucaucgaaacuuccuuguuuuaaaaaaauuuuauuuuacuucaacug

SEQ ID NO: 547613 - RNA, 64 nt, Homo Sapiens
caaaacuuguugcuuagaagaauuuucuuuugguuuuuaaaaaaccuauuacaaaacuguucug

SEQ ID NO: 547614 - RNA, 64 nt, Homo Sapiens
uuuauaauaaauaguagcaauaagaugaagaauuuuuuaaaacaucugcucuggucauuugcau

SEQ ID NO: 547615 - RNA, 64 nt, Homo Sapiens
uaauguugccaaacuuuggacauaauuugcauaauuuuaaaagauaaaauguaccucuuguuua

SEQ ID NO: 547616 - RNA, 64 nt, Homo Sapiens
aguggaaaagggcagguugaucuauaaaaacugguuuuaaaaucgucuuucccuuuauaguuuc

SEQ ID NO: 547617 - RNA, 64 nt, Homo Sapiens
ccuccaauacucuuauggagaaauaacaaacauuuuuuaaaaggugaaaagcccccauuuaaaa

SEQ ID NO: 547618 - RNA, 64 nt, Homo Sapiens
agaaguuuaacuuugcuauuguuuguugcuuuauuuuuaaaagguccauuuuguugcuugguug

SEQ ID NO: 547619 - RNA, 64 nt, Homo Sapiens
accuuuagagccuaauuacuccacuaggcccccuuuuuaaaaaccucucuuccuccucagcgaa

SEQ ID NO: 547620 - RNA, 64 nt, Homo Sapiens
cagagcgcucuagccacuacguguggggugcaguuuuuaaaaaucugagauggcgaaacccugu

SEQ ID NO: 547621 - RNA, 64 nt, Homo Sapiens
uuaaauccucuguccaacuguaugcuucuuaauuuuuuaaaaucugaccagagcacagauuacu

SEQ ID NO: 547622 - RNA, 64 nt, Homo Sapiens
cagcauugcucaacuuaccuaagaaacuuacccauuuuaaaauuugaaggcucucagacuggga

SEQ ID NO: 547623 - RNA, 64 nt, Homo Sapiens
uccacagaggagaauuugcuaaaaaauguaaauuuuuuaaaaagacucugcaaaguagccuuua

SEQ ID NO: 547624 - RNA, 64 nt, Homo Sapiens
aaauggcaaacauuaaaaacuguacaauuaaguauuuuaaaaaucaaaauguacuccacaagua

SEQ ID NO: 547625 - RNA, 64 nt, Homo Sapiens
acucuuuaguaauuuauuuuaguuuauuauacuuuuuuaaaauuuuuuuuuuuaaguuuauaaa

SEQ ID NO: 547626 - RNA, 64 nt, Homo Sapiens
cuuauaugcaaaccuuuuaaccuuuguaaggugguuuuaaaagcaagaugagaaauaaagaaag

SEQ ID NO: 547627 - RNA, 64 nt, Homo Sapiens
gugcccgcacuaccauacauuuuauauuaauacauuuuaaaaagcuuuaaaaaacuaugucuaa

SEQ ID NO: 547628 - RNA, 64 nt, Homo Sapiens
cauuuaaaaaaaauccaaaguacaaaauaauaauuuuuaaaaaagaaacaaaucuucuguuauu

SEQ ID NO: 547629 - RNA, 64 nt, Homo Sapiens
uuacguggaagcaagauuuccaauggacauuaguuuuuaaaaagcauauucagauugggaaaaa

SEQ ID NO: 547630 - RNA, 64 nt, Homo Sapiens
uggaacauaaaauacaaugucuuccuuggacucauuuuaaaaaauaauuaaaagaauauuuuaa

SEQ ID NO: 547631 - RNA, 64 nt, Homo Sapiens
aaauacugauguuccuagugcauuguaaaugugcuuuuaaaaaacagcaagggugaugggaaag

SEQ ID NO: 547632 - RNA, 64 nt, Homo Sapiens
auuugacgcuugcuuaggagcugauagaaugauguuuuaaaaaaugauaaaguuccuuaagcau

SEQ ID NO: 547633 - RNA, 64 nt, Homo Sapiens
auuuuuauaaauuacuaucuuuuucccaaagcacuuuuaaaaaauuaaguaaugauacugugug

SEQ ID NO: 547634 - RNA, 64 nt, Homo Sapiens
uuuuuuagucuguaauacacaauuucuuggcaaauuuuaaaacaaagaguauuuuuaacacuua

SEQ ID NO: 547635 - RNA, 64 nt, Homo Sapiens
gacugugaauuuuauuuuucaacuugaauucuaguuuuaaaacuaaauuaagauuuauuagcca

SEQ ID NO: 547636 - RNA, 64 nt, Homo Sapiens
uacaacacuccgaguucugcauaaaaaaauaauuuuuuaaaacugccggcuucaacaaaauggg

SEQ ID NO: 547637 - RNA, 64 nt, Homo Sapiens
uauucaggauuauuagccugguuuaaauuaucuuuuuuaaaaccugugaacacugcaaaaaugu

SEQ ID NO: 547638 - RNA, 64 nt, Homo Sapiens
uuaggugccuuugcggaugauuuauuuguuauuuuuuuaaaaguuccaucaccaguggaguuuu

SEQ ID NO: 547639 - RNA, 64 nt, Homo Sapiens
acuaaauaaaacaaauaaaaacuaaugaaggguuuuuuaaaagaagcagagaaauaagaauaaa

SEQ ID NO: 547640 - RNA, 64 nt, Homo Sapiens
ucuuucauucuuacuuuucaucagacuuugaaaauuuuaaaaaucugauuuugaaauacuaaga

SEQ ID NO: 547641 - RNA, 64 nt, Homo Sapiens
aaaauacuguguacccccccauuauuuuuauuuguuuuaaaauuugggaaucuuugacaaacaa

SEQ ID NO: 547642 - RNA, 64 nt, Homo Sapiens
uuaaaauuucugaaaaccaaaaaaggcaucugauuuuuaaaaaacagauaaacauacaacuucc

SEQ ID NO: 547643 - RNA, 64 nt, Homo Sapiens
aaauuuuuuuaaucucuagcgcaaaguguuggcuuuuuaaaaaaaauaagguauaacaagcuug

SEQ ID NO: 547644 - RNA, 64 nt, Homo Sapiens
acaugaccacauauguauauuaccauuacuuguuuuuuaaaaacuacaugguuuuguuuaaaau

SEQ ID NO: 547645 - RNA, 64 nt, Homo Sapiens
cagaaaaugaggggccaggugcugcagccugaguuuuuaaaaaaacuugcuaucuauucugugu

SEQ ID NO: 547646 - RNA, 64 nt, Homo Sapiens
aauuucaucagguuuuuuguguggaauauaaacuuuuuaaaaauaaauaggaaacugaaacucu

SEQ ID NO: 547647 - RNA, 64 nt, Homo Sapiens
gcauuuuugcaaaacaagauugacuuuggaaaccuuuuaaaaaugagcacuaugauuaucaagg

SEQ ID NO: 547648 - RNA, 64 nt, Homo Sapiens
ugaaauuuuuaauuuuuacuuaauauuuuugguuuuuuaaaaacuauuaaguguggaagcuuau

SEQ ID NO: 547649 - RNA, 64 nt, Homo Sapiens
cagaaagucauuuaaaauaguauuuaaagaaauuuuuuaaaaucaaauauuacaaaaaugauug

SEQ ID NO: 547650 - RNA, 64 nt, Homo Sapiens
acauaaaugucauaaaguuuaacgauacaaaguuuuuuaaaaauagaaugacuagccuuuuuau

SEQ ID NO: 547651 - RNA, 64 nt, Homo Sapiens
caugauacaaguaacaaaguuuaaagugguaggguuuuaaaauuaauaacccaucccugucuuc

SEQ ID NO: 547652 - RNA, 64 nt, Homo Sapiens
caguuugcaacaugucuguaauuuuaaaaaauuguuuuaaaaguaagaaaaaaaguuuguauau

SEQ ID NO: 547653 - RNA, 64 nt, Homo Sapiens
uuguuuuaaaagucaguuugaaaguuuguauauauuuuaaaaaauugagaagaauagaagaaaa

SEQ ID NO: 547654 - RNA, 64 nt, Homo Sapiens
aaauucuucaaguaugaagaugcaucuuaguuauuuuuaaaaacgacuagcuaauuuauuuuuu

SEQ ID NO: 547655 - RNA, 64 nt, Homo Sapiens
uaccauuugaauuuguauuuauauuccaauucacuuuuaaaaaacugcuguuuaaauuucccgc

SEQ ID NO: 547656 - RNA, 64 nt, Homo Sapiens
uccuuggaggcuggaaggggacauaauugcauguuuuuaaaaauacaguagccaaggaauacaa

SEQ ID NO: 547657 - RNA, 64 nt, Homo Sapiens
uugauauuccuguauggugcucaguguucuguuuuuuuaaaaacccacaauaccuuuuuaauac

SEQ ID NO: 547658 - RNA, 64 nt, Homo Sapiens
cuugucagaagaucccagaaggcauuuuaagauuuuuuaaaaaugauggcuucacugaagaaaa

SEQ ID NO: 547659 - RNA, 64 nt, Homo Sapiens
ugagggucuggaccaaaagauaacuugaagcuacuuuuaaaauuguggaaaaaugaccuuuccu

SEQ ID NO: 547660 - RNA, 64 nt, Homo Sapiens
uacgugugcacagagaggucuauuacccucuccuuuuuaaaaauucaagccucaguccccuuca

SEQ ID NO: 547661 - RNA, 64 nt, Homo Sapiens
aguucuuuuguaauguggugcaauccuuuuuuauuuuuaaaaauuuauuuuuuuucuuuucccu

SEQ ID NO: 547662 - RNA, 64 nt, Homo Sapiens
caacauguguacuuaauuucccugcuagacacauuuuuaaaaugauuuuaauuuuguacaauaa

SEQ ID NO: 547663 - RNA, 64 nt, Homo Sapiens
guuaaaauguauucuuaaauauaugauuaacuaauuuuaaaaauaauaaaauagauaaauaaau

SEQ ID NO: 547664 - RNA, 64 nt, Homo Sapiens
cugaaaauacuuaggaaggauggcaauaaauuuuuuuuaaaaaaccucuugacuccuugugaug

SEQ ID NO: 547665 - RNA, 64 nt, Homo Sapiens
agccacaaacaguaaagcccagagaagacaccaguuuuaaaaugccaauuaaugugucucauga

SEQ ID NO: 547666 - RNA, 64 nt, Homo Sapiens
cuggcaaugacccacucccccaccccuauguaguuuuuaaaacauaaacauacacacacacaca

SEQ ID NO: 547667 - RNA, 64 nt, Homo Sapiens
auaaauagauaauauauuaugcuggcuguauauauuuuaaaauuggguuuguuguuguuuuuga

SEQ ID NO: 547668 - RNA, 64 nt, Homo Sapiens
agcuuuaaaguuuuguuucagaggaaaauauuuguuuuaaaacucgccagaguaguuuagagca

SEQ ID NO: 547669 - RNA, 64 nt, Homo Sapiens
guucuuucuuaguucaaaugucauuauaaacaaguuuuaaaauugguaaggaaaugccgauucu

SEQ ID NO: 547670 - RNA, 64 nt, Homo Sapiens
uuucuagacucuuugcaaaaccuaaagagauuucuuuuaaaaacagaguuuucguguuacauca

SEQ ID NO: 547671 - RNA, 64 nt, Homo Sapiens
aaaauguaaagguguguuuuaaacaaaucaacauuuuuaaaaagaauggacaguagccacuuac

SEQ ID NO: 547672 - RNA, 64 nt, Homo Sapiens
uacauugcuucauuacuuucacacauguuguauguuuuaaaaacauuaggaugauuagauugaa

SEQ ID NO: 547673 - RNA, 64 nt, Homo Sapiens
aguucucuugauugauuucaugagcguggcacaguuuuaaaaauauauagaccauucauuugcc

SEQ ID NO: 547674 - RNA, 64 nt, Homo Sapiens
aaaaacagggaauaaaagcuguuuuaaauacagcuuuuaaaaacugucaucuacugggacuagg

SEQ ID NO: 547675 - RNA, 64 nt, Homo Sapiens
guaaaaccucucuugccaggaaaaaugaaaacaauuuuaaaaauuuuggaaagugcaaauaagc

SEQ ID NO: 547676 - RNA, 64 nt, Homo Sapiens
ucaauuauaaaaauaauaaauugcagauguuuaguuuuaaaaauguggaggacgugguacaggg

SEQ ID NO: 547677 - RNA, 64 nt, Homo Sapiens
agaaaccuagcagcccaucuucuuauaugaaauuuuuuaaaagccuuccugcuugaaacccaau

SEQ ID NO: 547678 - RNA, 64 nt, Homo Sapiens
ccuuuauaaucaggacugaguuuuaauaauguaauuuuaaaaauaaagaagaauaaauacauau

SEQ ID NO: 547679 - RNA, 64 nt, Homo Sapiens
gaaucucugcacccaaaugcgcgaugcuucgaauuuuuaaaacgcgaacaaagagcgaaccaaa

SEQ ID NO: 547680 - RNA, 64 nt, Homo Sapiens
uuuccacuuuuguucuacuccuucccuaauagcuuuuuaaaaaaaucuccccaguagagaaaca

SEQ ID NO: 547681 - RNA, 64 nt, Homo Sapiens
gggcucauagugagaacccaucuauacaaaaaauuuuuaaaaauuagcauggcggcacacaucu

SEQ ID NO: 547682 - RNA, 64 nt, Homo Sapiens
gugugacuuuaucuucugggugguuugauaguguuuuuaaaaguaauauauaauguggggugaa

SEQ ID NO: 547683 - RNA, 64 nt, Homo Sapiens
cuuuauuuuauuauuaacuaauuaacuaugagauuuuuaaaaaauggggccgcugaugugcaau

SEQ ID NO: 547684 - RNA, 64 nt, Homo Sapiens
accauaacugauuuuaauuuugcauuauuuaugauuuuaaaauauuuguugcccagguguuaug

SEQ ID NO: 547685 - RNA, 64 nt, Homo Sapiens
agaacuuaaagaaauucacuacugcaguuuuuauuuuuaaaaaacaguaauugagauauugaag

SEQ ID NO: 547686 - RNA, 64 nt, Homo Sapiens
auaaaaacccaucaggacagaaugaugcucaauauuuuaaaauucuaaaaauagggugggauuu

SEQ ID NO: 547687 - RNA, 64 nt, Homo Sapiens
uuagguggacaaauuuaacaaguuuucuguuacuuuuuaaaaagaaaaaauccagaacauaaga

SEQ ID NO: 547688 - RNA, 64 nt, Homo Sapiens
uuauucugaaggacuuuaaggaagggauacaugauuuuaaaaaagccuguaagaggugaaauau

SEQ ID NO: 547689 - RNA, 64 nt, Homo Sapiens
uuugaagucucuuuauagacuuuuuauauauauuuuuuaaaacacucaucuagaugaggugcuu

SEQ ID NO: 547690 - RNA, 64 nt, Homo Sapiens
gguuccuaaggaagaaauucuaaauaaugcaaacuuuuaaaauaagcaucuagguuuuugauaa

SEQ ID NO: 547691 - RNA, 64 nt, Homo Sapiens
caaauuuauacacugauuuuuguaaaggacaaaguuuuaaaagcguauuuaacuugauguuuuc

SEQ ID NO: 547692 - RNA, 64 nt, Homo Sapiens
auauuguacugguacaaaauaguuuuaaauuauauuuuaaaaagcuuccaaucuuguggugugu

SEQ ID NO: 547693 - RNA, 64 nt, Homo Sapiens
auuuugcauaaucaaggcacuguaaaucuuauaauuuuaaaauaaauuacuuaagaacaguugu

SEQ ID NO: 547694 - RNA, 64 nt, Homo Sapiens
auucaggcuuuauuucugguaugaaguuuauauuuuuuaaaaaaauccuauauuaucacaccag

SEQ ID NO: 547695 - RNA, 64 nt, Homo Sapiens
uuuccuuuuuuuuucuuuacuuuuaaauuuuaacuuuuaaaaucuauuucauuucuuaguuaug

SEQ ID NO: 547696 - RNA, 64 nt, Homo Sapiens
guauuuuguacauaccaguuguuaaauaaauaauuuuuaaaaucucagcucucacauugaauua

SEQ ID NO: 547697 - RNA, 64 nt, Homo Sapiens
auuuggggaaaggucuuuuuugcuuaauuuuguuuuuuaaaacucugaugauugcuugagcaac

SEQ ID NO: 547698 - RNA, 64 nt, Homo Sapiens
gaauguuuauaagcuuuccauuuccuagguaauuuuuuaaaagccagucaaaacaaaaacuuua

SEQ ID NO: 547699 - RNA, 64 nt, Homo Sapiens
caauuuaauuagcuguugcagaauaaguaauauauuuuaaaaaccuagcuccuuucauuauuua

SEQ ID NO: 547700 - RNA, 64 nt, Homo Sapiens
aggugugaugagagaauucagauauacuuuaucuuuuuaaaaaaguguaaauaaaaucaaagaa

SEQ ID NO: 547701 - RNA, 64 nt, Homo Sapiens
uaagcuuuauauuugcuuauuuguuguagcuacauuuuaaaaaaaagauugaacuugaugacuu

SEQ ID NO: 547702 - RNA, 64 nt, Homo Sapiens
acacuuaaugguguuagaaaucaacaaaacuccuuuuuaaaaagaaaagauauuaagccugccu

SEQ ID NO: 547703 - RNA, 64 nt, Homo Sapiens
cugcacagagcauaaugugaaguuuuauaccuacuuuuaaaauucugcuuuccagaaacaaaau

SEQ ID NO: 547704 - RNA, 64 nt, Homo Sapiens
guauucacuugaaagcaaacuggcaugguucguauuuuaaaaaucuugcacaaauuguaaugug

SEQ ID NO: 547705 - RNA, 64 nt, Homo Sapiens
gaaguuaaaauggacagcauuucuagaauuaacauuuuaaaaucuagucuuagcuagauaugug

SEQ ID NO: 547706 - RNA, 64 nt, Homo Sapiens
acuucuuucaucaggaaaccuuauucaggaggguuuuuaaaaaguguuuaaaugucaaauguga

SEQ ID NO: 547707 - RNA, 64 nt, Homo Sapiens
augauguuaguuuuccuuagcugauuuugaggguuuuuaaaaauaaagcaagguugacuaaccu

SEQ ID NO: 547708 - RNA, 64 nt, Homo Sapiens
uaacuccaaagugaaagucucuuucucuggauuauuuuaaaauuuuggcguguuuaaccauuaa

SEQ ID NO: 547709 - RNA, 64 nt, Homo Sapiens
auacuugugaugucugacgcaugauggccuaugguuuuaaaaauaguauuguggaauauauuuu

SEQ ID NO: 547710 - RNA, 64 nt, Homo Sapiens
uuucagauuuuuugaaccauccacuuacauauauuuuuaaaaaaugaaauccuuuuccuguuca

SEQ ID NO: 547711 - RNA, 64 nt, Homo Sapiens
agaauucuguauuggauauauaagagcaugaaauuuuuaaaaauacacuugugauuauaaaauu

SEQ ID NO: 547712 - RNA, 64 nt, Homo Sapiens
uagaagggggacuucuaggaauuuauaaccaaaauuuuaaaacuauuuuuauauuuuuuuaaau

SEQ ID NO: 547713 - RNA, 64 nt, Homo Sapiens
gaaaauugcauagcuuuuuguaacauuuacuuaauuuuaaaacuaaacucauacuuuugcuauc

SEQ ID NO: 547714 - RNA, 64 nt, Homo Sapiens
uuuuaauauuuaucucguuugggaguauacguguuuuuaaaauuuguguuuucuaucuguuuac

SEQ ID NO: 547715 - RNA, 64 nt, Homo Sapiens
gcucucucaaaaauuaauuuuuauuccuuaagcauuuuaaaaacauuuuaaaaaauguuuugua

SEQ ID NO: 547716 - RNA, 64 nt, Homo Sapiens
aauuaauuuuuauuccuuaagcauuuuaaaaacauuuuaaaaaauguuuuguaaauccaggugu

SEQ ID NO: 547717 - RNA, 64 nt, Homo Sapiens
aucuuuggagccgcuuuuuuuuucuuuuucauuuuuuuaaaagauugagugguacacuaauaaa

SEQ ID NO: 547718 - RNA, 64 nt, Homo Sapiens
cagaacuugaggcaaaucguaaggaagcuguuucuuuuaaaacacaaaccaccaccaaaaauuu

SEQ ID NO: 547719 - RNA, 64 nt, Homo Sapiens
guacauauugcuuaaguauuuggcuguuuuuauuuuuuaaaagguauaaacaccaaaaaaaaaa

SEQ ID NO: 547720 - RNA, 64 nt, Homo Sapiens
uuguaauaaauuugacucauuaaaaaccuuuuuuuuuuaaaaaaaaaaaaaaagaaaaucucau

SEQ ID NO: 547721 - RNA, 64 nt, Homo Sapiens
ugaacuuaucuuugcagcugaguacuuaaauucuuuuuaaaaagauacccuuuggauugaucac

SEQ ID NO: 547722 - RNA, 64 nt, Homo Sapiens
cuggcauugacauuauugguaaucaacuggcuuuuuuuaaaaaagguagcauuuuguugacagu

SEQ ID NO: 547723 - RNA, 64 nt, Homo Sapiens
agugaaggacaaaaaucaugauuguggaagauauuuuuaaaaucugauuuugcagcgaucacuu

SEQ ID NO: 547724 - RNA, 64 nt, Homo Sapiens
gugagccaccgcgccuggccagggacuauacucuuuuuaaaauagacauuuguggggcucacac

SEQ ID NO: 547725 - RNA, 64 nt, Homo Sapiens
aggacuauuacauacuucauuacuaggaaguucuuuuuaaaaugacacuuaaaacaaucacuga

SEQ ID NO: 547726 - RNA, 64 nt, Homo Sapiens
ucuuuaguaagaauguguuaaaauuacaaugaucuuuuaaaaagaugaugcaguucuguauuua

SEQ ID NO: 547727 - RNA, 64 nt, Homo Sapiens
guuucgccuuguugcccaggcugaauuuggguuuuuuuaaaaugagacuuucaguccuaauuug

SEQ ID NO: 547728 - RNA, 64 nt, Homo Sapiens
gaaauuuauagcuucaaauacuuauauacauauuuuuuaaaaguagcuuuacauaggaaggaag

SEQ ID NO: 547729 - RNA, 64 nt, Homo Sapiens
ucaaaacaacccccacacagaccccgcaauccuuuuuuaaaaaaucugccaauagacccaggac

SEQ ID NO: 547730 - RNA, 64 nt, Homo Sapiens
agacccaggacgaguaagagaggaagcaucaaccuuuuaaaaauuuccuuucgcuuucauuauu

SEQ ID NO: 547731 - RNA, 64 nt, Homo Sapiens
uuaaauacuguuucagaguucuaaaaaggcaguuuuuuaaaaaacuuaaguugauaaaaacugu

SEQ ID NO: 547732 - RNA, 64 nt, Homo Sapiens
auuuuaaacauggugugguauucuaaagccuuuuuuuuaaaaaaagagaucuuuuugagagaaa

SEQ ID NO: 547733 - RNA, 64 nt, Homo Sapiens
gaaaaucuauaguaaaacauguagcuauaacauauuuuaaaaauaaaaucugaaaaccucagaa

SEQ ID NO: 547734 - RNA, 64 nt, Homo Sapiens
uucugagauuuuccuucuuacacuguuaaucuuauuuuaaaaaauauuacauucuuguauacuu

SEQ ID NO: 547735 - RNA, 64 nt, Homo Sapiens
uuuugguuggcaguaaccgauuuuaaugacuagcuuuuaaaaauacaguacaaagacuuuguaa

SEQ ID NO: 547736 - RNA, 64 nt, Homo Sapiens
cuaauauacauuuugucugugaaaauauaguaaauuuuaaaauacuaauauaaugugguauucu

SEQ ID NO: 547737 - RNA, 64 nt, Homo Sapiens
cagacccauuuuuuaaagugcuagaaaaugcuuuuuuuaaaaaaaaaauacaaguuuuaaaaug

SEQ ID NO: 547738 - RNA, 64 nt, Homo Sapiens
cuagaaaaugcuuuuuuuaaaaaaaaaauacaaguuuuaaaaugaccacuuacucuuuaauuau

SEQ ID NO: 547739 - RNA, 64 nt, Homo Sapiens
gccaguuaaugugauucaguugugaccugugggauuuuaaaauuuuccugcccucauaauuuaa

SEQ ID NO: 547740 - RNA, 64 nt, Homo Sapiens
uuuugguaagccucucuuacuccuguuaugcacuuuuuaaaauaaauacugaauuccagaaaga

SEQ ID NO: 547741 - RNA, 64 nt, Homo Sapiens
ucaugucaaaauuuaguugaacugguuuuucaguuuuuaaaaggccuacagaugaguaaugaag

SEQ ID NO: 547742 - RNA, 64 nt, Homo Sapiens
uuuuaggaaaguuaucuaguuuaaauuucaaauguuuuaaaauuuguaggcauuuaauaaauua

SEQ ID NO: 547743 - RNA, 64 nt, Homo Sapiens
uauuuaauauguuucucuuaacaccugaaacuuguuuuaaaacaaaaagcaguauucacuucaa

SEQ ID NO: 547744 - RNA, 64 nt, Homo Sapiens
ccaaaugaaugaaaauguauguuucuuuguacuuuuuuaaaaaaaucagcuuaguaacaauacu

SEQ ID NO: 547745 - RNA, 64 nt, Homo Sapiens
uauauuucuaaugcaaacuuaacaauuguguacuuuuuaaaagcugcaauauguguuggaaaau

SEQ ID NO: 547746 - RNA, 64 nt, Homo Sapiens
gcaaaacuaggaaaagguuaaacuggauuuuuuuuuuuaaaaaaaagaaaaaaaaagaagaaaa

SEQ ID NO: 547747 - RNA, 64 nt, Homo Sapiens
guaguauuauuaaucuucugacauuuucuuauguuuuuaaaaagauaagagcaucuagugcauu

SEQ ID NO: 547748 - RNA, 64 nt, Homo Sapiens
ucuucucaagcguuuucaagaucuagcauguggauuuuaaaagauuugcccucauuaacaagaa

SEQ ID NO: 547749 - RNA, 64 nt, Homo Sapiens
cacuucugagaguaguaaaugacucuuugcuacauuuuaaaagcaauuguauuaguaagaacuu

SEQ ID NO: 547750 - RNA, 64 nt, Homo Sapiens
aguuuuccuuccuuaaccaugggugcuaguaacuuuuuaaaacucaagacaagauuaguuuuuu

SEQ ID NO: 547751 - RNA, 64 nt, Homo Sapiens
gaagaaaagauuugguuuucauggcagucuguuuuuuuaaaaaaaaauuuuugagccacuaucu

SEQ ID NO: 547752 - RNA, 64 nt, Homo Sapiens
uauagaucuggaggaaagaaagcuacgaaaaacuuuuuaaaaguucuagugguacgguaggagc

SEQ ID NO: 547753 - RNA, 64 nt, Homo Sapiens
uaagguuuuccccccuuuauuuuccguaguuguauuuuaaaagauucggcucuguauuauuuga

SEQ ID NO: 547754 - RNA, 64 nt, Homo Sapiens
gagaagaguaucuguaaauaaaaggguuccaaccuuuuaaaaaagaaggaaaaaacuuuuuggu

SEQ ID NO: 547755 - RNA, 64 nt, Homo Sapiens
aaaaacuuuuuggugcuccaguguagggcuaucuuuuuaaaaaaugucaacaaagggaaaauaa

SEQ ID NO: 547756 - RNA, 64 nt, Homo Sapiens
auugucuaucccuguuuuuauaugucuccauucuuuuuaaaaucuuaacauauggagcagccuu

SEQ ID NO: 547757 - RNA, 64 nt, Homo Sapiens
uuuagagaacaagaacaaaccaugucucaaauuuuuuuaaaaaaaauuaaugguuuuaaauaua

SEQ ID NO: 547758 - RNA, 64 nt, Homo Sapiens
uagucacuacuguuaucacaucccuuuguauaaguuuuaaaaagagauggagggagaucuucau

SEQ ID NO: 547759 - RNA, 64 nt, Homo Sapiens
augauauccaaacuuaauuuggcuaggacuucaauuuuaaaaaucaguguaccuaggcagugca

SEQ ID NO: 547760 - RNA, 64 nt, Homo Sapiens
cacuugugcacugugaaugaacuuuguauuauuuuuuuaaaaccuucacauuacguguagauau

SEQ ID NO: 547761 - RNA, 64 nt, Homo Sapiens
aucuuaaaaguaauacagaauugugauuuauuaauuuuaaaacauucagaacuuguugaaagaa

SEQ ID NO: 547762 - RNA, 64 nt, Homo Sapiens
uuaaagaauuugcauccauuuuugagucuaaaucuuuuaaaauauacugagauccacaucuagu

SEQ ID NO: 547763 - RNA, 64 nt, Homo Sapiens
aauaacucuuauuuuuauuuuugaagguuuuuuuuuuuaaaaaaaaaaacguauaaaauaaugc

SEQ ID NO: 547764 - RNA, 64 nt, Homo Sapiens
guuaucugauagggccuuggaggagaagguccaguuuuaaaaaaugacaguuuguguuuaauaa

SEQ ID NO: 547765 - RNA, 64 nt, Homo Sapiens
uguaauccuuguucaguucuuaaguuucgguuuuuuuuaaaaacaggaugcaacuuaaacuuuu

SEQ ID NO: 547766 - RNA, 64 nt, Homo Sapiens
caggcuccccaaagcacucuaauucucgggucuuuuuuaaaagcccuggugucuccgacucauc

SEQ ID NO: 547767 - RNA, 64 nt, Homo Sapiens
gugacuuuaacccgcccacccuagaguuuagccuuuuuaaaaaugagagagcaaauacagcaau

SEQ ID NO: 547768 - RNA, 64 nt, Homo Sapiens
gcauuuuuaaucaguggaaccacaaaagcaaaauuuuuaaaacuugauuucuccagaaauuuac

SEQ ID NO: 547769 - RNA, 64 nt, Homo Sapiens
cuauuuugaaaggucagaauuuucaaaaaaauguuuuuaaaaacguuuaaaagcaaauacugau

SEQ ID NO: 547770 - RNA, 64 nt, Homo Sapiens
uggcauuuuaaguguuuaaauaucugcaaggauuuuuuaaaaaugacugaaagaaacuaagauu

SEQ ID NO: 547771 - RNA, 64 nt, Homo Sapiens
aaauuuaauuagcacauauucauccaaagaucauuuuuaaaaugaacauaguuggaaauguaau

SEQ ID NO: 547772 - RNA, 64 nt, Homo Sapiens
cuguggcaucccauuguucaucuguuaaaaguuguuuuaaaaagugaaugauacugaucuuaua

SEQ ID NO: 547773 - RNA, 64 nt, Homo Sapiens
gaaaacuaccugggaucauauuuacaggaagaaauuuuaaaacugggguaacaacuguacuuac

SEQ ID NO: 547774 - RNA, 64 nt, Homo Sapiens
ccccugauguaccugaacaaguauuugcugcuauuuuuaaaacuaauuauuuccaaagacccca

SEQ ID NO: 547775 - RNA, 64 nt, Homo Sapiens
aaauuagacauuuuauaugucugccauauuuauauuuuaaaagguacaucuuugauauaaagca

SEQ ID NO: 547776 - RNA, 64 nt, Homo Sapiens
uuuauuuugauaugaugcuuuaccugugauuuuauuuuaaaauagauuacauuuaauagcuugu

SEQ ID NO: 547777 - RNA, 64 nt, Homo Sapiens
agugucuggaguuuguaaugugugacuaccggguuuuuaaaaguuguaugucaugcuguuuaug

SEQ ID NO: 547778 - RNA, 64 nt, Homo Sapiens
cgaaggguauccaagguucuaagacuuuaagguauuuuaaaauuuuaaaaaauaagauuaaugg

SEQ ID NO: 547779 - RNA, 64 nt, Homo Sapiens
uaagauuaauggaagacuuuaacaaaccuagcauuuuuaaaaaaugauugcugcagguaacuga

SEQ ID NO: 547780 - RNA, 64 nt, Homo Sapiens
auuuguuuuagacugccuugucuguucuucguauuuuuaaaaaaggcaccucuucccuucaaua

SEQ ID NO: 547781 - RNA, 64 nt, Homo Sapiens
auacaguaucagauuuuguuaaguaaacacuuuguuuuaaaaugauuuuaaaaaauccugccua

SEQ ID NO: 547782 - RNA, 64 nt, Homo Sapiens
uccugccuaaaguaaacacuguauugcugcuuuauuuuaaaaaauuuuugucuuaucugcgugg

SEQ ID NO: 547783 - RNA, 64 nt, Homo Sapiens
uaguuuagugacaaagucaugagaaugccaccuuuuuuaaaacugcagcaugggacugaaacau

SEQ ID NO: 547784 - RNA, 64 nt, Homo Sapiens
acuucucuggccucugguuucugcucucuuuuccuuuuaaaaucauuucuuuuggugaccgaag

SEQ ID NO: 547785 - RNA, 64 nt, Homo Sapiens
cauccuuucgauuucuuuugccccacauuuuauuuuuuaaaaacuugcagagaaaaaaaaaagu

SEQ ID NO: 547786 - RNA, 64 nt, Homo Sapiens
cguauauucaacauaaaaucucaauaagaacacuuuuuaaaagauguuauuuuacauuuuaugu

SEQ ID NO: 547787 - RNA, 64 nt, Homo Sapiens
gaaaucuuaauucauuuacuauaugucucuuuauuuuuaaaaauaagagaguuauuacaaauaa

SEQ ID NO: 547788 - RNA, 64 nt, Homo Sapiens
auaaaguacaucuugaaauuuuccucuuaagcacuuuuaaaauacugaauuaauaauucucucu

SEQ ID NO: 547789 - RNA, 64 nt, Homo Sapiens
gcgcaugauucuacauaugauaaaggaguuucaguuuuaaaagugauguccacugaugaaauuu

SEQ ID NO: 547790 - RNA, 64 nt, Homo Sapiens
aucaucgaagguggugaaacugguguuuuggaaauuuuaaaauuucauauaacucaagaauaaa

SEQ ID NO: 547791 - RNA, 64 nt, Homo Sapiens
ggcagccccuugauggcucacucuuuuuuuuuuuuuuuaaaaggguccuugggaucccagauca

SEQ ID NO: 547792 - RNA, 64 nt, Homo Sapiens
ucagcugcuccaaaaucauccacauaaagcauuuuuuuaaaaagcacugcucuuccucaccugu

SEQ ID NO: 547793 - RNA, 64 nt, Homo Sapiens
guuauuauugacaucccaaugaagaaccagccauuuuuaaaaaggauuuuuauuuucucugucu

SEQ ID NO: 547794 - RNA, 64 nt, Homo Sapiens
ucuuauuuuuaagaauuauagcacauuuaauauguuuuaaaauguauacuuuuuuccaaauaau

SEQ ID NO: 547795 - RNA, 64 nt, Homo Sapiens
aaaacaguucauuuuggggauguguuuuuaaacuuuuuaaaauuuaucagugcuucauugucau

SEQ ID NO: 547796 - RNA, 64 nt, Homo Sapiens
uaaagguugugaggaaaagacagcagauggcaguuuuuaaaaaaaaauguggacaucucuuguu

SEQ ID NO: 547797 - RNA, 64 nt, Homo Sapiens
uuuauuuuuuuuaaaguauuacuguaagcuauacuuuuaaaauagucuaaaauacuacauuguc

SEQ ID NO: 547798 - RNA, 64 nt, Homo Sapiens
aacuauuuaauguaaaauauuuaacaauccuagcuuuuaaaagaguuuaugaagagaguugagu

SEQ ID NO: 547799 - RNA, 64 nt, Homo Sapiens
uuggaaagauacacaucuuuucagacuuacguuguuuuaaaaguccaucaaauauguucuuauc

SEQ ID NO: 547800 - RNA, 64 nt, Homo Sapiens
uuguccuuuaacuaucagagcaaaugcauucauguuuuaaaaguuauguguugcauaaacaauc

SEQ ID NO: 547801 - RNA, 64 nt, Homo Sapiens
uuggugcaauuaacucuggaucauuauuauuacuuuuuaaaaugaagucuugcauugaauuuag

SEQ ID NO: 547802 - RNA, 64 nt, Homo Sapiens
aucuagccaucaucaagguguuuaaaaugaauuuuuuuaaaacaaaauguuuuauuguuacuuu

SEQ ID NO: 547803 - RNA, 64 nt, Homo Sapiens
aauuuuuuuaaaacaaucuauuuuauuguuacuuuuuuaaaauguuacuuuucaucuguaaaug

SEQ ID NO: 547804 - RNA, 64 nt, Homo Sapiens
auuuuacaguuguaaaaaauauagcuaaauaauuuuuuaaaaauauggaguaacaaauuacaga

SEQ ID NO: 547805 - RNA, 64 nt, Homo Sapiens
auggaguaacaaauuacagauaguuacuucuauuuuuuaaaauagaguagucugauuuagagac

SEQ ID NO: 547806 - RNA, 64 nt, Homo Sapiens
acaaucacuaaacuuuauuuuuuuuuuuuuuugguuuuaaaagcuuuaaucucucucucuuuuu

SEQ ID NO: 547807 - RNA, 64 nt, Homo Sapiens
uuuauuggguuuuuauuguuuuauugggauaucauuuuaaaaacaauugucguuuuuauuccuc

SEQ ID NO: 547808 - RNA, 64 nt, Homo Sapiens
aaagugcagauugcuuguauaaauuuuagaacuuuuuuaaaaucgcaagaccccauccuuuaaa

SEQ ID NO: 547809 - RNA, 64 nt, Homo Sapiens
guaggauagaggguacagugauuuaauggugagcuuuuaaaaauuuucuauaauaauuaguacu

SEQ ID NO: 547810 - RNA, 64 nt, Homo Sapiens
uuacccccucuucaacugaacagacugacccucuuuuuaaaaguauuauaaaacagggggaaag

SEQ ID NO: 547811 - RNA, 64 nt, Homo Sapiens
uauacauguagcucaacuugugugcaaaauaguuuuuuaaaaauuugaaacaaaaaauuuuacc

SEQ ID NO: 547812 - RNA, 64 nt, Homo Sapiens
auaauuuaguaucaaggcuugaauacuguguauuuuuuaaaaaagcagcucaagcaugcaguau

SEQ ID NO: 547813 - RNA, 64 nt, Homo Sapiens
acuaacugccaucaccugcuuuacuugugucauauuuuaaaauuggauuuuuuuauaaacaguu

SEQ ID NO: 547814 - RNA, 64 nt, Homo Sapiens
ccuucuauagcuagagcuuugcucuucuccuugauuuuaaaauuucuauuaguuuuuuggccuu

SEQ ID NO: 547815 - RNA, 64 nt, Homo Sapiens
ucuagguaauuugccacgcuugaucacuuaaaacuuuuaaaacuuuauauuugaugcaaauauu

SEQ ID NO: 547816 - RNA, 64 nt, Homo Sapiens
ugaaguugcucuuuuccuguggaaaauaagcauuuuuuaaaaucaaggcagaaaacccaccaug

SEQ ID NO: 547817 - RNA, 64 nt, Homo Sapiens
uuauuuuuuacccuaauacugacaacaaaaauaauuuuaaaaaguaagaaugcuuuauguuuag

SEQ ID NO: 547818 - RNA, 64 nt, Homo Sapiens
uuuucuuuuuuguuguuguuaaauuggaagauucuuuuaaaaauuuuaaaaaaugcuaauaaga

SEQ ID NO: 547819 - RNA, 64 nt, Homo Sapiens
ugcuaauaagaaaauuggaagagaugguauuaccuuuuaaaaaagacuucggaaaauuaaguca

SEQ ID NO: 547820 - RNA, 64 nt, Homo Sapiens
uaauuuccuuuggguagauaaacagugcaggugauuuuaaaauauuaugaauagugcugcgaua

SEQ ID NO: 547821 - RNA, 64 nt, Homo Sapiens
ugucuauuguuaaauuuugauuggcaguuugguauuuuaaaaauaaagacgguuucuuuuaauu

SEQ ID NO: 547822 - RNA, 64 nt, Homo Sapiens
guguuaaugucaauaugaugacuugagagacacuuuuuaaaaaucuaguuuuauuaaauauuac

SEQ ID NO: 547823 - RNA, 64 nt, Homo Sapiens
uacauuuauagauugaucagcuguuggaacucucuuuuaaaaagaacuuaccuauuauccaccu

SEQ ID NO: 547824 - RNA, 64 nt, Homo Sapiens
acuuauuagaagcaaacugcggaaaaaaaaauuuuuuuaaaaauaaauuuaaagaaaagcuaga

SEQ ID NO: 547825 - RNA, 64 nt, Homo Sapiens
guuuagacacagauauuuggaauaaauaaacaguuuuuaaaauucuagggguacauucuuacaa

SEQ ID NO: 547826 - RNA, 64 nt, Homo Sapiens
uacuuacuuuggacuagggguuuuggccaaaauuuuuuaaaacaugaaaggguuuuuguaaauu

SEQ ID NO: 547827 - RNA, 64 nt, Homo Sapiens
auaaaaagauuuuauuuaguaugugacagaauuuuuuuaaaauuuuaaauuuagacuauguagu

SEQ ID NO: 547828 - RNA, 64 nt, Homo Sapiens
uaaaauucugucagacuacauguuuaagaaaucuuuuuaaaaagaaaauucccccucauuagaa

SEQ ID NO: 547829 - RNA, 64 nt, Homo Sapiens
uaaccauuuuuauuaaaccuuuugccuuuuuauguuuuaaaagcuuuaaaaaccguuuuaacau

SEQ ID NO: 547830 - RNA, 64 nt, Homo Sapiens
gcugucaagauaaacacuguaagaaauuuuaaauuuuuaaaacauguguuuuucuggagggagg

SEQ ID NO: 547831 - RNA, 64 nt, Homo Sapiens
cugguauuaaacuaaauggauagucuuacuuguuuuuuaaaaugcucugccaugacucuuaaag

SEQ ID NO: 547832 - RNA, 64 nt, Homo Sapiens
aggaaccacaaucuuuauauguuauagcauacuuuuuuaaaaguuuauauuuuuaaggaaguaa

SEQ ID NO: 547833 - RNA, 64 nt, Homo Sapiens
auauguguaaauugaaauuuauuagaauguacuauuuuaaaauacauaucuaugucucauaaaa

SEQ ID NO: 547834 - RNA, 64 nt, Homo Sapiens
uuauauuugucucuuagaguauuuuuaauuucuuuuuuaaaaaauauuuagcauaagacgugau

SEQ ID NO: 547835 - RNA, 64 nt, Homo Sapiens
aguaaaaguugcugcuuucucuacuagcuuuuuuuuuuaaaaaaaugcucauuuuuacaugcug

SEQ ID NO: 547836 - RNA, 64 nt, Homo Sapiens
aaaaaggcaggcagacagaaaugauagucuucauuuuuaaaaaccugaagacaaacuuguuuca

SEQ ID NO: 547837 - RNA, 64 nt, Homo Sapiens
uuaauuuaaaaaauuuaauuuagauguuguuauauuuuaaaaguuuuguuuuguacaguucugu

SEQ ID NO: 547838 - RNA, 64 nt, Homo Sapiens
cacucauaaguaaguuuggcauuuacaaaguuguuuuuaaaacagcuugcuucuuugcccagac

SEQ ID NO: 547839 - RNA, 64 nt, Homo Sapiens
agcuguuuuaagaggaacagccucaggauauuucuuuuaaaauauguguuugcuuuguuaauug

SEQ ID NO: 547840 - RNA, 64 nt, Homo Sapiens
uucuaaaugucuaauauaaauagcaucuaaaaaguuuuaaaagcccuaguuuugccacaaccuu

SEQ ID NO: 547841 - RNA, 64 nt, Homo Sapiens
gcuggugaaaacuugccacuguugggccacuaucuuuuaaaauuguccacuauuuguuaccaga

SEQ ID NO: 547842 - RNA, 64 nt, Homo Sapiens
cuuuucuugaacuccuggccuagagguuuauuauuuuuaaaaaaguacaguuaggguaacacuu

SEQ ID NO: 547843 - RNA, 64 nt, Homo Sapiens
gcgcuaagaaggcaaagcagacuuaaauguguguuuuuaaaaaugagacuggggggaguuacca

SEQ ID NO: 547844 - RNA, 64 nt, Homo Sapiens
aaaguauuuuauacauuuaaggagcaaaaacaaauuuuaaaauuagcugaaauuggagaaccaa

SEQ ID NO: 547845 - RNA, 64 nt, Homo Sapiens
ucuuuauaggcuacugucaguacuaaaggauaaauuuuaaaaaacucccuugacacuuauucua

SEQ ID NO: 547846 - RNA, 64 nt, Homo Sapiens
uagaagucguugggcugcauugcagaaaaccagauuuuaaaaugcuggagaacugcgaacgagc

SEQ ID NO: 547847 - RNA, 64 nt, Homo Sapiens
uauuuuaggugacaccacuguauaaacugaauuauuuuaaaaggcuauaacuagcaaauaauuc

SEQ ID NO: 547848 - RNA, 64 nt, Homo Sapiens
uuaucaauauguauaauuuuaagcaauugauaauuuuuaaaaaauugugcuggguuaguuuugc

SEQ ID NO: 547849 - RNA, 64 nt, Homo Sapiens
ugcucccaggaauagacacaaaucugugcaauaauuuuaaaaugaaauaaauaaaaauuaaaaa

SEQ ID NO: 547850 - RNA, 64 nt, Homo Sapiens
uuacaucaagagaggcagucuacuguaauaauauuuuuaaaaauguuguuaguggggacuauga

SEQ ID NO: 547851 - RNA, 64 nt, Homo Sapiens
caaaccaauaaaauuuuuauauauuguuuauagguuuuaaaaacuuuaagugaucaaacuaaga

SEQ ID NO: 547852 - RNA, 64 nt, Homo Sapiens
uugaaaaauuacaggugagaauauuugaaacagauuuuaaaaacgucacgguuagaagaagcua

SEQ ID NO: 547853 - RNA, 64 nt, Homo Sapiens
cacuucuacuugguuuuuuguucguuuucaagacuuuuaaaaaguaccccauccuccugaagcc

SEQ ID NO: 547854 - RNA, 64 nt, Homo Sapiens
ugcuuacugugcacagauacauuagaaccacuauuuuuaaaaagagaagaaacaacaaaagcca

SEQ ID NO: 547855 - RNA, 64 nt, Homo Sapiens
uuuaauugaagcaugugaagaccccuagaguuuguuuuaaaauugccugggggucccuguguuc

SEQ ID NO: 547856 - RNA, 64 nt, Homo Sapiens
aucaguaaaguuagauuuuaguuugcuaaguauauuuuaaaauaaugugauguuucuagucuga

SEQ ID NO: 547857 - RNA, 64 nt, Homo Sapiens
ucuuccugcacuggcuaaaagauuuauuuuucuguuuuaaaauaaaaaccuuacacccauuauu

SEQ ID NO: 547858 - RNA, 64 nt, Homo Sapiens
uuauauuuucuaaagaaaaauguagauggcaucuuuuuaaaaaguuuugauuugucauugcuau

SEQ ID NO: 547859 - RNA, 64 nt, Homo Sapiens
auuuuaugcauguuaaguauaauuuaaguuuguauuuuaaaaauuacacauucagaaucuggcc

SEQ ID NO: 547860 - RNA, 64 nt, Homo Sapiens
uuaccuuuaauacaauccuuuaagauuucuaagguuuuaaaaagcauuauaacauuuaugugcu

SEQ ID NO: 547861 - RNA, 64 nt, Homo Sapiens
uauaaaaacuuuaugauccauucuaaauaagagguuuuaaaauaaaugauauuauugauacucu

SEQ ID NO: 547862 - RNA, 54 nt, Homo Sapiens
gggaaaauaugaaaucugguauuuuuuuaaaaauaagauucacagaaauucuga

SEQ ID NO: 547863 - RNA, 64 nt, Homo Sapiens
auaaauauucuaauguagcuacuucagagcaguuuuuuaaaaaaguuuuugguacacugggcag

SEQ ID NO: 547864 - RNA, 64 nt, Homo Sapiens
ccuguugaguuucuuuguguuucugaccuacuauuuuuaaaauuauaagaguuacuguugcauu

SEQ ID NO: 547865 - RNA, 64 nt, Homo Sapiens
caaaagccaauugaacaacauauugauuugauuuuuuuaaaaaugugguagcucuuacaaaguu

SEQ ID NO: 547866 - RNA, 64 nt, Homo Sapiens
ccuucacacuguaauuuaaugauacacuguucauuuuuaaaauucuuugcaaacauuuaaugag

SEQ ID NO: 547867 - RNA, 64 nt, Homo Sapiens
gcuguaacuaguuguaagugguagaaaucugaauuuuuaaaagaucucucccguuaaacugagu

SEQ ID NO: 547868 - RNA, 64 nt, Homo Sapiens
gagcuugaagagggaauguugggaauggacuggguuuuaaaagguuuucauuuucagugauguu

SEQ ID NO: 547869 - RNA, 64 nt, Homo Sapiens
auauaaacuuguauuauuuuucuuauuuuaaauuuuuuaaaauuucuguagguacauaguaugu

SEQ ID NO: 547870 - RNA, 64 nt, Homo Sapiens
aauuauaauucacacauuucuaagucaugaaugcuuuuaaaaaauguuccauauuuaucuuuga

SEQ ID NO: 547871 - RNA, 64 nt, Homo Sapiens
ccagcucagugcugguuuacggaacaacucuuacuuuuaaaaauuacuuguucccccaaauugu

SEQ ID NO: 547872 - RNA, 64 nt, Homo Sapiens
uuaauuccaucugagugauugucaguguaaggccuuuuaaaacaaaagcaaguucuuuguuagg

SEQ ID NO: 547873 - RNA, 64 nt, Homo Sapiens
uuuugccuuagugugaaaauguaacauuuuaugcuuuuaaaaucaauagauucaucaccuuagu

SEQ ID NO: 547874 - RNA, 64 nt, Homo Sapiens
ugcuuuuaaaaucaauagauucaucaccuuaguuuuuuaaaaaaaaucuauaaauaggguaauu

SEQ ID NO: 547875 - RNA, 64 nt, Homo Sapiens
aaucuaagcaaagcacccaacaaugguaaauguuuuuuaaaaaugcagaacuaagauuuuugac

SEQ ID NO: 547876 - RNA, 64 nt, Homo Sapiens
guagaaaauuauuaauuuugauuguauuuuuguauuuuaaaagcuucuucacuuguguucccua

SEQ ID NO: 547877 - RNA, 64 nt, Homo Sapiens
aguaagagaaacaaacuguuuagaauuaucauguuuuuaaaacaucauaguaauauaaaucugc

SEQ ID NO: 547878 - RNA, 64 nt, Homo Sapiens
guagugaggaaaaaaccuaagaaauuuccccuuuuuuuaaaaaauggaaauauucaauugagac

SEQ ID NO: 547879 - RNA, 64 nt, Homo Sapiens
auuuauaugugaaaaguuggacauuucuguaaguuuuuaaaauuauccauuuguuacuuuaaca

SEQ ID NO: 547880 - RNA, 64 nt, Homo Sapiens
aaguuuuuaaaauuauccauuuguuacuuuaacauuuuaaaauuaugguguuuuccugauuuua

SEQ ID NO: 547881 - RNA, 64 nt, Homo Sapiens
acuuuaacauuuuaaaauuaugguguuuuccugauuuuaaaagcaauauuuuccuuacuguaaa

SEQ ID NO: 547882 - RNA, 64 nt, Homo Sapiens
agaagucuguaucuagugauaaauauaccaguuuuuuuaaaaagaugcuguugugccuauauca

SEQ ID NO: 547883 - RNA, 64 nt, Homo Sapiens
uauuuccguaaguacuucuguggccuugaguauuuuuuaaaaggcucaacuguaagccucuuag

SEQ ID NO: 547884 - RNA, 64 nt, Homo Sapiens
gcucagccuguggcccauugggugauuuccuguauuuuaaaacugacaguagccugaucaaagu

SEQ ID NO: 547885 - RNA, 64 nt, Homo Sapiens
uggagguuucuaugagguucuuagaaaaauuugguuuuaaaaucauuugaggacaggaaugucu

SEQ ID NO: 547886 - RNA, 64 nt, Homo Sapiens
uauauuucauuacugaaugcuaaacuguauuucuuuuuaaaauuuggaaaauuuuuaauucuga

SEQ ID NO: 547887 - RNA, 64 nt, Homo Sapiens
ugaugcuguguuacuaaaauuacaaggaccugcuuuuuaaaaggccagaacaauugucugaaau

SEQ ID NO: 547888 - RNA, 64 nt, Homo Sapiens
agcauuggaaggucaaauuauuuugaagugauuuuuuuaaaaaaaagucuucuguuuauuaaca

SEQ ID NO: 547889 - RNA, 64 nt, Homo Sapiens
ugucaccaaaaaguugacuuugaauuuguuggacuuuuaaaaaaccaguuggaaauauagguug

SEQ ID NO: 547890 - RNA, 64 nt, Homo Sapiens
agaaaaauuaaguaccaaaccuauuaggaaauuuuuuuaaaaaguggauuuaacuuaaauuacu

SEQ ID NO: 547891 - RNA, 64 nt, Homo Sapiens
guuuuuaaucguuuuuguuuuaaggaaaaaagauuuuuaaaaugaaucuuaugcaaaacuuuuu

SEQ ID NO: 547892 - RNA, 64 nt, Homo Sapiens
aacuuuuugaccaguuucuuuucuuuuguuuuuuuuuuaaaaaagacauuuaaagacaaagaca

SEQ ID NO: 547893 - RNA, 64 nt, Homo Sapiens
ccuuuccauuuuacguuuuagaaaauuuuauguauuuuaaaauaaggggaagagucauuuucac

SEQ ID NO: 547894 - RNA, 64 nt, Homo Sapiens
ugauuuuuaguaaccuuuaaaaauguauaaugacuuuuaaaauuuguagaauugaaaagacgcu

SEQ ID NO: 547895 - RNA, 64 nt, Homo Sapiens
auggggccuaaccugccacuuauuuuuugucaauuuuuaaaacuuuuuuuuaauuacuguaaag

SEQ ID NO: 547896 - RNA, 64 nt, Homo Sapiens
aaauccuuucaauauucugggaacccagggaaguuuuuaaaaaugucauuacuuucaaaggaac

SEQ ID NO: 547897 - RNA, 64 nt, Homo Sapiens
uaaaguacuugaaauguauugacugcugacuauauuuuaaaaacaaaaugaaauaauuugaguu

SEQ ID NO: 547898 - RNA, 64 nt, Homo Sapiens
agaugauuucauugagcuucauugcagccugaaauuuuaaaaaaguuguguaauacgccaacca

SEQ ID NO: 547899 - RNA, 64 nt, Homo Sapiens
aaucacagcccaaaauuugauggacuaauuauuauuuuaaaauauaugaagacaauaauucuac

SEQ ID NO: 547900 - RNA, 64 nt, Homo Sapiens
guauuuuuccaaaugaaaaaucucaauugaaagcuuuuaaaauguagaaacuuaaacacaccuu

SEQ ID NO: 547901 - RNA, 64 nt, Homo Sapiens
agugucugacuuuuguuaaauucaguaaugcaguuuuuaaaaaccuguaucugacccacuuugu

SEQ ID NO: 547902 - RNA, 64 nt, Homo Sapiens
guacaaacaguauuucugguguauauuuuaauguuuuuaaaaagaguaauuucauuuaaauauc

SEQ ID NO: 547903 - RNA, 64 nt, Homo Sapiens
cucugagaauaacacauagugaagaucugugggcuuuuaaaauuguucacagccaauuuaagaa

SEQ ID NO: 547904 - RNA, 64 nt, Homo Sapiens
uuuguauuuuauauguaaaguaguauugcugacauuuuaaaaaaauacaaaauacaaaagaaac

SEQ ID NO: 547905 - RNA, 64 nt, Homo Sapiens
guauuguuuaucauaaaacauauuauguuccuaguuuuaaaaagacccaaaguaugauuaauau

SEQ ID NO: 547906 - RNA, 64 nt, Homo Sapiens
auuuuugcugaauagguuuaagucagauaauagauuuuaaaaaagcaaaugaggcaauguguca

SEQ ID NO: 547907 - RNA, 64 nt, Homo Sapiens
cacuuuuaaauugucucuugcaucacuaaaauuuuuuuaaaaugagcauaacaacgaaaggcau

SEQ ID NO: 547908 - RNA, 64 nt, Homo Sapiens
uaaaaagucaaaagaaacaaauagaagcuuuuuuuuuuaaaaaauguauugcuucugaacuuuu

SEQ ID NO: 547909 - RNA, 64 nt, Homo Sapiens
ugugaacagcauuagaacuuugucuauuucuuaauuuuaaaauaugcugauaugccuuaaacug

SEQ ID NO: 547910 - RNA, 64 nt, Homo Sapiens
uagccauaccucagauaauauguuuaguuuuacauuuuaaaauguuuaaauucucuuucacagc

SEQ ID NO: 547911 - RNA, 64 nt, Homo Sapiens
ugauaauuuaaaauccauuuuaggugauaaaauuuuuuaaaaguuuugaaggaaaccucuggau

SEQ ID NO: 547912 - RNA, 64 nt, Homo Sapiens
auuuauaaaaaguguauaugcaguaugauaccacuuuuaaaaaaagauaaauuuauagaaaaaa

SEQ ID NO: 547913 - RNA, 64 nt, Homo Sapiens
ccucgagguuccuuagugaguuuuguaccuucuauuuuaaaagaggcuuucccaaacugugcca

SEQ ID NO: 547914 - RNA, 64 nt, Homo Sapiens
aauacagucgaaucaccaggaaccuuugagcugcuuuuaaaauucuuccccuggcaccacucag

SEQ ID NO: 547915 - RNA, 64 nt, Homo Sapiens
gacaguaucacuuuccuguuaaaacauacaauaauuuuaaaaggugaaugccuaaaguuccaau

SEQ ID NO: 547916 - RNA, 64 nt, Homo Sapiens
guuauuauuggaaacauuacuuugagugcaguguuuuuaaaagccaauucuuuuuuaucccuuu

SEQ ID NO: 547917 - RNA, 64 nt, Homo Sapiens
uaaagcaaagcccugguccuuuuuaaacuacuaguuuuaaaaaccuguguuaaaugaacaguaa

SEQ ID NO: 547918 - RNA, 64 nt, Homo Sapiens
ugcuguuacgguuguauauagaggucugaaggauuuuuaaaaugauuugcacuuuuucacugca

SEQ ID NO: 547919 - RNA, 64 nt, Homo Sapiens
agauucuuuauuuucccaaacacuacaaaaaaacuuuuaaaacuuugccauuucaucuguuuac

SEQ ID NO: 547920 - RNA, 64 nt, Homo Sapiens
agaauuuaugggagccuauauaaacauaucuugcuuuuaaaaaguucuugagggaauagcaacu

SEQ ID NO: 547921 - RNA, 64 nt, Homo Sapiens
caacuuucccauggcugugccuauuuccuagaccuuuuaaaagaugugcagagcagcuuagcau

SEQ ID NO: 547922 - RNA, 64 nt, Homo Sapiens
uuaggggggauuguguuuaaaucaaauauauguauuuuaaaaauaaugacaugcucaaccuucc

SEQ ID NO: 547923 - RNA, 64 nt, Homo Sapiens
ugaaggauuguagauuuuugcuuuuucuuuuuguuuuuaaaacuuauuccaauugcuaaauugg

SEQ ID NO: 547924 - RNA, 64 nt, Homo Sapiens
uuugcauucaaauuaaggguuaagaaaagagauauuuuaaaaugagagucacuugaugugccau

SEQ ID NO: 547925 - RNA, 64 nt, Homo Sapiens
agauauuuuaaaaugagagucacuugaugugccauuuuaaaaaaaaaggcauauugcuuuuucu

SEQ ID NO: 547926 - RNA, 64 nt, Homo Sapiens
agaaacugauuucuucagaauuagauggcuuauuuuuuaaaauauuugaaugaaaacauuuuau

SEQ ID NO: 547927 - RNA, 64 nt, Homo Sapiens
uauuuuuuaaaauauuugaaugaaaacauuuuauuuuuaaaauauuacacaggaggcuucggag

SEQ ID NO: 547928 - RNA, 64 nt, Homo Sapiens
aguuagaagaacggaucaugugccaacuguaguuuuuuaaaaaaaacgcuccuuuguaggguuu

SEQ ID NO: 547929 - RNA, 64 nt, Homo Sapiens
gugagccaccacaccuggccuuucugcaacauuuuuuuaaaaaaaucuaauaaaucuuagauuu

SEQ ID NO: 547930 - RNA, 64 nt, Homo Sapiens
acauuuuuuuaaaaaaaucuaauaaaucuuagauuuuuaaaaaagaauuaaaaugugggaguuc

SEQ ID NO: 547931 - RNA, 64 nt, Homo Sapiens
aaguacuaauaucuacaugguccacacuuuucuauuuuaaaaaauuguguucucuuguuaaaua

SEQ ID NO: 547932 - RNA, 64 nt, Homo Sapiens
uuuaaucaucaucuagacuuguuaaguagaaaaauuuuaaaaauuugcuuaugaaaauauaacc

SEQ ID NO: 547933 - RNA, 64 nt, Homo Sapiens
cuuaauuuuauuuauaaguuuugguguuuaccuguuuuaaaaugauaauguuggcaucugugau

SEQ ID NO: 547934 - RNA, 64 nt, Homo Sapiens
cuuuuucacgcauuugcuuuauucgaaaagaggcuuuuaaaaugugcauguuuagaaacaaaau

SEQ ID NO: 547935 - RNA, 64 nt, Homo Sapiens
uagcuauggaaagaugcauagaaagaguauaauguuuuaaaacauaaggcauuugucugccauu

SEQ ID NO: 547936 - RNA, 64 nt, Homo Sapiens
uuaauacuuaucagaucuacaaaaaucauuauuauuuuaaaagaguuauuugaguuucuuucuu

SEQ ID NO: 547937 - RNA, 64 nt, Homo Sapiens
gcacauuuaugguuuuuuauuacuauuauuaugguuuuaaaaagaguaacuuuauuucuuuuug

SEQ ID NO: 547938 - RNA, 64 nt, Homo Sapiens
aaaggacuuauuuuuuaacuguaauauuuauuaguuuuaaaauauuuguaucucauuuguaaca

SEQ ID NO: 547939 - RNA, 64 nt, Homo Sapiens
aauuuguuuuaauuuuuuauauauauguuuuuauuuuuaaaaaacauaccaguugaaugggguu

SEQ ID NO: 547940 - RNA, 64 nt, Homo Sapiens
agaauugaugcuagagguaaaaaaaaauacuuguuuuuaaaaaauccuuuacgucuuguguaau

SEQ ID NO: 547941 - RNA, 64 nt, Homo Sapiens
agcaucacugugucuguauuucaaguacaaauguuuuuaaaaaggauucuuuauacauaugugc

SEQ ID NO: 547942 - RNA, 64 nt, Homo Sapiens
ugcuaacuuuauaguauuucuaauuguucaaggauuuuaaaauucuauuucagggaguauaucu

SEQ ID NO: 547943 - RNA, 64 nt, Homo Sapiens
aaccccuauaugcguuguugcauaacagaugauuuuuuaaaauauauacuuccuuaugcaaagu

SEQ ID NO: 547944 - RNA, 64 nt, Homo Sapiens
uucaaguguuuuauaauuaaaucauaauagcauauuuuaaaaucaaucuuccuaaaaggucugc

SEQ ID NO: 547945 - RNA, 64 nt, Homo Sapiens
ugccaaguaugccaguguaaugaaacugcccuuauuuuaaaagccagucaaagauuccacugau

SEQ ID NO: 547946 - RNA, 64 nt, Homo Sapiens
uagaaaguaugguuuaacuggacccuauuaugccuuuuaaaaauaauuucaguaacccauaaau

SEQ ID NO: 547947 - RNA, 64 nt, Homo Sapiens
aaggaaugugcauaauggagagaagacauauuuuuuuuaaaacugaagauauuggcacaaaugu

SEQ ID NO: 547948 - RNA, 64 nt, Homo Sapiens
uuauuauuguugauguugucaugguuaaucuauuuuuuaaaauugaaaugaagcagaaguaggc

SEQ ID NO: 547949 - RNA, 64 nt, Homo Sapiens
gaggaugaauuuucugcuuuaaaggcauguguguuuuuaaaauuaaugaauguagaugugugau

SEQ ID NO: 547950 - RNA, 64 nt, Homo Sapiens
ccagacuugaugguuuuaagucggaaccgauaaauuuuaaaaaggagaaaaaauaauuugaccu

SEQ ID NO: 547951 - RNA, 64 nt, Homo Sapiens
ucuuagcucaguuacucaauucauacguaguauuuuuuaaaauaauuuuauaucuguguaccac

SEQ ID NO: 547952 - RNA, 64 nt, Homo Sapiens
uaaauauuaauaaauggauacacauucaaaauacuuuuaaaaaaaagaaaauguuaccaguuuu

SEQ ID NO: 547953 - RNA, 64 nt, Homo Sapiens
gguugaauuuuuggauauauuauguugauuuaacuuuuaaaauguuguuuaaaagugugaagcu

SEQ ID NO: 547954 - RNA, 64 nt, Homo Sapiens
uuuauuaucuuuaaacuuguugcauuuaaaauauuuuuaaaaccuucuuaacaaaacuucuuaa

SEQ ID NO: 547955 - RNA, 64 nt, Homo Sapiens
aauggcagucucaauccuacugucauucuuuuuauuuuaaaauaaauaaauaagccuaucuuuu

SEQ ID NO: 547956 - RNA, 64 nt, Homo Sapiens
gaggugaguauguacucugacuucagcucucagguuuuaaaaauuauauuagugggaccaguua

SEQ ID NO: 547957 - RNA, 64 nt, Homo Sapiens
uuugauaggcaauacaucuacccacuccauuauuuuuuaaaacuucauuuaauaguuuaaacaa

SEQ ID NO: 547958 - RNA, 64 nt, Homo Sapiens
uuuucuauuuucccucgcugguuagacucuuacuuuuuaaaaucuuuuagugacagcucugccu

SEQ ID NO: 547959 - RNA, 64 nt, Homo Sapiens
uuaauauggguucuuuuuuguauuuggggcuuauuuuuaaaauucuggaugcauuucucugggg

SEQ ID NO: 547960 - RNA, 64 nt, Homo Sapiens
gauguagcagaauaauucuuuggauuuuuuucuuuuuuaaaagagaacuggugcuuuaguaaug

SEQ ID NO: 547961 - RNA, 64 nt, Homo Sapiens
cuguuuuguuuuaauuuuuggaagucaaaaaucuuuuuaaaaugcaacaguaguuuugaaacua

SEQ ID NO: 547962 - RNA, 64 nt, Homo Sapiens
cacaaaacugcaggacaguuaaguaaauuagaauuuuuaaaaaggauauuuauucuuuaaauca

SEQ ID NO: 547963 - RNA, 64 nt, Homo Sapiens
agcaaggaguuaaauguccuaaaaccacuggaguuuuuaaaagauuuauuguaguggcugccua

SEQ ID NO: 547964 - RNA, 64 nt, Homo Sapiens
uugaagcagaaccuuguaauaauuuuuaaauuuuuuuuaaaaaccuugugcugcacaugggcug

SEQ ID NO: 547965 - RNA, 64 nt, Homo Sapiens
uaguuggacuuuggcagcuuuaaaaaaaaucaauuuuuaaaaaaucaccagauuuuuauuaaug

SEQ ID NO: 547966 - RNA, 64 nt, Homo Sapiens
aaagagaucagauuaaauaucuacugaauuaauuuuuuaaaagaacacaggaaaaaauagaagu

SEQ ID NO: 547967 - RNA, 64 nt, Homo Sapiens
aaguugcuaaggcgaucaaucguugacauugucguuuuaaaagggacauacaaauuuagacucu

SEQ ID NO: 547968 - RNA, 64 nt, Homo Sapiens
gauuaauaaaaucauaaugcuucaaacugauuauuuuuaaaagagccuuucuuuuccgaugguu

SEQ ID NO: 547969 - RNA, 64 nt, Homo Sapiens
gaucaacuuuaaauuaagcauuucuuuaauaaguuuuuaaaauuuauuuuaaguuaaagacaga

SEQ ID NO: 547970 - RNA, 64 nt, Homo Sapiens
ucuuccucuuucucuggggauugagaaauaauuuuuuuaaaaaacaaguauaaguuucaccacc

SEQ ID NO: 547971 - RNA, 64 nt, Homo Sapiens
cuuaaaagugcuugauauaaugagcaugacuguauuuuaaaauagggacucuuucaaguguauc

SEQ ID NO: 547972 - RNA, 64 nt, Homo Sapiens
gucucuuuuguuaagaauaacuaucaguuaauaguuuuaaaaaucaucucacuggauguaaaau

SEQ ID NO: 547973 - RNA, 64 nt, Homo Sapiens
caaaauuaaugcaaaagauuauuuaagugaauauuuuuaaaacucaauaaucaagauaccuaau

SEQ ID NO: 547974 - RNA, 64 nt, Homo Sapiens
acuugcacuugugcauauacaugauuaauccacauuuuaaaaugagguauaaacauauauuuac

SEQ ID NO: 547975 - RNA, 64 nt, Homo Sapiens
aagagagcagcaaaugaaagaacuaaggggaauauuuuaaaauugaguuuuuuuaagguuuaau

SEQ ID NO: 547976 - RNA, 64 nt, Homo Sapiens
cugcccuaugaguaucaaccaacagacuaugacauuuuaaaaauuuuuuucauugauauuugaa

SEQ ID NO: 547977 - RNA, 64 nt, Homo Sapiens
acucagcauucaguuagauauuucagaaaaauuauuuuaaaagaaaaaagugaacuauguuuuu

SEQ ID NO: 547978 - RNA, 64 nt, Homo Sapiens
aauaaaaggaagaugaguauaaaacuugcgugucuuuuaaaaaucugaaguuggcauguuucgu

SEQ ID NO: 547979 - RNA, 64 nt, Homo Sapiens
agugauucucuaacagaccuguuaacuuugugcuuuuuaaaaaaagaguacuuuucuugauacu

SEQ ID NO: 547980 - RNA, 64 nt, Homo Sapiens
auaauucagaugagacugagauucaaaccaacacuuuuaaaaaacuuaguuuuuucauuuaaua

SEQ ID NO: 547981 - RNA, 64 nt, Homo Sapiens
uuaagaauauucacacaaucacaguuuuuaaaaguuuuaaaaauuugaaaacagugcaaagauc

SEQ ID NO: 547982 - RNA, 64 nt, Homo Sapiens
uuuaaaaauuuaagaauauugcaaagaucacaguuuuuaaaaguugcugacucuugaaaacagu

SEQ ID NO: 547983 - RNA, 64 nt, Homo Sapiens
uacuuauuugucuucuuuuugacugcugauaauauuuuaaaauaauguaaaaccacacaaaacg

SEQ ID NO: 547984 - RNA, 64 nt, Homo Sapiens
uuauuuaaguaaauauuuuuucuauuuagauuuauuuuaaaagucauauucauuacuuaucugc

SEQ ID NO: 547985 - RNA, 64 nt, Homo Sapiens
ccacuaucccuuuucuaaagguuuaaagacguguuuuuaaaauucaaauaaaaucaaaagucau

SEQ ID NO: 547986 - RNA, 64 nt, Homo Sapiens
uaaaaauuagcugggcguggucucuacaaaaaaauuuuaaaaagaaaagcauauugagacucug

SEQ ID NO: 547987 - RNA, 64 nt, Homo Sapiens
cucaacauuaacuauucauagucaauaaguauauuuuuaaaaugcaaaggaagacauauacaug

SEQ ID NO: 547988 - RNA, 64 nt, Homo Sapiens
aauacagacuuaucuccucauuaccuuuucucacuuuuaaaacuggcuuuuccauguuguuuua

SEQ ID NO: 547989 - RNA, 64 nt, Homo Sapiens
cccaucuugcuuucuuuuuguuccccacauuggcuuuuaaaauaugggcauuaucauuggaugu

SEQ ID NO: 547990 - RNA, 64 nt, Homo Sapiens
auaaauuaauaucuaauuguauuuuauguucuacuuuuaaaaaaguuacuguaguguuuauaua

SEQ ID NO: 547991 - RNA, 64 nt, Homo Sapiens
uguauuguaauuccaugaccuaaaggaaaguuauuuuuaaaaauucuuuaacaaugucuauugg

SEQ ID NO: 547992 - RNA, 64 nt, Homo Sapiens
auuaagcuuuuugcucauuuauuuaaaaauuugguuuuaaaaauauauaacuaguuucugaggu

SEQ ID NO: 547993 - RNA, 64 nt, Homo Sapiens
acaaagcuuaugucuuaagugacaagcccuacaauuuuaaaauaaggcaagauauguaaguaaa

SEQ ID NO: 547994 - RNA, 64 nt, Homo Sapiens
uuuuuuuuggaccuaaauaaauuucuguugugauuuuuaaaaacagaacauuuuauuuucucuu

SEQ ID NO: 547995 - RNA, 64 nt, Homo Sapiens
acuggaauaauuauaucuaugaauaucuuuuaaguuuuaaaaaauucuucuuaauucggcaaug

SEQ ID NO: 547996 - RNA, 64 nt, Homo Sapiens
aaagcuaaugcuaguauauaauagagaaaaaaaauuuuaaaaaguaugccuuuuaaaaaugcuu

SEQ ID NO: 547997 - RNA, 64 nt, Homo Sapiens
gcuuauagagaaaaaaaauucuuuuggguaugccuuuuaaaaaugggauggugauuaaacaccu

SEQ ID NO: 547998 - RNA, 64 nt, Homo Sapiens
ugucauuuuauuaagagugauuguaauaaaacauuuuuaaaaaugcauuuuuuuaaaagaagcu

SEQ ID NO: 547999 - RNA, 64 nt, Homo Sapiens
agcuuuguaauaaaacauuuugugcugagcauuuuuuuaaaagagucauuccaguuugaguuaa

SEQ ID NO: 548000 - RNA, 64 nt, Homo Sapiens
gcaaggcacagccuuugcccuugauguacccauuuuuuaaaaaagccaguuguuaaaaugagca

SEQ ID NO: 548001 - RNA, 64 nt, Homo Sapiens
aaauguaaaagcacaugagaagcauaaaaagguuuuuuaaaaggagagccaaguuccaaaauaa

SEQ ID NO: 548002 - RNA, 64 nt, Homo Sapiens
aaaaguaugugaauaugaauuauguagccuugccuuuuaaaagaauugcguccauguugcuuua

SEQ ID NO: 548003 - RNA, 64 nt, Homo Sapiens
caaaaauaaauauugcguccaagaauuugugacauuuuaaaaaacuaagauauauauuuacuaa

SEQ ID NO: 548004 - RNA, 64 nt, Homo Sapiens
aguuauguuugggcaaagccaacaaguugugcuuuuuuaaaaggacuuaaccucugugugccua

SEQ ID NO: 548005 - RNA, 64 nt, Homo Sapiens
cugaguguguacaaauaucuuauguuccuuaaguuuuuaaaauuaaauuuugccuaaaauucag

SEQ ID NO: 548006 - RNA, 64 nt, Homo Sapiens
uuaaggcacucugaaacaaauuaacagugucuuuuuuuaaaaagaagagaaauaauuguauuug

SEQ ID NO: 548007 - RNA, 64 nt, Homo Sapiens
gcauacagauaauggaaaauggaauauugaaagguuuuaaaaugucauauuuauuaauuucaag

SEQ ID NO: 548008 - RNA, 64 nt, Homo Sapiens
caaguagaaugauuuaaauaaagagucuuuuuauuuuuaaaacaauugaacuuucuaaaacuaa

SEQ ID NO: 548009 - RNA, 64 nt, Homo Sapiens
ggucuuucuccccgaaauacuaauugggauuauuuuuuaaaagaucagccauuuacucucccac

SEQ ID NO: 548010 - RNA, 64 nt, Homo Sapiens
aaucuuugcaugaagguuggcugacuuuugauaguuuuaaaauuugaccucuggaauaaaagaa

SEQ ID NO: 548011 - RNA, 64 nt, Homo Sapiens
cuuccaacccaaaggccuuuaaaacacuguugucuuuuaaaauggcucaaacaauucucagccu

SEQ ID NO: 548012 - RNA, 64 nt, Homo Sapiens
gaugauaaucaucagguuuaaggccaaauuaaucuuuuaaaaauaaauaaacuacuuugaauag

SEQ ID NO: 548013 - RNA, 64 nt, Homo Sapiens
aaguuuuauacauaaacaguuuuuaaaagguagguuuuaaaaaugagauagagggguuuuagau

SEQ ID NO: 548014 - RNA, 64 nt, Homo Sapiens
uagguuuuaaaaauaaguuugagggguuuuagauuuuuaaaaggggcauggagaccgggagaua

SEQ ID NO: 548015 - RNA, 64 nt, Homo Sapiens
guucaaggacuaacgaacguguaucguucgcuuguuuuaaaaggacuaugccguguaguuucug

SEQ ID NO: 548016 - RNA, 64 nt, Homo Sapiens
cugaauuggaauagaauugguagauuaaucugcauuuuaaaaaauucucguauggugcuagagu

SEQ ID NO: 548017 - RNA, 64 nt, Homo Sapiens
gaacuauguugcuaugaauuacuacaaaccugguuuuuaaaaaguaaaccagaacauucuaugu

SEQ ID NO: 548018 - RNA, 64 nt, Homo Sapiens
aaaaaagacuacuacagguuguauuuuauaaaaauuuuaaaaagcuuuauuuugggaaauuagu

SEQ ID NO: 548019 - RNA, 64 nt, Homo Sapiens
aaacaauguauauuauguucuaaauuaaccuuuuuuuuaaaaaaguugaagaugaaaucauucc

SEQ ID NO: 548020 - RNA, 64 nt, Homo Sapiens
aauuuuguaauaaaauuaugguugcauuucguuuuuuuaaaaaaaauuuuggguuuuuuaggau

SEQ ID NO: 548021 - RNA, 64 nt, Homo Sapiens
ugcagguuguagcuuuuugauguagagaaaauacuuuuaaaaaaguauagcugauaagauucuc

SEQ ID NO: 548022 - RNA, 64 nt, Homo Sapiens
ucaaaauuuaugauuuacauaaaccauuuaggauuuuuaaaacacaagucucgguaaguccuuu

SEQ ID NO: 548023 - RNA, 64 nt, Homo Sapiens
uggguuaaucaagucucgguaauuugauuuuuuauuuuaaaaacuuuuuauaauauaaauuuau

SEQ ID NO: 548024 - RNA, 64 nt, Homo Sapiens
gccaguaaaccaucggaucaauuuauguaauguguuuuaaaagcuucacaaaagauuucuaaag

SEQ ID NO: 548025 - RNA, 64 nt, Homo Sapiens
uuagccaggcaugguggcacaaaacauaaaagauuuuuaaaaaaagggcgacccccaucucuac

SEQ ID NO: 548026 - RNA, 64 nt, Homo Sapiens
cugugguaaaagccucaaugcucauuuuccauauuuuuaaaaccauuguuucuuugugcuucag

SEQ ID NO: 548027 - RNA, 64 nt, Homo Sapiens
uuaaaauuucacaaaacuaaucagucauuuaaaauuuuaaaaaugucauuuaaaauuuaaauuu

SEQ ID NO: 548028 - RNA, 64 nt, Homo Sapiens
cuauagugcaaaugcuuuuauuagccaauaggaauuuuaaaauaacauggaacuuacacaaaag

SEQ ID NO: 548029 - RNA, 64 nt, Homo Sapiens
aacuuacacaaaaggcuuuucaugugccuuacuuuuuuaaaaaggaguuuauuguauucauugg

SEQ ID NO: 548030 - RNA, 64 nt, Homo Sapiens
uugguugcaucuuguaggccaucugacuuccuguuuuuaaaacgggggucuggucuugcuaaac

SEQ ID NO: 548031 - RNA, 64 nt, Homo Sapiens
cgggucuggcagugcgugucccguggggugugcauuuuaaaacucgauucauagacacagguac

SEQ ID NO: 548032 - RNA, 64 nt, Homo Sapiens
guuguauucacacaaaccugaacaaagcaaauuuuuuuaaaagcagcguauguaagcaccgaca

SEQ ID NO: 548033 - RNA, 64 nt, Homo Sapiens
agcacuuugcauaggcaaaauacuuuucaggccuuuuuaaaaaauucauuacagcaaacagcug

SEQ ID NO: 548034 - RNA, 64 nt, Homo Sapiens
accaaaccaaaggucucacuaggaaauuuaucuguuuuaaaacauugcuuccuuccuggcucug

SEQ ID NO: 548035 - RNA, 64 nt, Homo Sapiens
guuacuguaacuuggguauuauguuaaaugucuguuuuaaaagaaaguagcguuaagauagauc

SEQ ID NO: 548036 - RNA, 64 nt, Homo Sapiens
ugcugggcuccagagagaagggaaaacuaagagguuuuaaaaccccuacccuccuugguuuacc

SEQ ID NO: 548037 - RNA, 64 nt, Homo Sapiens
gacaauaugcugaacauuagacauaauuaaaucuuuuuaaaaauugauaauuuaucucuguuuu

SEQ ID NO: 548038 - RNA, 64 nt, Homo Sapiens
agaguaagugcaauaauaugaaauagccuguacauuuuaaaaauguugucaccaaguuauauaa

SEQ ID NO: 548039 - RNA, 64 nt, Homo Sapiens
auccacaucucuguaaacaaccuuuuuuaaguaauuuuaaaaaaaauaaacacucugcuuacua

SEQ ID NO: 548040 - RNA, 64 nt, Homo Sapiens
aagaauucauaauuuuaagcaguuaguaauuucauuuuaaaauuucuguagaagcucaggaauu

SEQ ID NO: 548041 - RNA, 64 nt, Homo Sapiens
auacuguuucaagcccauaugauuagauuuauguuuuuaaaaucuguugucuccauaucuugau

SEQ ID NO: 548042 - RNA, 64 nt, Homo Sapiens
ucuuguaaaaacacuuuuuugguuuaauauauauuuuuaaaacauuucacuagugauugaauuc

SEQ ID NO: 548043 - RNA, 64 nt, Homo Sapiens
guuaauacuucauaauaugugaaaaacucggaucuuuuaaaaagcaucauagaucauuuuucca

SEQ ID NO: 548044 - RNA, 64 nt, Homo Sapiens
cauagaucauuuuuccauaugacacugguuccgauuuuaaaaauuauuuuuaaauaaccgauua

SEQ ID NO: 548045 - RNA, 64 nt, Homo Sapiens
aauauuuucaacuuuuucccucacuaauugguacuuuuaaaaacauaacauaaauuuuuugaag

SEQ ID NO: 548046 - RNA, 64 nt, Homo Sapiens
aauaacccauaauugaaguguauaauauaaaaaauuuuaaaaaucuaagcagcuuauuguuucu

SEQ ID NO: 548047 - RNA, 64 nt, Homo Sapiens
guaauuauuuucuuuauuguugguaaacuccauauuuuaaaaauuuaccuguauacauagugcu

SEQ ID NO: 548048 - RNA, 64 nt, Homo Sapiens
gccagauuuuauccuagacccugaggauauagcuuuuuaaaacccccuccuguuucagagcuua

SEQ ID NO: 548049 - RNA, 64 nt, Homo Sapiens
uuaaaaggcauucuuagauucauuuuaaccacauuuuuaaaaacucacaguugguuaacaugau

SEQ ID NO: 548050 - RNA, 64 nt, Homo Sapiens
auagagagauuuuucaaaagcaguaaucccucaauuuuaaaaaaggauugaaaauucuaaaugu

SEQ ID NO: 548051 - RNA, 64 nt, Homo Sapiens
uggauuuuuuaugccuccucaguaaccagaaauguuuuaaaaaacuaaguguuuaggauuucaa

SEQ ID NO: 548052 - RNA, 64 nt, Homo Sapiens
ucauuuuuguugaguaagcaaaauuacaaaguguuuuuaaaaaaaccuguacaaauauguuuau

SEQ ID NO: 548053 - RNA, 64 nt, Homo Sapiens
cccccaagcugugagaguguguuuauuuuuaauuuuuuaaaagguauuuaauuuccaaccacac

SEQ ID NO: 548054 - RNA, 64 nt, Homo Sapiens
cggauuuuuguuaauauucauuuuuguuauccuuuuuuaaaaguaaauguacaggaugccagua

SEQ ID NO: 548055 - RNA, 64 nt, Homo Sapiens
gugagaaguucauauuucuuuggcuuuuuuguguuuuuaaaaguuacuccuuuuagggagcugg

SEQ ID NO: 548056 - RNA, 64 nt, Homo Sapiens
augggacaaaguuccaaaaugccaaauucuuauuuuuuaaaaagcuaguucuauaaaauacugg

SEQ ID NO: 548057 - RNA, 64 nt, Homo Sapiens
uguguauuuuuuaaagcuacaaucuguucaauguuuuuaaaaaucuguuuauaugacauuguua

SEQ ID NO: 548058 - RNA, 64 nt, Homo Sapiens
auauuaauaaaguauaagugauguuuuauaugauuuuuaaaaaaaauucucaagugcaaugugu

SEQ ID NO: 548059 - RNA, 64 nt, Homo Sapiens
augauuuuuaaaaaaaauucucaagugcaauguguuuuaaaauaagcuugcaaaugacagcaga

SEQ ID NO: 548060 - RNA, 64 nt, Homo Sapiens
auuuauuuuuauauggaauugcauaaugugugccuuuuaaaacaauaacaaaaaccagagaugu

SEQ ID NO: 548061 - RNA, 64 nt, Homo Sapiens
auacuugacauuaaccucaucaaaagugugugaauuuuaaaacaaauucuaaaaaaacuauagu

SEQ ID NO: 548062 - RNA, 64 nt, Homo Sapiens
caugaguuuuaugguauuuugugagggaugcauuuuuuaaaagauuaauuuuggaaacagaagg

SEQ ID NO: 548063 - RNA, 64 nt, Homo Sapiens
uuuugccacuuagaauagcauuugccacuuaguauuuuaaaaaauaauuguuggaguauuuauu

SEQ ID NO: 548064 - RNA, 64 nt, Homo Sapiens
caaaaugacuuuauacaacgauuguauuugugacuuuuaaaaauaauuauuuuauuguguaauu

SEQ ID NO: 548065 - RNA, 64 nt, Homo Sapiens
ugaaggcuaaucauagaaaaaaaaccucuaguuuuuuuaaaaauagaauuuggaaacuuauuuu

SEQ ID NO: 548066 - RNA, 64 nt, Homo Sapiens
ucuuccugauucagaaauguguaugguuugcagcuuuuaaaaaccauuuuuuuaaaacuaauaa

SEQ ID NO: 548067 - RNA, 64 nt, Homo Sapiens
aauguguaugguuugcagcuuuuaaaaaccauuuuuuuaaaacuaauaaauagugacugaacca

SEQ ID NO: 548068 - RNA, 64 nt, Homo Sapiens
guuaaugcaguagaaaguagugguaauaauuccuuuuuaaaaaaauuucgguagucauauagua

SEQ ID NO: 548069 - RNA, 64 nt, Homo Sapiens
aggauugugauauuagaggcuggaaauccuuauuuuuuaaaaaaucagauaggcauaaauaguu

SEQ ID NO: 548070 - RNA, 64 nt, Homo Sapiens
ccacauaucuuuuuuuguguggauggggaaaauguuuuaaaauccaguuauuuaauaugaguuu

SEQ ID NO: 548071 - RNA, 64 nt, Homo Sapiens
guuauuuaauaugaguuugagagagaaaauuguuuuuuaaaaauauaugugcauugaaaugaug

SEQ ID NO: 548072 - RNA, 64 nt, Homo Sapiens
agguuugauguauauagaaauuccauguuugauuuuuuaaaauauguguauaagucugucaugu

SEQ ID NO: 548073 - RNA, 64 nt, Homo Sapiens
ugcuuuuuucauaguucuuguuuucauguuuuauuuuuaaaaagacauauaaagauugcauauu

SEQ ID NO: 548074 - RNA, 64 nt, Homo Sapiens
uuuccuaauaaaccccuuugauuuaaaaauguauuuuuaaaaauguuuacauugaugaugagua

SEQ ID NO: 548075 - RNA, 64 nt, Homo Sapiens
uuuauuuauugacagacuuugcagccuugcuaaauuuuaaaagcauuuuuaaaaaaacuucuac

SEQ ID NO: 548076 - RNA, 64 nt, Homo Sapiens
cagacuuugcagccuugcuaaauuuuaaaagcauuuuuaaaaaaacuucuacaaaacucuagua

SEQ ID NO: 548077 - RNA, 64 nt, Homo Sapiens
ucacauuuguauuaauaauuguuuaaaaugccucuuuuaaaagcuuauauaaauuuuuuucuuc

SEQ ID NO: 548078 - RNA, 64 nt, Homo Sapiens
aagauaauuuacuuaauauaucuucccugauuuguuuuaaaagaucagagggugacugaugaua

SEQ ID NO: 548079 - RNA, 64 nt, Homo Sapiens
gaguauauguguguguguguaacuaucauguggguuuuaaaaauccuuuuuuacagugguaucc

SEQ ID NO: 548080 - RNA, 64 nt, Homo Sapiens
cuauuuaauuggguuccacugaaccucaugggacuuuuaaaagaagggcuauuuaaggaauuca

SEQ ID NO: 548081 - RNA, 64 nt, Homo Sapiens
uguuccaaggugcagugcacugugaaucuuuuauuuuuaaaaaaauuuguaggugcuuuuaugu

SEQ ID NO: 548082 - RNA, 64 nt, Homo Sapiens
uuuuaaacaaacaauuugaaguuaaacauuucauuuuuaaaaacacugaauuacaguucuuauu

SEQ ID NO: 548083 - RNA, 64 nt, Homo Sapiens
caacaaaaaaccagugaaauucuacaagugucccuuuuaaaaauagugugugcuaacuaagggc

SEQ ID NO: 548084 - RNA, 64 nt, Homo Sapiens
aacaaguucaaaauuuaaacaaguucauacaaguuuuuaaaaauucucaacugguagcuugcuu

SEQ ID NO: 548085 - RNA, 64 nt, Homo Sapiens
aucuaaauauucagguuuuaagccugcugcaaacuuuuaaaauauuaugauagauucuguacua

SEQ ID NO: 548086 - RNA, 64 nt, Homo Sapiens
ucaaccaaaaguaauaguuggguauuggagauuuuuuuaaaauguuuuuauguuauuagcuauu

SEQ ID NO: 548087 - RNA, 64 nt, Homo Sapiens
aaaaucauaaaaaaucaaguuuuaagguuauauuuuuuaaaauaaugaauuuucuaucucuagg

SEQ ID NO: 548088 - RNA, 64 nt, Homo Sapiens
cuucauuuugauaugacugaauugcaaucuauauuuuuaaaaagaaaaaucaaaauacauuagg

SEQ ID NO: 548089 - RNA, 64 nt, Homo Sapiens
gguggcuauuuugauuuggcaugacuacuuaauuuuuuaaaaaaauugugguuugugaauugca

SEQ ID NO: 548090 - RNA, 64 nt, Homo Sapiens
cuguucuguacaaacaaaaaguauguaauacccauuuuaaaaaaccauuugaaaguagacaacu

SEQ ID NO: 548091 - RNA, 64 nt, Homo Sapiens
gaaaaaaaaaaaaaaagaaaaaaagaauguaaaauuuuaaaaauacaguuuaacagcuguaaaa

SEQ ID NO: 548092 - RNA, 64 nt, Homo Sapiens
acuuuguuaguacauuuuuuagugucacacugacuuuuaaaauuugaaugauauauagacuuug

SEQ ID NO: 548093 - RNA, 64 nt, Homo Sapiens
uucaugcuauauaucuuuuguaagacauuuccuuuuuuaaaaaaauuuuugcaaauaacugauc

SEQ ID NO: 548094 - RNA, 64 nt, Homo Sapiens
uaaaugaaucagcaguggauguagggauagcugauuuuaaaacacucggcugggcacaguggcu

SEQ ID NO: 548095 - RNA, 64 nt, Homo Sapiens
ucuauguauaggagauaaaauuugcuaguaagauuuuuaaaaacuggcuagugaaaggaaagua

SEQ ID NO: 548096 - RNA, 64 nt, Homo Sapiens
aacacagccuucauuucaacuuauauaaaauauguuuuaaaaugccugacaauguagauaauuc

SEQ ID NO: 548097 - RNA, 64 nt, Homo Sapiens
uucugucaguaauccauaagacagaaaucuguuuuuuuaaaaauaucuuuuucuccucucagcu

SEQ ID NO: 548098 - RNA, 64 nt, Homo Sapiens
agugcaagcuauuuguuuguuuucuaauuuauaguuuuaaaaacuucgcuuauugaguuuuugu

SEQ ID NO: 548099 - RNA, 64 nt, Homo Sapiens
agaagcauagacuguagaguaucuuuuuaagcauuuuuaaaaaaugcuuuuaaugcaucauaca

SEQ ID NO: 548100 - RNA, 64 nt, Homo Sapiens
auuuguaauacauuuuccugauuugaaaguuuguuuuuaaaaguuuucuauuaauuauagugca

SEQ ID NO: 548101 - RNA, 64 nt, Homo Sapiens
gauuuagacccuuaaaaaacaaguaaauaugcacuuuuaaaaugcaaucaaaagacuggugguu

SEQ ID NO: 548102 - RNA, 64 nt, Homo Sapiens
cauucacugacuuauuuuccuuccauuuucugguuuuuaaaauuagccacaccacaggaaaccc

SEQ ID NO: 548103 - RNA, 64 nt, Homo Sapiens
ccaaaaauccagauuuguauaugaaaucuuaccauuuuaaaagauuggcagcuaauuauuuuuu

SEQ ID NO: 548104 - RNA, 64 nt, Homo Sapiens
cuuaccauuuuaaaagauuggcagcuaauuauuuuuuuaaaaagcugugcagugugaugugucc

SEQ ID NO: 548105 - RNA, 64 nt, Homo Sapiens
aaggguaaauuauaaauguuucaugaagaaaaaauuuuaaaaaucuacgucuuuauuacacaaa

SEQ ID NO: 548106 - RNA, 64 nt, Homo Sapiens
aaggccuaaugcauuauuuugucauaaaaugcuauuuuaaaauucauggaacuuucauacguaa

SEQ ID NO: 548107 - RNA, 64 nt, Homo Sapiens
aaauauacagcaugagauuguacauuuuuuacuuuuuuaaaauuguguucuuaaaauauugugu

SEQ ID NO: 548108 - RNA, 64 nt, Homo Sapiens
uucaaaaaauuauuuuaggcaaaguccauacuccuuuuaaaacaauauuuauguccuauguuug

SEQ ID NO: 548109 - RNA, 64 nt, Homo Sapiens
uagcauucugugcgaaaaaguauugaagauuagcuuuuaaaaacugaaaaaaaaaaaugaauga

SEQ ID NO: 548110 - RNA, 64 nt, Homo Sapiens
caguaugaaaagaccaggaauccagauuucuggcuuuuaaaagucagaggcucucacuacacug

SEQ ID NO: 548111 - RNA, 64 nt, Homo Sapiens
gauaauuuccagagacuguuuauaugcaccacuguuuuaaaauuacggugauuggccaggugca

SEQ ID NO: 548112 - RNA, 64 nt, Homo Sapiens
uaggcagagcuagguuuauuuucucuuaaacaauuuuuaaaauucagaauguaaaaauugggua

SEQ ID NO: 548113 - RNA, 64 nt, Homo Sapiens
aaauaacaaaauugucuacagcuucuuacuaaguuuuuaaaauuauucauaaaaugcagacauu

SEQ ID NO: 548114 - RNA, 64 nt, Homo Sapiens
aucaaucuuucuacuaauguaaauuugagauuauuuuuaaaaauggaauaaaagagguuuuggu

SEQ ID NO: 548115 - RNA, 64 nt, Homo Sapiens
acaauauuguauucaacuguuuuauuuuuuauauuuuuaaaauuuaaaguauaauuaguuuuua

SEQ ID NO: 548116 - RNA, 64 nt, Homo Sapiens
ucagugagacuaugaagagcacugacuuguuaaauuuuaaaagaaccauaaauucuaagguauc

SEQ ID NO: 548117 - RNA, 64 nt, Homo Sapiens
aguauuuaauucauagaaaaaauguaaaaggucuuuuuaaaaaucaugaaaaauaguugaauau

SEQ ID NO: 548118 - RNA, 64 nt, Homo Sapiens
cuuuaaaagaguaagcuucaauaugugaauuuucuuuuaaaaacagucacugaguuaauaaugu

SEQ ID NO: 548119 - RNA, 64 nt, Homo Sapiens
agcaaacuaacuuuuuuuuuuuuaacaucuuuguuuuuaaaauagaaugauagaacuuugccag

SEQ ID NO: 548120 - RNA, 64 nt, Homo Sapiens
uguucaaauuuuuuuuuaacguggcuuguagaauuuuuaaaaaagugaucuuagguuuguuuuu

SEQ ID NO: 548121 - RNA, 64 nt, Homo Sapiens
caugcagagaaaaucugugcauccucuuuuauauuuuuaaaauacuguuuaacauuugugagaa

SEQ ID NO: 548122 - RNA, 64 nt, Homo Sapiens
caaaacaggucccuaagacaauucuucagaucauuuuuaaaaugacuaagucauuuuaguaugu

SEQ ID NO: 548123 - RNA, 64 nt, Homo Sapiens
caacgaguucaccuaaguaaggcucagauccuaguuuuaaaaaccauuucccauuaaaaugaag

SEQ ID NO: 548124 - RNA, 64 nt, Homo Sapiens
uaauccaugaguucaugcugauacucaaauuucuuuuuaaaaaggagaaacaggaagguuucuu

SEQ ID NO: 548125 - RNA, 64 nt, Homo Sapiens
auaaaccaguuuuuacaacuauuuuuguauuuauuuuuaaaaaaugcuaauguuuuauauuuau

SEQ ID NO: 548126 - RNA, 64 nt, Homo Sapiens
gugaagaaaaauuuuacagucuugcaaaugaagcuuuuaaaaaguguuagguacauguccugcc

SEQ ID NO: 548127 - RNA, 64 nt, Homo Sapiens
acaauagaaaaauaagcuguauuuuucuaugauuuuuuaaaauuaguugaaugugcauugacau

SEQ ID NO: 548128 - RNA, 64 nt, Homo Sapiens
cacuaacuaguuccuuagcugcuugcaauagggauuuuaaaauaacuagcgaggucaguguuag

SEQ ID NO: 548129 - RNA, 64 nt, Homo Sapiens
cauagaagaaacuugacuauugauaccucagugauuuuaaaagccagaagugaugauuaucaua

SEQ ID NO: 548130 - RNA, 64 nt, Homo Sapiens
cauguuguggaaaaaagccacucauauuguaucuuuuuaaaaacucaauuaauuuuuuuugaag

SEQ ID NO: 548131 - RNA, 64 nt, Homo Sapiens
cauuuuauuuugugauacaguagagacccacauuuuuuaaaaauaaaauuuacacuucuaagac

SEQ ID NO: 548132 - RNA, 64 nt, Homo Sapiens
ucuaagauuauucuccucuaaaaccaagcacagauuuuaaaacuguuuacuccuuucuagauga

SEQ ID NO: 548133 - RNA, 64 nt, Homo Sapiens
caaaguuagaucaagagaauaguacaaugucaguuuuuaaaaguauugagaauuauguaaauuc

SEQ ID NO: 548134 - RNA, 64 nt, Homo Sapiens
cauuuuacuggaaaguuggcuuuuuuuucucuuuuuuuaaaaucuguuucaauuaccgcuagau

SEQ ID NO: 548135 - RNA, 64 nt, Homo Sapiens
gcagugcugucuuaccucuuucaagugaccugucuuuuaaaaaguuauaucuuauauucucuau

SEQ ID NO: 548136 - RNA, 64 nt, Homo Sapiens
uuuguuuuauuggaaugcauuuuaugaagaugguuuuuaaaacuauaaguaaugaucuacauuu

SEQ ID NO: 548137 - RNA, 64 nt, Homo Sapiens
ugcauuuuuaaaugaauggccacaaaugagucauuuuuaaaauauuacaguaaguaauccuuac

SEQ ID NO: 548138 - RNA, 64 nt, Homo Sapiens
uguuaauuuuguaaacuuugaauuaaauaggaccuuuuaaaaauggggaagaaaaggaggaacc

SEQ ID NO: 548139 - RNA, 64 nt, Homo Sapiens
agaaaaauugaaaaacuguuuuuauuaugaacauuuuuaaaaacauaugacuucccccccaaau

SEQ ID NO: 548140 - RNA, 64 nt, Homo Sapiens
cuguaguguaugguaagucaccuccauaucccccuuuuaaaauugcgugagccaccgcacccgg

SEQ ID NO: 548141 - RNA, 64 nt, Homo Sapiens
cuggauuuggcaaaauuuagagaaugaagauauauuuuaaaauuacauguggcugaggccaaag

SEQ ID NO: 548142 - RNA, 64 nt, Homo Sapiens
aagggacaaagucaacuggagguuuuuuuuguuuuuuuaaaauggguuuauugacaggguuggg

SEQ ID NO: 548143 - RNA, 64 nt, Homo Sapiens
uacauaucugguuuugguaaaauaaauguucugguuuuaaaaaaaugucaacgauuagucaugc

SEQ ID NO: 548144 - RNA, 64 nt, Homo Sapiens
cuuaggauauucuauaugauaaugaggaggcaucuuuuaaaagcacaauaauguaaaugcagag

SEQ ID NO: 548145 - RNA, 64 nt, Homo Sapiens
auuaggauuauugaaauguaauguauaugaauccuuuuaaaaugcaccugcucuuuaugugaaa

SEQ ID NO: 548146 - RNA, 64 nt, Homo Sapiens
uauuucuucucuucuuuccauaggacuuaauuauuuuuaaaauauuuguaaaagaauucuagug

SEQ ID NO: 548147 - RNA, 64 nt, Homo Sapiens
aaaucauacuuacuauuagucuuagaaaguuauuuuuuaaaaaaagaaagccuuugccauuugu

SEQ ID NO: 548148 - RNA, 64 nt, Homo Sapiens
augaaaagcuuaugcaacaucucugaguuuuuaguuuuaaaagguuauccuuccuguuaagagc

SEQ ID NO: 548149 - RNA, 64 nt, Homo Sapiens
agccagaaaaaguauaauuuauaauagauaaaaauuuuaaaaacuagagaaaauaauuuuuaaa

SEQ ID NO: 548150 - RNA, 64 nt, Homo Sapiens
auagauaaaaauuuuaaaaaauagagaaaauaauuuuuaaaauaacuucaaguguuugauuaaa

SEQ ID NO: 548151 - RNA, 64 nt, Homo Sapiens
gccauaccucguguuucuuuaauaaacuuauuuuuuuuaaaaauuugaaaguaagugaaaugua

SEQ ID NO: 548152 - RNA, 64 nt, Homo Sapiens
guuuggccauuaguauuuuuaagauugccuuaguuuuuaaaaauagacuacugaaauauagaua

SEQ ID NO: 548153 - RNA, 64 nt, Homo Sapiens
cucuuuggugcacaaguaacguaggcaaaucucuuuuuaaaaaaguauacuucagugcucaccc

SEQ ID NO: 548154 - RNA, 64 nt, Homo Sapiens
ucaagacagggaaggaugacggggagggguggauuuuuaaaauggcauaacuggaggguggguu

SEQ ID NO: 548155 - RNA, 64 nt, Homo Sapiens
ucaaagcaguuaaacagcagguggcugaaugaauuuuuaaaauccuccaugcuuugaauacuau

SEQ ID NO: 548156 - RNA, 64 nt, Homo Sapiens
guuaaugcaggagaaaagauacacuuuaucaguauuuuaaaaauagcauuaguaauuuuuaaaa

SEQ ID NO: 548157 - RNA, 64 nt, Homo Sapiens
acuuuaucaguauuuuaaaaccagcauuaguaauuuuuaaaaacggcgugagccacugagccag

SEQ ID NO: 548158 - RNA, 64 nt, Homo Sapiens
ugucagccauauguauggggaaauaaaauuaaucuuuuaaaaugccccccagauuugggggaca

SEQ ID NO: 548159 - RNA, 64 nt, Homo Sapiens
aaugaauaaauggacaaaugugccuggccucauuuuuuaaaacaauuacaggcaugagucacca

SEQ ID NO: 548160 - RNA, 64 nt, Homo Sapiens
aagaaauguguuuuuaucguaccaugacuguggcuuuuaaaauagucaacagcaaaaugccugc

SEQ ID NO: 548161 - RNA, 64 nt, Homo Sapiens
aagccaagugcugucuaguccuuuuacgaagcuauuuuaaaaguuuucuuuauaugauauauuu

SEQ ID NO: 548162 - RNA, 64 nt, Homo Sapiens
cuuuuagcaaacaugcauuuuuguuuugauguaauuuuaaaagaucagugaacagguuuuaaug

SEQ ID NO: 548163 - RNA, 64 nt, Homo Sapiens
caccuguuugguucuggguguaugcuauaauauuuuuuaaaacuccuuauuaaucauuugaaau

SEQ ID NO: 548164 - RNA, 64 nt, Homo Sapiens
uagauauaaaugcuuacaugaaaaacuucaacccuuuuaaaaccacaguuuuucaucaacuguc

SEQ ID NO: 548165 - RNA, 64 nt, Homo Sapiens
uuaaauuaaaaaaauuaaaauaaagaauuaaaaauuuuaaaaauaauuuaaaaauuuuaaauuu

SEQ ID NO: 548166 - RNA, 64 nt, Homo Sapiens
uaauuagagguuuuuccauuuacuguggcuuuuauuuuaaaaagguacauaguaauuauuuaau

SEQ ID NO: 548167 - RNA, 64 nt, Homo Sapiens
aaaaacugaugauuagauuaaagcgcuugccuucuuuuaaaaagauucaucauggauaaaaacu

SEQ ID NO: 548168 - RNA, 64 nt, Homo Sapiens
uuucagauuggcuaaauauuuauguugggguaauuuuuaaaaauaucaaagaaagaaggccacg

SEQ ID NO: 548169 - RNA, 64 nt, Homo Sapiens
auuggucaauuccugacauauagaggcauuacuuuuuuaaaaaucccuuuaaaauguauuucuu

SEQ ID NO: 548170 - RNA, 64 nt, Homo Sapiens
ggcacauacucagagcagucucuaagcuuuucucuuuuaaaacuugcuccaacaugcuugaaga

SEQ ID NO: 548171 - RNA, 64 nt, Homo Sapiens
gcucugaauaaguucuagugaaaguuuucagcucuuuuaaaauuguuguacauuuagguuauuc

SEQ ID NO: 548172 - RNA, 64 nt, Homo Sapiens
aauuuaaauucuuucuucucauaauaacauauaauuuuaaaagaucucuugaccaaauagacuc

SEQ ID NO: 548173 - RNA, 64 nt, Homo Sapiens
gcaguuuagagcaaacugucuaccauauuauuguuuuuaaaaaaaguuccacaaaauccaaauu

SEQ ID NO: 548174 - RNA, 64 nt, Homo Sapiens
uaggaaauguucuauuuaaauuauguugaauaaauuuuaaaauuagaaaucagaauuaacauuu

SEQ ID NO: 548175 - RNA, 64 nt, Homo Sapiens
uuauuuuaacaaaaguuacauucaacacauuuuauuuuaaaauauuuuaaagguaacaguaauu

SEQ ID NO: 548176 - RNA, 64 nt, Homo Sapiens
cacacucuuccauauauggguuuguaacaauaauuuuuaaaaccaaauuaauguuuaaaauguu

SEQ ID NO: 548177 - RNA, 64 nt, Homo Sapiens
uauccaaggaucagagucucaauaauauggauuguuuuaaaaaaaaaauacuuaggauuaaaua

SEQ ID NO: 548178 - RNA, 64 nt, Homo Sapiens
ugagugaggguuauuauuugucaauauaccaauguuuuaaaaauaguuuucccaucaaacauua

SEQ ID NO: 548179 - RNA, 64 nt, Homo Sapiens
guuuuauuuugcacggcucuugccuggccgacauuuuuaaaaaaauuacaggcgugagccaccg

SEQ ID NO: 548180 - RNA, 64 nt, Homo Sapiens
uaucacacaaagacuuuuuuaaaguucuuauacuuuuuaaaagcaacuuuaaguaauuauuuuu

SEQ ID NO: 548181 - RNA, 64 nt, Homo Sapiens
ucuucagugcaaauuguaucuguguagguuaucuuuuuaaaaacugaggcaaauuaacuguaug

SEQ ID NO: 548182 - RNA, 64 nt, Homo Sapiens
uagagucuuacaaucaaauccaagugugcucuuuuuuuaaaaggguuuaaaagccauguauaac

SEQ ID NO: 548183 - RNA, 64 nt, Homo Sapiens
aauguuuuuauucuuuacucaugcuaaaugguauuuuuaaaauaugccaaacuuggggcaauug

SEQ ID NO: 548184 - RNA, 64 nt, Homo Sapiens
acccagucaaauguauuuucagaaugguggaacuuuuuaaaagauaaaaucagaaauagaugug

SEQ ID NO: 548185 - RNA, 64 nt, Homo Sapiens
gugacaacacuuuuauucucuguaugacagacauuuuuaaaaauuugaaccuugaacaaaaacu

SEQ ID NO: 548186 - RNA, 64 nt, Homo Sapiens
uuaauuggcuagcucuugccggugauauguuuaauuuuaaaauugugcuuuuacaaggaaaaaa

SEQ ID NO: 548187 - RNA, 64 nt, Homo Sapiens
uuuagauuuaaugucuacauauagguaguugauauuuuaaaaaccauuuaagacuacuuuucuu

SEQ ID NO: 548188 - RNA, 64 nt, Homo Sapiens
ccaauagauacaagagauguuuuuuagaggugcuuuuuaaaaauuuuauaaauuugagcuauuu

SEQ ID NO: 548189 - RNA, 64 nt, Homo Sapiens
uauuaaaagaaaccuaaauguuuauauaacuucauuuuaaaauacaaccgugguuacuguauuu

SEQ ID NO: 548190 - RNA, 64 nt, Homo Sapiens
aaaauauuauuuucugaauuauuuuguuuuucuauuuuaaaaauugccuuuaaaacacuuuuuu

SEQ ID NO: 548191 - RNA, 64 nt, Homo Sapiens
ucacucugaaguguuauggagccugcguguauauuuuuaaaaauaauacugcucaguuaucuuu

SEQ ID NO: 548192 - RNA, 64 nt, Homo Sapiens
aucaggagugacagagucaagacccaaacuggccuuuuaaaauaccuaagucaaagaccaguuu

SEQ ID NO: 548193 - RNA, 64 nt, Homo Sapiens
uaugcuauguagauauaaguacgucuguuuuuuauuuuaaaagaaggggugcgccuagacaggu

SEQ ID NO: 548194 - RNA, 64 nt, Homo Sapiens
uauuauuauuauuauuauugauuugcaucaugguuuuuaaaauuguuuuguguauuuaucugcc

SEQ ID NO: 548195 - RNA, 64 nt, Homo Sapiens
cagucacugguguuucuugagggagucugcugaauuuuaaaacguuuaaaaauaccauauucaa

SEQ ID NO: 548196 - RNA, 64 nt, Homo Sapiens
accauauucaagggagucugagccuuuuuuuuuuuuuuaaaaauucaguagcuccagguagaug

SEQ ID NO: 548197 - RNA, 64 nt, Homo Sapiens
ggagcuuggugagagcuuugaagaugugcuugcauuuuaaaaagccuuggauuugaggcuuccu

SEQ ID NO: 548198 - RNA, 64 nt, Homo Sapiens
gaaaaguaguaaauuagcaguuagcuguauuuuuuuuuaaaaaauaguauauucauuuauggag

SEQ ID NO: 548199 - RNA, 64 nt, Homo Sapiens
caaauuguugcuauuuccuauuuugccaaacucuuuuuaaaaaaggguguccaagagaaauggu

SEQ ID NO: 548200 - RNA, 64 nt, Homo Sapiens
uuuuuuuuccauuuggcauaaaauauuuuuaucauuuuaaaauaauuuagucauuucuguuucu

SEQ ID NO: 548201 - RNA, 64 nt, Homo Sapiens
aauaugcacagaaaauaaacucagggauuuauaauuuuaaaacaggaggaagaagaaaaagugc

SEQ ID NO: 548202 - RNA, 64 nt, Homo Sapiens
cugaaacaguaauaguuauucaauuuggggcaaguuuuaaaacaaguuuacacagcuacagaaa

SEQ ID NO: 548203 - RNA, 64 nt, Homo Sapiens
uuauuuaaugcccauuucaauguaauaauucauuuuuuaaaagacuugaagucuaguagugcac

SEQ ID NO: 548204 - RNA, 64 nt, Homo Sapiens
aaaauccuuccuucccauguuuuuuuaguuuuucuuuuaaaaauguuuauugaguuggcuuugc

SEQ ID NO: 548205 - RNA, 64 nt, Homo Sapiens
uaauuucuaagguuuaacacuaaugagaaucuuguuuuaaaauggugugguuuguguguguuuu

SEQ ID NO: 548206 - RNA, 64 nt, Homo Sapiens
uggcaauaaauggcucguggauauuuugcacgaauuuuaaaacauucucuguccagggcuucag

SEQ ID NO: 548207 - RNA, 64 nt, Homo Sapiens
uugauaggagacuuguacagcagcuuuucucuuuuuuuaaaaagcccacagggccugacuuuua

SEQ ID NO: 548208 - RNA, 64 nt, Homo Sapiens
ggaauaauuuguauguaucuauuuuuauucuggcuuuuaaaauguacuucugugguuaauguau

SEQ ID NO: 548209 - RNA, 64 nt, Homo Sapiens
uggcuuuccuaggauuuuaaugucauaugcuauuuuuuaaaauucuuuuuuuaaacuuaagcau

SEQ ID NO: 548210 - RNA, 64 nt, Homo Sapiens
gcaagaagaaaaacucagagaauauaaaaucaacuuuuaaaauugugugcucucuucuucacgu

SEQ ID NO: 548211 - RNA, 64 nt, Homo Sapiens
ucaaaggcaagagggcaaggcauuuuuuaacacuuuuuaaaauaaaaauuuauaccacaacuuu

SEQ ID NO: 548212 - RNA, 64 nt, Homo Sapiens
cauaaaccuuccacucuugaacaaagcagcugcuuuuuaaaagcgguaauugcuucuuuaccuu

SEQ ID NO: 548213 - RNA, 64 nt, Homo Sapiens
uaaagucuuuugugaacaaggcauuuguagccauuuuuaaaaguuuuugucuucagugcuggua

SEQ ID NO: 548214 - RNA, 64 nt, Homo Sapiens
cuaucucauuucacucuacugucucaaaauuuuguuuuaaaauaauagaaauguuuugccauua

SEQ ID NO: 548215 - RNA, 64 nt, Homo Sapiens
cagucagauuuuggaaacugccguauagucacuguuuuaaaaaccccggaggggcuguauuaau

SEQ ID NO: 548216 - RNA, 64 nt, Homo Sapiens
guuugacaccuucacaagucagcauuaaucuuucuuuuaaaacuuguuucauuuaugaucaugu

SEQ ID NO: 548217 - RNA, 64 nt, Homo Sapiens
aucaagucauauugcuauguuaauugguuuuuuuuuuuaaaagguaaguuagugauuacuguua

SEQ ID NO: 548218 - RNA, 64 nt, Homo Sapiens
gcccuucacagugaaaaaaagaaaaaucuuucauuuuuaaaauuaggagauguuacguaacuug

SEQ ID NO: 548219 - RNA, 64 nt, Homo Sapiens
cuaagaacauggcaaguauuuacuuuuaucuuuuuuuuaaaaacacucaugacagaaaacaguu

SEQ ID NO: 548220 - RNA, 64 nt, Homo Sapiens
auaugacuuuaaagagacuucaaaauauugaguauuuuaaaaauuuaaaaguaggucaguuuau

SEQ ID NO: 548221 - RNA, 64 nt, Homo Sapiens
aaacuucagaagaaagcugacauuuuaaugaauuuuuuaaaaaauuaauaaacaaauugucuaa

SEQ ID NO: 548222 - RNA, 64 nt, Homo Sapiens
gaauuuuuucauaauguaaugccguauuuauuguuuuuaaaaugaaaggaauacuaauaagucu

SEQ ID NO: 548223 - RNA, 64 nt, Homo Sapiens
uuuuaaagauuucuguauaagacuguugagcaguuuuuaaaauaguguaggauaauauaaaaag

SEQ ID NO: 548224 - RNA, 64 nt, Homo Sapiens
uaauuuuuuauauuuaaauguagacuuuugacacuuuuaaaaaacaaaaaaagacaagagagau

SEQ ID NO: 548225 - RNA, 64 nt, Homo Sapiens
uuuuuuuagaggcaggaucuugcuguccaauuuuuuuuaaaaagcuaaaauugccaacuuuaga

SEQ ID NO: 548226 - RNA, 64 nt, Homo Sapiens
uccaaccccagcaauuuauacaacgcugucauauuuuuaaaaaaacaaaaguaagccauccuca

SEQ ID NO: 548227 - RNA, 64 nt, Homo Sapiens
uguuuuuuaaauaaaguagccauauguaacgggauuuuaaaaauauauacauuuuacaacaugg

SEQ ID NO: 548228 - RNA, 64 nt, Homo Sapiens
gaaugagugugguaagaaauuuauaaaguuuugcuuuuaaaacguggacauaacucauuuuucu

SEQ ID NO: 548229 - RNA, 64 nt, Homo Sapiens
uggggagaucacugccauuuuuacacacuugacuuuuuaaaaauacaaccaaccaaccaccaca

SEQ ID NO: 548230 - RNA, 64 nt, Homo Sapiens
cucugaauauuuuagucucucucugagucucauuuuuuaaaaugcucuuuuagaacgggaaacg

SEQ ID NO: 548231 - RNA, 64 nt, Homo Sapiens
acacccuuguacauauaucuuuagagagaagauauuuuaaaaagaaauaccuuuuuaaaaauua

SEQ ID NO: 548232 - RNA, 64 nt, Homo Sapiens
cuuuagagagaagauauuuuaaaaagaaauaccuuuuuaaaaauuauuuuauuauuuuuuaaua

SEQ ID NO: 548233 - RNA, 64 nt, Homo Sapiens
cuuauuucuuaacugugcugggauugcaaacacuuuuuaaaaaauuguuugcuugaaaauacua

SEQ ID NO: 548234 - RNA, 64 nt, Homo Sapiens
guaacaucuaaaacacaaguggguuuauuuaaauuuuuaaaauuugaaauuuuuuauuugcaaa

SEQ ID NO: 548235 - RNA, 55 nt, Homo Sapiens
aggagaaacacaggaaaugaaaaauuuuuaaaaaaagaaggaaaaauguuuuaaa

SEQ ID NO: 548236 - RNA, 64 nt, Homo Sapiens
aauuauauuagguagaauacacauacaaucaaaauuuuaaaaaaaaaagcuaaauaacuuaaaa

SEQ ID NO: 548237 - RNA, 64 nt, Homo Sapiens
uugcaccagggaaucgccauauuugaccagcauguuuuaaaagcucuugguaggauuaguuggu

SEQ ID NO: 548238 - RNA, 64 nt, Homo Sapiens
gugggcagagaucuuuaguucaaauccacguauuuuuuaaaagagagaaccggagguagagcaa

SEQ ID NO: 548239 - RNA, 64 nt, Homo Sapiens
uuuuuaacuacucagacuuuugaggaauuaauccuuuuaaaacauuuuuguuaaaguuagugua

SEQ ID NO: 548240 - RNA, 64 nt, Homo Sapiens
aaggaaaugugcugcuaaaaaucaacuuaugccauuuuaaaauuagauaaaauauggagugcca

SEQ ID NO: 548241 - RNA, 64 nt, Homo Sapiens
uacauaauuuguuuuuguuauaagccauuugaauuuuuaaaaaauuucauacaugcaauggaau

SEQ ID NO: 548242 - RNA, 64 nt, Homo Sapiens
aauuuuaaugccaacaaaauugguuguaaucaaauuuuaaaauaauaauaauuuggcccccccu

SEQ ID NO: 548243 - RNA, 64 nt, Homo Sapiens
ucaaauuuuaaaauaauaauaauuuggcccccccuuuuaaaauagucuugacucuuugugugug

SEQ ID NO: 548244 - RNA, 64 nt, Homo Sapiens
cuccccagaggaacuuagggauuucaccccuggcuuuuaaaaaaaacgaaauaccgacaagcca

SEQ ID NO: 548245 - RNA, 64 nt, Homo Sapiens
auggauuggaacacaaaaaaucuuuuuuuaaucuuuuuaaaaacugcugugguuuugcugcuac

SEQ ID NO: 548246 - RNA, 64 nt, Homo Sapiens
agcuugggggacacaccuggcgagcaagcucgcuuuuuaaaaaugaaauuugggggcaggggaa

SEQ ID NO: 548247 - RNA, 64 nt, Homo Sapiens
gcccuuacggagugucuguuuuuagaaauuuagauuuuaaaaggcgugggacauacgaccaggc

SEQ ID NO: 548248 - RNA, 64 nt, Homo Sapiens
cuguuucuaaaguaaguguguauaaaagucuccuuuuuaaaaagaucauauuuuuaaauaaagc

SEQ ID NO: 548249 - RNA, 64 nt, Homo Sapiens
uaucccaaaucuuuucugaagaugaagaguuuaguuuuaaaacugcacugccaacaaguucacu

SEQ ID NO: 548250 - RNA, 64 nt, Homo Sapiens
uccagugacagaaaaauauauuaucucaaguauuuuuuaaaaauauaugaauucucucuccaaa

SEQ ID NO: 548251 - RNA, 64 nt, Homo Sapiens
aaauacauccuuuaaauauauaucuaagcauauauuuuaaaaggagcaaaaauaaaaccaaagu

SEQ ID NO: 548252 - RNA, 64 nt, Homo Sapiens
uuagauauuuuagaaaaauaauagaauucugaaguuuuaaaaaugucaguaauuaauuuauuuu

SEQ ID NO: 548253 - RNA, 64 nt, Homo Sapiens
gaacuuucauguaugauccagaaaauagguacgguuuuaaaauauuuuauauagaaaagcuaca

SEQ ID NO: 548254 - RNA, 64 nt, Homo Sapiens
caauuaaucuacaaagggaauuaauauuguugacuuuuaaaacaucugcuggauauauuauaug

SEQ ID NO: 548255 - RNA, 64 nt, Homo Sapiens
gaagucuucuuggauuucacccaacuaaaaggauuuuuaaaaauaaauaacagucuuaccuaaa

SEQ ID NO: 548256 - RNA, 64 nt, Homo Sapiens
uuguagccaguuguuaauaucuuaaugcagauuuuuuuaaaaaaaacauaaaaugauuuaucug

SEQ ID NO: 548257 - RNA, 64 nt, Homo Sapiens
ucacuuuucucgaucacuaaacauaugcauauauuuuuaaaaaucaguaaaagcauuacucuaa

SEQ ID NO: 548258 - RNA, 64 nt, Homo Sapiens
aauaucauauuuacucugauucuacucacuuguuuuuuaaaaauaaguguccuauuauuguauu

SEQ ID NO: 548259 - RNA, 64 nt, Homo Sapiens
aaucaugaagucugaaguuugcuuucaguaauuauuuuaaaaguuguuuugguucauugcuuua

SEQ ID NO: 548260 - RNA, 64 nt, Homo Sapiens
ccuucaagaaaaacuacagugggauucauuuacuuuuuaaaauacacuggguaaaucaccuaua

SEQ ID NO: 548261 - RNA, 64 nt, Homo Sapiens
accuaauuacauaguuuuaaucauuuguacauaauuuuaaaaacuuacuuuguauugauuuuga

SEQ ID NO: 548262 - RNA, 64 nt, Homo Sapiens
caccaagaaugaacugcauuuccuuuaaaaauuauuuuaaaacaccuuuauugaaaagaucuca

SEQ ID NO: 548263 - RNA, 64 nt, Homo Sapiens
caucccuaauaucacagggcuugugcauucagauuuuuaaaaaauuaggauagauaaggaaaca

SEQ ID NO: 548264 - RNA, 64 nt, Homo Sapiens
aggugauguauuuuuuucaugcauuaguaugcauuuuuaaaaaauaaugcauguuucuuuaaua

SEQ ID NO: 548265 - RNA, 64 nt, Homo Sapiens
gagguuguuuuuacuuuauuguguuguuuaaauauuuuaaaaauaucuuuagcguuuggucuuu

SEQ ID NO: 548266 - RNA, 64 nt, Homo Sapiens
ugcaauugcuucagcccaagaaagcuguguauuguuuuaaaaauuguaaaaauuauugugauga

SEQ ID NO: 548267 - RNA, 64 nt, Homo Sapiens
aacacuuuacaaagaacaugcccggguuuuuacauuuuaaaaguuauucuagacaaucacuauu

SEQ ID NO: 548268 - RNA, 64 nt, Homo Sapiens
uucuagacaaucacuauuggcuuuuuucuuuuauuuuuaaaaaacucacauagaggagacaauc

SEQ ID NO: 548269 - RNA, 64 nt, Homo Sapiens
uucucacucuuugcaggcacucuucaaauuuuuauuuuaaaaauuauaaugcaaacaucuggcc

SEQ ID NO: 548270 - RNA, 64 nt, Homo Sapiens
guggguucuuuuuaauguuuauacuuagauuuucuuuuaaaaaaauuaaaauaaaacaaaaaaa

SEQ ID NO: 548271 - RNA, 64 nt, Homo Sapiens
cuauucuuuuuuuugcauccaauugugccugaacuuuuaaaauauguaaaugcugccauguucc

SEQ ID NO: 548272 - RNA, 64 nt, Homo Sapiens
aaaucccauggauucugauuucugggucuuaggauuuuaaaagugaagggauauuuuucuuaua

SEQ ID NO: 548273 - RNA, 64 nt, Homo Sapiens
aucuuuucagaugcagucuauauuuuaugcugaguuuuaaaaaugaaauacuuuaugcaaacag

SEQ ID NO: 548274 - RNA, 64 nt, Homo Sapiens
auacugauuuuuucaaucaauguauaucaugaguuuuuaaaauaaugcuacaaucuucauaacu

SEQ ID NO: 548275 - RNA, 64 nt, Homo Sapiens
gaggcuugugucuguugcacauuucuugaagcauuuuuaaaauaacauguaaccuguaaccuug

SEQ ID NO: 548276 - RNA, 64 nt, Homo Sapiens
gcaugcuauuuaugucacaucucacauuaaauuauuuuaaaauaagcagugcccuucaaaacag

SEQ ID NO: 548277 - RNA, 64 nt, Homo Sapiens
auagaugcauauauacaugacauauugugguuaauuuuaaaacuacugugccuuaacguguuuc

SEQ ID NO: 548278 - RNA, 64 nt, Homo Sapiens
uuauuuucauuaauaacuuuugcuaaaauuuaccuuuuaaaaguucugaaauuugggguuggua

SEQ ID NO: 548279 - RNA, 64 nt, Homo Sapiens
ggaggaugcauuuagagggaagauugauuggagauuuuaaaacugacuacagcugugacacuua

SEQ ID NO: 548280 - RNA, 64 nt, Homo Sapiens
auuuuuugaucuuagucacugagauuuuuuacuuuuuuaaaaaaagauguuucccugccaucuu

SEQ ID NO: 548281 - RNA, 64 nt, Homo Sapiens
ugcuguuuaugacacaaugauuauuaaaucugaauuuuaaaacaauuuacugucuuaaaucagu

SEQ ID NO: 548282 - RNA, 64 nt, Homo Sapiens
caauugguuguauauaaaguuguuauuuuuguauuuuuaaaaaaagcaugacaaaagugacaga

SEQ ID NO: 548283 - RNA, 64 nt, Homo Sapiens
cauauagaaauauuaaauaauuuuauugcauguguuuuaaaaguacuaaaggauaauuacuuac

SEQ ID NO: 548284 - RNA, 55 nt, Homo Sapiens
agaguauauggaucgcaagaaacauuuuuaaaaagacuaugcugccguggcuuag

SEQ ID NO: 548285 - RNA, 64 nt, Homo Sapiens
ccaugcccacaauaccauuagacuaauaaagacauuuuaaaaaaauguauuuaguauaaucugu

SEQ ID NO: 548286 - RNA, 64 nt, Homo Sapiens
cuaaagcugaauuccuuuuccuaaggauauguguuuuuaaaaauuagcaccuaaauugcaagau

SEQ ID NO: 548287 - RNA, 64 nt, Homo Sapiens
aaaaaaucauuuagaugcacauuaaagacauuguuuuuaaaaaagccaagucagcauaugagga

SEQ ID NO: 548288 - RNA, 64 nt, Homo Sapiens
cccagucucaccuacgaaauuuaugaaauauuucuuuuaaaagccauuuaugcuuuugucuuuu

SEQ ID NO: 548289 - RNA, 64 nt, Homo Sapiens
aaaaucuguaggguugacaaguacuaagcuuaauuuuuaaaaacaaaaaaauuuugacuuuuua

SEQ ID NO: 548290 - RNA, 64 nt, Homo Sapiens
uuuugauaacucuuaaagcaauuaaugcauuauuuuuuaaaaaggaaaaauguggaggcuccau

SEQ ID NO: 548291 - RNA, 64 nt, Homo Sapiens
aacuugaguuuuccuaaguucaauuugauagguguuuuaaaaauggaagagaagcaucaugagc

SEQ ID NO: 548292 - RNA, 64 nt, Homo Sapiens
caaagugauuuugaaaaucucacauuugaugaguuuuuaaaaauuggucuuccccgccaugauu

SEQ ID NO: 548293 - RNA, 64 nt, Homo Sapiens
aaauuaacauguuuuuguugcuuugaaucaucauuuuuaaaaaauuacuucccuucaaaucugc

SEQ ID NO: 548294 - RNA, 64 nt, Homo Sapiens
cacaucugacauuuuuaacagauuuuuaaauguuuuuuaaaagagagagaaaguauuugaaaau

SEQ ID NO: 548295 - RNA, 64 nt, Homo Sapiens
aaaaucugaggaguguacaaaaaaugaaaacuccuuuuaaaaauaauccugaguuuccauaagg

SEQ ID NO: 548296 - RNA, 64 nt, Homo Sapiens
ucuggauguuuuuuauuuaguguuucagcugugcuuuuaaaaaaucuuuguauauuuguacaaa

SEQ ID NO: 548297 - RNA, 64 nt, Homo Sapiens
uuuuucugacacccuuuaauucuaaguaaauacauuuuaaaaaauguuccccagaugaaagaac

SEQ ID NO: 548298 - RNA, 64 nt, Homo Sapiens
uaauugauuuuccuuuggggcuuuguaaugaacuuuuuaaaaauuuagcauuuuauacagucaa

SEQ ID NO: 548299 - RNA, 64 nt, Homo Sapiens
uugauuugaaugcaguaggcuuuuuaaaguuuuuuuuuaaaauacuaagacaugucaauauucu

SEQ ID NO: 548300 - RNA, 64 nt, Homo Sapiens
ugcugaucucuguagaaucugguuguaauuaaauuuuuaaaaucucuagucagaguauaauuuu

SEQ ID NO: 548301 - RNA, 64 nt, Homo Sapiens
uagccuugauauucuccagaauuuuaaacauuuuuuuuaaaaauguuuuauuuaugaaguuuuu

SEQ ID NO: 548302 - RNA, 64 nt, Homo Sapiens
gaaaaacaagauuuggagucccaagagaauagcguuuuaaaaaauuauucugaacaguuuaguc

SEQ ID NO: 548303 - RNA, 64 nt, Homo Sapiens
caggcuaaucaugugguccaccauucuuguugcuuuuuaaaaauuugguguaauaguuguguca

SEQ ID NO: 548304 - RNA, 64 nt, Homo Sapiens
uuuacugauagauaauggauguuauacaucugaauuuuaaaaugauucugcggauguuauuucu

SEQ ID NO: 548305 - RNA, 64 nt, Homo Sapiens
uccaggcaauggcauuaaacguagcaaauuuuccuuuuaaaaaauuagaaguuguguuacaacu

SEQ ID NO: 548306 - RNA, 64 nt, Homo Sapiens
agaaaguuaucguagccagccacauuugaauuuuuuuuaaaaaaacuguggcuugauguugaua

SEQ ID NO: 548307 - RNA, 64 nt, Homo Sapiens
uagccugucucuuuucccugggccucaaguggaauuuuaaaacccuggggaccagaauccaaac

SEQ ID NO: 548308 - RNA, 64 nt, Homo Sapiens
agaacacuuucugcucauaugaccucuccucuucuuuuaaaaaacuauuguugccuuuccaagu

SEQ ID NO: 548309 - RNA, 64 nt, Homo Sapiens
ugccucuggguuuuuguuuuuuaaacaguuccacuuuuaaaaccaaaaaaaaaggcuuuucuuu

SEQ ID NO: 548310 - RNA, 64 nt, Homo Sapiens
aauuuuuuuguaaagaucagagagcucugauauuuuuuaaaaagcaagaaaaugcaaguugcca

SEQ ID NO: 548311 - RNA, 64 nt, Homo Sapiens
auuuguguuuauucuucauauucagacuauuccuuuuuaaaaucauuuuccuuaaauaugugau

SEQ ID NO: 548312 - RNA, 64 nt, Homo Sapiens
uacauaaagaauuuaagaaauugucuuauagacuuuuuaaaaugugagcucucuaaccuccuuu

SEQ ID NO: 548313 - RNA, 64 nt, Homo Sapiens
acacugcuaaaaguaggugaugggaacaaaccuguuuuaaaagcgagauuauuuucuguaaugc

SEQ ID NO: 548314 - RNA, 64 nt, Homo Sapiens
gugccagaugccccagugccggcagagacaucucuuuuaaaaaauuccagauuguucaucuaga

SEQ ID NO: 548315 - RNA, 64 nt, Homo Sapiens
uaauuugacugauccaugcugaauuaaagagggcuuuuaaaagauaacuuucuuuaucuccuug

SEQ ID NO: 548316 - RNA, 64 nt, Homo Sapiens
gcuuuggcuuaugcugaauugauaguauugguuauuuuaaaaaguuguaaagauuucauaaaau

SEQ ID NO: 548317 - RNA, 64 nt, Homo Sapiens
ucagauguaauuuaacaucaauuuuuaaauacauuuuuaaaauuaaauuguaagcuuuauuugg

SEQ ID NO: 548318 - RNA, 64 nt, Homo Sapiens
aguaagccacauuacauuuaaccucccugacaauuuuuaaaaguuuugaaaccacugauugcaa

SEQ ID NO: 548319 - RNA, 64 nt, Homo Sapiens
ucaucaguguugcucuuugauaauaaaugguucauuuuaaaaguuuaagaauaacagucugauu

SEQ ID NO: 548320 - RNA, 64 nt, Homo Sapiens
agaaacacugccuugauuauuccauuuccugauguuuuaaaagaugucuacuaaugagccuuau

SEQ ID NO: 548321 - RNA, 64 nt, Homo Sapiens
cguguuguaccuaaggccaucauuguuuuaggguuuuuaaaaaagucacaaauauaacaaaguu

SEQ ID NO: 548322 - RNA, 64 nt, Homo Sapiens
agaaauuagcagcccucugcuuaccccuuccauuuuuuaaaauaucugauagucuccugcuguu

SEQ ID NO: 548323 - RNA, 64 nt, Homo Sapiens
uauucuuucugaacuuaucucaaauuacaugcauuuuuaaaaacauagcugauuauuguauaug

SEQ ID NO: 548324 - RNA, 64 nt, Homo Sapiens
aagagcaguguucuccauucgaaaauuaaucugcuuuuaaaauagguuacucaaguagaagccu

SEQ ID NO: 548325 - RNA, 64 nt, Homo Sapiens
uaauaauggaaaccauauuauggaaaucauuuuguuuuaaaagucagugcauuguuuuuuaaac

SEQ ID NO: 548326 - RNA, 64 nt, Homo Sapiens
ugcugucuugcuuuagcuaugaaacauuauuuuuuuuuaaaaaaaguaccacguguagcauuuu

SEQ ID NO: 548327 - RNA, 64 nt, Homo Sapiens
guuugcuacuuguuaagggacuuggcuucacacauuuuaaaaauuguucuucugaaaacagacc

SEQ ID NO: 548328 - RNA, 64 nt, Homo Sapiens
uauguuugaugcuauuuuguuuagaaaaaaauuauuuuaaaaaaaauaaagugacccagggaau

SEQ ID NO: 548329 - RNA, 64 nt, Homo Sapiens
uacaauuucuucuuuaaaaagugucuaaugaagcuuuuaaaaucguuauuuguaugugucacua

SEQ ID NO: 548330 - RNA, 64 nt, Homo Sapiens
uauaaacaagucacuuaaauaagaacaugguuuauuuuaaaauuuugccuggcaggauacugca

SEQ ID NO: 548331 - RNA, 64 nt, Homo Sapiens
auauuagaccuuaagcuguuaauuuguuugacuauuuuaaaauuugaaaugaagaguaaaaaca

SEQ ID NO: 548332 - RNA, 64 nt, Homo Sapiens
aaguuaauugcuuuugcaggucuccaauuucuuuuuuuaaaaauaucaugcuuaaaugguugau

SEQ ID NO: 548333 - RNA, 64 nt, Homo Sapiens
acuugaaauuuuauuauaaaaggcuucauauucuuuuuaaaauguugcauuguaggagcaaaca

SEQ ID NO: 548334 - RNA, 64 nt, Homo Sapiens
uauaaaagggacuacuguucaaaaaauuccuuccuuuuaaaaaacuugacuuuuauauuucuuu

SEQ ID NO: 548335 - RNA, 64 nt, Homo Sapiens
uugggcugucaugugggaauacuuaagauaaccauuuuaaaaaaaauaaaauaaaacuggccug

SEQ ID NO: 548336 - RNA, 64 nt, Homo Sapiens
uauacuuucucuuuguccugacuaugaaaucaguuuuuaaaagaucaaaauauguagaaacauu

SEQ ID NO: 548337 - RNA, 64 nt, Homo Sapiens
uuacgcgcaaaacuccguggaccguaggaaggguuuuuaaaauuugcuccuggccuuaaacauc

SEQ ID NO: 548338 - RNA, 64 nt, Homo Sapiens
acaucuuaacuccacgcuuuaaagccuguauauuuuuuaaaaacuuucagauccaagcauauaa

SEQ ID NO: 548339 - RNA, 64 nt, Homo Sapiens
auuguuuuucaaaugucaccguucauuaauaguauuuuaaaaaaauagagaaacacagcauacu

SEQ ID NO: 548340 - RNA, 64 nt, Homo Sapiens
uuuaacguuuuuguuacauguuguaacuaucaacuuuuaaaacuaaaauuguuacguaccauau

SEQ ID NO: 548341 - RNA, 64 nt, Homo Sapiens
ugaaaaaacauuauuuuuucagcagacuaaaauguuuuaaaaugcuugcaacuccuuuugcaaa

SEQ ID NO: 548342 - RNA, 64 nt, Homo Sapiens
uuauugcaaagagcucuauuguuuaagccuguuuuuuuaaaauaguagaaugaauaggagaaga

SEQ ID NO: 548343 - RNA, 64 nt, Homo Sapiens
ugcuaaacuggaagauuaaagaguacagacuaauuuuuaaaauaauuuuuuuaacuaugcauuu

SEQ ID NO: 548344 - RNA, 64 nt, Homo Sapiens
aauugcugccacuuuuuuuucuuguacaaauugguuuuaaaaaagaaacaaaguaaacuauaaa

SEQ ID NO: 548345 - RNA, 64 nt, Homo Sapiens
auaguaccguaaagcauuaaagugcugauugugauuuuaaaauggcuggauugacuauaacuua

SEQ ID NO: 548346 - RNA, 64 nt, Homo Sapiens
guacagauguuugugccuuuauugggucugguacuuuuaaaauuacaaaauuugaaauuaaccu

SEQ ID NO: 548347 - RNA, 64 nt, Homo Sapiens
cauuguuuuuaaauuuagacuuuauaguuaugcuuuuuaaaauugcacaagcauuaacuuuugu

SEQ ID NO: 548348 - RNA, 64 nt, Homo Sapiens
aaauauaccucauuuagguucuaguuaucuaauguuuuaaaagacuccugguauuauauauuug

SEQ ID NO: 548349 - RNA, 64 nt, Homo Sapiens
aauccacaaagauguuuuuaaaugcaguuuaucguuuuaaaaauguaaaaucauaaaguuuggu

SEQ ID NO: 548350 - RNA, 64 nt, Homo Sapiens
gaacaaagcugccauaaaucgaugcugcuuccaauuuuaaaagguuuuccauauugguauuuuu

SEQ ID NO: 548351 - RNA, 64 nt, Homo Sapiens
caagaguuuuugaaauuuuuuauaugcuaaauaauuuuaaaauaaaaccugguaucuauuugua

SEQ ID NO: 548352 - RNA, 64 nt, Homo Sapiens
uuaauuuauuccagccguuuauuaugggaaauccuuuuaaaaugacaauauuuuauuuuccuaa

SEQ ID NO: 548353 - RNA, 64 nt, Homo Sapiens
caaauuugaauguacuauucuucugacaaauuuguuuuaaaaauacaaaaugcuguauuugagu

SEQ ID NO: 548354 - RNA, 63 nt, Homo Sapiens
cucucauuuuuacaaagacuaugucacuuaucuuuuuaaaaaaaaaccgucuuacuagacuga

SEQ ID NO: 548355 - RNA, 64 nt, Homo Sapiens
acauugauuauuaucuagguacaggugaagaaauuuuuaaaaauuagauaggccuuucaguaac

SEQ ID NO: 548356 - RNA, 64 nt, Homo Sapiens
gagagaauuagcauugugucaaaaaaaauaucuuuuuuaaaaaaugugaacuuaaaacugcucu

SEQ ID NO: 548357 - RNA, 64 nt, Homo Sapiens
cuuccucaacgaaggggaacguucccuuuuucccuuuuaaaaugcauccauaaauaacuauuca

SEQ ID NO: 548358 - RNA, 64 nt, Homo Sapiens
aacacuauguguucaguuuuaaacauuguucuuauuuuaaaauuuagcaaaguuggcucuacau

SEQ ID NO: 548359 - RNA, 64 nt, Homo Sapiens
uacgaaaguaauacucugcaauacaauguaaguguuuuaaaaaauuugguugaccaguauuacu

SEQ ID NO: 548360 - RNA, 64 nt, Homo Sapiens
guuuuuguuguugucuuggccaaaagaugucaguuuuuaaaauucagaacuucaaguagcaguu

SEQ ID NO: 548361 - RNA, 64 nt, Homo Sapiens
auuucugugguuucuauucagcuuggguuucauguuuuaaaauaaauuuuaaaaagcaagccuc

SEQ ID NO: 548362 - RNA, 64 nt, Homo Sapiens
ucuauucagcuuggguuucauguuuuaaaauaaauuuuaaaaagcaagccucucuuccugagcu

SEQ ID NO: 548363 - RNA, 64 nt, Homo Sapiens
uaucugcucauguaugugauuugacaaaccaguuuuuuaaaauaaauggcuuuuuaaaaaucug

SEQ ID NO: 548364 - RNA, 64 nt, Homo Sapiens
gauuugacaaaccaguuuuuuaaaauaaauggcuuuuuaaaaaucugggcuuauauugucagag

SEQ ID NO: 548365 - RNA, 64 nt, Homo Sapiens
uuaaaaauguuacugcuaaagauacauuauccuuuuuuaaaaagucuccauucaaauuaaauua

SEQ ID NO: 548366 - RNA, 64 nt, Homo Sapiens
uuuuuucaaucucauaaaaaagggauagugcaucuuuuaaaauacauuuuauuuggggaggaac

SEQ ID NO: 548367 - RNA, 64 nt, Homo Sapiens
uuaaauaaucuuagaauuaauugauaaaugucucuuuuaaaaucuacuguauuuauuauaauuu

SEQ ID NO: 548368 - RNA, 63 nt, Homo Sapiens
guuauaagucucuuccuuucucaaauaaaguuuuuuuuaaaagauccccuuucauacacuugg

SEQ ID NO: 548369 - RNA, 64 nt, Homo Sapiens
uggaauuguuaauaauugcuccuaaagauuauaauuuuaaaagucacaggaggagacaaauugc

SEQ ID NO: 548370 - RNA, 64 nt, Homo Sapiens
cuaauaauacaaugucacuuuaucagaauacuaguuuuaaaagcugaauguuaauaggggacac

SEQ ID NO: 548371 - RNA, 64 nt, Homo Sapiens
caagaucuugcccuccaaugaaaugacuuacauguuuuaaaaaaccgaguugguuuuauugaau

SEQ ID NO: 548372 - RNA, 64 nt, Homo Sapiens
ugucgacuugcuaauuucagaaauaauuauucauuuuuaaaaagccccuuuuaaagcaucuacu

SEQ ID NO: 548373 - RNA, 64 nt, Homo Sapiens
auaaccaugccuggcuaauuuauuuuuacuuuuauuuuaaaauaaaagaugaggucugucuuau

SEQ ID NO: 548374 - RNA, 64 nt, Homo Sapiens
uguguguguguguguguguguguguguucauggguuuuaaaagaacaguauuuuacaaaaggug

SEQ ID NO: 548375 - RNA, 64 nt, Homo Sapiens
cuuuacugcaugcauagcacuuaauaaaauggauuuuuaaaaaauccacuaguaauaucagaau

SEQ ID NO: 548376 - RNA, 64 nt, Homo Sapiens
aaaucuaauuauucaguuauucaugacaauauuuuuuuaaaaguaagaaauucugaguugucuu

SEQ ID NO: 548377 - RNA, 64 nt, Homo Sapiens
auuauuaagucaccuaucaccuuuaaacgccuuuuuuuaaaauuauaaaauauuguaaagcagg

SEQ ID NO: 548378 - RNA, 64 nt, Homo Sapiens
aaaaucaccaauuuuuuacauauaaaagauaccuuuuuaaaaaaauagguuuuaagagcucuuu

SEQ ID NO: 548379 - RNA, 64 nt, Homo Sapiens
acaggcgugagccaccguguccggccguaguuuauuuuaaaauauauuuuuaaaagcuuuguaa

SEQ ID NO: 548380 - RNA, 64 nt, Homo Sapiens
accguguccggccguaguuuauuuuaaaauauauuuuuaaaagcuuuguaaaaauuaugucauu

SEQ ID NO: 548381 - RNA, 64 nt, Homo Sapiens
ucugaauccucaauagaaaaucacauuaaucuuauuuuaaaauuuggccuuuuucaacacuaac

SEQ ID NO: 548382 - RNA, 64 nt, Homo Sapiens
guggaauaaaggaggagauuuuauuuacagauuuuuuuaaaagccaccuggguugacaccuucc

SEQ ID NO: 548383 - RNA, 64 nt, Homo Sapiens
uauucacaauuguguucucuaaaaugugucuaaauuuuaaaaauauguacaugcauaaugucau

SEQ ID NO: 548384 - RNA, 64 nt, Homo Sapiens
cuaaauuuuaaaaauauguacaugcauaaugucauuuuaaaaucugaaggaaagaauuugaagu

SEQ ID NO: 548385 - RNA, 64 nt, Homo Sapiens
cuguugaaauuuggaaguucugaaauuauaguauuuuuaaaaauugcacugaaguguauacaca

SEQ ID NO: 548386 - RNA, 64 nt, Homo Sapiens
aaauuauccaacuacccuauuguuaagcauuugguuuuaaaauuuuuaugcuaauauaaaugcu

SEQ ID NO: 548387 - RNA, 64 nt, Homo Sapiens
auaaucagauauaaauauauacuuaauuuuuuaauuuuaaaaauagauaccuguuugacuuuga

SEQ ID NO: 548388 - RNA, 64 nt, Homo Sapiens
agccuggcugcaaagaagaaucaacagggacacuuuuuaaaaacacucuuaucagccugggcaa

SEQ ID NO: 548389 - RNA, 64 nt, Homo Sapiens
cuauuggugaaaugguauaaaauaucauaugcaguuuuaaaacuuuuuauauuuuugcaauaaa

SEQ ID NO: 548390 - RNA, 64 nt, Homo Sapiens
ugaucuugacauuuaaugucacaaaguuuuguuuuuuuaaaaagugauuuaaacuuaagauccg

SEQ ID NO: 548391 - RNA, 64 nt, Homo Sapiens
caugaagaugacuuguuuuauauuucagauuuuauuuuaaaagccaugucuguuaaacaagaaa

SEQ ID NO: 548392 - RNA, 64 nt, Homo Sapiens
uaguaagaaaguaugguucuguauggcaauagguuuuuaaaauuauuagcuauucaucaugugu

SEQ ID NO: 548393 - RNA, 64 nt, Homo Sapiens
aaauuuuaguauaaaaacaauuccugggagcguuuuuuaaaaaucaguuguagacaccacccuc

SEQ ID NO: 548394 - RNA, 64 nt, Homo Sapiens
gagugggaauuuuuuccuaaucauguuuuuaacauuuuaaaauaaaauuuaauacuaagaaauu

SEQ ID NO: 548395 - RNA, 64 nt, Homo Sapiens
uaaauaaauaaauaaauaaacaaaccagucuuuauuuuaaaagaaacuuuaggaaacaaaccca

SEQ ID NO: 548396 - RNA, 64 nt, Homo Sapiens
guuacaggcgguguccuuuuaaauguggaaaggcuuuuaaaauauuuuaaaacuggaccuguau

SEQ ID NO: 548397 - RNA, 64 nt, Homo Sapiens
guguccuuuuaaauguggaaaggcuuuuaaaauauuuuaaaacuggaccuguauuauccugaau

SEQ ID NO: 548398 - RNA, 64 nt, Homo Sapiens
accuguauuauccugaauacacuauuuugaaaauuuuuaaaaaugacuucuuuauuuugcuuua

SEQ ID NO: 548399 - RNA, 64 nt, Homo Sapiens
gaucauugacaugugauuucaaaacacaguguucuuuuaaaaaucuauaauaugucaaaauaca

SEQ ID NO: 548400 - RNA, 64 nt, Homo Sapiens
ugaguagaaaaucacuuaccagugagcauauauauuuuaaaauacuuucuuuggauauuguaau

SEQ ID NO: 548401 - RNA, 64 nt, Homo Sapiens
aauaaaauauuucauuagcuugaauuguauagauuuuuaaaaauucaaugaaagcauguuguuu

SEQ ID NO: 548402 - RNA, 64 nt, Homo Sapiens
uaaaaauucaaugaaagcauguuguuuaauuucuuuuuaaaaucacuguugggcuuugaaagca

SEQ ID NO: 548403 - RNA, 64 nt, Homo Sapiens
ucugccucagaaaacaaggaugaauuaaguuuuuuuuuaaaaaagaaacauuugguaaggggaa

SEQ ID NO: 548404 - RNA, 64 nt, Homo Sapiens
uaauaauguuucaaacauauauaacaaugcuguauuuuaaaagaaugauuaugaauuacauuug

SEQ ID NO: 548405 - RNA, 64 nt, Homo Sapiens
gucagugcuucuaaaaagaauuuaagauaaugguuuuuaaaaugccuuuauaauaagcuuuguu

SEQ ID NO: 548406 - RNA, 64 nt, Homo Sapiens
aaaauugcaauuguauuagguguuaaaauaaaguuuuuaaaaaauuacuuguauuuauacuuua

SEQ ID NO: 548407 - RNA, 64 nt, Homo Sapiens
caggacucaauaauggugggugaacauuagucauuuuuaaaagacaccucuuauagcaauaagg

SEQ ID NO: 548408 - RNA, 64 nt, Homo Sapiens
uaaauauuucaguauuauauagaaaaaaauagauuuuuaaaauucagaauggacaaagagaaua

SEQ ID NO: 548409 - RNA, 64 nt, Homo Sapiens
uguugcccugaguggaucuccaaggaccagguuauuuuaaaaagauuuguuuugucaaguguca

SEQ ID NO: 548410 - RNA, 64 nt, Homo Sapiens
auuccgucuuaaaaaaaaaaaaaaaaaaguuuguuuuuaaaaaaaucuaaauaaaauaacuuug

SEQ ID NO: 548411 - RNA, 64 nt, Homo Sapiens
cccaaauuuggggauggggcccaggaauaugcauuuuuaaaaagucaucugcccuucccaggug

SEQ ID NO: 548412 - RNA, 64 nt, Homo Sapiens
guauguauuugcuggugucguguaaauauugguauuuuaaaauaaaaacuguuacaucacuauu

SEQ ID NO: 548413 - RNA, 64 nt, Homo Sapiens
augguguaauaggaauaauauuuauccaaaagauuuuuaaaaauagggcuguguuuaaaaaaaa

SEQ ID NO: 548414 - RNA, 64 nt, Homo Sapiens
uccuggaguuaauuuguuuuacaggaauuuuguuuuuuaaaaaaauaggaucauucugaacuuu

SEQ ID NO: 548415 - RNA, 64 nt, Homo Sapiens
cauuucuuaucaucacuuuuugucuuuucuuguuuuuuaaaauauacauuuuauuuuugaaggu

SEQ ID NO: 548416 - RNA, 64 nt, Homo Sapiens
aauaguuuuacguuguacauaauaguguaaaccuuuuuaaaaaggaaaguauaaaaacaaaagu

SEQ ID NO: 548417 - RNA, 64 nt, Homo Sapiens
guaacaaucagaggaacuauauggacuuucucuauuuuaaaaugcugaaaggaaaggcaucacu

SEQ ID NO: 548418 - RNA, 64 nt, Homo Sapiens
gaaagcgagacaggcccgugggcguggggcgcacuuuuaaaagaauccaaauucaaagaaacag

SEQ ID NO: 548419 - RNA, 64 nt, Homo Sapiens
ugaguauacaaucauguuugguguucccuucacauuuuaaaauuacccaggaaaugcuuaguaa

SEQ ID NO: 548420 - RNA, 64 nt, Homo Sapiens
ucaggacauuaacuaauuuuauuuuauuuugcuuuuuuaaaaacgcuucaccuuauuacaugcu

SEQ ID NO: 548421 - RNA, 64 nt, Homo Sapiens
ucgaucuacauacaauagauaaacacgauucaguuuuuaaaagaaauuuucuuuaguguauuuu

SEQ ID NO: 548422 - RNA, 64 nt, Homo Sapiens
auacacauaggugcugcauucccaauauuugauuuuuuaaaaaucucaguauuugauuuuuuuc

SEQ ID NO: 548423 - RNA, 64 nt, Homo Sapiens
uaaauuuaaaauuuaacagcgaaguccaaccguuuuuuaaaaaauuauauacuuuauaaugaua

SEQ ID NO: 548424 - RNA, 64 nt, Homo Sapiens
uagucaguacuagcaucuaugaacuauaugcagauuuuaaaaucacgaauuaaaauaugauaga

SEQ ID NO: 548425 - RNA, 64 nt, Homo Sapiens
acucauuaaauauuggauucgcacgugacuggcauuuuaaaacauguguagccuucuggaaucu

SEQ ID NO: 548426 - RNA, 64 nt, Homo Sapiens
gacauuucuaucagggauauccaauuauguaauuuuuuaaaaaggcgugagccaccacgccugg

SEQ ID NO: 548427 - RNA, 64 nt, Homo Sapiens
augugugaucacaagacuaagagauauacacaaauuuuaaaauuuuaaaaggauuaaaguaacg

SEQ ID NO: 548428 - RNA, 64 nt, Homo Sapiens
guagcaaguuaaacuucacuauaaggucacaugcuuuuaaaauacucucacaucuuacagaucu

SEQ ID NO: 548429 - RNA, 64 nt, Homo Sapiens
ugaauauaggugggagacauaccggccuuuguucuuuuaaaacuuuauuucuguucagaucucc

SEQ ID NO: 548430 - RNA, 64 nt, Homo Sapiens
uccauuauuuguguaaaacucugagcugguaauauuuuaaaaucuaaagauucuaaacauguau

SEQ ID NO: 548431 - RNA, 64 nt, Homo Sapiens
ugcaauguagaggggaaaagggaaccaaagcgaauuuuaaaagauauauauauauuucccugaa

SEQ ID NO: 548432 - RNA, 64 nt, Homo Sapiens
uaaauauuauauuauauauagugagguggaauuauuuuaaaagagaccuuccaagagccugaga

SEQ ID NO: 548433 - RNA, 64 nt, Homo Sapiens
uggagaauaucacuaagcuguuuaaaaauugaaauuuuaaaauagaauuauauauuauguaucu

SEQ ID NO: 548434 - RNA, 64 nt, Homo Sapiens
ugaaauuuuaaaauauggagauauauuauguaucuuuuaaaaauguuuauaauuauuaggaauu

SEQ ID NO: 548435 - RNA, 64 nt, Homo Sapiens
caauuuuauuggccuuuugcauuggaggcauuuauuuuaaaaaaaaauuucauaauuguggaca

SEQ ID NO: 548436 - RNA, 64 nt, Homo Sapiens
ugaucgaaaauauaaugcuucaauguuagugauguuuuaaaaugccuuuugauaucuguuguug

SEQ ID NO: 548437 - RNA, 64 nt, Homo Sapiens
auagauuaugaugcagaauaauaaaauuaggcuuuuuuaaaaaaggcgggaaauaauuguguac

SEQ ID NO: 548438 - RNA, 64 nt, Homo Sapiens
uuuaagaacuugauccauugagcaucauuuauucuuuuaaaauuauccucagguccagaauucc

SEQ ID NO: 548439 - RNA, 64 nt, Homo Sapiens
augguuuugcauggaaccugaauuggauccauuuuuuuaaaaaacaucuaagaauacagaacca

SEQ ID NO: 548440 - RNA, 64 nt, Homo Sapiens
guagaaauucuucaugaacauacacuuucauuacuuuuaaaaauuucacaauuauuaaauugug

SEQ ID NO: 548441 - RNA, 64 nt, Homo Sapiens
ucuguuguuccaaauguguacaccaaacuucauuuuuuaaaaaauaguuaaaaugcugacauaa

SEQ ID NO: 548442 - RNA, 64 nt, Homo Sapiens
acuacuuuugcuuuuuuauuugcucucauauauauuuuaaaaacaaugugaaaaaaauuauuca

SEQ ID NO: 548443 - RNA, 64 nt, Homo Sapiens
aauaaacuuuucuaugaucaauuguuuucuuuucuuuuaaaaaucuguucccuauaaccucuuc

SEQ ID NO: 548444 - RNA, 64 nt, Homo Sapiens
auuuccuccauaaauauucauauuaaccaaauauuuuuaaaaauaagauaucuuaccuguuugu

SEQ ID NO: 548445 - RNA, 64 nt, Homo Sapiens
guuggauuaucaccagauuauuuuuauacaauguuuuuaaaacuuacaaauaauuauuuaaaca

SEQ ID NO: 548446 - RNA, 64 nt, Homo Sapiens
aaaaaggcagauaagacauacuccuguaucugaauuuuaaaauuaagaaagaaagcaggauuuu

SEQ ID NO: 548447 - RNA, 64 nt, Homo Sapiens
uauauucaguaaaagccugcguagugaaauguauuuuuaaaaacauaauaacugaaaagacuau

SEQ ID NO: 548448 - RNA, 64 nt, Homo Sapiens
aauguagucuuguaguaugauuauaauucugcuauuuuaaaagaguuagcaaucaauuuugaau

SEQ ID NO: 548449 - RNA, 64 nt, Homo Sapiens
uauuuaucauacucuguauaauauauuuucucucuuuuaaaaaaauaaccaaugauauuucagu

SEQ ID NO: 548450 - RNA, 64 nt, Homo Sapiens
uuuuaagcuguacacuuucauaauggaaggaauuuuuuaaaaaaguaagcagguacuacauuua

SEQ ID NO: 548451 - RNA, 64 nt, Homo Sapiens
cugauacauccauuuugauaaaucagauuuuaguuuuuaaaauaucuauaugcuuuccuuuuaa

SEQ ID NO: 548452 - RNA, 64 nt, Homo Sapiens
agauuuuaguuuuuaaaauaucuauaugcuuuccuuuuaaaaucuaucaguauuuuucagauuu

SEQ ID NO: 548453 - RNA, 64 nt, Homo Sapiens
cuggaagacucauguuaaacuauauuacaguucuuuuuaaaacaccaaaauauuuugcuuuaug

SEQ ID NO: 548454 - RNA, 64 nt, Homo Sapiens
ugagaucagugaacucugguacaaacuuuuuucuuuuuaaaaugcauauugauuaaaacaguua

SEQ ID NO: 548455 - RNA, 64 nt, Homo Sapiens
caagcuuguguguauuuaucuaaauacaaguucuuuuuaaaaucaucauaguugcaaaauauaa

SEQ ID NO: 548456 - RNA, 64 nt, Homo Sapiens
ucauaguugcaaaauauaauuccuaaggccacuguuuuaaaagaucgcuugccaaagcagauuu

SEQ ID NO: 548457 - RNA, 64 nt, Homo Sapiens
ggaguugcauaggagagaugacaaggauaauguauuuuaaaauguuauccuuguaauguauuuu

SEQ ID NO: 548458 - RNA, 64 nt, Homo Sapiens
cauuauccuuguaauguauuuaugcguuaaaguauuuuaaaauaacauacaaaucuaggaauau

SEQ ID NO: 548459 - RNA, 64 nt, Homo Sapiens
cuaucagcagccuccuaauuacauuguuuuuaauuuuuaaaaucuggcucuuguuccacuauua

SEQ ID NO: 548460 - RNA, 64 nt, Homo Sapiens
cugaugcccaacuugcacucucaccaggggauuuuuuuaaaaucuggcugcacauucauaccaa

SEQ ID NO: 548461 - RNA, 64 nt, Homo Sapiens
uccucucucuuuuguaauuuaaaauuaaaugugguuuuaaaagugugcaacagauuugguauua

SEQ ID NO: 548462 - RNA, 64 nt, Homo Sapiens
aaguuauuccaacacuaaaaugcuagaaaauuaauuuuaaaacucaguaagaaagaugucaaca

SEQ ID NO: 548463 - RNA, 64 nt, Homo Sapiens
cagaguucaugaaaacugcaugucuaaaaguaacuuuuaaaaagggguccuagauuacugucau

SEQ ID NO: 548464 - RNA, 64 nt, Homo Sapiens
auauuuugccauuaauccaaauucacuuuccaucuuuuaaaaauauaaaaaucauggcaacaua

SEQ ID NO: 548465 - RNA, 64 nt, Homo Sapiens
uuugaaauaauuguauuucuuaugacaaaacaaauuuuaaaagacuucuccuaugcauuuuuaa

SEQ ID NO: 548466 - RNA, 64 nt, Homo Sapiens
cagauaaaacauggacaaugauuuuccccuacgguuuuaaaaaauuuuccccuugagaguauau

SEQ ID NO: 548467 - RNA, 64 nt, Homo Sapiens
caacccugcccccuccccaguuuuguuuuuuuaauuuuaaaaugcuuguagaucagguguuuug

SEQ ID NO: 548468 - RNA, 64 nt, Homo Sapiens
guagggggaggggcuggggacgggauggcuuacuuuuuaaaagggaugaaauaggcuauccacu

SEQ ID NO: 548469 - RNA, 64 nt, Homo Sapiens
acucuuuaaaaaaaaaauaccaccaguuaauacuuuuuaaaacuaaggaaauaugucuaaugga

SEQ ID NO: 548470 - RNA, 64 nt, Homo Sapiens
aacaaaagcuacuuuuuucuaguguuaaauaaccuuuuaaaagcgacggugcuagaaauaucca

SEQ ID NO: 548471 - RNA, 64 nt, Homo Sapiens
cuuugcgccuugcuuugauacccaaaccccuuauuuuuaaaauaaauaggucagaucuuggccu

SEQ ID NO: 548472 - RNA, 64 nt, Homo Sapiens
uacuuaguaaugcacauucaaagaagguuauauuuuuuaaaauuugcuguguuuucuucagagc

SEQ ID NO: 548473 - RNA, 64 nt, Homo Sapiens
agggggugauucugaggcaccugccuccauucucuuuuaaaaaaaggugcuuggccuccaguag

SEQ ID NO: 548474 - RNA, 64 nt, Homo Sapiens
caggucuguugaaagucuucauuuguugaggguuuuuuaaaaauuugcuuucccuuaguauuag

SEQ ID NO: 548475 - RNA, 64 nt, Homo Sapiens
cuuuagagcuguguguugagcuaaaaauauaauuuuuuaaaaauugacuagcaaaaucuauggc

SEQ ID NO: 548476 - RNA, 64 nt, Homo Sapiens
aggagauacguaaaguaggccccacaaauaauauuuuuaaaauacaaaggaucaccacaauccu

SEQ ID NO: 548477 - RNA, 64 nt, Homo Sapiens
uuaaucagaagaacauuguuguuugauuauauguuuuuaaaaaccugaagcuuuuuugguggca

SEQ ID NO: 548478 - RNA, 64 nt, Homo Sapiens
cuauauaaaacaauuguuuacguguacuuuuaacuuuuaaaaguacuuaauuaacauauguugu

SEQ ID NO: 548479 - RNA, 64 nt, Homo Sapiens
uuaauuaacauauguuguuugacuuguauaaaguuuuuaaaaauuguuguuuauuugccaaagu

SEQ ID NO: 548480 - RNA, 64 nt, Homo Sapiens
uacauuguuuaucuaauauuauuuaugacaguaauuuuaaaauauauuauucauaaguucaagg

SEQ ID NO: 548481 - RNA, 64 nt, Homo Sapiens
ugauacugauuuugagaauuuaaagcagauuaccuuuuaaaacuggaccaacuaaguaauuggu

SEQ ID NO: 548482 - RNA, 64 nt, Homo Sapiens
uuuuaacuuucauuuuagagcacguuuuggucauuuuuaaaaauaccuaaagugccagaccgga

SEQ ID NO: 548483 - RNA, 64 nt, Homo Sapiens
auaugcuuauaccuaauuuuuaguuuuuaaacuauuuuaaaauauacuaugauuuuauauguau

SEQ ID NO: 548484 - RNA, 64 nt, Homo Sapiens
uuguuuucuuuuaauuucuaugaauaaaagaaauuuuuaaaaacuuuaaaauuuuaaauauuag

SEQ ID NO: 548485 - RNA, 64 nt, Homo Sapiens
aagugaauugcccagagcugccuuuuucuuuucuuuuuaaaaauuuuaagaaguuuucuuugug

SEQ ID NO: 548486 - RNA, 64 nt, Homo Sapiens
guuguuuauuuguuauuuuaaagguaaauugcacuuuuaaaaaaauaauugguugacuuaauau

SEQ ID NO: 548487 - RNA, 64 nt, Homo Sapiens
uauuaaauguuacaaaguuccaaaugaaucaguauuuuaaaaaauaaaacuaugaaagcauuaa

SEQ ID NO: 548488 - RNA, 62 nt, Homo Sapiens
auaaaacuaugaaagcauuaaaauauaggugaauuuuuaaaacuguaucuaucucaucauuu

SEQ ID NO: 548489 - RNA, 64 nt, Homo Sapiens
cuaagcaaauauuuuuccaggcugugcugugcauuuuuaaaaggucuaauuuaauugcuuuuaa

SEQ ID NO: 548490 - RNA, 64 nt, Homo Sapiens
ugccuuuccgcccuaugaaaaucaagaaaaucuuuuuuaaaaauggaguccugcuauuuuccac

SEQ ID NO: 548491 - RNA, 64 nt, Homo Sapiens
ucagugaaauaggagauacauaguaguauuuuauuuuuaaaauuaauuucucauuugguuuuga

SEQ ID NO: 548492 - RNA, 64 nt, Homo Sapiens
cuauuugugcuagaauaguuguaucuaaaucauauuuuaaaauuauuuuuauuuuuaaaaaauu

SEQ ID NO: 548493 - RNA, 64 nt, Homo Sapiens
uuguaucuaaaucauauuuuaaaauuauuuuuauuuuuaaaaaauuaugguaaaaacauauaaa

SEQ ID NO: 548494 - RNA, 64 nt, Homo Sapiens
ucuaaacuuguguuguuucuuuuuuaaaucaacuuuuuaaaaaaauaaaguguaaauuaaccga

SEQ ID NO: 548495 - RNA, 64 nt, Homo Sapiens
ucuagaauacauagcagcucugcaaaggaacaguuuuuaaaaaugggaacuucuacauugaaaa

SEQ ID NO: 548496 - RNA, 64 nt, Homo Sapiens
cagaaaucucaguuuaauauaaaaugagcuaaguuuuuaaaaauaaauuauaaacuuggagauu

SEQ ID NO: 548497 - RNA, 64 nt, Homo Sapiens
uaaacucucugauaucacuuaaagcuggaguuuauuuuaaaacaaaugaagcaugggccaccuc

SEQ ID NO: 548498 - RNA, 64 nt, Homo Sapiens
uggaaaaacuggucgaguaauuaucaauaauuuuuuuuaaaaagaggaucccaaacuguaaaag

SEQ ID NO: 548499 - RNA, 64 nt, Homo Sapiens
gauguacauuacugugaauuuuuauaccacucauuuuuaaaagggcugucuuuucauuuuaguu

SEQ ID NO: 548500 - RNA, 64 nt, Homo Sapiens
uacuguggugguguacacaggauagaacacccuuuuuuaaaacacagucuuuccccuugcucau

SEQ ID NO: 548501 - RNA, 64 nt, Homo Sapiens
uagguuauaggaaagaucuguuuauguaguuuguuuuuaaaaugugccaaugccuguacauuaa

SEQ ID NO: 548502 - RNA, 64 nt, Homo Sapiens
uuaaaaugugccaaugccuguacauuaacaagauuuuuaaaaauaaaauuguauaaaacauuca

SEQ ID NO: 548503 - RNA, 64 nt, Homo Sapiens
uuuucagaauuuucucuuuuaaucacaagaagccuuuuaaaaaaugacuuacacauauucucaa

SEQ ID NO: 548504 - RNA, 64 nt, Homo Sapiens
uauuuuauauucugauuuuaucagaauuauucuauuuuaaaauuguuuuaaaauuuaaaacauu

SEQ ID NO: 548505 - RNA, 64 nt, Homo Sapiens
cugauuuuaucagaauuauucuauuuuaaaauuguuuuaaaauuuaaaacauuuaauucaugau

SEQ ID NO: 548506 - RNA, 64 nt, Homo Sapiens
guauacucucaguucucauucaguauaaauaaaauuuuaaaauccuuucauaguucuauuagaa

SEQ ID NO: 548507 - RNA, 64 nt, Homo Sapiens
ugcaaagcugaaacugauuagaaaauucuuuauauuuuaaaauagcucuuucucauuuuuagag

SEQ ID NO: 548508 - RNA, 64 nt, Homo Sapiens
aacuagaacugucaaauaacaaaacggcucauguuuuuaaaauauauguaacucauuuuaaaau

SEQ ID NO: 548509 - RNA, 64 nt, Homo Sapiens
aaacggcucauguuuuuaaaauauauguaacucauuuuaaaauauauuaaauuguauuccaaac

SEQ ID NO: 548510 - RNA, 64 nt, Homo Sapiens
ucacaaguaaaaugaauucuaauguacaaguuuguuuuaaaaaguguaugucaagcuuuuauuu

SEQ ID NO: 548511 - RNA, 64 nt, Homo Sapiens
aauucucaaaugauauacauuuaaagggcagauuuuuuaaaaagauacuacuauaauaaacauu

SEQ ID NO: 548512 - RNA, 64 nt, Homo Sapiens
uaaacuuucaugguauuuagccuuucuuaaauuuuuuuaaaauuuaaacuuucuaaccuaugua

SEQ ID NO: 548513 - RNA, 64 nt, Homo Sapiens
acauguacagaguuuuauauaaauuuaaaccaauuuuuaaaacaaaacugcggacaccaccaua

SEQ ID NO: 548514 - RNA, 64 nt, Homo Sapiens
uguuuaacuaaacugucaugguuuaguuuacaauuuuuaaaaaguucuuaaaauacugaaaaug

SEQ ID NO: 548515 - RNA, 64 nt, Homo Sapiens
ccucucugagcuuguuuguugcugaaaugcuacuuuuuaaaauuuagauguuagauugaaaacu

SEQ ID NO: 548516 - RNA, 64 nt, Homo Sapiens
uacugcuuugaacuuccaaguaugucuagucaccuuuuaaaauguaaacauuuucagaaaaaug

SEQ ID NO: 548517 - RNA, 64 nt, Homo Sapiens
gggcugcauuuugccaccauaaagggcugcauuuuuuuaaaaagccuaggcagcucuaacauca

SEQ ID NO: 548518 - RNA, 64 nt, Homo Sapiens
ccaccacagguaugcaccaccauaccuggcugauuuuuaaaauuuuuucuagagaugaggucuc

SEQ ID NO: 548519 - RNA, 64 nt, Homo Sapiens
aguuugauagaaaugaauuucuuguaacauucuuuuuuaaaaguggaagucauuaacagugauu

SEQ ID NO: 548520 - RNA, 64 nt, Homo Sapiens
aaauugccaaaaauuucuaccacuuuuuacuagauuuuaaaaagcuacuuucuuuuauauugcc

SEQ ID NO: 548521 - RNA, 64 nt, Homo Sapiens
guaauguuuuugcacuggugacagacaaaaucuguuuuaaaaucauauccagcacaaaaacuau

SEQ ID NO: 548522 - RNA, 64 nt, Homo Sapiens
gucuuagcuguaaaaaugagaaaguguugguugguuuuaaaaucugguaacuccaugaugaaaa

SEQ ID NO: 548523 - RNA, 64 nt, Homo Sapiens
cuggaaaagcuucauuucugaagaugaauuuuauuuuuaaaaaauacaugcacacucaaaacuu

SEQ ID NO: 548524 - RNA, 64 nt, Homo Sapiens
gguuaacaugaaauguuaccuuuuaacagacuguuuuuaaaaauuaaaaauguauguauagguu

SEQ ID NO: 548525 - RNA, 64 nt, Homo Sapiens
aaaauuaaaaauguauguauagguuuugaaauuuuuuuaaaaggggagaaagacuguuaagagg

SEQ ID NO: 548526 - RNA, 64 nt, Homo Sapiens
cgugagccaccaugccuggccuucauuaucucuuuuuuaaaaaugaaaaaguuuauaauuuaca

SEQ ID NO: 548527 - RNA, 64 nt, Homo Sapiens
gguguuuucugucccucuuguucauugacauuuauuuuaaaauaaaauauuuuaaaaucuacuu

SEQ ID NO: 548528 - RNA, 64 nt, Homo Sapiens
ucuuguucauugacauuuauuuuaaaauaaaauauuuuaaaaucuacuuuuugguguacaguuc

SEQ ID NO: 548529 - RNA, 64 nt, Homo Sapiens
aaaugcauaguauaaacccaacaugauguguuuguuuuaaaaaauuuguguaauuuauaguuug

SEQ ID NO: 548530 - RNA, 64 nt, Homo Sapiens
aacaaacaaaaaagccauagcucuggcuuuaaaauuuuaaaacaggguaguguguguguauuuu

SEQ ID NO: 548531 - RNA, 64 nt, Homo Sapiens
aaauuuaccuuuaaaauaauuauuacuauuuuuauuuuaaaauaacuaauaauaguacuauuac

SEQ ID NO: 548532 - RNA, 64 nt, Homo Sapiens
agaauguuauccaacuauuaauccacacauauuguuuuaaaauaccuagauugcaaaaucucca

SEQ ID NO: 548533 - RNA, 64 nt, Homo Sapiens
cgaaauauugaaaugguguaaaugaaaacagcauuuuuaaaaacaaugccaauauaauauaguu

SEQ ID NO: 548534 - RNA, 64 nt, Homo Sapiens
uauguguauuuccuuagcccucgcugagccugccuuuuaaaauaguggggagaaagagcagcca

SEQ ID NO: 548535 - RNA, 64 nt, Homo Sapiens
agcauuuagugcucagucccgcucuuuacauuucuuuuaaaauagguagccugaauugcuuucu

SEQ ID NO: 548536 - RNA, 64 nt, Homo Sapiens
agcaacucuuauuucuuuccuaaaagacaugcauuuuuaaaacuggggcagauucugaauuggc

SEQ ID NO: 548537 - RNA, 64 nt, Homo Sapiens
guuugggggcagauucugaauaucugucuugacuuuuuaaaaaauuuccgucuccccaaagcuu

SEQ ID NO: 548538 - RNA, 64 nt, Homo Sapiens
uuguguuccuuuuugcagcaucuuccuucccuccuuuuaaaauuauccugaaaggcaacauaau

SEQ ID NO: 548539 - RNA, 64 nt, Homo Sapiens
guaugccaacuuaaguauuuuuccuuuuuauuccuuuuaaaauggaaaauaucagcuuuucuua

SEQ ID NO: 548540 - RNA, 64 nt, Homo Sapiens
uaucacuugugaucauuuauguaagaaaagcauuuuuuaaaaggcugaagaauauccugagauu

SEQ ID NO: 548541 - RNA, 64 nt, Homo Sapiens
gguagcaccacaugguuguguaauuguucacagauuuuaaaagcguacguauccaaacuucuuu

SEQ ID NO: 548542 - RNA, 64 nt, Homo Sapiens
gugaaauguaauguuuuuacacuguuaaaaaauuuuuuaaaaaugucuuccaaguauuauuuuu

SEQ ID NO: 548543 - RNA, 64 nt, Homo Sapiens
cugucgccaaauagcugagccagagaaagagguuuuuuaaaagaaauggcuucuucuuaaagcc

SEQ ID NO: 548544 - RNA, 64 nt, Homo Sapiens
aagaaacaaaaauauuuuucgcgaacauuuuauuuuuuaaaaaaaagcaauuuucucccauugu

SEQ ID NO: 548545 - RNA, 64 nt, Homo Sapiens
aaaagaaaagaaaaagacagagguuugaauugcuuuuuaaaaaagaggaagaaagggaagaauu

SEQ ID NO: 548546 - RNA, 64 nt, Homo Sapiens
aaucuucgaaggugugguuuaaaggaauuucauuuuuuaaaagauuguugucguuguuguaguu

SEQ ID NO: 548547 - RNA, 64 nt, Homo Sapiens
gucauauauuuuuugcuacuaaaaaggaaaauguuuuuaaaaaguauuaaaaacaaaaaagaaa

SEQ ID NO: 548548 - RNA, 64 nt, Homo Sapiens
gucguuaccagagauuuaccauauuuacaugucuuuuuaaaaggaaguguauaaaucugaguau

SEQ ID NO: 548549 - RNA, 64 nt, Homo Sapiens
uccuguguaacacuuggcuccaaaaacauuuuauuuuuaaaauaagcaugggaggugaggauuc

SEQ ID NO: 548550 - RNA, 64 nt, Homo Sapiens
gucuacauugagcauuugaacuuauuuuucaagguuuuaaaacaagaacaaugacaaacaccca

SEQ ID NO: 548551 - RNA, 64 nt, Homo Sapiens
acaaugacaaacacccacuuuuuccuuuucacauuuuuaaaagaaggauucuaaucucauguuu

SEQ ID NO: 548552 - RNA, 64 nt, Homo Sapiens
uucccacucagcacucagagauuuuuuucuucuuuuuuaaaauacuugaaucaaguguaauaua

SEQ ID NO: 548553 - RNA, 64 nt, Homo Sapiens
cccuccacuccucacacacagaaaaugcuucuccuuuuaaaaucuuauuaauaaagugaggcag

SEQ ID NO: 548554 - RNA, 64 nt, Homo Sapiens
uauguuuccccucacuguuugugaauuaucuuuauuuuaaaauguggacagaauuuguguaaaa

SEQ ID NO: 548555 - RNA, 64 nt, Homo Sapiens
uauaaacuaaccucagaccuauuuuaacaaaauauuuuaaaaguuguaauuucagguuuuuuac

SEQ ID NO: 548556 - RNA, 64 nt, Homo Sapiens
aauucuauauauacuguaaaaguucagaauauuuuuuuaaaaaauugauuacuuauauaaaaac

SEQ ID NO: 548557 - RNA, 64 nt, Homo Sapiens
caauuuucaaguuuuuuuuaaaucaauguuucuuuuuuaaaaaaaacaaccugaagacuuguga

SEQ ID NO: 548558 - RNA, 64 nt, Homo Sapiens
uuuuaauaauuuuugaaaauccauugucuuacuauuuuaaaacagaacauuccuggcgcaugcu

SEQ ID NO: 548559 - RNA, 64 nt, Homo Sapiens
gaggaaaaaaauaacaagaagcuuuaaaguauauuuuuaaaagguuuuuuugauuaccuguagu

SEQ ID NO: 548560 - RNA, 64 nt, Homo Sapiens
uagagcuuggucaaccucuaauaggccaauauuuuuuuaaaaaauagugagcaauacacauauu

SEQ ID NO: 548561 - RNA, 64 nt, Homo Sapiens
cauauacugacugaaacauguggacaguagcgguuuuuaaaaacagugauauauuguguuaauu

SEQ ID NO: 548562 - RNA, 64 nt, Homo Sapiens
ucaauuguccuggcugauuauaccaaguucaguuuuuuaaaacucuuucauuuuaaaauccuau

SEQ ID NO: 548563 - RNA, 64 nt, Homo Sapiens
cuauuaccaaguucaguuuuuguuaaaacuuucauuuuaaaaucccuuuauaguuaucgaucac

SEQ ID NO: 548564 - RNA, 64 nt, Homo Sapiens
gacuguaguggucacuaaacuucagcuaauuuguuuuuaaaauucacuucagaguaagagggaa

SEQ ID NO: 548565 - RNA, 64 nt, Homo Sapiens
uaauauaagcuacagaaaccuauuuucauuccuuuuuuaaaaaacucucauuccccauacuccc

SEQ ID NO: 548566 - RNA, 64 nt, Homo Sapiens
uuaaacuaaagauguuuuaagaaagaaaagaauuuuuuaaaaaagauuaagauuuuaucugggg

SEQ ID NO: 548567 - RNA, 64 nt, Homo Sapiens
uaaugccuacuugauuuauauaaccugcaaacacuuuuaaaacacacagcaucuuagaaaaguu

SEQ ID NO: 548568 - RNA, 64 nt, Homo Sapiens
aaaaacauaauaaucguuacguauuacauccccauuuuaaaaacuuuauagguagugguuauua

SEQ ID NO: 548569 - RNA, 64 nt, Homo Sapiens
uuacugugcuucuuugguugauauaaacaggugauuuuaaaauaugauuuuuacauacuaauga

SEQ ID NO: 548570 - RNA, 64 nt, Homo Sapiens
cuuaugcuuacauaauauaccauugcuaaggccuuuuuaaaaaggucugcuucccucauuauug

SEQ ID NO: 548571 - RNA, 64 nt, Homo Sapiens
cuauuguuuuucagaauugaaaucaagucuuauuuuuuaaaagcacauauuacuuguuucuggu

SEQ ID NO: 548572 - RNA, 64 nt, Homo Sapiens
acauuuuaugguucucuuaauuuuuaagagaauuuuuuaaaaaugagagaaggauuguuuucag

SEQ ID NO: 548573 - RNA, 64 nt, Homo Sapiens
uuauaaccguuuuuguucuauuaacaauuaccacuuuuaaaaaacacuguuuauauacugcuag

SEQ ID NO: 548574 - RNA, 64 nt, Homo Sapiens
guuuuuaaucuguauagaugauugguaaauaauauuuuaaaauuguaaaaccauucaaucaaua

SEQ ID NO: 548575 - RNA, 64 nt, Homo Sapiens
ugauuaauguauuuuauaaauacaacuaaguucuuuuuaaaaagaccaugugaguuaaugauac

SEQ ID NO: 548576 - RNA, 64 nt, Homo Sapiens
uaggcaaaagucacuaucaauguggacauuuuuauuuuaaaauuuuaauguuuuaacaaaagag

SEQ ID NO: 548577 - RNA, 64 nt, Homo Sapiens
aagcucaaauuguugguauuugauuuauaagcuuuuuuaaaacacccauuuauaaauauaugua

SEQ ID NO: 548578 - RNA, 64 nt, Homo Sapiens
auaauaauaaaauauuuaauugggaaagcugguuuuuuaaaaaaaacccuauagcuccuuacgc

SEQ ID NO: 548579 - RNA, 64 nt, Homo Sapiens
ugaaacacaacagaauucuauaggaagugcuaaauuuuaaaagcaggugaauuauuuaugcacu

SEQ ID NO: 548580 - RNA, 64 nt, Homo Sapiens
ugcugaagcagccccauccguaauaauaauucuuuuuuaaaaucccauguuggagagcaaaacu

SEQ ID NO: 548581 - RNA, 64 nt, Homo Sapiens
cacagguguugauuguuauauuaugaaaaccaaauuuuaaaagcuuacuucaguauaaauuauc

SEQ ID NO: 548582 - RNA, 64 nt, Homo Sapiens
auggcuagauuuacuucaguugaccuaaagcauuuuuuaaaagcguuaacugccaagcuuggag

SEQ ID NO: 548583 - RNA, 64 nt, Homo Sapiens
ugauucauuaauaucaaaauuaagauagccuugauuuuaaaagcuaaucauauagcuaaaguga

SEQ ID NO: 548584 - RNA, 64 nt, Homo Sapiens
agaaccaagaacuguaaaacaguggcaaauacuauuuuaaaagaacuauucaaaaauuuagaag

SEQ ID NO: 548585 - RNA, 64 nt, Homo Sapiens
uucucagccuuccuagggaaaaaugaaggucuuuuuuuaaaagccagcugcaagggaguuaggg

SEQ ID NO: 548586 - RNA, 57 nt, Homo Sapiens
aagccauggaaaaacuuccucugaggauuuuaaaaagauuuaaaaaggagaagauaa

SEQ ID NO: 548587 - RNA, 64 nt, Homo Sapiens
uuuuaguuuuuccuaagugaaauuuguaccagccuuuuaaaaaguaaaauuguuuaaucaaugg

SEQ ID NO: 548588 - RNA, 64 nt, Homo Sapiens
uaguaaugagaaacugugaacaguuaggcaauguuuuuaaaacuuugguucagauuguaauuau

SEQ ID NO: 548589 - RNA, 64 nt, Homo Sapiens
auuaucuugcagauaaagaagaaguuguguaaucuuuuaaaaaucuuaguucuuaaagaaucaa

SEQ ID NO: 548590 - RNA, 64 nt, Homo Sapiens
cuugagcuguuauaagagauguguuucuuuaugguuuuaaaacuaccagcaauugacuuaggcu

SEQ ID NO: 548591 - RNA, 61 nt, Homo Sapiens
cuauaaacuugucauugguaaaaaccucuuguuuuaaaacuccuuggaugcagauuuuuaa

SEQ ID NO: 548592 - RNA, 64 nt, Homo Sapiens
gcucugugauuuuacuuuuuaaugguuacauuaguuuuaaaauaauaguuucuuuuuuuaaaaa

SEQ ID NO: 548593 - RNA, 64 nt, Homo Sapiens
augguuacauuaguuuuaaauaaauaguuucuuuuuuuaaaaaauuaaaaaucauuuucuuguu

SEQ ID NO: 548594 - RNA, 64 nt, Homo Sapiens
cauuuucuuguuuaaauaguuucuuacuuagaauuuuuaaaaaucaucuuugcuuguacuagau

SEQ ID NO: 548595 - RNA, 64 nt, Homo Sapiens
uauuaucaggggagaaaaauaggcaauuuuuaauuuuuaaaaaucuccuucaguccauucccuu

SEQ ID NO: 548596 - RNA, 64 nt, Homo Sapiens
auuuuuagaacuccaauacuauguaacuucauuauuuuaaaaauacuugcauguguauacauac

SEQ ID NO: 548597 - RNA, 64 nt, Homo Sapiens
ccugaggaaauacauuuuucuaaauguauauauauuuuaaaaugaaauacagcuccaaaaauau

SEQ ID NO: 548598 - RNA, 64 nt, Homo Sapiens
auuugucuauauucuaaauuaaaaacugaaaauauuuuaaaauugcuaaaauugugugccauuu

SEQ ID NO: 548599 - RNA, 64 nt, Homo Sapiens
caauguccucgaugcuucugcacacauguacccauuuuaaaaaacgguuuagauucauuuuguc

SEQ ID NO: 548600 - RNA, 64 nt, Homo Sapiens
uguuaagucaaaaccaucuugguaaacaaucacuuuuuaaaaccaaugagaaagaauggaagau

SEQ ID NO: 548601 - RNA, 64 nt, Homo Sapiens
gaauaguuuauuucugugaaucucucucucuaccuuuuaaaauugauagaaagaauaaaauguu

SEQ ID NO: 548602 - RNA, 64 nt, Homo Sapiens
aaauaaguucuuaaaaaauuaccuguucuuccuuuuuuaaaauauuacuuuucugccaaaauaa

SEQ ID NO: 548603 - RNA, 64 nt, Homo Sapiens
agguggaaaauaggaacugugagacuaaagcuuuuuuuaaaaaaacaugaugcuuggaaauuaa

SEQ ID NO: 548604 - RNA, 64 nt, Homo Sapiens
cuguuuaguaucauuuugugucuuaggacaucuuuuuuaaaaagaacuuauuguggcuugaucu

SEQ ID NO: 548605 - RNA, 64 nt, Homo Sapiens
cuaaaugagucaucuaauuagauguuacuuuuaguuuuaaaaugaaaucuuaggugccuuaggg

SEQ ID NO: 548606 - RNA, 64 nt, Homo Sapiens
ggugccuuagggguuuuuuuuuuuuuuaaguauuuuuuaaaaaccugcaaagauauaaauuuag

SEQ ID NO: 548607 - RNA, 64 nt, Homo Sapiens
aaugcuuucucaugcauagacaaguguuuuggguuuuuaaaaaaaauauucugucauugguuac

SEQ ID NO: 548608 - RNA, 64 nt, Homo Sapiens
acaucauaaauaguaaauaaugauucaaugugaauuuuaaaaugcaaauauugcuauuguuuau

SEQ ID NO: 548609 - RNA, 64 nt, Homo Sapiens
ccaaauuuuucuaagacuacuaugaacaguuuucuuuuaaaauuuugagauuaagaaugccagg

SEQ ID NO: 548610 - RNA, 64 nt, Homo Sapiens
uuuaagcuuaagccauaaaauagauuagauuguuuuuuaaaaauggauagcucauuaagaagug

SEQ ID NO: 548611 - RNA, 64 nt, Homo Sapiens
caccuugaaagcuucaccuggccuacaacuuuuauuuuaaaaagaugaucaagaaaacuucauc

SEQ ID NO: 548612 - RNA, 64 nt, Homo Sapiens
auucaagaaagauaaaccccugucucaaggaacauuuuaaaaagaacgucuguccccugugaug

SEQ ID NO: 548613 - RNA, 64 nt, Homo Sapiens
uuauuuguuucaaauugcaguuuuuauaaaacauuuuuaaaacacaaauggcauguaugcuaau

SEQ ID NO: 548614 - RNA, 64 nt, Homo Sapiens
cauaguuuugaacuaauguaacaugauuuuucuuuuuuaaaacagccugaaaauguacuagugu

SEQ ID NO: 548615 - RNA, 64 nt, Homo Sapiens
ucaucuuauguuauuagcaagguuaagacaucuuuuuuaaaaaaauuauagcuucuaccaagag

SEQ ID NO: 548616 - RNA, 64 nt, Homo Sapiens
gacuuuaaacaagaauuaaaaucaugugcuguauuuuuaaaaucuagccaaauuaaauaguaca

SEQ ID NO: 548617 - RNA, 64 nt, Homo Sapiens
uauuucugaacuuggcaaaauuggaaauuaaaauuuuuaaaaauuacaaauauacaaaguuauu

SEQ ID NO: 548618 - RNA, 64 nt, Homo Sapiens
cacagacgccauagcuggauuggaaacauugauguuuuaaaaauuuauuuuuuuuggaaauagu

SEQ ID NO: 548619 - RNA, 64 nt, Homo Sapiens
ccaacagcuagaaggauugcaagguagauuuuuguuuuaaaauggagagaaguggacagauaag

SEQ ID NO: 548620 - RNA, 64 nt, Homo Sapiens
aaugucccgauuguuaaaaaguuggcucaauuauuuuuaaaacauuuuguaagccaacaaaagu

SEQ ID NO: 548621 - RNA, 64 nt, Homo Sapiens
uaucccagcaggaaaaaaaaggauaauauaacuguuuuaaaacucuuucuggggaauccaauua

SEQ ID NO: 548622 - RNA, 64 nt, Homo Sapiens
guuaaggagacaauuuuggagagcaagcaaaucuuuuuaaaaaauaguaugaaugugaauacua

SEQ ID NO: 548623 - RNA, 64 nt, Homo Sapiens
guuaccugagacgacugaugugucacaagcuguuuuuuaaaaucaucuuccaauucuauacuuc

SEQ ID NO: 548624 - RNA, 64 nt, Homo Sapiens
uuuuuuggucagcuuuaauauauuuaugccagaauuuuaaaaccaacaaaauuuucuuguucaa

SEQ ID NO: 548625 - RNA, 64 nt, Homo Sapiens
cuguuuaugcgauaacuccuuuuuguuacaauuuuuuuaaaaaaagcuauuuuuguuaauguaa

SEQ ID NO: 548626 - RNA, 64 nt, Homo Sapiens
agcuaggcuaaaauuugcuaaaugccuugguuucuuuuaaaaguucauguaauauuucugauuu

SEQ ID NO: 548627 - RNA, 64 nt, Homo Sapiens
ugauuuuucagaauauuugcaauaagagucuggauuuuaaaaaacacaugcauacacacaauua

SEQ ID NO: 548628 - RNA, 64 nt, Homo Sapiens
cccacccuuugaagaguucaaguucuguacagguuuuuaaaacgugaaguaauguuugaacugg

SEQ ID NO: 548629 - RNA, 64 nt, Homo Sapiens
aaauauuaauagaauuuuuuaaauauacucuaauuuuuaaaacauacucuuuauuaucuucauu

SEQ ID NO: 548630 - RNA, 64 nt, Homo Sapiens
gaucugucauugcaaaguaacaaaaauuuuaagcuuuuaaaaauguagauuuuucauauuuuua

SEQ ID NO: 548631 - RNA, 64 nt, Homo Sapiens
auuuuaagcuuuuaaaaauguagauuuuucauauuuuuaaaauuugaaucuauuugagcuuuag

SEQ ID NO: 548632 - RNA, 64 nt, Homo Sapiens
ugagucuuaaucugaagucuuuuucaugcccuuguuuuaaaaaaacuacuuuuuuuggccucaa

SEQ ID NO: 548633 - RNA, 64 nt, Homo Sapiens
gaaccuuuucuuaaaaugaaaauaauuacugcuauuuuaaaauuucuugaucauugaaugugag

SEQ ID NO: 548634 - RNA, 64 nt, Homo Sapiens
uacuguuuacuucauuguuauauugcaguaaaaguuuuaaaacaaccauugcauguuugcuuuu

SEQ ID NO: 548635 - RNA, 64 nt, Homo Sapiens
uguuuaucagcaagucgugagucaaacugcugccuuuuaaaaaacccacaaaaugcugauucag

SEQ ID NO: 548636 - RNA, 64 nt, Homo Sapiens
aaaaaaauaaacagccuucuuuuuuuuuccuuuguuuuaaaacugugguuuuuuaaaaaagcaa

SEQ ID NO: 548637 - RNA, 64 nt, Homo Sapiens
uucuuuuuuuuuccuuuguuuuaaaacugugguuuuuuaaaaaagcaauaauuaacucagaccu

SEQ ID NO: 548638 - RNA, 64 nt, Homo Sapiens
aaaucuucuugucauguaaaaugaagcuagucuguuuuaaaauuuuuaguuuuggauuguauac

SEQ ID NO: 548639 - RNA, 64 nt, Homo Sapiens
uugagaggcugggaggguugaggggaagauaaacuuuuaaaaagcucuuaucuuucauuucaau

SEQ ID NO: 548640 - RNA, 64 nt, Homo Sapiens
accuccauucuuggauucccuuucuuuccuuuuauuuuaaaaaagaacaguaccccucuuuuaa

SEQ ID NO: 548641 - RNA, 64 nt, Homo Sapiens
gaaugcacagaccaagaauucagugaaugucauuuuuuaaaaaacuaauuuguauugucugcuc

SEQ ID NO: 548642 - RNA, 64 nt, Homo Sapiens
uuucccuucauaaaauguaauguacauuguaaucuuuuaaaagaaaaaucaggguugcacuugc

SEQ ID NO: 548643 - RNA, 64 nt, Homo Sapiens
cuuuuaaaagaaaaaucaggguugcacuugcaacuuuuaaaaaaccgaguguggaaacauuggg

SEQ ID NO: 548644 - RNA, 64 nt, Homo Sapiens
uuguuugaaacaaaagaaaauaaugcauuguguuuuuuaaaaagaguaucuuauacauguaucc

SEQ ID NO: 548645 - RNA, 64 nt, Homo Sapiens
uugcuuggguauggaacgguagaaauuuggguguuuuuaaaaccuuguuugggguuguuccugu

SEQ ID NO: 548646 - RNA, 64 nt, Homo Sapiens
guuauuuauauaaaaauaauuuaucaaaaggauauuuuaaaaaagcuagucugucuugaaacuu

SEQ ID NO: 548647 - RNA, 64 nt, Homo Sapiens
auuugacagacauccuugcaguuuaagaugacacuuuuaaaauaaauucucuccuaaugaugac

SEQ ID NO: 548648 - RNA, 64 nt, Homo Sapiens
auugugcccuugauuuuuaucuccaaguggcaguuuuuaaaauuggccuuuuaccuggauauaa

SEQ ID NO: 548649 - RNA, 64 nt, Homo Sapiens
gcaguccagcuguucuuugcagcuggagaugaacuuuuaaaaauccccuucacacuuaauguac

SEQ ID NO: 548650 - RNA, 64 nt, Homo Sapiens
gaucuuaaaugauggaaguauaggacguugcuuauuuuaaaacaagggaaggacacaaaaugga

SEQ ID NO: 548651 - RNA, 64 nt, Homo Sapiens
uuuauguacucacagucuuuaaacccauauaucuuuuuaaaaaauuuuccauuagaauacugca

SEQ ID NO: 548652 - RNA, 64 nt, Homo Sapiens
cuaguauaacuagauaguauuagaaugcauauguuuuuaaaaugcuuuucuagugcaguuauau

SEQ ID NO: 548653 - RNA, 64 nt, Homo Sapiens
gcagcagcauaggagugaacaugugcugcaacguuuuuaaaaauaaaauaaccuuuccuuuuaa

SEQ ID NO: 548654 - RNA, 64 nt, Homo Sapiens
acacuuggugauucuuucaaaccagaaaaccgcuuuuuaaaaaacacaggccaauuuguuggcc

SEQ ID NO: 548655 - RNA, 64 nt, Homo Sapiens
aauucacuuguauaaaaaugucaguaagugucuuuuuuaaaaaaccuuaaacuauugccauacu

SEQ ID NO: 548656 - RNA, 64 nt, Homo Sapiens
uccuguacuaguacauaaaugcacagaucugauuuuuuaaaaugaggugcuggcaugcuuuaca

SEQ ID NO: 548657 - RNA, 64 nt, Homo Sapiens
agaaaaaaacauggucuugugcauuaaugcacauuuuuaaaaaaagcucuauucauuuauguua

SEQ ID NO: 548658 - RNA, 64 nt, Homo Sapiens
ucaacaauauggagaauaacuuguuugaaaacuauuuuaaaauguucuaguaaauauaaacggu

SEQ ID NO: 548659 - RNA, 64 nt, Homo Sapiens
aagcagaaauacacaaugauaugaagauaacuuuuuuuaaaaaacaaaaucaugaaugauacac

SEQ ID NO: 548660 - RNA, 64 nt, Homo Sapiens
uuguauguacuugacaauucuguauauaauaaaguuuuaaaaauguguauguucaaauuguuua

SEQ ID NO: 548661 - RNA, 64 nt, Homo Sapiens
acauauuuccaccucucucuaucuauaaaucuuguuuuaaaaauccaaagugggcaucacaauu

SEQ ID NO: 548662 - RNA, 64 nt, Homo Sapiens
ucacaaaacaggaaccagcagugauuaaauccuguuuuaaaaugcucaagccuuuuuauucuuu

SEQ ID NO: 548663 - RNA, 64 nt, Homo Sapiens
augcacaauuuacuucccaaaaugcagcaacuuguuuuaaaaaacaagcacuuagauggauaua

SEQ ID NO: 548664 - RNA, 64 nt, Homo Sapiens
cacauuguagccuaagaucaucucccugcauuguuuuuaaaaagggucaauauucugauuuucc

SEQ ID NO: 548665 - RNA, 64 nt, Homo Sapiens
cuucaguucuuaauguaacugaauguuuaaagcuuuuuaaaagagaauguuuugguucaagaaa

SEQ ID NO: 548666 - RNA, 64 nt, Homo Sapiens
guacaccagaaaaggacuggaugugccuguauuuuuuuaaaauguauaaucuuuggcuaguguu

SEQ ID NO: 548667 - RNA, 64 nt, Homo Sapiens
guggcugaauuucccaacccuuuuaagacagucauuuuaaaaugauuuuugguggucauuuuuu

SEQ ID NO: 548668 - RNA, 64 nt, Homo Sapiens
aauuuagugaaccuauuuuuaaacguuuuaugauuuuuaaaauaauguaaugcucuuuuguaag

SEQ ID NO: 548669 - RNA, 64 nt, Homo Sapiens
aaguuaaugugaauuuugaaacucacaaaacugauuuuaaaauccauuuagcuugugguaaaug

SEQ ID NO: 548670 - RNA, 64 nt, Homo Sapiens
cuacuuguauaauaacccuuucugugugagaauuuuuuaaaaggaagucuaaauacaaagcugu

SEQ ID NO: 548671 - RNA, 64 nt, Homo Sapiens
ccuaaguuuuuaaauaacuauuuauagacauguuuuuuaaaaauacugccuuaaacguuguauu

SEQ ID NO: 548672 - RNA, 64 nt, Homo Sapiens
aaauuaaaaguuuuaaacuccagaaauaauuuauuuuuaaaaaguuuuuauaaauuguaugcuu

SEQ ID NO: 548673 - RNA, 64 nt, Homo Sapiens
uggauguuaaggcuguuuugguggauaaaaagguuuuuaaaacaugcuuggaugaaaggacagc

SEQ ID NO: 548674 - RNA, 64 nt, Homo Sapiens
cagcuuauaauuccucguuauuaaugauuguuauuuuuaaaaacuuaauauuuauaauggauau

SEQ ID NO: 548675 - RNA, 64 nt, Homo Sapiens
aaauuaauauuuauaauggaacaucuuccaauucuuuuaaaauauguaguauguaauauaugua

SEQ ID NO: 548676 - RNA, 64 nt, Homo Sapiens
augaccaagggcuugaaacauuaaaauauggaaauuuuaaaauuuacacccugcaaugugcaca

SEQ ID NO: 548677 - RNA, 64 nt, Homo Sapiens
aaaucucucauuccagcccagagaacuggagaauuuuuaaaacagacaacagacuuucugaccu

SEQ ID NO: 548678 - RNA, 64 nt, Homo Sapiens
guaauuuuuuacauuuuccuaauacuguguuaccuuuuaaaauauauaguuauacaucuucauu

SEQ ID NO: 548679 - RNA, 64 nt, Homo Sapiens
ucaaaaggcacugugaacuaauuucaaggccauauuuuaaaaaauccuuacuucgguuccucug

SEQ ID NO: 548680 - RNA, 64 nt, Homo Sapiens
augugaaaugucaucuuguaaugaaggauucuuuuuuuaaaaaagauuauuaggauauauuccc

SEQ ID NO: 548681 - RNA, 64 nt, Homo Sapiens
uuuugugugguuuggugcaauacacuaacuagacuuuuaaaagaucuggaguguccauuuagac

SEQ ID NO: 548682 - RNA, 64 nt, Homo Sapiens
uauuuuugguaaggucuucuugguuugacagauuuuuuaaaaguaaauauucaggucuaucaua

SEQ ID NO: 548683 - RNA, 64 nt, Homo Sapiens
uuuaaacacagacuucuaaaaaacucauuuguacuuuuaaaaaacagccuuauacaacauuucu

SEQ ID NO: 548684 - RNA, 64 nt, Homo Sapiens
caagggauuuuuuuuuuuuggauauucaaguauauuuuaaaaauacaaaaauaacucugaguuu

SEQ ID NO: 548685 - RNA, 64 nt, Homo Sapiens
augagugguucaguucauucucuuuuaagugugauuuuaaaaaaggaacuuuuuugcccaugug

SEQ ID NO: 548686 - RNA, 64 nt, Homo Sapiens
uaagauuucuggaguagauugucuuuguuuaacuuuuuaaaaaaguggauucauuuuuauuuuu

SEQ ID NO: 548687 - RNA, 64 nt, Homo Sapiens
augguuuuaucuguugugugacuuacauuuugaauuuuaaaauggcaacuuaaacucaaguugc

SEQ ID NO: 548688 - RNA, 64 nt, Homo Sapiens
acauccauguuuuaacuuauuacuagaguggucauuuuaaaaauuaaaagacuuuuaaauucac

SEQ ID NO: 548689 - RNA, 64 nt, Homo Sapiens
gucuauuaauauuccaucguaauauucuacaacuuuuuaaaaaugaccuuuuuuuauauuauua

SEQ ID NO: 548690 - RNA, 64 nt, Homo Sapiens
uuuuuuuuuuuucauauugguuaaccuagauuuuuuuuaaaacuuuaacaagguaacuuuuugu

SEQ ID NO: 548691 - RNA, 64 nt, Homo Sapiens
uaauauacuuuguaccauuugaagcccuucuguauuuuaaaauguacuguauuuaauuucuauu

SEQ ID NO: 548692 - RNA, 64 nt, Homo Sapiens
uccucucuauuuuauuuuuuuaucuguucuacuguuuuaaaaguaauucuaccuuuaccaggga

SEQ ID NO: 548693 - RNA, 64 nt, Homo Sapiens
uauaaaguaacaauucagaucaagauacuuuucauuuuaaaauguuggauuccaaacuaaacac

SEQ ID NO: 548694 - RNA, 64 nt, Homo Sapiens
guccagaauucuauuuuaacaucauccaaaaacuuuuuaaaaaggcucugccuccugugcuuau

SEQ ID NO: 548695 - RNA, 64 nt, Homo Sapiens
accugcccugaaaaguucuuuguaagaugacuaauuuuaaaagagugcuagaauacuguugugu

SEQ ID NO: 548696 - RNA, 64 nt, Homo Sapiens
uauuuugugguuuuuuaauauaguauaaaaauccuuuuaaaaaaacaacaaucugugugccucu

SEQ ID NO: 548697 - RNA, 64 nt, Homo Sapiens
ggcaaaauuugcaauaguguucuauuguauguaauuuuaaaauuuauaagauuauccacguugg

SEQ ID NO: 548698 - RNA, 64 nt, Homo Sapiens
cuugguuuggagacauaaggaauauucugacccuuuuuaaaaaaggauuuucucauguuuuuau

SEQ ID NO: 548699 - RNA, 64 nt, Homo Sapiens
guuuucacucaaauauuuugccucauuauucuuguuuuaaaagaaagaaaacaggccgggcaca

SEQ ID NO: 548700 - RNA, 64 nt, Homo Sapiens
gaaguggccacaguaugugcuguuuuugaagcauuuuuaaaaacgaauuguaguuguuuuucuu

SEQ ID NO: 548701 - RNA, 64 nt, Homo Sapiens
uauccagcccugauauuuuguguaaauaaaauguuuuuaaaaccuguuaguuaaaacacuuagg

SEQ ID NO: 548702 - RNA, 64 nt, Homo Sapiens
augcaaauguccuucaccaguaaagcaagcaaauuuuuaaaaucucuguuuuugaaaucuacuc

SEQ ID NO: 548703 - RNA, 64 nt, Homo Sapiens
cuguugucauauaggcuauaugcgaaauuguuaauuuuaaaauaaccucaggccacagacuugu

SEQ ID NO: 548704 - RNA, 64 nt, Homo Sapiens
ugagaccugguaacccacgcucuugcauuguggauuuuaaaauguauacucuguacgguucugu

SEQ ID NO: 548705 - RNA, 64 nt, Homo Sapiens
aucgggaccggcagaaauggaaguauccauacauuuuuaaaaagcaacaaguuugcacagcuag

SEQ ID NO: 548706 - RNA, 64 nt, Homo Sapiens
caguuccuggaggggcucuuauuauuuucucucuuuuuaaaaaacuuccaguagaaguaaagug

SEQ ID NO: 548707 - RNA, 64 nt, Homo Sapiens
cauucaauuuuaugauuuacauuuaucauguaauuuuuaaaaaaauccaucuaucuaggauaug

SEQ ID NO: 548708 - RNA, 64 nt, Homo Sapiens
augaauaguguguuuauuguaacuccucauacacuuuuaaaaccaacaucuuuuuucauaaaug

SEQ ID NO: 548709 - RNA, 64 nt, Homo Sapiens
guacguaguuaagucguagcuauaacuucaaauuuuuuaaaagagacaaacuguaaaaaaugug

SEQ ID NO: 548710 - RNA, 64 nt, Homo Sapiens
cccuauuuugccauuuagcgaacaaccacaggaauuuuaaaaacaaaaacaucccaagauuuuu

SEQ ID NO: 548711 - RNA, 64 nt, Homo Sapiens
auacugaaacaugucuuucauaggugauacaacuuuuuaaaauguauguguagauauaacuuaa

SEQ ID NO: 548712 - RNA, 64 nt, Homo Sapiens
gagauguuuauuagggcaaucaaaagauuuauuauuuuaaaaaaaucaguguggacuuccauuc

SEQ ID NO: 548713 - RNA, 64 nt, Homo Sapiens
ggucaauuccuaguaugcauaaauuuuuuaacccuuuuaaaagagaccuauguugaaaaccccu

SEQ ID NO: 548714 - RNA, 64 nt, Homo Sapiens
uuacaaguuuuaaguugugguaguuuagugauuuuuuuaaaagaugugugaaauguucucugca

SEQ ID NO: 548715 - RNA, 64 nt, Homo Sapiens
acaagacugaauguuaccuuuucuuucugacagauuuuaaaaauugauaugauaaaagcacaac

SEQ ID NO: 548716 - RNA, 64 nt, Homo Sapiens
ggaaaaaaagcaauucacaaaaccauuucauauuuuuuaaaauauugugcuuaaagaugguccu

SEQ ID NO: 548717 - RNA, 64 nt, Homo Sapiens
gaaagcaguacagaggaaaacaggaaccugauuuuuuuaaaauaaauuuuaaauaaaauagaau

SEQ ID NO: 548718 - RNA, 64 nt, Homo Sapiens
uguacuuguacaaacucaacacuaacuuuuuuuuuuuuaaaaaaaaaaagguacuaaguaucuu

SEQ ID NO: 548719 - RNA, 64 nt, Homo Sapiens
acacuggcauuuuccaaaacuguggcagcuaacuuuuuaaaaucucaaaugacaugcaguguga

SEQ ID NO: 548720 - RNA, 64 nt, Homo Sapiens
acaauauguggggagagcacucgguugucuuuacuuuuaaaaguaauacuuggugcuaagaauu

SEQ ID NO: 548721 - RNA, 64 nt, Homo Sapiens
ugguuggaggcuguucauaaauuguaaauauauauuuuaaaagcacuuucuauuuuuaaaagua

SEQ ID NO: 548722 - RNA, 64 nt, Homo Sapiens
aauuguaaauauauauuuuaaaagcacuuucuauuuuuaaaaguaacuugaaauaauauaguau

SEQ ID NO: 548723 - RNA, 64 nt, Homo Sapiens
ugauauaaugaaauguucguucauguauauacauuuuuaaaagugcuuucuuugaaacacugga

SEQ ID NO: 548724 - RNA, 64 nt, Homo Sapiens
uccuucauguaagugccuauucagaguuucagaauuuuaaaaugccaaauauuuucauggucau

SEQ ID NO: 548725 - RNA, 64 nt, Homo Sapiens
aggacgacccgagucccaagagugggguuuugcuuuuuaaaaggagagaggaggggugauggca

SEQ ID NO: 548726 - RNA, 64 nt, Homo Sapiens
uuccauguguuuuccuccuguuguuuuagaacuuuuuuaaaaaaacagaccucguuuuagauuu

SEQ ID NO: 548727 - RNA, 64 nt, Homo Sapiens
auuaaaacaacaaacgaaaccuagugaagcaucuuuuuaaaaggcugccagcuuaaugaauuua

SEQ ID NO: 548728 - RNA, 64 nt, Homo Sapiens
cguuagccacugcgcccggcccgagaaaauacaguuuuaaaaagagaaagcuuuauaaccucac

SEQ ID NO: 548729 - RNA, 64 nt, Homo Sapiens
uuugacaaagcucaccaacuuuaaaauauuaaguuuuuaaaaaaucaaauaugaaguauguuca

SEQ ID NO: 548730 - RNA, 64 nt, Homo Sapiens
guauuuaucaguauuuuuuaaacauccuguccuuuuuuaaaaucuuugcuuagucagucauauu

SEQ ID NO: 548731 - RNA, 64 nt, Homo Sapiens
uagcaccuuaaucacuguuuaguuuuguauucauuuuuaaaagcaauuauugaagccauuuuca

SEQ ID NO: 548732 - RNA, 64 nt, Homo Sapiens
ucugaaggggaaauauaacaucuaugguuauauauuuuaaaaacuuagauuauaggcuguaauu

SEQ ID NO: 548733 - RNA, 64 nt, Homo Sapiens
caaaacauuuuauggcuaguaauauuuauguaauuuuuaaaauguauuuuugguacugauggga

SEQ ID NO: 548734 - RNA, 64 nt, Homo Sapiens
agaagacuuuggaguauauguuuuuaaaguaauuuuuuaaaauaugguaauguauuaaacuuau

SEQ ID NO: 548735 - RNA, 64 nt, Homo Sapiens
uuuauaugccauucuuguuauagaagaauaugccuuuuaaaaaagcuuauuaauaacacuuucc

SEQ ID NO: 548736 - RNA, 64 nt, Homo Sapiens
aaaaagcuuauuaauaacacuuucccaauuuauauuuuaaaaagcuaaagaacacuggauuaau

SEQ ID NO: 548737 - RNA, 64 nt, Homo Sapiens
gggugggauggggugguuggagaaccagaacuauuuuuaaaacauuagguuucaauauaaauac

SEQ ID NO: 548738 - RNA, 64 nt, Homo Sapiens
caccaauggaauuagaugagugcuaugcacuuaauuuuaaaauaaaacuaguuuucaguaaaau

SEQ ID NO: 548739 - RNA, 64 nt, Homo Sapiens
uuuucuacuucaguauaguaccugaaaucgaacauuuuaaaaguugauuguauuucuguggaag

SEQ ID NO: 548740 - RNA, 64 nt, Homo Sapiens
uaggauagauuccuaagggacaugcccaacagaguuuuaaaauggauguuuucaugaugacaac

SEQ ID NO: 548741 - RNA, 64 nt, Homo Sapiens
uguuguuuuuucuuaaguuauauuuguuuuuacuuuuuaaaaaagaagaggaaacaaagccccc

SEQ ID NO: 548742 - RNA, 64 nt, Homo Sapiens
cuugaagaauaucuaagcuuuuucugagaugggcuuuuaaaauuauaauaagggaaguuuauuu

SEQ ID NO: 548743 - RNA, 64 nt, Homo Sapiens
gaauauauuuuuuucuuuaaauaggaacaaccucuuuuaaaagagaaaaauuauuucagugauu

SEQ ID NO: 548744 - RNA, 64 nt, Homo Sapiens
uuaaucuuaaaagaggcauuaguucagaauacuuuuuuaaaaguuuaaauuaaauauuuaggca

SEQ ID NO: 548745 - RNA, 64 nt, Homo Sapiens
cucaaaugcuggguugaaaaauguuuugaaagccuuuuaaaauauauaucuuuauaaaguaaua

SEQ ID NO: 548746 - RNA, 64 nt, Homo Sapiens
aaucuauagcauuaguauacacuggcacauaauuuuuuaaaaaguuuuaagaaaagauucauuu

SEQ ID NO: 548747 - RNA, 64 nt, Homo Sapiens
ccaaaagcaaugucuuucuugguugauauuugaguuuuaaaagggucaaaucuuucuaauuuuu

SEQ ID NO: 548748 - RNA, 64 nt, Homo Sapiens
aauaguaaccugugaacuaugcuuuuccauaacuuuuuaaaaauauauauaucuaaaugaaugc

SEQ ID NO: 548749 - RNA, 64 nt, Homo Sapiens
aagcacuuuguaccaaguuauuaaguaacauaauuuuuaaaauuuaaagaaugugucuucaacu

SEQ ID NO: 548750 - RNA, 64 nt, Homo Sapiens
guuuacuaauagaggaguagagauuguugaccauuuuuaaaaaacgauagccacucuuuuucuu

SEQ ID NO: 548751 - RNA, 64 nt, Homo Sapiens
augcugguauucuacuacuugugcaauauauauguuuuaaaaaacaaauuugagaauacauuua

SEQ ID NO: 548752 - RNA, 64 nt, Homo Sapiens
caugguggcaaaauauuagcucuguuuugggacauuuuaaaauagaacuauccuuguucgauag

SEQ ID NO: 548753 - RNA, 64 nt, Homo Sapiens
auucuuuuauaagucuauggaaauuauuuaauuauuuuaaaacguacacacuuuucuuguaaau

SEQ ID NO: 548754 - RNA, 64 nt, Homo Sapiens
aaaagauacauuuuauggugguuucaguaggucauuuuaaaaaccaaugugcauuaguuuucaa

SEQ ID NO: 548755 - RNA, 64 nt, Homo Sapiens
auuuuacaacacaaaaauaagccugugucaaagauuuuaaaaucauggaaaguuaaaaucuaga

SEQ ID NO: 548756 - RNA, 64 nt, Homo Sapiens
cuccaaaguccugaaaauuuugguggacaaugauuuuuaaaaaacuaacuuuguauaaccuaau

SEQ ID NO: 548757 - RNA, 63 nt, Homo Sapiens
aaguuaaucauugacaacgaaaaauaaaauguuauuuuaaaagacucacagugucugaccaau

SEQ ID NO: 548758 - RNA, 64 nt, Homo Sapiens
accugcuauacaguuguuaaaucuuaaauaugcuuuuuaaaaauuggaauaauguauuaagguc

SEQ ID NO: 548759 - RNA, 64 nt, Homo Sapiens
aacacacuagaguagcuggugacuauaaauaauauuuuaaaaugcugugucuacaccaucaaga

SEQ ID NO: 548760 - RNA, 64 nt, Homo Sapiens
caugugcuauaugaaugaagaaugcauaccaguguuuuaaaagguauuuuuauguguuuuuaaa

SEQ ID NO: 548761 - RNA, 64 nt, Homo Sapiens
aacuauauaaggauggucccagaaaaagcaagauuuuuaaaacuaucauaacaucugauuaaac

SEQ ID NO: 548762 - RNA, 64 nt, Homo Sapiens
uauacagaucaaagcaaaaacucacugguaauauuuuuaaaaagcaugaagcaaucaucgaaga

SEQ ID NO: 548763 - RNA, 64 nt, Homo Sapiens
augauucuaauucuagcccauuuuuuauuucuaauuuuaaaauauuuuauguuaauuaaagaag

SEQ ID NO: 548764 - RNA, 64 nt, Homo Sapiens
aauuuuauaaacaaaucaagauguggaauauucuuuuuaaaaacuaugaaacugauaaauauau

SEQ ID NO: 548765 - RNA, 64 nt, Homo Sapiens
uucugaaaacaaagcuguauacaguuugauacacuuuuaaaagggccugacagaagcacaagga

SEQ ID NO: 548766 - RNA, 64 nt, Homo Sapiens
ugaguuaaagaugacuguguacagcuaaagaagauuuuaaaaauguaucucgugcaugaagcug

SEQ ID NO: 548767 - RNA, 64 nt, Homo Sapiens
aucauuuaaaaaaaaaugacaaccaaagugcuauuuuuaaaagcuuggaaaauuauauguauaa

SEQ ID NO: 548768 - RNA, 64 nt, Homo Sapiens
uagaagauacuuuuaagacacccaaaccuaaucuuuuuaaaagaugagcuuuauucuaauguau

SEQ ID NO: 548769 - RNA, 64 nt, Homo Sapiens
uaucuuuaaaagacugaucaacagagguugaauuuuuuaaaaaagcccuguccuaaaugugaag

SEQ ID NO: 548770 - RNA, 64 nt, Homo Sapiens
agggaaaggacaauuuaauaaauagauucccauauuuuaaaaggauaccgggaaugcagcuauu

SEQ ID NO: 548771 - RNA, 64 nt, Homo Sapiens
aaauaauugggaaagaagguuagcaacauuagaauuuuaaaauauuuaauccauuaccuggcac

SEQ ID NO: 548772 - RNA, 64 nt, Homo Sapiens
ugcccauauuuucagaacauacugucuuaauauguuuuaaaaugggacuauuaugguuaacaga

SEQ ID NO: 548773 - RNA, 64 nt, Homo Sapiens
cacaaguuaucaggcaacauuacauauaugaagcuuuuaaaaagaaaggaaaccugcaaauguc

SEQ ID NO: 548774 - RNA, 64 nt, Homo Sapiens
aaaccugcaaaugucuacauccgagauugcucuauuuuaaaaggaucauguugcagaucugaug

SEQ ID NO: 548775 - RNA, 64 nt, Homo Sapiens
ugucacguagaacuuggauggguaauccaagauauuuuaaaaucaguggggcagucauuaucca

SEQ ID NO: 548776 - RNA, 64 nt, Homo Sapiens
caguccacaaaauaaccaauaacuuguuuuugguuuuuaaaaccugaggaaaacaagcauucac

SEQ ID NO: 548777 - RNA, 64 nt, Homo Sapiens
gaagaugucccacuugccauuuuuugaauguuaauuuuaaaauagauaguguauauuuuacuac

SEQ ID NO: 548778 - RNA, 64 nt, Homo Sapiens
cccacgugugaaaguuuacugauggguggagauuuuuuaaaaauucuuuuuuuuucagaggugg

SEQ ID NO: 548779 - RNA, 64 nt, Homo Sapiens
aguuuuaacaacuuuacacuuggugaaacaaaaguuuuaaaaguuauuuuacaucuuuauuucu

SEQ ID NO: 548780 - RNA, 64 nt, Homo Sapiens
uuguuuguuuuaaaucuuugggaaauaaaaaggcuuuuaaaauuuguaaaacaauaauggugaa

SEQ ID NO: 548781 - RNA, 64 nt, Homo Sapiens
gcaaugacuuaaauaaugagaagacugcuuaugguuuuaaaauuuuauagcuaaauugaaucag

SEQ ID NO: 548782 - RNA, 64 nt, Homo Sapiens
ucaaucauaggaggaaaagaggaaaagagcaugauuuuaaaaaagacuguuuauguugauguau

SEQ ID NO: 548783 - RNA, 64 nt, Homo Sapiens
gucuaauauuuuaucaaaucgucaauacaaguauuuuuaaaaauugccaagcagaaaacucaua

SEQ ID NO: 548784 - RNA, 64 nt, Homo Sapiens
caagaggucaggggauuuuauuaaauaauaauuuuuuuaaaaccauggaaaaacauuuauucuu

SEQ ID NO: 548785 - RNA, 64 nt, Homo Sapiens
auauauuuuaaccuacagucgcaaauuggucauuuuuuaaaaaagccuuaagaauugcagugga

SEQ ID NO: 548786 - RNA, 64 nt, Homo Sapiens
gaugcaagcaucaugauaagagagacugcuccuauuuuaaaaguauccacugcaaggcaccuag

SEQ ID NO: 548787 - RNA, 64 nt, Homo Sapiens
aaacaaaucuuuaaaaucugaacugcuagcuugauuuuaaaaaauauaauguuuguauaugcaa

SEQ ID NO: 548788 - RNA, 64 nt, Homo Sapiens
ucgauaguuuugcuguaaauacuauuuguuucuuuuuuaaaacacaaacugucaggguauaaac

SEQ ID NO: 548789 - RNA, 64 nt, Homo Sapiens
caagucaucauuugaaaauauguuaccuuuggguuuuuaaaagauuaguuaacucugggaaaga

SEQ ID NO: 548790 - RNA, 64 nt, Homo Sapiens
cuaaaugcacaccuccuaagggcaaagaaggcauuuuuaaaauuguauuuuaauaucuugcaag

SEQ ID NO: 548791 - RNA, 64 nt, Homo Sapiens
ucauugcuguuuuugacagcauuuuuggguuauuuuuuaaaacuuaaaggauauuauuguuuga

SEQ ID NO: 548792 - RNA, 64 nt, Homo Sapiens
cuaauuagaauuuccaaauacaagagcagaacaguuuuaaaaauauaauaaugcuuuuuguaaa

SEQ ID NO: 548793 - RNA, 64 nt, Homo Sapiens
uuaauuagauuuccuuuuccuuuucagaauucuuuuuuaaaauuaaguuggccaugguaaauaa

SEQ ID NO: 548794 - RNA, 64 nt, Homo Sapiens
uaagaauuccauuuauucugauauuaagaaaauguuuuaaaauggauuugaauuguuauccuuu

SEQ ID NO: 548795 - RNA, 64 nt, Homo Sapiens
ucaguguguuucccagaggcgugacuuacauguguuuuaaaaugguuauuaugagguacuauga

SEQ ID NO: 548796 - RNA, 64 nt, Homo Sapiens
cugacaguguuuauuauuauauuguuaucaugguuuuuaaaagacaugcuguucaaaguuuuua

SEQ ID NO: 548797 - RNA, 64 nt, Homo Sapiens
uugaaaaacaaaguguuagauaauuuuagaugucuuuuaaaaaagcugaaauuguaucucucag

SEQ ID NO: 548798 - RNA, 64 nt, Homo Sapiens
cauucacacacaaauacaaaccuuuuguuguugguuuuaaaauauccuuguagcuguuuucuuu

SEQ ID NO: 548799 - RNA, 64 nt, Homo Sapiens
cuuuuucuuagaaagccaaaagggaauugauuuuuuuuaaaaguuacaaguccuuucagugaug

SEQ ID NO: 548800 - RNA, 64 nt, Homo Sapiens
acagaugauuuuguucaggauuuuuuuaucccuuuuuuaaaaugaaugcucaccacuuagccug

SEQ ID NO: 548801 - RNA, 64 nt, Homo Sapiens
aacacgaaaucaucauauuguacuuuguggguucuuuuaaaaguuucaucuguggacaauugcu

SEQ ID NO: 548802 - RNA, 64 nt, Homo Sapiens
cucugagucucagugacuucaucuuuaaaaauguuuuuaaaacuauuuacaaacaacaaacuug

SEQ ID NO: 548803 - RNA, 64 nt, Homo Sapiens
aaucauaauaguuaggauaguuaaucuaaacuuuuuuuaaaaaaugcauuuguggcuagaaauu

SEQ ID NO: 548804 - RNA, 64 nt, Homo Sapiens
gccaaugauguauacauguaaauuauuaaaacaauuuuaaaaugaauuguaauuaagggaaaug

SEQ ID NO: 548805 - RNA, 64 nt, Homo Sapiens
caaaauacauugauauuuauuuaguuauauuuuauuuuaaaaugaugauacccguaaaauuaaa

SEQ ID NO: 548806 - RNA, 64 nt, Homo Sapiens
auauugguaaaugauacccggcuuagcaaaauacuuuuaaaaacugcccugaguauuaaagcua

SEQ ID NO: 548807 - RNA, 64 nt, Homo Sapiens
guguugucauugguaaaucuuauauguguuggaauuuuaaaauucccuucauaggacaaaguaa

SEQ ID NO: 548808 - RNA, 64 nt, Homo Sapiens
uaaaauauauugacuuuuuguauauccauucuguuuuuaaaauucugauguguaaaaaggucau

SEQ ID NO: 548809 - RNA, 64 nt, Homo Sapiens
cagagguguucugaccugcaucaaaaaaauuauuuuuuaaaacaauauuaaaagagaggguccu

SEQ ID NO: 548810 - RNA, 64 nt, Homo Sapiens
uggaagauuguacagcauaauaacacugagauuuuuuuaaaagccccucuuucauguauuaaaa

SEQ ID NO: 548811 - RNA, 64 nt, Homo Sapiens
aguuuuuuucauucaaagaauaaaaauacucauuuuuuaaaaaauuaagaaucuauauaagcua

SEQ ID NO: 548812 - RNA, 64 nt, Homo Sapiens
gaaaauuguuuaaaguauuagccuaaaauuuuauuuuuaaaaagucugaagaguaauaccaaau

SEQ ID NO: 548813 - RNA, 64 nt, Homo Sapiens
cauuguaagauucuuucugucaaauucguaaacuuuuuaaaaaagcuuugaauauggcccgaca

SEQ ID NO: 548814 - RNA, 64 nt, Homo Sapiens
uccagacuugcuuacaucuaacaggggacccguauuuuaaaaucauaaacuaugcuacucucau

SEQ ID NO: 548815 - RNA, 64 nt, Homo Sapiens
augcuauaaacuaugcuacuuuaccgaaugccauuuuuaaaaguuuucuguccagaaggcaaaa

SEQ ID NO: 548816 - RNA, 64 nt, Homo Sapiens
gagaauuagaaaauauuaaaaacagcauccuuuuuuuuaaaagacuuuuuuuuuuucccaaucc

SEQ ID NO: 548817 - RNA, 64 nt, Homo Sapiens
cauguuuuugguugggcucuuguuuauuucuuuguuuuaaaagcgguauuugguuguuuuuguu

SEQ ID NO: 548818 - RNA, 64 nt, Homo Sapiens
cacugucccaguggauugauaacugccaguaauuuuuuaaaaagaaaauaugaaaugugugcuc

SEQ ID NO: 548819 - RNA, 64 nt, Homo Sapiens
uucaauggcuuguucauccuguagcuaaaccaauuuuuaaaagaugccacccccaaacuuuaag

SEQ ID NO: 548820 - RNA, 64 nt, Homo Sapiens
ugacucucccagagaagaaggugucugaaaccgguuuuaaaaugcccgugccagcccuucuuuu

SEQ ID NO: 548821 - RNA, 64 nt, Homo Sapiens
uguuaugcaggcuuaacgugaacuaauuucaagauuuuaaaaaagcucucaauuaaguguuggg

SEQ ID NO: 548822 - RNA, 64 nt, Homo Sapiens
aagccacauaucuagauuuugcaaaucuucuguuuuuuaaaaauauuuugcaguguuuaaguca

SEQ ID NO: 548823 - RNA, 64 nt, Homo Sapiens
agugauuuggaugaaggcauuuauucaacuuuacuuuuaaaaucauauuucauagggcccuguc

SEQ ID NO: 548824 - RNA, 64 nt, Homo Sapiens
agaaacuaaauaaaauuauuugaaaugcuaccuuuuuuaaaauauugagucuaaauuuauaugu

SEQ ID NO: 548825 - RNA, 64 nt, Homo Sapiens
ggaucugggguauauucauucaggaaguuuuuauuuuuaaaacuacaguauuguaucauaauua

SEQ ID NO: 548826 - RNA, 64 nt, Homo Sapiens
uuauuugccuaaaauuagcaugcaaagacuucaguuuuaaaacagguguuugagcucaccucca

SEQ ID NO: 548827 - RNA, 64 nt, Homo Sapiens
ucuuaugauuuuaaauaccuuuucaaaaauugaauuuuaaaauugccaaagcucaggggaaauu

SEQ ID NO: 548828 - RNA, 64 nt, Homo Sapiens
uuauccaggcaugguggugcucucuacaaagaaauuuuaaaagagcaacauagcgagaccccca

SEQ ID NO: 548829 - RNA, 64 nt, Homo Sapiens
uaugcaugaaaacaggugguaaaaaugacucaccuuuuaaaaauccuuuaaaauauguaauguc

SEQ ID NO: 548830 - RNA, 64 nt, Homo Sapiens
uuugcauuuuaccaccaguaacaaaauaaacauauuuuaaaacaaaguauucauuguaaaacau

SEQ ID NO: 548831 - RNA, 64 nt, Homo Sapiens
uggcagagugacuuaacugaugugaaucguauuauuuuaaaaagguuuaugugauugaagcaaa

SEQ ID NO: 548832 - RNA, 64 nt, Homo Sapiens
gcauuaugaccuagcccccaaguuaauauaaagauuuuaaaacuuguaucugugagaaucucau

SEQ ID NO: 548833 - RNA, 64 nt, Homo Sapiens
uauuuuguggcaauguaucuugacuaucuauggcuuuuaaaaaaaaauuagacauuuuuuauuu

SEQ ID NO: 548834 - RNA, 64 nt, Homo Sapiens
cugguauuuuguaaauguguuaauuugaccaaaauuuuaaaaaaguuuuuaaaucaaccacuca

SEQ ID NO: 548835 - RNA, 64 nt, Homo Sapiens
aaaaauagaaguuuuuauugcacuguguauauuauuuuaaaauagacggucuugaagaaaauaa

SEQ ID NO: 548836 - RNA, 64 nt, Homo Sapiens
agcuuuauucuaagcaaauccaacuuuugugugcuuuuaaaaucuuaauccucuccuuuguguu

SEQ ID NO: 548837 - RNA, 64 nt, Homo Sapiens
uaucugcaaccuuaauucagugauguguguuguauuuuaaaaauuaauuuuaauauacuaguca

SEQ ID NO: 548838 - RNA, 64 nt, Homo Sapiens
uaggaaacacuaaauaguguaauauuucuuuugcuuuuaaaaaaauuccugguagcaaaucaag

SEQ ID NO: 548839 - RNA, 63 nt, Homo Sapiens
auuacccuggguauuaaaaagaacuccuuucacauuuuaaaauaacaaucugagcacuucaua

SEQ ID NO: 548840 - RNA, 64 nt, Homo Sapiens
uaaauauuugaaccacugaauuuuaauaacaaaauuuuaaaauuggcaugaauacggaauacug

SEQ ID NO: 548841 - RNA, 64 nt, Homo Sapiens
guuuacuccuugcucuuacaacauuucuaaggauuuuuaaaaguuuacuucuugucuuguucuu

SEQ ID NO: 548842 - RNA, 64 nt, Homo Sapiens
gaugcauaucauuuuucuauaaguaaucaguugcuuuuaaaaucagaaggcuauauuauucuaa

SEQ ID NO: 548843 - RNA, 64 nt, Homo Sapiens
guucuccucccuuuauaaauuuuauucauaggacuuuuaaaaggcuugugcuaucuuuccagug

SEQ ID NO: 548844 - RNA, 64 nt, Homo Sapiens
gccagauuuucuguaguaaaacuuuuaaauauuauuuuaaaagaaauauguauauaaauaucuc

SEQ ID NO: 548845 - RNA, 64 nt, Homo Sapiens
aaaauuggucucuuuagagaccaauuugccuaaauuuuaaaaucuuccuacacacaucuagacg

SEQ ID NO: 548846 - RNA, 64 nt, Homo Sapiens
gucucauguuuguauuuggucccaguuggguacauuuuaaaauccugauuuuggagacuuaaaa

SEQ ID NO: 548847 - RNA, 64 nt, Homo Sapiens
guuugugauuaaauucauugugauugcacaaaaauuuuaaaaacacgugauguaaacuugcaag

SEQ ID NO: 548848 - RNA, 64 nt, Homo Sapiens
agcuguuugggugguuggaauaauuuuauuuuucuuuuaaaaaagcuaacaucagaccccuuua

SEQ ID NO: 548849 - RNA, 64 nt, Homo Sapiens
ucuugaaggcaauccuuccucuggccaggaaauuuuuuaaaaaauaauacuguguuguguuuau

SEQ ID NO: 548850 - RNA, 64 nt, Homo Sapiens
cuuucucaaauguaggcuuuuuacaaauuuuaaauuuuaaaauauuaguuuaaauguguguuau

SEQ ID NO: 548851 - RNA, 64 nt, Homo Sapiens
ggucacauguuuuuccuucagcuugaaagcuuuuuuuuaaaaggaaaagauaccaaaugccugc

SEQ ID NO: 548852 - RNA, 64 nt, Homo Sapiens
aggguggugggaaaugggggaucuucaauguuuauuuuaaaauaaaauaaaauaaguucuugac

SEQ ID NO: 548853 - RNA, 64 nt, Homo Sapiens
auauaaaucaucucauguggauaugaaacuucuuuuuuaaaacuuaaaaagguagaauguuauu

SEQ ID NO: 548854 - RNA, 64 nt, Homo Sapiens
uuuuacucacaggaaugucacuguuggacaauuauuuuaaaaguguauaaaaccaagucucaua

SEQ ID NO: 548855 - RNA, 64 nt, Homo Sapiens
gcaauuaccaaaaauccuuuuauggaaaccauuuuuuuaaaaagugaauguacacaaauccaca

SEQ ID NO: 548856 - RNA, 64 nt, Homo Sapiens
aguguuucaacaagauguugcugcaggagcagcuuuuuaaaacaagauaaaacucacaggggaa

SEQ ID NO: 548857 - RNA, 64 nt, Homo Sapiens
uaaaacaagauaaaacucacaggggaauguacuuuuuuaaaaaaaaaugaaaaagaaaaaaaaa

SEQ ID NO: 548858 - RNA, 64 nt, Homo Sapiens
aguuguauuuugaaaugaugugucaggaaaaguuuuuuaaaaacuuguauguuuuugcaaaucc

SEQ ID NO: 548859 - RNA, 64 nt, Homo Sapiens
gacaaguuguggcaaaggaaacuauacuuuucauuuuuaaaaauguaaauagaaaaguuuuuaa

SEQ ID NO: 548860 - RNA, 64 nt, Homo Sapiens
cacaaagaagagauaacuuccaaaagagugcuguuuuuaaaaauaauaauuaggaaauguuuau

SEQ ID NO: 548861 - RNA, 64 nt, Homo Sapiens
uaaaauauuacuaacuuaaggguuucuaugugcuuuuuaaaauauuccuucuuugauguugaca

SEQ ID NO: 548862 - RNA, 64 nt, Homo Sapiens
uaggcaagcucuccuuauaaguaaggcuuucaauuuuuaaaacagacauccugcuuuaacaauu

SEQ ID NO: 548863 - RNA, 64 nt, Homo Sapiens
aaugaauaaauaaaauaaaaauaaaaauguuacuuuuuaaaaaguaacuuuuuuaauaauauaa

SEQ ID NO: 548864 - RNA, 64 nt, Homo Sapiens
uaauaacuggucagaaaaauuuagacggucuucauuuuaaaauuggcaucaggaaggauuacca

SEQ ID NO: 548865 - RNA, 64 nt, Homo Sapiens
uuggcaaaugaauccauauugacauauuugauuuuuuuaaaaacauggaaacguacuguuuugu

SEQ ID NO: 548866 - RNA, 64 nt, Homo Sapiens
uuuuugccaauguaauuaaaaaaugguaugucauuuuuaaaauuuguauuucuuucauuacaaa

SEQ ID NO: 548867 - RNA, 64 nt, Homo Sapiens
agaaacuugcauucaugaagagcccauuaucaacuuuuaaaagugaauuugauuuguacccacc

SEQ ID NO: 548868 - RNA, 64 nt, Homo Sapiens
uauucaugcacugaaaaaugcuguuaucuuuuguuuuuaaaaaaugcaauuaaaacuagaaaua

SEQ ID NO: 548869 - RNA, 64 nt, Homo Sapiens
acuugccaaauauauguacauauauauuuauauauuuuaaaaauaaacauuuuuuaaaucguca

SEQ ID NO: 548870 - RNA, 64 nt, Homo Sapiens
ugccaaaggaggaaacaggaaaaauugccguccauuuuaaaaauuuagguuuguuguuuuaaac

SEQ ID NO: 548871 - RNA, 64 nt, Homo Sapiens
cuuuuuaagaugucuauuauauuuacuuauuaguuuuuaaaaauugcgcuacuugccugggaaa

SEQ ID NO: 548872 - RNA, 64 nt, Homo Sapiens
ggaaacauagcagaccucguuucuacuaaaaauuuuuuaaaaaagaaaauuagggcaaggugug

SEQ ID NO: 548873 - RNA, 64 nt, Homo Sapiens
caacaugaugugaaaacccaucucuacaaaaauuuuuuaaaaaauaagccagggauuguggcau

SEQ ID NO: 548874 - RNA, 64 nt, Homo Sapiens
ccagauaaguuauuuauaaugggcauuacugaauuuuuaaaaugccgauuacacccaaauauug

SEQ ID NO: 548875 - RNA, 64 nt, Homo Sapiens
gaaggguagaaaacuucaaggaaaauaagugaaauuuuaaaagucagcauuuucuuagaccucu

SEQ ID NO: 548876 - RNA, 64 nt, Homo Sapiens
accuuugaaagaguuuaaucuuaacguuuucuaauuuuaaaauuuuaaaaucuuguuuaacaaa

SEQ ID NO: 548877 - RNA, 64 nt, Homo Sapiens
aagaguuuaaucuuaacguuuucuaauuuuaaaauuuuaaaaucuuguuuaacaaaagcuugua

SEQ ID NO: 548878 - RNA, 64 nt, Homo Sapiens
uagacuucugaauaagaugauagacgagaauuuuuuuuaaaaaaggaauuuaaaggaaucuugu

SEQ ID NO: 548879 - RNA, 64 nt, Homo Sapiens
uaucuuccaaacccaaucuaguaggauguucucauuuuaaaaacgaggggaaaagaccagaguu

SEQ ID NO: 548880 - RNA, 64 nt, Homo Sapiens
cccuaaauauaguuauauuucauacuuaguuuguuuuuaaaaaguuuucucuguagaaaauuuu

SEQ ID NO: 548881 - RNA, 64 nt, Homo Sapiens
caguuuuguuugaaaguuguuuguccguaugauuuuuuaaaagucaaguuuaauuucaaaaaac

SEQ ID NO: 548882 - RNA, 64 nt, Homo Sapiens
cccacagcaacugccaaugaaggaugaauccccuuuuuaaaaaguuguuguuguuguuguuuau

SEQ ID NO: 548883 - RNA, 64 nt, Homo Sapiens
accauacaaucauguacucuuuaacagaaauugcuuuuaaaaaauaucuggaacuaucuuuaaa

SEQ ID NO: 548884 - RNA, 64 nt, Homo Sapiens
uuuuugaaaguaaaauaauucacaagcuuugguauuuuaaaauuauuguuaaacauaucauaac

SEQ ID NO: 548885 - RNA, 64 nt, Homo Sapiens
ugauacccuaaucuugcuucuggaucuguucuuuuuuuaaaaaaacuuccuucaccgcgccuau

SEQ ID NO: 548886 - RNA, 64 nt, Homo Sapiens
aauauauugucauacaauguuaaauaaccuauuuuuuuaaaaaaguucaacuuaagguagaagu

SEQ ID NO: 548887 - RNA, 64 nt, Homo Sapiens
auugcgaaaucaagucugucaaguacaauaacauuuuuaaaagaaaauggaucccacuguuccu

SEQ ID NO: 548888 - RNA, 64 nt, Homo Sapiens
cauuucaaauuggacucgauauguuugugugcuguuuuaaaauuuugugcgcugggggcuugug

SEQ ID NO: 548889 - RNA, 64 nt, Homo Sapiens
uuucugaaaagugaacagaguucagauuaccuaauuuuaaaaugauuagacuugcugaguuuaa

SEQ ID NO: 548890 - RNA, 64 nt, Homo Sapiens
auuuuuuaauuaaauucaaggugggagucguuuuuuuuaaaaaauggugaguaacacacauaua

SEQ ID NO: 548891 - RNA, 64 nt, Homo Sapiens
aaacuucccaugucuuccauaucauuugucccccuuuuaaaaaucuuuuauuuuugcuauucug

SEQ ID NO: 548892 - RNA, 64 nt, Homo Sapiens
uacguguuccacagaauaaauaaauugcacauauuuuuaaaaguggagcauuuauuuuguuaau

SEQ ID NO: 548893 - RNA, 64 nt, Homo Sapiens
guuaagagaguccuugugaguuucucaguccugauuuuaaaacagucugucugauuugcugaac

SEQ ID NO: 548894 - RNA, 64 nt, Homo Sapiens
ugcuaucauguauauuuacacaacuauuuacaaguuuuaaaaauguguuguaauuuuguaaggc

SEQ ID NO: 548895 - RNA, 64 nt, Homo Sapiens
auauuaacagcuguuagguuaaaccugaagauguuuuuaaaacauuaagcaauuuauaaaucua

SEQ ID NO: 548896 - RNA, 64 nt, Homo Sapiens
ugauuuucuauaacugaagauuuuuaaaaaucuauuuuaaaauguaaagaacagcuguuaauau

SEQ ID NO: 548897 - RNA, 64 nt, Homo Sapiens
cuauuuuaaaaugugauuuucagcuguuaauauuuuuuaaaaauauuaagcacaagauaaagaa

SEQ ID NO: 548898 - RNA, 64 nt, Homo Sapiens
ugugguaauacccagaauggugcuaugcuucuacuuuuaaaauuuuuuuaaaauaacuggcaaa

SEQ ID NO: 548899 - RNA, 64 nt, Homo Sapiens
acuggcaaaugcuaugcuucguauugacucgguuuuuuaaaauaaagaacuuugagacuaauuu

SEQ ID NO: 548900 - RNA, 64 nt, Homo Sapiens
uaucauuguccuccuccucuagccucaaauauguuuuuaaaaaauggcgugagccaccaugccc

SEQ ID NO: 548901 - RNA, 64 nt, Homo Sapiens
gacaggaucuugcuuugucuuuguuuguuuuuuguuuuaaaagauuuuuuguuuuuuuuuuggu

SEQ ID NO: 548902 - RNA, 64 nt, Homo Sapiens
guugagaccaaaguaguauaaaaauuaauugauguuuuaaaaauuuguuaaauuguaaauuuuc

SEQ ID NO: 548903 - RNA, 64 nt, Homo Sapiens
cuuuuuuaauauuaaaauguaguuguuauagauuuuuuaaaaugaaaugcagauuuugucauaa

SEQ ID NO: 548904 - RNA, 64 nt, Homo Sapiens
aagaauuuagaagugguaaauuaucuuuauuauuuuuuaaaaauguaaaugguagugaguuaaa

SEQ ID NO: 548905 - RNA, 64 nt, Homo Sapiens
ccugaguguaaguuaccaugaaauauuuguugccuuuuaaaaucgguugucuuuuaaguuuuuu

SEQ ID NO: 548906 - RNA, 64 nt, Homo Sapiens
ccuuuaaaaaauaaaaggauuuuguaguuucaaauuuuaaaagugcagaauguaugaaauccgu

SEQ ID NO: 548907 - RNA, 64 nt, Homo Sapiens
uggauggcuuaugauuguaauuucaacaguuuuauuuuaaaaaccgcuugaagauuugugaguu

SEQ ID NO: 548908 - RNA, 64 nt, Homo Sapiens
aaauuuugguuccaauucugguuaaaaacucacauuuuaaaagcaagaaugaaauccuucaagu

SEQ ID NO: 548909 - RNA, 64 nt, Homo Sapiens
uuuuauacuuacaaaaaucuuggacauaccuuuguuuuaaaauaauaguucucuagcuaaggaa

SEQ ID NO: 548910 - RNA, 64 nt, Homo Sapiens
uaugaauuacuguaaaauaauucaaaguaacuuguuuuaaaaaaccuccuuauuagaguugaac

SEQ ID NO: 548911 - RNA, 64 nt, Homo Sapiens
aucagauugcaauagacauuuauggauuucugucuuuuaaaacauccaggcaucaagcucauuu

SEQ ID NO: 548912 - RNA, 64 nt, Homo Sapiens
acauuuuuguuuauuuaaaaaaucauaacauugauuuuaaaaauauuuuugaaucuauuuuuaa

SEQ ID NO: 548913 - RNA, 64 nt, Homo Sapiens
auaacauugauuuuaaaaauauuuuugaaucuauuuuuaaaaucuucagauucagguguaugga

SEQ ID NO: 548914 - RNA, 64 nt, Homo Sapiens
uaaccccuccauccaggauaaaaacaugccuccuuuuuaaaaaauuuuaaaaaacaaaguugug

SEQ ID NO: 548915 - RNA, 64 nt, Homo Sapiens
caaaguugugaaaacaugccagcugcuaauuuuauuuuaaaaaauuuaaaauauuuuuuggaag

SEQ ID NO: 548916 - RNA, 64 nt, Homo Sapiens
uuuuuuggaagagcugcuaaaaucuuuuguuguauuuuaaaauaaaccucaaaggguuauuuga

SEQ ID NO: 548917 - RNA, 64 nt, Homo Sapiens
auaauacugugcaggcaagggcuuggguuuucuuuuuuaaaaaccucuuuaagcaauagauuuu

SEQ ID NO: 548918 - RNA, 64 nt, Homo Sapiens
gucaagaguuauucuguuuguguuucucccaagguuuuaaaauuaaaaugaaguucuaaugaac

SEQ ID NO: 548919 - RNA, 64 nt, Homo Sapiens
ucagguuagaacaaaaauguuuccagcacauuuuuuuuaaaaacgacuuuuuaaggguccuucu

SEQ ID NO: 548920 - RNA, 64 nt, Homo Sapiens
uaagagauauacagaugacuuaagggaauaaaaauuuuaaaaaucaaaaucuuuuuuuuauuuu

SEQ ID NO: 548921 - RNA, 64 nt, Homo Sapiens
uguaaaacaucuuuuguuuuaauuuuuguuuuauuuuuaaaaugacuggagaagauauguguag

SEQ ID NO: 548922 - RNA, 64 nt, Homo Sapiens
gagguccaguuuauucuaacacuaaaacuacauguuuuaaaacaaauuuuaaguauuaugaaau

SEQ ID NO: 548923 - RNA, 64 nt, Homo Sapiens
uuaggaauauaaauaaagauagugaguuugcugauuuuaaaaucuaggugcuuccucuauauca

SEQ ID NO: 548924 - RNA, 64 nt, Homo Sapiens
uugguuugagccuuaugcccaagcauuuccucuuuuuuaaaaaugguggucaaauucuggaagu

SEQ ID NO: 548925 - RNA, 64 nt, Homo Sapiens
uaugcauacguucuucacaagagguauccaaagcuuuuaaaauuggucuuaauugccuuuagca

SEQ ID NO: 548926 - RNA, 64 nt, Homo Sapiens
aacugcauuauggaguuuauuuuuuaaaauaaaguuuuaaaaauuuuuaaaauagaugcucaua

SEQ ID NO: 548927 - RNA, 64 nt, Homo Sapiens
aaguuuuaaaaauaacugcaauagaugcucauauuuuuaaaauauaauuaucaaaacuuuuaaa

SEQ ID NO: 548928 - RNA, 64 nt, Homo Sapiens
gaugcucauauuuuuaaaauauaauuaucaaaacuuuuaaaauaaucacaagaaaauaauggca

SEQ ID NO: 548929 - RNA, 64 nt, Homo Sapiens
aaugugaaaacauagacuuaaaacaugcuauauuuuuuaaaaucugcuuaaucauuuguaauuc

SEQ ID NO: 548930 - RNA, 64 nt, Homo Sapiens
aguaagaguuugcugcccaagugaugccauaccauuuuaaaaguaaaaaccuuacuauuucuag

SEQ ID NO: 548931 - RNA, 64 nt, Homo Sapiens
uuaucuuuucacuuaguguuaauauauuaaagauuuuuaaaaguaaugcaaguucuacaaugau

SEQ ID NO: 548932 - RNA, 64 nt, Homo Sapiens
aagacgauuuaauuuuaauuggcuucuuuugcauuuuuaaaaaugguuguuaagucuacugucu

SEQ ID NO: 548933 - RNA, 63 nt, Homo Sapiens
uuucuucagaucccguucaggguguaccuuccauuuuaaaauuccaaaaguaaaaacuauuga

SEQ ID NO: 548934 - RNA, 64 nt, Homo Sapiens
uuauauugccucugccaaacuaaacaucuuacauuuuuaaaaaugcuaaaggcuaauggcauuu

SEQ ID NO: 548935 - RNA, 64 nt, Homo Sapiens
uguacucuggccgguugcagauccucauuccaaauuuuaaaauacauguucuaaaacaagagcu

SEQ ID NO: 548936 - RNA, 64 nt, Homo Sapiens
uggaccuuuucuggaagggcuaacuaauguuauuuuuuaaaaccagaaaauauacauuuguugg

SEQ ID NO: 548937 - RNA, 64 nt, Homo Sapiens
uuuguucuuuuauagacugacagccucugcaagauuuuaaaaguaggagaguuuacugaugaaa

SEQ ID NO: 548938 - RNA, 64 nt, Homo Sapiens
ggugacacucuuaucguaaauaaauuccucugacuuuuaaaaaucuguccucuugccuuuuacu

SEQ ID NO: 548939 - RNA, 64 nt, Homo Sapiens
cccuugugucucccagugaguuuuggggacagacuuuuaaaaugucugguuggaaaugccauug

SEQ ID NO: 548940 - RNA, 64 nt, Homo Sapiens
caccuauuugggaucauuugaguauuaaagcccuuuuuaaaaagccuauuugaacuacuuaaac

SEQ ID NO: 548941 - RNA, 64 nt, Homo Sapiens
cuucugauuggauauuguguuucccauugaucauuuuuaaaaggguauauguagagaaaaauac

SEQ ID NO: 548942 - RNA, 64 nt, Homo Sapiens
auccuucaggcauaaauauuaagccucuugccacuuuuaaaauuaacaaugcuuaggcuuuucu

SEQ ID NO: 548943 - RNA, 64 nt, Homo Sapiens
guaaauuacaucugaaggcuguuuuaaagugcaauuuuaaaacuauacugucuaaaaaagcaaa

SEQ ID NO: 548944 - RNA, 64 nt, Homo Sapiens
uuguaugauuuacauaugaauuuccaauacuauuuuuuaaaaaaaauguauagaccuugauauu

SEQ ID NO: 548945 - RNA, 64 nt, Homo Sapiens
ugucuucuuauuuugguuucuuuuuuucuuuuucuuuuaaaaaaaguaacucuuucuuuccguu

SEQ ID NO: 548946 - RNA, 64 nt, Homo Sapiens
uguuuucuggggaaaggggacacuaacugcugguuuuuaaaaaaugcugacugaacauuaguug

SEQ ID NO: 548947 - RNA, 64 nt, Homo Sapiens
cccaacuuuuuuuuuuuaauacgcugguuuugguuuuuaaaaagcgaagggacaucuuuggaaa

SEQ ID NO: 548948 - RNA, 64 nt, Homo Sapiens
acaaaaacaaaacaacaacaccgcucccuaaauuuuuuaaaaagcucccuuccccgugguggcc

SEQ ID NO: 548949 - RNA, 64 nt, Homo Sapiens
aaaugcaaaaaaauucuuauaagugucgauguuuuuuuaaaaaagcuuagagauguagcgaugu

SEQ ID NO: 548950 - RNA, 64 nt, Homo Sapiens
cagaacugagguagcuuagagaaaagcaggugcuuuuuaaaaauagaagcaagaugaaaaaaag

SEQ ID NO: 548951 - RNA, 64 nt, Homo Sapiens
ugaaaauuuagaagcaagauauauaauuuauauuuuuuaaaagcauuuuccaacuuguauuuuc

SEQ ID NO: 548952 - RNA, 64 nt, Homo Sapiens
acacguuaacuucagaggaaguugcguuuaugcuuuuuaaaaacgugguuuauacacuggaaau

SEQ ID NO: 548953 - RNA, 64 nt, Homo Sapiens
cauccaugaaaaagugucuuauguguccaaucauuuuuaaaaaucuuaacagagaaagagacua

SEQ ID NO: 548954 - RNA, 64 nt, Homo Sapiens
accuggauuugaagagauggccaaggucauagauuuuuaaaaggagguauucugcacauucauu

SEQ ID NO: 548955 - RNA, 64 nt, Homo Sapiens
cacagaggaaaauauugugggcaguuguuuuaaguuuuaaaauaaauggaauguucauuuuaug

SEQ ID NO: 548956 - RNA, 64 nt, Homo Sapiens
aaaaucuuuaaacuggccuuaagguuuaaacuuuuuuuaaaaaaauuguuuaaucuuuuuaaaa

SEQ ID NO: 548957 - RNA, 64 nt, Homo Sapiens
gguuuaaacuuuuuuuaaaaugauuguuuaaucuuuuuaaaaaaugaguaccuuuuugcuagcc

SEQ ID NO: 548958 - RNA, 64 nt, Homo Sapiens
gcaacggucccuaauagaguuaucucaagguauuuuuuaaaaaagugaugacuucuaaugcuua

SEQ ID NO: 548959 - RNA, 64 nt, Homo Sapiens
uacaauugugaguuguguuggcauuaaaacuguauuuuaaaaaaagacagaaauuuaagggaaa

SEQ ID NO: 548960 - RNA, 64 nt, Homo Sapiens
aauucaggucaguuucaguauuuuucaaauauuuuuuuaaaacugaauugcaauugugccaagc

SEQ ID NO: 548961 - RNA, 64 nt, Homo Sapiens
ccuuggacuuuuagcuguuaaaugguaucucauuuuuuaaaacacauuucacauuuaaagucau

SEQ ID NO: 548962 - RNA, 64 nt, Homo Sapiens
ucuucagaguaaucagguaaagcuuaaacaaguguuuuaaaagaugaguuuuuccuacauucug

SEQ ID NO: 548963 - RNA, 64 nt, Homo Sapiens
ugccaacguugucuuugauaauauuuaauauauuuuuuaaaaaacaauucuuguaaaauacuuu

SEQ ID NO: 548964 - RNA, 64 nt, Homo Sapiens
cugcuugaugaagcaaggaagauauacaugaaaauuuuaaaaauacauaucgcugacuucaugg

SEQ ID NO: 548965 - RNA, 64 nt, Homo Sapiens
uaucuaaaguuuguuagauagcugcauguggcuuuuuuaaaaaagcaacagaaaccuauccuca

SEQ ID NO: 548966 - RNA, 64 nt, Homo Sapiens
auuauccauuugaucuauagcaaugugauuuuauuuuuaaaaagaaaagcaguguguuuucuuu

SEQ ID NO: 548967 - RNA, 64 nt, Homo Sapiens
uaucugcgaaguaaucugcaaucucuuuuguucuuuuuaaaauuugauuuguuauaaaauugcc

SEQ ID NO: 548968 - RNA, 64 nt, Homo Sapiens
acauuuagcuucaaauuguaacaauucaauugaauuuuaaaaugacaccugaaaagauacaucu

SEQ ID NO: 548969 - RNA, 64 nt, Homo Sapiens
acuaacuaaggucccauaauaaaaagauaguaucuuuuaaaaugaaauguuuuugcuauagauu

SEQ ID NO: 548970 - RNA, 64 nt, Homo Sapiens
uuuuaaaaugaaauguuuuugcuauagauuuguauuuuaaaacauaagaacgucauuuugggac

SEQ ID NO: 548971 - RNA, 64 nt, Homo Sapiens
uuuugcaguauauuucugaaaugacagaaugcuguuuuaaaaacaaagaaauaaaauccugcuc

SEQ ID NO: 548972 - RNA, 64 nt, Homo Sapiens
agguggaguaaucuguggauuuguuucuguugucuuuuaaaaugucaaauauauaauauguaau

SEQ ID NO: 548973 - RNA, 64 nt, Homo Sapiens
ucuuuuaaaaugucaaauauauaauauguaauuuuuuuaaaaaccaccagauacagaaaugugc

SEQ ID NO: 548974 - RNA, 64 nt, Homo Sapiens
aauugguagaugaaaaaaaccugguucaaguuuuuuuuaaaauguggugucccauuccaaggga

SEQ ID NO: 548975 - RNA, 64 nt, Homo Sapiens
caaagucaauaauugggacaaaugguaaagaugauuuuaaaaucuguuguauuuaggucccuug

SEQ ID NO: 548976 - RNA, 64 nt, Homo Sapiens
gaauuuccagugaccuguaauuucauuacauauauuuuaaaaucuauuuauuuuagaugguguu

SEQ ID NO: 548977 - RNA, 64 nt, Homo Sapiens
aauuuucuauucaccguacuuauccaaaaaucucuuuuaaaaaguaaauuugugcaacaacguu

SEQ ID NO: 548978 - RNA, 64 nt, Homo Sapiens
uguuuuuuuaaccaugaaaugacaauaaaaugauuuuuaaaaugagaauguuuuggauaaguga

SEQ ID NO: 548979 - RNA, 64 nt, Homo Sapiens
acucaguuugaaacuauucauuucuacacacuauuuuuaaaaauugccuacuaggugaaacaua

SEQ ID NO: 548980 - RNA, 64 nt, Homo Sapiens
gguauuuaggcuggcaauauauauauuaaccauauuuuaaaaguaccaauuuuguuuuuacaga

SEQ ID NO: 548981 - RNA, 64 nt, Homo Sapiens
aauucaccugauuauuagauaacuuaaaguuuauuuuuaaaagcugacaacuuuuuaugaaucu

SEQ ID NO: 548982 - RNA, 64 nt, Homo Sapiens
uuaaaucguauuauuuuuuucuuaacagaaauauuuuuaaaaaugaaaaaguacucaaaaguga

SEQ ID NO: 548983 - RNA, 64 nt, Homo Sapiens
aucuguaauuuaaauguuucuaguaaccacauuuuuuuaaaaguaaaaagaaacccaugguauu

SEQ ID NO: 548984 - RNA, 64 nt, Homo Sapiens
aacucaccaucuccugaagaccuuucuuaccuuuuuuuaaaaacaaaaaaugaaauuauuuugc

SEQ ID NO: 548985 - RNA, 64 nt, Homo Sapiens
agaguauugaagauugaaaggguuuuucuuucuuuuuuaaaaaagaaaaacaaacuauugauug

SEQ ID NO: 548986 - RNA, 64 nt, Homo Sapiens
ggcaagauuucccaguaaagauuuucugugcguauuuuaaaagucguguuaauacucaugauaa

SEQ ID NO: 548987 - RNA, 64 nt, Homo Sapiens
guguucuuuugaaauguucaucaggaauaggcuuuuuuaaaaaauguuguguaucuguauauag

SEQ ID NO: 548988 - RNA, 64 nt, Homo Sapiens
ugaaugcaaaaaggaaaaaaacccacaaacauguuuuuaaaauaaaauaucuuuuuuugccuug

SEQ ID NO: 548989 - RNA, 64 nt, Homo Sapiens
aaguuuucgauguauuggaauuauuugggaaugcuuuuaaaacaauuuguaauuauuucuuuac

SEQ ID NO: 548990 - RNA, 64 nt, Homo Sapiens
aguuauggacuuuuuugaugcauguguguauguguuuuaaaaaguaugcaggcucuaaaaaugu

SEQ ID NO: 548991 - RNA, 64 nt, Homo Sapiens
cugaguaaauuuuacuuguaaucuacaauuggcuuuuuaaaaauaaccuguugauauauaauug

SEQ ID NO: 548992 - RNA, 64 nt, Homo Sapiens
guugcaagagugaauguaaaaaauaguuguggcauuuuaaaaggucgccuuugaugcagaugca

SEQ ID NO: 548993 - RNA, 64 nt, Homo Sapiens
uauucauauaaugacuuuuuuuuaagagucucuuuuuuaaaaaaacuuaauucucuaaaaccga

SEQ ID NO: 548994 - RNA, 64 nt, Homo Sapiens
uuaauucucuaaaaccgaaaugguucaugcuucuuuuuaaaaaugauuguauaaaauguaugga

SEQ ID NO: 548995 - RNA, 64 nt, Homo Sapiens
agagggugaaaaaaguuaagggaaaagacuuugcuuuuaaaaaaauguuucaaaagaaagguau

SEQ ID NO: 548996 - RNA, 64 nt, Homo Sapiens
cacagucuacuggguagguauuguaaauaauaauuuuuaaaacuugcacaaaucaaaacaaaca

SEQ ID NO: 548997 - RNA, 64 nt, Homo Sapiens
gacuuuaauuguaaaagccguuaauguagaaaacuuuuaaaaaaauuaauauggcagaauacga

SEQ ID NO: 548998 - RNA, 64 nt, Homo Sapiens
aaacccaacucuucaugauuugccugugacuuauuuuuaaaacuuuuuuaaaaaagauuuagcu

SEQ ID NO: 548999 - RNA, 64 nt, Homo Sapiens
uucaugauuugccugugacuuauuuuuaaaacuuuuuuaaaaaagauuuagcuuuaaaauaguu

SEQ ID NO: 549000 - RNA, 64 nt, Homo Sapiens
aaaccugaucuuuccuaauccucacuuuuuucuuuuuuaaaaagcaguuucuccacugcuaaau

SEQ ID NO: 549001 - RNA, 64 nt, Homo Sapiens
cugacuguuauaaaguauaacaacacacaucagguuuuaaaaagccuugaauggcccuugucuu

SEQ ID NO: 549002 - RNA, 64 nt, Homo Sapiens
uauagcuuauaugauuuuuuugccuugguauacauuuuaaaauaugaauuuaaaaaauuuuugu

SEQ ID NO: 549003 - RNA, 64 nt, Homo Sapiens
aaguugugaccauaagguuuaauuucaaaguuccuuuuaaaagagguuaaggaacuguguuacc

SEQ ID NO: 549004 - RNA, 64 nt, Homo Sapiens
gguaguuuugugugacugugacuaaacuauuuuauuuuaaaaugucauucuuauuuauacauuc

SEQ ID NO: 549005 - RNA, 64 nt, Homo Sapiens
ugauuuucuuuugggagucacuuuuaaucuguaauuuuaaaauacaagucugaauauuuauagu

SEQ ID NO: 549006 - RNA, 64 nt, Homo Sapiens
gugugagacuuuuucauuaaauaauauugaaagauuuuaaaauucauuugaaagucugauggcu

SEQ ID NO: 549007 - RNA, 64 nt, Homo Sapiens
ccaaaggcucuacuuucaaagguuaagaaugagauuuuaaaauuggauuuuugccuggacuuga

SEQ ID NO: 549008 - RNA, 64 nt, Homo Sapiens
aaaacaucagauuaaauaauuacacuguucaggcuuuuaaaaaaauaccacugugagaauaaag

SEQ ID NO: 549009 - RNA, 64 nt, Homo Sapiens
gaauaaagcgcuagcaagauacaucacuuacugauuuuaaaaauacagaaagauuuugaguaaa

SEQ ID NO: 549010 - RNA, 64 nt, Homo Sapiens
agguauguaaguuauuaaaugguuaaucauggccuuuuaaaaauaaaauaaagugauaccuuua

SEQ ID NO: 549011 - RNA, 64 nt, Homo Sapiens
gaucaucuaauuuccugcuuaccuuaacugggaauuuuaaaaaguuggccuaaaaauguuccau

SEQ ID NO: 549012 - RNA, 64 nt, Homo Sapiens
guugcauuucuuaaaaaagaguaauaaaaaggauuuuuaaaaaguaauuccuuaaacauaccau

SEQ ID NO: 549013 - RNA, 64 nt, Homo Sapiens
gaggcugggaugauggagaaagcucgaggugaaguuuuaaaaaaaaaguuguggaaaggaaagu

SEQ ID NO: 549014 - RNA, 64 nt, Homo Sapiens
uaaauaugcacaauauuccauagcucacugaggauuuuaaaauuauaagcauaggauuuuauau

SEQ ID NO: 549015 - RNA, 64 nt, Homo Sapiens
aaaaaaagccaaauuucacagucuuaauaacuuuuuuuaaaaaaaacuaaaaggcgcuucaugu

SEQ ID NO: 549016 - RNA, 64 nt, Homo Sapiens
gggacuggaaaguuauguucaaaggcugaagcuauuuuaaaacauuauuuugacuacuaagugg

SEQ ID NO: 549017 - RNA, 64 nt, Homo Sapiens
cgcuagcugauuuuaacuuuaggaauaaaauuaguuuuaaaagcuuuuguuuacauugucuugg

SEQ ID NO: 549018 - RNA, 64 nt, Homo Sapiens
acugagaguugauauggccaaagggagagaggccuuuuaaaauauauauauauauacacauaua

SEQ ID NO: 549019 - RNA, 64 nt, Homo Sapiens
guugauaauuuuacugaucuaaagcugagugauuuuuuaaaagaauuugaauuuggcuuccuca

SEQ ID NO: 549020 - RNA, 64 nt, Homo Sapiens
aucgccaugcaaauuacaaucuugaaugaguguuuuuuaaaaauaaaguauuagaaaaaugugu

SEQ ID NO: 549021 - RNA, 64 nt, Homo Sapiens
uacacacuuaaucuuagcggauuacuucagauguuuuuaaaaaguauauuaagaugccuuuuca

SEQ ID NO: 549022 - RNA, 64 nt, Homo Sapiens
ucucaacaggcgcucacugaaguguaugaauauuuuuuaaaaagguuuuugcaguaagcuaguc

SEQ ID NO: 549023 - RNA, 64 nt, Homo Sapiens
uuaauucuuuauagaaaugugaacacugaauuuauuuuaaaaaauaauaauaaaaauuuaaaaa

SEQ ID NO: 549024 - RNA, 64 nt, Homo Sapiens
gagugaaccuaugacugcaguggaucucaaaaacuuuuaaaaccauagacaagccuuauagagu

SEQ ID NO: 549025 - RNA, 64 nt, Homo Sapiens
agugguugacagauguucacuuugaagugugaaguuuuaaaaauacgugaauaaauugguuauu

SEQ ID NO: 549026 - RNA, 64 nt, Homo Sapiens
aaaguauguguaauaugaagaauguuucugccuuuuuuaaaaaauguugaguguuguuuccuuc

SEQ ID NO: 549027 - RNA, 60 nt, Homo Sapiens
gauuuucaagguccuucuagcagcaaggccuuuuaaaacuccaugaaaaagacuauguga

SEQ ID NO: 549028 - RNA, 64 nt, Homo Sapiens
uuuuuuuccaauuuauuucuuugcaaauuaaacauuuuaaaauacaauuccaguauuauguaua

SEQ ID NO: 549029 - RNA, 64 nt, Homo Sapiens
augcuacaaaaagccccaaaaucuguacaacugauuuuaaaaaaaaacaauuucguuuaauggg

SEQ ID NO: 549030 - RNA, 64 nt, Homo Sapiens
uacuuuucccucucuauauauuaacuagaugauguuuuaaaaauuuuuucugcccucccuauuu

SEQ ID NO: 549031 - RNA, 64 nt, Homo Sapiens
cuacuuuuucugcccucccuccauuuagcuuguguuuuaaaaaucgccccugagugcucaugua

SEQ ID NO: 549032 - RNA, 64 nt, Homo Sapiens
uggucaaucuucauagaugauaaauagaaagccuuuuuaaaauuuguaacauuuuucuauuguu

SEQ ID NO: 549033 - RNA, 64 nt, Homo Sapiens
gugaauuuaagugguaaggaagacggaaaaguguuuuuaaaauggagcacucauuaaaggcaga

SEQ ID NO: 549034 - RNA, 64 nt, Homo Sapiens
aagugucaagacaaaggcaaaguagaaaccaagauuuuaaaaugagcuuuuuugaaaacacauc

SEQ ID NO: 549035 - RNA, 64 nt, Homo Sapiens
ggauuuccucccaucacuguuuuuaaaucaagacuuuuaaaacucacagaaaguguuuucuuuu

SEQ ID NO: 549036 - RNA, 64 nt, Homo Sapiens
agcuaaauuacauagacuuaccuuguugaaguuuuuuuaaaaaaacagccuuaaagacaaaaau

SEQ ID NO: 549037 - RNA, 64 nt, Homo Sapiens
aaugaagugagauggcaugguaaaauguuacuuauuuuaaaauaaacaauccuuuugauaaauu

SEQ ID NO: 549038 - RNA, 64 nt, Homo Sapiens
uacuuuuaaauauuaacucagaaaacaaacucuuuuuuaaaaaugcauugcuuuuguuucuuaa

SEQ ID NO: 549039 - RNA, 64 nt, Homo Sapiens
acaguggaaguuuuuuuuucaccuuaaaugcuuauuuuaaaaugcaugcagacuguuagcuuuu

SEQ ID NO: 549040 - RNA, 64 nt, Homo Sapiens
uaugaugucagaauaaaaugucgcauccuuuuguuuuuaaaagaacauugagaagugcaaaugu

SEQ ID NO: 549041 - RNA, 64 nt, Homo Sapiens
gaaaaaaaaggauaaaaaaaagaaaacauacuuauuuuaaaaaaaaaagaaaacacaaauaagc

SEQ ID NO: 549042 - RNA, 64 nt, Homo Sapiens
cuggagagaauuuauaugucauuuagauaccaauuuuuaaaauaaccuaguucaaaaugaaauu

SEQ ID NO: 549043 - RNA, 64 nt, Homo Sapiens
ugaaugaagacaacuuaggucaauuuuuuuucaauuuuaaaagcagucuuuauuauauuugaag

SEQ ID NO: 549044 - RNA, 64 nt, Homo Sapiens
uugauuuacauuuauauuccuugcauuacugggauuuuaaaaguauaaauaaggaaagaagcug

SEQ ID NO: 549045 - RNA, 64 nt, Homo Sapiens
agaggcaagaaaauaaaaacaaaauuggugguuuuuuuaaaaaaauauauuucaagcuuauuuc

SEQ ID NO: 549046 - RNA, 64 nt, Homo Sapiens
cuaauaaucuucaucucaaauguucaacugauauuuuuaaaauuagcucaaauaucuguugcac

SEQ ID NO: 549047 - RNA, 64 nt, Homo Sapiens
agaauugccaauacagaaaaaauaaauccuuucauuuuaaaaaguacaaaucuuaaauauuuuu

SEQ ID NO: 549048 - RNA, 64 nt, Homo Sapiens
uaauuauuagauaaaggcucuuuguuuugacauauuuuaaaaguaugaagaugagacaucuuaa

SEQ ID NO: 549049 - RNA, 64 nt, Homo Sapiens
gaauuuagaguauuugggguguggguugacagauuuuuaaaauauaaagcauauuagaauaauu

SEQ ID NO: 549050 - RNA, 64 nt, Homo Sapiens
caggauugacuuuuuucucccaaaaaauguugaguuuuaaaaauuaauaucauucaaaaggaaa

SEQ ID NO: 549051 - RNA, 64 nt, Homo Sapiens
aauguuauagaagacucaugucacuucuguguguuuuuaaaauuuuuuuggaaaauagcacuuu

SEQ ID NO: 549052 - RNA, 64 nt, Homo Sapiens
ccagcuuuuaguacaggagauuguaauacuaguuuuuuaaaaguuaaagucaucacauuaaaca

SEQ ID NO: 549053 - RNA, 64 nt, Homo Sapiens
cuuucuuuugcuugaucccaacuguccuaucucauuuuaaaagacuuccaguauuuuuuaaaaa

SEQ ID NO: 549054 - RNA, 64 nt, Homo Sapiens
cuguccuaucucauuuuaaauuucuuccaguauuuuuuaaaaaauugaacauuauucacuuaga

SEQ ID NO: 549055 - RNA, 64 nt, Homo Sapiens
cagacaugaacuugcaugucuugaaaucaagacuuuuuaaaaguagggauuucauggccucuuc

SEQ ID NO: 549056 - RNA, 64 nt, Homo Sapiens
cuaagucuuauaauuaugacaguugagaguuuuauuuuaaaaagaaaauuaaaaggguagacac

SEQ ID NO: 549057 - RNA, 64 nt, Homo Sapiens
gaaguacaccuaauuguuauuuuuuucugaaauguuuuaaaauaaguauugcuauaacauauau

SEQ ID NO: 549058 - RNA, 64 nt, Homo Sapiens
ucuuuuuagagcaaauguuaguuguguucuuuauuuuuaaaauucuucuaagacuaaauaggua

SEQ ID NO: 549059 - RNA, 64 nt, Homo Sapiens
uuacauaaguuuuuuuuaacauggcaaauugcuuuuuuaaaagugaauacaucgagagagauaa

SEQ ID NO: 549060 - RNA, 64 nt, Homo Sapiens
aaagcucuuauaaagucacuuuauaacagcaaccuuuuaaaaggaguaauagagucauacuuuu

SEQ ID NO: 549061 - RNA, 64 nt, Homo Sapiens
gcauuauccuuuuaucucacuuuuucauuauugguuuuaaaaaaguuuguuuucaaaauacuuc

SEQ ID NO: 549062 - RNA, 64 nt, Homo Sapiens
auuuuacugcagccaaguuuucagaaaucauggauuuuaaaaauaaauaaagagaaaaacucau

SEQ ID NO: 549063 - RNA, 64 nt, Homo Sapiens
aucucagaagucuguagauuguuucaaaauuaccuuuuaaaaugugacaguuccaucuuggaag

SEQ ID NO: 549064 - RNA, 64 nt, Homo Sapiens
cuaaaguugaauaaaaugcacauggauugccaauuuuuaaaacauguugguccauugaaaguua

SEQ ID NO: 549065 - RNA, 64 nt, Homo Sapiens
agcacaaagaacguugaaguuccuguuuuaauaauuuuaaaaugauuugcuuguccuuuugaau

SEQ ID NO: 549066 - RNA, 64 nt, Homo Sapiens
aaaguaccuuaauucuuuauaagggaaaugaggcuuuuaaaaauuaucuugaugcuccugucaa

SEQ ID NO: 549067 - RNA, 64 nt, Homo Sapiens
auuuuuuuauuuuuuacuuauugcccaggcugcuuuuuaaaaauccuaaacccacccacuucuc

SEQ ID NO: 549068 - RNA, 64 nt, Homo Sapiens
auuuuuacugguuuuauaccgaaguaaacgcuuuuuuuaaaaguuuccaaacuaaauuacucgg

SEQ ID NO: 549069 - RNA, 64 nt, Homo Sapiens
uuuagacucugaaaguaauaugaaccaauuuuguuuuuaaaacccguuucguuuugauaauugu

SEQ ID NO: 549070 - RNA, 64 nt, Homo Sapiens
uaagugaggggaggccggguagaagagaaauggguuuuaaaaaucaguccaguugugaagcugg

SEQ ID NO: 549071 - RNA, 64 nt, Homo Sapiens
ccuuuucuccucaucauugcaaucuuuguauauuuuuuaaaaauuuugcaucccaaauguuuuu

SEQ ID NO: 549072 - RNA, 64 nt, Homo Sapiens
cauuucagcuucuuuacucaucauggcaauguuuuuuuaaaagaugcccuuuuauuaaauaaau

SEQ ID NO: 549073 - RNA, 64 nt, Homo Sapiens
uuugaaaacuugcuaauaacagcaacuguuuaauuuuuaaaauuuuacuacuuaaugguuuuga

SEQ ID NO: 549074 - RNA, 64 nt, Homo Sapiens
aaaaaagcaaagcuuucugcauguagauuuauuuuuuuaaaaaacagaagacacacuuguacga

SEQ ID NO: 549075 - RNA, 64 nt, Homo Sapiens
uucuggaagaaacagauucauacuaaaauuuuaauuuuaaaaaaguuauuuuaauauuucacga

SEQ ID NO: 549076 - RNA, 64 nt, Homo Sapiens
aaacugcaguguuuccuggagcugcauuuuuuguuuuuaaaauuuccucacgaauuguuuuacu

SEQ ID NO: 549077 - RNA, 64 nt, Homo Sapiens
agaguaaguauguucuuacagauacuuguaagacuuuuaaaaucagguucuaaacuguguuaca

SEQ ID NO: 549078 - RNA, 64 nt, Homo Sapiens
agauacuuaauauuuuuaauaaauauuucucuacuuuuaaaacaaaauagaaauaguucuuuaa

SEQ ID NO: 549079 - RNA, 64 nt, Homo Sapiens
uuuaaguagcagucucaaagugcuuuguuccauguuuuaaaauuaaacgucuggacucaaaaaa

SEQ ID NO: 549080 - RNA, 64 nt, Homo Sapiens
ucuggacucaaaaaaugcuugcaaacacuacuuuuuuuaaaacguaaagggcuaaauuauauaa

SEQ ID NO: 549081 - RNA, 64 nt, Homo Sapiens
auucccucucaacaaaacuuccccaguguguaccuuuuaaaauucacuucuuuuuauuucuugu

SEQ ID NO: 549082 - RNA, 64 nt, Homo Sapiens
uuguuaaaauaugcuugacucuguauauacauuuuuuuaaaaguaacuuuacucuuauucuuag

SEQ ID NO: 549083 - RNA, 64 nt, Homo Sapiens
cacuugaagcacagcuggucaagggaccaauuaauuuuaaaacugagccagacccucuucaggg

SEQ ID NO: 549084 - RNA, 64 nt, Homo Sapiens
uggcaaaagccuagauuuacguuuccaguauccuuuuuaaaaaaaugaaugucaucucuuuuca

SEQ ID NO: 549085 - RNA, 64 nt, Homo Sapiens
ccagauacucugaauuuuaguuaaaaagugcuacuuuuaaaaucuaugugacuuguugaacuuu

SEQ ID NO: 549086 - RNA, 64 nt, Homo Sapiens
ugcuacuuuuaaaaucccagugacuuguugaacuuuuuaaaaaguugauguuuuaaguguuaug

SEQ ID NO: 549087 - RNA, 64 nt, Homo Sapiens
aaaaacccaaugaggaacaaagaguugauguguguuuuaaaagagcaaacaaagcaaccccaaa

SEQ ID NO: 549088 - RNA, 64 nt, Homo Sapiens
caaacugguguguauucucacccuaugugggauuuuuuaaaaaggauuuaaaauuaugcagggc

SEQ ID NO: 549089 - RNA, 64 nt, Homo Sapiens
agugucacagucucucuuggaggacuuugccgcuuuuuaaaacuccaagcauguauguagagaa

SEQ ID NO: 549090 - RNA, 64 nt, Homo Sapiens
aaacucaguauuauuuuugcgacgguuuaaaacuuuuuaaaagauacaaaaagaaacauuuaau

SEQ ID NO: 549091 - RNA, 64 nt, Homo Sapiens
uuuuguuuugugaauuuguaguuaccucaacuuguuuuaaaagacauuaaaauuuauguuugag

SEQ ID NO: 549092 - RNA, 64 nt, Homo Sapiens
auguuuguguuccugugguugaaauauuucaugcuuuuaaaaagccauuuuaguucuauggaug

SEQ ID NO: 549093 - RNA, 64 nt, Homo Sapiens
ugaucaaguuagugugugucaaaaauaaaaaaaguuuuaaaaacaaaaacuuaaaaaaaauuua

SEQ ID NO: 549094 - RNA, 64 nt, Homo Sapiens
uauauguugauuucuuguaauucauuuauuuuguuuuuaaaauagaagcacagaaaacuagaau

SEQ ID NO: 549095 - RNA, 64 nt, Homo Sapiens
ucuuauuauguacuucugugugaauggcaauagauuuuaaaaaacguuuuugugcaaaaauaaa

SEQ ID NO: 549096 - RNA, 64 nt, Homo Sapiens
ucuuccaagagacuuccauggagaaucaugcaaauuuuaaaagugagcucuugucaucugugga

SEQ ID NO: 549097 - RNA, 64 nt, Homo Sapiens
augccuuuuuaaagcauuaauuuguggugggacuuuuuaaaaaauuaguacuugaaguugagcc

SEQ ID NO: 549098 - RNA, 64 nt, Homo Sapiens
ucugccauguuaaguggccaaacaacaaacuggauuuuaaaaguacccagcaguagguuuuguu

SEQ ID NO: 549099 - RNA, 64 nt, Homo Sapiens
aagaaccagcucaaguacaucauaaucugggacuuuuuaaaaauccuguggguuaccugaacuc

SEQ ID NO: 549100 - RNA, 64 nt, Homo Sapiens
cccuguuauaaacguugaacaaaacuuuucuccauuuuaaaaaguuucuuuuuaaaaauuuucc

SEQ ID NO: 549101 - RNA, 64 nt, Homo Sapiens
uuuccaaaacuuuucuccauaaucauaaguuucuuuuuaaaaauuuggauccuguacucuaaua

SEQ ID NO: 549102 - RNA, 64 nt, Homo Sapiens
agcagggcugggugugacggaaaaaaaaguccccuuuuaaaacaucauuuuuuuccauuaagaa

SEQ ID NO: 549103 - RNA, 64 nt, Homo Sapiens
aauacaacaucuuauucuuuuauauuuuaaauuauuuuaaaagaccugccuuaggaaaauuuaa

SEQ ID NO: 549104 - RNA, 64 nt, Homo Sapiens
gaauuggcugcuuaaagccaucuuuuuaaaaucuuuuuaaaaggaaauauaaaagauauuucuc

SEQ ID NO: 549105 - RNA, 64 nt, Homo Sapiens
uuuuuaaaagggaauuggcuagauauuucucucuuuuuaaaaucaauauguggguaaauauaaa

SEQ ID NO: 549106 - RNA, 64 nt, Homo Sapiens
ccuugagaaaaaaagauaaugauaaacagaauacuuuuaaaacaucacauucaugaaaagcacu

SEQ ID NO: 549107 - RNA, 64 nt, Homo Sapiens
caaacaguguaaaaaaagucuuagaaagagaaguuuuuaaaaagcaagagucacuaagcagaau

SEQ ID NO: 549108 - RNA, 64 nt, Homo Sapiens
uaagugcuuaauuuggaauagagaaaccaguauauuuuaaaaaagaaaaauauucuuuguagca

SEQ ID NO: 549109 - RNA, 64 nt, Homo Sapiens
ugucagaauuacauacacaauuacaacaaacuuuuuuuaaaagacauuucauuguacugcaaaa

SEQ ID NO: 549110 - RNA, 64 nt, Homo Sapiens
guauagcucuuuccuucaaauucaacuagagccuuuuuaaaaagacauuugccugcuagucaga

SEQ ID NO: 549111 - RNA, 64 nt, Homo Sapiens
uaaaaagaaaauuauugcauuugaucuggauggauuuuaaaagaauauaauguucaauauuaaa

SEQ ID NO: 549112 - RNA, 64 nt, Homo Sapiens
agauuuguuuguguuuaugaaacagccauuuauuuuuuaaaaaguguuuugaauugugucuuaa

SEQ ID NO: 549113 - RNA, 64 nt, Homo Sapiens
cacauaauuucuguuucagcaguacaaaggcauguuuuaaaaucuauaacauaaagaauaagga

SEQ ID NO: 549114 - RNA, 64 nt, Homo Sapiens
gcuggccacauuggacaucuuggucacugcagaauuuuaaaaggcaaacuucucagaacagaug

SEQ ID NO: 549115 - RNA, 64 nt, Homo Sapiens
uucucuuaggcagcucugcacuucauguucaguuuuuuaaaaauagacuguaguauccuuucau

SEQ ID NO: 549116 - RNA, 64 nt, Homo Sapiens
aaagagaaucugugggaaauaggcagauauagcuuuuuaaaauauaaaguacuugggauuuugc

SEQ ID NO: 549117 - RNA, 64 nt, Homo Sapiens
uaccaauaauagagcuaaauacaaugacauuugcuuuuaaaagguggauauuuuauuucugcuu

SEQ ID NO: 549118 - RNA, 64 nt, Homo Sapiens
uagucugacaucagaaaauaaaauugaggcugauuuuuaaaaauuucuaguagauuuuuggccu

SEQ ID NO: 549119 - RNA, 64 nt, Homo Sapiens
uaaaaauuucuaguagauuuuuggccuuuccuguuuuuaaaaaucaguuucauuuucauauuuc

SEQ ID NO: 549120 - RNA, 64 nt, Homo Sapiens
caagugaaaacuuaaauuguaaaacauguugaaauuuuaaaaauuaauguuaauauggaaaugc

SEQ ID NO: 549121 - RNA, 64 nt, Homo Sapiens
uuuaggaaaaucacuuugucuaacucagaauuauuuuuaaaaagaaaucuggucuuguuagaaa

SEQ ID NO: 549122 - RNA, 64 nt, Homo Sapiens
auguuacuauuuucuacaauuaauaguuugucuauuuuaaaauaaauuaguuguuaagagucuu

SEQ ID NO: 549123 - RNA, 64 nt, Homo Sapiens
cuggggcagauauguauguuauauacaacuauuuuuuuaaaaaacuuauauccauguugggagu

SEQ ID NO: 549124 - RNA, 64 nt, Homo Sapiens
uuuggagaauguauuuuuguauuuauaaaucaacuuuuaaaaacugucucauucaaaagggaau

SEQ ID NO: 549125 - RNA, 64 nt, Homo Sapiens
aauucacaaauagccauugaacaaauguguggguuuuuaaaaauuauauacauauaugaguugc

SEQ ID NO: 549126 - RNA, 64 nt, Homo Sapiens
ucaaccucuuacaauaagcuaaacgcaaugucauuuuuaaaaagaaggacuuagggugucguuu

SEQ ID NO: 549127 - RNA, 64 nt, Homo Sapiens
aggggucuuaauugaaaugaaaauuuaauuuuguuuuuaaaauauuguuuaucuuuauuuauuu

SEQ ID NO: 549128 - RNA, 64 nt, Homo Sapiens
uauaaauauguguuguaugucuuuuuugcuuuuuuuuuaaaaaaaagaauaacuuuuuuugccu

SEQ ID NO: 549129 - RNA, 64 nt, Homo Sapiens
guuagugguguuuugaagaggguauuuuauuguuuuuuaaaaaaagguucuuaaacauuauuug

SEQ ID NO: 549130 - RNA, 64 nt, Homo Sapiens
uuucuguauccuuccuucuaccuauuauucugauuuuuaaaaaugcaguuaauguaccauuuau

SEQ ID NO: 549131 - RNA, 64 nt, Homo Sapiens
uagguuagaccacccaauaaaucuagaaaucagcuuuuaaaaauauugucugaagucuaacaaa

SEQ ID NO: 549132 - RNA, 64 nt, Homo Sapiens
auggugugcuuuuggggagauacacuagcaauuuuuuuaaaaacuggaacagugugauaggaag

SEQ ID NO: 549133 - RNA, 64 nt, Homo Sapiens
uaguccaguuaugaaaucaguguaauacauugauuuuuaaaacugcugcuuuuuaugcuuuaag

SEQ ID NO: 549134 - RNA, 64 nt, Homo Sapiens
uuaaauacauuacacggguuguaaggacaaaggauuuuaaaaucugagcacuuaggugaaggga

SEQ ID NO: 549135 - RNA, 64 nt, Homo Sapiens
cuguucaggccuuuuccuuuuuacuucuggcuuauuuuaaaaauauuuuuuaucuauuuacugu

SEQ ID NO: 549136 - RNA, 64 nt, Homo Sapiens
ucuugaaauuuugccaccacagaaagaaagauguuuuuaaaagcuuggcccaaagaauaggaac

SEQ ID NO: 549137 - RNA, 64 nt, Homo Sapiens
guaugaggacuccuuguuaugccuuuaagguaauuuuuaaaaaaaaucugaguagagauaguac

SEQ ID NO: 549138 - RNA, 64 nt, Homo Sapiens
auuacuauguaaacaaaaaguagauaguuucacuuuuuaaaaaauccauuacuguuuugcauuu

SEQ ID NO: 549139 - RNA, 64 nt, Homo Sapiens
cuuucuuuuuuuucuuuuguuucaugauuuugauuuuuaaaauuauuagcacacaacuauuuuc

SEQ ID NO: 549140 - RNA, 64 nt, Homo Sapiens
gugcaaaugggugacuuagugcauugauucagauuuuuaaaauuucuugaugugguuuguaaua

SEQ ID NO: 549141 - RNA, 64 nt, Homo Sapiens
aacuacccauauuccagacucugagcuguuuccuuuuuaaaaaucauauagacaauuagcuguu

SEQ ID NO: 549142 - RNA, 64 nt, Homo Sapiens
caauacaccucaaggaaaagguucagauuuuuauuuuuaaaauauuuucauuuuuuucuugaau

SEQ ID NO: 549143 - RNA, 64 nt, Homo Sapiens
guagguuguugauuuuguuacuucauacuggaacuuuuaaaaagauuucaucaaauaaaguuuu

SEQ ID NO: 549144 - RNA, 64 nt, Homo Sapiens
ucaaaagacaguuuuaggaagucuuauuuauugauuuuaaaaguuuuacauguaggaguguggg

SEQ ID NO: 549145 - RNA, 64 nt, Homo Sapiens
uuucuauaaauuacuaauuguaaaaagucuugcuuuuuaaaacaaguugguaaugcauaucaug

SEQ ID NO: 549146 - RNA, 64 nt, Homo Sapiens
uuuucuuuuugauacuccagguuuauaaacuaucuuuuaaaauuuuaagccaggacuucaaaaa

SEQ ID NO: 549147 - RNA, 64 nt, Homo Sapiens
ccauuuuccuauuauguuugauaauuauauguauuuuuaaaaacugugagaggaaaaauuaguc

SEQ ID NO: 549148 - RNA, 64 nt, Homo Sapiens
caaacauuuacauuuguuuuuuacaauaaauuucuuuuaaaauauacuuucuauuuuucuguac

SEQ ID NO: 549149 - RNA, 64 nt, Homo Sapiens
uucaguaacaaagguuuaaaguuugaagauuauuuuuuaaaaagguaaaugguuaaauuuuaca

SEQ ID NO: 549150 - RNA, 64 nt, Homo Sapiens
uauuuuaucuauuggccuguuccccaaauggccauuuuaaaaugcuuggguacacuucucuuaa

SEQ ID NO: 549151 - RNA, 64 nt, Homo Sapiens
cucuaguaguauauuuaauuuugacauaaguaacuuuuaaaauuugucuuaaaaauuuauacac

SEQ ID NO: 549152 - RNA, 64 nt, Homo Sapiens
ucucuuuuauucauuuauuuaacauacugucuaauuuuaaaaauagguuuuuaaagcuuucauu

SEQ ID NO: 549153 - RNA, 64 nt, Homo Sapiens
aagucacuaaacuuuuacacacucccaaacgucuuuuuaaaaauugcuugggaaauuauuaaau

SEQ ID NO: 549154 - RNA, 64 nt, Homo Sapiens
ugguuuucuaaaauuaaaaucugcauuuaagaauuuuuaaaaauguaacuauguucugaaaaca

SEQ ID NO: 549155 - RNA, 64 nt, Homo Sapiens
uaagugguuauucucugacuuaauguuuuaaucuuuuuaaaauauuguugauuugaggauauaa

SEQ ID NO: 549156 - RNA, 64 nt, Homo Sapiens
aaaacauuauuugugcccucguuguuaaaauauuuuuuaaaacaauuuuuuuucuauuaaaacu

SEQ ID NO: 549157 - RNA, 64 nt, Homo Sapiens
uacuuugaugcauuuauuuuuacacguuucuguauuuuaaaaaauaauaucagucauccagaag

SEQ ID NO: 549158 - RNA, 64 nt, Homo Sapiens
cauuuaauuaauauucuguuuucauuucuuaagcuuuuaaaauuucucauucauguuuucuacu

SEQ ID NO: 549159 - RNA, 64 nt, Homo Sapiens
aauguaaauagcacuaaacguguauagagcagaguuuuaaaaugauacugaucagaauuaaauu

SEQ ID NO: 549160 - RNA, 64 nt, Homo Sapiens
aagaaauaaguaguuucauuuuccuuuuauuaacuuuuaaaauacuuccuaaaaauugagaggu

SEQ ID NO: 549161 - RNA, 64 nt, Homo Sapiens
agagauuugauuauuuuuccacuaagaagguuuuuuuuaaaaaauuuggacauuuaaccaagau

SEQ ID NO: 549162 - RNA, 64 nt, Homo Sapiens
uuguauuugauaacauccuguuuaauggucaagcuuuuaaaaauucucauuaggcaauuuaugc

SEQ ID NO: 549163 - RNA, 64 nt, Homo Sapiens
caaguuuggaauuuuuuucagaaauuccugcaauuuuuaaaaaauuuuguugauaaaauacgaa

SEQ ID NO: 549164 - RNA, 64 nt, Homo Sapiens
aggaaaagggaaaaaaaggaaacacagugcaucuuuuuaaaacaucauaucaccgcugcauaac

SEQ ID NO: 549165 - RNA, 64 nt, Homo Sapiens
agaacuuuauauauauuacucccuacuaauauaauuuuaaaaugcuuccuggagauggcuacau

SEQ ID NO: 549166 - RNA, 64 nt, Homo Sapiens
uguaaaguaaaugaaagcuaacuuaauugaagcuuuuuaaaaauuguuuagauaaaauugaagu

SEQ ID NO: 549167 - RNA, 64 nt, Homo Sapiens
aaaccagaucaaauuaauacagcaagggggaauauuuuaaaaauagaaaaggaagauguucugu

SEQ ID NO: 549168 - RNA, 64 nt, Homo Sapiens
auugauucagcuaagcaaagguaaagaagaaagcuuuuaaaaggaauugaagauagguuuagca

SEQ ID NO: 549169 - RNA, 64 nt, Homo Sapiens
ugcacacauuaugauuaaaaaacugacaguuaccuuuuaaaauucuucuggacuuuccuuacuu

SEQ ID NO: 549170 - RNA, 64 nt, Homo Sapiens
aucuugcuuucagcuuucagccauuggugauguuuuuuaaaaaaacugcaaaagucuaaaauac

SEQ ID NO: 549171 - RNA, 64 nt, Homo Sapiens
cauauuugaagaccuuugaguguggauuaaauaguuuuaaaauaauagagucaccuguuuguua

SEQ ID NO: 549172 - RNA, 64 nt, Homo Sapiens
gccuacaacuuacauauguaauuuuuugaaagauuuuuaaaaaaucaagcuuuuugcaucauac

SEQ ID NO: 549173 - RNA, 64 nt, Homo Sapiens
auaguuguauauaacauacacauggauauaaguuuuuuaaaaaaauauacccaucuacucccaa

SEQ ID NO: 549174 - RNA, 64 nt, Homo Sapiens
ugauuuauaaauacaaaaauuugaaugagacaguuuuuaaaaguacacaggucuuuauucccuu

SEQ ID NO: 549175 - RNA, 64 nt, Homo Sapiens
aaaaacuugaaagaacacuuaagacugguuucuuuuuuaaaagaauauucaacaaaaaucuuca

SEQ ID NO: 549176 - RNA, 64 nt, Homo Sapiens
augagcacuuuucauucacuacauaaaccacauuuuuuaaaaaaaaagcaguugaguaacagca

SEQ ID NO: 549177 - RNA, 64 nt, Homo Sapiens
uuaagcaacaguguaaugauauucaaaaggaauuuuuuaaaacagacaauuuguguuggauggu

SEQ ID NO: 549178 - RNA, 64 nt, Homo Sapiens
guaaacugaauauuuuuguuuuacucaauuuaguuuuuaaaauauagucuaaaucacaaauacu

SEQ ID NO: 549179 - RNA, 64 nt, Homo Sapiens
guguagacaauggugguuaaguaacaaacuuaauuuuuaaaaagugaaugacauuggacuuuua

SEQ ID NO: 549180 - RNA, 64 nt, Homo Sapiens
gaaucucguacuguaucuuacuauuuuuccuuguuuuuaaaaauuuucaguguuuaaauuagug

SEQ ID NO: 549181 - RNA, 64 nt, Homo Sapiens
gauggccuucuuaagaauaaagucuuagaucuacuuuuaaaacgcagugguugaggaagcuaac

SEQ ID NO: 549182 - RNA, 64 nt, Homo Sapiens
ugauauaaacuuugaugcuguauaaaauguugaguuuuaaaagaaauccaugcauuguagaguc

SEQ ID NO: 549183 - RNA, 64 nt, Homo Sapiens
cauaaagggagcaccauuguuauguaaguaaaauuuuuaaaaaucuauuuuggaauuacauagu

SEQ ID NO: 549184 - RNA, 64 nt, Homo Sapiens
ccaaauuuaaauaaauauaggaaaagcuuaccuauuuuaaaaaguauuaaacaauaauugaaau

SEQ ID NO: 549185 - RNA, 64 nt, Homo Sapiens
auguuugauucaaaacuuuaugcauucaguggcuuuuuaaaaaaugcauuauuuauaauaaaau

SEQ ID NO: 549186 - RNA, 64 nt, Homo Sapiens
aaaauuauuacauccuuuacuuaaaauauaauacuuuuaaaaagggcacaugugccagcugaau

SEQ ID NO: 549187 - RNA, 64 nt, Homo Sapiens
cuuuaaaacaacuuuucaauuacucaauuuaaaauuuuaaaauccuuuuaaaugaagcuuaaau

SEQ ID NO: 549188 - RNA, 64 nt, Homo Sapiens
uuaaauaugguuuuaaccuuauguaauauaaaguuuuuaaaauuuuuaguuucauuuuggcuuu

SEQ ID NO: 549189 - RNA, 64 nt, Homo Sapiens
ugcgaaacuauuucagaaucauaucaaaguuaacuuuuaaaaaucucaaaaacauuuugagcga

SEQ ID NO: 549190 - RNA, 64 nt, Homo Sapiens
uugccuucuccaguggcaguucugacuucuguauuuuuaaaaaguaauauaacaugggcaaaua

SEQ ID NO: 549191 - RNA, 64 nt, Homo Sapiens
uuugcaaccuauauauuuaucauuuuaaucauuauuuuaaaagcacaugaacaucuuucacuga

SEQ ID NO: 549192 - RNA, 64 nt, Homo Sapiens
gacauaguuagauuauuuaauaaguugcuuugacuuuuaaaaauauuguaacuuucauuagaaa

SEQ ID NO: 549193 - RNA, 64 nt, Homo Sapiens
agcucacauuuaauuucuugaauaaagcuugcaauuuuaaaaguauugaauugguuugauuaaa

SEQ ID NO: 549194 - RNA, 64 nt, Homo Sapiens
aaggccgggcgugguggcucugaugaauuauagauuuuaaaaucaaaaacauuuauuuuaugag

SEQ ID NO: 549195 - RNA, 64 nt, Homo Sapiens
uauuuuaauuacauuuaaaacauaaaguauguuuuuuuaaaauauugaccugccugagaagcuu

SEQ ID NO: 549196 - RNA, 64 nt, Homo Sapiens
ggugccagcaauucacgauuuagagucuaauguuuuuuaaaauuuaagggagaggaucuugucg

SEQ ID NO: 549197 - RNA, 64 nt, Homo Sapiens
gaguaugguucccaauuuuuaaauccauuucauuuuuuaaaaaauaagggaaauaaauguaauu

SEQ ID NO: 549198 - RNA, 64 nt, Homo Sapiens
acuuauucuagggcacacaaacacuauuuuacuuuuuuaaaaucauaaaacggcagaacagauu

SEQ ID NO: 549199 - RNA, 64 nt, Homo Sapiens
uuaugcuucuugaggugguaaugagaaaaaaguuuuuuaaaaaagugugccuugcuguauuucu

SEQ ID NO: 549200 - RNA, 64 nt, Homo Sapiens
gaaaaaguaaauugggaggacuuaauggaaggucuuuuaaaaaguuaacuuggagcuucuguau

SEQ ID NO: 549201 - RNA, 64 nt, Homo Sapiens
uauauauacaugcacacacaccgauacauuuaccuuuuaaaaaaaugauuuauaagugaacugu

SEQ ID NO: 549202 - RNA, 64 nt, Homo Sapiens
aucucuagaaaagaugugguuuguuuuggcacuguuuuaaaaacucaaauauuuuaaacauuug

SEQ ID NO: 549203 - RNA, 64 nt, Homo Sapiens
cggaacuggcuccauuagaccaugguucauccucuuuuaaaaccaaauuuuuuuuucuucuggc

SEQ ID NO: 549204 - RNA, 64 nt, Homo Sapiens
aauuuuuuuuucuucuggccuacaaguauuuuuuuuuuaaaaaagaaaaaaagccuacauuggc

SEQ ID NO: 549205 - RNA, 64 nt, Homo Sapiens
ucuuaauugauuuuacagucuguaaugcuugauguuuuaaaauaauaacauuuuuauauuuuuu

SEQ ID NO: 549206 - RNA, 64 nt, Homo Sapiens
gcuugauguuuuaaaauaauaacauuuuuauauuuuuuaaaagacaaacuucauauuauccugu

SEQ ID NO: 549207 - RNA, 64 nt, Homo Sapiens
cucuuuccucucuauucgcuuucuccuguuuuuuuuuuaaaaaaaaagcaugaaaaaggaagag

SEQ ID NO: 549208 - RNA, 64 nt, Homo Sapiens
uccucaauaucaacuccaguuuaaaaaguguuauuuuuaaaacauuugaaaccaaguacuguuu

SEQ ID NO: 549209 - RNA, 64 nt, Homo Sapiens
cugcaauagaugacacugaugguuuuacuccuuuuuuuaaaaacacaugcgcgcgcacacacac

SEQ ID NO: 549210 - RNA, 64 nt, Homo Sapiens
cuuccuuucuuauuacuuuccuaauuuuucuauauuuuaaaaacuacaguuuccaugauaaaag

SEQ ID NO: 549211 - RNA, 64 nt, Homo Sapiens
uguuucugugaaacaauuauuuuaaauauuuuucuuuuaaaaauaacuuuuuaucaguacagaa

SEQ ID NO: 549212 - RNA, 64 nt, Homo Sapiens
auuguuuaagggaaaagaaaagaguaauaauuuuuuuuaaaacauuaaggaauuggaauucaga

SEQ ID NO: 549213 - RNA, 64 nt, Homo Sapiens
aagauuuaagaaugauuaaaaauaagcuuuuacuuuuuaaaaccacuugagguuucauaaagcu

SEQ ID NO: 549214 - RNA, 64 nt, Homo Sapiens
cuucugugcgaccaaugagacgacuucagcaucuuuuuaaaauaaucuaagcaucauugaagca

SEQ ID NO: 549215 - RNA, 64 nt, Homo Sapiens
gaaaguaacccacauucuguucaggauacuuuuguuuuaaaaggcuaaaauguuugugugcuuu

SEQ ID NO: 549216 - RNA, 64 nt, Homo Sapiens
ggugagcugagguagaaaaaaaacaagaaaaaaauuuuaaaaauagcguuaaaaugcauuuuag

SEQ ID NO: 549217 - RNA, 64 nt, Homo Sapiens
uugcaguuagcuauagacaucccauuguguuaucuuuuaaaaggcccuugacauuuugcguuuu

SEQ ID NO: 549218 - RNA, 64 nt, Homo Sapiens
uuuggaugguuauugauaucuuuguaguagcuuuuuuuaaaagacuaccaaaauguaugguugu

SEQ ID NO: 549219 - RNA, 64 nt, Homo Sapiens
uugaaauacaguuuugaguuauuuugauguggcuuuuuaaaaaaguuaauggguagcuaauguu

SEQ ID NO: 549220 - RNA, 64 nt, Homo Sapiens
caaauguaaauguuuugaggauauuuuucuuguuuuuuaaaaucaauuuuuaaccaaauauuaa

SEQ ID NO: 549221 - RNA, 64 nt, Homo Sapiens
auuaaacuguaaauaacuugcccugggggccuuuuuuuaaaaaacaaaaaccacaaaaauuccc

SEQ ID NO: 549222 - RNA, 64 nt, Homo Sapiens
ugauacaaucauuaauggaucauacacaauagguuuuuaaaaauuaauaacuuuuaguaauuac

SEQ ID NO: 549223 - RNA, 64 nt, Homo Sapiens
gauacaaccauuaaugaaucauacacaauagguuuuuuaaaauuaauauuaauaacuuuuauua

SEQ ID NO: 549224 - RNA, 64 nt, Homo Sapiens
cuuccauuugcucacuucucucuucacccaucuuuuuuaaaaacaaauaaaugaauaaagcugc

SEQ ID NO: 549225 - RNA, 64 nt, Homo Sapiens
ucuguuaaagucuuaaaauggaaugagaauguuguuuuaaaagaaaauagcaaaacaacaaaaa

SEQ ID NO: 549226 - RNA, 64 nt, Homo Sapiens
uggcugcacaagauauccauuacguacuuauacauuuuaaaaugaguacuaauuuucacugcua

SEQ ID NO: 549227 - RNA, 64 nt, Homo Sapiens
ggacacaucaaagcuggccaaaauaaugaauuuuuuuuaaaaagcaauaccugguuuccaccuu

SEQ ID NO: 549228 - RNA, 64 nt, Homo Sapiens
aagaaucugccagaaaaacuuacauguaucagauuuuuaaaaauauaaauagagaacauuuugc

SEQ ID NO: 549229 - RNA, 64 nt, Homo Sapiens
aacaaaacugauaaaacaguuuuucgaaacuuacuuuuaaaagcauacgugcuaugacucucuc

SEQ ID NO: 549230 - RNA, 64 nt, Homo Sapiens
uuuaaaugugggcaaaaaggcauuuucuccaagauuuuaaaacuaauucuuauuuuuaaauggu

SEQ ID NO: 549231 - RNA, 64 nt, Homo Sapiens
caaaauuugucaguacauuuuacguguagaagcauuuuaaaaaucauuucuagcaagcacuuga

SEQ ID NO: 549232 - RNA, 64 nt, Homo Sapiens
aggauuccaggaguaagccuguagaagagauuuauuuuaaaagagauugcucugaaauuuaucu

SEQ ID NO: 549233 - RNA, 64 nt, Homo Sapiens
gagcuugcucugucuaccuugacagaaauuggaguuuuaaaauuauguguuaauauuuuuauuu

SEQ ID NO: 549234 - RNA, 64 nt, Homo Sapiens
cccuuuaauuucuugcuugaguauuacuuucauguuuuaaaaaugcuacuuuuccuaguuuuca

SEQ ID NO: 549235 - RNA, 64 nt, Homo Sapiens
ggaaguggaaauaaaaaaauagcaaggugauguauuuuaaaaaaucacccuuuaacacaaaaaa

SEQ ID NO: 549236 - RNA, 64 nt, Homo Sapiens
ggagauagaaaauaaaugguaaacgcaguaguuuuuuuaaaaggaauauccaacuuaugugacu

SEQ ID NO: 549237 - RNA, 64 nt, Homo Sapiens
uuguuccuuaauuuuagccauuuucuugcucaccuuuuaaaaacagacccaaaguggcacugaa

SEQ ID NO: 549238 - RNA, 64 nt, Homo Sapiens
uccuaaugaugaugcauuuccugugauuguacaauuuuaaaaucuagguuuguguaaguacacu

SEQ ID NO: 549239 - RNA, 64 nt, Homo Sapiens
caaacauacuaaauuuuuuuaugaauuuguuuuauuuuaaaaagugaacaaauuuugauaaagu

SEQ ID NO: 549240 - RNA, 64 nt, Homo Sapiens
uuguuauaucugagaggcuuuuccaugaaguauguuuuaaaaccgcuaugauacaugaagaaca

SEQ ID NO: 549241 - RNA, 64 nt, Homo Sapiens
aaugcauuuacguaaacacgacauugcuuaauccuuuuaaaaaauuguauaguacuagguuaga

SEQ ID NO: 549242 - RNA, 64 nt, Homo Sapiens
aaaguuuaccgcuguaguguaaucugcgguauuuuuuuaaaaaacuucuuuaaaaaaaaaaaag

SEQ ID NO: 549243 - RNA, 57 nt, Homo Sapiens
uuaaguuuuguaagagcuuugcugauuuuuuaaaaauaacauggaaaaaauuuuuga

SEQ ID NO: 549244 - RNA, 64 nt, Homo Sapiens
ccuuuuaaagacauuaaaugauagaacuuauagcuuuuaaaagaaauuuaguuggcaauuuaua

SEQ ID NO: 549245 - RNA, 64 nt, Homo Sapiens
aaauuuagguguucuuacauuguuauaaacuuuauuuuaaaaccugagaucugaugagaauggu

SEQ ID NO: 549246 - RNA, 64 nt, Homo Sapiens
uuaauagccaccaagaauguaagauuugaauuuauuuuaaaauuucacuacuuaaauuauuccc

SEQ ID NO: 549247 - RNA, 64 nt, Homo Sapiens
uucuagauuacuccaauaaacaaagauguaacaauuuuaaaauuaguaucacauuuauaaauac

SEQ ID NO: 549248 - RNA, 64 nt, Homo Sapiens
gaagguuguuauugcaaguucuuuacuacuguauuuuuaaaaauugaaaagcugauaccucaau

SEQ ID NO: 549249 - RNA, 64 nt, Homo Sapiens
ugcuccuuguggagcaggaccuuaaacuuuuuuuuuuuaaaaacaagugcuacauaaaacacuu

SEQ ID NO: 549250 - RNA, 64 nt, Homo Sapiens
uagccugguaaggccggguguuaaaaacgcauguuuuuaaaaauuaucagguaaauccugguaa

SEQ ID NO: 549251 - RNA, 64 nt, Homo Sapiens
uacucacaacuagcagauggaaaauuguacaguuuuuuaaaaacuguaaaaacacaaauuuuau

SEQ ID NO: 549252 - RNA, 64 nt, Homo Sapiens
uccuacuucugguagccauuaauuugauaucauguuuuaaaauaaugugauuuaauguauguuu

SEQ ID NO: 549253 - RNA, 64 nt, Homo Sapiens
ugagcaaugucauuaauccaaauguuuggacugcuuuuaaaaccuaaggaagguguacuuaaaa

SEQ ID NO: 549254 - RNA, 64 nt, Homo Sapiens
uccaacuaucugcuugcauuaaaucaacuucauauuuuaaaaauuauaucugaaauuuguaaua

SEQ ID NO: 549255 - RNA, 64 nt, Homo Sapiens
cuaucaaaguagguuaaauuuaggaucuuccuuguuuuaaaaaauugccauaguugcaaguccu

SEQ ID NO: 549256 - RNA, 64 nt, Homo Sapiens
uuucacagcacaggucuucuuaaaaauuugagauuuuuaaaauuuuuauaaaugauuuuuuauu

SEQ ID NO: 549257 - RNA, 64 nt, Homo Sapiens
uaaagcauauacuuguugcuuuguuuggauuaauuuuuaaaauggagaagugcuucaaauuauu

SEQ ID NO: 549258 - RNA, 64 nt, Homo Sapiens
gcucaaacaucucucauuaauuaucucucaccaauuuuaaaaugaauuuuaaaaaauaaaaauu

SEQ ID NO: 549259 - RNA, 64 nt, Homo Sapiens
uaaaaauuuuaucucucacccaagcugacucuaauuuuaaaaaauucuuuacagugaauaacua

SEQ ID NO: 549260 - RNA, 64 nt, Homo Sapiens
aggaguuaagagagaagaggugguacuccuuuaguuuuaaaauuuuccaguaaccagguagucc

SEQ ID NO: 549261 - RNA, 64 nt, Homo Sapiens
aaaaaucggucuucaaagauuuguucucacccucuuuuaaaaaagaacuuugcaaacauaauca

SEQ ID NO: 549262 - RNA, 64 nt, Homo Sapiens
aaagccaaauugaagauuaacuaugcuaaauguauuuuaaaauauuuucuguccuaugacaguu

SEQ ID NO: 549263 - RNA, 64 nt, Homo Sapiens
uguaugucagggugacaggcuaaucaagcaaauauuuuaaaaaaacuuuaucuuaaguuacaua

SEQ ID NO: 549264 - RNA, 64 nt, Homo Sapiens
augaaaaauuaauuuaaaaauuuugguuauuuuauuuuaaaaaauuuuuuguaacuuuacacuu

SEQ ID NO: 549265 - RNA, 64 nt, Homo Sapiens
aauaacaacaaaaaaaaaaucauaugugacaucuuuuuaaaaaaggugcuaaaguuccccaguu

SEQ ID NO: 549266 - RNA, 64 nt, Homo Sapiens
aauuuuuuuucaaauuucuucuagcuccuuuggcuuuuaaaaaacuuuucauuaggggcuuaag

SEQ ID NO: 549267 - RNA, 64 nt, Homo Sapiens
ccaacucuagagaaaaccaauucaaguucuugauuuuuaaaauuccuuucuuucuuucuguacc

SEQ ID NO: 549268 - RNA, 64 nt, Homo Sapiens
ggauucuugcuucuguagucugauagggcaaggauuuuaaaacagucacuaucguaaacauuca

SEQ ID NO: 549269 - RNA, 64 nt, Homo Sapiens
gacacuauaguuuuacccauaaauauuuuuuucuuuuuaaaauauuuuaaaaaauauauauaua

SEQ ID NO: 549270 - RNA, 64 nt, Homo Sapiens
uauauauauaaaauauuuuuugauuauaaugcuauuuuaaaaaaucuaaagucccuauaguaua

SEQ ID NO: 549271 - RNA, 64 nt, Homo Sapiens
uuauauaaaggcaaggaaauaagagagcuuauuguuuuaaaaagcugguuaaagguaugauuau

SEQ ID NO: 549272 - RNA, 64 nt, Homo Sapiens
ccuuaagcuggcauugugaauguagaagaggaaguuuuaaaagaagauguaaccacuauaaaua

SEQ ID NO: 549273 - RNA, 64 nt, Homo Sapiens
gaggguugggagguuucuuacagcauauuuguuauuuuaaaaggcacaugcaauuagacauauu

SEQ ID NO: 549274 - RNA, 64 nt, Homo Sapiens
aacauuauagagguguaauuauguaucuaauauuuuuuaaaacgaaccaagugauuuccagcug

SEQ ID NO: 549275 - RNA, 64 nt, Homo Sapiens
gccucuuuaauaaacuaccugaugagugggaugauuuuaaaaauacuuuugaaaugcaggauau

SEQ ID NO: 549276 - RNA, 64 nt, Homo Sapiens
aguacuccuagggaaauggcuuguuuugcaugauuuuuaaaagcauaacaucacuauuuggcuu

SEQ ID NO: 549277 - RNA, 64 nt, Homo Sapiens
uacaauuuguuuuagcugguggcuuuauuguuuauuuuaaaagccuuuuagauaauaaauaacg

SEQ ID NO: 549278 - RNA, 64 nt, Homo Sapiens
agacuuuuuuuuuuagagcacuuuuaaaaauuguuuuuaaaaauugaaucugagacgaauacaa

SEQ ID NO: 549279 - RNA, 64 nt, Homo Sapiens
uguuuuuaaaaauagacuuugagacgaauacaacuuuuaaaaauugugauaauauuuugaaucu

SEQ ID NO: 549280 - RNA, 64 nt, Homo Sapiens
uagauuauucuauaauuuacacuucguuuuuaguuuuuaaaauuuucaguauuuuaugauaauc

SEQ ID NO: 549281 - RNA, 64 nt, Homo Sapiens
gcaacaagagacacagacagaaguaaaggaaauguuuuaaaacuugaauuuuaucagauaucca

SEQ ID NO: 549282 - RNA, 64 nt, Homo Sapiens
cugauauuuuuauuuguuaacuccuguaauugucuuuuaaaauaauuuagaaugaccucuaaca

SEQ ID NO: 549283 - RNA, 64 nt, Homo Sapiens
uuuguuauauuucuuuucuuacucuuaauuauguuuuuaaaauggaaacagauuuguuaacuga

SEQ ID NO: 549284 - RNA, 64 nt, Homo Sapiens
ucuuuuauaauaugcuuuccuucauuuguaaauuuuuuaaaauucaaguuaguuaacaugaacc

SEQ ID NO: 549285 - RNA, 64 nt, Homo Sapiens
ccuuaauguaagauaugaccaugucuauuugauuuuuuaaaaaaauuccgauuuggaaccuuag

SEQ ID NO: 549286 - RNA, 64 nt, Homo Sapiens
auuuaauuccgauuuggaacaauuaggugacuuguuuuaaaaauauuaaacgaguuuuugagca

SEQ ID NO: 549287 - RNA, 64 nt, Homo Sapiens
ugugggucagucuugcacuccucuuaauuuaccuuuuuaaaagcuugcacuguaacuauaauac

SEQ ID NO: 549288 - RNA, 64 nt, Homo Sapiens
cagaauauguagucuacggaguauacugaagacauuuuaaaaacuacuaaaauuucugucauau

SEQ ID NO: 549289 - RNA, 57 nt, Homo Sapiens
caaaacaagaaacaaaacaaaaccgcuuuuuaaaauucucagguucccaauagcuga

SEQ ID NO: 549290 - RNA, 64 nt, Homo Sapiens
aacaugaccaucgucaaagaccugcucaagaaauuuuuaaaaaagaaacaaaguuaugggguua

SEQ ID NO: 549291 - RNA, 64 nt, Homo Sapiens
uauaguuucucuaaaacuuuaucugaaagagucauuuuaaaauaacuauuaaacaauguaacug

SEQ ID NO: 549292 - RNA, 64 nt, Homo Sapiens
cugcuaucuuaauguucugaaauaaguuaaaacauuuuaaaauaugaauacuguaaaggaaaua

SEQ ID NO: 549293 - RNA, 64 nt, Homo Sapiens
agauauauguugucugcuuuaaacaauuuuuaaauuuuaaaaaugcauuaacgucuuuuuauau

SEQ ID NO: 549294 - RNA, 64 nt, Homo Sapiens
uucugagagaugaaucaauaaugaaacaugucuguuuuaaaaacuaccacaugugacuccuauu

SEQ ID NO: 549295 - RNA, 64 nt, Homo Sapiens
gccuacaaugaauagguauggugguuucacagaauuuuaaaauagaguuaaagggaagugaugu

SEQ ID NO: 549296 - RNA, 64 nt, Homo Sapiens
ccugaauuaaguguuaauuugauggaaacucugcuuuuaaaaucaucauuuacuggguucuaau

SEQ ID NO: 549297 - RNA, 64 nt, Homo Sapiens
auauuuauauguaaguuuuucaaauuuugcuuaauuuuaaaauuuauuauuuugaucuugaauu

SEQ ID NO: 549298 - RNA, 64 nt, Homo Sapiens
ucuuaguguaguuaugauguggauccuacguauuuuuuaaaaaacucuccagauaauuuugaug

SEQ ID NO: 549299 - RNA, 64 nt, Homo Sapiens
aauauauuugaaugcauggguagaaaauaucauauuuuaaaacuauguauauuuaaauuuagua

SEQ ID NO: 549300 - RNA, 64 nt, Homo Sapiens
gacaaaagaaaauacacacuaaaacuaaucuucauuuuaaaaggguaaaacaugacuauacaga

SEQ ID NO: 549301 - RNA, 64 nt, Homo Sapiens
uuugugcaaaauauacauauaagcagaguaagccuuuuaaaaauguucuuugaaagauaaaauu

SEQ ID NO: 549302 - RNA, 64 nt, Homo Sapiens
cacauaaggagacauagguuauaaacuaguuaucuuuuaaaaggcucagcaacacaacucuuga

SEQ ID NO: 549303 - RNA, 64 nt, Homo Sapiens
uuuauucuaaaaaaaaaaauggaaacuuuaauuuuuuuaaaacgagaauuucauuuacagcuac

SEQ ID NO: 549304 - RNA, 64 nt, Homo Sapiens
uggcccugaguucaauauauuauuaacagcaguauuuuaaaacuuaggguugaacugggcaugg

SEQ ID NO: 549305 - RNA, 64 nt, Homo Sapiens
uuucauuagauugguuguaccaugucaccuuagcuuuuaaaaauacucuuuucagauucacguu

SEQ ID NO: 549306 - RNA, 64 nt, Homo Sapiens
gugucauuuaguaaggauuuuaugaguucuuguuuuuuaaaauccagacuuucuuuuucuacau

SEQ ID NO: 549307 - RNA, 64 nt, Homo Sapiens
uuuucuguauuuaauuauaaaaaauuaacuuaguuuuuaaaauuuauuugcaaauauacuuuac

SEQ ID NO: 549308 - RNA, 64 nt, Homo Sapiens
uaaaaugcuccuagaagucuuaauuguguuuauuuuuuaaaaaaacaaauguuagacuugugug

SEQ ID NO: 549309 - RNA, 64 nt, Homo Sapiens
gcagagaccaucugugaccauagccuagcuagcauuuuaaaaggggaaauuuuguucucuaggu

SEQ ID NO: 549310 - RNA, 64 nt, Homo Sapiens
uaaggcacucucugucucuaauccuuaggaguuguuuuaaaagacauaaucacuuugaacuucc

SEQ ID NO: 549311 - RNA, 64 nt, Homo Sapiens
acuacaggcucugucucaggagagcauaggcacauuuuaaaagguuauguacuagguuuuugug

SEQ ID NO: 549312 - RNA, 64 nt, Homo Sapiens
ucuagcacuuaccugaaaacuuaguauggagcucuuuuaaaaugugauuauuuauauuuauguu

SEQ ID NO: 549313 - RNA, 64 nt, Homo Sapiens
uacuuguagccuggauagcagacuguguucaacuuuuuaaaaagauguuuccuuucuaaagauu

SEQ ID NO: 549314 - RNA, 64 nt, Homo Sapiens
uuucucuaaauguacacugauucugugugugugauuuuaaaaggagaauaugguucaagcaagu

SEQ ID NO: 549315 - RNA, 64 nt, Homo Sapiens
gucagcugaagaccucacuggagugggucuuaauuuuuaaaaagugucucacuacauuuaagac

SEQ ID NO: 549316 - RNA, 64 nt, Homo Sapiens
gugcuggagaauuccaguuguauuugaagacugauuuuaaaacuuuucugcauuugguaaaggu

SEQ ID NO: 549317 - RNA, 64 nt, Homo Sapiens
aacuuaaugugcugcugcuuuuccauaaccaacauuuuaaaaauaaaugaaaaacaggaauugg

SEQ ID NO: 549318 - RNA, 64 nt, Homo Sapiens
uuagucguauuccuucaccugaugaauaacaguguuuuaaaacauauuugaaagguaaguaaaa

SEQ ID NO: 549319 - RNA, 64 nt, Homo Sapiens
ucugugauuggggauuugcguuauaaaaugaauauuuuaaaaagcaacagcccuaauagccucu

SEQ ID NO: 549320 - RNA, 64 nt, Homo Sapiens
auccuuaucuuuguuccucuuuacauaauguuccuuuuaaaaaaaaucacugauuaugaugugc

SEQ ID NO: 549321 - RNA, 64 nt, Homo Sapiens
aaguugucucacagcucacuuguauucuguugacuuuuaaaaaauuaugcuuucuguuucacug

SEQ ID NO: 549322 - RNA, 64 nt, Homo Sapiens
uuugggucuuuuuauauauguucugugucuaaccuuuuaaaaccuggaacacagauauaacaau

SEQ ID NO: 549323 - RNA, 64 nt, Homo Sapiens
gccccuccccaaaagaaaccaugacaaaccuagcuuuuaaaaaauauuuuaagaaagagaauga

SEQ ID NO: 549324 - RNA, 64 nt, Homo Sapiens
aacccuuuguauuauaauuguugauauuuucccuuuuuaaaaaauaccauugaaaucagcauga

SEQ ID NO: 549325 - RNA, 64 nt, Homo Sapiens
gauugauucaguaucuuagaguuuacaguuuguguuuuaaaaaaacugaagguuuuuuuuuuaa

SEQ ID NO: 549326 - RNA, 64 nt, Homo Sapiens
gcaucucgauuucuaucucuaguuagaguuguacuuuuaaaaaaauuaacgggaaagaaaauaa

SEQ ID NO: 549327 - RNA, 64 nt, Homo Sapiens
aagaaaauaacuuugugaagccaguguauucuguuuuuaaaacugugccugcagugcaauacuc

SEQ ID NO: 549328 - RNA, 64 nt, Homo Sapiens
uuauguuuucaucauucauuuuugauaguauuuauuuuaaaaaaauagagcauauaacuucuga

SEQ ID NO: 549329 - RNA, 64 nt, Homo Sapiens
cuuaaauccucucaauggaugcaacaacauuauuuuuuaaaaauugauuugugaacugagagca

SEQ ID NO: 549330 - RNA, 64 nt, Homo Sapiens
uuuuaacauuauuuaaacagugaauauucucuucuuuuaaaacacauuaaccuggaagcuuuca

SEQ ID NO: 549331 - RNA, 64 nt, Homo Sapiens
ugaauacuguaaaggaaauaaauaaguuaaaacauuuuaaaauacugcuaucuuaauguucuga

SEQ ID NO: 549332 - RNA, 64 nt, Homo Sapiens
acuauuaaacaauguaacugaucugaaagagucauuuuaaaauauauaguuucucuaaaacuuu

SEQ ID NO: 549333 - RNA, 64 nt, Homo Sapiens
uaaauccuguaguuuaaaagucugaaauaaaacauuuuaaaauauguaacugcuaucuuaaugu

SEQ ID NO: 549334 - RNA, 64 nt, Homo Sapiens
auauaaauauuaaaaaauguaucuuaaagagucauuuuaaaauagcccauggguuuaaaacugu

SEQ ID NO: 549335 - RNA, 64 nt, Homo Sapiens
gaaacaaaguuaugggguuagcugcucaagaaauuuuuaaaaacaacaccaccaucaucaaaga

SEQ ID NO: 549336 - RNA, 64 nt, Homo Sapiens
ugauuuaaaugaagaaauggcuaagguucaagauuuuuaaaauuauuacuguaaguuuuagauu

SEQ ID NO: 549337 - RNA, 64 nt, Homo Sapiens
cccaccagcuuuuaacaguacuguaaaaaugaacuuuuaaaacuauauuguaugcuuacaaaag

SEQ ID NO: 549338 - RNA, 64 nt, Homo Sapiens
aaaauuuucaagucugggauuauaggucacaauuuuuuaaaaccuaaugagcuaaugugauauc

SEQ ID NO: 549339 - RNA, 64 nt, Homo Sapiens
uaaagcguguacuguguugcuucccaagguauacuuuuaaaauuuguaucuguaagaucagccu

SEQ ID NO: 549340 - RNA, 64 nt, Homo Sapiens
cuccuguuuuuggaaaguagguuaugugguuuucuuuuaaaaagcccagcgccuuuuaaaaguu

SEQ ID NO: 549341 - RNA, 64 nt, Homo Sapiens
uguuaugugguuuucuuuuaggaaucccagcgccuuuuaaaaguagcauugaucuagaagcaga

SEQ ID NO: 549342 - RNA, 64 nt, Homo Sapiens
aaagauuuauaaauaacuuuuuaacaagguagaauuuuaaaauaggacacuuacugauuaauuu

SEQ ID NO: 549343 - RNA, 64 nt, Homo Sapiens
aacuggaggcaucuuuguacuauuguuauaaguuuuuuaaaaacgacuauuagaaguaacuaag

SEQ ID NO: 549344 - RNA, 64 nt, Homo Sapiens
uugaauccacaaauaaaguuaguguaaaaucauuuuuuaaaaucaaauuuauugcacacuuuaa

SEQ ID NO: 549345 - RNA, 64 nt, Homo Sapiens
uucugacacaguaaauauauuaaacuauuugacuuuuuaaaaucaacacaauucauuuugauua

SEQ ID NO: 549346 - RNA, 64 nt, Homo Sapiens
cuguuuacuaugaagacaaucuauuucuuaugccuuuuaaaauaaauuuguauuaaauuuauua

SEQ ID NO: 549347 - RNA, 64 nt, Homo Sapiens
gcuuugagagguaauuacuuuguaauaaugcguuuuuuaaaaaugaaauaauucauugguaaag

SEQ ID NO: 549348 - RNA, 64 nt, Homo Sapiens
gaauuaggaauuugagauaucuaguguuuuguguuuuuaaaacaguaauuucauagcaacuguu

SEQ ID NO: 549349 - RNA, 64 nt, Homo Sapiens
caagacuuuacuuucuucuggcugacaacuucuauuuuaaaaaacagaaucuauauagucuaau

SEQ ID NO: 549350 - RNA, 64 nt, Homo Sapiens
auguagguuuaacaaaccuuucugaaacgugauauuuuaaaaacgauauauauauauauauuua

SEQ ID NO: 549351 - RNA, 64 nt, Homo Sapiens
uuuuaagauacagcuacucacuggauuauaugauuuuuaaaacacccacucagccccaaaugcc

SEQ ID NO: 549352 - RNA, 64 nt, Homo Sapiens
cauuuuacugguuuggcaugugucuacuauacauuuuuaaaagcacuuuuauacaaacugacau

SEQ ID NO: 549353 - RNA, 64 nt, Homo Sapiens
uguucuuuucacuugggagagagcaauuaauuuuuuuuaaaaagccccugggccugaaaacuug

SEQ ID NO: 549354 - RNA, 64 nt, Homo Sapiens
aauuuauuuucauaaaugguauaacuuuuaugccuuuuaaaauauauuuuuucuuuuuacacua

SEQ ID NO: 549355 - RNA, 64 nt, Homo Sapiens
agaugaauauguuagucuuuauugguagguuuuuuuuuaaaauuaauaaaauauauuuuguucu

SEQ ID NO: 549356 - RNA, 64 nt, Homo Sapiens
auuagugugaguguguuuuuuguaugcacuacuguuuuaaaagagcuuuauaggaggaguauaa

SEQ ID NO: 549357 - RNA, 64 nt, Homo Sapiens
uauuuacuguaguccaauaaccucauugguguccuuuuaaaaaagguuaacaccagauggugcc

SEQ ID NO: 549358 - RNA, 64 nt, Homo Sapiens
aaauaaauauauauauauauacauccccuggaguuuuuaaaaauaacuguuuacuaacuuuggg

SEQ ID NO: 549359 - RNA, 64 nt, Homo Sapiens
uaguaacauccauuuuuuucuuuuauaaagcagauuuuaaaauaagauugauauuuauacacuu

SEQ ID NO: 549360 - RNA, 64 nt, Homo Sapiens
aacuguuuucuuuuggaacuuuuuaaauguagacuuuuaaaauaaaaccagacaaagcauugac

SEQ ID NO: 549361 - RNA, 64 nt, Homo Sapiens
uacugauuuaauuucauguugacauuuuagccuuuuuuaaaaguguuguguuucggggggaaaa

SEQ ID NO: 549362 - RNA, 64 nt, Homo Sapiens
gauaguuuucuagcucucgggucccuuuauugcuuuuuaaaauaggguuugaaacaugccacag

SEQ ID NO: 549363 - RNA, 64 nt, Homo Sapiens
uauguguuuaaaccuuuauaaaccaguauuucacuuuuaaaaagacaaggcaucucuacccauu

SEQ ID NO: 549364 - RNA, 64 nt, Homo Sapiens
uguaauucuaaaagagaucuuauuuaaauuuccuuuuuaaaagccgcaugguucugugauccau

SEQ ID NO: 549365 - RNA, 64 nt, Homo Sapiens
gcuuuugugucuuugacaucuaccacccuccuccuuuuaaaaaauuucuuuagaauuucucaau

SEQ ID NO: 549366 - RNA, 64 nt, Homo Sapiens
uaguuccaucuagaacuccuuucuaguuuguuauuuuuaaaauguuuauacauaaaaccaccaa

SEQ ID NO: 549367 - RNA, 64 nt, Homo Sapiens
augaagaaaugggugaaugagcuugucaaugugauuuuaaaaaauugacuaccuggaggaauga

SEQ ID NO: 549368 - RNA, 64 nt, Homo Sapiens
gauucaaccaacugcaaauggaaaauacgauuuuuuuuaaaaaaaggaugguuacauccguauu

SEQ ID NO: 549369 - RNA, 64 nt, Homo Sapiens
uagauugccucuccuggacauggcaaugaugaguuuuuaaaaaacaguguggaugaugauaugc

SEQ ID NO: 549370 - RNA, 64 nt, Homo Sapiens
ggacuuuucuaggaaagacuuauguauaauugcuuuuuaaaaugcagugcuuuacuuuaaacua

SEQ ID NO: 549371 - RNA, 64 nt, Homo Sapiens
cccauuuccuuuuguguuuuuauagucuauagcauuuuaaaacugcugauguuguuugcauuau

SEQ ID NO: 549372 - RNA, 64 nt, Homo Sapiens
gucacaggcuggcuucuguuuuauucagggauuuuuuuaaaaagucaaucagaaaagggauacu

SEQ ID NO: 549373 - RNA, 64 nt, Homo Sapiens
accuugcagauuuucuuaaggaauuuugucucacuuuuaaaaagaaggggagaagucagcuacu

SEQ ID NO: 549374 - RNA, 64 nt, Homo Sapiens
gcuacucuaguucuguuguuuuguguauauaauuuuuuaaaaaaaauuugugugcuucugcuca

SEQ ID NO: 549375 - RNA, 64 nt, Homo Sapiens
uaaauagccauacccaguuguacuacaaugagcuuuuuaaaaucuugaaugaauugaguauucu

SEQ ID NO: 549376 - RNA, 64 nt, Homo Sapiens
uauuggaaauuauaaauggcaaccaaaaacuggcuuuuaaaaaauauuuuuggauaucauugau

SEQ ID NO: 549377 - RNA, 64 nt, Homo Sapiens
aucuacaaugguuaccauaaaaaaucuggcaggauuuuaaaacucaaucagucuuuccuuugag

SEQ ID NO: 549378 - RNA, 64 nt, Homo Sapiens
agaauaugaucaacgacuuguaguagacucaaguuuuuaaaaaacacuauuuuacuuaaacugu

SEQ ID NO: 549379 - RNA, 64 nt, Homo Sapiens
ugcugcuggucaggacauuaaaauauugaaguguuuuuaaaaauuaaagaagaagaaaaguaaa

SEQ ID NO: 549380 - RNA, 64 nt, Homo Sapiens
ugugugacagucaugugcacacaugggcgggggcuuuuaaaaaccuuucaggaagucaaugauu

SEQ ID NO: 549381 - RNA, 64 nt, Homo Sapiens
gccgagcagggcaaugcaagaggaaagagccauuuuuuaaaaauguucugacgugugaaauuua

SEQ ID NO: 549382 - RNA, 64 nt, Homo Sapiens
caagauagaguaucuauuagguaaucuuuuaccuuuuuaaaaacuagaaaguagcuaauccagu

SEQ ID NO: 549383 - RNA, 64 nt, Homo Sapiens
aacaacaaagauuuguucauaaaauugucuugaauuuuaaaauauuugaaucagcauuugcaaa

SEQ ID NO: 549384 - RNA, 64 nt, Homo Sapiens
ugccacacuuauuucaaauaacucagaguugacauuuuaaaacuugcaugggacaugcaugaua

SEQ ID NO: 549385 - RNA, 64 nt, Homo Sapiens
uguucuuguauuuauugguuggacaaaucacauauuuuaaaauuuuuccuuuuucagauaucuu

SEQ ID NO: 549386 - RNA, 64 nt, Homo Sapiens
agcuauuuugugaagccaugguucauuagaaauauuuuaaaaucuucuuuucccccauuaauca

SEQ ID NO: 549387 - RNA, 64 nt, Homo Sapiens
uuuuauugucuuauaaauaggcacauuuggaagauuuuaaaacuuugaauuuguacuguuaaca

SEQ ID NO: 549388 - RNA, 64 nt, Homo Sapiens
guagauaauacuuaaaauggagaccacugugauuuuuuaaaaaaguuuuuucgccaugugauga

SEQ ID NO: 549389 - RNA, 64 nt, Homo Sapiens
uuuaaaaaauacugauaaauagagaaaaacgaaauuuuaaaaacggacagguuuucucagguua

SEQ ID NO: 549390 - RNA, 64 nt, Homo Sapiens
acaacuucuguuaaucaauaccaaaaauaaacacuuuuaaaaaguuauguugugcucuuuauug

SEQ ID NO: 549391 - RNA, 64 nt, Homo Sapiens
uaacuucugcacaggcuccuaggugaaaaucugguuuuaaaaugugacaucugguugacgccuc

SEQ ID NO: 549392 - RNA, 63 nt, Homo Sapiens
aaacguauggagaguuuucauauugaauaaaagguuuuaaaagauuauuuuaaaaguauauau

SEQ ID NO: 549393 - RNA, 64 nt, Homo Sapiens
auauauuauugaauaaaaggguuacauauuauuauuuuaaaagucaguauguggcauggcggca

SEQ ID NO: 549394 - RNA, 64 nt, Homo Sapiens
gguauuuaaacugaagacauuuuuuugauuggcauuuuaaaaucuuguuauuuuguuugcacuu

SEQ ID NO: 549395 - RNA, 64 nt, Homo Sapiens
acaaauguauuguggcuuccuuuuuaauucaguuuuuuaaaaaaagauauacuauuuuuuuccu

SEQ ID NO: 549396 - RNA, 64 nt, Homo Sapiens
uaauguuuauuuuaaauagguauacaaagcucuauuuuaaaauuauauaaaacugcuuacauag

SEQ ID NO: 549397 - RNA, 64 nt, Homo Sapiens
caaaauguacaagaacacacacucccauaaaagguuuuaaaauaauuuguguaaggagcacugc

SEQ ID NO: 549398 - RNA, 64 nt, Homo Sapiens
cacaggacccuuaacuuugcugaccaaauggacuuuuuaaaagauuccuuaaaugaaaaguuau

SEQ ID NO: 549399 - RNA, 64 nt, Homo Sapiens
guccaacacuaaugguuuauauaugaaaauagacuuuuaaaacuuccuuguuugucccauucau

SEQ ID NO: 549400 - RNA, 64 nt, Homo Sapiens
cgaaucucaugaauauucacgagaaauuggucucuuuuaaaagagaauagccuuuccucagucu

SEQ ID NO: 549401 - RNA, 64 nt, Homo Sapiens
uauaguuuuguaaauauuuaaacuuuauaaauauuuuuaaaagaaauucuacaaaauugcaugu

SEQ ID NO: 549402 - RNA, 64 nt, Homo Sapiens
aauuauaauauucagacuaucaguuggauauuuauuuuaaaaaaaucuugcaguugggauuuug

SEQ ID NO: 549403 - RNA, 64 nt, Homo Sapiens
cugauauugauuuaaacuguguuucacuuacaaguuuuaaaaaaaugacaggguuuaauggagc

SEQ ID NO: 549404 - RNA, 64 nt, Homo Sapiens
gauuguuaagaguucacugaagauauugacacaauuuuaaaaaaucaguaaaggaauguauaua

SEQ ID NO: 549405 - RNA, 64 nt, Homo Sapiens
uguguguguguaugauguuuuguuuuuuuaaauguuuuaaaagcuuaauagguuggcaucaguu

SEQ ID NO: 549406 - RNA, 64 nt, Homo Sapiens
auuuuuuucucauaaaauagucugauaagcuaauuuuuaaaaagaaaugccauuaacuguguug

SEQ ID NO: 549407 - RNA, 64 nt, Homo Sapiens
agaaaaauaauauuugauuuugaaucuuaaauguuuuuaaaaauuagacuugaaugggcacaaa

SEQ ID NO: 549408 - RNA, 64 nt, Homo Sapiens
auuuguuaaccuuacguuuucugucuguauauuuuuuuaaaaaucugguaguuucuggaaaaaa

SEQ ID NO: 549409 - RNA, 64 nt, Homo Sapiens
auauguucuuguacugcauuuugaucaguugagcuuuuaaaauauuauuuauagacaauagaag

SEQ ID NO: 549410 - RNA, 64 nt, Homo Sapiens
guuuauuucaugcacugugccuucaaaaugaaauuuuuaaaagggacuuuaaaugaaguugaau

SEQ ID NO: 549411 - RNA, 64 nt, Homo Sapiens
uuaaaagggacuuuaaaugaaguugaauaguaguuuuuaaaagucaauuuguaauuuaugugaa

SEQ ID NO: 549412 - RNA, 64 nt, Homo Sapiens
ccucagugggaagaaaaauaaaauuuccuucagguuuuaaaaacaugcagagagguguuuuaau

SEQ ID NO: 549413 - RNA, 64 nt, Homo Sapiens
gccagcuuuucccaccaguggugcuguugagauauuuuaaaauauugccuccguuuuaucgagg

SEQ ID NO: 549414 - RNA, 64 nt, Homo Sapiens
ugucucccugucuucuuuagaucggucugauugauuuuaaaaguggacccaaacuuagggaauu

SEQ ID NO: 549415 - RNA, 64 nt, Homo Sapiens
uaggauauuuucccuaccuaagaauuucacugucuuuuaaaaaacaaaaaguaaaguaaugcau

SEQ ID NO: 549416 - RNA, 64 nt, Homo Sapiens
aauauauauauuuuugugaauuauacuuuguuguuuuuaaaaagaaaaucaguugauuaaguua

SEQ ID NO: 549417 - RNA, 64 nt, Homo Sapiens
uauauagaaaagaggagaggaaaacuauuccauguuuuaaaauuauauagcaaagauauauauu

SEQ ID NO: 549418 - RNA, 64 nt, Homo Sapiens
gcaaugaucagauuguuaaucuacagauuuuauuuuuuaaaauuuggauguaaguagagacuuu

SEQ ID NO: 549419 - RNA, 64 nt, Homo Sapiens
guccaaagugcuuagcgaaguaaaaaaaaaagcuuuuuaaaauuucuauuguugucuauuggua

SEQ ID NO: 549420 - RNA, 64 nt, Homo Sapiens
agaacacuucagacacaggaaaaauaaacguggauuuuaaaaaaucaaucaauggugcaaaaaa

SEQ ID NO: 549421 - RNA, 64 nt, Homo Sapiens
cugucuaccuuccuuauauuuuuuuccucaacaguuuuaaaaagaaaaaaaggucuauuuuuuu

SEQ ID NO: 549422 - RNA, 64 nt, Homo Sapiens
agaaucuauuagauuuuagaaaaacauuuaaacuuuuuaaaauacuuauuaaaaaauuuguaua

SEQ ID NO: 549423 - RNA, 64 nt, Homo Sapiens
uccaaaaugcuugggaccagaaguguuucagauuuuuuaaaauuuuggaauauuugcuuuauac

SEQ ID NO: 549424 - RNA, 64 nt, Homo Sapiens
auuacugcuguggcuagagaguuugaggauugcuuuuuaaaaaagacagcaaacuuuuuuuuuu

SEQ ID NO: 549425 - RNA, 64 nt, Homo Sapiens
uggcauccuucaauuucuguauaaaagcagaucuuuuuaaaaagauacuucuguaacuuaagaa

SEQ ID NO: 549426 - RNA, 64 nt, Homo Sapiens
aagguacggaccaugugcuauuuguugucguuguuuuuaaaacacaguguauuccuaacagucu

SEQ ID NO: 549427 - RNA, 64 nt, Homo Sapiens
gugaaaucuuucuuaacagguagugagcuaccccuuuuaaaaaguuuacgcuaagcuguauuuu

SEQ ID NO: 549428 - RNA, 64 nt, Homo Sapiens
auaagcauggauugccaauucugcccugcuuagauuuuaaaaguuaucuuuuuagucuggauuu

SEQ ID NO: 549429 - RNA, 64 nt, Homo Sapiens
aguaguucaugaaagaagcuugauuauuugaggcuuuuaaaacagauggguuuucuuguuuugu

SEQ ID NO: 549430 - RNA, 64 nt, Homo Sapiens
uuacuuaaauuuguguguaauaaauacuuauuuuuuuuaaaaaccagagcaaaaaaauauagcg

SEQ ID NO: 549431 - RNA, 64 nt, Homo Sapiens
aucuuaaaggauccaaguccuaauguaauauuauuuuuaaaaucguuauuagaccaggaaaacu

SEQ ID NO: 549432 - RNA, 64 nt, Homo Sapiens
aaguuuaauguccguuguauaauuguuuuuuucuuuuuaaaaggcagaaaagggagagcuacca

SEQ ID NO: 549433 - RNA, 64 nt, Homo Sapiens
aaggaacugagguucagaauuguauugugaccuuuuuuaaaaaaaaguuaguagagcuuguucu

SEQ ID NO: 549434 - RNA, 64 nt, Homo Sapiens
aaaaauaaaaauaaaccuuauuccagaauagugauuuuaaaagucuaggggcauuuucuuuaac

SEQ ID NO: 549435 - RNA, 64 nt, Homo Sapiens
uuuuccuccccucuggccaguucccuucuguaaauuuuaaaacaucugcuuuuuuccucugcuc

SEQ ID NO: 549436 - RNA, 64 nt, Homo Sapiens
uagcauugucauacaguacauauauauauauuauuuuuaaaaauccuuaacagaaacaaaaaua

SEQ ID NO: 549437 - RNA, 64 nt, Homo Sapiens
uguaaacugugcuuaguuaauauuaaaaugauuuuuuuaaaagauuucauggucaagccuguag

SEQ ID NO: 549438 - RNA, 64 nt, Homo Sapiens
ugcaguuuuccaaacuuuucgagaaauugccaauuuuuaaaaacugauaguuuuauuaagcaug

SEQ ID NO: 549439 - RNA, 64 nt, Homo Sapiens
auauuucauugauaugcaucaguuuuuuguaaauuuuuaaaaaacuuuuuuaaauagaaacuuu

SEQ ID NO: 549440 - RNA, 64 nt, Homo Sapiens
guuugaaaggagucuuacacuuuuauacguuguauuuuaaaaacaaaggcuucaguccacauuu

SEQ ID NO: 549441 - RNA, 64 nt, Homo Sapiens
uagacuauauuuugaggcaacagaaucaacauucuuuuaaaauccccugcugcauguaaugucu

SEQ ID NO: 549442 - RNA, 64 nt, Homo Sapiens
gcaguuuacaaccagaauuacuguuuguuuuguuuuuuaaaauauuuuguguuuuugauguuuu

SEQ ID NO: 549443 - RNA, 64 nt, Homo Sapiens
aaccaaaaaaggccgggugcgcuaucacuuaucuuuuuaaaacucacuaauaacaucaacaucu

SEQ ID NO: 549444 - RNA, 64 nt, Homo Sapiens
gugaauauguuugagacuccuucuuugucuuaaauuuuaaaauauugggguuuuuuuucuaagc

SEQ ID NO: 549445 - RNA, 64 nt, Homo Sapiens
ccuaauuuucagaaauaugaaagacuucaaucauuuuuaaaauuauuggccagucaaaaaaaaa

SEQ ID NO: 549446 - RNA, 64 nt, Homo Sapiens
uuucacgugggauaaaugauaacuggcaaagugguuuuaaaagcgauauuaaaauagugacaug

SEQ ID NO: 549447 - RNA, 64 nt, Homo Sapiens
cuaaauauggaccugcucaauuuaaaaauaaaauuuuuaaaaauguuauuuacaaugaaaaguu

SEQ ID NO: 549448 - RNA, 64 nt, Homo Sapiens
aaaauuuuuaaaaaucuaaauuacaaugaaaaguuuuuaaaaauaccuuuuucaugaaaguuau

SEQ ID NO: 549449 - RNA, 64 nt, Homo Sapiens
auggcuggguggaacauuucuuccuaauugggccuuuuaaaaacaugguagccuuugugaaauu

SEQ ID NO: 549450 - RNA, 64 nt, Homo Sapiens
gaaagggcccuaaguagcucuguuugguccuauuuuuuaaaaagugugucuuuaacucuuaaau

SEQ ID NO: 549451 - RNA, 64 nt, Homo Sapiens
ugugcugcccuauauaaagguggcagaaagacauuuuuaaaaagcuuauuauuucuugcauuau

SEQ ID NO: 549452 - RNA, 64 nt, Homo Sapiens
gacauuuuuaaaaagcuuauuauuucuugcauuauuuuaaaaaguucagaguugaaaugccuuu

SEQ ID NO: 549453 - RNA, 64 nt, Homo Sapiens
uaaaaauauuuguuaucuucuuugccugccuguauuuuaaaaagaaauacaaaguuguaaaagu

SEQ ID NO: 549454 - RNA, 64 nt, Homo Sapiens
uaaguuaaguuguaaagacuuuggaauaaguuucuuuuaaaaauaugacauagccagugaugug

SEQ ID NO: 549455 - RNA, 64 nt, Homo Sapiens
cauaaaaagcuuaauuucaucccuuuuauguugguuuuaaaagguaaaugcuuaccauauuuua

SEQ ID NO: 549456 - RNA, 64 nt, Homo Sapiens
aauaacucuaaugaauauucaagauauuuuagccuuuuaaaaaguugagauuuagcucauggau

SEQ ID NO: 549457 - RNA, 64 nt, Homo Sapiens
augccuaauguuuucuuaaugaugacaacaaauauuuuaaaacugcauuuaucauuuuuuaggu

SEQ ID NO: 549458 - RNA, 64 nt, Homo Sapiens
aacugcauuuaucauuuuuuaggucuucauuaaauuuuaaaauguaauaucuguuucccacccc

SEQ ID NO: 549459 - RNA, 64 nt, Homo Sapiens
uuuuuauucuuaaacauagguguguuggcucuuuuuuuaaaagaugcgcucuaccugaaaagga

SEQ ID NO: 549460 - RNA, 64 nt, Homo Sapiens
uucuuagagcuuugcacauuccuauucacugagauuuuaaaaauuucaccuuuauucgagggaa

SEQ ID NO: 549461 - RNA, 64 nt, Homo Sapiens
gcuuuuucuccuaagguguggaacuuuuauuuuguuuuaaaaauaugaaucaaaauuccugugu

SEQ ID NO: 549462 - RNA, 64 nt, Homo Sapiens
agugcaaggagcuccuuuguguugugaugauguguuuuaaaaguugcacuaucuuaauguugaa

SEQ ID NO: 549463 - RNA, 64 nt, Homo Sapiens
agccacaagaaaucccaagagagcagaagcgaauuuuuaaaagauuuaucgugaggacugcauu

SEQ ID NO: 549464 - RNA, 64 nt, Homo Sapiens
gggccuugccugcuauggaauauugagagagauuuuuuaaaaaagauuuugcauuuuguccaaa

SEQ ID NO: 549465 - RNA, 64 nt, Homo Sapiens
acaagauauuuuucuuccauguauacaauaauuuuuuuaaaaagugcaauuugcguugcagcaa

SEQ ID NO: 549466 - RNA, 64 nt, Homo Sapiens
augggauguccuauggaaaccuauuucaccagaguuuuaaaaauaaaaaggguauuguuuuguc

SEQ ID NO: 549467 - RNA, 64 nt, Homo Sapiens
ugugacuugugguguaaaaugucuugaugauaauuuuuaaaacuuggguaacacuuccaaauau

SEQ ID NO: 549468 - RNA, 64 nt, Homo Sapiens
cucuuaguaguuuuuaguacgugcuggacaccacuuuuaaaaagcaaucacugugcuagaaaag

SEQ ID NO: 549469 - RNA, 64 nt, Homo Sapiens
ucauuuacauuugagaaagcuguuuuuaacauuauuuuaaaaugccaaauauguucuuucuaga

SEQ ID NO: 549470 - RNA, 64 nt, Homo Sapiens
gauacuggcuuuacagaaauuucagagaacuaauuuuuaaaaucuuuagcauuuaaaacuuuuu

SEQ ID NO: 549471 - RNA, 64 nt, Homo Sapiens
agucacugaacuaguagaugucaauaauuauuauuuuuaaaaauuuuuauuuguuggccgggca

SEQ ID NO: 549472 - RNA, 64 nt, Homo Sapiens
acuguguugcccagccugggugucaauaauuauuuuuuaaaaaaaauuuuuaaaaagguuuuuu

SEQ ID NO: 549473 - RNA, 64 nt, Homo Sapiens
gccugggugucaauaauuauuuuuuaaaaaaaauuuuuaaaaagguuuuuugagacagauucuu

SEQ ID NO: 549474 - RNA, 64 nt, Homo Sapiens
accacaauaauuauugccuguaugucaauuauuauuuuaaaauauuguuguauuuacuuaaugu

SEQ ID NO: 549475 - RNA, 64 nt, Homo Sapiens
auucacauuuuauuaguuugguuauguuuuguccuuuuaaaacauuuucuuuugagaugggggu

SEQ ID NO: 549476 - RNA, 64 nt, Homo Sapiens
auaugagaaauacauguuuaacauucaauaauaauuuuaaaaauuugagaaauaaacucucaua

SEQ ID NO: 549477 - RNA, 64 nt, Homo Sapiens
aaaaaggcagcauucaaauuauauagaaucuaguuuuuaaaaucagcacagaucuucuuaaaaa

SEQ ID NO: 549478 - RNA, 64 nt, Homo Sapiens
aaaguaaucuucuacuugcuucaagauuugauuuuuuuaaaaaagccugcgaccuauucaauac

SEQ ID NO: 549479 - RNA, 64 nt, Homo Sapiens
uuuggaguggaauaauuucuucauuaaaaaauguuuuuaaaaacacuauaucuugggugguuua

SEQ ID NO: 549480 - RNA, 64 nt, Homo Sapiens
uuucuuauaauauguuguaguuacuagugaauucuuuuaaaagcaauaccuagaguuagaacac

SEQ ID NO: 549481 - RNA, 64 nt, Homo Sapiens
uaaaacacuacuuacuucuuauucucuuaacaaauuuuaaaagguagugaucuuaaaaaaaaau

SEQ ID NO: 549482 - RNA, 64 nt, Homo Sapiens
uuagaauuaauguuuucaaaugugcaacucuaguuuuuaaaacaaaauuugguucuuuacauuc

SEQ ID NO: 549483 - RNA, 64 nt, Homo Sapiens
gucggugucaugucacuaaguuuaaugcugcuguuuuuaaaaaaaaaaaaaaguuuuuuuaaaa

SEQ ID NO: 549484 - RNA, 64 nt, Homo Sapiens
uaaugcugcuguuuuuaaaaaaaaaaaaaaguuuuuuuaaaaagccaaucuauguacuaaauug

SEQ ID NO: 549485 - RNA, 64 nt, Homo Sapiens
ugauauauucugaauuuauuuauucucauucguuuuuuaaaaacaucguuuuaguugcuauuca

SEQ ID NO: 549486 - RNA, 64 nt, Homo Sapiens
ugaagauggacuucaugcaacaaauucaaaccauuuuuaaaaugugugccauggcauauauguu

SEQ ID NO: 549487 - RNA, 64 nt, Homo Sapiens
cucucauauagucacacuuugucugguguauauguuuuaaaauaaauugaugaauaaaaugaag

SEQ ID NO: 549488 - RNA, 64 nt, Homo Sapiens
uagacuucguacugugaguaauuuuaaaagcccuuuuuaaaaaccaugcaaaguaagacccagc

SEQ ID NO: 549489 - RNA, 64 nt, Homo Sapiens
ccuuuuuaaaaacuagacuuaguaagacccagcauuuuaaaagcgaucuuuagauagcaugcaa

SEQ ID NO: 549490 - RNA, 64 nt, Homo Sapiens
uagagaaaaauaaaauggcuauuaaagucuucuauuuuaaaauugaugguacuaaauguuuucc

SEQ ID NO: 549491 - RNA, 64 nt, Homo Sapiens
cuuagccuggucugacuuuacuuguggagcuugguuuuaaaaucacaggguaauucacuaagag

SEQ ID NO: 549492 - RNA, 64 nt, Homo Sapiens
augacuacuguuuuuauuaauaggagaaugugcuuuuuaaaauauauguauauaaauaugcacc

SEQ ID NO: 549493 - RNA, 64 nt, Homo Sapiens
acuacccagaagggcacaagccccaggcuugaguuuuuaaaaugaaaucuaccccuuuugauga

SEQ ID NO: 549494 - RNA, 64 nt, Homo Sapiens
aaaaauaucuacuucuuuuauuuuuauaaaugaauuuuaaaagagggucucaaacuaaaauuua

SEQ ID NO: 549495 - RNA, 64 nt, Homo Sapiens
aauggcaacuuggcacaccucauucugguuucacuuuuaaaauauccuagauucauuauucuuu

SEQ ID NO: 549496 - RNA, 64 nt, Homo Sapiens
ccugaacuauacuuugaagaaauuugaagcuaauuuuuaaaaggugcaauauuaaguguuuugg

SEQ ID NO: 549497 - RNA, 64 nt, Homo Sapiens
ugaggcaauaagaauuacuucauuuauaauacuguuuuaaaauguuaaaccuuuuuauaaagau

SEQ ID NO: 549498 - RNA, 64 nt, Homo Sapiens
cuuccaguuuuguggauuaaaguaaaaagacauuuuuuaaaagcggcacugugauacaguuuug

SEQ ID NO: 549499 - RNA, 64 nt, Homo Sapiens
gaucaguuuugccaaggggcugaacuuuacuuuguuuuaaaacuuuuuguccaccucacagaug

SEQ ID NO: 549500 - RNA, 64 nt, Homo Sapiens
acaaaacaaacaaaacaccuucuuuuuccuuuuuuuuuaaaaaauuucuuuuuuccuuugucuu

SEQ ID NO: 549501 - RNA, 64 nt, Homo Sapiens
uuuauuggcaaaacuggggaaccacuuugcuuauuuuuaaaaaaucuaagcuuuuaaccccuuu

SEQ ID NO: 549502 - RNA, 64 nt, Homo Sapiens
uucuuaagcaaauauauaccaaaaaaagaaauauuuuuaaaaugcuauugugaauuccaaaucu

SEQ ID NO: 549503 - RNA, 64 nt, Homo Sapiens
auagaagaaauagaaauuuuuuucuccagagaaauuuuaaaauauuaauuuuuaaucaguuugc

SEQ ID NO: 549504 - RNA, 64 nt, Homo Sapiens
uaccuuuacugaaguuaaauuaauaacaaaaacauuuuaaaacuagguguuuuuuucggggagc

SEQ ID NO: 549505 - RNA, 64 nt, Homo Sapiens
ggggauaauaacagaacuugguccauuuucaucauuuuaaaaugaaguugcuugcuuuugcuuu

SEQ ID NO: 549506 - RNA, 64 nt, Homo Sapiens
uagaguuuguuuuggagacauccuguuauacauuuuuuaaaaugguaagaccccuuccuuagau

SEQ ID NO: 549507 - RNA, 64 nt, Homo Sapiens
uagugugaguuuguucaucaguaaauuaagcaguuuuuaaaacuauauuacuagucaugauaaa

SEQ ID NO: 549508 - RNA, 64 nt, Homo Sapiens
guaaaacaaaaugaaacuuaccaaacuauuuaaauuuuaaaacauuaacaaauguagaaaugag

SEQ ID NO: 549509 - RNA, 64 nt, Homo Sapiens
cugucucucuuuucuucucuaaagaauccaaauauuuuaaaaauuuuuaauuuccauaugggcu

SEQ ID NO: 549510 - RNA, 64 nt, Homo Sapiens
cuuucagaauguauuuuuaccagugaaauuuaaguuuuaaaauaccucuguuaccuacuuuugc

SEQ ID NO: 549511 - RNA, 64 nt, Homo Sapiens
aauuacaaaccaagaauuuuaguggcuuuaugacuuuuaaaaaacuaauaagucucugaaagcc

SEQ ID NO: 549512 - RNA, 64 nt, Homo Sapiens
uaaaguguuuuugagugugaaaauaguuuuuagcuuuuaaaauuaauuaaaauggauaauuugu

SEQ ID NO: 549513 - RNA, 64 nt, Homo Sapiens
aaaauggauaauuuguaaauccaacaacaaacauuuuuaaaauuuuuaacauggaacaaugaaa

SEQ ID NO: 549514 - RNA, 64 nt, Homo Sapiens
ugggggaaaagccauuuauuuuaugaauucagaauuuuaaaaaugauuguuauucuacacauaa

SEQ ID NO: 549515 - RNA, 64 nt, Homo Sapiens
gcuaaucuauaaauaccguuacauauuuaucccuuuuuaaaaaagauaugcuagaauuacuucc

SEQ ID NO: 549516 - RNA, 64 nt, Homo Sapiens
cacaauaaauuuuugcacucugaacuacuuaacuuuuuaaaaauuucuaaagaauaugcauucu

SEQ ID NO: 549517 - RNA, 64 nt, Homo Sapiens
ucaaauugguuuuucuacuaaguagcauccacauuuuuaaaauucguugaugacagcccucaug

SEQ ID NO: 549518 - RNA, 64 nt, Homo Sapiens
uugaaaggacuuauuaauuuuaauaggauugaaauuuuaaaauugauaauugcuuuuauuauaa

SEQ ID NO: 549519 - RNA, 64 nt, Homo Sapiens
uggcaccauauuuggccuaggcacagagagauuguuuuaaaaaaguauguguucaguguuguuu

SEQ ID NO: 549520 - RNA, 64 nt, Homo Sapiens
acaaaacuaugcauauuaugcugccacuuucuccuuuuaaaaaauucuacacaggucuguacuu

SEQ ID NO: 549521 - RNA, 64 nt, Homo Sapiens
uccuauuugauacaauuaaauauauauuuaguaauuuuaaaaauguugaucuuccagcaacguu

SEQ ID NO: 549522 - RNA, 64 nt, Homo Sapiens
gucaaauucauguuuuuaagcuuuaaaauuacuuuuuuaaaauaacuuuguuuuuaaagugaag

SEQ ID NO: 549523 - RNA, 64 nt, Homo Sapiens
uuuacaaauacuuuguuuuuugcaaaaaaaugcuuuuuaaaauuauagaaaagaucugaccaag

SEQ ID NO: 549524 - RNA, 64 nt, Homo Sapiens
gcacuuacgcuaggagaaauuucuuuuacaaaacuuuuaaaauacaauuagugcugauaauucc

SEQ ID NO: 549525 - RNA, 64 nt, Homo Sapiens
guucugucagauuaguaaggugugcuaaucuaaauuuuaaaaaaucucuuacagguuuucuugc

SEQ ID NO: 549526 - RNA, 64 nt, Homo Sapiens
augugcauguuaaguauucaaaucagucuuaaauuuuuaaaaauauguaauuuuagaaaauaau

SEQ ID NO: 549527 - RNA, 64 nt, Homo Sapiens
acuggaggucauggagauuuucuccuacauuuucuuuuaaaaguuuuauaguuucagaguuuac

SEQ ID NO: 549528 - RNA, 64 nt, Homo Sapiens
auucaaaguacuuuuuuuugaaaauacagauuuuuuuuaaaagugaauaauguguucaacucuu

SEQ ID NO: 549529 - RNA, 64 nt, Homo Sapiens
aaaaucuauacauuucugaguucugaauaaauauuuuuaaaaauuuuaauauauuuuucuuuga

SEQ ID NO: 549530 - RNA, 64 nt, Homo Sapiens
auuuaugaaaguuaauccauuucugauacgugguuuuuaaaaauaugaaauggauuuauauaua

SEQ ID NO: 549531 - RNA, 64 nt, Homo Sapiens
gauaaacugaauaagcauuuagcuuuuuaaaucauuuuaaaaauuaagucuaauuuugaagcuu

SEQ ID NO: 549532 - RNA, 64 nt, Homo Sapiens
uaugaauucuuuacaagcuguuguaaacauuuaguuuuaaaaagaaaagcaugcugaaacaugu

SEQ ID NO: 549533 - RNA, 64 nt, Homo Sapiens
caacugcucuuccuacugacucaaauaguuuauuuuuuaaaaauacuuauauaauacaugcaga

SEQ ID NO: 549534 - RNA, 64 nt, Homo Sapiens
cagccucggcaacaugccaagaccccgucucuauuuuuaaaaaagaaaaagaaccgacuucuga

SEQ ID NO: 549535 - RNA, 64 nt, Homo Sapiens
ucuguauguuaguaauaaagcuuaaauuauuccauuuuaaaauuaugaauaugaauaggguuuu

SEQ ID NO: 549536 - RNA, 64 nt, Homo Sapiens
cugguccauaguaagugcucaguaaacuuagcuguuuuaaaaacuuuguauuugaacauugaaa

SEQ ID NO: 549537 - RNA, 64 nt, Homo Sapiens
ucuccaguagugggugagguuuugccuuuguugguuuuaaaacuugauucuauaaugccaaguu

SEQ ID NO: 549538 - RNA, 64 nt, Homo Sapiens
uuaguuuacagugcaauuuuaucucaggaauuauuuuuaaaaggaggaggggacauagaaaaaa

SEQ ID NO: 549539 - RNA, 64 nt, Homo Sapiens
uuguagccauaugguaaauuuuuauuuguuaaauuuuuaaaaauuacuuagcucaaaaugucag

SEQ ID NO: 549540 - RNA, 64 nt, Homo Sapiens
agaaaucuacucugauuuagcacugggaccuacguuuuaaaaaaaguauucuuguagaauacag

SEQ ID NO: 549541 - RNA, 64 nt, Homo Sapiens
aagucuuuucaacuuaugaaacuaagucuauaccuuuuaaaaccuuauuccucacuccauccag

SEQ ID NO: 549542 - RNA, 64 nt, Homo Sapiens
ccaggugugccgcacccacuuuuauuucugacuuuuuuaaaauucauugggaugucugguuguu

SEQ ID NO: 549543 - RNA, 64 nt, Homo Sapiens
cucgauugccguuucaauugaugggguaacaauuuuuuaaaacuauaacugaaaucccccagcg

SEQ ID NO: 549544 - RNA, 64 nt, Homo Sapiens
gaaaaaaaaaagucacucuuuuuuuaaaauaaacuuuuaaaaagucccacccucggcccucuug

SEQ ID NO: 549545 - RNA, 64 nt, Homo Sapiens
aacuuuuaaaaaggaaaaaacucggcccucuuguuuuuaaaauagcaauucauuuucucccacc

SEQ ID NO: 549546 - RNA, 64 nt, Homo Sapiens
aaacuauuuaauuuuuuaaucuuuuuuuuuuuuuuuuuaaaaaagccugguucuucucguuuuc

SEQ ID NO: 549547 - RNA, 64 nt, Homo Sapiens
accuuuuaauuuucugguaaaaaaaaaaaaaaaguuuuaaaaauucuggaagccauuuguuaaa

SEQ ID NO: 549548 - RNA, 64 nt, Homo Sapiens
uaaaauuaaauuguuauugauauacuuuuaguuauuuuaaaauguauuacaagcaacccaguuu

SEQ ID NO: 549549 - RNA, 64 nt, Homo Sapiens
uuuaaucauuaagucuguaaauacaggaaaaauuuuuuaaaaauacuaaaacauauuuuugcag

SEQ ID NO: 549550 - RNA, 64 nt, Homo Sapiens
agaaaacugugucacucuucuagaaauuagccacuuuuaaaaugugcauaaccaguauuagcau

SEQ ID NO: 549551 - RNA, 64 nt, Homo Sapiens
uuagagugaagaaaaaugauauuaacagaaauauuuuuaaaaaagugacaaauuaagucuauau

SEQ ID NO: 549552 - RNA, 64 nt, Homo Sapiens
uuagggcaggaaagaacuucuuauaagaagauguuuuuaaaaccuacuuaauaauauaacaguu

SEQ ID NO: 549553 - RNA, 64 nt, Homo Sapiens
guuauaggaaaauuuauauauaacacuuuuuuguuuuuaaaauuauaaaauacauuaaaaugaa

SEQ ID NO: 549554 - RNA, 64 nt, Homo Sapiens
guuaaguaucucaauuuuucugaagacuuaguuauuuuaaaaaauuuuguaaaacacaagauuc

SEQ ID NO: 549555 - RNA, 64 nt, Homo Sapiens
aauuucuggcugggcccgguuuuaaaaugaauuauuuuaaaaaaauccaugaaauuauagccag

SEQ ID NO: 549556 - RNA, 64 nt, Homo Sapiens
uaaaauguauuuggaggagauuuuuaagcgcauuuuuuaaaacuuaaagguaaaagguuugaaa

SEQ ID NO: 549557 - RNA, 64 nt, Homo Sapiens
uaaaauguaauguugcugccaguagaaaaagaauuuuuaaaaauccagucacuagaguucuuuc

SEQ ID NO: 549558 - RNA, 64 nt, Homo Sapiens
cuuugcagugguauucggauuuaauaucagcucauuuuaaaagugcuuucugugaacugagguc

SEQ ID NO: 549559 - RNA, 64 nt, Homo Sapiens
auuuuuaguagagacagggucccggcuaauuuuuuuuuaaaaauuacaggugcaugccaacacg

SEQ ID NO: 549560 - RNA, 63 nt, Homo Sapiens
uauuuccuuuguaccuugucucauuaaacaaauauuuuaaaaugugaaacuagucaauuuguu

SEQ ID NO: 549561 - RNA, 64 nt, Homo Sapiens
gaugagauaauuggugucgggaaguacugugaauuuuuaaaacauacuuuuaaguggaggaaau

SEQ ID NO: 549562 - RNA, 64 nt, Homo Sapiens
aaauuauauaaaaauacuuugaagcuccauuauuuuuuaaaaagaauaccugaugcccuuauuu

SEQ ID NO: 549563 - RNA, 64 nt, Homo Sapiens
cuugaugcuggcugggugggggcacauacuuuaauuuuaaaacaguguuaugucuaggaaacaa

SEQ ID NO: 549564 - RNA, 64 nt, Homo Sapiens
gagccaggugugguagugugcucuacaaacaauuuuuuaaaaaugcaacaugaugagaccccau

SEQ ID NO: 549565 - RNA, 64 nt, Homo Sapiens
uaaauauuuuaucgcuucugaucacacaaauauauuuuaaaaugcuuuuauaaccccccaaaaa

SEQ ID NO: 549566 - RNA, 64 nt, Homo Sapiens
uaaaggcucuuuuauaacccucuucagaaugcaauuuuaaaaugauauuauuuaaugcauagcc

SEQ ID NO: 549567 - RNA, 64 nt, Homo Sapiens
uuuauuuuagccauucuaaugccccagcuuaguuuuuuaaaaagggggugagccaccacgccca

SEQ ID NO: 549568 - RNA, 64 nt, Homo Sapiens
uuuucuuguuuauuuguuuuagugguuuaucaauuuuuaaaaccuccucucucucuuucuugcu

SEQ ID NO: 549569 - RNA, 64 nt, Homo Sapiens
uuaaaccauuuuuuaucguuuuugaaggagaucuuuuuaaaaccuacaagagacaucucucuau

SEQ ID NO: 549570 - RNA, 64 nt, Homo Sapiens
gagaacuguagcgugcagauguguugccccucccuuuuaaaauuuuauuuucguuuuucuauug

SEQ ID NO: 549571 - RNA, 64 nt, Homo Sapiens
agacauucgucaucaguuguucuugaacauggucuuuuaaaaacuagucagaugaauuguuuuc

SEQ ID NO: 549572 - RNA, 64 nt, Homo Sapiens
agaugaauuguuuucaucugaagccugcuaucuuuuuuaaaagaugugcuauuuauucuugcac

SEQ ID NO: 549573 - RNA, 64 nt, Homo Sapiens
augucuuauuuuuuuccuaaaagauaauguuuauuuuuaaaaaggaaggaaggagcaagugaag

SEQ ID NO: 549574 - RNA, 64 nt, Homo Sapiens
ccguugcuuucguagccccugcuaaguguugacuuuuuaaaauauaaguuuauuguaaaaguga

SEQ ID NO: 549575 - RNA, 64 nt, Homo Sapiens
uacacaagugagggcuuuuuaacuugauuaugccuuuuaaaaauacuauguauguaaaauauuu

SEQ ID NO: 549576 - RNA, 64 nt, Homo Sapiens
aaagaagucacggguuguaaaaccauuuggauuuuuuuaaaacaaaaguauuaauaaucuggaa

SEQ ID NO: 549577 - RNA, 64 nt, Homo Sapiens
uuacucuuaagaggagugugugugucuguguuuguuuuaaaagucacuuauuucuuacagugau

SEQ ID NO: 549578 - RNA, 64 nt, Homo Sapiens
aauauauagagacuucuaaaucauaaucauccuuuuuuaaaaaaaagaauuuuaaaaaagaugg

SEQ ID NO: 549579 - RNA, 64 nt, Homo Sapiens
cuaaaucauaaucauccuuuuuuaaaaaaaagaauuuuaaaaaagauggauuugacacacucac

SEQ ID NO: 549580 - RNA, 64 nt, Homo Sapiens
auugcugagauguuuaguagcugauaaagaaaccuuuuaaaaaaauaauauaaaugaaugaaau

SEQ ID NO: 549581 - RNA, 64 nt, Homo Sapiens
ucauuuuuuuuuuuguuucugagaaaagaacguauuuuaaaagccacauagagugacuccaaga

SEQ ID NO: 549582 - RNA, 64 nt, Homo Sapiens
ucuauaucaugcuuuaaaguguaauaauaugauuuuuuaaaagaaauuuauuacuuguugcaaa

SEQ ID NO: 549583 - RNA, 64 nt, Homo Sapiens
ccuaacugaagagacaguuauuuauagucauuuauuuuaaaaaaugaaaauaagugaauaauaa

SEQ ID NO: 549584 - RNA, 64 nt, Homo Sapiens
ucccaauagcuuucaauuguucuuucuggaagacuuuuaaaaaaauauaaauaugcauauauau

SEQ ID NO: 549585 - RNA, 64 nt, Homo Sapiens
uggccagauucuguuauuugcaauuaaagcaaguuuuuaaaaaaugcaagaggcaguuguuagu

SEQ ID NO: 549586 - RNA, 64 nt, Homo Sapiens
cugaauuaguaguuaagucugauagccaaguaaguuuuaaaaaccaaagcauccaggaugcaca

SEQ ID NO: 549587 - RNA, 64 nt, Homo Sapiens
ucacccuuugccuauaugguagagcaauaaugcuuuuuaaaaauaaacuucugaaaacccaagg

SEQ ID NO: 549588 - RNA, 64 nt, Homo Sapiens
agagauuauuuguuuagauguaggcauuuuaauuuuuuaaaaauuccucuaccagaacuaagca

SEQ ID NO: 549589 - RNA, 64 nt, Homo Sapiens
cuucuucaaaugacauggaaagcaaaacuuucuuuuuuaaaaauuuucauuuauuuaauggaaa

SEQ ID NO: 549590 - RNA, 64 nt, Homo Sapiens
cccauuuucacaugucugcuuauuuauuuuauauuuuuaaaagaagacaguauucaccuaugua

SEQ ID NO: 549591 - RNA, 64 nt, Homo Sapiens
uuggaauaauaauauucauauuugcuaugaauccuuuuaaaaaaaucuuuggauaaaugcugac

SEQ ID NO: 549592 - RNA, 64 nt, Homo Sapiens
guaauaacgauauuucucuuuaauugauguuuuguuuuaaaaguuaaaaguaauucuuggcgug

SEQ ID NO: 549593 - RNA, 64 nt, Homo Sapiens
uuacauuaagaauaucuugaauguuguguauauauuuuaaaaagcacuuugcaaaauaguuugu

SEQ ID NO: 549594 - RNA, 64 nt, Homo Sapiens
acauauuacacuuggaccuugucucuaaaauaaauuuuaaaaaggggugacagagcaagacccu

SEQ ID NO: 549595 - RNA, 64 nt, Homo Sapiens
agcugggcgugguggugugucaucuacagaaaaauuuuaaaauuggcaacacagcaagacaccg

SEQ ID NO: 549596 - RNA, 64 nt, Homo Sapiens
ucaacaucuugagguuguguaaguuggcuaaaaauuuuaaaaaauuuucuaggcauaaaaauaa

SEQ ID NO: 549597 - RNA, 64 nt, Homo Sapiens
uacagaauaauugugcuugcuugcugaauaaaacuuuuaaaaaguaugaaaaauuauggucuua

SEQ ID NO: 549598 - RNA, 64 nt, Homo Sapiens
ccacaaauuuuucauacuccuacauguauucagcuuuuaaaacuuaugugccuugauccaacgc

SEQ ID NO: 549599 - RNA, 64 nt, Homo Sapiens
ugguuaugaaauaauguuccgagauaaaauuuaauuuuaaaaaaaacuggcugaauggcugaau

SEQ ID NO: 549600 - RNA, 64 nt, Homo Sapiens
aacauaggaaagccuuuccuaaauaacacagucuuuuuaaaacuacaaaaaaaaauugaauuaa

SEQ ID NO: 549601 - RNA, 64 nt, Homo Sapiens
uacauuugcaaauauuucucaaauuauauccucauuuuaaaaguaaaacugcucaaagccauuu

SEQ ID NO: 549602 - RNA, 64 nt, Homo Sapiens
uagauuuucuaaaacacagauuaaaaauagauauuuuuaaaaaauguaagguuuaucuucuggc

SEQ ID NO: 549603 - RNA, 64 nt, Homo Sapiens
auguuauuaaucuuuuaguacuguaucuggagcuuuuuaaaauugaaauauauuauuuguuagu

SEQ ID NO: 549604 - RNA, 64 nt, Homo Sapiens
ugucuaccuugguacgcagccuaauuaagguuuauuuuaaaaagguuucagugagucccaggga

SEQ ID NO: 549605 - RNA, 64 nt, Homo Sapiens
accagauauuaaaaugucugagcuugggauaccuuuuuaaaaacuguuuugauuuaggcagggu

SEQ ID NO: 549606 - RNA, 64 nt, Homo Sapiens
cacuaaguuccuuaucucagggguuguaaauacuuuuuaaaaaagcuccuugcuggugggcagu

SEQ ID NO: 549607 - RNA, 64 nt, Homo Sapiens
ccaguggguaccuuuguaugaguaaaaacacugauuuuaaaauccccaggguuccguuugcuga

SEQ ID NO: 549608 - RNA, 64 nt, Homo Sapiens
ugaaacaguguuaagugaaauauuauuaguggcuuuuuaaaaaacaguaguuuggauguacaau

SEQ ID NO: 549609 - RNA, 64 nt, Homo Sapiens
uucuugaaaauguauucuguauuggaguuucaguuuuuaaaaaacuguuuaucuuguucugggc

SEQ ID NO: 549610 - RNA, 64 nt, Homo Sapiens
aguauuuccuauuaaacuaucaaaggggucagucuuuuaaaauaccuacaaaucagcguaguua

SEQ ID NO: 549611 - RNA, 64 nt, Homo Sapiens
gaaguugaaauuaucuuuguuguuauaucuagguuuuuaaaacuggggcccauucauaagaaag

SEQ ID NO: 549612 - RNA, 64 nt, Homo Sapiens
gaauaaaauuucuguauacaaaguccucauuuucuuuuaaaauuauaggguaaagcuuugucua

SEQ ID NO: 549613 - RNA, 64 nt, Homo Sapiens
aaaugucuccuucuguguucacuuuuuagcucucuuuuaaaaauaaauaaggagaaaccccaua

SEQ ID NO: 549614 - RNA, 64 nt, Homo Sapiens
acuaauaguccggccaggcgauauuuuaagugccuuuuaaaaauuugaguuggauuggaaagga

SEQ ID NO: 549615 - RNA, 64 nt, Homo Sapiens
uuuauccaaaauguaguugaaaaaauuaugugcuuuuuaaaauaguuauaagaaaaaauugcac

SEQ ID NO: 549616 - RNA, 64 nt, Homo Sapiens
gcagacuuacagcuuucaggaacuccaauuucucuuuuaaaaaaaaaaaaugaaaagucugcuu

SEQ ID NO: 549617 - RNA, 64 nt, Homo Sapiens
ugaaauagaauacagcauggggauacaaccagcauuuuaaaaaaauuuugaaaccaguuuaaug

SEQ ID NO: 549618 - RNA, 64 nt, Homo Sapiens
cacuuuucacaaaaauagucgaaaucuaaagauguuuuaaaaaacagggguacauuuuugcacu

SEQ ID NO: 549619 - RNA, 64 nt, Homo Sapiens
uaauuuucuagcuggcuccacauguaaaaugccuuuuuaaaauuaaguauaauuguaaauaagc

SEQ ID NO: 549620 - RNA, 64 nt, Homo Sapiens
uuaccuucuuuggguggggacuuugguuucauuuuuuuaaaaaauucuagaucucugguguucu

SEQ ID NO: 549621 - RNA, 64 nt, Homo Sapiens
uaccaacauuaugaaauuuagaaccucccgugccuuuuaaaaaauuauauauuuaauauuaagu

SEQ ID NO: 549622 - RNA, 64 nt, Homo Sapiens
uaaaauucuuuuauguuuuuuucuaguuugucaguuuuaaaauacagauagaguuucuaacauu

SEQ ID NO: 549623 - RNA, 64 nt, Homo Sapiens
auaaagguuuguuuugguuuguuauggcuuccuuuuuuaaaaaauuacccuguagugccaguuu

SEQ ID NO: 549624 - RNA, 64 nt, Homo Sapiens
ccuuucaaggcauuaguaaauuacuugcaaauaguuuuaaaaggaaaauacgaccuuuguuaua

SEQ ID NO: 549625 - RNA, 64 nt, Homo Sapiens
cuuacggccuagagaguugacaaguugcuuguaguuuuaaaaaaauaauaaaguauacccuucu

SEQ ID NO: 549626 - RNA, 64 nt, Homo Sapiens
acaagaauuuaaguaaaagaaauguucauuuuuguuuuaaaauuuguuuuccaugugaaguuuu

SEQ ID NO: 549627 - RNA, 64 nt, Homo Sapiens
gccgauuucaggggcgggugcauuguaguuauuauuuuaaaauagaaacuaccccaccgacuca

SEQ ID NO: 549628 - RNA, 64 nt, Homo Sapiens
aaacaguuuggguuauuuggggguucuguuggcuuuuuaaaauuuucuuuuuuggauguguaaa

SEQ ID NO: 549629 - RNA, 64 nt, Homo Sapiens
aaaacaaauuagguuuggguucaauuccuucaauuuuuaaaaaacuggucucugagaguuuuuu

SEQ ID NO: 549630 - RNA, 64 nt, Homo Sapiens
guccacguuguuucacaucugguuagggggcagauuuuaaaauguaguuuuguaauguuacauu

SEQ ID NO: 549631 - RNA, 64 nt, Homo Sapiens
aaacacagagaauggguaauucaagaggccuuucuuuuaaaauagacuuuugugacccacuaau

SEQ ID NO: 549632 - RNA, 64 nt, Homo Sapiens
cugcacaaagaugucuucuguucauccugaacauuuuuaaaaaaugcagaauuuuaugugacug

SEQ ID NO: 549633 - RNA, 64 nt, Homo Sapiens
ugcauggucgcuuuaccauguuagcuguguauuguuuuaaaaguuuuaacuucaaaauauguua

SEQ ID NO: 549634 - RNA, 64 nt, Homo Sapiens
guuaagaagucagugggaaacacacagaaauuuguuuuaaaaucuuucaggagcuuuacugaaa

SEQ ID NO: 549635 - RNA, 64 nt, Homo Sapiens
aguugguuucuguuagucuuaacagucuguuuucuuuuaaaagcauguagggcuucauugccau

SEQ ID NO: 549636 - RNA, 64 nt, Homo Sapiens
augccuaaguuuugacagcaggaagaaaacaauuuuuuaaaaauucucauuacauagacgcaca

SEQ ID NO: 549637 - RNA, 64 nt, Homo Sapiens
guaaauuuaauuguacauaugguugauuuauuauuuuuaaaaauacagacuaacugauguaaug

SEQ ID NO: 549638 - RNA, 64 nt, Homo Sapiens
ucuauucaaauuuucuuuagugcuuaaaauuaaguuuuaaaaugaaaucagacacugcagguuu

SEQ ID NO: 549639 - RNA, 64 nt, Homo Sapiens
cagauucauaggcagcaucuaucuggagcacuuguuuuaaaaugagaccacuugcauuagaacc

SEQ ID NO: 549640 - RNA, 64 nt, Homo Sapiens
aaugaguaugaacuugagauccaguuuuggaucuuuuuaaaacugaauaaaauguaccugccau

SEQ ID NO: 549641 - RNA, 64 nt, Homo Sapiens
cuuaaugauuauuuuuauuauucacagaucucauuuuuaaaauuucauugugaacagguauuuc

SEQ ID NO: 549642 - RNA, 64 nt, Homo Sapiens
aauaaaauucaccauagcaaccagggaaacaaaauuuuaaaaaugucaaugaaaugcuaggggg

SEQ ID NO: 549643 - RNA, 64 nt, Homo Sapiens
uuaccaaagguuuuuauucuguuucguacaaaaauuuuaaaaagagaaagcauggaaauuaagu

SEQ ID NO: 549644 - RNA, 64 nt, Homo Sapiens
ucuagaauucaggaugcuaguugcaucuugaauuuuuuaaaaugugucuuucaccuuuccauug

SEQ ID NO: 549645 - RNA, 64 nt, Homo Sapiens
aauaauuguuuuacaaaaccucuuaagaaauugcuuuuaaaacaucuugcuguuuucaguauuu

SEQ ID NO: 549646 - RNA, 64 nt, Homo Sapiens
uauuuuugacucuuuuaucaaaguaaauugcaaauuuuaaaauuauuauuaauuuaaaacccca

SEQ ID NO: 549647 - RNA, 64 nt, Homo Sapiens
gcaugagauuagcaaaauuauuagcuuaaggacauuuuaaaauuggauuacagcccuuaaaauu

SEQ ID NO: 549648 - RNA, 64 nt, Homo Sapiens
uggcuucacauacacagagucacuuguuaccauauuuuaaaaucuugagccacauauuuucaga

SEQ ID NO: 549649 - RNA, 64 nt, Homo Sapiens
ugcgcauaagauaaaagcagaaugaaacauauuuuuuuaaaaccugaagaguauggaauauuua

SEQ ID NO: 549650 - RNA, 64 nt, Homo Sapiens
aggcaacuacuuuggguuacuuuacaaguuucauuuuuaaaagugguuugggcucccucuuauu

SEQ ID NO: 549651 - RNA, 64 nt, Homo Sapiens
ccaauuuuuguccaguuuucauuacuuuucagcuuuuuaaaaggugaacuuaugaaucauacuc

SEQ ID NO: 549652 - RNA, 64 nt, Homo Sapiens
aauuccucaugaacacuaaguuugcccaguuguguuuuaaaaacgcuuuugucuggaugaaagu

SEQ ID NO: 549653 - RNA, 64 nt, Homo Sapiens
uauauuccaguuuuaaucauccaaccugcuuuguuuuuaaaaaugugacuuuaaaaugacuuuu

SEQ ID NO: 549654 - RNA, 64 nt, Homo Sapiens
uccuuuuagagacagucuuuacaaugucagguguuuuuaaaaauuggaggagaaaaaaugaguu

SEQ ID NO: 549655 - RNA, 64 nt, Homo Sapiens
uagguuuucauuuauggcuuuacuaaacuuuaaguuuuaaaaaaaaguguucuuuaacacugac

SEQ ID NO: 549656 - RNA, 64 nt, Homo Sapiens
gacugguguuuugucuucacgcauaucuguuagauuuuaaaaauuugaucuaaacauagguucu

SEQ ID NO: 549657 - RNA, 64 nt, Homo Sapiens
aauauuguuaaucaguaaaacauuuucgaagauuuuuuaaaaauggaccuaaaccuuuaugcua

SEQ ID NO: 549658 - RNA, 64 nt, Homo Sapiens
caacuacugucauuaagaaauucuuucaaauuuuuuuuaaaagccuaguuuguguuacgaggua

SEQ ID NO: 549659 - RNA, 64 nt, Homo Sapiens
uugugguucuggaccuuacauuuagaaauacagcuuuuaaaauauacuuaguaauguccuuaac

SEQ ID NO: 549660 - RNA, 64 nt, Homo Sapiens
auuucuguucuaaugccauaaaaccccuuccccuuuuuaaaauggcacaacugauuccaacaca

SEQ ID NO: 549661 - RNA, 64 nt, Homo Sapiens
caaagauugacccaguuacuggaaaggcggguauuuuuaaaagcaacagaggcauugagaaagg

SEQ ID NO: 549662 - RNA, 64 nt, Homo Sapiens
uuuugcuuugggaaaguaggcagauugccuugaauuuuaaaacauuuggaaauagucccuguuc

SEQ ID NO: 549663 - RNA, 64 nt, Homo Sapiens
uguaucuuuacuagaacaugccuuuuuggacaauuuuuaaaauucuucauauaaaaauucaggc

SEQ ID NO: 549664 - RNA, 64 nt, Homo Sapiens
auuuauuggauuuuccucccgaauagcuaaaccuuuuuaaaaaauuguauuaaauagcauuggg

SEQ ID NO: 549665 - RNA, 64 nt, Homo Sapiens
ccaugcuaugugcacagccccuuggauuacuuuguuuuaaaaagcaucagaguuggggguacuu

SEQ ID NO: 549666 - RNA, 64 nt, Homo Sapiens
guggccuugcuucuuagacggucuucacuguguguuuuaaaacaacaacaacaacaacaacaac

SEQ ID NO: 549667 - RNA, 64 nt, Homo Sapiens
auaaacuucaggcaauaauauuuucuguguaagcuuuuaaaauuauuuuuggggaucauagcuu

SEQ ID NO: 549668 - RNA, 64 nt, Homo Sapiens
aaaaauuuaagauguucuaguucugcucucuuuguuuuaaaaaucacugcuucaaucuacuuca

SEQ ID NO: 549669 - RNA, 64 nt, Homo Sapiens
guuuaaauucuccugacuccaguuuauaacauccuuuuaaaaaauuuaaaaacaaacagccaca

SEQ ID NO: 549670 - RNA, 64 nt, Homo Sapiens
aaaaccagacucuguucugauuuuuuccuucucuuuuuaaaaauaccucacuagcauuuaucac

SEQ ID NO: 549671 - RNA, 64 nt, Homo Sapiens
acuagacccucucuaaagaccaaauccuuacuuauuuuaaaaaggcuuccucucuguuaguccc

SEQ ID NO: 549672 - RNA, 64 nt, Homo Sapiens
auauguaaagugcagucuucuuuuuuucuuucuuuuuuaaaaaagcucaugaaauugaguguua

SEQ ID NO: 549673 - RNA, 64 nt, Homo Sapiens
uuucucgcuccccacgacccagaaaccccugaaguuuuaaaaaccucaugguccuggcaaccuc

SEQ ID NO: 549674 - RNA, 64 nt, Homo Sapiens
gaaacuugucugccacaguaaaccucaaaaguuuuuuuaaaaaaggguuaauuuaaaggggggg

SEQ ID NO: 549675 - RNA, 64 nt, Homo Sapiens
aaaagcaaaauguaagaucuuuuagaaguuuacuuuuuaaaaauacauaccaguguauaagauu

SEQ ID NO: 549676 - RNA, 64 nt, Homo Sapiens
agguggaauacccaaggucaauuaucugccccauuuuuaaaacgcuucuugcaaucuccugagg

SEQ ID NO: 549677 - RNA, 64 nt, Homo Sapiens
uugggauccuccaaaggccuuauucguauugcccuuuuaaaacacuuuuuauguauuagaauca

SEQ ID NO: 549678 - RNA, 64 nt, Homo Sapiens
uuaaaauuaauuuaaauguaaaaaaaaaaaacuuuuuuaaaauggugagacuccgucucaaaaa

SEQ ID NO: 549679 - RNA, 64 nt, Homo Sapiens
uguauuuauggcugggcgugcaagcagaaauuacuuuuaaaaaauuuaaaucauuugacuuuga

SEQ ID NO: 549680 - RNA, 64 nt, Homo Sapiens
cagcuauagucaagagcuugauaauaucugcuauuuuuaaaagaugcgaaauuagaaaaaaauu

SEQ ID NO: 549681 - RNA, 64 nt, Homo Sapiens
uuagcuggguguggugguaccuaugaaaaaacuuuuuuaaaaauaacauaaugagaccuguccu

SEQ ID NO: 549682 - RNA, 64 nt, Homo Sapiens
agaaaaaaguacaaaaaaauuuuaaauaucugaguuuuaaaaaaguuuuguaaauuguauaauu

SEQ ID NO: 549683 - RNA, 64 nt, Homo Sapiens
aucucguuaaagaucuccaacccuuuugauucuguuuuaaaauuuuaaaugaaaggugcgcuau

SEQ ID NO: 549684 - RNA, 64 nt, Homo Sapiens
agucuauauguuuucguaaucuucaucaagaaguuuuuaaaaggcaagcaaaaacagaagcaaa

SEQ ID NO: 549685 - RNA, 64 nt, Homo Sapiens
uggaaaaaaaaauaauauuuuuauguuaaaacaauuuuaaaaucuuaaaauggccaucagacau

SEQ ID NO: 549686 - RNA, 64 nt, Homo Sapiens
gccaucagacauagagagcuuugugugauucauguuuuaaaaagaaccgaagaagccacaggca

SEQ ID NO: 549687 - RNA, 64 nt, Homo Sapiens
gagaaagaucuuuuuuaaauaaucuuuuugcuguuuuuaaaaaauuaaacaaggcuuuguguuc

SEQ ID NO: 549688 - RNA, 64 nt, Homo Sapiens
gaauaaucaagugcuaaaacaaaaucaggugcuuuuuuaaaacagcuugauugagauauaaucc

SEQ ID NO: 549689 - RNA, 64 nt, Homo Sapiens
ugauugaagauugaaaagggucagcugggaaaauuuuuaaaaagacuguuuuuaaaaaggugcu

SEQ ID NO: 549690 - RNA, 64 nt, Homo Sapiens
aagggucagcugggaaaauuuuuaaaaagacuguuuuuaaaaaggugcuacaaaauaaagugcu

SEQ ID NO: 549691 - RNA, 64 nt, Homo Sapiens
auuaaauuuaaagccuaagaauguauagagcuaguuuuaaaauaaugaucucagauuuuuaaaa

SEQ ID NO: 549692 - RNA, 64 nt, Homo Sapiens
guauagagcuaguuuuaaaauaaugaucucagauuuuuaaaaaggauauaggaaccugcauugu

SEQ ID NO: 549693 - RNA, 64 nt, Homo Sapiens
augguuucuaucauuauuuagccccaccuuuguauuuuaaaauccuucagaauacauuuaugaa

SEQ ID NO: 549694 - RNA, 64 nt, Homo Sapiens
aggaccaaacuuuuucaggaaaaugcugccucguuuuuaaaacaagccuccuaagcuauguucu

SEQ ID NO: 549695 - RNA, 64 nt, Homo Sapiens
cauuguuuuaaauauccuuaacuaacuuaaagaauuuuaaaauuguacugugauuuucauaacc

SEQ ID NO: 549696 - RNA, 64 nt, Homo Sapiens
uaauuaaauuuuacaugugcuguacaagggguuauuuuaaaaagcauuuguucaauuucaauaa

SEQ ID NO: 549697 - RNA, 64 nt, Homo Sapiens
cugucucaugauuugaaaaguacaccuugcaaaguuuuaaaaauaaaguuuuuaggcaaaugcg

SEQ ID NO: 549698 - RNA, 64 nt, Homo Sapiens
uuauuauugacauuaaguaaugguaccauauauuuuuuaaaauacauauugacuugaauuguga

SEQ ID NO: 549699 - RNA, 64 nt, Homo Sapiens
cguaucuauguuguguaggggaaauuuuuucauuuuuuaaaaauucuacuuugguuuuguuguu

SEQ ID NO: 549700 - RNA, 64 nt, Homo Sapiens
uugcaucucucuaugaagauacgucuguccaaacuuuuaaaaggcauaacuguauuuuaugugu

SEQ ID NO: 549701 - RNA, 64 nt, Homo Sapiens
uauuuuauucucacccgaaguauucacacaaucuuuuuaaaaaaaauuugaaauggcauuuugu

SEQ ID NO: 549702 - RNA, 64 nt, Homo Sapiens
guuuacauaaauacuauguuuuacaguuuucauauuuuaaaauauuaauaaaguuaaaucacaa

SEQ ID NO: 549703 - RNA, 64 nt, Homo Sapiens
aaugaagcugcaaacuucuuuuuacucuaaucauuuuuaaaauacuaauggaagaacuuucuag

SEQ ID NO: 549704 - RNA, 64 nt, Homo Sapiens
uuguuugguuugaguuugauuuggcuuuuauauuuuuuaaaaucccuuuugcuaccccaucugg

SEQ ID NO: 549705 - RNA, 64 nt, Homo Sapiens
uaccugauugauauuacauucaccuuugauuguuuuuuaaaaguuuauuuuuacagaauauauu

SEQ ID NO: 549706 - RNA, 64 nt, Homo Sapiens
uuagucuuucaagaaugacggaauaagagaccuguuuuaaaaaggaacugcagcaaucuuugaa

SEQ ID NO: 549707 - RNA, 64 nt, Homo Sapiens
aaaaugagugugaagggggaacaagucaaaauauuuuuaaaagaucuucaaaaguaaugccucu

SEQ ID NO: 549708 - RNA, 64 nt, Homo Sapiens
cggcccacaagggugcccaccucuuguuuuccccuuuuaaaaacucagauuuuuaaaagcccuu

SEQ ID NO: 549709 - RNA, 64 nt, Homo Sapiens
ccaccucuuguuuuccccuuuuaaaaacucagauuuuuaaaagcccuuuccaaagguuucaacu

SEQ ID NO: 549710 - RNA, 64 nt, Homo Sapiens
ucagccccacuccacaguuaggccaagaauuagauuuuaaaacuucaucugucugucccaguua

SEQ ID NO: 549711 - RNA, 64 nt, Homo Sapiens
augcuaaaacuguagaagcccaaucaccagcaguuuuuaaaaaggugauaacuuuuauuagcuc

SEQ ID NO: 549712 - RNA, 64 nt, Homo Sapiens
gcagcuauuaugaaaucagcuuucauaggccuauuuuuaaaaggaaucugaaauuuaauucuau

SEQ ID NO: 549713 - RNA, 64 nt, Homo Sapiens
ggacagucauuuggcuucugaauguuugaaacgauuuuaaaaaauaaguagugcuaugguuguu

SEQ ID NO: 549714 - RNA, 64 nt, Homo Sapiens
uugugaacaaguaauuuuauauugugcuuuaauuuuuuaaaaaguauucuuuauucauauguau

SEQ ID NO: 549715 - RNA, 64 nt, Homo Sapiens
uuuuucucugggugaggcaucugguuacugguuauuuuaaaaagaauaaagacauuccuggaau

SEQ ID NO: 549716 - RNA, 64 nt, Homo Sapiens
aucuauguuacauuaaaaaagaaacgcguguacauuuuaaaagcaaugauguaaacuuuguucu

SEQ ID NO: 549717 - RNA, 64 nt, Homo Sapiens
ugcucauuucaacuuggcuuuuugucuuuuaaauuuuuaaaaaaugcaguaguguguuagagac

SEQ ID NO: 549718 - RNA, 64 nt, Homo Sapiens
agagccuuaaaaguuaaaaacauuuucaguuuuuuuuuaaaaaacguacucuuauuaucuggaa

SEQ ID NO: 549719 - RNA, 64 nt, Homo Sapiens
ugugcuauauaaaaaaaaaaaaagacuuguuaaguuuuaaaauaacaaaaauggcuaguugaau

SEQ ID NO: 549720 - RNA, 64 nt, Homo Sapiens
uuucaagcauggaucuccauauuucaaaggaaaguuuuaaaaauguuuuuaaaacuucaaauau

SEQ ID NO: 549721 - RNA, 64 nt, Homo Sapiens
aucuccauauuucaaaggaaaguuuuaaaaauguuuuuaaaacuucaaauaucucaccacagug

SEQ ID NO: 549722 - RNA, 64 nt, Homo Sapiens
gucuuacugaaccaacaaucaaaaaaugguucuguuuuaaaaaggauuuuguuugauuugaaau

SEQ ID NO: 549723 - RNA, 64 nt, Homo Sapiens
acacuaaccgucaugugcuuuuaguaaauaugauuuuuaaaagcaguucaaguugacaacagca

SEQ ID NO: 549724 - RNA, 64 nt, Homo Sapiens
gaguaaaaguuauacuuaacuugucugucuauuauuuuaaaauaugcauugaaauaauguggua

SEQ ID NO: 549725 - RNA, 64 nt, Homo Sapiens
gaagcaccauuuaugcagauuuucuucagaauauuuuuaaaagguacagaauccuuaaaauauu

SEQ ID NO: 549726 - RNA, 64 nt, Homo Sapiens
auucaugcuuacuguaaaguggaaguugagauuauuuuaaaacuucaagcucaguaauuuugaa

SEQ ID NO: 549727 - RNA, 64 nt, Homo Sapiens
uuguacuaagugaaacuuguuaaauaaaucuuccuuuuaaaaacuggaaaaaaucuugaacuga

SEQ ID NO: 549728 - RNA, 64 nt, Homo Sapiens
cauuuauaacaauuuucuuauaaaaacauguugcuuuuaaaauguggaguagcuguaaucacuu

SEQ ID NO: 549729 - RNA, 64 nt, Homo Sapiens
uuaaagcaaaauauucauuuuuacuuuuucuuauuuuuaaaauuaggcugaauguacuucaugu

SEQ ID NO: 549730 - RNA, 64 nt, Homo Sapiens
agaggacauaacauuuugaagaauuccuuuuguguuuuaaaaugugauauauauauauauaaaa

SEQ ID NO: 549731 - RNA, 64 nt, Homo Sapiens
uugaguuuuaucccguaaguucuguuuugauuuuuuuuaaaaaacaaacccuuuuagucacuuu

SEQ ID NO: 549732 - RNA, 64 nt, Homo Sapiens
aguucccauuuuucuugacaacaauaaauaccacuuuuaaaaaugacacauauuuaaacacuua

SEQ ID NO: 549733 - RNA, 64 nt, Homo Sapiens
ccaacauagauauuuucuuucuccugaccauguauuuuaaaauauagucuauuucuugacuuug

SEQ ID NO: 549734 - RNA, 64 nt, Homo Sapiens
uuggcaagaaaagaagaauaguuguuuaaauauuuuuuaaaaaacacuugaauaagaaucagua

SEQ ID NO: 549735 - RNA, 64 nt, Homo Sapiens
cgcccggcuaaaacauugcaaauuuaaaugagaguuuuaaaaauuaaauaaugacugcccuguu

SEQ ID NO: 549736 - RNA, 64 nt, Homo Sapiens
aaaguuuucuacaaggggagaaaaguguuaaaauuuuuaaaauauguuuuccaggacacuucac

SEQ ID NO: 549737 - RNA, 64 nt, Homo Sapiens
uaguuggcuuuugaaucgauuauuucaugcuuuuuuuuaaaaaaaaaaaaaaacaaaauaacaa

SEQ ID NO: 549738 - RNA, 64 nt, Homo Sapiens
uacaauuuuuucaucuaaaaguauuuuaagauauuuuuaaaauccaagagcuucucuauacuuu

SEQ ID NO: 549739 - RNA, 64 nt, Homo Sapiens
cauuuuuagugaaauauuauuuuauagcuacuaauuuuaaaaugucuugcuugauuguauggug

SEQ ID NO: 549740 - RNA, 64 nt, Homo Sapiens
acaaaaccacuggaaaguuuaugguuguauuauuuuuuaaaaaaauuccaagugauugaaaccu

SEQ ID NO: 549741 - RNA, 64 nt, Homo Sapiens
uuuuguaaauuaucaagcuucaaaaagcuuuuuuuuuuaaaaaaaaacaugcauauucuaaaaa

SEQ ID NO: 549742 - RNA, 64 nt, Homo Sapiens
ucauaauuaucacuaauaagcaucaguuuguuguuuuuaaaaggauauuuaagugagcauuuuc

SEQ ID NO: 549743 - RNA, 64 nt, Homo Sapiens
uacauugagauauucugcagcugauagagcagcauuuuaaaaauguaacagguggaaaauuaca

SEQ ID NO: 549744 - RNA, 64 nt, Homo Sapiens
acuuucuuuccuuacaacagcuugaaaaucauuauuuuaaaauccuuaaaucacugugucuaga

SEQ ID NO: 549745 - RNA, 64 nt, Homo Sapiens
gcaaaagaaaaaguguucuagaguguuguugcuuuuuuaaaaaaagcgcugaaguuagaccaag

SEQ ID NO: 549746 - RNA, 64 nt, Homo Sapiens
uuauaagaacauagacagcuuuuuuuuuuacuaguuuuaaaacccaucuuccaagguauaugaa

SEQ ID NO: 549747 - RNA, 64 nt, Homo Sapiens
uccuuugguauucaaucaugugucuuuuagugcuuuuuaaaauuuuacccauucuuuaauucag

SEQ ID NO: 549748 - RNA, 64 nt, Homo Sapiens
gcacaaaaagauaccuuaaaauuugaaacauugcuuuuaaaacuacuuagcacuucagggcaga

SEQ ID NO: 549749 - RNA, 64 nt, Homo Sapiens
aaacugcacaugauuucacaaauauuaaaaagucuuuuaaaaaguauugccaaacauuaauguu

SEQ ID NO: 549750 - RNA, 64 nt, Homo Sapiens
gguaccuugcacacaucaucuguaagcuguuugguuuuaaaauacuguagauaauuaaccaagg

SEQ ID NO: 549751 - RNA, 64 nt, Homo Sapiens
aauugauguugaugcaauccuuacaaaugauugcuuuuaaaauuuuaagcuaggaaaagaaauc

SEQ ID NO: 549752 - RNA, 64 nt, Homo Sapiens
aacguguauguuuuucaguucaaagucaugauguuuuuaaaaucuuauuaaaguuucaaaaauc

SEQ ID NO: 549753 - RNA, 64 nt, Homo Sapiens
uccaaacucucuaaauaguagcuaacuuuuauuuuuuuaaaaugagucgugggguagugcuuca

SEQ ID NO: 549754 - RNA, 64 nt, Homo Sapiens
gacauaauuggaaaagcagauuagcugcuacuacuuuuaaaagacuuaaggucgggaugccuuu

SEQ ID NO: 549755 - RNA, 64 nt, Homo Sapiens
uauauauuuugugggcuuaauugaaacaacauuauuuuaaaaucaaaggggauauauguuugug

SEQ ID NO: 549756 - RNA, 64 nt, Homo Sapiens
uccccuaauuuuccagagaagccuauuuuuauauuuuuaaaaaacugacagggcccaguuaaau

SEQ ID NO: 549757 - RNA, 64 nt, Homo Sapiens
aaacuguaucaaaguuguacauauuuccaaacauuuuuaaaaugaaaaggcacucucguguucu

SEQ ID NO: 549758 - RNA, 64 nt, Homo Sapiens
aaauguuuuugaaguuaaauaaacaguauuacauuuuuaaaacucuucucuauuauaacaguca

SEQ ID NO: 549759 - RNA, 64 nt, Homo Sapiens
gugauugcucuaauaaagaauauaauuuuuugaauuuuaaaaaucaaaugaucaaaaauauagu

SEQ ID NO: 549760 - RNA, 64 nt, Homo Sapiens
uccuuugauugauagagaaguauuauugguaauguuuuaaaaauaaggucuuugugugcuagaa

SEQ ID NO: 549761 - RNA, 64 nt, Homo Sapiens
uagaaguuagggguuuuguuagcaagagugcaauuuuuaaaaucuguuuguacuaaaaugcaaa

SEQ ID NO: 549762 - RNA, 64 nt, Homo Sapiens
uaacaugccuauuaacuggucaaaauuuauuacuuuuuaaaaaauuuaaaaaugacaacauuca

SEQ ID NO: 549763 - RNA, 64 nt, Homo Sapiens
gacaacauucacaaaauuuaauucuguauaggauuuuuaaaaauuagauucugacaguguugug

SEQ ID NO: 549764 - RNA, 64 nt, Homo Sapiens
uugaugcaguugacuuuucuucaauaaaugcugcuuuuaaaaccaucuacacauuuauuuucaa

SEQ ID NO: 549765 - RNA, 64 nt, Homo Sapiens
gaacuuuaguuaauuaagugccuacacaauuuuuuuuuaaaagggcuaagccgcuucauucaug

SEQ ID NO: 549766 - RNA, 64 nt, Homo Sapiens
uuaauaaaguuaaucgcaacuuacaguuuucauauuuuaaaauaguuuacauaaauacuauguu

SEQ ID NO: 549767 - RNA, 64 nt, Homo Sapiens
uuccauauuuucacuacgcuugaaauuccuauuauuuuaaaacugucagauuaaauuuuuucag

SEQ ID NO: 549768 - RNA, 64 nt, Homo Sapiens
uagaugagauuaaccuguuuagaauucucucucuuuuuaaaaccuucuuaguucauacccuucc

SEQ ID NO: 549769 - RNA, 64 nt, Homo Sapiens
uuaaaugucuggccggguguaugagcaaagauuuuuuuaaaaccacauuuuuuaaaaaccacaa

SEQ ID NO: 549770 - RNA, 64 nt, Homo Sapiens
cacaaaugagcaaagauuuucauuguaguacauuuuuuaaaaacuuccacaaauaguaugugcu

SEQ ID NO: 549771 - RNA, 64 nt, Homo Sapiens
ugauuaucuuuuagagaagucugugguuauguuguuuuaaaaaauuuuaagaugugauauggua

SEQ ID NO: 549772 - RNA, 64 nt, Homo Sapiens
gaggacuugcaucagcugcccaaagugaagguuuuuuuaaaaaagcugcuauuagaggggaaca

SEQ ID NO: 549773 - RNA, 64 nt, Homo Sapiens
auauauaagacauuuuuuuguuuauaaaaauaaauuuuaaaauggcaaaauaauguugugaguu

SEQ ID NO: 549774 - RNA, 64 nt, Homo Sapiens
uaaagcaauauauacacagguuuuucuuuuuccuuuuuaaaaagaucagaaucguuuguaaagc

SEQ ID NO: 549775 - RNA, 64 nt, Homo Sapiens
uaaguccauucuaauuacccaucuguauauugcuuuuuaaaaguaccaucacacuuuaauucca

SEQ ID NO: 549776 - RNA, 64 nt, Homo Sapiens
uuggggguguucagccacuguugaaguuuuuguuuuuuaaaagggaaauauugaauuuuuauuu

SEQ ID NO: 549777 - RNA, 64 nt, Homo Sapiens
aggagacuguguuugguccucugaacacauuucuuuuuaaaaaaaaucaagaaacaaacaaaag

SEQ ID NO: 549778 - RNA, 59 nt, Homo Sapiens
cuuggccucagaggacccuuggcuacagguuuuaaaagcuuccuggagaugaaaguuga

SEQ ID NO: 549779 - RNA, 64 nt, Homo Sapiens
ugcucuacaugccuaauguuugucauuuuccuauuuuuaaaacauuccugguaauacagcucag

SEQ ID NO: 549780 - RNA, 64 nt, Homo Sapiens
auuauuccugguaauacagcggccauaccuggaauuuuaaaaaucauugcuauuaaauguagaa

SEQ ID NO: 549781 - RNA, 64 nt, Homo Sapiens
uacaauuuagaucucugaaacuaaucagaaauauuuuuaaaaaagcuuagugauccacugaucu

SEQ ID NO: 549782 - RNA, 64 nt, Homo Sapiens
uuccccuuuaaguuaugaugacacauuaaaaauuuuuuaaaaauugcaagugacuauuugauua

SEQ ID NO: 549783 - RNA, 64 nt, Homo Sapiens
ugguguuuucuuuuucuuaaugauggcaaaaggcuuuuaaaagugcaaauugcuaugugugugg

SEQ ID NO: 549784 - RNA, 64 nt, Homo Sapiens
uacauguauuaaauuacauuauaacagggauugauuuuaaaaugaaacucugaauuuaucuuug

SEQ ID NO: 549785 - RNA, 64 nt, Homo Sapiens
uagccuaagauauacuuguuagcagaaauucuguuuuuaaaaaucuuuagcuguguuauuauag

SEQ ID NO: 549786 - RNA, 64 nt, Homo Sapiens
caguaccguguggaaaaugcaauaaaguuagcuauuuuaaaauggugccuaucuuuucacugac

SEQ ID NO: 549787 - RNA, 64 nt, Homo Sapiens
auguaucuugauuguugauuuagcuugagcuuucuuuuaaaaucucuuuuuuugaaauaaaaag

SEQ ID NO: 549788 - RNA, 64 nt, Homo Sapiens
uuuucccuuuucugaucugcucuccuucagugccuuuuaaaagguacugaauuucugucuugcc

SEQ ID NO: 549789 - RNA, 64 nt, Homo Sapiens
uauuauuugaagaguauuuugaaacuuaaucaucuuuuaaaauguuuaugcuauuuaauuuugu

SEQ ID NO: 549790 - RNA, 64 nt, Homo Sapiens
auuacauugaaacaucaaacgucacgccuuaggauuuuaaaaaaucaaaaauaguuugccuuag

SEQ ID NO: 549791 - RNA, 64 nt, Homo Sapiens
cuaaguguauaguuucauuuggcuuaauauaacauuuuaaaauuaaggcaucucagcuuucugu

SEQ ID NO: 549792 - RNA, 64 nt, Homo Sapiens
acuggauauuucaaucuuuuuuguuuaaucuuuuuuuuaaaaaauagaguagguauuaaucuua

SEQ ID NO: 549793 - RNA, 64 nt, Homo Sapiens
uagaguagguauuaaucuuaaagauacaaaagcuuuuuaaaauuuuauguggcuguaaugacaa

SEQ ID NO: 549794 - RNA, 64 nt, Homo Sapiens
gauagguauuguuggaaagcuugaaaauguuugcuuuuaaaacuucaauuuucuuuaguuuuaa

SEQ ID NO: 549795 - RNA, 64 nt, Homo Sapiens
guuaguagaucacuaugguaguguacaauuguguuuuuaaaauauuuuagaguaaaacuauuuu

SEQ ID NO: 549796 - RNA, 64 nt, Homo Sapiens
aaguuuagauguugccuuuacuucauuggggaaguuuuaaaaaaguccaaacacauccugcuuc

SEQ ID NO: 549797 - RNA, 64 nt, Homo Sapiens
gacauuuucaauacauaaaauuuauuuugaagacuuuuaaaaugcucaaauuuucuaacuuguu

SEQ ID NO: 549798 - RNA, 64 nt, Homo Sapiens
auguaguuagacugugaggagugcuuugcuuacuuuuuaaaaaaguguguaaacuaguauguau

SEQ ID NO: 549799 - RNA, 64 nt, Homo Sapiens
acugcccuauguugucuauacccucaaucacagguuuuaaaauucuuagaccaucacaugccuc

SEQ ID NO: 549800 - RNA, 64 nt, Homo Sapiens
gaaaagaaggaaaaagaaaaccucuucuuucccauuuuaaaaaacccaccucuucuacccuccc

SEQ ID NO: 549801 - RNA, 64 nt, Homo Sapiens
aucuaaagaaagcacauuuucucuuucucucuguuuuuaaaauauguucacuccucuccccuuu

SEQ ID NO: 549802 - RNA, 64 nt, Homo Sapiens
caauauaagaaacaaagucauaaauaaaacauaauuuuaaaaaauuaaaugaagaagcacucau

SEQ ID NO: 549803 - RNA, 64 nt, Homo Sapiens
agcucuaggaagagcucaagucuuaaagaaugauuuuuaaaaucagcauaucagagaggcaaau

SEQ ID NO: 549804 - RNA, 64 nt, Homo Sapiens
gucuuacugaagcaacaaucgaaaaaugguucuguuuuaaaaaggauuuuguuugauuugaaau

SEQ ID NO: 549805 - RNA, 64 nt, Homo Sapiens; identical to SEQ ID NO: 549723

SEQ ID NO: 549806 - RNA, 64 nt, Homo Sapiens
uggggacaacaucugaaggguauguugcaugcauuuuuaaaaaaaucaucucauaugcauugua

SEQ ID NO: 549807 - RNA, 64 nt, Homo Sapiens
cuguggagaguuucuguuaggaaaagccauacauuuuuaaaaauguagcaaaaugucaagggaa

SEQ ID NO: 549808 - RNA, 64 nt, Homo Sapiens
gaagauccgcagauucaugcagcauuccauauuuuuuuaaaaaaagguuacacugugcaccgac

SEQ ID NO: 549809 - RNA, 64 nt, Homo Sapiens
gacugaaagaauguuaagauuuaucugcaaggauuuuuaaaaaauugaaacuugcauuuuaagu

SEQ ID NO: 549810 - RNA, 64 nt, Homo Sapiens
guguuuaaaagcaaauacugacuuucaaaaaaguuuuuaaaaccugauuugaaagcuaacaauu

SEQ ID NO: 549811 - RNA, 64 nt, Homo Sapiens
ugauuuaucuagaaauuuaccucaaaagcagaauuuuuaaaacugcauuuuuaaucaguggaac

SEQ ID NO: 549812 - RNA, 64 nt, Homo Sapiens; identical to SEQ ID NO: 549809

SEQ ID NO: 549813 - RNA, 64 nt, Homo Sapiens; identical to SEQ ID NO: 549810

SEQ ID NO: 549814 - RNA, 64 nt, Homo Sapiens; identical to SEQ ID NO: 549811

SEQ ID NO: 549815 - RNA, 64 nt, Homo Sapiens
uuuauuuuuuacaucuaugguauaauuguauagauuuuaaaaguuauauacagaaaccucgaua

SEQ ID NO: 549816 - RNA, 64 nt, Homo Sapiens
uguguacuauuaucugaggaucuccucgaucagcuuuuaaaaaauaagauagcaaauuuaaauc

SEQ ID NO: 549817 - RNA, 64 nt, Homo Sapiens
gggcggcccuuaccuggcagcacugggguggaggcggcaggaagcagggccuucgcucccucag

SEQ ID NO: 549818 - RNA, 64 nt, Homo Sapiens
aaccucagagagggcagaggacucugcggaggaacggcaggaagucaaggauuaguuuuccagg

SEQ ID NO: 549819 - RNA, 64 nt, Homo Sapiens
aauguggaccuuagaauacaguuuugaguagaguugaucaaaaucaauuaaaauagucucuuua

SEQ ID NO: 549820 - RNA, 64 nt, Homo Sapiens
aaaauguucacaauauauuuaguuguaaaccaagugaucaaacuacauauuguaaagcccauuu

SEQ ID NO: 549821 - RNA, 64 nt, Homo Sapiens
uaacgucaccagugauaaguacgucuucaccaagugaucaaaauggggagaaaaaugacaaaug

SEQ ID NO: 549822 - RNA, 64 nt, Homo Sapiens
uucauuuuuaaaccucucuuuuuacaguagaauaugaucaaaccaauuuuuuaucugcauaaau

SEQ ID NO: 549823 - RNA, 64 nt, Homo Sapiens
gccauucacaguguaaggcagaacauaaauuuagugaucaaacuguaugaaguaucucaaacug

SEQ ID NO: 549824 - RNA, 64 nt, Homo Sapiens
acugaaccaugucuccgcacaauaaucaucacaaugaucaaauccguaaauagauagcauugua

SEQ ID NO: 549825 - RNA, 64 nt, Homo Sapiens
guggguauuauggaggagguagagagcaaaacuaugaucaaauagggcugcuuuguguggccau

SEQ ID NO: 549826 - RNA, 64 nt, Homo Sapiens
cuucaaauaguuaaaccaaaaaauuucagcucagugaucaaaguauuuuccuuuuuauuaugag

SEQ ID NO: 549827 - RNA, 64 nt, Homo Sapiens
cauucuagccaugugcaaccccugauuugcaaagugaucaaaagaguuuuagaucauugguuau

SEQ ID NO: 549828 - RNA, 64 nt, Homo Sapiens
uccgagaggcauagaaggaaugcucagacucaucugaucaaaguaaaagaguuagaugggauga

SEQ ID NO: 549829 - RNA, 64 nt, Homo Sapiens
ugccccaguuuccuuugaaaagcaccagucuccaugaucaaaaacauguccuucaugguaggug

SEQ ID NO: 549830 - RNA, 64 nt, Homo Sapiens
auagcauguaugccuuauuagugucauuauuuaaugaucaaaguagcaaaggaguuugcugguu

SEQ ID NO: 549831 - RNA, 64 nt, Homo Sapiens
aaagucuggguauucauugguuauuggccugaaaugaucaaauaacuacaaaugaucuguugaa

SEQ ID NO: 549832 - RNA, 64 nt, Homo Sapiens
ggaauaagagaaacaaauuauaucaagguaaaacugaucaaaagcauaauugaaaguucugaaa

SEQ ID NO: 549833 - RNA, 65 nt, Homo Sapiens
ggccaguugucugguuuccauguauucuaggccagguaggcaacacagagccaaggcgggugcug

SEQ ID NO: 549834 - RNA, 65 nt, Homo Sapiens
uuaugcacacggugauuucauguuauauaugcaaaguaggcaacuguuuucuuaguuacagaagu

SEQ ID NO: 549835 - RNA, 65 nt, Homo Sapiens
uaagucuuagguggguugggaagacagauaaugaaguaggcaaagagaaaaggacccaagauaga

SEQ ID NO: 549836 - RNA, 65 nt, Homo Sapiens
gacaccaccaucuauagggucccaacuugguuauuguaggcaaccuucccucucuccuuggugaa

SEQ ID NO: 549837 - RNA, 65 nt, Homo Sapiens
caguaaaucaugaguagucgcauguguggacaucaguaggcaaguaaccaguuuuacuaaugcau

SEQ ID NO: 549838 - RNA, 65 nt, Homo Sapiens
gauugguaaucugaaaaggaccacaagcauagcugguaggcaaauuguuaggcagaauaauggua

SEQ ID NO: 549839 - RNA, 65 nt, Homo Sapiens
uugcacauaaauaacccccgaccccacccucagcuguaggcaagcgcaguggggccaaggaugcc

SEQ ID NO: 549840 - RNA, 65 nt, Homo Sapiens
caggacuccgggaaggagguccucccauggaauagguaggcaagcccuugacacauccaggccaa

SEQ ID NO: 549841 - RNA, 65 nt, Homo Sapiens
cuucuuuucuaaaagguauaaaugauggcuuuuggguaggcaaaacacuaauauuguguuauuaa

SEQ ID NO: 549842 - RNA, 65 nt, Homo Sapiens
guaacacaaugguaaguaucacuguauugaauacaguaggcaauuacaaaucuguacaacauguu

SEQ ID NO: 549843 - RNA, 65 nt, Homo Sapiens
ugauuuguaaauuugcuucucucuaauucucaauuguaggcaaaccugguauugcaagucauuug

SEQ ID NO: 549844 - RNA, 65 nt, Homo Sapiens
agagaucgaagccuccuaucuauuuuuaagagaucguaggcaauuagucaacugcacguguuuua

SEQ ID NO: 549845 - RNA, 65 nt, Homo Sapiens
gaaaugcgccaaggguucagggcuggauaugggaaguaggcaaauugcaguggagcccugagcag

SEQ ID NO: 549846 - RNA, 65 nt, Homo Sapiens
guggaaguccuccagggauccaaugggguccuucuguaggcaaagcagccuguggcccagagaca

SEQ ID NO: 549847 - RNA, 65 nt, Homo Sapiens
uuaauuuucauguaguuguuaauguauuucuaauaguaggcaauuggaucccuagacuaaguuga

SEQ ID NO: 549848 - RNA, 65 nt, Homo Sapiens
aaacguugucuacacaaacggcguugugugucuuuguaggcaagcgugugugucuguauguuucu

SEQ ID NO: 549849 - RNA, 65 nt, Homo Sapiens
gugggaggaucauuugagcuaaucccagcacuuugguaggcaaaggacaugguggcucagcuucu

SEQ ID NO: 549850 - RNA, 65 nt, Homo Sapiens
gcucccugggugaaaggccacaguauuuuggguugguaggcaaauugcaacauucuggacauggc

SEQ ID NO: 549851 - RNA, 65 nt, Homo Sapiens
aaaacaucugauugcuggcuccuccuccguuugcaguaggcaagcucugcugcgaugccucugcc

SEQ ID NO: 549852 - RNA, 65 nt, Homo Sapiens
aauuauaucgauacaugaauuuaacuuacuuuaauguaggcaaacuaucaauuuuuuguccauuu

SEQ ID NO: 549853 - RNA, 65 nt, Homo Sapiens
uagaaaucacuggaaagaggagaggaaagaaccagguaggcaaauggucugugaaacccuugggu

SEQ ID NO: 549854 - RNA, 65 nt, Homo Sapiens
ccaagcagugaaaugaaccuuggguuagaguuaugguaggcaaaaagaaaaggagaauuuaggaa

SEQ ID NO: 549855 - RNA, 65 nt, Homo Sapiens
auuuugaagauacauuugcaacaaauuguaugcauguaggcaaagucccuaagcaguugggaaga

SEQ ID NO: 549856 - RNA, 65 nt, Homo Sapiens
uuaguagaaucagggaggacgggacuuaugcugugguaggcaacagaaaaaaacuucuauugauu

SEQ ID NO: 549857 - RNA, 65 nt, Homo Sapiens
uauguaaguaaagacaagccuuuaagguaaggucuguaggcaagaaaucuauuauaguuaccuau

SEQ ID NO: 549858 - RNA, 65 nt, Homo Sapiens
cuucacugcuuugaauacauacuauggauauaaauguaggcaaaaugaaagauuaugacuaauau

SEQ ID NO: 549859 - RNA, 65 nt, Homo Sapiens
acagauuuaaauuuuauuugaaaaaaugaaauaaaguaggcaaaaaaauaaagauguuuauuuuu

SEQ ID NO: 549860 - RNA, 65 nt, Homo Sapiens
gauaauaaccaaagaagaaaucugugaguuuuaaaguaggcaaggcuugcacauaaugugcuauu

SEQ ID NO: 549861 - RNA, 65 nt, Homo Sapiens
cucuuuuuaaaaaacucuuucuucagugcucacccguaggcaaauuuacauuggcacaauguaua

SEQ ID NO: 549862 - RNA, 65 nt, Homo Sapiens
aacgguguuuuuaaggggguagugcucaaauuaugguaggcaacuuuuuuuuuuuuucaugaaaa

SEQ ID NO: 549863 - RNA, 65 nt, Homo Sapiens
uuuguaaaaaggaaguauuucucccaaaauugggaguaggcaaacuacuaaucaguuuagcuuug

SEQ ID NO: 549864 - RNA, 65 nt, Homo Sapiens
ucauuuuuaagagaguacagacauacacuuuuugaguaggcaauauguucacauaguuugaaauu

SEQ ID NO: 549865 - RNA, 65 nt, Homo Sapiens
uugaagguggcccaugcuucaccagcaggugugcaguaggcaagccacggguguuggugcaacuc

SEQ ID NO: 549866 - RNA, 65 nt, Homo Sapiens
gcagugagauccacugcuauuagauaaagcccugaguaggcaagaucugaggggcuaucaaugug

SEQ ID NO: 549867 - RNA, 65 nt, Homo Sapiens
guaacagugguauuuguauaauguuacugaauacuguaggcaauaaggcuacagacauauacagc

SEQ ID NO: 549868 - RNA, 65 nt, Homo Sapiens
agagguccugccuccccauuucucaagggaagccaguaggcaacacagccagcacggugcucucc

SEQ ID NO: 549869 - RNA, 65 nt, Homo Sapiens
uuuguauaauuaaaaggaaaacagaaaaaggaaaaguaggcaaaugugaaaauaguuucaauaua

SEQ ID NO: 549870 - RNA, 65 nt, Homo Sapiens
gcacuuuauaauaaagcauggaagaaauuaucuuaguaggcaauuguaacacuuuuugaaaguaa

SEQ ID NO: 549871 - RNA, 65 nt, Homo Sapiens
ccccucaguguauaccuuuauacaaaauaaagcuaguaggcaagauuucacauaauguaaaguuc

SEQ ID NO: 549872 - RNA, 65 nt, Homo Sapiens
caauuuuagaauguaauauaaggauacaaaccauaguaggcaauauaaaauuaauuguagacucc

SEQ ID NO: 549873 - RNA, 65 nt, Homo Sapiens
agguaauguggaaaucugaaaacucaaaauuuucaguaggcaaauuuaucagguuguuagaugau

SEQ ID NO: 549874 - RNA, 65 nt, Homo Sapiens
cauguaucuaaacaauguauaaucuaugcauguauguaggcaauacaucuauguaucuaccaucu

SEQ ID NO: 549875 - RNA, 65 nt, Homo Sapiens
cacuucauuuuucagaacuuugcuagaagcuuaauguaggcaagccaagaaguagcuuuucaauu

SEQ ID NO: 549876 - RNA, 65 nt, Homo Sapiens
uuuuuauuucugccuuuguguagacugaugauuaaguaggcaaacuacuucuacuuucaaagagc

SEQ ID NO: 549877 - RNA, 65 nt, Homo Sapiens
cggaauauagcucuuuugaaaaaacaaaagauuuuguaggcaacugauccauuccacucuauaau

SEQ ID NO: 549878 - RNA, 65 nt, Homo Sapiens
uuuugcuacugauuuuccuuaauuugugggaaggaguaggcaaagaauaugcuuacaugauuaca

SEQ ID NO: 549879 - RNA, 65 nt, Homo Sapiens
guuucaagcacuuuagaaacaaagagaacagugacguaggcaaauuuaugaaggaggucauugaa

SEQ ID NO: 549880 - RNA, 65 nt, Homo Sapiens
cgagccaacugcagccaucauuugccucauuuaaaguaggcaagcaauggcacuaggagcugaug

SEQ ID NO: 549881 - RNA, 65 nt, Homo Sapiens
ggaaucugcaaugagugauuacaugcuuguaauagguaggcaauuccuugauuacaggaagcuuu

SEQ ID NO: 549882 - RNA, 65 nt, Homo Sapiens
uaaucuuguggcaucagggaaauauuuguuacauaguaggcaauuuuuauccaguacuuuauaga

SEQ ID NO: 549883 - RNA, 65 nt, Homo Sapiens
uuaaauguuuuuauuuaaaauugauuguauggucaguaggcaaucuuucuagugccuuucuuguc

SEQ ID NO: 549884 - RNA, 65 nt, Homo Sapiens
aaauuuugccuucaugguaccaaggaauucugagaguaggcaaaccuccugguacauugccauuc

SEQ ID NO: 549885 - RNA, 65 nt, Homo Sapiens
ugcaggcaggauuugaaggcuaaauugaugccaucguaggcaaggucuucaaagguccuuaggug

SEQ ID NO: 549886 - RNA, 65 nt, Homo Sapiens
ugagcuuccaccucuguccaacuccaauuaccagcguaggcaaaaaagacauauguccacuaagu

SEQ ID NO: 549887 - RNA, 65 nt, Homo Sapiens
uuuguuuucaaugccugugccuagagucuuuacagguaggcaaaacaggaccauugucccaaagu

SEQ ID NO: 549888 - RNA, 65 nt, Homo Sapiens
uaacuaaauuuuucuaguuuuaaagacuacuuugaguaggcaacagacacacuacuuaacacucc

SEQ ID NO: 549889 - RNA, 65 nt, Homo Sapiens
ucugggaccgcagccugccgcuccgaacugagcccguaggcaaggugcaccugggugcccgggcc

SEQ ID NO: 549890 - RNA, 65 nt, Homo Sapiens
caugacagaauguauguagagaguuggggugucugguaggcaaacugcaaggcaguugagauagu

SEQ ID NO: 549891 - RNA, 65 nt, Homo Sapiens
gccugccuucuccuugaaaccuugguuaugacugcguaggcaagaaguugaaaaacaguugauuu

SEQ ID NO: 549892 - RNA, 65 nt, Homo Sapiens
cacuuguuaguggcuuccuaccugccaaguguuguguaggcaaagaucacugagguuggccagcc

SEQ ID NO: 549893 - RNA, 65 nt, Homo Sapiens
aaaaugccacuaaucaaagcgaauguuuuuaauaaguaggcaagagaaaccaucuacauuccaug

SEQ ID NO: 549894 - RNA, 65 nt, Homo Sapiens
gauguuugcuuuuguuaaaacugugucauccuuauguaggcaagaucuuuuuuuuuuuuuaagag

SEQ ID NO: 549895 - RNA, 65 nt, Homo Sapiens
ucccagcucacuaugaacgcgcuaggucuuaaugcguaggcaaccgcuuugagucauuuuaugaa

SEQ ID NO: 549896 - RNA, 65 nt, Homo Sapiens
uugcuucuagggaguuagcaguagcauccucagagguaggcaagugguuuccccauccacugagu

SEQ ID NO: 549897 - RNA, 65 nt, Homo Sapiens
gcaaaaucacuuaauuaguacaucuuauuuucaaaguaggcaaaaauucagaaccuauuuuuuau

SEQ ID NO: 549898 - RNA, 65 nt, Homo Sapiens
ucuuaaaucaaggcugucugcuuauuuauacuagcguaggcaacacuuggauuucccuucuuagu

SEQ ID NO: 549899 - RNA, 65 nt, Homo Sapiens
auugagcacuugcuguauaugcaguauugagcacuguaggcaagagggaagaaagagaaggagcc

SEQ ID NO: 549900 - RNA, 65 nt, Homo Sapiens
ucaguuacacucaaagcuuucuuggaccccguuccguaggcaauaacgugcguccgccucagcgc

SEQ ID NO: 549901 - RNA, 65 nt, Homo Sapiens
ugacuuguuuuauaauugcuacugauuuuuuuaauguaggcaaagcuuuguuacuuugaaauuua

SEQ ID NO: 549902 - RNA, 65 nt, Homo Sapiens
guugaggcccagccacucucccuggggccugguggguaggcaaguagcucuggggccaccucaag

SEQ ID NO: 549903 - RNA, 65 nt, Homo Sapiens
auugacuagaccaccagaggaggaugugugggauuguaggcaaacccaccuguggcaucacugaa

SEQ ID NO: 549904 - RNA, 65 nt, Homo Sapiens
agaacauuucuaaagucucaaaaaaauguguuuuuguaggcaaaauuaaaguuccucaguaagaa

SEQ ID NO: 549905 - RNA, 65 nt, Homo Sapiens
ugcuacaguucauaucuucccaaauccagaauucuguaggcaaaagaagacaauguuuuuaauua

SEQ ID NO: 549906 - RNA, 65 nt, Homo Sapiens
ggaacauuuuuccuguaguagagggaaaauaaucaguaggcaagauguuuaauuuagauaaguuu

SEQ ID NO: 549907 - RNA, 65 nt, Homo Sapiens
ccugccauguuuccaugugccauuucuuaccccuuguaggcaauggcaaagaauguggucaggcu

SEQ ID NO: 549908 - RNA, 65 nt, Homo Sapiens
ccccuugggauuauggcuuagaagaagggggcuggguaggcaagcacuccuuggcuguguccucu

SEQ ID NO: 549909 - RNA, 65 nt, Homo Sapiens
gcagguugaacaacuccauguagauaagagcaaguguaggcaaagguuuagaaaauggacauaaa

SEQ ID NO: 549910 - RNA, 65 nt, Homo Sapiens
cuuuguauauuuuaaggcaauauuuuuuuuucaaaguaggcaauuuauuuauuuacaaguaugac

SEQ ID NO: 549911 - RNA, 65 nt, Homo Sapiens
acugcacguuucuuucucucccucccccuccccaaguaggcaaggaaggaguuugugguacgacc

SEQ ID NO: 549912 - RNA, 65 nt, Homo Sapiens
acugcacguuucuuucucucggguccuccccugaaguaggcaagguacuaucaaccgggaguuug

SEQ ID NO: 549913 - RNA, 65 nt, Homo Sapiens
aauuuccccccucgugcgcaucucagaacccaucgguaggcaaaggaaaauacgcucaggugguu

SEQ ID NO: 549914 - RNA, 65 nt, Homo Sapiens
cugccccugccgccugugcccuugcuggguccaggguaggcaaggcugccggcugcacccuguau

SEQ ID NO: 549915 - RNA, 65 nt, Homo Sapiens
aggcuuugugggccuuugccccuuagaaaguagcuguaggcaaagauuugugauuuuccaauuac

SEQ ID NO: 549916 - RNA, 65 nt, Homo Sapiens
auuuaaaauuuguugcagcaagaacuuuccuaccuguaggcaauagauugcuauguuuuuaacaa

SEQ ID NO: 549917 - RNA, 65 nt, Homo Sapiens
cccggugcgggcugugugggucucggagcccuuguguaggcaacgccccacccucacuccagcca

SEQ ID NO: 549918 - RNA, 65 nt, Homo Sapiens
cuacaucagucauuguuacauggaaaagacaggugguaggcaaguagguggaggaucucgguuug

SEQ ID NO: 549919 - RNA, 65 nt, Homo Sapiens
cagucugagaaagaaauaggaaacgugagagucugguaggcaaagugcauuuccugaagauguuu

SEQ ID NO: 549920 - RNA, 65 nt, Homo Sapiens
acuuuggguuacaguauuuuguuucauuuuuaaaaguaggcaacugcucccucuuauuuuuacaa

SEQ ID NO: 549921 - RNA, 65 nt, Homo Sapiens
acuugguguaaaacaaguuguguuuaucucagccaguaggcaaauucaguaaaguuuuuuaagaa

SEQ ID NO: 549922 - RNA, 65 nt, Homo Sapiens
ugcagugagcugagauaacgccacugcacuccaguguaggcaacagagugagacccugucucaaa

SEQ ID NO: 549923 - RNA, 65 nt, Homo Sapiens
agcgggacaggcagcggcuggcgcccauccucgugguaggcaacaggccggcgggcgcgcccgaa

SEQ ID NO: 549924 - RNA, 65 nt, Homo Sapiens
accuucaccuucacacagaugggaccuguccaaggguaggcaaccgacaaccucagucucccuuu

SEQ ID NO: 549925 - RNA, 65 nt, Homo Sapiens
guuauggcaguggguccagcacccagggaccccaaguaggcaacucaccccacccacuccauccu

SEQ ID NO: 549926 - RNA, 65 nt, Homo Sapiens
ugcagauaaaagagguuuaugaaguuuagggugaaguaggcaagggaaucuguuuacucccucuu

SEQ ID NO: 549927 - RNA, 65 nt, Homo Sapiens
ucauaugaaaggccaaggggcuuuaucuuuuacuaguaggcaagccugggcauuucugcauuugu

SEQ ID NO: 549928 - RNA, 65 nt, Homo Sapiens
aauugcaaaauauguauuuuuaaaguucaugauuuguaggcaaagauguuaagagcauuguuucc

SEQ ID NO: 549929 - RNA, 65 nt, Homo Sapiens
cauauuagaaaacuuuguuaggccaaagacaaauaguaggcaagauggcacagggcaugaaauga

SEQ ID NO: 549930 - RNA, 65 nt, Homo Sapiens
guaacuacugaguaucucuuuuaguuaaauaggaaguaggcaaaucuuguguuguuucaagaguu

SEQ ID NO: 549931 - RNA, 65 nt, Homo Sapiens
gaaagaauauguuauuguucuaagcaguacagaguguaggcaagaagugaccaauauguucauau

SEQ ID NO: 549932 - RNA, 65 nt, Homo Sapiens
auguccugcuuugauaaaacccucauuuccagaguguaggcaauuuuugaaaaaggugacucacc

SEQ ID NO: 549933 - RNA, 65 nt, Homo Sapiens
caguuguuaaagaagaauaaauguuaugcugugaaguaggcaauacucaguuacucccuguaacu

SEQ ID NO: 549934 - RNA, 64 nt, Homo Sapiens; identical to SEQ ID NO: 266194

SEQ ID NO: 549935 - RNA, 64 nt, Homo Sapiens; identical to SEQ ID NO: 266195

SEQ ID NO: 549936 - RNA, 64 nt, Homo Sapiens; identical to SEQ ID NO: 266196

SEQ ID NO: 549937 - RNA, 64 nt, Homo Sapiens; identical to SEQ ID NO: 266197

SEQ ID NO: 549938 - RNA, 64 nt, Homo Sapiens; identical to SEQ ID NO: 266198

SEQ ID NO: 549939 - RNA, 64 nt, Homo Sapiens; identical to SEQ ID NO: 266199

SEQ ID NO: 549940 - RNA, 64 nt, Homo Sapiens; identical to SEQ ID NO: 266200

SEQ ID NO: 549941 - RNA, 64 nt, Homo Sapiens; identical to SEQ ID NO: 266201

SEQ ID NO: 549942 - RNA, 64 nt, Homo Sapiens; identical to SEQ ID NO: 266202

SEQ ID NO: 549943 - RNA, 64 nt, Homo Sapiens; identical to SEQ ID NO: 266203

SEQ ID NO: 549944 - RNA, 64 nt, Homo Sapiens; identical to SEQ ID NO: 266204

SEQ ID NO: 549945 - RNA, 64 nt, Homo Sapiens; identical to SEQ ID NO: 266205

SEQ ID NO: 549946 - RNA, 64 nt, Homo Sapiens; identical to SEQ ID NO: 266206

SEQ ID NO: 549947 - RNA, 64 nt, Homo Sapiens; identical to SEQ ID NO: 266207

SEQ ID NO: 549948 - RNA, 64 nt, Homo Sapiens; identical to SEQ ID NO: 266208

SEQ ID NO: 549949 - RNA, 64 nt, Homo Sapiens; identical to SEQ ID NO: 266209

SEQ ID NO: 549950 - RNA, 64 nt, Homo Sapiens; identical to SEQ ID NO: 266210

SEQ ID NO: 549951 - RNA, 64 nt, Homo Sapiens; identical to SEQ ID NO: 266211

SEQ ID NO: 549952 - RNA, 64 nt, Homo Sapiens; identical to SEQ ID NO: 266212

SEQ ID NO: 549953 - RNA, 64 nt, Homo Sapiens; identical to SEQ ID NO: 266213

SEQ ID NO: 549954 - RNA, 64 nt, Homo Sapiens; identical to SEQ ID NO: 266214

SEQ ID NO: 549955 - RNA, 64 nt, Homo Sapiens; identical to SEQ ID NO: 266215

SEQ ID NO: 549956 - RNA, 64 nt, Homo Sapiens; identical to SEQ ID NO: 266216

SEQ ID NO: 549957 - RNA, 64 nt, Homo Sapiens; identical to SEQ ID NO: 266217

SEQ ID NO: 549958 - RNA, 64 nt, Homo Sapiens; identical to SEQ ID NO: 266218

SEQ ID NO: 549959 - RNA, 64 nt, Homo Sapiens; identical to SEQ ID NO: 266219

SEQ ID NO: 549960 - RNA, 64 nt, Homo Sapiens; identical to SEQ ID NO: 266220

SEQ ID NO: 549961 - RNA, 64 nt, Homo Sapiens; identical to SEQ ID NO: 266221

SEQ ID NO: 549962 - RNA, 64 nt, Homo Sapiens; identical to SEQ ID NO: 266222

SEQ ID NO: 549963 - RNA, 64 nt, Homo Sapiens; identical to SEQ ID NO: 266223

SEQ ID NO: 549964 - RNA, 64 nt, Homo Sapiens; identical to SEQ ID NO: 266224

SEQ ID NO: 549965 - RNA, 64 nt, Homo Sapiens; identical to SEQ ID NO: 266225

SEQ ID NO: 549966 - RNA, 64 nt, Homo Sapiens; identical to SEQ ID NO: 266226

SEQ ID NO: 549967 - RNA, 64 nt, Homo Sapiens; identical to SEQ ID NO: 266227

SEQ ID NO: 549968 - RNA, 64 nt, Homo Sapiens; identical to SEQ ID NO: 266228

SEQ ID NO: 549969 - RNA, 64 nt, Homo Sapiens; identical to SEQ ID NO: 266229

SEQ ID NO: 549970 - RNA, 64 nt, Homo Sapiens; identical to SEQ ID NO: 266230

SEQ ID NO: 549971 - RNA, 64 nt, Homo Sapiens; identical to SEQ ID NO: 266231

SEQ ID NO: 549972 - RNA, 64 nt, Homo Sapiens; identical to SEQ ID NO: 266232

SEQ ID NO: 549973 - RNA, 64 nt, Homo Sapiens; identical to SEQ ID NO: 266233

SEQ ID NO: 549974 - RNA, 64 nt, Homo Sapiens; identical to SEQ ID NO: 266234

SEQ ID NO: 549975 - RNA, 64 nt, Homo Sapiens; identical to SEQ ID NO: 266235

SEQ ID NO: 549976 - RNA, 64 nt, Homo Sapiens; identical to SEQ ID NO: 266236

SEQ ID NO: 549977 - RNA, 64 nt, Homo Sapiens; identical to SEQ ID NO: 266237

SEQ ID NO: 549978 - RNA, 64 nt, Homo Sapiens; identical to SEQ ID NO: 266238

SEQ ID NO: 549979 - RNA, 64 nt, Homo Sapiens; identical to SEQ ID NO: 266239

SEQ ID NO: 549980 - RNA, 64 nt, Homo Sapiens; identical to SEQ ID NO: 266240

SEQ ID NO: 549981 - RNA, 64 nt, Homo Sapiens; identical to SEQ ID NO: 266241

SEQ ID NO: 549982 - RNA, 64 nt, Homo Sapiens; identical to SEQ ID NO: 266242

SEQ ID NO: 549983 - RNA, 64 nt, Homo Sapiens; identical to SEQ ID NO: 266243

SEQ ID NO: 549984 - RNA, 64 nt, Homo Sapiens; identical to SEQ ID NO: 266244

SEQ ID NO: 549985 - RNA, 64 nt, Homo Sapiens; identical to SEQ ID NO: 266245

SEQ ID NO: 549986 - RNA, 64 nt, Homo Sapiens; identical to SEQ ID NO: 266246

SEQ ID NO: 549987 - RNA, 64 nt, Homo Sapiens; identical to SEQ ID NO: 266247

SEQ ID NO: 549988 - RNA, 64 nt, Homo Sapiens; identical to SEQ ID NO: 266248

SEQ ID NO: 549989 - RNA, 64 nt, Homo Sapiens; identical to SEQ ID NO: 266249

SEQ ID NO: 549990 - RNA, 64 nt, Homo Sapiens; identical to SEQ ID NO: 266250

SEQ ID NO: 549991 - RNA, 64 nt, Homo Sapiens; identical to SEQ ID NO: 266251

SEQ ID NO: 549992 - RNA, 64 nt, Homo Sapiens; identical to SEQ ID NO: 266252

SEQ ID NO: 549993 - RNA, 64 nt, Homo Sapiens
accucuuuauguaauucagguccaaaauaugucugcacaacaagucacauuaaauaguaugguu

SEQ ID NO: 549994 - RNA, 64 nt, Homo Sapiens
auauuuccauguaauguuuuaaccugcagucuaugcacaacacuaucuugaugcaggguuucuu

SEQ ID NO: 549995 - RNA, 64 nt, Homo Sapiens
aaagccugggaggguuguugaaauggggauuugagcacaacaggacugccagggaaggcuaagg

SEQ ID NO: 549996 - RNA, 64 nt, Homo Sapiens
gacugauucaaucugcaugccugcaugccccugggcacaacaagggggcuccacaugagagguc

SEQ ID NO: 549997 - RNA, 64 nt, Homo Sapiens; identical to SEQ ID NO: 247936

SEQ ID NO: 549998 - RNA, 64 nt, Homo Sapiens; identical to SEQ ID NO: 247937

SEQ ID NO: 549999 - RNA, 64 nt, Homo Sapiens; identical to SEQ ID NO: 247938

SEQ ID NO: 550000 - RNA, 64 nt, Homo Sapiens; identical to SEQ ID NO: 247939

SEQ ID NO: 550001 - RNA, 64 nt, Homo Sapiens; identical to SEQ ID NO: 247940

SEQ ID NO: 550002 - RNA, 64 nt, Homo Sapiens; identical to SEQ ID NO: 247941

SEQ ID NO: 550003 - RNA, 64 nt, Homo Sapiens; identical to SEQ ID NO: 247942

SEQ ID NO: 550004 - RNA, 64 nt, Homo Sapiens; identical to SEQ ID NO: 247943

SEQ ID NO: 550005 - RNA, 64 nt, Homo Sapiens; identical to SEQ ID NO: 247944

SEQ ID NO: 550006 - RNA, 64 nt, Homo Sapiens; identical to SEQ ID NO: 247945

SEQ ID NO: 550007 - RNA, 64 nt, Homo Sapiens; identical to SEQ ID NO: 247946

SEQ ID NO: 550008 - RNA, 64 nt, Homo Sapiens; identical to SEQ ID NO: 247947

SEQ ID NO: 550009 - RNA, 64 nt, Homo Sapiens; identical to SEQ ID NO: 247948

SEQ ID NO: 550010 - RNA, 64 nt, Homo Sapiens; identical to SEQ ID NO: 247949

SEQ ID NO: 550011 - RNA, 64 nt, Homo Sapiens; identical to SEQ ID NO: 247950

SEQ ID NO: 550012 - RNA, 64 nt, Homo Sapiens; identical to SEQ ID NO: 247951

SEQ ID NO: 550013 - RNA, 64 nt, Homo Sapiens; identical to SEQ ID NO: 247952

SEQ ID NO: 550014 - RNA, 64 nt, Homo Sapiens; identical to SEQ ID NO: 247953

SEQ ID NO: 550015 - RNA, 64 nt, Homo Sapiens; identical to SEQ ID NO: 247954

SEQ ID NO: 550016 - RNA, 64 nt, Homo Sapiens; identical to SEQ ID NO: 247955

SEQ ID NO: 550017 - RNA, 64 nt, Homo Sapiens; identical to SEQ ID NO: 247956

SEQ ID NO: 550018 - RNA, 64 nt, Homo Sapiens; identical to SEQ ID NO: 247957

SEQ ID NO: 550019 - RNA, 64 nt, Homo Sapiens; identical to SEQ ID NO: 247958

SEQ ID NO: 550020 - RNA, 64 nt, Homo Sapiens; identical to SEQ ID NO: 247959

SEQ ID NO: 550021 - RNA, 64 nt, Homo Sapiens; identical to SEQ ID NO: 247960

SEQ ID NO: 550022 - RNA, 64 nt, Homo Sapiens; identical to SEQ ID NO: 247961

SEQ ID NO: 550023 - RNA, 64 nt, Homo Sapiens; identical to SEQ ID NO: 247962

SEQ ID NO: 550024 - RNA, 64 nt, Homo Sapiens; identical to SEQ ID NO: 247963

SEQ ID NO: 550025 - RNA, 64 nt, Homo Sapiens; identical to SEQ ID NO: 247964

SEQ ID NO: 550026 - RNA, 64 nt, Homo Sapiens; identical to SEQ ID NO: 247965

SEQ ID NO: 550027 - RNA, 64 nt, Homo Sapiens; identical to SEQ ID NO: 247966

SEQ ID NO: 550028 - RNA, 64 nt, Homo Sapiens; identical to SEQ ID NO: 247967

SEQ ID NO: 550029 - RNA, 64 nt, Homo Sapiens; identical to SEQ ID NO: 247968

SEQ ID NO: 550030 - RNA, 64 nt, Homo Sapiens; identical to SEQ ID NO: 247969

SEQ ID NO: 550031 - RNA, 64 nt, Homo Sapiens; identical to SEQ ID NO: 247970

SEQ ID NO: 550032 - RNA, 64 nt, Homo Sapiens; identical to SEQ ID NO: 247971

SEQ ID NO: 550033 - RNA, 64 nt, Homo Sapiens; identical to SEQ ID NO: 247972

SEQ ID NO: 550034 - RNA, 64 nt, Homo Sapiens; identical to SEQ ID NO: 247973

SEQ ID NO: 550035 - RNA, 64 nt, Homo Sapiens; identical to SEQ ID NO: 247974

SEQ ID NO: 550036 - RNA, 64 nt, Homo Sapiens; identical to SEQ ID NO: 247975

SEQ ID NO: 550037 - RNA, 64 nt, Homo Sapiens; identical to SEQ ID NO: 247976

SEQ ID NO: 550038 - RNA, 64 nt, Homo Sapiens; identical to SEQ ID NO: 247977

SEQ ID NO: 550039 - RNA, 64 nt, Homo Sapiens; identical to SEQ ID NO: 247978

SEQ ID NO: 550040 - RNA, 64 nt, Homo Sapiens
cccagcuacucgggaggcugggcaugguggugcacgccucuaauuaaaaauacaaaauuagccg

SEQ ID NO: 550041 - RNA, 64 nt, Homo Sapiens
aaaaauacaaaauuagccggacauggagaaacuccgccucuaguuuucgagaccaaccugaccu

SEQ ID NO: 550042 - RNA, 64 nt, Homo Sapiens
gcuggacuccugaagccccgcugcugagaugggcgcucccgacacagcgcagacccaccaggag

SEQ ID NO: 550043 - RNA, 64 nt, Homo Sapiens
ggaaccuacagccccagccgucaggagaaggagggcucccgaguggaaauguggaacuugaugc

SEQ ID NO: 550044 - RNA, 64 nt, Homo Sapiens
acucugugcacuucagaccagcagcagcaggagggcucccgagggccuuaugagaaaaccugug

SEQ ID NO: 550045 - RNA, 64 nt, Homo Sapiens
gagucacccugacacuggugccaggcugaccucagcucccgaaggcucgcacagccuccccauc

SEQ ID NO: 550046 - RNA, 64 nt, Homo Sapiens
ggucucucccuuaacugcugcccuuccaagacuugcucccgagauggagugggcguggucuucc

SEQ ID NO: 550047 - RNA, 64 nt, Homo Sapiens
gcagcgucugacccggaaacccuuucacuucucugcucccgagguguccucgggcucauaugug

SEQ ID NO: 550048 - RNA, 64 nt, Homo Sapiens
auuccaucgugcugguagaagagucuuugcuguugcucccgaaagccgugcucuccagccuggc

SEQ ID NO: 550049 - RNA, 64 nt, Homo Sapiens
ccuagauguuccuggaaguugucaaugcuggguugcucccgagcuagguggauucugauucacu

SEQ ID NO: 550050 - RNA, 64 nt, Homo Sapiens
gcaauacgaauuaugcaaucacaauacauuuguagcucccgaguguccuaaagggagugcacuu

SEQ ID NO: 550051 - RNA, 64 nt, Homo Sapiens
gugcccaccgcccagcugcccacacccggugcaggcucccgaccagugcugcccuguuugcccu

SEQ ID NO: 550052 - RNA, 64 nt, Homo Sapiens
uuggaaacaugcuccgcgccuccagagaaaaguugcucccgagguccaugccccuggaacgugu

SEQ ID NO: 550053 - RNA, 64 nt, Homo Sapiens
uccugagcucaagcaauccugccauguugccuaggcucccgaacuuuuuuguagagguggucua

SEQ ID NO: 550054 - RNA, 64 nt, Homo Sapiens
cuggccugccacccuccugcgcaggccaugcauggcucccgaguacaguaguaucugcuuaggu

SEQ ID NO: 550055 - RNA, 64 nt, Homo Sapiens
cacaccacagacccagacacagccaagggagagugcucccgacagguggccccagcuuccucuc

SEQ ID NO: 550056 - RNA, 64 nt, Homo Sapiens
gcuucuugcagaggcugagauuuucacucacacagcucccgacuacaaccgguccacuccugcc

SEQ ID NO: 550057 - RNA, 64 nt, Homo Sapiens
ucagacacagcccccaggagcagggcccagucuggcucccgagcacccggggcccccuuuccuc

SEQ ID NO: 550058 - RNA, 64 nt, Homo Sapiens
ggaagcgauuacuuuuuuuaguucuuacauuauggcucccgaggcgaguuuucaaugugaauuu

SEQ ID NO: 550059 - RNA, 64 nt, Homo Sapiens
agaggagcgcucaugucuuuaccugugucuacuugcucccgagaaucaucuuccugacccuggc

SEQ ID NO: 550060 - RNA, 64 nt, Homo Sapiens
uuucaccauuugucuuucauuuuaaagguuauuugcucccgauuauaugauucaaguguuauaa

SEQ ID NO: 550061 - RNA, 64 nt, Homo Sapiens
cgcugcccccugagaaaacauccagccacagacagcucccgauggaauccucgaagcuuaugua

SEQ ID NO: 550062 - RNA, 64 nt, Homo Sapiens
gcuugcuucaugggcuaggagccgccgagcccgggcucccgagagcaaccucgugaccucagca

SEQ ID NO: 550063 - RNA, 64 nt, Homo Sapiens
ucggaccagccagcugguccucugggaacagccagcucccgagcacagccgcacuccuguugac

SEQ ID NO: 550064 - RNA, 64 nt, Homo Sapiens
gaaggggucugugucuuguaguagagacuagccagcucccgacgaaucagugguguggggcacu

SEQ ID NO: 550065 - RNA, 64 nt, Homo Sapiens
gaugacacuagucagaaaauaggcugccccacgugcucccgagagcuggcuguguauacccacu

SEQ ID NO: 550066 - RNA, 64 nt, Homo Sapiens
auggugcagccaaaggccccgucuagcuuggcuggcucccgaacauguccauauuugaaggcug

SEQ ID NO: 550067 - RNA, 64 nt, Homo Sapiens
uggaagcccugaucccccagagagcuacaggucugcucccgacgggccucgggccugacccguc

SEQ ID NO: 550068 - RNA, 64 nt, Homo Sapiens
ucccagucaccuuugcagacaaagaccaggggcagcucccgagggcacugugaaggcucccaug

SEQ ID NO: 550069 - RNA, 64 nt, Homo Sapiens
gccugccuuuccugcccuucgacuggaccacagugcucccgagaagcacagagcaucucaguug

SEQ ID NO: 550070 - RNA, 64 nt, Homo Sapiens
ccagguccccugaucuugggagacugcaccccaagcucccgacuucgagagggugucagugagc

SEQ ID NO: 550071 - RNA, 64 nt, Homo Sapiens
uuccaaaucacaauuucuuacaaccaagcuuugugcucccgaguaagcagggauguacuagggg

SEQ ID NO: 550072 - RNA, 64 nt, Homo Sapiens
agggaggacaggcgggaggaggugugaggaggaggcucccgaggggaaggggcggugcccacac

SEQ ID NO: 550073 - RNA, 64 nt, Homo Sapiens
gugggcugaaccuugccuuccuaucugagcccccgcucccgaucgaacuuugggguacgccucc

SEQ ID NO: 550074 - RNA, 64 nt, Homo Sapiens
gggaccucccccaucacccagguuccuacucugggcucccgauucccauggcucccaaaccaug

SEQ ID NO: 550075 - RNA, 64 nt, Homo Sapiens
ugugucugcaccagaagaggcucccacagacucugcucccgagaagccaagugaugcuggggag

SEQ ID NO: 550076 - RNA, 64 nt, Homo Sapiens
ccugagcucauccgccguggggaccaggacugcagcucccgaagagccaugcugugauaccggc

SEQ ID NO: 550077 - RNA, 64 nt, Homo Sapiens
ccccuccccaccaccucccaggguuuucccugaugcucccgacuugagaggcgugaguugagau

SEQ ID NO: 550078 - RNA, 64 nt, Homo Sapiens
uaggcaccacuguauccucccccugccucccugggcucccgagacaagccugccacuccugugu

SEQ ID NO: 550079 - RNA, 64 nt, Homo Sapiens
ccgccaguguuggcggugucgccgcaaccugcaggcucccgaguggggccugccuggucucuag

SEQ ID NO: 550080 - RNA, 64 nt, Homo Sapiens
cuguugaccugcccgauccagauucccaggccaggcucccgaccccauccaccuauccaccacc

SEQ ID NO: 550081 - RNA, 64 nt, Homo Sapiens
ucccagaguuaacacuaaucuggugguggugcacgcucccgagcgcgggugcgcucggugacac

SEQ ID NO: 550082 - RNA, 64 nt, Homo Sapiens
aaugugcucgcugccccgcggcuucgagccccaagcucccgaggacuuggcgcagcggaguuug

SEQ ID NO: 550083 - RNA, 64 nt, Homo Sapiens
acugagggcagagccuguaggugcagaggcccuggcucccgagguccagccacucucccugggg

SEQ ID NO: 550084 - RNA, 64 nt, Homo Sapiens
aaugaacccaagagcaaggggauaggccccuggggcucccgaagcacccacucccuuccccaua

SEQ ID NO: 550085 - RNA, 64 nt, Homo Sapiens
acuagcucuguuaguuccagacuccaaagcaaaagcucccgacuccacucacuuaucucagugg

SEQ ID NO: 550086 - RNA, 64 nt, Homo Sapiens
cuaugaaccucugcugggcccagccccugucccagcucccgaccugcacuuccugcuggacuca

SEQ ID NO: 550087 - RNA, 64 nt, Homo Sapiens
ugguuccugggccuuauagccagguuuguguggcgcucccgacuuuugugacugacuggugucu

SEQ ID NO: 550088 - RNA, 64 nt, Homo Sapiens
cugggacaguccuuucuguggggagccaucucuugcucccgagguuggaugaggcccguccgga

SEQ ID NO: 550089 - RNA, 64 nt, Homo Sapiens
gggaugaugggaaauucagcauuugcccagggcugcucccgaggucacagcugucagugcagcc

SEQ ID NO: 550090 - RNA, 64 nt, Homo Sapiens
gucgcauuugguggacgagaacugcaaaggcuuggcucccgaauggggguccugacucacacuu

SEQ ID NO: 550091 - RNA, 64 nt, Homo Sapiens
uaaugacauggacuuggcggggggacaagacaaagcucccgaugcugcauggggcgcugccaga

SEQ ID NO: 550092 - RNA, 64 nt, Homo Sapiens
agggugaacaaaccccgagggaggcccggcccuugcucccgaguuggggggaggggguguggca

SEQ ID NO: 550093 - RNA, 64 nt, Homo Sapiens
ccuccugcccacgcagaccugcagcgggcaaagagcucccgaggaagcacagcuugggucaggu

SEQ ID NO: 550094 - RNA, 64 nt, Homo Sapiens
uaccuugguggugggacuuggaacccaacccugagcucccgauaaagcuaaaguccaucaucug

SEQ ID NO: 550095 - RNA, 64 nt, Homo Sapiens
ccuccccuucgggcccccuccuccugcaaaacccgcucccgaagcggcgcugccgucugcagcc

SEQ ID NO: 550096 - RNA, 64 nt, Homo Sapiens
gcucgaggcugcuucuguuucuuccacaaagucggcucccgagagcccccuccacuccacucug

SEQ ID NO: 550097 - RNA, 64 nt, Homo Sapiens
uuaacauucaagcguuucuagcaauaacaugucugcucccgaggguccgacucaguaugcaguc

SEQ ID NO: 550098 - RNA, 64 nt, Homo Sapiens
caugcacucaggcagacagcugugccgugacagggcucccgagucaggcugccaggauggcgug

SEQ ID NO: 550099 - RNA, 64 nt, Homo Sapiens
gaaaguaaaauuguuuuuucuguccgcaacacuggcucccgagcagcuuuuguuaaagcaguag

SEQ ID NO: 550100 - RNA, 64 nt, Homo Sapiens
ucggugacuuccacugucgccuccgagcccguccgcucccgagcucugccggcugccucucccc

SEQ ID NO: 550101 - RNA, 64 nt, Homo Sapiens
cacggggagaagggcgacuuagggccacgcgccugcucccgaugccacccgccaagcauaguuc

SEQ ID NO: 550102 - RNA, 64 nt, Homo Sapiens
cucucugccaaggcuccagcuucuucccccagcugcucccgaccaggagggggagagcagccuc

SEQ ID NO: 550103 - RNA, 64 nt, Homo Sapiens
ccuccgcgggccugagcgugggcgcgccccugcggcucccgaggguccaggccccgcccccaaa

SEQ ID NO: 550104 - RNA, 64 nt, Homo Sapiens
caaguacaccagccaccuccagacaccagugcgugcucccgaugcugcuauggaaggugcuacu

SEQ ID NO: 550105 - RNA, 64 nt, Homo Sapiens
gccugcagugguuggagacgggaguggcccuucggcucccgagcucccucuggggacggcuggc

SEQ ID NO: 550106 - RNA, 64 nt, Homo Sapiens
cucugccuucagcucccaaaucugagccgggagggcucccgagucacacccagcguagggggag

SEQ ID NO: 550107 - RNA, 64 nt, Homo Sapiens
gucccagagaugaaacuccccucccggaagugcagcucccgaaauggcugugcccgaugugcac

SEQ ID NO: 550108 - RNA, 64 nt, Homo Sapiens
guggcuuuuuaacaugaaaaacacggcagcuguagcucccgagcuacucucuugccagcauuuu

SEQ ID NO: 550109 - RNA, 64 nt, Homo Sapiens
uacuggcgcucacgcugccauccgaccacccucggcucccgaguccacgccugccugggccugu

SEQ ID NO: 550110 - RNA, 64 nt, Homo Sapiens
gcaucugaucuauucgcuaccgggacuccuccaggcucccgagaggagucgggacccuucggcu

SEQ ID NO: 550111 - RNA, 64 nt, Homo Sapiens
cuccagcugcucacagacgccagcaaagcaguaugcucccgaucaaguagauuuuuaaaaaauc

SEQ ID NO: 550112 - RNA, 64 nt, Homo Sapiens
uaagcuagcacccgugguaagcgggacgagacaagcucccgaagcccgccagcuuccugcucca

SEQ ID NO: 550113 - RNA, 64 nt, Homo Sapiens
caagcgccagggccagggcuaaaauaugaugauggcucccgacauucccuggucccuacucaac

SEQ ID NO: 550114 - RNA, 64 nt, Homo Sapiens
ggacccaggacggagcggggcugcccugccugaggcucccgaggagcuuugugcuuugguguuc

SEQ ID NO: 550115 - RNA, 64 nt, Homo Sapiens; identical to SEQ ID NO: 344618

SEQ ID NO: 550116 - RNA, 64 nt, Homo Sapiens; identical to SEQ ID NO: 344619

SEQ ID NO: 550117 - RNA, 64 nt, Homo Sapiens; identical to SEQ ID NO: 344620

SEQ ID NO: 550118 - RNA, 64 nt, Homo Sapiens; identical to SEQ ID NO: 344621

SEQ ID NO: 550119 - RNA, 64 nt, Homo Sapiens; identical to SEQ ID NO: 344622

SEQ ID NO: 550120 - RNA, 64 nt, Homo Sapiens; identical to SEQ ID NO: 344623

SEQ ID NO: 550121 - RNA, 64 nt, Homo Sapiens; identical to SEQ ID NO: 247175

SEQ ID NO: 550122 - RNA, 64 nt, Homo Sapiens; identical to SEQ ID NO: 247176

SEQ ID NO: 550123 - RNA, 64 nt, Homo Sapiens; identical to SEQ ID NO: 247177

SEQ ID NO: 550124 - RNA, 64 nt, Homo Sapiens; identical to SEQ ID NO: 247178

SEQ ID NO: 550125 - RNA, 64 nt, Homo Sapiens; identical to SEQ ID NO: 247179

SEQ ID NO: 550126 - RNA, 64 nt, Homo Sapiens; identical to SEQ ID NO: 247180

SEQ ID NO: 550127 - RNA, 64 nt, Homo Sapiens; identical to SEQ ID NO: 247181

SEQ ID NO: 550128 - RNA, 64 nt, Homo Sapiens; identical to SEQ ID NO: 247182

SEQ ID NO: 550129 - RNA, 64 nt, Homo Sapiens; identical to SEQ ID NO: 247183

SEQ ID NO: 550130 - RNA, 64 nt, Homo Sapiens; identical to SEQ ID NO: 247184

SEQ ID NO: 550131 - RNA, 64 nt, Homo Sapiens; identical to SEQ ID NO: 247185

SEQ ID NO: 550132 - RNA, 64 nt, Homo Sapiens; identical to SEQ ID NO: 247186

SEQ ID NO: 550133 - RNA, 64 nt, Homo Sapiens; identical to SEQ ID NO: 247187

SEQ ID NO: 550134 - RNA, 64 nt, Homo Sapiens; identical to SEQ ID NO: 247188

SEQ ID NO: 550135 - RNA, 64 nt, Homo Sapiens; identical to SEQ ID NO: 247189

SEQ ID NO: 550136 - RNA, 64 nt, Homo Sapiens; identical to SEQ ID NO: 247190

SEQ ID NO: 550137 - RNA, 64 nt, Homo Sapiens; identical to SEQ ID NO: 247191

SEQ ID NO: 550138 - RNA, 64 nt, Homo Sapiens; identical to SEQ ID NO: 247192

SEQ ID NO: 550139 - RNA, 64 nt, Homo Sapiens; identical to SEQ ID NO: 247193

SEQ ID NO: 550140 - RNA, 64 nt, Homo Sapiens; identical to SEQ ID NO: 247194

SEQ ID NO: 550141 - RNA, 64 nt, Homo Sapiens; identical to SEQ ID NO: 247195

SEQ ID NO: 550142 - RNA, 64 nt, Homo Sapiens; identical to SEQ ID NO: 247196

SEQ ID NO: 550143 - RNA, 64 nt, Homo Sapiens; identical to SEQ ID NO: 247197

SEQ ID NO: 550144 - RNA, 64 nt, Homo Sapiens; identical to SEQ ID NO: 247198

SEQ ID NO: 550145 - RNA, 64 nt, Homo Sapiens; identical to SEQ ID NO: 247199

SEQ ID NO: 550146 - RNA, 64 nt, Homo Sapiens; identical to SEQ ID NO: 247200

SEQ ID NO: 550147 - RNA, 64 nt, Homo Sapiens; identical to SEQ ID NO: 247201

SEQ ID NO: 550148 - RNA, 61 nt, Homo Sapiens; identical to SEQ ID NO: 247202

SEQ ID NO: 550149 - RNA, 64 nt, Homo Sapiens; identical to SEQ ID NO: 247203

SEQ ID NO: 550150 - RNA, 64 nt, Homo Sapiens; identical to SEQ ID NO: 247204

SEQ ID NO: 550151 - RNA, 64 nt, Homo Sapiens; identical to SEQ ID NO: 247205

SEQ ID NO: 550152 - RNA, 64 nt, Homo Sapiens; identical to SEQ ID NO: 247206

SEQ ID NO: 550153 - RNA, 64 nt, Homo Sapiens; identical to SEQ ID NO: 247207

SEQ ID NO: 550154 - RNA, 64 nt, Homo Sapiens; identical to SEQ ID NO: 247208

SEQ ID NO: 550155 - RNA, 64 nt, Homo Sapiens; identical to SEQ ID NO: 247209

SEQ ID NO: 550156 - RNA, 64 nt, Homo Sapiens; identical to SEQ ID NO: 247210

SEQ ID NO: 550157 - RNA, 64 nt, Homo Sapiens; identical to SEQ ID NO: 247211

SEQ ID NO: 550158 - RNA, 64 nt, Homo Sapiens; identical to SEQ ID NO: 247212

SEQ ID NO: 550159 - RNA, 64 nt, Homo Sapiens; identical to SEQ ID NO: 247213

SEQ ID NO: 550160 - RNA, 64 nt, Homo Sapiens; identical to SEQ ID NO: 247214

SEQ ID NO: 550161 - RNA, 64 nt, Homo Sapiens; identical to SEQ ID NO: 247215

SEQ ID NO: 550162 - RNA, 64 nt, Homo Sapiens; identical to SEQ ID NO: 247216

SEQ ID NO: 550163 - RNA, 64 nt, Homo Sapiens; identical to SEQ ID NO: 247217

SEQ ID NO: 550164 - RNA, 64 nt, Homo Sapiens; identical to SEQ ID NO: 247218

SEQ ID NO: 550165 - RNA, 64 nt, Homo Sapiens; identical to SEQ ID NO: 247219

SEQ ID NO: 550166 - RNA, 64 nt, Homo Sapiens; identical to SEQ ID NO: 247220

SEQ ID NO: 550167 - RNA, 64 nt, Homo Sapiens; identical to SEQ ID NO: 247221

SEQ ID NO: 550168 - RNA, 64 nt, Homo Sapiens; identical to SEQ ID NO: 247222

SEQ ID NO: 550169 - RNA, 64 nt, Homo Sapiens; identical to SEQ ID NO: 247223

SEQ ID NO: 550170 - RNA, 64 nt, Homo Sapiens; identical to SEQ ID NO: 247224

SEQ ID NO: 550171 - RNA, 64 nt, Homo Sapiens; identical to SEQ ID NO: 247225

SEQ ID NO: 550172 - RNA, 64 nt, Homo Sapiens; identical to SEQ ID NO: 247226

SEQ ID NO: 550173 - RNA, 64 nt, Homo Sapiens; identical to SEQ ID NO: 247227

SEQ ID NO: 550174 - RNA, 64 nt, Homo Sapiens; identical to SEQ ID NO: 247228

SEQ ID NO: 550175 - RNA, 64 nt, Homo Sapiens; identical to SEQ ID NO: 247229

SEQ ID NO: 550176 - RNA, 64 nt, Homo Sapiens; identical to SEQ ID NO: 247230

SEQ ID NO: 550177 - RNA, 64 nt, Homo Sapiens; identical to SEQ ID NO: 247231

SEQ ID NO: 550178 - RNA, 64 nt, Homo Sapiens; identical to SEQ ID NO: 247232

SEQ ID NO: 550179 - RNA, 64 nt, Homo Sapiens; identical to SEQ ID NO: 247233

SEQ ID NO: 550180 - RNA, 64 nt, Homo Sapiens; identical to SEQ ID NO: 247234

SEQ ID NO: 550181 - RNA, 64 nt, Homo Sapiens; identical to SEQ ID NO: 247235

SEQ ID NO: 550182 - RNA, 64 nt, Homo Sapiens; identical to SEQ ID NO: 247236

SEQ ID NO: 550183 - RNA, 64 nt, Homo Sapiens; identical to SEQ ID NO: 247237

SEQ ID NO: 550184 - RNA, 64 nt, Homo Sapiens; identical to SEQ ID NO: 247238

SEQ ID NO: 550185 - RNA, 64 nt, Homo Sapiens; identical to SEQ ID NO: 247239

SEQ ID NO: 550186 - RNA, 64 nt, Homo Sapiens; identical to SEQ ID NO: 247240

SEQ ID NO: 550187 - RNA, 64 nt, Homo Sapiens; identical to SEQ ID NO: 247241

SEQ ID NO: 550188 - RNA, 64 nt, Homo Sapiens; identical to SEQ ID NO: 247242

SEQ ID NO: 550189 - RNA, 64 nt, Homo Sapiens; identical to SEQ ID NO: 247243

SEQ ID NO: 550190 - RNA, 64 nt, Homo Sapiens; identical to SEQ ID NO: 247244

SEQ ID NO: 550191 - RNA, 64 nt, Homo Sapiens; identical to SEQ ID NO: 247245

SEQ ID NO: 550192 - RNA, 64 nt, Homo Sapiens; identical to SEQ ID NO: 247246

SEQ ID NO: 550193 - RNA, 64 nt, Homo Sapiens; identical to SEQ ID NO: 247247

SEQ ID NO: 550194 - RNA, 64 nt, Homo Sapiens; identical to SEQ ID NO: 247248

SEQ ID NO: 550195 - RNA, 64 nt, Homo Sapiens; identical to SEQ ID NO: 247249

SEQ ID NO: 550196 - RNA, 64 nt, Homo Sapiens; identical to SEQ ID NO: 247250

SEQ ID NO: 550197 - RNA, 64 nt, Homo Sapiens; identical to SEQ ID NO: 247251

SEQ ID NO: 550198 - RNA, 64 nt, Homo Sapiens; identical to SEQ ID NO: 247252

SEQ ID NO: 550199 - RNA, 64 nt, Homo Sapiens; identical to SEQ ID NO: 409917

SEQ ID NO: 550200 - RNA, 64 nt, Homo Sapiens; identical to SEQ ID NO: 409918

SEQ ID NO: 550201 - RNA, 64 nt, Homo Sapiens; identical to SEQ ID NO: 409919

SEQ ID NO: 550202 - RNA, 64 nt, Homo Sapiens; identical to SEQ ID NO: 409920

SEQ ID NO: 550203 - RNA, 64 nt, Homo Sapiens; identical to SEQ ID NO: 409921

SEQ ID NO: 550204 - RNA, 64 nt, Homo Sapiens; identical to SEQ ID NO: 409922

SEQ ID NO: 550205 - RNA, 64 nt, Homo Sapiens; identical to SEQ ID NO: 409923

SEQ ID NO: 550206 - RNA, 64 nt, Homo Sapiens; identical to SEQ ID NO: 409924

SEQ ID NO: 550207 - RNA, 64 nt, Homo Sapiens; identical to SEQ ID NO: 409925

SEQ ID NO: 550208 - RNA, 64 nt, Homo Sapiens; identical to SEQ ID NO: 409926

SEQ ID NO: 550209 - RNA, 64 nt, Homo Sapiens; identical to SEQ ID NO: 409927

SEQ ID NO: 550210 - RNA, 64 nt, Homo Sapiens; identical to SEQ ID NO: 409928

SEQ ID NO: 550211 - RNA, 64 nt, Homo Sapiens; identical to SEQ ID NO: 409929

SEQ ID NO: 550212 - RNA, 64 nt, Homo Sapiens; identical to SEQ ID NO: 409930

SEQ ID NO: 550213 - RNA, 64 nt, Homo Sapiens; identical to SEQ ID NO: 409931

SEQ ID NO: 550214 - RNA, 64 nt, Homo Sapiens; identical to SEQ ID NO: 409932

SEQ ID NO: 550215 - RNA, 64 nt, Homo Sapiens; identical to SEQ ID NO: 409933

SEQ ID NO: 550216 - RNA, 64 nt, Homo Sapiens; identical to SEQ ID NO: 409934

SEQ ID NO: 550217 - RNA, 64 nt, Homo Sapiens; identical to SEQ ID NO: 409935

SEQ ID NO: 550218 - RNA, 64 nt, Homo Sapiens; identical to SEQ ID NO: 409936

SEQ ID NO: 550219 - RNA, 64 nt, Homo Sapiens; identical to SEQ ID NO: 409937

SEQ ID NO: 550220 - RNA, 64 nt, Homo Sapiens; identical to SEQ ID NO: 409938

SEQ ID NO: 550221 - RNA, 64 nt, Homo Sapiens; identical to SEQ ID NO: 409939

SEQ ID NO: 550222 - RNA, 64 nt, Homo Sapiens; identical to SEQ ID NO: 409940

SEQ ID NO: 550223 - RNA, 64 nt, Homo Sapiens; identical to SEQ ID NO: 409941

SEQ ID NO: 550224 - RNA, 64 nt, Homo Sapiens; identical to SEQ ID NO: 409942

SEQ ID NO: 550225 - RNA, 64 nt, Homo Sapiens; identical to SEQ ID NO: 409943

SEQ ID NO: 550226 - RNA, 64 nt, Homo Sapiens; identical to SEQ ID NO: 409944

SEQ ID NO: 550227 - RNA, 64 nt, Homo Sapiens; identical to SEQ ID NO: 409945

SEQ ID NO: 550228 - RNA, 64 nt, Homo Sapiens; identical to SEQ ID NO: 409946

SEQ ID NO: 550229 - RNA, 64 nt, Homo Sapiens; identical to SEQ ID NO: 409947

SEQ ID NO: 550230 - RNA, 64 nt, Homo Sapiens; identical to SEQ ID NO: 409948

SEQ ID NO: 550231 - RNA, 64 nt, Homo Sapiens; identical to SEQ ID NO: 409949

SEQ ID NO: 550232 - RNA, 64 nt, Homo Sapiens; identical to SEQ ID NO: 409950

SEQ ID NO: 550233 - RNA, 64 nt, Homo Sapiens; identical to SEQ ID NO: 409951

SEQ ID NO: 550234 - RNA, 64 nt, Homo Sapiens; identical to SEQ ID NO: 409952

SEQ ID NO: 550235 - RNA, 64 nt, Homo Sapiens; identical to SEQ ID NO: 409953

SEQ ID NO: 550236 - RNA, 64 nt, Homo Sapiens; identical to SEQ ID NO: 409954

SEQ ID NO: 550237 - RNA, 64 nt, Homo Sapiens; identical to SEQ ID NO: 409955

SEQ ID NO: 550238 - RNA, 64 nt, Homo Sapiens; identical to SEQ ID NO: 409956

SEQ ID NO: 550239 - RNA, 64 nt, Homo Sapiens; identical to SEQ ID NO: 409957

SEQ ID NO: 550240 - RNA, 64 nt, Homo Sapiens; identical to SEQ ID NO: 409958

SEQ ID NO: 550241 - RNA, 64 nt, Homo Sapiens; identical to SEQ ID NO: 409959

SEQ ID NO: 550242 - RNA, 64 nt, Homo Sapiens; identical to SEQ ID NO: 409960

SEQ ID NO: 550243 - RNA, 64 nt, Homo Sapiens; identical to SEQ ID NO: 409961

SEQ ID NO: 550244 - RNA, 64 nt, Homo Sapiens; identical to SEQ ID NO: 409962

SEQ ID NO: 550245 - RNA, 64 nt, Homo Sapiens; identical to SEQ ID NO: 409963

SEQ ID NO: 550246 - RNA, 64 nt, Homo Sapiens; identical to SEQ ID NO: 409964

SEQ ID NO: 550247 - RNA, 64 nt, Homo Sapiens; identical to SEQ ID NO: 409965

SEQ ID NO: 550248 - RNA, 64 nt, Homo Sapiens; identical to SEQ ID NO: 409966

SEQ ID NO: 550249 - RNA, 64 nt, Homo Sapiens; identical to SEQ ID NO: 409967

SEQ ID NO: 550250 - RNA, 52 nt, Homo Sapiens; identical to SEQ ID NO: 409968

SEQ ID NO: 550251 - RNA, 64 nt, Homo Sapiens; identical to SEQ ID NO: 409969

SEQ ID NO: 550252 - RNA, 64 nt, Homo Sapiens; identical to SEQ ID NO: 409970

SEQ ID NO: 550253 - RNA, 64 nt, Homo Sapiens; identical to SEQ ID NO: 409971

SEQ ID NO: 550254 - RNA, 64 nt, Homo Sapiens; identical to SEQ ID NO: 409972

SEQ ID NO: 550255 - RNA, 64 nt, Homo Sapiens; identical to SEQ ID NO: 409973

SEQ ID NO: 550256 - RNA, 64 nt, Homo Sapiens; identical to SEQ ID NO: 43914

SEQ ID NO: 550257 - RNA, 64 nt, Homo Sapiens; identical to SEQ ID NO: 43915

SEQ ID NO: 550258 - RNA, 64 nt, Homo Sapiens; identical to SEQ ID NO: 43916

SEQ ID NO: 550259 - RNA, 64 nt, Homo Sapiens; identical to SEQ ID NO: 43917

SEQ ID NO: 550260 - RNA, 64 nt, Homo Sapiens; identical to SEQ ID NO: 43918

SEQ ID NO: 550261 - RNA, 64 nt, Homo Sapiens; identical to SEQ ID NO: 43919

SEQ ID NO: 550262 - RNA, 64 nt, Homo Sapiens; identical to SEQ ID NO: 43920

SEQ ID NO: 550263 - RNA, 64 nt, Homo Sapiens; identical to SEQ ID NO: 43921

SEQ ID NO: 550264 - RNA, 64 nt, Homo Sapiens; identical to SEQ ID NO: 43922

SEQ ID NO: 550265 - RNA, 64 nt, Homo Sapiens; identical to SEQ ID NO: 43923

SEQ ID NO: 550266 - RNA, 64 nt, Homo Sapiens; identical to SEQ ID NO: 43924

SEQ ID NO: 550267 - RNA, 64 nt, Homo Sapiens; identical to SEQ ID NO: 43925

SEQ ID NO: 550268 - RNA, 64 nt, Homo Sapiens; identical to SEQ ID NO: 43926

SEQ ID NO: 550269 - RNA, 64 nt, Homo Sapiens; identical to SEQ ID NO: 43927

SEQ ID NO: 550270 - RNA, 64 nt, Homo Sapiens; identical to SEQ ID NO: 43928

SEQ ID NO: 550271 - RNA, 64 nt, Homo Sapiens; identical to SEQ ID NO: 43929

SEQ ID NO: 550272 - RNA, 64 nt, Homo Sapiens; identical to SEQ ID NO: 43930

SEQ ID NO: 550273 - RNA, 64 nt, Homo Sapiens; identical to SEQ ID NO: 43931

SEQ ID NO: 550274 - RNA, 64 nt, Homo Sapiens; identical to SEQ ID NO: 43932

SEQ ID NO: 550275 - RNA, 64 nt, Homo Sapiens; identical to SEQ ID NO: 43933

SEQ ID NO: 550276 - RNA, 64 nt, Homo Sapiens; identical to SEQ ID NO: 43934

SEQ ID NO: 550277 - RNA, 64 nt, Homo Sapiens; identical to SEQ ID NO: 43935

SEQ ID NO: 550278 - RNA, 64 nt, Homo Sapiens; identical to SEQ ID NO: 43936

SEQ ID NO: 550279 - RNA, 64 nt, Homo Sapiens; identical to SEQ ID NO: 43937

SEQ ID NO: 550280 - RNA, 64 nt, Homo Sapiens; identical to SEQ ID NO: 43938

SEQ ID NO: 550281 - RNA, 64 nt, Homo Sapiens; identical to SEQ ID NO: 43939

SEQ ID NO: 550282 - RNA, 64 nt, Homo Sapiens; identical to SEQ ID NO: 43940

SEQ ID NO: 550283 - RNA, 64 nt, Homo Sapiens; identical to SEQ ID NO: 43941

SEQ ID NO: 550284 - RNA, 64 nt, Homo Sapiens; identical to SEQ ID NO: 43942

SEQ ID NO: 550285 - RNA, 64 nt, Homo Sapiens; identical to SEQ ID NO: 43943

SEQ ID NO: 550286 - RNA, 64 nt, Homo Sapiens; identical to SEQ ID NO: 43944

SEQ ID NO: 550287 - RNA, 64 nt, Homo Sapiens; identical to SEQ ID NO: 43945

SEQ ID NO: 550288 - RNA, 64 nt, Homo Sapiens; identical to SEQ ID NO: 43946

SEQ ID NO: 550289 - RNA, 64 nt, Homo Sapiens; identical to SEQ ID NO: 43947

SEQ ID NO: 550290 - RNA, 64 nt, Homo Sapiens; identical to SEQ ID NO: 43948

SEQ ID NO: 550291 - RNA, 64 nt, Homo Sapiens; identical to SEQ ID NO: 111894

SEQ ID NO: 550292 - RNA, 64 nt, Homo Sapiens; identical to SEQ ID NO: 111895

SEQ ID NO: 550293 - RNA, 64 nt, Homo Sapiens; identical to SEQ ID NO: 111896

SEQ ID NO: 550294 - RNA, 64 nt, Homo Sapiens; identical to SEQ ID NO: 111897

SEQ ID NO: 550295 - RNA, 64 nt, Homo Sapiens; identical to SEQ ID NO: 111898

SEQ ID NO: 550296 - RNA, 64 nt, Homo Sapiens; identical to SEQ ID NO: 111899

SEQ ID NO: 550297 - RNA, 64 nt, Homo Sapiens; identical to SEQ ID NO: 111900

SEQ ID NO: 550298 - RNA, 64 nt, Homo Sapiens; identical to SEQ ID NO: 111901

SEQ ID NO: 550299 - RNA, 64 nt, Homo Sapiens; identical to SEQ ID NO: 111902

SEQ ID NO: 550300 - RNA, 64 nt, Homo Sapiens; identical to SEQ ID NO: 111903

SEQ ID NO: 550301 - RNA, 64 nt, Homo Sapiens; identical to SEQ ID NO: 111904

SEQ ID NO: 550302 - RNA, 64 nt, Homo Sapiens; identical to SEQ ID NO: 111905

SEQ ID NO: 550303 - RNA, 64 nt, Homo Sapiens; identical to SEQ ID NO: 111906

SEQ ID NO: 550304 - RNA, 64 nt, Homo Sapiens; identical to SEQ ID NO: 111907

SEQ ID NO: 550305 - RNA, 64 nt, Homo Sapiens; identical to SEQ ID NO: 111908

SEQ ID NO: 550306 - RNA, 64 nt, Homo Sapiens; identical to SEQ ID NO: 111909

SEQ ID NO: 550307 - RNA, 64 nt, Homo Sapiens; identical to SEQ ID NO: 111910

SEQ ID NO: 550308 - RNA, 64 nt, Homo Sapiens; identical to SEQ ID NO: 111911

SEQ ID NO: 550309 - RNA, 64 nt, Homo Sapiens; identical to SEQ ID NO: 111912

SEQ ID NO: 550310 - RNA, 64 nt, Homo Sapiens; identical to SEQ ID NO: 111913

SEQ ID NO: 550311 - RNA, 64 nt, Homo Sapiens; identical to SEQ ID NO: 111914

SEQ ID NO: 550312 - RNA, 64 nt, Homo Sapiens; identical to SEQ ID NO: 111915

SEQ ID NO: 550313 - RNA, 64 nt, Homo Sapiens; identical to SEQ ID NO: 111916

SEQ ID NO: 550314 - RNA, 64 nt, Homo Sapiens; identical to SEQ ID NO: 111917

SEQ ID NO: 550315 - RNA, 64 nt, Homo Sapiens; identical to SEQ ID NO: 111918

SEQ ID NO: 550316 - RNA, 64 nt, Homo Sapiens; identical to SEQ ID NO: 111919

SEQ ID NO: 550317 - RNA, 64 nt, Homo Sapiens; identical to SEQ ID NO: 111920

SEQ ID NO: 550318 - RNA, 64 nt, Homo Sapiens; identical to SEQ ID NO: 111921

SEQ ID NO: 550319 - RNA, 64 nt, Homo Sapiens; identical to SEQ ID NO: 111922

SEQ ID NO: 550320 - RNA, 64 nt, Homo Sapiens; identical to SEQ ID NO: 111923

SEQ ID NO: 550321 - RNA, 64 nt, Homo Sapiens; identical to SEQ ID NO: 111924

SEQ ID NO: 550322 - RNA, 64 nt, Homo Sapiens; identical to SEQ ID NO: 111925

SEQ ID NO: 550323 - RNA, 64 nt, Homo Sapiens; identical to SEQ ID NO: 111926

SEQ ID NO: 550324 - RNA, 64 nt, Homo Sapiens; identical to SEQ ID NO: 111927

SEQ ID NO: 550325 - RNA, 64 nt, Homo Sapiens
cacuugauaaaucauggggaacagauguguuccacccaacaaaugugauaagugaucaugcagc

SEQ ID NO: 550326 - RNA, 64 nt, Homo Sapiens
ccgaguacugggaauauaggugcacgccaccacacccaacaaauuuuuguacuuuuaguacaga

SEQ ID NO: 550327 - RNA, 64 nt, Homo Sapiens
cuggcuucagggccacuaugucagaaccucucaacccaacaaggugcuccuuuggccaagauca

SEQ ID NO: 550328 - RNA, 64 nt, Homo Sapiens
uccucugccacacacaacaauccucaucaucauucccaacaacauucccuuuccucugcuucuc

SEQ ID NO: 550329 - RNA, 64 nt, Homo Sapiens
gggaccaguguugccacaccgcggagccuggacugacacccagucagucguucccagcagaaca

SEQ ID NO: 550330 - RNA, 64 nt, Homo Sapiens
cucucacugacuaacaggucuccucccagcagcagacacccaccagcagagccugcucccaccc

SEQ ID NO: 550331 - RNA, 64 nt, Homo Sapiens
auaauauaagcaacauuuagcuaguuguuuugaagacacccaguacuaaguaauauuguuguuc

SEQ ID NO: 550332 - RNA, 64 nt, Homo Sapiens
aaucagcaaaauaauaaaaugaacgaaaaaaaaugacacccagggaguucccaaccccagugua

SEQ ID NO: 550333 - RNA, 64 nt, Homo Sapiens
uccugaguccccagacagcagaguaugaacugcugacacccagauuccauuaaaaauucugcua

SEQ ID NO: 550334 - RNA, 64 nt, Homo Sapiens
caauucagggcagaacuccuguaucagccucauggacacccagaauugguaucucauggcugga

SEQ ID NO: 550335 - RNA, 64 nt, Homo Sapiens
aacgggugcaucccaccacucccuggaggcauuagacacccaaguggaaggugcuacaaccuga

SEQ ID NO: 550336 - RNA, 64 nt, Homo Sapiens
auuguauuuuuuauuucuuucuaacuuaaaauacgacacccaguauuuucuuuaaguuucacca

SEQ ID NO: 550337 - RNA, 64 nt, Homo Sapiens
ccacugggaccccugcuaacuaagggacuuugcagacacccaagauagcuucucuccauacucc

SEQ ID NO: 550338 - RNA, 64 nt, Homo Sapiens
gguguauccagagcccagccgcuuggcuggguuggacacccacaugaagucugagccaccaagg

SEQ ID NO: 550339 - RNA, 64 nt, Homo Sapiens
ucuugcuugucacccgcuccagguuggagccacagacacccaccgccaccccggcugggucugc

SEQ ID NO: 550340 - RNA, 64 nt, Homo Sapiens
uuuucauuugacccgcccccuucucgcucauaaugacacccagcuccuuugagaggaucagagc

SEQ ID NO: 550341 - RNA, 64 nt, Homo Sapiens
ucagggaggcagcucauuuccaccccggccccaggacacccagccugugccccacaaggaucuc

SEQ ID NO: 550342 - RNA, 64 nt, Homo Sapiens
cagauuuccauuugaaguacuucccauccacccugacacccaaagggguuuuuuuguuuuguuu

SEQ ID NO: 550343 - RNA, 63 nt, Homo Sapiens
uguucugaaguuacccucugaaaaauauuuugucucucugacuugauuucuauaaaugcuuuu

SEQ ID NO: 550344 - RNA, 63 nt, Homo Sapiens
uucuuuuuuaaauuauuuuuuaaaagucuuucucucucugauucagcuuaaauuuuuuuaucg

SEQ ID NO: 550345 - RNA, 63 nt, Homo Sapiens
acccuagcagaacugauaccuggggcccucggucucucugaagaucuuugaguagcacuguuu

SEQ ID NO: 550346 - RNA, 63 nt, Homo Sapiens
cccagcuauggggaacaucuacaacacguuuuccucucugaguagugucugaucaugugaaac

SEQ ID NO: 550347 - RNA, 63 nt, Homo Sapiens
agacuccgucucaaaaaaagggcaauaaaugcccucucugaauguuugaacugccaagaaaag

SEQ ID NO: 550348 - RNA, 63 nt, Homo Sapiens
gggaggcuggucucccuccagcuggaauugcugcucucugagggagaggcugugguggcuguc

SEQ ID NO: 550349 - RNA, 63 nt, Homo Sapiens
agccaccacuacagggcuguuucauguacuucucucucugacucugucuuguccgacucucuu

SEQ ID NO: 550350 - RNA, 63 nt, Homo Sapiens
acuauuuuugguugugugauagaguuauuuaaccucucugagccucaguucccucguauguaa

SEQ ID NO: 550351 - RNA, 63 nt, Homo Sapiens
agucagaauagggacacugcggucacaagcucacucucugacagauacccaccaucuuucaag

SEQ ID NO: 550352 - RNA, 63 nt, Homo Sapiens
ggaaguugugaauguuugcagacaucugccagccucucugaauccgggguuuuucuuccaucu

SEQ ID NO: 550353 - RNA, 63 nt, Homo Sapiens
ucuuuauuuuucaaucucugaauauuuuagucucucucugagucucauuuuuuaaaaugcucu

SEQ ID NO: 550354 - RNA, 63 nt, Homo Sapiens
ccuacuauaauaugacugucugaaacuuauuuucucucugagaaauaaauguucuaaugggca

SEQ ID NO: 550355 - RNA, 63 nt, Homo Sapiens
ugauuuuuugaguuuuguuucaaggccacgcugcucucugaauuguuggguguggguggucuc

SEQ ID NO: 550356 - RNA, 63 nt, Homo Sapiens
uguaugacacccagcuuuaauguauacuuuaugcucucugaaaaacuccugucucugugagaa

SEQ ID NO: 550357 - RNA, 63 nt, Homo Sapiens
cugggggucaggacagggccugauuugagccuccucucugaagaugauuuggccgagcggaag

SEQ ID NO: 550358 - RNA, 63 nt, Homo Sapiens
uuggacaggaggugcugaggcuggcugcaccugcucucugaagacgccuuccucucuagguuc

SEQ ID NO: 550359 - RNA, 63 nt, Homo Sapiens
gguguccucggccccccugacuucuuccucugacucucugaguaccguggccucccgaaucgc

SEQ ID NO: 550360 - RNA, 63 nt, Homo Sapiens
cucugucucugcuucugaacagcauggcuccgccucucugagccucgcuguguuuccucaggc

SEQ ID NO: 550361 - RNA, 63 nt, Homo Sapiens
cuuguugccugaaauuguuauuguuuguuauuucucucugauguuuuuuguaagacauuguau

SEQ ID NO: 550362 - RNA, 63 nt, Homo Sapiens
ucagcuuaauaacaacacuuauugcaccugucucucucugagaacacggugugucucgacacg

SEQ ID NO: 550363 - RNA, 63 nt, Homo Sapiens
cccugggcaggccgcuccugagcugcugucucccucucugaccuaugccuaccuucucuuucu

SEQ ID NO: 550364 - RNA, 63 nt, Homo Sapiens
gccagggucccuaagaacagguuugcagcuacccucucugaccuuuuccccauaucuugugcu

SEQ ID NO: 550365 - RNA, 63 nt, Homo Sapiens
uaugcuaacccccaaauacucaagugugcuggccucucugacacacugcacagaagacagcag

SEQ ID NO: 550366 - RNA, 63 nt, Homo Sapiens
gugauggggcugagcaggagcacacauacagagcucucugaggagcgcgcacacgcacgcaca

SEQ ID NO: 550367 - RNA, 63 nt, Homo Sapiens
uuaccaaaguaggauuuugagggugggggugcucucucugagggggugggggugccgcugucu

SEQ ID NO: 550368 - RNA, 63 nt, Homo Sapiens
gugccgcugucucugaggggugggggugccgcucucucugagggggugggggugccgcuuucu

SEQ ID NO: 550369 - RNA, 63 nt, Homo Sapiens
ugccgcuuucucugagggggugggggugccgcucucucugagggggugggggugcugcucucu

SEQ ID NO: 550370 - RNA, 63 nt, Homo Sapiens
ccuacauuccgucaguuucccuuugcugcuuugcucucugaaaccucuugucuuucuucccug

SEQ ID NO: 550371 - RNA, 63 nt, Homo Sapiens
gccccgaaccuugcaucaagucguguugggcuucucucugaacuggccuacacagagaaccgu

SEQ ID NO: 550372 - RNA, 63 nt, Homo Sapiens
agaaggugcacgaaggagacaccacuuggggaccucucugagcaggcucucgugaaucagcuc

SEQ ID NO: 550373 - RNA, 63 nt, Homo Sapiens
cuguggagucaaggucccccucucccaggcaggcucucugagggcauucuguagucccaggcc

SEQ ID NO: 550374 - RNA, 63 nt, Homo Sapiens
guguccuggccagcccuggaccucuucacuagccucucugaagaauucacccuacauuccucu

SEQ ID NO: 550375 - RNA, 63 nt, Homo Sapiens
augucaaaucgugguuuagauaucuacuucucucucucugaagcaaccuggaauggagacuuu

SEQ ID NO: 550376 - RNA, 63 nt, Homo Sapiens
uccccacggcccuugccacugucuccuggcccucucucugaucaugccagguuugcaccagcc

SEQ ID NO: 550377 - RNA, 63 nt, Homo Sapiens
uguaguacauucuccaagaugcagcccaggagccucucugaaggaccagucugguuacgaugg

SEQ ID NO: 550378 - RNA, 63 nt, Homo Sapiens
uggugccugcuggagggagggugggccuggggccucucugacgugggucuccucccgggcuca

SEQ ID NO: 550379 - RNA, 63 nt, Homo Sapiens
aguccaucaccugcaacuuauccacugauuacucucucugacgguggguuacacugaucuugu

SEQ ID NO: 550380 - RNA, 64 nt, Homo Sapiens; identical to SEQ ID NO: 157984

SEQ ID NO: 550381 - RNA, 64 nt, Homo Sapiens; identical to SEQ ID NO: 157985

SEQ ID NO: 550382 - RNA, 64 nt, Homo Sapiens; identical to SEQ ID NO: 157986

SEQ ID NO: 550383 - RNA, 64 nt, Homo Sapiens; identical to SEQ ID NO: 157987

SEQ ID NO: 550384 - RNA, 64 nt, Homo Sapiens; identical to SEQ ID NO: 157988

SEQ ID NO: 550385 - RNA, 64 nt, Homo Sapiens; identical to SEQ ID NO: 157989

SEQ ID NO: 550386 - RNA, 64 nt, Homo Sapiens; identical to SEQ ID NO: 157990

SEQ ID NO: 550387 - RNA, 64 nt, Homo Sapiens; identical to SEQ ID NO: 157991

SEQ ID NO: 550388 - RNA, 64 nt, Homo Sapiens; identical to SEQ ID NO: 157992

SEQ ID NO: 550389 - RNA, 64 nt, Homo Sapiens; identical to SEQ ID NO: 157993

SEQ ID NO: 550390 - RNA, 64 nt, Homo Sapiens; identical to SEQ ID NO: 157994

SEQ ID NO: 550391 - RNA, 64 nt, Homo Sapiens; identical to SEQ ID NO: 157995

SEQ ID NO: 550392 - RNA, 64 nt, Homo Sapiens; identical to SEQ ID NO: 157996

SEQ ID NO: 550393 - RNA, 64 nt, Homo Sapiens; identical to SEQ ID NO: 157997

SEQ ID NO: 550394 - RNA, 64 nt, Homo Sapiens; identical to SEQ ID NO: 157998

SEQ ID NO: 550395 - RNA, 64 nt, Homo Sapiens; identical to SEQ ID NO: 157999

SEQ ID NO: 550396 - RNA, 64 nt, Homo Sapiens; identical to SEQ ID NO: 158000

SEQ ID NO: 550397 - RNA, 64 nt, Homo Sapiens; identical to SEQ ID NO: 158001

SEQ ID NO: 550398 - RNA, 64 nt, Homo Sapiens; identical to SEQ ID NO: 158002

SEQ ID NO: 550399 - RNA, 64 nt, Homo Sapiens; identical to SEQ ID NO: 158003

SEQ ID NO: 550400 - RNA, 64 nt, Homo Sapiens; identical to SEQ ID NO: 158004

SEQ ID NO: 550401 - RNA, 64 nt, Homo Sapiens; identical to SEQ ID NO: 158005

SEQ ID NO: 550402 - RNA, 64 nt, Homo Sapiens; identical to SEQ ID NO: 158006

SEQ ID NO: 550403 - RNA, 64 nt, Homo Sapiens; identical to SEQ ID NO: 158007

SEQ ID NO: 550404 - RNA, 64 nt, Homo Sapiens; identical to SEQ ID NO: 158008

SEQ ID NO: 550405 - RNA, 64 nt, Homo Sapiens; identical to SEQ ID NO: 158009

SEQ ID NO: 550406 - RNA, 64 nt, Homo Sapiens; identical to SEQ ID NO: 158010

SEQ ID NO: 550407 - RNA, 64 nt, Homo Sapiens; identical to SEQ ID NO: 158011

SEQ ID NO: 550408 - RNA, 64 nt, Homo Sapiens; identical to SEQ ID NO: 158012

SEQ ID NO: 550409 - RNA, 64 nt, Homo Sapiens; identical to SEQ ID NO: 158013

SEQ ID NO: 550410 - RNA, 64 nt, Homo Sapiens; identical to SEQ ID NO: 158014

SEQ ID NO: 550411 - RNA, 64 nt, Homo Sapiens; identical to SEQ ID NO: 158015

SEQ ID NO: 550412 - RNA, 64 nt, Homo Sapiens; identical to SEQ ID NO: 158016

SEQ ID NO: 550413 - RNA, 64 nt, Homo Sapiens; identical to SEQ ID NO: 158017

SEQ ID NO: 550414 - RNA, 64 nt, Homo Sapiens; identical to SEQ ID NO: 158018

SEQ ID NO: 550415 - RNA, 64 nt, Homo Sapiens; identical to SEQ ID NO: 158019

SEQ ID NO: 550416 - RNA, 64 nt, Homo Sapiens; identical to SEQ ID NO: 158020

SEQ ID NO: 550417 - RNA, 64 nt, Homo Sapiens; identical to SEQ ID NO: 158021

SEQ ID NO: 550418 - RNA, 64 nt, Homo Sapiens; identical to SEQ ID NO: 158022

SEQ ID NO: 550419 - RNA, 64 nt, Homo Sapiens; identical to SEQ ID NO: 158023

SEQ ID NO: 550420 - RNA, 64 nt, Homo Sapiens; identical to SEQ ID NO: 158024

SEQ ID NO: 550421 - RNA, 64 nt, Homo Sapiens; identical to SEQ ID NO: 158025

SEQ ID NO: 550422 - RNA, 64 nt, Homo Sapiens; identical to SEQ ID NO: 158026

SEQ ID NO: 550423 - RNA, 64 nt, Homo Sapiens; identical to SEQ ID NO: 158027

SEQ ID NO: 550424 - RNA, 64 nt, Homo Sapiens; identical to SEQ ID NO: 158028

SEQ ID NO: 550425 - RNA, 64 nt, Homo Sapiens; identical to SEQ ID NO: 158029

SEQ ID NO: 550426 - RNA, 64 nt, Homo Sapiens; identical to SEQ ID NO: 158030

SEQ ID NO: 550427 - RNA, 64 nt, Homo Sapiens; identical to SEQ ID NO: 158031

SEQ ID NO: 550428 - RNA, 64 nt, Homo Sapiens; identical to SEQ ID NO: 158032

SEQ ID NO: 550429 - RNA, 64 nt, Homo Sapiens; identical to SEQ ID NO: 158033

SEQ ID NO: 550430 - RNA, 64 nt, Homo Sapiens; identical to SEQ ID NO: 158034

SEQ ID NO: 550431 - RNA, 64 nt, Homo Sapiens; identical to SEQ ID NO: 158035

SEQ ID NO: 550432 - RNA, 64 nt, Homo Sapiens; identical to SEQ ID NO: 158036

SEQ ID NO: 550433 - RNA, 64 nt, Homo Sapiens; identical to SEQ ID NO: 158037

SEQ ID NO: 550434 - RNA, 64 nt, Homo Sapiens; identical to SEQ ID NO: 158038

SEQ ID NO: 550435 - RNA, 64 nt, Homo Sapiens; identical to SEQ ID NO: 158039

SEQ ID NO: 550436 - RNA, 64 nt, Homo Sapiens; identical to SEQ ID NO: 158040

SEQ ID NO: 550437 - RNA, 64 nt, Homo Sapiens; identical to SEQ ID NO: 158041

SEQ ID NO: 550438 - RNA, 64 nt, Homo Sapiens; identical to SEQ ID NO: 158042

SEQ ID NO: 550439 - RNA, 64 nt, Homo Sapiens; identical to SEQ ID NO: 158043

SEQ ID NO: 550440 - RNA, 64 nt, Homo Sapiens; identical to SEQ ID NO: 158044

SEQ ID NO: 550441 - RNA, 64 nt, Homo Sapiens; identical to SEQ ID NO: 158045

SEQ ID NO: 550442 - RNA, 64 nt, Homo Sapiens; identical to SEQ ID NO: 158046

SEQ ID NO: 550443 - RNA, 64 nt, Homo Sapiens; identical to SEQ ID NO: 158047

SEQ ID NO: 550444 - RNA, 64 nt, Homo Sapiens; identical to SEQ ID NO: 158048

SEQ ID NO: 550445 - RNA, 64 nt, Homo Sapiens; identical to SEQ ID NO: 158049

SEQ ID NO: 550446 - RNA, 64 nt, Homo Sapiens; identical to SEQ ID NO: 158050

SEQ ID NO: 550447 - RNA, 64 nt, Homo Sapiens; identical to SEQ ID NO: 158051

SEQ ID NO: 550448 - RNA, 64 nt, Homo Sapiens; identical to SEQ ID NO: 158052

SEQ ID NO: 550449 - RNA, 64 nt, Homo Sapiens; identical to SEQ ID NO: 158053

SEQ ID NO: 550450 - RNA, 64 nt, Homo Sapiens; identical to SEQ ID NO: 158054

SEQ ID NO: 550451 - RNA, 64 nt, Homo Sapiens; identical to SEQ ID NO: 158055

SEQ ID NO: 550452 - RNA, 64 nt, Homo Sapiens; identical to SEQ ID NO: 158056

SEQ ID NO: 550453 - RNA, 64 nt, Homo Sapiens; identical to SEQ ID NO: 158057

SEQ ID NO: 550454 - RNA, 64 nt, Homo Sapiens; identical to SEQ ID NO: 158058

SEQ ID NO: 550455 - RNA, 64 nt, Homo Sapiens; identical to SEQ ID NO: 158059

SEQ ID NO: 550456 - RNA, 64 nt, Homo Sapiens; identical to SEQ ID NO: 158060

SEQ ID NO: 550457 - RNA, 64 nt, Homo Sapiens; identical to SEQ ID NO: 158061

SEQ ID NO: 550458 - RNA, 64 nt, Homo Sapiens; identical to SEQ ID NO: 158062

SEQ ID NO: 550459 - RNA, 64 nt, Homo Sapiens; identical to SEQ ID NO: 158063

SEQ ID NO: 550460 - RNA, 64 nt, Homo Sapiens; identical to SEQ ID NO: 158064

SEQ ID NO: 550461 - RNA, 64 nt, Homo Sapiens; identical to SEQ ID NO: 158065

SEQ ID NO: 550462 - RNA, 64 nt, Homo Sapiens; identical to SEQ ID NO: 158066

SEQ ID NO: 550463 - RNA, 64 nt, Homo Sapiens; identical to SEQ ID NO: 158067

SEQ ID NO: 550464 - RNA, 64 nt, Homo Sapiens; identical to SEQ ID NO: 158068

SEQ ID NO: 550465 - RNA, 64 nt, Homo Sapiens; identical to SEQ ID NO: 158069

SEQ ID NO: 550466 - RNA, 64 nt, Homo Sapiens; identical to SEQ ID NO: 158070

SEQ ID NO: 550467 - RNA, 64 nt, Homo Sapiens; identical to SEQ ID NO: 158071

SEQ ID NO: 550468 - RNA, 64 nt, Homo Sapiens; identical to SEQ ID NO: 158072

SEQ ID NO: 550469 - RNA, 64 nt, Homo Sapiens; identical to SEQ ID NO: 158073

SEQ ID NO: 550470 - RNA, 64 nt, Homo Sapiens; identical to SEQ ID NO: 158074

SEQ ID NO: 550471 - RNA, 64 nt, Homo Sapiens; identical to SEQ ID NO: 158075

SEQ ID NO: 550472 - RNA, 64 nt, Homo Sapiens; identical to SEQ ID NO: 158076

SEQ ID NO: 550473 - RNA, 64 nt, Homo Sapiens; identical to SEQ ID NO: 158077

SEQ ID NO: 550474 - RNA, 64 nt, Homo Sapiens; identical to SEQ ID NO: 158078

SEQ ID NO: 550475 - RNA, 64 nt, Homo Sapiens; identical to SEQ ID NO: 311803

SEQ ID NO: 550476 - RNA, 64 nt, Homo Sapiens; identical to SEQ ID NO: 311804

SEQ ID NO: 550477 - RNA, 64 nt, Homo Sapiens; identical to SEQ ID NO: 311805

SEQ ID NO: 550478 - RNA, 64 nt, Homo Sapiens; identical to SEQ ID NO: 311806

SEQ ID NO: 550479 - RNA, 64 nt, Homo Sapiens; identical to SEQ ID NO: 311807

SEQ ID NO: 550480 - RNA, 64 nt, Homo Sapiens; identical to SEQ ID NO: 311808

SEQ ID NO: 550481 - RNA, 64 nt, Homo Sapiens; identical to SEQ ID NO: 311809

SEQ ID NO: 550482 - RNA, 64 nt, Homo Sapiens; identical to SEQ ID NO: 311810

SEQ ID NO: 550483 - RNA, 64 nt, Homo Sapiens; identical to SEQ ID NO: 311811

SEQ ID NO: 550484 - RNA, 64 nt, Homo Sapiens; identical to SEQ ID NO: 311812

SEQ ID NO: 550485 - RNA, 64 nt, Homo Sapiens; identical to SEQ ID NO: 311813

SEQ ID NO: 550486 - RNA, 64 nt, Homo Sapiens; identical to SEQ ID NO: 311814

SEQ ID NO: 550487 - RNA, 64 nt, Homo Sapiens; identical to SEQ ID NO: 311815

SEQ ID NO: 550488 - RNA, 64 nt, Homo Sapiens; identical to SEQ ID NO: 311816

SEQ ID NO: 550489 - RNA, 64 nt, Homo Sapiens; identical to SEQ ID NO: 311817

SEQ ID NO: 550490 - RNA, 64 nt, Homo Sapiens; identical to SEQ ID NO: 311818

SEQ ID NO: 550491 - RNA, 64 nt, Homo Sapiens; identical to SEQ ID NO: 311819

SEQ ID NO: 550492 - RNA, 64 nt, Homo Sapiens; identical to SEQ ID NO: 311820

SEQ ID NO: 550493 - RNA, 64 nt, Homo Sapiens; identical to SEQ ID NO: 311821

SEQ ID NO: 550494 - RNA, 64 nt, Homo Sapiens; identical to SEQ ID NO: 311822

SEQ ID NO: 550495 - RNA, 64 nt, Homo Sapiens; identical to SEQ ID NO: 311823

SEQ ID NO: 550496 - RNA, 64 nt, Homo Sapiens; identical to SEQ ID NO: 311824

SEQ ID NO: 550497 - RNA, 64 nt, Homo Sapiens; identical to SEQ ID NO: 311825

SEQ ID NO: 550498 - RNA, 64 nt, Homo Sapiens; identical to SEQ ID NO: 311824

SEQ ID NO: 550499 - RNA, 64 nt, Homo Sapiens; identical to SEQ ID NO: 311824

SEQ ID NO: 550500 - RNA, 64 nt, Homo Sapiens; identical to SEQ ID NO: 311828

SEQ ID NO: 550501 - RNA, 64 nt, Homo Sapiens; identical to SEQ ID NO: 311829

SEQ ID NO: 550502 - RNA, 64 nt, Homo Sapiens; identical to SEQ ID NO: 311830

SEQ ID NO: 550503 - RNA, 64 nt, Homo Sapiens; identical to SEQ ID NO: 311831

SEQ ID NO: 550504 - RNA, 64 nt, Homo Sapiens; identical to SEQ ID NO: 311832

SEQ ID NO: 550505 - RNA, 64 nt, Homo Sapiens; identical to SEQ ID NO: 311833

SEQ ID NO: 550506 - RNA, 64 nt, Homo Sapiens; identical to SEQ ID NO: 311834

SEQ ID NO: 550507 - RNA, 64 nt, Homo Sapiens; identical to SEQ ID NO: 311835

SEQ ID NO: 550508 - RNA, 64 nt, Homo Sapiens; identical to SEQ ID NO: 311836

SEQ ID NO: 550509 - RNA, 64 nt, Homo Sapiens; identical to SEQ ID NO: 311837

SEQ ID NO: 550510 - RNA, 64 nt, Homo Sapiens; identical to SEQ ID NO: 311838

SEQ ID NO: 550511 - RNA, 64 nt, Homo Sapiens; identical to SEQ ID NO: 311839

SEQ ID NO: 550512 - RNA, 64 nt, Homo Sapiens; identical to SEQ ID NO: 311840

SEQ ID NO: 550513 - RNA, 64 nt, Homo Sapiens; identical to SEQ ID NO: 311841

SEQ ID NO: 550514 - RNA, 64 nt, Homo Sapiens; identical to SEQ ID NO: 311842

SEQ ID NO: 550515 - RNA, 64 nt, Homo Sapiens; identical to SEQ ID NO: 311843

SEQ ID NO: 550516 - RNA, 64 nt, Homo Sapiens; identical to SEQ ID NO: 311844

SEQ ID NO: 550517 - RNA, 64 nt, Homo Sapiens; identical to SEQ ID NO: 311845

SEQ ID NO: 550518 - RNA, 64 nt, Homo Sapiens; identical to SEQ ID NO: 311846

SEQ ID NO: 550519 - RNA, 64 nt, Homo Sapiens; identical to SEQ ID NO: 542642

SEQ ID NO: 550520 - RNA, 64 nt, Homo Sapiens; identical to SEQ ID NO: 542643

SEQ ID NO: 550521 - RNA, 64 nt, Homo Sapiens; identical to SEQ ID NO: 542644

SEQ ID NO: 550522 - RNA, 64 nt, Homo Sapiens; identical to SEQ ID NO: 542645

SEQ ID NO: 550523 - RNA, 64 nt, Homo Sapiens; identical to SEQ ID NO: 542646

SEQ ID NO: 550524 - RNA, 64 nt, Homo Sapiens; identical to SEQ ID NO: 542647

SEQ ID NO: 550525 - RNA, 64 nt, Homo Sapiens; identical to SEQ ID NO: 542648

SEQ ID NO: 550526 - RNA, 64 nt, Homo Sapiens; identical to SEQ ID NO: 542649

SEQ ID NO: 550527 - RNA, 64 nt, Homo Sapiens
ccuggcucuccagaaccuucuaucccacagucaggccccagagagggcaggacaagccuugucc

SEQ ID NO: 550528 - RNA, 64 nt, Homo Sapiens
gugcugggauuacaggugugagcuacugcgcccagccccagaaaucucagugcuguuuggagcu

SEQ ID NO: 550529 - RNA, 64 nt, Homo Sapiens
cugccugcagucagcucggccuccccgaccugcagccccagacucugcucucccagcacugacu

SEQ ID NO: 550530 - RNA, 64 nt, Homo Sapiens
ccacaguucuggguuaucuccucucauacaucaagccccagaggaggcggcaagaggaacagcc

SEQ ID NO: 550531 - RNA, 64 nt, Homo Sapiens
gauuuuacauuugcucuuuuagccaccaugccccgccccagauggugcugggauuacaggcgug

SEQ ID NO: 550532 - RNA, 64 nt, Homo Sapiens
gcaagagaggaagacuauuuagggacguaccuaugccccagaagggacaggaagccuugcgaga

SEQ ID NO: 550533 - RNA, 64 nt, Homo Sapiens
aggccccgacgaggagggguaugcaggcuggcaggccccagagcugguggagggcaucucacuc

SEQ ID NO: 550534 - RNA, 64 nt, Homo Sapiens
ccauugacaacugcucguguacaggcaccccacagccccagagcauggggcacagcaggcaugc

SEQ ID NO: 550535 - RNA, 64 nt, Homo Sapiens
agagccccaccgcagcccaguagggaugcagcacgccccagagggcucaugugggccccagaug

SEQ ID NO: 550536 - RNA, 64 nt, Homo Sapiens
uagggaugcagcacgccccagagggcucaugugggccccagauggcaaugccaccauuguugau

SEQ ID NO: 550537 - RNA, 64 nt, Homo Sapiens
ggcauggccucccugaugaucaccaccaaggguagccccagaggggagcuccgagggcagguag

SEQ ID NO: 550538 - RNA, 64 nt, Homo Sapiens
augcuguucccgcugcacggcccaccggcggccagccccagagaccagaacugauccagagcug

SEQ ID NO: 550539 - RNA, 64 nt, Homo Sapiens
cuccuuccaaguaugugacguaguccugaaccacgccccagacuuccgccgggucuaccugccu

SEQ ID NO: 550540 - RNA, 64 nt, Homo Sapiens
gagcugaagaacaagcugcucauggcaagggcuggccccagaacccugcaagagaggccuucug

SEQ ID NO: 550541 - RNA, 64 nt, Homo Sapiens
gggugggcuuccugcccuucgagccuggccccaggccccagacaagcagaagccuccaagcaca

SEQ ID NO: 550542 - RNA, 64 nt, Homo Sapiens
ggcccaccguggcacuagaaugccaccagcccccgccccagaguggcagaugucuucccugggc

SEQ ID NO: 550543 - RNA, 64 nt, Homo Sapiens
gccggcggaugcuggauccggagccccagguuccgccccagagcgguccuggacaaggccagac

SEQ ID NO: 550544 - RNA, 64 nt, Homo Sapiens
gguagcauccaucugguggccaaagagaaucguagccccagagcugcccaaguucacugggcuc

SEQ ID NO: 550545 - RNA, 64 nt, Homo Sapiens
augccaggacccgccagccccgcucccaccuagugccccagacugagcucuccaggccaggugg

SEQ ID NO: 550546 - RNA, 64 nt, Homo Sapiens
aguggcuaguggggugaacagcuggugccaaauagccccagacugggcccaggcaggucugcaa

SEQ ID NO: 550547 - RNA, 64 nt, Homo Sapiens
caaaggcuggccuguguguaccgcagcugugcgugccccagacaaagaaguuucugggagaugc

SEQ ID NO: 550548 - RNA, 64 nt, Homo Sapiens
gggaagucuccccgcuggagagccggcucugccagccccagauucagccugcccucccugccgg

SEQ ID NO: 550549 - RNA, 64 nt, Homo Sapiens
ggcaugggggggaggggggcguguuucugggccugccccagacacugcccuuggcugccagccu

SEQ ID NO: 550550 - RNA, 64 nt, Homo Sapiens
ccuuaggaguucuugcuucuugcguugauacuuugccccagaaaggccugggauucauucuggu

SEQ ID NO: 550551 - RNA, 64 nt, Homo Sapiens
aaccaauaagaauccucuauccaugcccaccccagccccagagagccacaaaugaagagaaaag

SEQ ID NO: 550552 - RNA, 64 nt, Homo Sapiens
ccugucccccacacccaggguuuccagaucgcuggccccagaacacaaauucagaacgugccuc

SEQ ID NO: 550553 - RNA, 64 nt, Homo Sapiens
uugaggcaaagccaggccgucagagacaccugaggccccagagcugcaucuuuguuugcaucuc

SEQ ID NO: 550554 - RNA, 64 nt, Homo Sapiens
ccaccugaucugcaucuuugcaagccaacucagugccccagaccccuucuccucaucuguggag

SEQ ID NO: 550555 - RNA, 64 nt, Homo Sapiens
cuucucucuggaggaagaggagguacugagcaaggccccagaucccuagaccacccuccauguc

SEQ ID NO: 550556 - RNA, 64 nt, Homo Sapiens
gaucuuccuggaugccaacgcccugugccuuccggccccagaagcaaacacugguuccccacug

SEQ ID NO: 550557 - RNA, 64 nt, Homo Sapiens
aucaagccaaaccugcugccacagcccucccccggccccagauagcagccccagggaggaugcu

SEQ ID NO: 550558 - RNA, 64 nt, Homo Sapiens
cccaaccaaggagcuggggcccaaggccaguccugccccagagacacuccaaguccgccagggg

SEQ ID NO: 550559 - RNA, 64 nt, Homo Sapiens
ggcggccucugggcuugggcaccagcucaugccagccccagagggucaggguuggaggccugug

SEQ ID NO: 550560 - RNA, 64 nt, Homo Sapiens
uccauggugucaugccaagacaguaucagacacagccccagaagggggcauuaugggcccugcc

SEQ ID NO: 550561 - RNA, 64 nt, Homo Sapiens
gacuccgacucuccgcuggggggaggcgucacuggccccagaguacuuugggauucuugucagc

SEQ ID NO: 550562 - RNA, 64 nt, Homo Sapiens
uagauuuuaugcuugggccuucccuccaccgccagccccagagucagagcccccucccucaccu

SEQ ID NO: 550563 - RNA, 64 nt, Homo Sapiens
ggugguugaaacccugcacauccucccagggccagccccagaaugggccuuucucugccugccc

SEQ ID NO: 550564 - RNA, 64 nt, Homo Sapiens
aggauuuucaagacaaacuggaguaagaauuaaagccccagaggauuuaauuauccugguuugc

SEQ ID NO: 550565 - RNA, 64 nt, Homo Sapiens
uugaugccucagggucucugaaaucucccgggaagccccagagcuuuccugaggcugccuggcc

SEQ ID NO: 550566 - RNA, 64 nt, Homo Sapiens
uaguuccucuccauccgccaccuccccucccgcugccccagaaguuucuaucauuccauggaga

SEQ ID NO: 550567 - RNA, 64 nt, Homo Sapiens
ccggcuaaaggacccugcacuccgcgucuucccagccccagaaauacacacaguguuucauugc

SEQ ID NO: 550568 - RNA, 64 nt, Homo Sapiens
ccacauggccaccagccccagggcuccaaggcuugccccagaggccuaggcaggggcugggcca

SEQ ID NO: 550569 - RNA, 64 nt, Homo Sapiens
cucccucacccucucggcccccaccccagacccugccccagacgacaggcccaggcaggagguc

SEQ ID NO: 550570 - RNA, 64 nt, Homo Sapiens
cguuaagggacugguuggccggacacagcgacaugccccagacaacacacggacagacgcagac

SEQ ID NO: 550571 - RNA, 64 nt, Homo Sapiens
uuccccgagagaaaguguuaacauugagacucuggccccagauugguaucuucuaugaagaugg

SEQ ID NO: 550572 - RNA, 64 nt, Homo Sapiens
cugcuuuccaaaugugguuaaauguaauugguuagccccagacuugggcuagagcagaaggcau

SEQ ID NO: 550573 - RNA, 60 nt, Homo Sapiens
aauaccauaaacccugcugaagacaggagaguacagaaugacaacauugagcccacacug

SEQ ID NO: 550574 - RNA, 64 nt, Homo Sapiens
caaacuuuugugaacaugcaaucaucuuauguggguacagaaagagguaaagagucugaaucaa

SEQ ID NO: 550575 - RNA, 64 nt, Homo Sapiens
guacuguauuuuugaauagcugacuuuuuucuuuguacagaagaucaucuuauuaaaugugaug

SEQ ID NO: 550576 - RNA, 64 nt, Homo Sapiens
auuguauauacuuacauaugaugucucuggcaauguacagaaauaauacaauuacugcccuaaa

SEQ ID NO: 550577 - RNA, 64 nt, Homo Sapiens
gauuuccauguagauagaagaacuauagggccuaguacagaaggugcacacaaauguuggcaaa

SEQ ID NO: 550578 - RNA, 64 nt, Homo Sapiens
cccuaccaagugaaaauugauguguguuaagaggguacagaauuaucaacugauuuggucaguu

SEQ ID NO: 550579 - RNA, 64 nt, Homo Sapiens
cuuuuaagcagacccauaccuuuccagggucaaaguacagaauagaauacauugauacaaagua

SEQ ID NO: 550580 - RNA, 64 nt, Homo Sapiens
ggucaaaguacagaauagaauacauugauacaaaguacagaaaaauacuuugauuuuuauccau

SEQ ID NO: 550581 - RNA, 64 nt, Homo Sapiens
aaaaacguugccccauuaacauuuguauguaaauguacagaaaucuguuguaccuuuggggaaa

SEQ ID NO: 550582 - RNA, 64 nt, Homo Sapiens
ggaccuauccaguagccaggcaaacccccauuauguacagaauagcuauaaagccaccugucaa

SEQ ID NO: 550583 - RNA, 64 nt, Homo Sapiens
uuucuucauuaauuuuguguguguccaccguuguguacagaauuuuacuguauaaaggugugcu

SEQ ID NO: 550584 - RNA, 64 nt, Homo Sapiens
aauuuuugguguaaauuuguacugagacaaucauguacagaaagaaacguauaauauguacauc

SEQ ID NO: 550585 - RNA, 64 nt, Homo Sapiens
guccucaucuaacugccaucccuguggaauuucaguacagaacacugacaaacaaggaaagcgg

SEQ ID NO: 550586 - RNA, 64 nt, Homo Sapiens
caaaguuaagaaauaggaaacugaauuuuucauuguacagaaaauguaucucuuggggagggcc

SEQ ID NO: 550587 - RNA, 64 nt, Homo Sapiens
gcauuacgcugagucuuaccugauuaagcaugguguacagaaaacaacugguaaacuaacagag

SEQ ID NO: 550588 - RNA, 64 nt, Homo Sapiens
uauuugaaauuauaguaaaacauucuuaguaaaaguacagaaucuuuacuauucaaauugguuu

SEQ ID NO: 550589 - RNA, 64 nt, Homo Sapiens
agguuuuauuuaucauguuaaauauuaaauagcuguacagaagcuaacauguacguauuucuga

SEQ ID NO: 550590 - RNA, 64 nt, Homo Sapiens
auaguuaguugugcauuuguggcuaacaguguagguacagaacuccccaaaccauguuaaacgu

SEQ ID NO: 550591 - RNA, 64 nt, Homo Sapiens
aauuuugaaaugugucauuuuuaaacaaucuuaaaaguaauacagaauugugauuuauuaauuu

SEQ ID NO: 550592 - RNA, 64 nt, Homo Sapiens
cucuuagaacuuagaaguguuucuaagagaacagaaguaauaagagaaacaguuacguguggaa

SEQ ID NO: 550593 - RNA, 64 nt, Homo Sapiens
ccuguuugaagcuuuaagagauauacuuuuccucaaguaauauaucauccuuaguacacagaga

SEQ ID NO: 550594 - RNA, 64 nt, Homo Sapiens
aauuaccucuuuaaaaaguaaauuauucacucagaaguaauauauuuaucacagugaaaggcaa

SEQ ID NO: 550595 - RNA, 64 nt, Homo Sapiens
uguauuguugagauauauugguaauauauuguacaaguaauaaauuuauguuauuaugugugaa

SEQ ID NO: 550596 - RNA, 64 nt, Homo Sapiens
uuguacaaguaauaaauguauguuauuaugugugaaguaauauauuuagugaaaugauguuuua

SEQ ID NO: 550597 - RNA, 64 nt, Homo Sapiens
uucuuauuucuucauuuuaagucauugcaauggaaaguaauauuauaaaaugguaauuacaaca

SEQ ID NO: 550598 - RNA, 64 nt, Homo Sapiens
ucugacaacguguuucugaaaaacagauuuucauaaguaauaauaaaaauaauaauaaaaaagu

SEQ ID NO: 550599 - RNA, 64 nt, Homo Sapiens
aaaagucaaagcaguguucuuacuaauaaauacaaaguaauaacgcaaaauuaugaauaggaua

SEQ ID NO: 550600 - RNA, 64 nt, Homo Sapiens
uucuguaugaauaagcauaacccaaaauucuagaaaguaauaaauuagugauuaugauucuuau

SEQ ID NO: 550601 - RNA, 64 nt, Homo Sapiens
aguuccauuuaaauaugaguuugaaagcuguacaaaguaauagauguucuauucaacuucuaau

SEQ ID NO: 550602 - RNA, 64 nt, Homo Sapiens
uccccaauaucaucuaaucauaauaccauuguaaaaguaauaaugacauucuccuaaaaauccg

SEQ ID NO: 550603 - RNA, 64 nt, Homo Sapiens
agacuggauucuguaccagacaacuaaacauaguaaguaauacuaugauaguaaaaacaccuga

SEQ ID NO: 550604 - RNA, 64 nt, Homo Sapiens
aaaacuauuucagauguauuauugcauugugcccaaguaauaauacaggcaggaacgggggacc

SEQ ID NO: 550605 - RNA, 64 nt, Homo Sapiens
uguggggagagcacucgguugucuuuacuuuuaaaaguaauacuuggugcuaagaauuucagga

SEQ ID NO: 550606 - RNA, 64 nt, Homo Sapiens
aggagagcaacaggccccugauuauacaguuccaaaguaauaagauguuaauuguaauucagcc

SEQ ID NO: 550607 - RNA, 64 nt, Homo Sapiens
auuuuagcuuuagaaagaaaugcguuauagaaacaaguaauagcaagaaaauugauguauauuu

SEQ ID NO: 550608 - RNA, 64 nt, Homo Sapiens
aagcauuauugggugccuuuguuuguaaaccaaaaaguaauaaaugaaucccuauauuuccauu

SEQ ID NO: 550609 - RNA, 64 nt, Homo Sapiens
agaauacggugguugagaaggaaccaguguuuacaaguaauaucagaaaguugaaggaaccagu

SEQ ID NO: 550610 - RNA, 64 nt, Homo Sapiens
guaauaucagaaaguugaaggaaccaguguuuacaaguaauaccagaaaguugccaaacccuuc

SEQ ID NO: 550611 - RNA, 64 nt, Homo Sapiens
aguaccaccuaaaacugaauuuuaucauauaagcaaguaauaccuauuagucauaccuaaauuu

SEQ ID NO: 550612 - RNA, 64 nt, Homo Sapiens
aucaggcuuuaccgguuuuuuuaguuguuuaaauaaguaauauuuucaaaagaauaaaauaacc

SEQ ID NO: 550613 - RNA, 64 nt, Homo Sapiens
acauuucuuccuggacaguucaaacauuuuuaggaaguaauaauucaaaguaauagcuuuuguu

SEQ ID NO: 550614 - RNA, 64 nt, Homo Sapiens
uuuuguucaaacauuuuuaggaauacaucauucaaaguaauagcaaacagcaauuaccuaugga

SEQ ID NO: 550615 - RNA, 64 nt, Homo Sapiens
ugccacaugugggaaguaggugucauuaauuuugaaguaauaacgguaguauaacaugagugaa

SEQ ID NO: 550616 - RNA, 64 nt, Homo Sapiens
ugugccucagacuugggggugcauccacuggcagaaguaauagugccuuaaauaugcuuguaua

SEQ ID NO: 550617 - RNA, 64 nt, Homo Sapiens
aaaugguaauaguuaacauuuuuuuuguuacaaaaaguaauagauauuacaaaaaacucccacu

SEQ ID NO: 550618 - RNA, 64 nt, Homo Sapiens
ugaaggagcuaacuacccaaucaagcaguaccccaaguaauaacgucaccauauuuucgcuagc

SEQ ID NO: 550619 - RNA, 64 nt, Homo Sapiens
caaugugucuaccaagaacaauugaguuuucuaaaaguaauaaugaagauuaugcaauucuaac

SEQ ID NO: 550620 - RNA, 64 nt, Homo Sapiens
uuuaaucuuuuuaaauuguacagcaaggugcucuaaguaauauucgauaaaauauauuuaauag

SEQ ID NO: 550621 - RNA, 64 nt, Homo Sapiens; identical to SEQ ID NO: 117373

SEQ ID NO: 550622 - RNA, 64 nt, Homo Sapiens; identical to SEQ ID NO: 117374

SEQ ID NO: 550623 - RNA, 64 nt, Homo Sapiens; identical to SEQ ID NO: 117375

SEQ ID NO: 550624 - RNA, 64 nt, Homo Sapiens; identical to SEQ ID NO: 117376

SEQ ID NO: 550625 - RNA, 64 nt, Homo Sapiens; identical to SEQ ID NO: 117377

SEQ ID NO: 550626 - RNA, 64 nt, Homo Sapiens; identical to SEQ ID NO: 117378

SEQ ID NO: 550627 - RNA, 64 nt, Homo Sapiens; identical to SEQ ID NO: 117379

SEQ ID NO: 550628 - RNA, 64 nt, Homo Sapiens; identical to SEQ ID NO: 117380

SEQ ID NO: 550629 - RNA, 64 nt, Homo Sapiens; identical to SEQ ID NO: 117381

SEQ ID NO: 550630 - RNA, 64 nt, Homo Sapiens; identical to SEQ ID NO: 117382

SEQ ID NO: 550631 - RNA, 64 nt, Homo Sapiens; identical to SEQ ID NO: 117383

SEQ ID NO: 550632 - RNA, 64 nt, Homo Sapiens; identical to SEQ ID NO: 117384

SEQ ID NO: 550633 - RNA, 64 nt, Homo Sapiens; identical to SEQ ID NO: 117385

SEQ ID NO: 550634 - RNA, 64 nt, Homo Sapiens; identical to SEQ ID NO: 117386

SEQ ID NO: 550635 - RNA, 64 nt, Homo Sapiens; identical to SEQ ID NO: 117387

SEQ ID NO: 550636 - RNA, 64 nt, Homo Sapiens; identical to SEQ ID NO: 117388

SEQ ID NO: 550637 - RNA, 64 nt, Homo Sapiens; identical to SEQ ID NO: 117389

SEQ ID NO: 550638 - RNA, 64 nt, Homo Sapiens; identical to SEQ ID NO: 117390

SEQ ID NO: 550639 - RNA, 64 nt, Homo Sapiens; identical to SEQ ID NO: 117391

SEQ ID NO: 550640 - RNA, 64 nt, Homo Sapiens; identical to SEQ ID NO: 117392

SEQ ID NO: 550641 - RNA, 64 nt, Homo Sapiens; identical to SEQ ID NO: 117393

SEQ ID NO: 550642 - RNA, 64 nt, Homo Sapiens; identical to SEQ ID NO: 117394

SEQ ID NO: 550643 - RNA, 64 nt, Homo Sapiens; identical to SEQ ID NO: 61334

SEQ ID NO: 550644 - RNA, 64 nt, Homo Sapiens; identical to SEQ ID NO: 61335

SEQ ID NO: 550645 - RNA, 64 nt, Homo Sapiens; identical to SEQ ID NO: 61336

SEQ ID NO: 550646 - RNA, 64 nt, Homo Sapiens; identical to SEQ ID NO: 61337

SEQ ID NO: 550647 - RNA, 64 nt, Homo Sapiens; identical to SEQ ID NO: 61338

SEQ ID NO: 550648 - RNA, 64 nt, Homo Sapiens; identical to SEQ ID NO: 61339

SEQ ID NO: 550649 - RNA, 64 nt, Homo Sapiens; identical to SEQ ID NO: 61340

SEQ ID NO: 550650 - RNA, 64 nt, Homo Sapiens; identical to SEQ ID NO: 61341

SEQ ID NO: 550651 - RNA, 64 nt, Homo Sapiens; identical to SEQ ID NO: 61342

SEQ ID NO: 550652 - RNA, 64 nt, Homo Sapiens; identical to SEQ ID NO: 61343

SEQ ID NO: 550653 - RNA, 64 nt, Homo Sapiens; identical to SEQ ID NO: 61344

SEQ ID NO: 550654 - RNA, 64 nt, Homo Sapiens; identical to SEQ ID NO: 61345

SEQ ID NO: 550655 - RNA, 64 nt, Homo Sapiens; identical to SEQ ID NO: 61346

SEQ ID NO: 550656 - RNA, 64 nt, Homo Sapiens; identical to SEQ ID NO: 61347

SEQ ID NO: 550657 - RNA, 64 nt, Homo Sapiens; identical to SEQ ID NO: 61348

SEQ ID NO: 550658 - RNA, 64 nt, Homo Sapiens; identical to SEQ ID NO: 61349

SEQ ID NO: 550659 - RNA, 64 nt, Homo Sapiens; identical to SEQ ID NO: 61350

SEQ ID NO: 550660 - RNA, 64 nt, Homo Sapiens; identical to SEQ ID NO: 61351

SEQ ID NO: 550661 - RNA, 53 nt, Homo Sapiens; identical to SEQ ID NO: 167525

SEQ ID NO: 550662 - RNA, 64 nt, Homo Sapiens; identical to SEQ ID NO: 167526

SEQ ID NO: 550663 - RNA, 64 nt, Homo Sapiens; identical to SEQ ID NO: 167527

SEQ ID NO: 550664 - RNA, 64 nt, Homo Sapiens; identical to SEQ ID NO: 167528

SEQ ID NO: 550665 - RNA, 64 nt, Homo Sapiens; identical to SEQ ID NO: 167529

SEQ ID NO: 550666 - RNA, 64 nt, Homo Sapiens; identical to SEQ ID NO: 167530

SEQ ID NO: 550667 - RNA, 64 nt, Homo Sapiens; identical to SEQ ID NO: 167531

SEQ ID NO: 550668 - RNA, 64 nt, Homo Sapiens; identical to SEQ ID NO: 167532

SEQ ID NO: 550669 - RNA, 64 nt, Homo Sapiens; identical to SEQ ID NO: 167533

SEQ ID NO: 550670 - RNA, 64 nt, Homo Sapiens; identical to SEQ ID NO: 167534

SEQ ID NO: 550671 - RNA, 64 nt, Homo Sapiens; identical to SEQ ID NO: 167535

SEQ ID NO: 550672 - RNA, 64 nt, Homo Sapiens; identical to SEQ ID NO: 167536

SEQ ID NO: 550673 - RNA, 64 nt, Homo Sapiens; identical to SEQ ID NO: 167537

SEQ ID NO: 550674 - RNA, 64 nt, Homo Sapiens; identical to SEQ ID NO: 167538

SEQ ID NO: 550675 - RNA, 64 nt, Homo Sapiens; identical to SEQ ID NO: 167539

SEQ ID NO: 550676 - RNA, 64 nt, Homo Sapiens; identical to SEQ ID NO: 167540

SEQ ID NO: 550677 - RNA, 64 nt, Homo Sapiens; identical to SEQ ID NO: 167541

SEQ ID NO: 550678 - RNA, 64 nt, Homo Sapiens; identical to SEQ ID NO: 167542

SEQ ID NO: 550679 - RNA, 64 nt, Homo Sapiens; identical to SEQ ID NO: 167543

SEQ ID NO: 550680 - RNA, 64 nt, Homo Sapiens; identical to SEQ ID NO: 167544

SEQ ID NO: 550681 - RNA, 64 nt, Homo Sapiens; identical to SEQ ID NO: 167545

SEQ ID NO: 550682 - RNA, 64 nt, Homo Sapiens; identical to SEQ ID NO: 167546

SEQ ID NO: 550683 - RNA, 64 nt, Homo Sapiens; identical to SEQ ID NO: 167547

SEQ ID NO: 550684 - RNA, 64 nt, Homo Sapiens; identical to SEQ ID NO: 167548

SEQ ID NO: 550685 - RNA, 64 nt, Homo Sapiens; identical to SEQ ID NO: 167549

SEQ ID NO: 550686 - RNA, 64 nt, Homo Sapiens; identical to SEQ ID NO: 167550

SEQ ID NO: 550687 - RNA, 64 nt, Homo Sapiens; identical to SEQ ID NO: 167551

SEQ ID NO: 550688 - RNA, 64 nt, Homo Sapiens; identical to SEQ ID NO: 167552

SEQ ID NO: 550689 - RNA, 64 nt, Homo Sapiens; identical to SEQ ID NO: 167553

SEQ ID NO: 550690 - RNA, 64 nt, Homo Sapiens; identical to SEQ ID NO: 167554

SEQ ID NO: 550691 - RNA, 64 nt, Homo Sapiens; identical to SEQ ID NO: 167555

SEQ ID NO: 550692 - RNA, 64 nt, Homo Sapiens; identical to SEQ ID NO: 167556

SEQ ID NO: 550693 - RNA, 64 nt, Homo Sapiens; identical to SEQ ID NO: 167557

SEQ ID NO: 550694 - RNA, 64 nt, Homo Sapiens; identical to SEQ ID NO: 167558

SEQ ID NO: 550695 - RNA, 64 nt, Homo Sapiens; identical to SEQ ID NO: 167559

SEQ ID NO: 550696 - RNA, 64 nt, Homo Sapiens; identical to SEQ ID NO: 167560

SEQ ID NO: 550697 - RNA, 64 nt, Homo Sapiens; identical to SEQ ID NO: 167561

SEQ ID NO: 550698 - RNA, 64 nt, Homo Sapiens; identical to SEQ ID NO: 167562

SEQ ID NO: 550699 - RNA, 64 nt, Homo Sapiens; identical to SEQ ID NO: 167563

SEQ ID NO: 550700 - RNA, 64 nt, Homo Sapiens; identical to SEQ ID NO: 167564

SEQ ID NO: 550701 - RNA, 64 nt, Homo Sapiens; identical to SEQ ID NO: 167565

SEQ ID NO: 550702 - RNA, 64 nt, Homo Sapiens; identical to SEQ ID NO: 167566

SEQ ID NO: 550703 - RNA, 64 nt, Homo Sapiens; identical to SEQ ID NO: 167567

SEQ ID NO: 550704 - RNA, 64 nt, Homo Sapiens; identical to SEQ ID NO: 167568

SEQ ID NO: 550705 - RNA, 64 nt, Homo Sapiens; identical to SEQ ID NO: 167569

SEQ ID NO: 550706 - RNA, 64 nt, Homo Sapiens; identical to SEQ ID NO: 167570

SEQ ID NO: 550707 - RNA, 64 nt, Homo Sapiens; identical to SEQ ID NO: 167571

SEQ ID NO: 550708 - RNA, 64 nt, Homo Sapiens; identical to SEQ ID NO: 167572

SEQ ID NO: 550709 - RNA, 64 nt, Homo Sapiens; identical to SEQ ID NO: 167573

SEQ ID NO: 550710 - RNA, 64 nt, Homo Sapiens; identical to SEQ ID NO: 167574

SEQ ID NO: 550711 - RNA, 64 nt, Homo Sapiens; identical to SEQ ID NO: 167575

SEQ ID NO: 550712 - RNA, 64 nt, Homo Sapiens; identical to SEQ ID NO: 193524

SEQ ID NO: 550713 - RNA, 64 nt, Homo Sapiens; identical to SEQ ID NO: 193525

SEQ ID NO: 550714 - RNA, 64 nt, Homo Sapiens; identical to SEQ ID NO: 193526

SEQ ID NO: 550715 - RNA, 64 nt, Homo Sapiens; identical to SEQ ID NO: 193527

SEQ ID NO: 550716 - RNA, 64 nt, Homo Sapiens; identical to SEQ ID NO: 193528

SEQ ID NO: 550717 - RNA, 64 nt, Homo Sapiens; identical to SEQ ID NO: 193529

SEQ ID NO: 550718 - RNA, 64 nt, Homo Sapiens; identical to SEQ ID NO: 193530

SEQ ID NO: 550719 - RNA, 64 nt, Homo Sapiens; identical to SEQ ID NO: 193531

SEQ ID NO: 550720 - RNA, 64 nt, Homo Sapiens; identical to SEQ ID NO: 193532

SEQ ID NO: 550721 - RNA, 64 nt, Homo Sapiens; identical to SEQ ID NO: 193533

SEQ ID NO: 550722 - RNA, 64 nt, Homo Sapiens; identical to SEQ ID NO: 193534

SEQ ID NO: 550723 - RNA, 64 nt, Homo Sapiens; identical to SEQ ID NO: 193535

SEQ ID NO: 550724 - RNA, 64 nt, Homo Sapiens; identical to SEQ ID NO: 193536

SEQ ID NO: 550725 - RNA, 64 nt, Homo Sapiens; identical to SEQ ID NO: 193537

SEQ ID NO: 550726 - RNA, 64 nt, Homo Sapiens; identical to SEQ ID NO: 193538

SEQ ID NO: 550727 - RNA, 64 nt, Homo Sapiens; identical to SEQ ID NO: 193539

SEQ ID NO: 550728 - RNA, 64 nt, Homo Sapiens; identical to SEQ ID NO: 193540

SEQ ID NO: 550729 - RNA, 64 nt, Homo Sapiens; identical to SEQ ID NO: 193541

SEQ ID NO: 550730 - RNA, 64 nt, Homo Sapiens; identical to SEQ ID NO: 193542

SEQ ID NO: 550731 - RNA, 64 nt, Homo Sapiens; identical to SEQ ID NO: 193543

SEQ ID NO: 550732 - RNA, 64 nt, Homo Sapiens; identical to SEQ ID NO: 193544

SEQ ID NO: 550733 - RNA, 64 nt, Homo Sapiens; identical to SEQ ID NO: 193545

SEQ ID NO: 550734 - RNA, 64 nt, Homo Sapiens; identical to SEQ ID NO: 193546

SEQ ID NO: 550735 - RNA, 64 nt, Homo Sapiens; identical to SEQ ID NO: 193547

SEQ ID NO: 550736 - RNA, 64 nt, Homo Sapiens; identical to SEQ ID NO: 193548

SEQ ID NO: 550737 - RNA, 64 nt, Homo Sapiens; identical to SEQ ID NO: 193549

SEQ ID NO: 550738 - RNA, 64 nt, Homo Sapiens; identical to SEQ ID NO: 193550

SEQ ID NO: 550739 - RNA, 64 nt, Homo Sapiens; identical to SEQ ID NO: 193551

SEQ ID NO: 550740 - RNA, 64 nt, Homo Sapiens; identical to SEQ ID NO: 193552

SEQ ID NO: 550741 - RNA, 64 nt, Homo Sapiens; identical to SEQ ID NO: 193553

SEQ ID NO: 550742 - RNA, 64 nt, Homo Sapiens; identical to SEQ ID NO: 193554

SEQ ID NO: 550743 - RNA, 64 nt, Homo Sapiens; identical to SEQ ID NO: 193555

SEQ ID NO: 550744 - RNA, 64 nt, Homo Sapiens; identical to SEQ ID NO: 193556

SEQ ID NO: 550745 - RNA, 64 nt, Homo Sapiens; identical to SEQ ID NO: 193557

SEQ ID NO: 550746 - RNA, 64 nt, Homo Sapiens; identical to SEQ ID NO: 193558

SEQ ID NO: 550747 - RNA, 64 nt, Homo Sapiens; identical to SEQ ID NO: 193559

SEQ ID NO: 550748 - RNA, 64 nt, Homo Sapiens; identical to SEQ ID NO: 193560

SEQ ID NO: 550749 - RNA, 64 nt, Homo Sapiens; identical to SEQ ID NO: 193561

SEQ ID NO: 550750 - RNA, 64 nt, Homo Sapiens; identical to SEQ ID NO: 193562

SEQ ID NO: 550751 - RNA, 64 nt, Homo Sapiens; identical to SEQ ID NO: 193563

SEQ ID NO: 550752 - RNA, 64 nt, Homo Sapiens; identical to SEQ ID NO: 193564

SEQ ID NO: 550753 - RNA, 64 nt, Homo Sapiens; identical to SEQ ID NO: 193565

SEQ ID NO: 550754 - RNA, 64 nt, Homo Sapiens; identical to SEQ ID NO: 193566

SEQ ID NO: 550755 - RNA, 64 nt, Homo Sapiens; identical to SEQ ID NO: 193567

SEQ ID NO: 550756 - RNA, 64 nt, Homo Sapiens; identical to SEQ ID NO: 193568

SEQ ID NO: 550757 - RNA, 64 nt, Homo Sapiens; identical to SEQ ID NO: 193569

SEQ ID NO: 550758 - RNA, 64 nt, Homo Sapiens; identical to SEQ ID NO: 193570

SEQ ID NO: 550759 - RNA, 64 nt, Homo Sapiens; identical to SEQ ID NO: 193571

SEQ ID NO: 550760 - RNA, 64 nt, Homo Sapiens; identical to SEQ ID NO: 193572

SEQ ID NO: 550761 - RNA, 64 nt, Homo Sapiens; identical to SEQ ID NO: 193573

SEQ ID NO: 550762 - RNA, 64 nt, Homo Sapiens; identical to SEQ ID NO: 193574

SEQ ID NO: 550763 - RNA, 64 nt, Homo Sapiens; identical to SEQ ID NO: 193575

SEQ ID NO: 550764 - RNA, 64 nt, Homo Sapiens; identical to SEQ ID NO: 193576

SEQ ID NO: 550765 - RNA, 64 nt, Homo Sapiens; identical to SEQ ID NO: 193577

SEQ ID NO: 550766 - RNA, 64 nt, Homo Sapiens; identical to SEQ ID NO: 193578

SEQ ID NO: 550767 - RNA, 64 nt, Homo Sapiens; identical to SEQ ID NO: 193579

SEQ ID NO: 550768 - RNA, 64 nt, Homo Sapiens; identical to SEQ ID NO: 193580

SEQ ID NO: 550769 - RNA, 64 nt, Homo Sapiens; identical to SEQ ID NO: 193581

SEQ ID NO: 550770 - RNA, 64 nt, Homo Sapiens; identical to SEQ ID NO: 193582

SEQ ID NO: 550771 - RNA, 64 nt, Homo Sapiens; identical to SEQ ID NO: 193583

SEQ ID NO: 550772 - RNA, 64 nt, Homo Sapiens; identical to SEQ ID NO: 193584

SEQ ID NO: 550773 - RNA, 64 nt, Homo Sapiens; identical to SEQ ID NO: 193585

SEQ ID NO: 550774 - RNA, 64 nt, Homo Sapiens; identical to SEQ ID NO: 193586

SEQ ID NO: 550775 - RNA, 64 nt, Homo Sapiens; identical to SEQ ID NO: 193587

SEQ ID NO: 550776 - RNA, 64 nt, Homo Sapiens; identical to SEQ ID NO: 193588

SEQ ID NO: 550777 - RNA, 64 nt, Homo Sapiens; identical to SEQ ID NO: 193589

SEQ ID NO: 550778 - RNA, 64 nt, Homo Sapiens; identical to SEQ ID NO: 193590

SEQ ID NO: 550779 - RNA, 64 nt, Homo Sapiens; identical to SEQ ID NO: 193591

SEQ ID NO: 550780 - RNA, 64 nt, Homo Sapiens; identical to SEQ ID NO: 193592

SEQ ID NO: 550781 - RNA, 64 nt, Homo Sapiens; identical to SEQ ID NO: 193593

SEQ ID NO: 550782 - RNA, 64 nt, Homo Sapiens; identical to SEQ ID NO: 193594

SEQ ID NO: 550783 - RNA, 64 nt, Homo Sapiens; identical to SEQ ID NO: 193595

SEQ ID NO: 550784 - RNA, 64 nt, Homo Sapiens; identical to SEQ ID NO: 193596

SEQ ID NO: 550785 - RNA, 64 nt, Homo Sapiens; identical to SEQ ID NO: 107827

SEQ ID NO: 550786 - RNA, 64 nt, Homo Sapiens; identical to SEQ ID NO: 107828

SEQ ID NO: 550787 - RNA, 64 nt, Homo Sapiens; identical to SEQ ID NO: 107829

SEQ ID NO: 550788 - RNA, 64 nt, Homo Sapiens; identical to SEQ ID NO: 107830

SEQ ID NO: 550789 - RNA, 64 nt, Homo Sapiens; identical to SEQ ID NO: 107831

SEQ ID NO: 550790 - RNA, 64 nt, Homo Sapiens; identical to SEQ ID NO: 107832

SEQ ID NO: 550791 - RNA, 64 nt, Homo Sapiens; identical to SEQ ID NO: 107833

SEQ ID NO: 550792 - RNA, 64 nt, Homo Sapiens; identical to SEQ ID NO: 107834

SEQ ID NO: 550793 - RNA, 64 nt, Homo Sapiens; identical to SEQ ID NO: 107835

SEQ ID NO: 550794 - RNA, 64 nt, Homo Sapiens; identical to SEQ ID NO: 107836

SEQ ID NO: 550795 - RNA, 64 nt, Homo Sapiens; identical to SEQ ID NO: 107837

SEQ ID NO: 550796 - RNA, 64 nt, Homo Sapiens; identical to SEQ ID NO: 107838

SEQ ID NO: 550797 - RNA, 64 nt, Homo Sapiens; identical to SEQ ID NO: 107839

SEQ ID NO: 550798 - RNA, 64 nt, Homo Sapiens; identical to SEQ ID NO: 107840

SEQ ID NO: 550799 - RNA, 64 nt, Homo Sapiens; identical to SEQ ID NO: 118014

SEQ ID NO: 550800 - RNA, 64 nt, Homo Sapiens; identical to SEQ ID NO: 118015

SEQ ID NO: 550801 - RNA, 64 nt, Homo Sapiens; identical to SEQ ID NO: 118016

SEQ ID NO: 550802 - RNA, 64 nt, Homo Sapiens; identical to SEQ ID NO: 118017

SEQ ID NO: 550803 - RNA, 64 nt, Homo Sapiens; identical to SEQ ID NO: 118018

SEQ ID NO: 550804 - RNA, 64 nt, Homo Sapiens; identical to SEQ ID NO: 118019

SEQ ID NO: 550805 - RNA, 64 nt, Homo Sapiens; identical to SEQ ID NO: 118020

SEQ ID NO: 550806 - RNA, 64 nt, Homo Sapiens; identical to SEQ ID NO: 118021

SEQ ID NO: 550807 - RNA, 64 nt, Homo Sapiens; identical to SEQ ID NO: 118022

SEQ ID NO: 550808 - RNA, 64 nt, Homo Sapiens; identical to SEQ ID NO: 118023

SEQ ID NO: 550809 - RNA, 64 nt, Homo Sapiens; identical to SEQ ID NO: 118024

SEQ ID NO: 550810 - RNA, 64 nt, Homo Sapiens; identical to SEQ ID NO: 118025

SEQ ID NO: 550811 - RNA, 64 nt, Homo Sapiens; identical to SEQ ID NO: 376674

SEQ ID NO: 550812 - RNA, 64 nt, Homo Sapiens; identical to SEQ ID NO: 376675

SEQ ID NO: 550813 - RNA, 64 nt, Homo Sapiens; identical to SEQ ID NO: 376676

SEQ ID NO: 550814 - RNA, 64 nt, Homo Sapiens; identical to SEQ ID NO: 376677

SEQ ID NO: 550815 - RNA, 64 nt, Homo Sapiens; identical to SEQ ID NO: 376678

SEQ ID NO: 550816 - RNA, 64 nt, Homo Sapiens; identical to SEQ ID NO: 376679

SEQ ID NO: 550817 - RNA, 64 nt, Homo Sapiens; identical to SEQ ID NO: 376680

SEQ ID NO: 550818 - RNA, 64 nt, Homo Sapiens; identical to SEQ ID NO: 376681

SEQ ID NO: 550819 - RNA, 64 nt, Homo Sapiens; identical to SEQ ID NO: 376682

SEQ ID NO: 550820 - RNA, 64 nt, Homo Sapiens; identical to SEQ ID NO: 376683

SEQ ID NO: 550821 - RNA, 64 nt, Homo Sapiens; identical to SEQ ID NO: 376684

SEQ ID NO: 550822 - RNA, 64 nt, Homo Sapiens; identical to SEQ ID NO: 376685

SEQ ID NO: 550823 - RNA, 64 nt, Homo Sapiens; identical to SEQ ID NO: 376686

SEQ ID NO: 550824 - RNA, 64 nt, Homo Sapiens; identical to SEQ ID NO: 376687

SEQ ID NO: 550825 - RNA, 64 nt, Homo Sapiens; identical to SEQ ID NO: 376688

SEQ ID NO: 550826 - RNA, 64 nt, Homo Sapiens; identical to SEQ ID NO: 376689

SEQ ID NO: 550827 - RNA, 64 nt, Homo Sapiens; identical to SEQ ID NO: 376690

SEQ ID NO: 550828 - RNA, 64 nt, Homo Sapiens; identical to SEQ ID NO: 376691

SEQ ID NO: 550829 - RNA, 64 nt, Homo Sapiens; identical to SEQ ID NO: 376692

SEQ ID NO: 550830 - RNA, 64 nt, Homo Sapiens; identical to SEQ ID NO: 376693

SEQ ID NO: 550831 - RNA, 64 nt, Homo Sapiens; identical to SEQ ID NO: 376694

SEQ ID NO: 550832 - RNA, 64 nt, Homo Sapiens; identical to SEQ ID NO: 376695

SEQ ID NO: 550833 - RNA, 64 nt, Homo Sapiens; identical to SEQ ID NO: 376696

SEQ ID NO: 550834 - RNA, 64 nt, Homo Sapiens; identical to SEQ ID NO: 376697

SEQ ID NO: 550835 - RNA, 64 nt, Homo Sapiens; identical to SEQ ID NO: 376698

SEQ ID NO: 550836 - RNA, 64 nt, Homo Sapiens; identical to SEQ ID NO: 376699

SEQ ID NO: 550837 - RNA, 64 nt, Homo Sapiens; identical to SEQ ID NO: 376700

SEQ ID NO: 550838 - RNA, 64 nt, Homo Sapiens; identical to SEQ ID NO: 376701

SEQ ID NO: 550839 - RNA, 64 nt, Homo Sapiens; identical to SEQ ID NO: 376702

SEQ ID NO: 550840 - RNA, 64 nt, Homo Sapiens; identical to SEQ ID NO: 376703

SEQ ID NO: 550841 - RNA, 64 nt, Homo Sapiens; identical to SEQ ID NO: 376704

SEQ ID NO: 550842 - RNA, 64 nt, Homo Sapiens; identical to SEQ ID NO: 376705

SEQ ID NO: 550843 - RNA, 64 nt, Homo Sapiens; identical to SEQ ID NO: 376706

SEQ ID NO: 550844 - RNA, 64 nt, Homo Sapiens; identical to SEQ ID NO: 376707

SEQ ID NO: 550845 - RNA, 64 nt, Homo Sapiens; identical to SEQ ID NO: 376708

SEQ ID NO: 550846 - RNA, 64 nt, Homo Sapiens; identical to SEQ ID NO: 376709

SEQ ID NO: 550847 - RNA, 64 nt, Homo Sapiens; identical to SEQ ID NO: 376710

SEQ ID NO: 550848 - RNA, 64 nt, Homo Sapiens; identical to SEQ ID NO: 376711

SEQ ID NO: 550849 - RNA, 64 nt, Homo Sapiens; identical to SEQ ID NO: 376712

SEQ ID NO: 550850 - RNA, 64 nt, Homo Sapiens; identical to SEQ ID NO: 376713

SEQ ID NO: 550851 - RNA, 64 nt, Homo Sapiens; identical to SEQ ID NO: 376714

SEQ ID NO: 550852 - RNA, 64 nt, Homo Sapiens; identical to SEQ ID NO: 376715

SEQ ID NO: 550853 - RNA, 64 nt, Homo Sapiens; identical to SEQ ID NO: 376716

SEQ ID NO: 550854 - RNA, 64 nt, Homo Sapiens; identical to SEQ ID NO: 376717

SEQ ID NO: 550855 - RNA, 64 nt, Homo Sapiens; identical to SEQ ID NO: 376718

SEQ ID NO: 550856 - RNA, 64 nt, Homo Sapiens; identical to SEQ ID NO: 376719

SEQ ID NO: 550857 - RNA, 64 nt, Homo Sapiens; identical to SEQ ID NO: 376720

SEQ ID NO: 550858 - RNA, 64 nt, Homo Sapiens; identical to SEQ ID NO: 376721

SEQ ID NO: 550859 - RNA, 64 nt, Homo Sapiens; identical to SEQ ID NO: 376722

SEQ ID NO: 550860 - RNA, 64 nt, Homo Sapiens; identical to SEQ ID NO: 376723

SEQ ID NO: 550861 - RNA, 64 nt, Homo Sapiens; identical to SEQ ID NO: 376724

SEQ ID NO: 550862 - RNA, 64 nt, Homo Sapiens; identical to SEQ ID NO: 376725

SEQ ID NO: 550863 - RNA, 64 nt, Homo Sapiens; identical to SEQ ID NO: 376726

SEQ ID NO: 550864 - RNA, 64 nt, Homo Sapiens; identical to SEQ ID NO: 376727

SEQ ID NO: 550865 - RNA, 64 nt, Homo Sapiens; identical to SEQ ID NO: 376728

SEQ ID NO: 550866 - RNA, 64 nt, Homo Sapiens; identical to SEQ ID NO: 376729

SEQ ID NO: 550867 - RNA, 64 nt, Homo Sapiens; identical to SEQ ID NO: 376730

SEQ ID NO: 550868 - RNA, 64 nt, Homo Sapiens; identical to SEQ ID NO: 376731

SEQ ID NO: 550869 - RNA, 62 nt, Homo Sapiens; identical to SEQ ID NO: 376732

SEQ ID NO: 550870 - RNA, 64 nt, Homo Sapiens; identical to SEQ ID NO: 376733

SEQ ID NO: 550871 - RNA, 64 nt, Homo Sapiens; identical to SEQ ID NO: 376734

SEQ ID NO: 550872 - RNA, 55 nt, Homo Sapiens; identical to SEQ ID NO: 376735

SEQ ID NO: 550873 - RNA, 64 nt, Homo Sapiens; identical to SEQ ID NO: 376736

SEQ ID NO: 550874 - RNA, 64 nt, Homo Sapiens; identical to SEQ ID NO: 376737

SEQ ID NO: 550875 - RNA, 64 nt, Homo Sapiens; identical to SEQ ID NO: 376738

SEQ ID NO: 550876 - RNA, 64 nt, Homo Sapiens; identical to SEQ ID NO: 376739

SEQ ID NO: 550877 - RNA, 64 nt, Homo Sapiens; identical to SEQ ID NO: 376740

SEQ ID NO: 550878 - RNA, 64 nt, Homo Sapiens; identical to SEQ ID NO: 376741

SEQ ID NO: 550879 - RNA, 64 nt, Homo Sapiens; identical to SEQ ID NO: 376742

SEQ ID NO: 550880 - RNA, 64 nt, Homo Sapiens; identical to SEQ ID NO: 376743

SEQ ID NO: 550881 - RNA, 64 nt, Homo Sapiens; identical to SEQ ID NO: 376744

SEQ ID NO: 550882 - RNA, 64 nt, Homo Sapiens; identical to SEQ ID NO: 376745

SEQ ID NO: 550883 - RNA, 64 nt, Homo Sapiens; identical to SEQ ID NO: 376746

SEQ ID NO: 550884 - RNA, 64 nt, Homo Sapiens; identical to SEQ ID NO: 376747

SEQ ID NO: 550885 - RNA, 64 nt, Homo Sapiens; identical to SEQ ID NO: 376748

SEQ ID NO: 550886 - RNA, 64 nt, Homo Sapiens; identical to SEQ ID NO: 376749

SEQ ID NO: 550887 - RNA, 64 nt, Homo Sapiens; identical to SEQ ID NO: 376750

SEQ ID NO: 550888 - RNA, 64 nt, Homo Sapiens; identical to SEQ ID NO: 376751

SEQ ID NO: 550889 - RNA, 64 nt, Homo Sapiens; identical to SEQ ID NO: 376752

SEQ ID NO: 550890 - RNA, 64 nt, Homo Sapiens; identical to SEQ ID NO: 376753

SEQ ID NO: 550891 - RNA, 64 nt, Homo Sapiens; identical to SEQ ID NO: 376754

SEQ ID NO: 550892 - RNA, 64 nt, Homo Sapiens; identical to SEQ ID NO: 376755

SEQ ID NO: 550893 - RNA, 64 nt, Homo Sapiens; identical to SEQ ID NO: 376756

SEQ ID NO: 550894 - RNA, 64 nt, Homo Sapiens; identical to SEQ ID NO: 376757

SEQ ID NO: 550895 - RNA, 64 nt, Homo Sapiens; identical to SEQ ID NO: 376758

SEQ ID NO: 550896 - RNA, 64 nt, Homo Sapiens; identical to SEQ ID NO: 376759

SEQ ID NO: 550897 - RNA, 64 nt, Homo Sapiens; identical to SEQ ID NO: 376760

SEQ ID NO: 550898 - RNA, 64 nt, Homo Sapiens; identical to SEQ ID NO: 376761

SEQ ID NO: 550899 - RNA, 64 nt, Homo Sapiens; identical to SEQ ID NO: 376762

SEQ ID NO: 550900 - RNA, 64 nt, Homo Sapiens; identical to SEQ ID NO: 376763

SEQ ID NO: 550901 - RNA, 64 nt, Homo Sapiens; identical to SEQ ID NO: 376764

SEQ ID NO: 550902 - RNA, 64 nt, Homo Sapiens; identical to SEQ ID NO: 376765

SEQ ID NO: 550903 - RNA, 64 nt, Homo Sapiens; identical to SEQ ID NO: 376766

SEQ ID NO: 550904 - RNA, 64 nt, Homo Sapiens; identical to SEQ ID NO: 376767

SEQ ID NO: 550905 - RNA, 64 nt, Homo Sapiens; identical to SEQ ID NO: 376768

SEQ ID NO: 550906 - RNA, 64 nt, Homo Sapiens; identical to SEQ ID NO: 376769

SEQ ID NO: 550907 - RNA, 64 nt, Homo Sapiens; identical to SEQ ID NO: 376770

SEQ ID NO: 550908 - RNA, 64 nt, Homo Sapiens; identical to SEQ ID NO: 376771

SEQ ID NO: 550909 - RNA, 64 nt, Homo Sapiens; identical to SEQ ID NO: 376772

SEQ ID NO: 550910 - RNA, 64 nt, Homo Sapiens; identical to SEQ ID NO: 376773

SEQ ID NO: 550911 - RNA, 64 nt, Homo Sapiens; identical to SEQ ID NO: 376774

SEQ ID NO: 550912 - RNA, 64 nt, Homo Sapiens; identical to SEQ ID NO: 376775

SEQ ID NO: 550913 - RNA, 64 nt, Homo Sapiens; identical to SEQ ID NO: 376776

SEQ ID NO: 550914 - RNA, 64 nt, Homo Sapiens; identical to SEQ ID NO: 376777

SEQ ID NO: 550915 - RNA, 64 nt, Homo Sapiens; identical to SEQ ID NO: 376778

SEQ ID NO: 550916 - RNA, 64 nt, Homo Sapiens; identical to SEQ ID NO: 376779

SEQ ID NO: 550917 - RNA, 64 nt, Homo Sapiens; identical to SEQ ID NO: 376780

SEQ ID NO: 550918 - RNA, 64 nt, Homo Sapiens; identical to SEQ ID NO: 376781

SEQ ID NO: 550919 - RNA, 64 nt, Homo Sapiens; identical to SEQ ID NO: 376782

SEQ ID NO: 550920 - RNA, 64 nt, Homo Sapiens; identical to SEQ ID NO: 376783

SEQ ID NO: 550921 - RNA, 64 nt, Homo Sapiens; identical to SEQ ID NO: 376784

SEQ ID NO: 550922 - RNA, 64 nt, Homo Sapiens; identical to SEQ ID NO: 376785

SEQ ID NO: 550923 - RNA, 64 nt, Homo Sapiens; identical to SEQ ID NO: 83612

SEQ ID NO: 550924 - RNA, 64 nt, Homo Sapiens; identical to SEQ ID NO: 83613

SEQ ID NO: 550925 - RNA, 64 nt, Homo Sapiens; identical to SEQ ID NO: 83614

SEQ ID NO: 550926 - RNA, 64 nt, Homo Sapiens; identical to SEQ ID NO: 83615

SEQ ID NO: 550927 - RNA, 64 nt, Homo Sapiens; identical to SEQ ID NO: 83616

SEQ ID NO: 550928 - RNA, 64 nt, Homo Sapiens; identical to SEQ ID NO: 83617

SEQ ID NO: 550929 - RNA, 64 nt, Homo Sapiens; identical to SEQ ID NO: 83618

SEQ ID NO: 550930 - RNA, 64 nt, Homo Sapiens; identical to SEQ ID NO: 83619

SEQ ID NO: 550931 - RNA, 64 nt, Homo Sapiens; identical to SEQ ID NO: 83620

SEQ ID NO: 550932 - RNA, 64 nt, Homo Sapiens; identical to SEQ ID NO: 83621

SEQ ID NO: 550933 - RNA, 64 nt, Homo Sapiens; identical to SEQ ID NO: 83622

SEQ ID NO: 550934 - RNA, 64 nt, Homo Sapiens; identical to SEQ ID NO: 83623

SEQ ID NO: 550935 - RNA, 64 nt, Homo Sapiens; identical to SEQ ID NO: 83624

SEQ ID NO: 550936 - RNA, 64 nt, Homo Sapiens; identical to SEQ ID NO: 83625

SEQ ID NO: 550937 - RNA, 64 nt, Homo Sapiens; identical to SEQ ID NO: 83626

SEQ ID NO: 550938 - RNA, 64 nt, Homo Sapiens; identical to SEQ ID NO: 83627

SEQ ID NO: 550939 - RNA, 64 nt, Homo Sapiens; identical to SEQ ID NO: 83628

SEQ ID NO: 550940 - RNA, 64 nt, Homo Sapiens; identical to SEQ ID NO: 83629

SEQ ID NO: 550941 - RNA, 64 nt, Homo Sapiens; identical to SEQ ID NO: 83630

SEQ ID NO: 550942 - RNA, 64 nt, Homo Sapiens; identical to SEQ ID NO: 83631

SEQ ID NO: 550943 - RNA, 64 nt, Homo Sapiens; identical to SEQ ID NO: 83632

SEQ ID NO: 550944 - RNA, 60 nt, Homo Sapiens; identical to SEQ ID NO: 83633

SEQ ID NO: 550945 - RNA, 64 nt, Homo Sapiens; identical to SEQ ID NO: 83634

SEQ ID NO: 550946 - RNA, 64 nt, Homo Sapiens; identical to SEQ ID NO: 83635

SEQ ID NO: 550947 - RNA, 64 nt, Homo Sapiens; identical to SEQ ID NO: 83636

SEQ ID NO: 550948 - RNA, 64 nt, Homo Sapiens; identical to SEQ ID NO: 83637

SEQ ID NO: 550949 - RNA, 64 nt, Homo Sapiens; identical to SEQ ID NO: 83638

SEQ ID NO: 550950 - RNA, 64 nt, Homo Sapiens; identical to SEQ ID NO: 83639

SEQ ID NO: 550951 - RNA, 64 nt, Homo Sapiens; identical to SEQ ID NO: 83640

SEQ ID NO: 550952 - RNA, 64 nt, Homo Sapiens; identical to SEQ ID NO: 83641

SEQ ID NO: 550953 - RNA, 64 nt, Homo Sapiens; identical to SEQ ID NO: 83642

SEQ ID NO: 550954 - RNA, 64 nt, Homo Sapiens; identical to SEQ ID NO: 83643

SEQ ID NO: 550955 - RNA, 64 nt, Homo Sapiens; identical to SEQ ID NO: 83644

SEQ ID NO: 550956 - RNA, 64 nt, Homo Sapiens; identical to SEQ ID NO: 83645

SEQ ID NO: 550957 - RNA, 64 nt, Homo Sapiens; identical to SEQ ID NO: 83646

SEQ ID NO: 550958 - RNA, 64 nt, Homo Sapiens; identical to SEQ ID NO: 83647

SEQ ID NO: 550959 - RNA, 64 nt, Homo Sapiens; identical to SEQ ID NO: 83648

SEQ ID NO: 550960 - RNA, 64 nt, Homo Sapiens; identical to SEQ ID NO: 83649

SEQ ID NO: 550961 - RNA, 64 nt, Homo Sapiens; identical to SEQ ID NO: 83650

SEQ ID NO: 550962 - RNA, 54 nt, Homo Sapiens; identical to SEQ ID NO: 83651

SEQ ID NO: 550963 - RNA, 64 nt, Homo Sapiens; identical to SEQ ID NO: 83652

SEQ ID NO: 550964 - RNA, 64 nt, Homo Sapiens; identical to SEQ ID NO: 83653

SEQ ID NO: 550965 - RNA, 64 nt, Homo Sapiens; identical to SEQ ID NO: 83654

SEQ ID NO: 550966 - RNA, 64 nt, Homo Sapiens; identical to SEQ ID NO: 83655

SEQ ID NO: 550967 - RNA, 64 nt, Homo Sapiens; identical to SEQ ID NO: 83656

SEQ ID NO: 550968 - RNA, 64 nt, Homo Sapiens; identical to SEQ ID NO: 83657

SEQ ID NO: 550969 - RNA, 59 nt, Homo Sapiens; identical to SEQ ID NO: 83658

SEQ ID NO: 550970 - RNA, 64 nt, Homo Sapiens; identical to SEQ ID NO: 83659

SEQ ID NO: 550971 - RNA, 64 nt, Homo Sapiens; identical to SEQ ID NO: 83660

SEQ ID NO: 550972 - RNA, 64 nt, Homo Sapiens; identical to SEQ ID NO: 83661

SEQ ID NO: 550973 - RNA, 64 nt, Homo Sapiens; identical to SEQ ID NO: 83662

SEQ ID NO: 550974 - RNA, 64 nt, Homo Sapiens; identical to SEQ ID NO: 83663

SEQ ID NO: 550975 - RNA, 64 nt, Homo Sapiens; identical to SEQ ID NO: 83664

SEQ ID NO: 550976 - RNA, 64 nt, Homo Sapiens; identical to SEQ ID NO: 83665

SEQ ID NO: 550977 - RNA, 64 nt, Homo Sapiens; identical to SEQ ID NO: 83666

SEQ ID NO: 550978 - RNA, 64 nt, Homo Sapiens; identical to SEQ ID NO: 83667

SEQ ID NO: 550979 - RNA, 64 nt, Homo Sapiens; identical to SEQ ID NO: 83668

SEQ ID NO: 550980 - RNA, 64 nt, Homo Sapiens
gaagaacaaccccugaacaauggaggccuuucuuucccgcuaggcucccagccuccuucccgcu

SEQ ID NO: 550981 - RNA, 64 nt, Homo Sapiens
aggccuuucuuucccgcuaggcucccagccuccuucccgcuacagaaucgcucaucggcgaggc

SEQ ID NO: 550982 - RNA, 64 nt, Homo Sapiens
cugaccacuacccucuuuccuagggcauaguccaucccgcuaguccaucccgcuagccccacuc

SEQ ID NO: 550983 - RNA, 64 nt, Homo Sapiens
ucuuuccuagggcauaguccaucccgcuaguccaucccgcuagccccacuccagggacucagac

SEQ ID NO: 550984 - RNA, 64 nt, Homo Sapiens; identical to SEQ ID NO: 307517

SEQ ID NO: 550985 - RNA, 64 nt, Homo Sapiens; identical to SEQ ID NO: 307518

SEQ ID NO: 550986 - RNA, 64 nt, Homo Sapiens; identical to SEQ ID NO: 307519

SEQ ID NO: 550987 - RNA, 64 nt, Homo Sapiens; identical to SEQ ID NO: 307520

SEQ ID NO: 550988 - RNA, 64 nt, Homo Sapiens; identical to SEQ ID NO: 307521

SEQ ID NO: 550989 - RNA, 64 nt, Homo Sapiens; identical to SEQ ID NO: 307522

SEQ ID NO: 550990 - RNA, 64 nt, Homo Sapiens; identical to SEQ ID NO: 307523

SEQ ID NO: 550991 - RNA, 64 nt, Homo Sapiens; identical to SEQ ID NO: 247465

SEQ ID NO: 550992 - RNA, 64 nt, Homo Sapiens; identical to SEQ ID NO: 247466

SEQ ID NO: 550993 - RNA, 64 nt, Homo Sapiens; identical to SEQ ID NO: 247467

SEQ ID NO: 550994 - RNA, 64 nt, Homo Sapiens; identical to SEQ ID NO: 247468

SEQ ID NO: 550995 - RNA, 64 nt, Homo Sapiens; identical to SEQ ID NO: 247469

SEQ ID NO: 550996 - RNA, 64 nt, Homo Sapiens; identical to SEQ ID NO: 247470

SEQ ID NO: 550997 - RNA, 64 nt, Homo Sapiens; identical to SEQ ID NO: 247471

SEQ ID NO: 550998 - RNA, 64 nt, Homo Sapiens; identical to SEQ ID NO: 247472

SEQ ID NO: 550999 - RNA, 64 nt, Homo Sapiens; identical to SEQ ID NO: 247473

SEQ ID NO: 551000 - RNA, 64 nt, Homo Sapiens; identical to SEQ ID NO: 247474

SEQ ID NO: 551001 - RNA, 64 nt, Homo Sapiens; identical to SEQ ID NO: 247475

SEQ ID NO: 551002 - RNA, 64 nt, Homo Sapiens; identical to SEQ ID NO: 247476

SEQ ID NO: 551003 - RNA, 64 nt, Homo Sapiens; identical to SEQ ID NO: 247477

SEQ ID NO: 551004 - RNA, 64 nt, Homo Sapiens; identical to SEQ ID NO: 247478

SEQ ID NO: 551005 - RNA, 64 nt, Homo Sapiens; identical to SEQ ID NO: 247479

SEQ ID NO: 551006 - RNA, 64 nt, Homo Sapiens; identical to SEQ ID NO: 247480

SEQ ID NO: 551007 - RNA, 64 nt, Homo Sapiens
cuaaaccuuaacuguuccuuaaggauuuuagccaguauuuuaauagaacaugauuaaugaaagu

SEQ ID NO: 551008 - RNA, 64 nt, Homo Sapiens
gaaagggaacaaaguguauaaaacugccacaauuguauuuuaauuuugagguaugauauuuuca

SEQ ID NO: 551009 - RNA, 64 nt, Homo Sapiens
cauccuuuuuuuugauuauaaaauuuucuaaaauguauuuuagacuuccuguagggggcgauau

SEQ ID NO: 551010 - RNA, 64 nt, Homo Sapiens
uaaauguauuccuguagggggcgauauacuaaauguauuuuagacuuccuguagggggcgauaa

SEQ ID NO: 551011 - RNA, 64 nt, Homo Sapiens
auucaguggcucauuuauaccuaauaaaauaaugguauuuuaaaauaaugcuacuuucaaagua

SEQ ID NO: 551012 - RNA, 64 nt, Homo Sapiens
augauaaaugaauuuaccaguuuaguaugcugugguauuuuaauaaguuuucaaagauaauugg

SEQ ID NO: 551013 - RNA, 64 nt, Homo Sapiens
cagccauuauuuuauugucuagcuccaguuaucuguauuuuauguaauguaauugacaggaugg

SEQ ID NO: 551014 - RNA, 64 nt, Homo Sapiens
caacacuuggcauuuuuauguuuuaagaaaaacaguauuuuauuuauaauaaaaucugaauauu

SEQ ID NO: 551015 - RNA, 64 nt, Homo Sapiens
agcaugccugguuguauuaaagcagggauaugcuguauuuuauaaaauuggcaaaauuagagaa

SEQ ID NO: 551016 - RNA, 64 nt, Homo Sapiens
acucuuaagauuauucuuucaccaacuauagaauguauuuuauauaucguucauuguaaaaagc

SEQ ID NO: 551017 - RNA, 64 nt, Homo Sapiens
uuuuggaauuugggaagcagggugaggugggggaguauuuuaaucaaagggcgcugguugguag

SEQ ID NO: 551018 - RNA, 64 nt, Homo Sapiens
uuaguuuuaauauuuucauuaauacuaacuauauguauuuuaacucaaauuuuaugcugugugg

SEQ ID NO: 551019 - RNA, 64 nt, Homo Sapiens
uguuuauguuuuaagaaugaaugaaagcucugcuguauuuuaaaagaaaugccagaauacaaau

SEQ ID NO: 551020 - RNA, 64 nt, Homo Sapiens
uugcauuuguguaguacuuugaaauaugguuaauguauuuuacuuuuaaauuauauaaaugcua

SEQ ID NO: 551021 - RNA, 64 nt, Homo Sapiens
cacauuauuugcaauauccauauuuaaaauucaaguauuuuauuauuugaagaaacaauuuaau

SEQ ID NO: 551022 - RNA, 64 nt, Homo Sapiens
aauguauuuaugcugcuagaagaucaacaaugaaguauuuuauauguuuuaaaucaaugaccua

SEQ ID NO: 551023 - RNA, 64 nt, Homo Sapiens
cagagaacauuuuauuugcaauuaaaccagguaaguauuuuaaauggccagauaaauguguuau

SEQ ID NO: 551024 - RNA, 64 nt, Homo Sapiens
ggcuugggauuuggugcaaaacuuaaaauuagucguauuuuaaugagcagacgacuucuguuua

SEQ ID NO: 551025 - RNA, 64 nt, Homo Sapiens
gaaccacaugaaguuauagccucuaaagccugugguauuuuauauaauauuuuuauaacuuuaa

SEQ ID NO: 551026 - RNA, 64 nt, Homo Sapiens
uaaaugaagcauuugaaugucauaucuuuuuaaaguauuuuauuguauacuguaucauagaagu

SEQ ID NO: 551027 - RNA, 64 nt, Homo Sapiens
auaguguggaaauccccuaaauugauuagaaauuguauuuuaugaaaaauaacuuguauucauu

SEQ ID NO: 551028 - RNA, 64 nt, Homo Sapiens
acaggugugagccacugugccuggccuccggugaguauuuuauauuuagucuacacuuccauac

SEQ ID NO: 551029 - RNA, 64 nt, Homo Sapiens
uagagugccacuuauguuuucuuucuuguguacaguauuuuauuguauggauuuaccauccccu

SEQ ID NO: 551030 - RNA, 64 nt, Homo Sapiens
auucaccucuuauuuuauaucaacauguaauacaguauuuuaaccauuuucagauaaauguauu

SEQ ID NO: 551031 - RNA, 64 nt, Homo Sapiens
cuuaccgcacaucuccauucucaaaauccagaguguauuuuacauauuuuuugguacugaaucu

SEQ ID NO: 551032 - RNA, 64 nt, Homo Sapiens
auauguugcauaguauuuugcaauuguaggucauguauuuuacugaaggaaagcuguugcauau

SEQ ID NO: 551033 - RNA, 64 nt, Homo Sapiens
auguguaaauuguacaauaaucuagagaaagaaaguauuuuaguagguuuuguucugaguuauu

SEQ ID NO: 551034 - RNA, 64 nt, Homo Sapiens
uuuguauucacuugaaagcaaacuggcaugguucguauuuuaaaaaucuugcacaaauuguaau

SEQ ID NO: 551035 - RNA, 64 nt, Homo Sapiens
uuuuaucaucaugauguuuuggaguuauuacuguguauuuuagaaaucauucuuuacaguuuug

SEQ ID NO: 551036 - RNA, 64 nt, Homo Sapiens
caugaugauuuacuaaaucucuccaucugcauuaguauuuuaaggagcacugugagagaaauca

SEQ ID NO: 551037 - RNA, 64 nt, Homo Sapiens
ggaugguuauuagggcccauuagaaacaggagaaguauuuuacccauucuuaaagcucuaaaaa

SEQ ID NO: 551038 - RNA, 64 nt, Homo Sapiens
aaucucccacaaguauauacuuuuaaauuauggaguauuuuaagucuacaaaaagguauaaaua

SEQ ID NO: 551039 - RNA, 64 nt, Homo Sapiens
gguuuaaaggauaugaaacucuacauuuaaacaaguauuuuauauuuggguacagaggaagaaa

SEQ ID NO: 551040 - RNA, 64 nt, Homo Sapiens
ugcugcuuauuuguggaaugcuguaccuuguaaaguauuuuaucuuuucuucaauacaacugug

SEQ ID NO: 551041 - RNA, 64 nt, Homo Sapiens
auuuaugacagaaugaagucaaacagccaccuuuguauuuuauauguuuugaguuuugucauua

SEQ ID NO: 551042 - RNA, 64 nt, Homo Sapiens
uacauaaauaggauugaaucauggccauuauuuuguauuuuaaacuaccguuggaacuagccag

SEQ ID NO: 551043 - RNA, 64 nt, Homo Sapiens
agucucaugcucuaccguuguuaagauguauuuuguauuuuaagacuguggucuucuugacaca

SEQ ID NO: 551044 - RNA, 64 nt, Homo Sapiens
ugacaccacugcauuucuauaauuauuuuaaaagguauuuuagggcaaauaauucuauaaacug

SEQ ID NO: 551045 - RNA, 64 nt, Homo Sapiens
agagaugggguuucaccaugagcuacuuuuuuguguauuuuaguaggugcaugccaccacgccc

SEQ ID NO: 551046 - RNA, 64 nt, Homo Sapiens
uuuaguuuuauuaguugauuuguuaguuucaguuguauuuuauuauuaguuuuuaaaugaguuu

SEQ ID NO: 551047 - RNA, 64 nt, Homo Sapiens
uaucgauuuauuaguuuuuaaguuacuuucugagguauuuuauguguagagagaguucguucca

SEQ ID NO: 551048 - RNA, 64 nt, Homo Sapiens
aaccugagguuuaccuagugacaccaaauuaucgguauuuuaacugaauuuacccauugacuaa

SEQ ID NO: 551049 - RNA, 64 nt, Homo Sapiens
aacaguugucugcugucuguaauucaguuugcguguauuuuaugcucaugcaccaacccauaca

SEQ ID NO: 551050 - RNA, 64 nt, Homo Sapiens
aauuuuaauaguuaaucaucucugagaguaaccuguauuuuaauuguugaaacuuaaccaaaau

SEQ ID NO: 551051 - RNA, 64 nt, Homo Sapiens
gaaaguuauacauguauacuuauuaucuugcucaguauuuuaucucacuuguucuagaauuuuc

SEQ ID NO: 551052 - RNA, 64 nt, Homo Sapiens
acugcauaauagauggugaauuagacaggggaagguauuuuauuguuuucaauauucuugggga

SEQ ID NO: 551053 - RNA, 64 nt, Homo Sapiens
uggucuuuucuauauagucuucucuuccuugaauguauuuuauccuugacaacuucacauugcc

SEQ ID NO: 551054 - RNA, 64 nt, Homo Sapiens
ggugacauguuacuucguucuuacacuauccuggguauuuuacaguuauuuugcacaucacaaa

SEQ ID NO: 551055 - RNA, 64 nt, Homo Sapiens
uccuaauuuacccuucaggugcuacucucaucuuguauuuuaacuuauaaugugcuagcuaauu

SEQ ID NO: 551056 - RNA, 64 nt, Homo Sapiens
uguuugaguaaauuugaaaguguggcauagguggguauuuuagagauuaaaauagcacagcuca

SEQ ID NO: 551057 - RNA, 64 nt, Homo Sapiens
aucuuauuccuacuauuuuuuguuuuuuuccauuguauuuuaaauuuuuggcaaauuuaaaauu

SEQ ID NO: 551058 - RNA, 64 nt, Homo Sapiens
uauuuguauuuauuucauuacuuucaguuuccuuguauuuuaaauuguuucgcgucgcuuauua

SEQ ID NO: 551059 - RNA, 64 nt, Homo Sapiens
cuugaaguuggccaacagaguucaguauuuaccuguauuuuauuagaacuuauuuaagaauuau

SEQ ID NO: 551060 - RNA, 64 nt, Homo Sapiens
ugaagugaagaacuuauuuagaaauaucucagaaguauuuuauuguuguacuagauguucuuag

SEQ ID NO: 551061 - RNA, 64 nt, Homo Sapiens
cacuggugguuugugugugugauaaaucuaagaaguauuuuaccuuaacguaugccaccucaga

SEQ ID NO: 551062 - RNA, 64 nt, Homo Sapiens
uacucaguuuuauaaggugaucaagggcugcauuguauuuuauauuuauaaagauucuuagcua

SEQ ID NO: 551063 - RNA, 64 nt, Homo Sapiens
agccugauaauguuauaaccauugauuugauaaaguauuuuacaaccccugcuuuaacugaugc

SEQ ID NO: 551064 - RNA, 64 nt, Homo Sapiens
augcaauuuacugccauaaucuaggauaauuaagguauuuuagugccaagccagaucuaggcau

SEQ ID NO: 551065 - RNA, 60 nt, Homo Sapiens
acuguuaaagcacgaauugguaacuugacuguauuuuagcuuguuucccuucauagauga

SEQ ID NO: 551066 - RNA, 64 nt, Homo Sapiens
cccacuaaguugugugugaggaaauccucaucuuguauuuuaagaaucugcagauggcauccau

SEQ ID NO: 551067 - RNA, 64 nt, Homo Sapiens
cccggugaauaaauguagauccugccauucauugguauuuuaaagaaccacuugaaaucggauc

SEQ ID NO: 551068 - RNA, 64 nt, Homo Sapiens
cuuucugcacaucuccauuuucgaaaucugguguguauuuuacacucuuuuucauacuaagcuu

SEQ ID NO: 551069 - RNA, 64 nt, Homo Sapiens
ucaaaauucauguaacaagaaacucauaaacucaguauuuuaacuaacacuucagaaagauuca

SEQ ID NO: 551070 - RNA, 64 nt, Homo Sapiens
guguguguguguguucauggguuuuaaaagaacaguauuuuacaaaagguguagcuuuuauaag

SEQ ID NO: 551071 - RNA, 64 nt, Homo Sapiens
ucuauuauauuuuagacaaacauaucauuuucgaguauuuuaaauacugaauucauaguuguug

SEQ ID NO: 551072 - RNA, 64 nt, Homo Sapiens
uccuauaagaucuugaacuugaauuuuauggguuguauuuuaauaauguaaguaaauuauuuau

SEQ ID NO: 551073 - RNA, 64 nt, Homo Sapiens
ucaaggaauuccaaugaugaagauuuuaaggaaaguauuuuauauucaacagguauauucugcu

SEQ ID NO: 551074 - RNA, 64 nt, Homo Sapiens
ggagacauuaacaugaaucucauuuauucucucaguauuuuaacugaagaaauuauacuguuug

SEQ ID NO: 551075 - RNA, 64 nt, Homo Sapiens
uccugguaaaaauuacagggcucuauuuaaggauguauuuuaauguaaaugcuuauguuuuuua

SEQ ID NO: 551076 - RNA, 64 nt, Homo Sapiens
augggaguugcauaggagaguuuacaaggauaauguauuuuaaaacauuauccuuguaauguau

SEQ ID NO: 551077 - RNA, 64 nt, Homo Sapiens
aggauaauguauuuuaaaauauuauccuuguaauguauuuuacaguuaaaguauuuuaaaauac

SEQ ID NO: 551078 - RNA, 64 nt, Homo Sapiens
auacauuauccuuguaauguuauuaugcguuaaaguauuuuaaacuaacauacaaaucuaggaa

SEQ ID NO: 551079 - RNA, 64 nt, Homo Sapiens
aaauauuguugaauuuuuaaaaaaguguauuuuuguauuuuaauaacacugauuguaaugugag

SEQ ID NO: 551080 - RNA, 64 nt, Homo Sapiens
caggaaaaccaccaaaauucauagaccuguacauguauuuuaagcuucagaggcuaaggggaag

SEQ ID NO: 551081 - RNA, 64 nt, Homo Sapiens
cugacaagccucagcaaacccaaagauguuaacaguauuuuaagaaguugcugcagauuccuuu

SEQ ID NO: 551082 - RNA, 64 nt, Homo Sapiens
aaugaguauauguaacaguuuaaaaaaaaaguugguauuuuauaagcacagacaauucuaaugg

SEQ ID NO: 551083 - RNA, 64 nt, Homo Sapiens
aauauaccagcacuacuaauuguuugucuguuuaguauuuuagaugauuaaguucacaguuuau

SEQ ID NO: 551084 - RNA, 64 nt, Homo Sapiens
agaugcagaaacagauuggacaaaugcuuaccugguauuuuauuccuuuuauguauaaaacugc

SEQ ID NO: 551085 - RNA, 64 nt, Homo Sapiens
guggugcuuaacuucuuauuuguuuucuaaaaauguauuuuacuguauugauggcaguccacuc

SEQ ID NO: 551086 - RNA, 64 nt, Homo Sapiens
uauauauuacuuauuuuaaugauacagguuuuaaguauuuuaagaucuauugaaaauggauaua

SEQ ID NO: 551087 - RNA, 64 nt, Homo Sapiens
uaauaaauuaauuuaaaaagccccccaaucugugguauuuuauuauggcagcccuagcaagcua

SEQ ID NO: 551088 - RNA, 64 nt, Homo Sapiens
uucuuagauucauaauguuaggagcauuuaaucuguauuuuacaaguuaggaagcagaggauca

SEQ ID NO: 551089 - RNA, 64 nt, Homo Sapiens
ucuuaguuguguuugaaaacucucauuuuaugcuguauuuuauaaugugggaaacagaucuaaa

SEQ ID NO: 551090 - RNA, 64 nt, Homo Sapiens
ggaauagugaaaacauuuaguucugccccgcauuguauuuuauaaccaguggcuuugauguugu

SEQ ID NO: 551091 - RNA, 64 nt, Homo Sapiens
gcugaggugauucaguucccuccuucuuacagaaguauuuuaauucaccccacacuagaaaugc

SEQ ID NO: 551092 - RNA, 64 nt, Homo Sapiens
ugcagcucuguaguuucuugaggccaaacacacuguauuuuacaagucaaaauauaauuuacau

SEQ ID NO: 551093 - RNA, 64 nt, Homo Sapiens
ucuacuagacuuucuuacagauuuaauuucuuuuguauuuuaagaacuuuauaaugacugaagg

SEQ ID NO: 551094 - RNA, 64 nt, Homo Sapiens
aaagaugugcugccuucauaagauuuggguugauguauuuuacuauuaguucuacaagaaguag

SEQ ID NO: 551095 - RNA, 64 nt, Homo Sapiens
guagaauacagcuccuuaucguucuauguaccagguauuuuauuacugaacuagcaacuagccu

SEQ ID NO: 551096 - RNA, 64 nt, Homo Sapiens
gacuuaaaauuucuaguggcuuuuauuuuucuuuguauuuuaauuuuccuacaaaguccuuuuu

SEQ ID NO: 551097 - RNA, 64 nt, Homo Sapiens
cuaguguuaaauuggaaaauaucaauaauuaagaguauuuuacccaaggaauccucucauggaa

SEQ ID NO: 551098 - RNA, 64 nt, Homo Sapiens
uauaacugagacuagacggaaaaggaauacucguguauuuuaagauaugaaugugacucaagac

SEQ ID NO: 551099 - RNA, 64 nt, Homo Sapiens
auauauuauauuuaaaguguugcauuuaagaugaguauuuuaccagaguguuuccauucauauc

SEQ ID NO: 551100 - RNA, 64 nt, Homo Sapiens
gauaauagguaauaagguuaaauuuuuuuaugacguauuuuauuuacaaauaucauacacugcu

SEQ ID NO: 551101 - RNA, 64 nt, Homo Sapiens
gacuucaaaacauaugugacuguggauaaucuugguauuuuauauauuuuacagacuuuagaau

SEQ ID NO: 551102 - RNA, 64 nt, Homo Sapiens
gacauaauuaaugagaagaauuuggaagaaauugguauuuuaauacugucuguauuuauuacug

SEQ ID NO: 551103 - RNA, 64 nt, Homo Sapiens
ucggggagaggguaagggaauagaucacucagauguauuuuagauaagcuauuuagccuuugau

SEQ ID NO: 551104 - RNA, 64 nt, Homo Sapiens
gugcuccuauguaagaugaacuucagauugugguguauuuuauuuucucguaauucuggaguuu

SEQ ID NO: 551105 - RNA, 64 nt, Homo Sapiens
auugaaacugauggaacauuccaauuugacaaucguauuuuaaaacuguguuuauuucauuuuc

SEQ ID NO: 551106 - RNA, 64 nt, Homo Sapiens
auggcaaugaaaauuuuaagaagaaagauuuaaaguauuuuaauuuuaaagaguguguuauaaa

SEQ ID NO: 551107 - RNA, 64 nt, Homo Sapiens
cuuuauaaagcuguucuugaaagccaaguguuuuguauuuuauagugaguugcauguuuuugaa

SEQ ID NO: 551108 - RNA, 64 nt, Homo Sapiens
gguuacuacuuaaugcuuaccuaauuucauuuuaguauuuuaggugcuguuauguuuuuucaug

SEQ ID NO: 551109 - RNA, 64 nt, Homo Sapiens
aaugacauacuuggagagcaaauuauggaaauguguauuuuauaugauuuuugagguccugucu

SEQ ID NO: 551110 - RNA, 64 nt, Homo Sapiens
gaacccagaaauagccacuauuaacauuuccuacguauuuuauuuuacauagaucauauuguau

SEQ ID NO: 551111 - RNA, 64 nt, Homo Sapiens
auuauauaauguuucccuuuuugauuauugcauuguauuuuaauuugugcagaaugauaaagaa

SEQ ID NO: 551112 - RNA, 64 nt, Homo Sapiens
uuuucaccuuaaaaguuaaaugaaaugcaugaugguauuuuauuccuugaauuaugcaaugcaa

SEQ ID NO: 551113 - RNA, 64 nt, Homo Sapiens
uauacuaugccagagaggaaauugcccaugauauguauuuuacuguagcagggggaaguauuua

SEQ ID NO: 551114 - RNA, 64 nt, Homo Sapiens
auacaguuucauacagaauuuuugcuuaacaaaaguauuuuauaguucaacacacacaugcaau

SEQ ID NO: 551115 - RNA, 64 nt, Homo Sapiens
auaaaagccaaauugaagauguucuaugcuaaauguauuuuaaauuauuuucuguccuaugaca

SEQ ID NO: 551116 - RNA, 64 nt, Homo Sapiens
uccuauuauuuuuucaacuuuaaaauuaguaucaguauuuuagauuaagguaaauuauaaaacc

SEQ ID NO: 551117 - RNA, 64 nt, Homo Sapiens
auuugggcucugaaauaaaacauuuugccugaguguauuuuacuaagaauagccuauugucuuu

SEQ ID NO: 551118 - RNA, 64 nt, Homo Sapiens
uuauuuuuuaaaugggagcaugcaagaaccaaacguauuuuauuaaaagagugagaacuaggug

SEQ ID NO: 551119 - RNA, 64 nt, Homo Sapiens
auaaucacuucguuuuuaguaaauagaaaauucaguauuuuaugucacagaauuaaaugagcuu

SEQ ID NO: 551120 - RNA, 64 nt, Homo Sapiens
cuuuacuuagauauucaaaaauguuuucgcuuuuguauuuuaaguagauaguucuuucuauauu

SEQ ID NO: 551121 - RNA, 64 nt, Homo Sapiens
uuaaugacuuuuguaugugugcucucuuuauaauguauuuuauaucacuuuaauuuguauaaau

SEQ ID NO: 551122 - RNA, 64 nt, Homo Sapiens
cauuccugaugacgucuggucuuuucuuuucauuguauuuuaagcuuaccugugaauagcccaa

SEQ ID NO: 551123 - RNA, 64 nt, Homo Sapiens
uuaaguucagugaacuuuuuaaagauguuuacaaguauuuuaauaaaauuauauuucauauugc

SEQ ID NO: 551124 - RNA, 64 nt, Homo Sapiens
cuuuuuugacuugaaaaauuuaauacagauugaaguauuuuauuguuuuaaagagaaauugcau

SEQ ID NO: 551125 - RNA, 64 nt, Homo Sapiens
auuaaaaucauguuuaagauagcugcuuuuauguguauuuuauauugcaugcuuuuguaaaaac

SEQ ID NO: 551126 - RNA, 64 nt, Homo Sapiens
uaaauguuacuacauuucugaauuuuugaaaaauguauuuuaucauuaaauggcauuauuuuaa

SEQ ID NO: 551127 - RNA, 64 nt, Homo Sapiens
aacguuugaaaggagucuuauuuuuuuauacguuguauuuuaaaucuaaaggcuucaguccaca

SEQ ID NO: 551128 - RNA, 64 nt, Homo Sapiens
gguccuugaaagauuggucggacuguguacucagguauuuuauuugucauuuuacuguauagcu

SEQ ID NO: 551129 - RNA, 64 nt, Homo Sapiens
aucuauucugcauucccaagaguuuauguuuauuguauuuuauaugaucuacaacauauaaaau

SEQ ID NO: 551130 - RNA, 64 nt, Homo Sapiens
guauuuuucuuugguugucccuauuaacaaaaaaguauuuuaauaaaaaauugaaaugagugag

SEQ ID NO: 551131 - RNA, 64 nt, Homo Sapiens
uacuguggccugauuuuuuuagaugauguuuuuuguauuuuaucguguuugaugcuuuuuaacg

SEQ ID NO: 551132 - RNA, 64 nt, Homo Sapiens
auauuucaacagcagaccuuccguuuuuccaaagguauuuuacaaaaaagcuaaucuauaaaua

SEQ ID NO: 551133 - RNA, 64 nt, Homo Sapiens
aaaauauuaaaauguuuuuuuaugcauauauguuguauuuuauucguauuuuacaguacacuaa

SEQ ID NO: 551134 - RNA, 64 nt, Homo Sapiens
guacacuaauaugcauauauuuugcaauuaauacguauuuuacauaaggauaguuaaaacuuau

SEQ ID NO: 551135 - RNA, 64 nt, Homo Sapiens
agagacaggguuucauaaugcccagcuaauuuuuguauuuuaguuacaggcacccaccaccaug

SEQ ID NO: 551136 - RNA, 64 nt, Homo Sapiens
aaaucagagugcugaguauacacugaugcuucagguauuuuacuuacaguagaaauauguaagg

SEQ ID NO: 551137 - RNA, 64 nt, Homo Sapiens
ucucuuguagguuuauuuaugugugugugaauguguauuuuaauuauguguauuuaacucuuua

SEQ ID NO: 551138 - RNA, 64 nt, Homo Sapiens
uguuccaaaaacucugaaucaucuacauuuuaagguauuuuaccucaaaaaugaaucauugugu

SEQ ID NO: 551139 - RNA, 64 nt, Homo Sapiens
ugcuucuaauauaagaugugaauaaaagcccaggguauuuuaaauuauuuucagaaaauaaaau

SEQ ID NO: 551140 - RNA, 64 nt, Homo Sapiens
uuagaaauagacuuagcuggaauuaaaguauaaaguauuuuaaguaaagguacuacaaauuaaa

SEQ ID NO: 551141 - RNA, 64 nt, Homo Sapiens
uuuaaagguguacccauauauaucucuuucuggaguauuuuaucugucugauguugcaguauuc

SEQ ID NO: 551142 - RNA, 64 nt, Homo Sapiens
gauacgucuguccaaacuuuuaaaaggcauaacuguauuuuauguguuuauucuuuauauagau

SEQ ID NO: 551143 - RNA, 64 nt, Homo Sapiens
acuguauuuuauguguuuauucuuuauauagauaguauuuuauauuuuauucucacccgaagua

SEQ ID NO: 551144 - RNA, 64 nt, Homo Sapiens
auaagcagaacuuuuacaauuuuuucaucuaaaaguauuuuaagauauuuuuaaaauccaagag

SEQ ID NO: 551145 - RNA, 64 nt, Homo Sapiens
ugaguguucaugcuuuaaaaugauuuuuaaauuuguauuuuauauuguuuuaucuaucugucuu

SEQ ID NO: 551146 - RNA, 64 nt, Homo Sapiens
acuugauguggaccucagaguuucugugcucuugguauuuuacuagauuuccuccaacccagcu

SEQ ID NO: 551147 - RNA, 63 nt, Homo Sapiens
aagaguugggaguugccaaguucuauuuucuggguauuuuaggcaaggcaaaguguugucuga

SEQ ID NO: 551148 - RNA, 64 nt, Homo Sapiens
ugggccaguuuauauacugccagugaauauuuuuguauuuuacauuuuauagaaaaccugacuu

SEQ ID NO: 551149 - RNA, 64 nt, Homo Sapiens
auuuucuuuuucuuaagaaauuguugauagugauguauuuuauucuuuagccuuccaacauuuc

SEQ ID NO: 551150 - RNA, 64 nt, Homo Sapiens
acaguagaaaacauauagucauugcuggaaaauuguauuuuauaauagugauagcccauaaaua

SEQ ID NO: 551151 - RNA, 64 nt, Homo Sapiens
uguguguguauguguacacaccuaaugauuauauguauuuuauaacuuuuuguucauuuucaaa

SEQ ID NO: 551152 - RNA, 64 nt, Homo Sapiens
ccugcagaauuuuccuuaguauuaauauucauuuguauuuuaaccucuauuucugggcugauga

SEQ ID NO: 551153 - RNA, 64 nt, Homo Sapiens; identical to SEQ ID NO: 510984

SEQ ID NO: 551154 - RNA, 64 nt, Homo Sapiens; identical to SEQ ID NO: 510985

SEQ ID NO: 551155 - RNA, 64 nt, Homo Sapiens; identical to SEQ ID NO: 510986

SEQ ID NO: 551156 - RNA, 53 nt, Homo Sapiens; identical to SEQ ID NO: 510987

SEQ ID NO: 551157 - RNA, 64 nt, Homo Sapiens; identical to SEQ ID NO: 510988

SEQ ID NO: 551158 - RNA, 64 nt, Homo Sapiens; identical to SEQ ID NO: 510989

SEQ ID NO: 551159 - RNA, 64 nt, Homo Sapiens; identical to SEQ ID NO: 510990

SEQ ID NO: 551160 - RNA, 64 nt, Homo Sapiens; identical to SEQ ID NO: 510991

SEQ ID NO: 551161 - RNA, 64 nt, Homo Sapiens; identical to SEQ ID NO: 510992

SEQ ID NO: 551162 - RNA, 64 nt, Homo Sapiens; identical to SEQ ID NO: 510993

SEQ ID NO: 551163 - RNA, 64 nt, Homo Sapiens; identical to SEQ ID NO: 510994

SEQ ID NO: 551164 - RNA, 64 nt, Homo Sapiens; identical to SEQ ID NO: 510995

SEQ ID NO: 551165 - RNA, 64 nt, Homo Sapiens; identical to SEQ ID NO: 510996

SEQ ID NO: 551166 - RNA, 64 nt, Homo Sapiens; identical to SEQ ID NO: 510997

SEQ ID NO: 551167 - RNA, 64 nt, Homo Sapiens; identical to SEQ ID NO: 510998

SEQ ID NO: 551168 - RNA, 64 nt, Homo Sapiens; identical to SEQ ID NO: 510999

SEQ ID NO: 551169 - RNA, 64 nt, Homo Sapiens; identical to SEQ ID NO: 511000

SEQ ID NO: 551170 - RNA, 64 nt, Homo Sapiens; identical to SEQ ID NO: 511001

SEQ ID NO: 551171 - RNA, 64 nt, Homo Sapiens; identical to SEQ ID NO: 511002

SEQ ID NO: 551172 - RNA, 64 nt, Homo Sapiens; identical to SEQ ID NO: 511003

SEQ ID NO: 551173 - RNA, 64 nt, Homo Sapiens; identical to SEQ ID NO: 511004

SEQ ID NO: 551174 - RNA, 64 nt, Homo Sapiens; identical to SEQ ID NO: 511005

SEQ ID NO: 551175 - RNA, 64 nt, Homo Sapiens; identical to SEQ ID NO: 511006

SEQ ID NO: 551176 - RNA, 64 nt, Homo Sapiens; identical to SEQ ID NO: 511007

SEQ ID NO: 551177 - RNA, 64 nt, Homo Sapiens; identical to SEQ ID NO: 277176

SEQ ID NO: 551178 - RNA, 64 nt, Homo Sapiens; identical to SEQ ID NO: 277177

SEQ ID NO: 551179 - RNA, 64 nt, Homo Sapiens; identical to SEQ ID NO: 277178

SEQ ID NO: 551180 - RNA, 64 nt, Homo Sapiens; identical to SEQ ID NO: 277179

SEQ ID NO: 551181 - RNA, 64 nt, Homo Sapiens; identical to SEQ ID NO: 277180

SEQ ID NO: 551182 - RNA, 64 nt, Homo Sapiens; identical to SEQ ID NO: 277181

SEQ ID NO: 551183 - RNA, 64 nt, Homo Sapiens; identical to SEQ ID NO: 277182

SEQ ID NO: 551184 - RNA, 64 nt, Homo Sapiens; identical to SEQ ID NO: 277183

SEQ ID NO: 551185 - RNA, 64 nt, Homo Sapiens; identical to SEQ ID NO: 277184

SEQ ID NO: 551186 - RNA, 64 nt, Homo Sapiens; identical to SEQ ID NO: 277185

SEQ ID NO: 551187 - RNA, 52 nt, Homo Sapiens; identical to SEQ ID NO: 277186

SEQ ID NO: 551188 - RNA, 64 nt, Homo Sapiens; identical to SEQ ID NO: 277187

SEQ ID NO: 551189 - RNA, 64 nt, Homo Sapiens; identical to SEQ ID NO: 277188

SEQ ID NO: 551190 - RNA, 64 nt, Homo Sapiens; identical to SEQ ID NO: 277189

SEQ ID NO: 551191 - RNA, 64 nt, Homo Sapiens; identical to SEQ ID NO: 277190

SEQ ID NO: 551192 - RNA, 64 nt, Homo Sapiens; identical to SEQ ID NO: 277191

SEQ ID NO: 551193 - RNA, 64 nt, Homo Sapiens; identical to SEQ ID NO: 277192

SEQ ID NO: 551194 - RNA, 64 nt, Homo Sapiens; identical to SEQ ID NO: 277193

SEQ ID NO: 551195 - RNA, 64 nt, Homo Sapiens; identical to SEQ ID NO: 277194

SEQ ID NO: 551196 - RNA, 64 nt, Homo Sapiens; identical to SEQ ID NO: 277195

SEQ ID NO: 551197 - RNA, 64 nt, Homo Sapiens; identical to SEQ ID NO: 277196

SEQ ID NO: 551198 - RNA, 64 nt, Homo Sapiens; identical to SEQ ID NO: 277197

SEQ ID NO: 551199 - RNA, 64 nt, Homo Sapiens; identical to SEQ ID NO: 277198

SEQ ID NO: 551200 - RNA, 64 nt, Homo Sapiens; identical to SEQ ID NO: 277199

SEQ ID NO: 551201 - RNA, 64 nt, Homo Sapiens; identical to SEQ ID NO: 48511

SEQ ID NO: 551202 - RNA, 64 nt, Homo Sapiens; identical to SEQ ID NO: 48512

SEQ ID NO: 551203 - RNA, 64 nt, Homo Sapiens; identical to SEQ ID NO: 48513

SEQ ID NO: 551204 - RNA, 64 nt, Homo Sapiens; identical to SEQ ID NO: 48514

SEQ ID NO: 551205 - RNA, 64 nt, Homo Sapiens; identical to SEQ ID NO: 48515

SEQ ID NO: 551206 - RNA, 64 nt, Homo Sapiens; identical to SEQ ID NO: 48516

SEQ ID NO: 551207 - RNA, 64 nt, Homo Sapiens; identical to SEQ ID NO: 48517

SEQ ID NO: 551208 - RNA, 64 nt, Homo Sapiens; identical to SEQ ID NO: 48518

SEQ ID NO: 551209 - RNA, 64 nt, Homo Sapiens; identical to SEQ ID NO: 48519

SEQ ID NO: 551210 - RNA, 64 nt, Homo Sapiens; identical to SEQ ID NO: 48520

SEQ ID NO: 551211 - RNA, 64 nt, Homo Sapiens; identical to SEQ ID NO: 48521

SEQ ID NO: 551212 - RNA, 64 nt, Homo Sapiens; identical to SEQ ID NO: 48522

SEQ ID NO: 551213 - RNA, 64 nt, Homo Sapiens; identical to SEQ ID NO: 48523

SEQ ID NO: 551214 - RNA, 64 nt, Homo Sapiens; identical to SEQ ID NO: 48524

SEQ ID NO: 551215 - RNA, 64 nt, Homo Sapiens; identical to SEQ ID NO: 48525

SEQ ID NO: 551216 - RNA, 64 nt, Homo Sapiens; identical to SEQ ID NO: 48526

SEQ ID NO: 551217 - RNA, 64 nt, Homo Sapiens; identical to SEQ ID NO: 48527

SEQ ID NO: 551218 - RNA, 64 nt, Homo Sapiens; identical to SEQ ID NO: 48528

SEQ ID NO: 551219 - RNA, 63 nt, Homo Sapiens; identical to SEQ ID NO: 68055

SEQ ID NO: 551220 - RNA, 64 nt, Homo Sapiens; identical to SEQ ID NO: 68056

SEQ ID NO: 551221 - RNA, 64 nt, Homo Sapiens; identical to SEQ ID NO: 68057

SEQ ID NO: 551222 - RNA, 64 nt, Homo Sapiens; identical to SEQ ID NO: 68058

SEQ ID NO: 551223 - RNA, 64 nt, Homo Sapiens; identical to SEQ ID NO: 68059

SEQ ID NO: 551224 - RNA, 64 nt, Homo Sapiens; identical to SEQ ID NO: 68060

SEQ ID NO: 551225 - RNA, 64 nt, Homo Sapiens; identical to SEQ ID NO: 68061

SEQ ID NO: 551226 - RNA, 64 nt, Homo Sapiens; identical to SEQ ID NO: 68062

SEQ ID NO: 551227 - RNA, 64 nt, Homo Sapiens; identical to SEQ ID NO: 68063

SEQ ID NO: 551228 - RNA, 64 nt, Homo Sapiens; identical to SEQ ID NO: 68064

SEQ ID NO: 551229 - RNA, 64 nt, Homo Sapiens; identical to SEQ ID NO: 68065

SEQ ID NO: 551230 - RNA, 64 nt, Homo Sapiens; identical to SEQ ID NO: 68066

SEQ ID NO: 551231 - RNA, 64 nt, Homo Sapiens; identical to SEQ ID NO: 68067

SEQ ID NO: 551232 - RNA, 64 nt, Homo Sapiens; identical to SEQ ID NO: 68068

SEQ ID NO: 551233 - RNA, 64 nt, Homo Sapiens; identical to SEQ ID NO: 68069

SEQ ID NO: 551234 - RNA, 64 nt, Homo Sapiens; identical to SEQ ID NO: 68070

SEQ ID NO: 551235 - RNA, 64 nt, Homo Sapiens; identical to SEQ ID NO: 68071

SEQ ID NO: 551236 - RNA, 64 nt, Homo Sapiens; identical to SEQ ID NO: 68072

SEQ ID NO: 551237 - RNA, 64 nt, Homo Sapiens; identical to SEQ ID NO: 68073

SEQ ID NO: 551238 - RNA, 64 nt, Homo Sapiens; identical to SEQ ID NO: 68074

SEQ ID NO: 551239 - RNA, 64 nt, Homo Sapiens; identical to SEQ ID NO: 68075

SEQ ID NO: 551240 - RNA, 64 nt, Homo Sapiens; identical to SEQ ID NO: 68076

SEQ ID NO: 551241 - RNA, 64 nt, Homo Sapiens; identical to SEQ ID NO: 68077

SEQ ID NO: 551242 - RNA, 64 nt, Homo Sapiens; identical to SEQ ID NO: 68078

SEQ ID NO: 551243 - RNA, 64 nt, Homo Sapiens; identical to SEQ ID NO: 68079

SEQ ID NO: 551244 - RNA, 64 nt, Homo Sapiens; identical to SEQ ID NO: 68080

SEQ ID NO: 551245 - RNA, 64 nt, Homo Sapiens; identical to SEQ ID NO: 68081

SEQ ID NO: 551246 - RNA, 64 nt, Homo Sapiens; identical to SEQ ID NO: 68082

SEQ ID NO: 551247 - RNA, 64 nt, Homo Sapiens; identical to SEQ ID NO: 68083

SEQ ID NO: 551248 - RNA, 64 nt, Homo Sapiens; identical to SEQ ID NO: 68084

SEQ ID NO: 551249 - RNA, 64 nt, Homo Sapiens; identical to SEQ ID NO: 68085

SEQ ID NO: 551250 - RNA, 64 nt, Homo Sapiens; identical to SEQ ID NO: 68086

SEQ ID NO: 551251 - RNA, 64 nt, Homo Sapiens; identical to SEQ ID NO: 68087

SEQ ID NO: 551252 - RNA, 64 nt, Homo Sapiens; identical to SEQ ID NO: 68088

SEQ ID NO: 551253 - RNA, 64 nt, Homo Sapiens; identical to SEQ ID NO: 68089

SEQ ID NO: 551254 - RNA, 64 nt, Homo Sapiens; identical to SEQ ID NO: 68090

SEQ ID NO: 551255 - RNA, 64 nt, Homo Sapiens; identical to SEQ ID NO: 68091

SEQ ID NO: 551256 - RNA, 64 nt, Homo Sapiens; identical to SEQ ID NO: 68092

SEQ ID NO: 551257 - RNA, 64 nt, Homo Sapiens; identical to SEQ ID NO: 68093

SEQ ID NO: 551258 - RNA, 64 nt, Homo Sapiens; identical to SEQ ID NO: 68094

SEQ ID NO: 551259 - RNA, 64 nt, Homo Sapiens; identical to SEQ ID NO: 68095

SEQ ID NO: 551260 - RNA, 64 nt, Homo Sapiens; identical to SEQ ID NO: 68096

SEQ ID NO: 551261 - RNA, 64 nt, Homo Sapiens; identical to SEQ ID NO: 68097

SEQ ID NO: 551262 - RNA, 64 nt, Homo Sapiens; identical to SEQ ID NO: 68098

SEQ ID NO: 551263 - RNA, 64 nt, Homo Sapiens; identical to SEQ ID NO: 68099

SEQ ID NO: 551264 - RNA, 64 nt, Homo Sapiens; identical to SEQ ID NO: 68100

SEQ ID NO: 551265 - RNA, 64 nt, Homo Sapiens; identical to SEQ ID NO: 68101

SEQ ID NO: 551266 - RNA, 64 nt, Homo Sapiens; identical to SEQ ID NO: 68102

SEQ ID NO: 551267 - RNA, 64 nt, Homo Sapiens; identical to SEQ ID NO: 68103

SEQ ID NO: 551268 - RNA, 64 nt, Homo Sapiens; identical to SEQ ID NO: 68104

SEQ ID NO: 551269 - RNA, 64 nt, Homo Sapiens; identical to SEQ ID NO: 68105

SEQ ID NO: 551270 - RNA, 64 nt, Homo Sapiens; identical to SEQ ID NO: 68106

SEQ ID NO: 551271 - RNA, 64 nt, Homo Sapiens; identical to SEQ ID NO: 68107

SEQ ID NO: 551272 - RNA, 64 nt, Homo Sapiens; identical to SEQ ID NO: 68108

SEQ ID NO: 551273 - RNA, 64 nt, Homo Sapiens; identical to SEQ ID NO: 68109

SEQ ID NO: 551274 - RNA, 64 nt, Homo Sapiens; identical to SEQ ID NO: 68110

SEQ ID NO: 551275 - RNA, 64 nt, Homo Sapiens; identical to SEQ ID NO: 68111

SEQ ID NO: 551276 - RNA, 64 nt, Homo Sapiens; identical to SEQ ID NO: 68112

SEQ ID NO: 551277 - RNA, 64 nt, Homo Sapiens; identical to SEQ ID NO: 68113

SEQ ID NO: 551278 - RNA, 64 nt, Homo Sapiens; identical to SEQ ID NO: 68114

SEQ ID NO: 551279 - RNA, 64 nt, Homo Sapiens; identical to SEQ ID NO: 68115

SEQ ID NO: 551280 - RNA, 64 nt, Homo Sapiens; identical to SEQ ID NO: 68116

SEQ ID NO: 551281 - RNA, 64 nt, Homo Sapiens; identical to SEQ ID NO: 68117

SEQ ID NO: 551282 - RNA, 64 nt, Homo Sapiens; identical to SEQ ID NO: 68118

SEQ ID NO: 551283 - RNA, 64 nt, Homo Sapiens; identical to SEQ ID NO: 68119

SEQ ID NO: 551284 - RNA, 64 nt, Homo Sapiens; identical to SEQ ID NO: 68120

SEQ ID NO: 551285 - RNA, 64 nt, Homo Sapiens; identical to SEQ ID NO: 68121

SEQ ID NO: 551286 - RNA, 64 nt, Homo Sapiens; identical to SEQ ID NO: 68122

SEQ ID NO: 551287 - RNA, 64 nt, Homo Sapiens; identical to SEQ ID NO: 68123

SEQ ID NO: 551288 - RNA, 64 nt, Homo Sapiens; identical to SEQ ID NO: 68124

SEQ ID NO: 551289 - RNA, 64 nt, Homo Sapiens; identical to SEQ ID NO: 68125

SEQ ID NO: 551290 - RNA, 64 nt, Homo Sapiens; identical to SEQ ID NO: 68126

SEQ ID NO: 551291 - RNA, 64 nt, Homo Sapiens; identical to SEQ ID NO: 68127

SEQ ID NO: 551292 - RNA, 64 nt, Homo Sapiens; identical to SEQ ID NO: 68128

SEQ ID NO: 551293 - RNA, 64 nt, Homo Sapiens; identical to SEQ ID NO: 68129

SEQ ID NO: 551294 - RNA, 64 nt, Homo Sapiens; identical to SEQ ID NO: 68130

SEQ ID NO: 551295 - RNA, 64 nt, Homo Sapiens; identical to SEQ ID NO: 68131

SEQ ID NO: 551296 - RNA, 64 nt, Homo Sapiens; identical to SEQ ID NO: 68132

SEQ ID NO: 551297 - RNA, 64 nt, Homo Sapiens; identical to SEQ ID NO: 68133

SEQ ID NO: 551298 - RNA, 64 nt, Homo Sapiens; identical to SEQ ID NO: 68134

SEQ ID NO: 551299 - RNA, 64 nt, Homo Sapiens; identical to SEQ ID NO: 68135

SEQ ID NO: 551300 - RNA, 64 nt, Homo Sapiens; identical to SEQ ID NO: 68136

SEQ ID NO: 551301 - RNA, 64 nt, Homo Sapiens; identical to SEQ ID NO: 68137

SEQ ID NO: 551302 - RNA, 64 nt, Homo Sapiens; identical to SEQ ID NO: 68138

SEQ ID NO: 551303 - RNA, 64 nt, Homo Sapiens; identical to SEQ ID NO: 68139

SEQ ID NO: 551304 - RNA, 64 nt, Homo Sapiens; identical to SEQ ID NO: 68140

SEQ ID NO: 551305 - RNA, 64 nt, Homo Sapiens; identical to SEQ ID NO: 68141

SEQ ID NO: 551306 - RNA, 64 nt, Homo Sapiens; identical to SEQ ID NO: 68142

SEQ ID NO: 551307 - RNA, 64 nt, Homo Sapiens; identical to SEQ ID NO: 68143

SEQ ID NO: 551308 - RNA, 64 nt, Homo Sapiens; identical to SEQ ID NO: 68144

SEQ ID NO: 551309 - RNA, 64 nt, Homo Sapiens; identical to SEQ ID NO: 68145

SEQ ID NO: 551310 - RNA, 64 nt, Homo Sapiens; identical to SEQ ID NO: 68146

SEQ ID NO: 551311 - RNA, 64 nt, Homo Sapiens; identical to SEQ ID NO: 68147

SEQ ID NO: 551312 - RNA, 64 nt, Homo Sapiens; identical to SEQ ID NO: 68148

SEQ ID NO: 551313 - RNA, 64 nt, Homo Sapiens; identical to SEQ ID NO: 68149

SEQ ID NO: 551314 - RNA, 64 nt, Homo Sapiens; identical to SEQ ID NO: 68150

SEQ ID NO: 551315 - RNA, 62 nt, Homo Sapiens; identical to SEQ ID NO: 68151

SEQ ID NO: 551316 - RNA, 64 nt, Homo Sapiens; identical to SEQ ID NO: 68152

SEQ ID NO: 551317 - RNA, 64 nt, Homo Sapiens; identical to SEQ ID NO: 68153

SEQ ID NO: 551318 - RNA, 64 nt, Homo Sapiens; identical to SEQ ID NO: 68154

SEQ ID NO: 551319 - RNA, 64 nt, Homo Sapiens; identical to SEQ ID NO: 68155

SEQ ID NO: 551320 - RNA, 64 nt, Homo Sapiens; identical to SEQ ID NO: 68156

SEQ ID NO: 551321 - RNA, 64 nt, Homo Sapiens; identical to SEQ ID NO: 68157

SEQ ID NO: 551322 - RNA, 64 nt, Homo Sapiens; identical to SEQ ID NO: 68158

SEQ ID NO: 551323 - RNA, 64 nt, Homo Sapiens; identical to SEQ ID NO: 68159

SEQ ID NO: 551324 - RNA, 64 nt, Homo Sapiens; identical to SEQ ID NO: 68160

SEQ ID NO: 551325 - RNA, 64 nt, Homo Sapiens; identical to SEQ ID NO: 68161

SEQ ID NO: 551326 - RNA, 64 nt, Homo Sapiens; identical to SEQ ID NO: 68162

SEQ ID NO: 551327 - RNA, 64 nt, Homo Sapiens; identical to SEQ ID NO: 68163

SEQ ID NO: 551328 - RNA, 64 nt, Homo Sapiens; identical to SEQ ID NO: 68164

SEQ ID NO: 551329 - RNA, 64 nt, Homo Sapiens; identical to SEQ ID NO: 68165

SEQ ID NO: 551330 - RNA, 64 nt, Homo Sapiens; identical to SEQ ID NO: 68166

SEQ ID NO: 551331 - RNA, 64 nt, Homo Sapiens; identical to SEQ ID NO: 68167

SEQ ID NO: 551332 - RNA, 64 nt, Homo Sapiens; identical to SEQ ID NO: 68168

SEQ ID NO: 551333 - RNA, 64 nt, Homo Sapiens; identical to SEQ ID NO: 68169

SEQ ID NO: 551334 - RNA, 64 nt, Homo Sapiens; identical to SEQ ID NO: 68170

SEQ ID NO: 551335 - RNA, 64 nt, Homo Sapiens; identical to SEQ ID NO: 68171

SEQ ID NO: 551336 - RNA, 64 nt, Homo Sapiens; identical to SEQ ID NO: 68172

SEQ ID NO: 551337 - RNA, 64 nt, Homo Sapiens; identical to SEQ ID NO: 68173

SEQ ID NO: 551338 - RNA, 64 nt, Homo Sapiens; identical to SEQ ID NO: 68174

SEQ ID NO: 551339 - RNA, 64 nt, Homo Sapiens; identical to SEQ ID NO: 68175

SEQ ID NO: 551340 - RNA, 64 nt, Homo Sapiens; identical to SEQ ID NO: 68176

SEQ ID NO: 551341 - RNA, 64 nt, Homo Sapiens; identical to SEQ ID NO: 68177

SEQ ID NO: 551342 - RNA, 64 nt, Homo Sapiens; identical to SEQ ID NO: 68178

SEQ ID NO: 551343 - RNA, 64 nt, Homo Sapiens; identical to SEQ ID NO: 68179

SEQ ID NO: 551344 - RNA, 64 nt, Homo Sapiens; identical to SEQ ID NO: 68180

SEQ ID NO: 551345 - RNA, 64 nt, Homo Sapiens; identical to SEQ ID NO: 68181

SEQ ID NO: 551346 - RNA, 64 nt, Homo Sapiens; identical to SEQ ID NO: 68182

SEQ ID NO: 551347 - RNA, 64 nt, Homo Sapiens; identical to SEQ ID NO: 68183

SEQ ID NO: 551348 - RNA, 64 nt, Homo Sapiens; identical to SEQ ID NO: 68184

SEQ ID NO: 551349 - RNA, 64 nt, Homo Sapiens; identical to SEQ ID NO: 68185

SEQ ID NO: 551350 - RNA, 64 nt, Homo Sapiens; identical to SEQ ID NO: 68186

SEQ ID NO: 551351 - RNA, 64 nt, Homo Sapiens; identical to SEQ ID NO: 68187

SEQ ID NO: 551352 - RNA, 64 nt, Homo Sapiens; identical to SEQ ID NO: 68188

SEQ ID NO: 551353 - RNA, 64 nt, Homo Sapiens; identical to SEQ ID NO: 68189

SEQ ID NO: 551354 - RNA, 64 nt, Homo Sapiens; identical to SEQ ID NO: 68190

SEQ ID NO: 551355 - RNA, 64 nt, Homo Sapiens; identical to SEQ ID NO: 68191

SEQ ID NO: 551356 - RNA, 64 nt, Homo Sapiens; identical to SEQ ID NO: 68192

SEQ ID NO: 551357 - RNA, 64 nt, Homo Sapiens; identical to SEQ ID NO: 68193

SEQ ID NO: 551358 - RNA, 64 nt, Homo Sapiens; identical to SEQ ID NO: 68194

SEQ ID NO: 551359 - RNA, 64 nt, Homo Sapiens; identical to SEQ ID NO: 68195

SEQ ID NO: 551360 - RNA, 64 nt, Homo Sapiens; identical to SEQ ID NO: 68196

SEQ ID NO: 551361 - RNA, 64 nt, Homo Sapiens; identical to SEQ ID NO: 68197

SEQ ID NO: 551362 - RNA, 64 nt, Homo Sapiens; identical to SEQ ID NO: 68198

SEQ ID NO: 551363 - RNA, 64 nt, Homo Sapiens; identical to SEQ ID NO: 68199

SEQ ID NO: 551364 - RNA, 64 nt, Homo Sapiens; identical to SEQ ID NO: 68200

SEQ ID NO: 551365 - RNA, 64 nt, Homo Sapiens; identical to SEQ ID NO: 68201

SEQ ID NO: 551366 - RNA, 64 nt, Homo Sapiens; identical to SEQ ID NO: 68202

SEQ ID NO: 551367 - RNA, 64 nt, Homo Sapiens; identical to SEQ ID NO: 68203

SEQ ID NO: 551368 - RNA, 64 nt, Homo Sapiens; identical to SEQ ID NO: 68204

SEQ ID NO: 551369 - RNA, 64 nt, Homo Sapiens; identical to SEQ ID NO: 68205

SEQ ID NO: 551370 - RNA, 64 nt, Homo Sapiens; identical to SEQ ID NO: 68206

SEQ ID NO: 551371 - RNA, 64 nt, Homo Sapiens; identical to SEQ ID NO: 68207

SEQ ID NO: 551372 - RNA, 64 nt, Homo Sapiens; identical to SEQ ID NO: 68208

SEQ ID NO: 551373 - RNA, 64 nt, Homo Sapiens; identical to SEQ ID NO: 68209

SEQ ID NO: 551374 - RNA, 64 nt, Homo Sapiens; identical to SEQ ID NO: 68210

SEQ ID NO: 551375 - RNA, 64 nt, Homo Sapiens; identical to SEQ ID NO: 68211

SEQ ID NO: 551376 - RNA, 64 nt, Homo Sapiens; identical to SEQ ID NO: 68212

SEQ ID NO: 551377 - RNA, 64 nt, Homo Sapiens; identical to SEQ ID NO: 68213

SEQ ID NO: 551378 - RNA, 64 nt, Homo Sapiens; identical to SEQ ID NO: 68214

SEQ ID NO: 551379 - RNA, 64 nt, Homo Sapiens; identical to SEQ ID NO: 68215

SEQ ID NO: 551380 - RNA, 64 nt, Homo Sapiens; identical to SEQ ID NO: 68216

SEQ ID NO: 551381 - RNA, 64 nt, Homo Sapiens; identical to SEQ ID NO: 68217

SEQ ID NO: 551382 - RNA, 64 nt, Homo Sapiens; identical to SEQ ID NO: 68218

SEQ ID NO: 551383 - RNA, 64 nt, Homo Sapiens; identical to SEQ ID NO: 68219

SEQ ID NO: 551384 - RNA, 64 nt, Homo Sapiens; identical to SEQ ID NO: 68220

SEQ ID NO: 551385 - RNA, 64 nt, Homo Sapiens; identical to SEQ ID NO: 68221

SEQ ID NO: 551386 - RNA, 64 nt, Homo Sapiens; identical to SEQ ID NO: 68222

SEQ ID NO: 551387 - RNA, 64 nt, Homo Sapiens; identical to SEQ ID NO: 68223

SEQ ID NO: 551388 - RNA, 64 nt, Homo Sapiens; identical to SEQ ID NO: 68224

SEQ ID NO: 551389 - RNA, 64 nt, Homo Sapiens; identical to SEQ ID NO: 68225

SEQ ID NO: 551390 - RNA, 64 nt, Homo Sapiens; identical to SEQ ID NO: 68226

SEQ ID NO: 551391 - RNA, 64 nt, Homo Sapiens; identical to SEQ ID NO: 68227

SEQ ID NO: 551392 - RNA, 64 nt, Homo Sapiens; identical to SEQ ID NO: 68228

SEQ ID NO: 551393 - RNA, 64 nt, Homo Sapiens; identical to SEQ ID NO: 68229

SEQ ID NO: 551394 - RNA, 64 nt, Homo Sapiens; identical to SEQ ID NO: 68230

SEQ ID NO: 551395 - RNA, 64 nt, Homo Sapiens; identical to SEQ ID NO: 338191

SEQ ID NO: 551396 - RNA, 64 nt, Homo Sapiens; identical to SEQ ID NO: 338192

SEQ ID NO: 551397 - RNA, 64 nt, Homo Sapiens; identical to SEQ ID NO: 338193

SEQ ID NO: 551398 - RNA, 64 nt, Homo Sapiens; identical to SEQ ID NO: 338194

SEQ ID NO: 551399 - RNA, 64 nt, Homo Sapiens; identical to SEQ ID NO: 338195

SEQ ID NO: 551400 - RNA, 64 nt, Homo Sapiens; identical to SEQ ID NO: 338196

SEQ ID NO: 551401 - RNA, 64 nt, Homo Sapiens; identical to SEQ ID NO: 338197

SEQ ID NO: 551402 - RNA, 64 nt, Homo Sapiens; identical to SEQ ID NO: 338198

SEQ ID NO: 551403 - RNA, 64 nt, Homo Sapiens; identical to SEQ ID NO: 338199

SEQ ID NO: 551404 - RNA, 64 nt, Homo Sapiens; identical to SEQ ID NO: 338200

SEQ ID NO: 551405 - RNA, 64 nt, Homo Sapiens; identical to SEQ ID NO: 321937

SEQ ID NO: 551406 - RNA, 64 nt, Homo Sapiens; identical to SEQ ID NO: 321938

SEQ ID NO: 551407 - RNA, 64 nt, Homo Sapiens; identical to SEQ ID NO: 321939

SEQ ID NO: 551408 - RNA, 64 nt, Homo Sapiens; identical to SEQ ID NO: 321940

SEQ ID NO: 551409 - RNA, 64 nt, Homo Sapiens
aaaugaacaggagacacagagugggacaggauuaacuucagaaucacugaugguuauaaugacu

SEQ ID NO: 551410 - RNA, 64 nt, Homo Sapiens
uuaagucaccaauagugaucagugaauaaucuggacuucagagauguaacuagcauguuacaag

SEQ ID NO: 551411 - RNA, 64 nt, Homo Sapiens
ggcuguucugaaauuccuaaccccaggagaagauacuucagaagccaaaaggaaaaaugaagug

SEQ ID NO: 551412 - RNA, 64 nt, Homo Sapiens
auuucugcagagcccugcccuauucuuauuuaauacuucagaaagaaauuugaaagauaagauu

SEQ ID NO: 551413 - RNA, 64 nt, Homo Sapiens
gugcauuauacuaagaauuacaugccauaagaugacuucagaaauccuacuucagaaguguaau

SEQ ID NO: 551414 - RNA, 64 nt, Homo Sapiens
gaauuacaugccauaagaugacuucagaaauccuacuucagaaguguaauaaauggauggggaa

SEQ ID NO: 551415 - RNA, 64 nt, Homo Sapiens
ugaggaccauuguguggauccauggugauucuagacuucagauauauuuaggaaggcgcagauu

SEQ ID NO: 551416 - RNA, 64 nt, Homo Sapiens
ccuuggccacaucccuauuaacagaggcagcuccacuucagacagggacaaggcuuccugcugu

SEQ ID NO: 551417 - RNA, 64 nt, Homo Sapiens
agagggacagucccauguguggcagcauugucccacuucagaugccaggagugggcucauccua

SEQ ID NO: 551418 - RNA, 64 nt, Homo Sapiens
ucauacauggaaccauuuuagucccauuugacucacuucagaccaucuuccacacacuaugucu

SEQ ID NO: 551419 - RNA, 64 nt, Homo Sapiens
gaaaccaauaccagcuuccuaaaaguuagaucugacuucagacaucugaaacuauugucuucgu

SEQ ID NO: 551420 - RNA, 64 nt, Homo Sapiens
aaagcuacccaaggacuuagggacuucaguuuuuacuucagacucauaaaaagcacaauugcua

SEQ ID NO: 551421 - RNA, 64 nt, Homo Sapiens
ugaucucgaacuccugaccucaagugaucugcccacuucagacccccaaagugcugggauucca

SEQ ID NO: 551422 - RNA, 64 nt, Homo Sapiens
uccccuccuuccuauuagcuacaaaacuggauaaacuucagaauaugagccaaugaguaggaag

SEQ ID NO: 551423 - RNA, 64 nt, Homo Sapiens
auuuggaaaauacagaaaauaugcaaucauagugacuucagaaauaguuuuaaccauuguuaaa

SEQ ID NO: 551424 - RNA, 64 nt, Homo Sapiens
cacugaguuaagaaaguuuucauguguaguugucacuucagauuuauauugcuuuaccaaaaua

SEQ ID NO: 551425 - RNA, 64 nt, Homo Sapiens
augcucaccccuuauugcacaggaaagcauuuauacuucagaaagauuguacaaauacaaggaa

SEQ ID NO: 551426 - RNA, 64 nt, Homo Sapiens
gagaauucacaguagaaauaucuaagguacugacacuucagacauugcugaguauagaaucaga

SEQ ID NO: 551427 - RNA, 64 nt, Homo Sapiens
uaagucauggagaggacauuaacauuggcucgaaacuucagagauguaaauaguguacauuuua

SEQ ID NO: 551428 - RNA, 64 nt, Homo Sapiens
ggucccccugcugacuggagcagcacaugacaacacuucagaagcuuguucaaguucugaaucc

SEQ ID NO: 551429 - RNA, 64 nt, Homo Sapiens
caaaaguuagacugagaacaaacguuagaaaaucacuucagauuguguuugaaaauuauauacu

SEQ ID NO: 551430 - RNA, 64 nt, Homo Sapiens
ugugagcauugagcccccauuaaaacucuuuuuuacuucagaaagaauuuuacagguuaaaggg

SEQ ID NO: 551431 - RNA, 64 nt, Homo Sapiens
gucauuugaguaagucucugcaggacguggcaugacuucagaggcuucugggaacccaggcugg

SEQ ID NO: 551432 - RNA, 64 nt, Homo Sapiens
gcauuuucuuggguguugagaacuuguaccauggacuucagaccgccuugcagccguaugcugc

SEQ ID NO: 551433 - RNA, 64 nt, Homo Sapiens
cccaaagaagccagcuacagcaaagacaggaccaacuucagauuaugugcuuuuggccaugucu

SEQ ID NO: 551434 - RNA, 64 nt, Homo Sapiens
aagcuuacauuacuguuuucgugacuaaaccguuacuucagaugucgacaaccaaauuugucau

SEQ ID NO: 551435 - RNA, 64 nt, Homo Sapiens
accaagcuaguuauuaauccaagacuggaauuguacuucagacauuuagagcagaauuccaaga

SEQ ID NO: 551436 - RNA, 64 nt, Homo Sapiens
uuacuagcgucauggagcuaccucugcgcaucagacuucagaccuugaacaaacuuaaaaccuu

SEQ ID NO: 551437 - RNA, 64 nt, Homo Sapiens
aguuagguacggucugaaguuaugucuagauaagacuucagacguccugggauugaaagaaugu

SEQ ID NO: 551438 - RNA, 64 nt, Homo Sapiens
ggccuggauaugguuucuaaaaucucagcugagaacuucagaaaacagcagcaguauuuuccuu

SEQ ID NO: 551439 - RNA, 64 nt, Homo Sapiens
gaacauucaacucaggaagcauuugacucguuguacuucagagaccauaaaugacaagguuuug

SEQ ID NO: 551440 - RNA, 64 nt, Homo Sapiens
gaguauuacuuuuccuacaacagaaccuggugaaacuucagagagcugucuagaacucgagaau

SEQ ID NO: 551441 - RNA, 64 nt, Homo Sapiens
acaaauuucuuacauugugaaauuuaaacuguauacuucagauucgucuguuuuauuaccaagu

SEQ ID NO: 551442 - RNA, 64 nt, Homo Sapiens
uauaagaaaugugggaaacacacauugcagagaaacuucagaaauuaucuaacaucaccaaauu

SEQ ID NO: 551443 - RNA, 64 nt, Homo Sapiens
cuacuccaggacucucacaaagcugaugagcuguacuucagaaaaaaauaauaauuuccauguu

SEQ ID NO: 551444 - RNA, 64 nt, Homo Sapiens
aaagguaauggauugcacauagacuaaggaauaaacuucagauuugugauuuuuguuucuaauc

SEQ ID NO: 551445 - RNA, 64 nt, Homo Sapiens
ugugauuuuuguuucuaaacagacaaagaaauaaacuucagauuaaagauaauggauugcacau

SEQ ID NO: 551446 - RNA, 64 nt, Homo Sapiens
aauaauauuaaucauauguugcugauccagcuguacuucagaaaucugcuucaggacuuaacau

SEQ ID NO: 551447 - RNA, 62 nt, Homo Sapiens
agaaucucguuaguagcauguggccuaacaaaaggaaaaaauguuuuuaaacacacacacac

SEQ ID NO: 551448 - RNA, 62 nt, Homo Sapiens
ggaggagacaucuggccuuuuuagaaccugagaggaaaaaaagagucuuuuuuuccccucug

SEQ ID NO: 551449 - RNA, 62 nt, Homo Sapiens
ugcacuuucugguaaaaaguuaaaaauuuuuaaggaaaaaauaauuucaaugguuaaaguuu

SEQ ID NO: 551450 - RNA, 62 nt, Homo Sapiens
uuuacauuuaaagaucauuugcaccuuuuucaaggaaaaaaaguauugaguaaacaauuguu

SEQ ID NO: 551451 - RNA, 62 nt, Homo Sapiens
aguggcuuucuacuuucaaaaaugaaacaaaaaggaaaaauggcaaaguacuguuuuagcug

SEQ ID NO: 551452 - RNA, 62 nt, Homo Sapiens
uagaaaauguuaaaaauaccaacucacuuggaaggaaaaauaaaaaucacaaagguauauug

SEQ ID NO: 551453 - RNA, 62 nt, Homo Sapiens
aauauuguauauuaaggggaucagaaguaggaaggaaaaaauaagagauagcagaggaaaaa

SEQ ID NO: 551454 - RNA, 62 nt, Homo Sapiens
agaaguaggaaggaaaaaauaagagauagcagaggaaaaagaaaaacauuuccucuuauaac

SEQ ID NO: 551455 - RNA, 62 nt, Homo Sapiens
aaaaaguaaaacaaagacaacaccaucccaugaggaaaaaaacaucuacgccauauacccau

SEQ ID NO: 551456 - RNA, 62 nt, Homo Sapiens
ucuuuggaaauagauugaaauaccccaagggcaggaaaaaagugcacagcggcagcaaggau

SEQ ID NO: 551457 - RNA, 62 nt, Homo Sapiens
aaaaaggaaaaccagaagccaaaaaaggaaaaaggaaaaaaagcuuucuucuuaaaaaaaaa

SEQ ID NO: 551458 - RNA, 62 nt, Homo Sapiens
aaaaaaaaaaaaggaaaaccaaaaaaaaaaaaaggaaaaaggccucuaugcuuucuucuuaa

SEQ ID NO: 551459 - RNA, 62 nt, Homo Sapiens
ccaaaacuuuauaccaaugacuuuaaacuaucaggaaaaaaauguuuuuguacuuuacuaau

SEQ ID NO: 551460 - RNA, 62 nt, Homo Sapiens
aaauuaaaaaaaaaaugcaauggaauacggugaggaaaaaaacuuccccagccacagguaug

SEQ ID NO: 551461 - RNA, 62 nt, Homo Sapiens
uaaaacauguuuaauuuuauuauguucuugugaggaaaaaaguaagucccuuccguaauuuu

SEQ ID NO: 551462 - RNA, 62 nt, Homo Sapiens
guguuaccuuuuuuaaauucaggacuacuaaaaggaaaaauuuauucuaucauaacuaccca

SEQ ID NO: 551463 - RNA, 62 nt, Homo Sapiens
aagaugggguaagaaaacuacguuaauuauugaggaaaaaaauucaaacaaugguuucucug

SEQ ID NO: 551464 - RNA, 62 nt, Homo Sapiens
gaaaccgaagccaguauuuuaggaaauuugaaaggaaaaaaacaaauauguaaagcaauugu

SEQ ID NO: 551465 - RNA, 62 nt, Homo Sapiens
caaguaaggaugugagaauuuacaguuaacauaggaaaaauacguguuuacuuguauuaacu

SEQ ID NO: 551466 - RNA, 62 nt, Homo Sapiens
uccgaaacuuucuuuuguuguuugcaaaaacaaggaaaaaaauccugcaauuccagcugcca

SEQ ID NO: 551467 - RNA, 62 nt, Homo Sapiens
agucgaaaauaaagguugauuauaauggaaauaggaaaaauucaaaagaugguauagccgaa

SEQ ID NO: 551468 - RNA, 62 nt, Homo Sapiens
aagugccccaggagaagauaacuuagaccaaaaggaaaaaugaaaauagcuuccaauaagua

SEQ ID NO: 551469 - RNA, 62 nt, Homo Sapiens
uuagauuucacucagcauuuaguagguccaguaggaaaaacccaaaaugguacauugaguag

SEQ ID NO: 551470 - RNA, 62 nt, Homo Sapiens
caugaaaagagucuuagaaguaaagaacaacaaggaaaaaaauguuuguucuauuauucccu

SEQ ID NO: 551471 - RNA, 62 nt, Homo Sapiens
aaaaaaaaccaauguuuugcaaagaaaaaaaaaggaaaaaaaucauaugcaguaaaagaaag

SEQ ID NO: 551472 - RNA, 62 nt, Homo Sapiens
gucuuuggauuaacccucuauauaacgugaggaggaaaaacauaucauguacaguuuuauuu

SEQ ID NO: 551473 - RNA, 62 nt, Homo Sapiens
aucuguuauuccagucuuaauuacagcauugcaggaaaaacaugcugauaaauuugcaguaa

SEQ ID NO: 551474 - RNA, 62 nt, Homo Sapiens
gcauugcuguuuaccucuuuuauucaagcuuaaggaaaaauuuucuuuauuguucccuuaug

SEQ ID NO: 551475 - RNA, 62 nt, Homo Sapiens
caaggaugaagucuuuccgaaauuaaaagagaaggaaaaacaaagcugaccucguugcaugg

SEQ ID NO: 551476 - RNA, 62 nt, Homo Sapiens
acuuugcucugcccuuuuauaauauucaccuuaggaaaaaagaaaugaauacuuaccuuaga

SEQ ID NO: 551477 - RNA, 62 nt, Homo Sapiens
cuaguuuauaaugucuuacuaaugcagaaacaaggaaaaaagcaaaauuggccugaauauuc

SEQ ID NO: 551478 - RNA, 62 nt, Homo Sapiens
uuaguugauucacaguacagaacaagguauaaaggaaaaaacccugcuagguaguguuauaa

SEQ ID NO: 551479 - RNA, 62 nt, Homo Sapiens
uucauuuuaagauuuacuuggaagagcaaagaaggaaaaauuauauuuuuaaagaaagagaa

SEQ ID NO: 551480 - RNA, 62 nt, Homo Sapiens
gucccccaaccccagccgcucggaggccccaaaggaaaaagcacaagaagcgugagacgcca

SEQ ID NO: 551481 - RNA, 62 nt, Homo Sapiens
auucucguagcuuuuuaaaaaaaugaaaguaaaggaaaaaaaaaaaacugcaaaucuagaaa

SEQ ID NO: 551482 - RNA, 62 nt, Homo Sapiens
ucguuuuucuuuuguuugcauuuucugcaaaaaggaaaaagaaaccacaaauuggggaaaaa

SEQ ID NO: 551483 - RNA, 62 nt, Homo Sapiens
ggaagagaggagagggagaaaaauaaaaugaaaggaaaaaaaaaaguuugcaaauucagaca

SEQ ID NO: 551484 - RNA, 62 nt, Homo Sapiens
auggagaaaacccgguacgcucaaaaagaaaaaggaaaaaaaaaaaucccaucacccacagc

SEQ ID NO: 551485 - RNA, 62 nt, Homo Sapiens
uggacauuuuaauuguuuaaaaauuguacaaaaggaaaaaauuagaauaaguacuggcgaac

SEQ ID NO: 551486 - RNA, 62 nt, Homo Sapiens
gugaaauccaccuuccucuuacaaccuauuugaggaaaaacaucagcacugcaccagagcag

SEQ ID NO: 551487 - RNA, 62 nt, Homo Sapiens
guauaucacaugucucauucgucauauucucaaggaaaaaaguacaauggaaggacaagaau

SEQ ID NO: 551488 - RNA, 62 nt, Homo Sapiens
aaacaggaccuagguguuuguccugucucaaaaggaaaaagagcuugggcaacagagcaaga

SEQ ID NO: 551489 - RNA, 62 nt, Homo Sapiens
ugcauuuaaccaugccaccuuauacaacuacaaggaaaaaaaauaaauggaaccagagguua

SEQ ID NO: 551490 - RNA, 62 nt, Homo Sapiens
auuaaauuuugaauugaguguguuauuuaaggaggaaaaaaugcugccucaugacaaguaca

SEQ ID NO: 551491 - RNA, 62 nt, Homo Sapiens
aguauuuuugagaauaacauauuugauuuuauaggaaaaaauuaaaaguguggccacugagc

SEQ ID NO: 551492 - RNA, 62 nt, Homo Sapiens
aauuuuuuuaaaaauacuuaaagaaaagcuagaggaaaaaaauauuagaggaagaaaauuua

SEQ ID NO: 551493 - RNA, 62 nt, Homo Sapiens
gcauaaaaagauaccuggucuuuucuuaguaaaggaaaaacauugucuucaagaugcaauac

SEQ ID NO: 551494 - RNA, 62 nt, Homo Sapiens
ugaagaaacugccgcucugagacugcacauccaggaaaaaagacuaggacuugccacacacu

SEQ ID NO: 551495 - RNA, 62 nt, Homo Sapiens
ggccuauuaucuggaugucccuugccuagagcaggaaaaaagucucagaauuaccuaaaaac

SEQ ID NO: 551496 - RNA, 62 nt, Homo Sapiens
uuugccucuuccuuccuauuucccuuccgcuaaggaaaaaaauuggugucacauuuguaaaa

SEQ ID NO: 551497 - RNA, 62 nt, Homo Sapiens
uggucauguguauguuaaaauagaaaauuuugaggaaaaauggaaauaggguggaaaaguac

SEQ ID NO: 551498 - RNA, 62 nt, Homo Sapiens
ccugcucuccaguagccugggcaaaguagugaaggaaaaaagcacugcagaaaccacuccag

SEQ ID NO: 551499 - RNA, 62 nt, Homo Sapiens
auggacucuguuaagaaaucuggccuuuggaaaggaaaaauuucuguaacaucagagcuguc

SEQ ID NO: 551500 - RNA, 62 nt, Homo Sapiens
ccaccuuucuucaauuuacaaugauucaguagaggaaaaagaaggggcacucuaccuugguu

SEQ ID NO: 551501 - RNA, 62 nt, Homo Sapiens
aacaacagcaacaacacgaaaauguguagaagaggaaaaagcuguacaagaaaguuuguuug

SEQ ID NO: 551502 - RNA, 62 nt, Homo Sapiens
guaaccgugaaagagugacaaggacagccuauaggaaaaacaauaccacuuaaaacaaucuc

SEQ ID NO: 551503 - RNA, 62 nt, Homo Sapiens
uucaaauuggaaguaaugauauguauugcccaaggaaaaauacaggauguugucccaucaag

SEQ ID NO: 551504 - RNA, 62 nt, Homo Sapiens
uauacuaaaaauauaggcucuugggauuggagaggaaaaauuagaggugauuuucagauuuc

SEQ ID NO: 551505 - RNA, 62 nt, Homo Sapiens
auuucuuuaaagcaagacacaaaagcauacacaggaaaaaaugaugcauaaaaacauggcuu

SEQ ID NO: 551506 - RNA, 62 nt, Homo Sapiens
aagugcagcaggagaacucuuuucccugaaaaaggaaaaauauugaacucaaugauagcacc

SEQ ID NO: 551507 - RNA, 62 nt, Homo Sapiens
ugaacuuuccucacaccuggaagaaacaaaguaggaaaaagugaacaggggaugucaaaucg

SEQ ID NO: 551508 - RNA, 62 nt, Homo Sapiens
uuauuugaagauggagcacugcugauuuaugaaggaaaaaagaagaauuuucuaaagauuac

SEQ ID NO: 551509 - RNA, 62 nt, Homo Sapiens
uucaggauuuaagucugagguagucaacccucaggaaaaaaaaaauggcuuaucugaaauca

SEQ ID NO: 551510 - RNA, 62 nt, Homo Sapiens
gagacucugucucagaaaaaaaaaaaaagaaaaggaaaaagaaaaauauauauucuauauuu

SEQ ID NO: 551511 - RNA, 62 nt, Homo Sapiens
aaauugcaaagcacagauaaauggaaauaaacaggaaaaagaaucaccuauaaccucaccau

SEQ ID NO: 551512 - RNA, 62 nt, Homo Sapiens
aauuaaccuccuaaaaggaauucauauuuuaaaggaaaaaaauacaacuaaugaugcacauu

SEQ ID NO: 551513 - RNA, 62 nt, Homo Sapiens
ucauaugguauugugauuuucuuuccccugcuaggaaaaaauugcacugaaaugcugacaaa

SEQ ID NO: 551514 - RNA, 62 nt, Homo Sapiens
gcaggggagcaaaaggacgccaugugagcauuaggaaaaaaaauacucacucuuacuaacaa

SEQ ID NO: 551515 - RNA, 62 nt, Homo Sapiens
uguaguuuguauagcuguaguacugagguuugaggaaaaauaaauguugaucagcagaccac

SEQ ID NO: 551516 - RNA, 62 nt, Homo Sapiens
aagagaaugaaaaguauuugguaacuaacggaaggaaaaacuauuuggaaaaacccaugaag

SEQ ID NO: 551517 - RNA, 62 nt, Homo Sapiens
cagaagacauugcuaaaagacuaaguuaugugaggaaaaaaaaauauauaauaaugaaauga

SEQ ID NO: 551518 - RNA, 62 nt, Homo Sapiens
gugauauguuuaauuuuaaaagugcuuuuacaaggaaaaaagcacguacucauuacauuuuc

SEQ ID NO: 551519 - RNA, 62 nt, Homo Sapiens
aaucuaccauaggaauguuaucaguuuuauggaggaaaaauacaagcccuauucugcacugu

SEQ ID NO: 551520 - RNA, 62 nt, Homo Sapiens
uauaacaaaauguuuuauuuauuuucuauaaaaggaaaaaagaaagaaauaaaaauauuuuu

SEQ ID NO: 551521 - RNA, 62 nt, Homo Sapiens
aaauaaaaauauuuuuauuuuggagagaaaggaggaaaaaagggagaccagagaccgccuac

SEQ ID NO: 551522 - RNA, 62 nt, Homo Sapiens
uagcaccguuuguucugugagcuggaaacagaaggaaaaaacauacccuuggguacccauag

SEQ ID NO: 551523 - RNA, 62 nt, Homo Sapiens
agauaaugaaaagugauaucuucgcauacgaaaggaaaaaagguugagguauauaugauuuu

SEQ ID NO: 551524 - RNA, 62 nt, Homo Sapiens
auccuuaagauuuaaaaaaaaaaaaaaaaaaaaggaaaaaaaagugauggaagccguaagug

SEQ ID NO: 551525 - RNA, 62 nt, Homo Sapiens
ugucuauuuuuucucuucauguuguaacaaaaaggaaaaaagaaaaaaaaaucccaucccuu

SEQ ID NO: 551526 - RNA, 62 nt, Homo Sapiens
ucauauguuuaauugaauugaaaauaucccuuaggaaaaaaaaaaaacacacaaaaaaccac

SEQ ID NO: 551527 - RNA, 62 nt, Homo Sapiens
auaaaauugcaguauuuaaagcuuaagcuuucaggaaaaagaaaauaagaauucagugugug

SEQ ID NO: 551528 - RNA, 62 nt, Homo Sapiens
aacacaggaaaugaaaaauuuuuaaaaaaagaaggaaaaauguuuuaaauacaaaaggaaaa

SEQ ID NO: 551529 - RNA, 62 nt, Homo Sapiens
aaaaaaagaaggaaaaauguuuuaaauacaaaaggaaaaacagacaaaaauuuaauuuuagc

SEQ ID NO: 551530 - RNA, 62 nt, Homo Sapiens
aauaccuggcaaaacuaaauaaauuaccaaaaaggaaaaaaaauccaccaaaccaugauaaa

SEQ ID NO: 551531 - RNA, 62 nt, Homo Sapiens
uguuuauuuauuguggauucccaucaggaaagaggaaaaaauacacauguucuuucauauag

SEQ ID NO: 551532 - RNA, 62 nt, Homo Sapiens
aggaagcauauaccggggaauguguagccuucaggaaaaaaaugccaauugacacaaagcau

SEQ ID NO: 551533 - RNA, 62 nt, Homo Sapiens
uucacauuuugauuuauuagguacuagcacugaggaaaaaaaauucagcacuuggacuauca

SEQ ID NO: 551534 - RNA, 62 nt, Homo Sapiens
caacacuacaagucuugaguuaagaaggaaagaggaaaaaagaaaaaacaccaauacccaga

SEQ ID NO: 551535 - RNA, 62 nt, Homo Sapiens
augcuuucuuuuccagucgucuuugagaauaaaggaaaaaaaaaucuucagaugcaaugguu

SEQ ID NO: 551536 - RNA, 58 nt, Homo Sapiens
uggauggauuucaacuuuaacuuacuggaggaaaaaaaauuuauggcuaaaaagggua

SEQ ID NO: 551537 - RNA, 62 nt, Homo Sapiens
ugaugaggacacagcagccauauuaugccaagaggaaaaauaucaugaucauauugaaagau

SEQ ID NO: 551538 - RNA, 62 nt, Homo Sapiens
acuuuuaugaaagccaaagacugcuugcuaguaggaaaaaauuucaaauaauaaccaaagcu

SEQ ID NO: 551539 - RNA, 62 nt, Homo Sapiens
ugucauaaauuauuuccccgguaauuuuugaaaggaaaaauguauaacaaguacuauuuaca

SEQ ID NO: 551540 - RNA, 62 nt, Homo Sapiens
uuuguucaaaaguuagaacaucuggcugcaccaggaaaaaaaaaaaaaaaaaguccuguucu

SEQ ID NO: 551541 - RNA, 62 nt, Homo Sapiens
gcauauugcuuaugucuggauccauguuucugaggaaaaagacauucucaggugauguauuu

SEQ ID NO: 551542 - RNA, 62 nt, Homo Sapiens
gcaaagcguaagccuugauuggauuuugguuuaggaaaaaucucauagguauaaaagacaac

SEQ ID NO: 551543 - RNA, 62 nt, Homo Sapiens
agagaugaagcaucauauugacaacuuacuccaggaaaaaagguguguguauaggugugugu

SEQ ID NO: 551544 - RNA, 62 nt, Homo Sapiens
uccugguccaaauaaaguugcaaccuuauguaaggaaaaauucuaagguguuuaaaacaugu

SEQ ID NO: 551545 - RNA, 62 nt, Homo Sapiens
ggaauuuaugcuguacauuugccauucaggagaggaaaaaaaccaucaagccauuguuuugu

SEQ ID NO: 551546 - RNA, 62 nt, Homo Sapiens
aaagugagugaacagcaaggcccacgccuuuuaggaaaaagaccugggaucccucugucaac

SEQ ID NO: 551547 - RNA, 62 nt, Homo Sapiens
aucuugccaaauaaugaauuugauaauuauguaggaaaaacacuaauuaaaaagcacucagg

SEQ ID NO: 551548 - RNA, 62 nt, Homo Sapiens
uagcaauauuugaguuauguuuuaguaaaggcaggaaaaaaagauguaaacgaaagugccau

SEQ ID NO: 551549 - RNA, 62 nt, Homo Sapiens
uuccaugucagauaaggcaaugcaagccagacaggaaaaagagaccagaaacacuucgcugc

SEQ ID NO: 551550 - RNA, 62 nt, Homo Sapiens
cuugucgcuauuugagaaucggaaaaaaaaucaggaaaaaagaauaacaaaguugcuaggca

SEQ ID NO: 551551 - RNA, 62 nt, Homo Sapiens
aucaggaaaaaagcuugucgaaguugcuaggcaggaaaaaaaagacagugaggauaauaaca

SEQ ID NO: 551552 - RNA, 62 nt, Homo Sapiens
ccucacucauucccauguugaaaaguaaauuaaggaaaaaaucaaaaaaauguaagaggaaa

SEQ ID NO: 551553 - RNA, 62 nt, Homo Sapiens
guaaauuaaggaaaaaauccaaaaaauguaagaggaaaaaaaaucaauggagcaugugugca

SEQ ID NO: 551554 - RNA, 62 nt, Homo Sapiens
aucaaaaacaaaguaaggugaaauucagcuaaaggaaaaauguaagugcuauuggcauucca

SEQ ID NO: 551555 - RNA, 62 nt, Homo Sapiens
aauaagaaugaaaacugcugaugaaaaaaagaaggaaaaaagguuaacauugcaaugaaaaa

SEQ ID NO: 551556 - RNA, 62 nt, Homo Sapiens
gaaguacaucuaucuuuaugaaucaagauuuuaggaaaaacagaauucuuguccauuuuugu

SEQ ID NO: 551557 - RNA, 62 nt, Homo Sapiens
gaaaaacauuuuucuaaauaaaugguacuaugaggaaaaaaaagaaccacuaaacaucuuca

SEQ ID NO: 551558 - RNA, 62 nt, Homo Sapiens
uggggaggaagaggccugcuuuugaaauggagaggaaaaacuugaagauaaaauagugcuuu

SEQ ID NO: 551559 - RNA, 62 nt, Homo Sapiens
ugcuucuuuuauugguuuccaguaaaaagaacaggaaaaaaucgcucugauagguagaugug

SEQ ID NO: 551560 - RNA, 62 nt, Homo Sapiens
auuuuucucuguaagaaaguuauacauuuuuaaggaaaaaaguuucagccauuuuugccaca

SEQ ID NO: 551561 - RNA, 62 nt, Homo Sapiens
uaucuacguuuuuaguuuuugugaaacuguauaggaaaaaaguuacagcauauuuaagucuu

SEQ ID NO: 551562 - RNA, 62 nt, Homo Sapiens
guauaaaauuucucaggcagaguccuggauauaggaaaaaguaauuuaugaaguaaacuuca

SEQ ID NO: 551563 - RNA, 62 nt, Homo Sapiens
uuugugauaaaaauauaaagacagaagacaugaggaaaaacaaaagguuugaggaaaucagg

SEQ ID NO: 551564 - RNA, 62 nt, Homo Sapiens
ggguagcacuuauucauuccuuaugccuacuuaggaaaaaaaagaaggaaaugaaaauauuu

SEQ ID NO: 551565 - RNA, 62 nt, Homo Sapiens
aaacuuauuuuucuaguaaagggagaacaaauaggaaaaaaacuuauuucauuaaagaaguu

SEQ ID NO: 551566 - RNA, 62 nt, Homo Sapiens
uuugaauuuauuggaguaacucaaauugccugaggaaaaauggaaaaauuauccaccagucg

SEQ ID NO: 551567 - RNA, 62 nt, Homo Sapiens
uucaacuuugacuucuuuugacaaaggacuuuaggaaaaagaggaacaaagacauuauuuga

SEQ ID NO: 551568 - RNA, 62 nt, Homo Sapiens
uggacaacauagggagaccccaucucuaccggaggaaaaaaaaaagagucaggccugguggu

SEQ ID NO: 551569 - RNA, 62 nt, Homo Sapiens
agagugagaccuugucucaaaaaaguaacauaaggaaaaaagaagccuugcuuuagcacagg

SEQ ID NO: 551570 - RNA, 62 nt, Homo Sapiens
auaacaaccuuuaaaaaagcaaaauaauaagaaggaaaaauuccaggagggaaaaugaauug

SEQ ID NO: 551571 - RNA, 62 nt, Homo Sapiens
gaaugcaaaaaaucuuccaaagacaagaaaagaggaaaaaaagccguuuucaugagcugagu

SEQ ID NO: 551572 - RNA, 62 nt, Homo Sapiens
aagaacuauuuuaaaguguuccagacccaaaaaggaaaaauaaaaaaaaaggaauauuugua

SEQ ID NO: 551573 - RNA, 62 nt, Homo Sapiens
agucugaggcuaagaaagguucaucucacaacaggaaaaacaaaucucaacacacauuagag

SEQ ID NO: 551574 - RNA, 62 nt, Homo Sapiens
caguuugaacacaaaggcucaaaaaagaaaaaaggaaaaaaaaaaaaaugaaaaaaaaagga

SEQ ID NO: 551575 - RNA, 62 nt, Homo Sapiens
gaaaaaaggaaaaaaacaguaaugaaaaaaaaaggaaaaaaagaaaucuuaaaaaaagaaaa

SEQ ID NO: 551576 - RNA, 62 nt, Homo Sapiens
ugcuuuuggccaugucucaacugcaucaagugaggaaaaauggcaggagauaacauuuucuu

SEQ ID NO: 551577 - RNA, 62 nt, Homo Sapiens
acacauaauacaaacauacagagggagagaggaggaaaaaauucucucuagagcgagcaaga

SEQ ID NO: 551578 - RNA, 62 nt, Homo Sapiens
aguauagcaccaagccaguaaaaauauuaacuaggaaaaaacuuacguagacagaaauaaua

SEQ ID NO: 551579 - RNA, 62 nt, Homo Sapiens
aaaugaaaguacuuuuuacuaaacauuuucaaaggaaaaauaguaguccuguuugccacuaa

SEQ ID NO: 551580 - RNA, 62 nt, Homo Sapiens
uuuaauauagucuuaucuacaaauuguuaaugaggaaaaauugauuuuuuuuuaauuuaaug

SEQ ID NO: 551581 - RNA, 62 nt, Homo Sapiens
auaauaauauaaaugacaaacuucuccaaaaaaggaaaaauuaggaagaaaaacuguccuuc

SEQ ID NO: 551582 - RNA, 62 nt, Homo Sapiens
gcuuuaauguugagcaugcuguuuuuaaugggaggaaaaaaauucaaaauagcauuccccag

SEQ ID NO: 551583 - RNA, 62 nt, Homo Sapiens
cauguuuuaaauuucaaaauaauaauuuuauuaggaaaaaauaauaagaugucagaauaacu

SEQ ID NO: 551584 - RNA, 62 nt, Homo Sapiens
uuuuuuuucaauaaucuuauaaaaagaaaaucaggaaaaaaacuacaaaaauaaccuucagg

SEQ ID NO: 551585 - RNA, 62 nt, Homo Sapiens
aaaucaggaaaaaaauuuuuaaaauaaccuucaggaaaaagauuuuuaccaugguuucuaca

SEQ ID NO: 551586 - RNA, 62 nt, Homo Sapiens
ccuucaauuccauauauccuuuucuucuauguaggaaaaaaauagucuaguguaguauucuu

SEQ ID NO: 551587 - RNA, 62 nt, Homo Sapiens
uaggcuuucagcuuacacaaaucuauuuaauuaggaaaaaaacuauuaaggauguagcuuuu

SEQ ID NO: 551588 - RNA, 62 nt, Homo Sapiens
aaggccuaugaguauggauugggggggccaaaaggaaaaagcuccaugugccucuuugucug

SEQ ID NO: 551589 - RNA, 62 nt, Homo Sapiens
aguuuuauuuuauguuuagauagggcugggcaaggaaaaagaaaauaaagacaaccauauuu

SEQ ID NO: 551590 - RNA, 62 nt, Homo Sapiens
auccuaaauguuugauuaccgaagaauaugucaggaaaaauauucaguuuauacagcagacu

SEQ ID NO: 551591 - RNA, 62 nt, Homo Sapiens
aacaagauagugaucucucugaagaaauucacaggaaaaaucuuuuuaagcuugaaacugca

SEQ ID NO: 551592 - RNA, 62 nt, Homo Sapiens
caugcuuucugacugacauguuuuuguuuuuaaggaaaaaggcaaaaguuggcagauuuuuu

SEQ ID NO: 551593 - RNA, 62 nt, Homo Sapiens
aaauaguuuuuuacuggauuuuguuuucaaaaaggaaaaacaacuggcucucaagcuauagu

SEQ ID NO: 551594 - RNA, 62 nt, Homo Sapiens
acaagggaauuccagucagguuuuaucaucuaaggaaaaaagucagcaaggcauguuacuac

SEQ ID NO: 551595 - RNA, 62 nt, Homo Sapiens
aaaacaaaaucuccgcagugucggacuaaaaaaggaaaaagaccaucuggaggaaaaccaga

SEQ ID NO: 551596 - RNA, 62 nt, Homo Sapiens
ggggguggggggugggggguaacaaaagggaaaggaaaaaauacuggaugagcggugagacg

SEQ ID NO: 551597 - RNA, 62 nt, Homo Sapiens
uuacucuguguuuacagauuacucuuuacuguaggaaaaauauaucuuuugagauuaaagug

SEQ ID NO: 551598 - RNA, 62 nt, Homo Sapiens
gcuuaaaauccugucauuuauguauuauauauaggaaaaaauaauaaaauuuuaagugaugc

SEQ ID NO: 551599 - RNA, 62 nt, Homo Sapiens
gcuuuuaucaauuuuuuucuaagaaauggagaaggaaaaauaucauaaaaauuaaaugcuuu

SEQ ID NO: 551600 - RNA, 62 nt, Homo Sapiens
uguuacugaaagagacuacaaagaaggaaggaaggaaaaacuuggacaaagagagagaaaga

SEQ ID NO: 551601 - RNA, 62 nt, Homo Sapiens
aaucugaacaauccuacagggaaaucagaauuaggaaaaaaaucuggagaacaauaugguug

SEQ ID NO: 551602 - RNA, 62 nt, Homo Sapiens
ggagugauacauugugggaacccucagaagauaggaaaaaagcauggaauagauucucccuc

SEQ ID NO: 551603 - RNA, 62 nt, Homo Sapiens
agaauuccacuucuaguuauuuauucaagagaaggaaaaacaaugaucacagcaauacuugu

SEQ ID NO: 551604 - RNA, 62 nt, Homo Sapiens
auaaaugcaauauuauuggcagacauuguugaaggaaaaaagccagacaaacaacuacauaa

SEQ ID NO: 551605 - RNA, 62 nt, Homo Sapiens
acacccaucccucaaaaaggccugauagcaaaaggaaaaaaacaccauuuuuaguuuuauuu

SEQ ID NO: 551606 - RNA, 62 nt, Homo Sapiens
uauauagaauaccagaaaugggugacaguuuaaggaaaaauacuuuuaaaauguagagaaaa

SEQ ID NO: 551607 - RNA, 62 nt, Homo Sapiens
auuguuaaugcugacuguggauggaugaaaauaggaaaaauguaacaugauauuggaaaaua

SEQ ID NO: 551608 - RNA, 62 nt, Homo Sapiens
gguaauaucagggcuucugcguauaagaaaugaggaaaaagacugcuuuauuuuaaaaggua

SEQ ID NO: 551609 - RNA, 62 nt, Homo Sapiens
gaauaaaguuuuuuuccuuaugacaaguuccuaggaaaaaaggaauggucacuaaaguaucc

SEQ ID NO: 551610 - RNA, 62 nt, Homo Sapiens
aaaauguuacaagcuaagagcaugcaagauacaggaaaaauguauuuaauggcacugagaaa

SEQ ID NO: 551611 - RNA, 62 nt, Homo Sapiens
auacuucuguuuacuuacucgauggguaugcaaggaaaaaauacuguguguugacauuugag

SEQ ID NO: 551612 - RNA, 62 nt, Homo Sapiens
uauauguggauaacuguaugucaguguucaguaggaaaaagucugugguuucuugucuaaug

SEQ ID NO: 551613 - RNA, 62 nt, Homo Sapiens
uaaacaaacaaaaaaaaauuuuaaacaaagaaaggaaaaaaauugacaauaaaagucacucu

SEQ ID NO: 551614 - RNA, 62 nt, Homo Sapiens
aagauucuuucuucugaaagccaagcaccacaaggaaaaaaaaaauuauuaauagcucaggu

SEQ ID NO: 551615 - RNA, 62 nt, Homo Sapiens
ugaagccaaccagagaucuugaucucucucugaggaaaaaaccuagaaaugaugguuagaau

SEQ ID NO: 551616 - RNA, 62 nt, Homo Sapiens
gcauuaaaauauguacacaaaaaguuugguaaaggaaaaaugcugucauguguuacaaaagc

SEQ ID NO: 551617 - RNA, 62 nt, Homo Sapiens
ucaauaaggucaagggaaaagagggcugauggaggaaaaaggaguuuucuccauaucaaaac

SEQ ID NO: 551618 - RNA, 62 nt, Homo Sapiens
gcaaaaagcaagggagaaaagugaggaggaaaaggaaaaaaacucuagcaggccuaagacau

SEQ ID NO: 551619 - RNA, 62 nt, Homo Sapiens
uuuggcuccuuuaauuccucaugcauuaucaaaggaaaaauaauucaguguugcgguagcag

SEQ ID NO: 551620 - RNA, 62 nt, Homo Sapiens
aaucuaaaacugcgaagaauguuuucgcuuaaaggaaaaaaagaauuuuuuucaguggagug

SEQ ID NO: 551621 - RNA, 62 nt, Homo Sapiens
gguauaaaagguugccaaauugcacuguaaugaggaaaaaauacggcagugucauuccccuu

SEQ ID NO: 551622 - RNA, 62 nt, Homo Sapiens
aaaaaagcaauuagguagcaagaaaguuggaaaggaaaaaagacugcugcugccucugaaac

SEQ ID NO: 551623 - RNA, 62 nt, Homo Sapiens
uacuaaaaaaaguguguauuaggaggagagagaggaaaaaaagaggaaagaaggaaaaaaaa

SEQ ID NO: 551624 - RNA, 62 nt, Homo Sapiens
uaggaggagagagaggaaaaaaagaggaaagaaggaaaaaaaaaagaauuaaaaaaaaaaaa

SEQ ID NO: 551625 - RNA, 62 nt, Homo Sapiens
uugguugacuguuuuuguuucgcaauuauauuaggaaaaaagucacuuuguucugguauuga

SEQ ID NO: 551626 - RNA, 62 nt, Homo Sapiens
uaucuuaaaacuuuggccauguuuugugccauaggaaaaaauuuuggguauacuugugguua

SEQ ID NO: 551627 - RNA, 62 nt, Homo Sapiens
gugaaucuuaccagcaguucuccugagcuaggaggaaaaaauuuuuguccccauuccccuac

SEQ ID NO: 551628 - RNA, 62 nt, Homo Sapiens
caguaaaguugcaaugaagagacggggauguuaggaaaaauaugccucagugagaacggggg

SEQ ID NO: 551629 - RNA, 62 nt, Homo Sapiens
acuuaguagcuugcugcucccauccccucuguaggaaaaagaaaagaguggguguguguccg

SEQ ID NO: 551630 - RNA, 62 nt, Homo Sapiens
uccccccaggcauuucuaggaucaugacaaggaggaaaaaugagaacagcgugagcuggugg

SEQ ID NO: 551631 - RNA, 62 nt, Homo Sapiens
agcaucaugaaaggcaaaaaccguggcuccuaaggaaaaaacuaauugaaguucagagucac

SEQ ID NO: 551632 - RNA, 62 nt, Homo Sapiens
uuguuuucaguuaaacacuaccaacagaaaaaaggaaaaaaauaaugcauaaugcuuucuca

SEQ ID NO: 551633 - RNA, 62 nt, Homo Sapiens
ugugguuuggccuugcugcuugcuuaacagagaggaaaaaaauaccucauuucaagaaaaua

SEQ ID NO: 551634 - RNA, 62 nt, Homo Sapiens
aaaucacucuauguugccccaucugucaauuaaggaaaaaaaagcuuguugaaauguuuugc

SEQ ID NO: 551635 - RNA, 62 nt, Homo Sapiens
aaaaaacuucuuuaggcauucaucuuuggaaaaggaaaaaaaauaaacuagcucauuauuuc

SEQ ID NO: 551636 - RNA, 62 nt, Homo Sapiens
cagcuuucaaaucauugggguuugaaauuggcaggaaaaaugucaaccugaugauuuguuug

SEQ ID NO: 551637 - RNA, 62 nt, Homo Sapiens
aagaaaaaauuuaaaaaauucaaaaaaaaggaaggaaaaaaacaaaacaaaacaaaauaaaa

SEQ ID NO: 551638 - RNA, 62 nt, Homo Sapiens
auggaaacacaucucauuauuuauaggaaaggaggaaaaauacagcggggagggacugauuu

SEQ ID NO: 551639 - RNA, 62 nt, Homo Sapiens
auuuggaaaauaguaacauuguaggagaggaaaggaaaaaacucuaaacugggacuauacua

SEQ ID NO: 551640 - RNA, 62 nt, Homo Sapiens
auuuuucuauaauuuguaaaucuguaaagaagaggaaaaaucuacgauuugggagugacauu

SEQ ID NO: 551641 - RNA, 62 nt, Homo Sapiens
ccugcugcauuuaaaaacaaagccagggccaaaggaaaaagcuccuagggaguuggcuuuuc

SEQ ID NO: 551642 - RNA, 62 nt, Homo Sapiens
caacucuaaaaaaaaaaaaaauacaaauaaaaaggaaaaaaaauuacauuuuuuaucuuaua

SEQ ID NO: 551643 - RNA, 62 nt, Homo Sapiens
gcaguauucagcuucuuaaccagucgcuauuuaggaaaaaaaacccacuaguuaggccauca

SEQ ID NO: 551644 - RNA, 62 nt, Homo Sapiens
acccccccacuaugcccucauuuuuuuaaaaaaggaaaaaaaaaagaaacuggguuccaguc

SEQ ID NO: 551645 - RNA, 62 nt, Homo Sapiens
aaaaaaauaaauaaaaauaaaaaaaauaaaaaaggaaaaaaaaaaaagaagaaacaagacau

SEQ ID NO: 551646 - RNA, 62 nt, Homo Sapiens
uuuaucgcaaugauagucagauugucaucauaaggaaaaacugucuuucagcaacauucuuu

SEQ ID NO: 551647 - RNA, 62 nt, Homo Sapiens
uccacauagcucugggccuuugaaagguauuaaggaaaaaaugccgucuucacagacaaacu

SEQ ID NO: 551648 - RNA, 62 nt, Homo Sapiens
caaaccccacucagaaacaguguguacaauccaggaaaaaaacuccauuccaccugacccug

SEQ ID NO: 551649 - RNA, 62 nt, Homo Sapiens
uucagacaucgcuacaauaacucuuaacacauaggaaaaaaggauacagcggucacuauuuu

SEQ ID NO: 551650 - RNA, 62 nt, Homo Sapiens
agacuuagacuucccgaguuuucuuuuguauuaggaaaaacacaggaaagggaaaugaucgu

SEQ ID NO: 551651 - RNA, 62 nt, Homo Sapiens
ggguuguacacacugccauuuuuguauuuuaaaggaaaaaugacuuucauucccaacugauu

SEQ ID NO: 551652 - RNA, 62 nt, Homo Sapiens
cagucaugaauacauuuuuagccauuuaccuaaggaaaaagacaguuuuucuagguaccaug

SEQ ID NO: 551653 - RNA, 62 nt, Homo Sapiens
ucaacggccacuguguguggcugcucugagugaggaaaaaauuaaaaagaaaaacugguucc

SEQ ID NO: 551654 - RNA, 62 nt, Homo Sapiens
aaggcucagcuggggaugguguuugacuucggaggaaaaaaguugcuauugcccguuaaagg

SEQ ID NO: 551655 - RNA, 62 nt, Homo Sapiens
ccuucccuagagcuaguauccgcuguuuaaaaaggaaaaaauuccuaggcaacagagugaua

SEQ ID NO: 551656 - RNA, 62 nt, Homo Sapiens
aggaaaauaggagaagguggcaucucaacagaaggaaaaaaaugggugacagagugagacuc

SEQ ID NO: 551657 - RNA, 62 nt, Homo Sapiens
cuagggcccugggaggagguugagccuggggaaggaaaaagcaggaaacugaaggaagcagg

SEQ ID NO: 551658 - RNA, 62 nt, Homo Sapiens
auuggauucgguaaaaagaggggguugcuagaaggaaaaacaggugugaccugauccugccc

SEQ ID NO: 551659 - RNA, 62 nt, Homo Sapiens
auuuauaaauuaaacuuuagauauguauguacaggaaaaaauguaguauauaguaucguaua

SEQ ID NO: 551660 - RNA, 62 nt, Homo Sapiens
aaaauguaguauauaguaucguauauauguacaggaaaaaaacguacuaucugugguuucag

SEQ ID NO: 551661 - RNA, 62 nt, Homo Sapiens
aaaaagacauaaacuggcacuaaaaaaaaaaaaggaaaaaaagaaaacacacagaagagauu

SEQ ID NO: 551662 - RNA, 62 nt, Homo Sapiens
agcaacaaaaaaagaaaacacacaaacagaagaggaaaaaaaucaaaaaagcgacaaaaaaa

SEQ ID NO: 551663 - RNA, 62 nt, Homo Sapiens
uauagguauguguacauauagcauugcuuuaaaggaaaaaagagugaacagaguuuugaaag

SEQ ID NO: 551664 - RNA, 62 nt, Homo Sapiens
cuucucauuguuaacuggagauauuggaaauaaggaaaaaccuacagaguuggacuaugugu

SEQ ID NO: 551665 - RNA, 62 nt, Homo Sapiens
uuauaaucccagucuuuuaucacucaggugcuaggaaaaaaaacauagacucaagacccaag

SEQ ID NO: 551666 - RNA, 62 nt, Homo Sapiens
aacccccagaaacccacaauauguacacgcuaaggaaaaacuagcacccuucuguccacuca

SEQ ID NO: 551667 - RNA, 62 nt, Homo Sapiens
ggggaaguuggggauaggcaaaauguucagugaggaaaaaaaugaggaaaaaacauucagac

SEQ ID NO: 551668 - RNA, 62 nt, Homo Sapiens
auucagacaaauguucagugacauguucagugaggaaaaaacguucagugugagugaggaaa

SEQ ID NO: 551669 - RNA, 62 nt, Homo Sapiens
accuagaauauuugggggggaaagaggacaacaggaaaaagcucuucccauugcuuccuacu

SEQ ID NO: 551670 - RNA, 62 nt, Homo Sapiens
gggaggucuuuuuuuucuccugugcucacgaaaggaaaaaugaauggcuuuguggucgucgu

SEQ ID NO: 551671 - RNA, 62 nt, Homo Sapiens
ugaaucugguuacacauaugguuuuacaagggaggaaaaaagggaaggaaaagaaaguaguu

SEQ ID NO: 551672 - RNA, 62 nt, Homo Sapiens
uaaugcuagcaaaaaauaaacaucguuuaaauaggaaaaauuuuagcucauauucuauacag

SEQ ID NO: 551673 - RNA, 62 nt, Homo Sapiens
agguugaggacagugacugcauguuauuagguaggaaaaauaugugggauaaccuucaguuu

SEQ ID NO: 551674 - RNA, 62 nt, Homo Sapiens
cuucucauucaaagaggaauaauagcaaguccaggaaaaacuucccacaugaaccuccagca

SEQ ID NO: 551675 - RNA, 62 nt, Homo Sapiens
guuugguuuuauaaaauucacuucaaaguugaaggaaaaaaaucaacuuuuuaguuuuguuc

SEQ ID NO: 551676 - RNA, 62 nt, Homo Sapiens
aagcccaaacuuaaccucugugaauuaaaagaaggaaaaaaauuuuguauaaaaauuuaaau

SEQ ID NO: 551677 - RNA, 62 nt, Homo Sapiens
guuaugaagauacagauuuauccaagcauaaaaggaaaaagaaaaggccagagaaagagcag

SEQ ID NO: 551678 - RNA, 62 nt, Homo Sapiens
uaaaacauguuuaauuuuauuauguucuugugaggaaaaaagaaguuccccuccauaauuuu

SEQ ID NO: 551679 - RNA, 62 nt, Homo Sapiens
guguuacuuuuuuuaaauucaggacuacuaaaaggaaaaauuuauucuaucauaacuaccca

SEQ ID NO: 551680 - RNA, 64 nt, Homo Sapiens; identical to SEQ ID NO: 284691

SEQ ID NO: 551681 - RNA, 64 nt, Homo Sapiens; identical to SEQ ID NO: 284692

SEQ ID NO: 551682 - RNA, 64 nt, Homo Sapiens; identical to SEQ ID NO: 284693

SEQ ID NO: 551683 - RNA, 64 nt, Homo Sapiens
accugagaaggacggcaaggcugagguggcuaagggggaccauggggagguggcacuagggauc

SEQ ID NO: 551684 - RNA, 64 nt, Homo Sapiens
cagagggugggaggggccaugcugugugagaccaggggaccagagggaugggagagucaaggga

SEQ ID NO: 551685 - RNA, 64 nt, Homo Sapiens
gaaggcacacucccuuacccagccucacccauguggggaccacgugcugcacugguccuaugcc

SEQ ID NO: 551686 - RNA, 64 nt, Homo Sapiens
agggagcggggucgggaucagaucuguccugggcggggaccagggcagacggcacccaggcugu

SEQ ID NO: 551687 - RNA, 64 nt, Homo Sapiens
aggccagagcagguagcaaggcauuguggaaagaggggaccaggguggcuggggaagaggccga

SEQ ID NO: 551688 - RNA, 64 nt, Homo Sapiens
aaaccguuaagccucuacgauuuuuaaguaaguuggggaccaucaguuuaaaauaaaugcaaua

SEQ ID NO: 551689 - RNA, 64 nt, Homo Sapiens
cagucauuuggugacuuagguacacugcuucaguggggaccaagccaaaaauacuauggagagc

SEQ ID NO: 551690 - RNA, 64 nt, Homo Sapiens
uucugccaggugagaugcuugggaacagccauagggggaccagccacccccauuggacaagcug

SEQ ID NO: 551691 - RNA, 64 nt, Homo Sapiens
ugggcagaugagaggcugagguggaagagguggcggggaccagcgcaggggaguccagcugaga

SEQ ID NO: 551692 - RNA, 64 nt, Homo Sapiens
uacucuggcaggaucuggacgccggacauggcugggggaccaacaccaugaguccuguguccag

SEQ ID NO: 551693 - RNA, 64 nt, Homo Sapiens; identical to SEQ ID NO: 542714

SEQ ID NO: 551694 - RNA, 64 nt, Homo Sapiens; identical to SEQ ID NO: 542715

SEQ ID NO: 551695 - RNA, 64 nt, Homo Sapiens; identical to SEQ ID NO: 542716

SEQ ID NO: 551696 - RNA, 64 nt, Homo Sapiens; identical to SEQ ID NO: 542717

SEQ ID NO: 551697 - RNA, 64 nt, Homo Sapiens; identical to SEQ ID NO: 542718

SEQ ID NO: 551698 - RNA, 64 nt, Homo Sapiens; identical to SEQ ID NO: 542719

SEQ ID NO: 551699 - RNA, 64 nt, Homo Sapiens; identical to SEQ ID NO: 542720

SEQ ID NO: 551700 - RNA, 64 nt, Homo Sapiens; identical to SEQ ID NO: 542721

SEQ ID NO: 551701 - RNA, 64 nt, Homo Sapiens; identical to SEQ ID NO: 542722

SEQ ID NO: 551702 - RNA, 64 nt, Homo Sapiens; identical to SEQ ID NO: 542723

SEQ ID NO: 551703 - RNA, 64 nt, Homo Sapiens
gaagggacucaggugagggucuucuggacucuaagacgguaaaggcacuaaagucacuuuaaag

SEQ ID NO: 551704 - RNA, 64 nt, Homo Sapiens
uuccccucuaccagccuccagaggagacagccgugacgguaaaccgagggcucagcaaggccaa

SEQ ID NO: 551705 - RNA, 64 nt, Homo Sapiens
ccaucauggaagucagagaauuaaccaauuaagugacgguaacuauuuuuuguauaccuuguuc

SEQ ID NO: 551706 - RNA, 64 nt, Homo Sapiens
gauauucuaguauuugcuucugguggaauuaaaugacgguaaaauuggcuaauuauuugaauga

SEQ ID NO: 551707 - RNA, 64 nt, Homo Sapiens
gauccuggagcuuugcuuucuauugaaggcuuuugacgguaauaggugguaacuugguaaaagg

SEQ ID NO: 551708 - RNA, 64 nt, Homo Sapiens
agaaggcauuagguugacaacuugucaugauuuugacgguaagccaccaugauuguguucucug

SEQ ID NO: 551709 - RNA, 64 nt, Homo Sapiens
gcgaugugggugacgacugcgggaggagugugacgacgguaacaggaugggcuccugcagccug

SEQ ID NO: 551710 - RNA, 64 nt, Homo Sapiens
agcaaaggcuuuacuucuuugaugcuugcaggaggacgguaaaccuguuuuauguguaaaauca

SEQ ID NO: 551711 - RNA, 64 nt, Homo Sapiens
uggcugcauuugccugucauaaccuuucggcaaggacgguaacucaucuugcauccaaaccugu

SEQ ID NO: 551712 - RNA, 64 nt, Homo Sapiens
gaggucuuacugcaauaagaaguaaugccugggggacgguaauccuaauaggacgucccgcacu

SEQ ID NO: 551713 - RNA, 64 nt, Homo Sapiens
aagaaaggaaucaaaggacuguguguaguaagcugacgguaaaguuaagauuaaauuaagacag

SEQ ID NO: 551714 - RNA, 64 nt, Homo Sapiens
uuaugauagaagguguggcaccaauaaaggaaaggacgguaaccuuuuuaaaaaauucagaaau

SEQ ID NO: 551715 - RNA, 64 nt, Homo Sapiens; identical to SEQ ID NO: 551714

SEQ ID NO: 551716 - RNA, 64 nt, Homo Sapiens
augagccaugguggagaacuuuaucacucaaguagacgguaaacauccuuaauauguucuaaau

SEQ ID NO: 551717 - RNA, 64 nt, Homo Sapiens
gagaaugagugagguuucgugcagggccaauccugacgguaauugccugggggcugccaggugu

SEQ ID NO: 551718 - RNA, 64 nt, Homo Sapiens
gcaagugucccaugaauguggaauagagggugaugacgguaagaauggggccaaaguugagaua

SEQ ID NO: 551719 - RNA, 64 nt, Homo Sapiens
cuaccuauuacagccguauucugcuguccguggagacgguaagaucuuagguuccaagauuuua

SEQ ID NO: 551720 - RNA, 64 nt, Homo Sapiens
ucuauuaucacauuaaucucaaagagauucgaaugacgguaaguguucucaugaagcaggaggc

SEQ ID NO: 551721 - RNA, 64 nt, Homo Sapiens
gaauaaacacuuguacugggcauauaagaaucgugacgguaagaaacucuuugaguugguccuu

SEQ ID NO: 551722 - RNA, 64 nt, Homo Sapiens
gaaagugucgucuccgcuucucucgguguggcgugacgguaaccccauacucuccuuuugacuc

SEQ ID NO: 551723 - RNA, 64 nt, Homo Sapiens
ucgaagccuaccaggcucccggugugugcagggagacgguaaagcuggaggugccugagaccag

SEQ ID NO: 551724 - RNA, 64 nt, Homo Sapiens
gaauccacacuuccugagccagaggggccguguugacgguaaugcauucucuauagagccaagu

SEQ ID NO: 551725 - RNA, 64 nt, Homo Sapiens
ggaugcauccaaagcacgagucacuuaaaauaucgacgguaaacuacuauuuuguagagaaacu

SEQ ID NO: 551726 - RNA, 64 nt, Homo Sapiens
ugcauuuugucucuuuguauguuauaggaauaaggacgguaaucucaacaaagaaaauuuuuga

SEQ ID NO: 551727 - RNA, 64 nt, Homo Sapiens; identical to SEQ ID NO: 551725

SEQ ID NO: 551728 - RNA, 64 nt, Homo Sapiens; identical to SEQ ID NO: 328547

SEQ ID NO: 551729 - RNA, 64 nt, Homo Sapiens; identical to SEQ ID NO: 328548

SEQ ID NO: 551730 - RNA, 64 nt, Homo Sapiens; identical to SEQ ID NO: 328549

SEQ ID NO: 551731 - RNA, 64 nt, Homo Sapiens; identical to SEQ ID NO: 328550

SEQ ID NO: 551732 - RNA, 64 nt, Homo Sapiens; identical to SEQ ID NO: 328551

SEQ ID NO: 551733 - RNA, 64 nt, Homo Sapiens; identical to SEQ ID NO: 328552

SEQ ID NO: 551734 - RNA, 64 nt, Homo Sapiens; identical to SEQ ID NO: 328553

SEQ ID NO: 551735 - RNA, 64 nt, Homo Sapiens; identical to SEQ ID NO: 328554

SEQ ID NO: 551736 - RNA, 64 nt, Homo Sapiens; identical to SEQ ID NO: 328555

SEQ ID NO: 551737 - RNA, 64 nt, Homo Sapiens; identical to SEQ ID NO: 328556

SEQ ID NO: 551738 - RNA, 64 nt, Homo Sapiens; identical to SEQ ID NO: 328557

SEQ ID NO: 551739 - RNA, 64 nt, Homo Sapiens; identical to SEQ ID NO: 328558

SEQ ID NO: 551740 - RNA, 64 nt, Homo Sapiens; identical to SEQ ID NO: 328559

SEQ ID NO: 551741 - RNA, 64 nt, Homo Sapiens; identical to SEQ ID NO: 328560

SEQ ID NO: 551742 - RNA, 64 nt, Homo Sapiens; identical to SEQ ID NO: 328561

SEQ ID NO: 551743 - RNA, 64 nt, Homo Sapiens; identical to SEQ ID NO: 328562

SEQ ID NO: 551744 - RNA, 64 nt, Homo Sapiens; identical to SEQ ID NO: 328563

SEQ ID NO: 551745 - RNA, 64 nt, Homo Sapiens; identical to SEQ ID NO: 328564

SEQ ID NO: 551746 - RNA, 64 nt, Homo Sapiens; identical to SEQ ID NO: 328565

SEQ ID NO: 551747 - RNA, 64 nt, Homo Sapiens; identical to SEQ ID NO: 328566

SEQ ID NO: 551748 - RNA, 64 nt, Homo Sapiens; identical to SEQ ID NO: 328567

SEQ ID NO: 551749 - RNA, 64 nt, Homo Sapiens; identical to SEQ ID NO: 328568

SEQ ID NO: 551750 - RNA, 64 nt, Homo Sapiens; identical to SEQ ID NO: 328569

SEQ ID NO: 551751 - RNA, 64 nt, Homo Sapiens; identical to SEQ ID NO: 328570

SEQ ID NO: 551752 - RNA, 64 nt, Homo Sapiens; identical to SEQ ID NO: 328571

SEQ ID NO: 551753 - RNA, 64 nt, Homo Sapiens; identical to SEQ ID NO: 328572

SEQ ID NO: 551754 - RNA, 64 nt, Homo Sapiens; identical to SEQ ID NO: 328573

SEQ ID NO: 551755 - RNA, 64 nt, Homo Sapiens; identical to SEQ ID NO: 328574

SEQ ID NO: 551756 - RNA, 64 nt, Homo Sapiens; identical to SEQ ID NO: 328575

SEQ ID NO: 551757 - RNA, 64 nt, Homo Sapiens; identical to SEQ ID NO: 328576

SEQ ID NO: 551758 - RNA, 64 nt, Homo Sapiens; identical to SEQ ID NO: 328577

SEQ ID NO: 551759 - RNA, 64 nt, Homo Sapiens; identical to SEQ ID NO: 328578

SEQ ID NO: 551760 - RNA, 64 nt, Homo Sapiens; identical to SEQ ID NO: 328579

SEQ ID NO: 551761 - RNA, 64 nt, Homo Sapiens; identical to SEQ ID NO: 328580

SEQ ID NO: 551762 - RNA, 64 nt, Homo Sapiens; identical to SEQ ID NO: 328581

SEQ ID NO: 551763 - RNA, 64 nt, Homo Sapiens; identical to SEQ ID NO: 328582

SEQ ID NO: 551764 - RNA, 64 nt, Homo Sapiens; identical to SEQ ID NO: 328583

SEQ ID NO: 551765 - RNA, 64 nt, Homo Sapiens; identical to SEQ ID NO: 328584

SEQ ID NO: 551766 - RNA, 64 nt, Homo Sapiens; identical to SEQ ID NO: 328585

SEQ ID NO: 551767 - RNA, 64 nt, Homo Sapiens; identical to SEQ ID NO: 328586

SEQ ID NO: 551768 - RNA, 64 nt, Homo Sapiens; identical to SEQ ID NO: 328587

SEQ ID NO: 551769 - RNA, 64 nt, Homo Sapiens; identical to SEQ ID NO: 328588

SEQ ID NO: 551770 - RNA, 64 nt, Homo Sapiens; identical to SEQ ID NO: 328589

SEQ ID NO: 551771 - RNA, 64 nt, Homo Sapiens; identical to SEQ ID NO: 328590

SEQ ID NO: 551772 - RNA, 64 nt, Homo Sapiens; identical to SEQ ID NO: 328591

SEQ ID NO: 551773 - RNA, 64 nt, Homo Sapiens; identical to SEQ ID NO: 328592

SEQ ID NO: 551774 - RNA, 64 nt, Homo Sapiens; identical to SEQ ID NO: 328593

SEQ ID NO: 551775 - RNA, 64 nt, Homo Sapiens; identical to SEQ ID NO: 328594

SEQ ID NO: 551776 - RNA, 64 nt, Homo Sapiens; identical to SEQ ID NO: 328595

SEQ ID NO: 551777 - RNA, 64 nt, Homo Sapiens; identical to SEQ ID NO: 328596

SEQ ID NO: 551778 - RNA, 64 nt, Homo Sapiens; identical to SEQ ID NO: 328597

SEQ ID NO: 551779 - RNA, 64 nt, Homo Sapiens; identical to SEQ ID NO: 328598

SEQ ID NO: 551780 - RNA, 64 nt, Homo Sapiens; identical to SEQ ID NO: 328599

SEQ ID NO: 551781 - RNA, 55 nt, Homo Sapiens; identical to SEQ ID NO: 328600

SEQ ID NO: 551782 - RNA, 64 nt, Homo Sapiens; identical to SEQ ID NO: 328601

SEQ ID NO: 551783 - RNA, 64 nt, Homo Sapiens; identical to SEQ ID NO: 328602

SEQ ID NO: 551784 - RNA, 64 nt, Homo Sapiens; identical to SEQ ID NO: 328603

SEQ ID NO: 551785 - RNA, 64 nt, Homo Sapiens; identical to SEQ ID NO: 328604

SEQ ID NO: 551786 - RNA, 64 nt, Homo Sapiens; identical to SEQ ID NO: 328605

SEQ ID NO: 551787 - RNA, 64 nt, Homo Sapiens; identical to SEQ ID NO: 328606

SEQ ID NO: 551788 - RNA, 64 nt, Homo Sapiens; identical to SEQ ID NO: 328607

SEQ ID NO: 551789 - RNA, 64 nt, Homo Sapiens; identical to SEQ ID NO: 328608

SEQ ID NO: 551790 - RNA, 64 nt, Homo Sapiens; identical to SEQ ID NO: 328609

SEQ ID NO: 551791 - RNA, 64 nt, Homo Sapiens; identical to SEQ ID NO: 328610

SEQ ID NO: 551792 - RNA, 64 nt, Homo Sapiens; identical to SEQ ID NO: 328611

SEQ ID NO: 551793 - RNA, 64 nt, Homo Sapiens; identical to SEQ ID NO: 328612

SEQ ID NO: 551794 - RNA, 64 nt, Homo Sapiens; identical to SEQ ID NO: 328613

SEQ ID NO: 551795 - RNA, 64 nt, Homo Sapiens; identical to SEQ ID NO: 328614

SEQ ID NO: 551796 - RNA, 64 nt, Homo Sapiens; identical to SEQ ID NO: 328615

SEQ ID NO: 551797 - RNA, 64 nt, Homo Sapiens; identical to SEQ ID NO: 328616

SEQ ID NO: 551798 - RNA, 64 nt, Homo Sapiens; identical to SEQ ID NO: 328617

SEQ ID NO: 551799 - RNA, 64 nt, Homo Sapiens; identical to SEQ ID NO: 328618

SEQ ID NO: 551800 - RNA, 64 nt, Homo Sapiens; identical to SEQ ID NO: 328619

SEQ ID NO: 551801 - RNA, 64 nt, Homo Sapiens; identical to SEQ ID NO: 328620

SEQ ID NO: 551802 - RNA, 64 nt, Homo Sapiens; identical to SEQ ID NO: 328621

SEQ ID NO: 551803 - RNA, 64 nt, Homo Sapiens; identical to SEQ ID NO: 328622

SEQ ID NO: 551804 - RNA, 64 nt, Homo Sapiens; identical to SEQ ID NO: 328623

SEQ ID NO: 551805 - RNA, 64 nt, Homo Sapiens; identical to SEQ ID NO: 328624

SEQ ID NO: 551806 - RNA, 64 nt, Homo Sapiens; identical to SEQ ID NO: 328625

SEQ ID NO: 551807 - RNA, 64 nt, Homo Sapiens; identical to SEQ ID NO: 328626

SEQ ID NO: 551808 - RNA, 64 nt, Homo Sapiens; identical to SEQ ID NO: 328627

SEQ ID NO: 551809 - RNA, 64 nt, Homo Sapiens; identical to SEQ ID NO: 328628

SEQ ID NO: 551810 - RNA, 57 nt, Homo Sapiens; identical to SEQ ID NO: 328629

SEQ ID NO: 551811 - RNA, 64 nt, Homo Sapiens; identical to SEQ ID NO: 328630

SEQ ID NO: 551812 - RNA, 64 nt, Homo Sapiens; identical to SEQ ID NO: 328631

SEQ ID NO: 551813 - RNA, 64 nt, Homo Sapiens; identical to SEQ ID NO: 328632

SEQ ID NO: 551814 - RNA, 64 nt, Homo Sapiens; identical to SEQ ID NO: 328633

SEQ ID NO: 551815 - RNA, 64 nt, Homo Sapiens; identical to SEQ ID NO: 328634

SEQ ID NO: 551816 - RNA, 64 nt, Homo Sapiens; identical to SEQ ID NO: 328635

SEQ ID NO: 551817 - RNA, 64 nt, Homo Sapiens; identical to SEQ ID NO: 328636

SEQ ID NO: 551818 - RNA, 64 nt, Homo Sapiens; identical to SEQ ID NO: 328637

SEQ ID NO: 551819 - RNA, 64 nt, Homo Sapiens; identical to SEQ ID NO: 328638

SEQ ID NO: 551820 - RNA, 64 nt, Homo Sapiens; identical to SEQ ID NO: 328639

SEQ ID NO: 551821 - RNA, 64 nt, Homo Sapiens; identical to SEQ ID NO: 328640

SEQ ID NO: 551822 - RNA, 64 nt, Homo Sapiens; identical to SEQ ID NO: 328641

SEQ ID NO: 551823 - RNA, 64 nt, Homo Sapiens; identical to SEQ ID NO: 328642

SEQ ID NO: 551824 - RNA, 64 nt, Homo Sapiens; identical to SEQ ID NO: 328643

SEQ ID NO: 551825 - RNA, 64 nt, Homo Sapiens; identical to SEQ ID NO: 328644

SEQ ID NO: 551826 - RNA, 64 nt, Homo Sapiens; identical to SEQ ID NO: 328645

SEQ ID NO: 551827 - RNA, 64 nt, Homo Sapiens; identical to SEQ ID NO: 328646

SEQ ID NO: 551828 - RNA, 64 nt, Homo Sapiens; identical to SEQ ID NO: 328647

SEQ ID NO: 551829 - RNA, 64 nt, Homo Sapiens; identical to SEQ ID NO: 328648

SEQ ID NO: 551830 - RNA, 64 nt, Homo Sapiens; identical to SEQ ID NO: 328649

SEQ ID NO: 551831 - RNA, 64 nt, Homo Sapiens; identical to SEQ ID NO: 328650

SEQ ID NO: 551832 - RNA, 64 nt, Homo Sapiens; identical to SEQ ID NO: 328651

SEQ ID NO: 551833 - RNA, 64 nt, Homo Sapiens; identical to SEQ ID NO: 328652

SEQ ID NO: 551834 - RNA, 64 nt, Homo Sapiens; identical to SEQ ID NO: 328653

SEQ ID NO: 551835 - RNA, 64 nt, Homo Sapiens; identical to SEQ ID NO: 328654

SEQ ID NO: 551836 - RNA, 64 nt, Homo Sapiens; identical to SEQ ID NO: 328655

SEQ ID NO: 551837 - RNA, 64 nt, Homo Sapiens; identical to SEQ ID NO: 328656

SEQ ID NO: 551838 - RNA, 64 nt, Homo Sapiens; identical to SEQ ID NO: 328657

SEQ ID NO: 551839 - RNA, 64 nt, Homo Sapiens; identical to SEQ ID NO: 328658

SEQ ID NO: 551840 - RNA, 64 nt, Homo Sapiens; identical to SEQ ID NO: 328659

SEQ ID NO: 551841 - RNA, 64 nt, Homo Sapiens; identical to SEQ ID NO: 328660

SEQ ID NO: 551842 - RNA, 64 nt, Homo Sapiens; identical to SEQ ID NO: 328661

SEQ ID NO: 551843 - RNA, 64 nt, Homo Sapiens; identical to SEQ ID NO: 328662

SEQ ID NO: 551844 - RNA, 64 nt, Homo Sapiens; identical to SEQ ID NO: 328663

SEQ ID NO: 551845 - RNA, 64 nt, Homo Sapiens; identical to SEQ ID NO: 328664

SEQ ID NO: 551846 - RNA, 64 nt, Homo Sapiens; identical to SEQ ID NO: 328665

SEQ ID NO: 551847 - RNA, 64 nt, Homo Sapiens; identical to SEQ ID NO: 328664

SEQ ID NO: 551848 - RNA, 64 nt, Homo Sapiens; identical to SEQ ID NO: 328665

SEQ ID NO: 551849 - RNA, 62 nt, Homo Sapiens
aaagacuuuaaaaaaugguaaugaaaauggaaugcagcuacugcagcuaauaaaaaauuuua

SEQ ID NO: 551850 - RNA, 62 nt, Homo Sapiens
aaaaaaugguaaugaaaauggaaugcagcuacugcagcuaauaaaaaauuuuagauagcaau

SEQ ID NO: 551851 - RNA, 62 nt, Homo Sapiens
cagggcagugcugcugcagagcuagaaggcccugcagcuacagcugcuucauucccugcauu

SEQ ID NO: 551852 - RNA, 62 nt, Homo Sapiens
uacacugagcgggcuacagagcuagaaggcccugcagcuacagcugcuucauucccugcauu

SEQ ID NO: 551853 - RNA, 62 nt, Homo Sapiens
aucaugucucagcacuccagaucauagcucacugcagcuaugagcuaucaucugcagcuaua

SEQ ID NO: 551854 - RNA, 62 nt, Homo Sapiens
aucauagcucacugcagcuagcagcuaucaucugcagcuauagagucuaggaguucggggcu

SEQ ID NO: 551855 - RNA, 62 nt, Homo Sapiens
aucugcagcuauaaucauagggaguucggggcugcagcuaucuguaggaucacuugagucua

SEQ ID NO: 551856 - RNA, 62 nt, Homo Sapiens
gggaaagccagaagguugcuugugucugugacugcagcuauggccuuguuugcuuaguuuau

SEQ ID NO: 551857 - RNA, 62 nt, Homo Sapiens
cuuugguugucaugagaaagagacauucuccuugcagcuaccuccaugugagugaauuccug

SEQ ID NO: 551858 - RNA, 62 nt, Homo Sapiens
caaugcugugaguuuccaacuuugacgggaacacugcagagaauuaaauucagccuaaacuu

SEQ ID NO: 551859 - RNA, 62 nt, Homo Sapiens
guagaacacugagcaggacaaaucaccagacaacugcagaaugccugaguuucauaggaggu

SEQ ID NO: 551860 - RNA, 62 nt, Homo Sapiens
gauuuuuacugagaagagauaugccuguuguuacugcagaaccugaaccguaaguaggauga

SEQ ID NO: 551861 - RNA, 62 nt, Homo Sapiens
uaagcauaaaaagaaagggaaaaagcagaaacacugcagaagacacaaacaaacaaagaaga

SEQ ID NO: 551862 - RNA, 62 nt, Homo Sapiens
agccugguuucauaccgaaaagacauugaaggacugcagaaauguaugggugcaccgggccg

SEQ ID NO: 551863 - RNA, 62 nt, Homo Sapiens
ucucuucugucccgucaccaggcucuugcuucacugcagauacaguucacucugaaagcugg

SEQ ID NO: 551864 - RNA, 62 nt, Homo Sapiens
ccagaacagaaggccacaggcaauacacacacacugcagaacucuuacccacauuccccaau

SEQ ID NO: 551865 - RNA, 62 nt, Homo Sapiens
gaacacauuucggcgaggguccccgcaucagcacugcagagaacuccucucugguaccccau

SEQ ID NO: 551866 - RNA, 62 nt, Homo Sapiens
cuucauguaaauaaaaacuauuacauuuuuguacugcagacgcuauuaugagcuaucaaagu

SEQ ID NO: 551867 - RNA, 62 nt, Homo Sapiens
cgcucuaggaagaacuggagccgacccccaccacugcagacuggcuucaugcauuauggauc

SEQ ID NO: 551868 - RNA, 62 nt, Homo Sapiens
ucuacuguaaugagacaagccuuucuucugucacugcagaauuuagaaggggccgugagcag

SEQ ID NO: 551869 - RNA, 62 nt, Homo Sapiens
aggcaucaagaagccagggccgugccuggagcacugcagagaugacuuuggagaaagcaaag

SEQ ID NO: 551870 - RNA, 62 nt, Homo Sapiens
uuagaucuaauguauacugcgugugcuuagaaacugcagauuaucugaaagaucuaaacaug

SEQ ID NO: 551871 - RNA, 62 nt, Homo Sapiens
gaucugaaagaucuaaacauaaauaaccuaaaacugcagaagacuuaaagguaccucuguag

SEQ ID NO: 551872 - RNA, 62 nt, Homo Sapiens
ccucucgugguccucagccccucacccccaguacugcagaucucacaguuugccuuccagaa

SEQ ID NO: 551873 - RNA, 62 nt, Homo Sapiens
ggcucugcuggcucagugugggcugcaggaggacugcagacucagcugcaauucugaggggg

SEQ ID NO: 551874 - RNA, 62 nt, Homo Sapiens
acgcugcuagucuuaaccccagaccagagagaacugcagaucugacugggccuaaauuaagu

SEQ ID NO: 551875 - RNA, 62 nt, Homo Sapiens
ucuguauuaacagcaauguuacucucaaugaaacugcagaagccaccaugaacauggaagac

SEQ ID NO: 551876 - RNA, 62 nt, Homo Sapiens
augugcagguacuaugcaugucuguguuacagacugcagagggcuacauagaagggacaggg

SEQ ID NO: 551877 - RNA, 62 nt, Homo Sapiens
aaauucacaggaaaaaucaauuuaagcuugaaacugcagaagcuggaaaagaugccauucuu

SEQ ID NO: 551878 - RNA, 62 nt, Homo Sapiens
augucguaggugauagaaaacucgccuacuccacugcagaacuugcagaaugcgugguguua

SEQ ID NO: 551879 - RNA, 62 nt, Homo Sapiens
gucagagauaauugccuauacuaagaaucuauacugcagaauauaguguaucaaaaacuuuu

SEQ ID NO: 551880 - RNA, 62 nt, Homo Sapiens
ggcagcucagaagaaugcagguuucucagcacacugcagaagaccgugugaagcuagggggu

SEQ ID NO: 551881 - RNA, 62 nt, Homo Sapiens
aagggguguuguuagaugcuuuucuugauuuuacugcagaucuuuggauguauacacacaug

SEQ ID NO: 551882 - RNA, 62 nt, Homo Sapiens
auagauuuuuuuuuaauauaguaugucaaaagacugcagacucacauauccacccuugagaa

SEQ ID NO: 551883 - RNA, 62 nt, Homo Sapiens
uauuaaggauguuaggagagggugcugcccacacugcagauacccucucugcugcuuuuguu

SEQ ID NO: 551884 - RNA, 62 nt, Homo Sapiens
uucuuaaaaccaaucaauaauagcuagcuauuacugcagacuauaaaaucuggauauagaaa

SEQ ID NO: 551885 - RNA, 62 nt, Homo Sapiens
auaaacauuuaaagacaaagacauuucaaauaacugcagaaaaaauauuguaguuugaauau

SEQ ID NO: 551886 - RNA, 62 nt, Homo Sapiens
aucacuggaauccagaucgaaggcaggugggcacugcagaggcuucuucagucgcucccugg

SEQ ID NO: 551887 - RNA, 62 nt, Homo Sapiens
uuccuuaugaugauugugugcuugaaaaagcaacugcagaaaaaaggacuggggaggcgugu

SEQ ID NO: 551888 - RNA, 62 nt, Homo Sapiens
uuacuuuuuuccccccaaauagguauauauagacugcagaagcuucagucccauauauaaac

SEQ ID NO: 551889 - RNA, 62 nt, Homo Sapiens
aguguuuuugagaauuuuuauauauauuacucacugcagagaucauguucauuuacauuccc

SEQ ID NO: 551890 - RNA, 62 nt, Homo Sapiens
ccauuuuguuuuuccagaguucguggagguggacugcagagcccagagcccuucaucucucu

SEQ ID NO: 551891 - RNA, 62 nt, Homo Sapiens
uuggagaguggaucagagagacuaggacaguuacugcagagcuccuaagucaccacucaacc

SEQ ID NO: 551892 - RNA, 62 nt, Homo Sapiens
ucaucugaugcauuuggaccauaugcugccagacugcagaacgggggagccggggcucaggg

SEQ ID NO: 551893 - RNA, 62 nt, Homo Sapiens
ggguuguguggacaccccucgcucugaugccaacugcagauaauacacaccuccugcagcgu

SEQ ID NO: 551894 - RNA, 62 nt, Homo Sapiens
ucaggacuguccuggcuccgaccuuuguguacacugcagacgcugguucugaggaacuguug

SEQ ID NO: 551895 - RNA, 62 nt, Homo Sapiens
ccuuucaugcugcauauuaacugguuaauuauacugcagaaaccuuuucaccuccacuaguc

SEQ ID NO: 551896 - RNA, 62 nt, Homo Sapiens
aaucuuacaaaugugaagaccauagucuucauacugcagagaagucacaccuugcaagucau

SEQ ID NO: 551897 - RNA, 62 nt, Homo Sapiens
aacuuuacaaauaggaagaacauagaauucauacugcagagaaaacaacccuugcacgucau

SEQ ID NO: 551898 - RNA, 62 nt, Homo Sapiens
aaauauucauguagcaaaucugagaauugaaaacugcagauaaccggccggguauggugacu

SEQ ID NO: 551899 - RNA, 62 nt, Homo Sapiens
aaaaaaaaaaaacagaaagaaagaaaaagaaaacugcagauaacccuauacauuaauacugg

SEQ ID NO: 551900 - RNA, 62 nt, Homo Sapiens
caccggugaggaagggucucuuccucccaggcacugcagaggggaagggucuccaggcuuua

SEQ ID NO: 551901 - RNA, 62 nt, Homo Sapiens
cccgguggggaagggucuccuugcucccaggcacugcagaggguucagggagaacagcugcg

SEQ ID NO: 551902 - RNA, 66 nt, Homo Sapiens
aucauugugcggauuaaaagaaauaauauauguaaagcacuuuaacacagcaccaggcccacggaa

SEQ ID NO: 551903 - RNA, 66 nt, Homo Sapiens
ggcaaggggaucuuuggggcuaacuucgggaucccugcacuuuauguaagaauguaaaccuggagu

SEQ ID NO: 551904 - RNA, 66 nt, Homo Sapiens
auuguuauagggaguaguuuuuucccuuaggacucugcacuuuauagaauguuguaaaacagacaa

SEQ ID NO: 551905 - RNA, 66 nt, Homo Sapiens
ugggcugauaguuuuguuuaagguuuuggauaaggagcacuuuaaaacaaacugguguguuguuuu

SEQ ID NO: 551906 - RNA, 66 nt, Homo Sapiens
uucuuauucucuagguucugagagugaaugcauugggcacuuuaaguugauauuuucucuucuccg

SEQ ID NO: 551907 - RNA, 66 nt, Homo Sapiens
uaaaguguccacaacaguuagggaaaugaugcuagagcacuuuaaaaaucagcaggacaacccuga

SEQ ID NO: 551908 - RNA, 66 nt, Homo Sapiens
uuucuaccugcauauggacuuuaacuugcuucuguugcacuuuaguuauaagugaguacacucuaa

SEQ ID NO: 551909 - RNA, 66 nt, Homo Sapiens
aaaagugaaagcgacaaauuuaugacauuuuauguagcacuuuauauauguuuuuaaauuuggaaa

SEQ ID NO: 551910 - RNA, 66 nt, Homo Sapiens
aggaugcuagucuuugugaccgauugcuaaucuucugcacuuuaauuuauuuuauauaaacuuuac

SEQ ID NO: 551911 - RNA, 66 nt, Homo Sapiens
ucgacaaucaagaauguuauuaauguguaauacugagcacuuuacuucuuaauaaaaacuugauau

SEQ ID NO: 551912 - RNA, 66 nt, Homo Sapiens
aauguaacaaacuuacaaggacaaagaggcuuguuggcacuuuacauauacaguguauacaugugu

SEQ ID NO: 551913 - RNA, 66 nt, Homo Sapiens
ugucaaacgaagacauuccaauacugcuuaauuauagcacuuuauuuuuagcugcugaacugccaa

SEQ ID NO: 551914 - RNA, 66 nt, Homo Sapiens
cacaguuaugucuuauaacuuacuuuaauuugaaaugcacuuuauguaaauuucucuccugauggg

SEQ ID NO: 551915 - RNA, 66 nt, Homo Sapiens
uuucucuccugauggguacuaaguaccuuauguauugcacuuuaaauagcaacuuugcacuaugua

SEQ ID NO: 551916 - RNA, 66 nt, Homo Sapiens
cuguuguguucuauuuccacaacugagggucucaaagcacuuuaaauguauucacguguacuguuu

SEQ ID NO: 551917 - RNA, 66 nt, Homo Sapiens
aaauauaagggagaaaaugauaaaugaguuuuuaaagcacuuuagaccucugaaaaauguguagau

SEQ ID NO: 551918 - RNA, 66 nt, Homo Sapiens
cauacaaaauaaucaaaauauccuaauccagucucagcacuuuauuacuggaggcccauucuguau

SEQ ID NO: 551919 - RNA, 66 nt, Homo Sapiens
gccauuugcacuuuucaaaugccuuuggaugacccagcacuuuaaucugaaaccugcaacaagacu

SEQ ID NO: 551920 - RNA, 66 nt, Homo Sapiens
caccucuggagccuauggcuuuaagcaagcacuacugcacuuuacagaauuaccccacuggauccu

SEQ ID NO: 551921 - RNA, 66 nt, Homo Sapiens
cgcaggaguucuuagcuccucagcgagcaacagagagcacuuuagauggcaccuuucaccacuugg

SEQ ID NO: 551922 - RNA, 66 nt, Homo Sapiens
uuauucuauuuauaucuuauuacaauaaaauuaguggcacuuuauucauaaauauucaugagccug

SEQ ID NO: 551923 - RNA, 66 nt, Homo Sapiens
ucuuuauuuaaauuuuuuuuuuagagugcacugagugcacuuuacagagugugaagguaguacuuu

SEQ ID NO: 551924 - RNA, 66 nt, Homo Sapiens
uaaccaaagcuuagcaguuugauacaucauugaacugcacuuuauauggauuugaaugauugggau

SEQ ID NO: 551925 - RNA, 66 nt, Homo Sapiens
cuaaugggucacaaaucuuguuugcacugaacauaagcacuuuauagcccuucugagucugccuuu

SEQ ID NO: 551926 - RNA, 66 nt, Homo Sapiens
uuagacuugccacucugaaaucuccauuuaaaagaggcacuuuacuuucugaacaaaugaaacucu

SEQ ID NO: 551927 - RNA, 66 nt, Homo Sapiens
guccuguggcuugugaccucugccaauaaauuucaugcacuuuaaaugguauacaugcggcuucau

SEQ ID NO: 551928 - RNA, 66 nt, Homo Sapiens
cauuucuuuuaaaaggucuaauucaugcagagcaaagcacuuuaacguggugccacccucucuggc

SEQ ID NO: 551929 - RNA, 66 nt, Homo Sapiens
aaagguuuuguuucaguuuguaagauuucuuuucuggcacuuuaauggcuugagguaucauuauca

SEQ ID NO: 551930 - RNA, 66 nt, Homo Sapiens
cuuggcagggcacgguagcucacaccuguaaucccagcacuuuaggaggucaaggugggcagauca

SEQ ID NO: 551931 - RNA, 66 nt, Homo Sapiens
gacuuggauuuuguaaaucuaaauuugugauugaaagcacuuuaguaccaggcuuuuggucuuuca

SEQ ID NO: 551932 - RNA, 66 nt, Homo Sapiens
caguuaacuuggugcaaaacaaacgguuccuuaauggcacuuuaacucuauuucauucuagaaugg

SEQ ID NO: 551933 - RNA, 66 nt, Homo Sapiens
cgccgaagacagcccugcagauuguauuccucaguagcacuuuaaagaugaacuuacgugacaaug

SEQ ID NO: 551934 - RNA, 66 nt, Homo Sapiens
uucgucaaguuucaagucugugagaguuuugacagagcacuuuauuuuccagcugaaaaccugcug

SEQ ID NO: 551935 - RNA, 65 nt, Homo Sapiens; identical to SEQ ID NO: 192258

SEQ ID NO: 551936 - RNA, 65 nt, Homo Sapiens; identical to SEQ ID NO: 192259

SEQ ID NO: 551937 - RNA, 65 nt, Homo Sapiens; identical to SEQ ID NO: 192260

SEQ ID NO: 551938 - RNA, 65 nt, Homo Sapiens; identical to SEQ ID NO: 192261

SEQ ID NO: 551939 - RNA, 65 nt, Homo Sapiens; identical to SEQ ID NO: 192262

SEQ ID NO: 551940 - RNA, 65 nt, Homo Sapiens; identical to SEQ ID NO: 192263

SEQ ID NO: 551941 - RNA, 65 nt, Homo Sapiens; identical to SEQ ID NO: 192264

SEQ ID NO: 551942 - RNA, 65 nt, Homo Sapiens; identical to SEQ ID NO: 192265

SEQ ID NO: 551943 - RNA, 65 nt, Homo Sapiens; identical to SEQ ID NO: 192266

SEQ ID NO: 551944 - RNA, 65 nt, Homo Sapiens; identical to SEQ ID NO: 192267

SEQ ID NO: 551945 - RNA, 65 nt, Homo Sapiens; identical to SEQ ID NO: 192268

SEQ ID NO: 551946 - RNA, 65 nt, Homo Sapiens; identical to SEQ ID NO: 192269

SEQ ID NO: 551947 - RNA, 65 nt, Homo Sapiens; identical to SEQ ID NO: 192270

SEQ ID NO: 551948 - RNA, 65 nt, Homo Sapiens; identical to SEQ ID NO: 192271

SEQ ID NO: 551949 - RNA, 65 nt, Homo Sapiens; identical to SEQ ID NO: 192272

SEQ ID NO: 551950 - RNA, 65 nt, Homo Sapiens; identical to SEQ ID NO: 192273

SEQ ID NO: 551951 - RNA, 65 nt, Homo Sapiens; identical to SEQ ID NO: 192274

SEQ ID NO: 551952 - RNA, 65 nt, Homo Sapiens; identical to SEQ ID NO: 192275

SEQ ID NO: 551953 - RNA, 65 nt, Homo Sapiens; identical to SEQ ID NO: 192276

SEQ ID NO: 551954 - RNA, 65 nt, Homo Sapiens; identical to SEQ ID NO: 192277

SEQ ID NO: 551955 - RNA, 65 nt, Homo Sapiens; identical to SEQ ID NO: 192278

SEQ ID NO: 551956 - RNA, 65 nt, Homo Sapiens; identical to SEQ ID NO: 192279

SEQ ID NO: 551957 - RNA, 65 nt, Homo Sapiens; identical to SEQ ID NO: 192280

SEQ ID NO: 551958 - RNA, 65 nt, Homo Sapiens; identical to SEQ ID NO: 192281

SEQ ID NO: 551959 - RNA, 65 nt, Homo Sapiens; identical to SEQ ID NO: 192282

SEQ ID NO: 551960 - RNA, 65 nt, Homo Sapiens; identical to SEQ ID NO: 192283

SEQ ID NO: 551961 - RNA, 65 nt, Homo Sapiens; identical to SEQ ID NO: 192284

SEQ ID NO: 551962 - RNA, 65 nt, Homo Sapiens; identical to SEQ ID NO: 192285

SEQ ID NO: 551963 - RNA, 65 nt, Homo Sapiens; identical to SEQ ID NO: 192286

SEQ ID NO: 551964 - RNA, 65 nt, Homo Sapiens; identical to SEQ ID NO: 192287

SEQ ID NO: 551965 - RNA, 65 nt, Homo Sapiens; identical to SEQ ID NO: 192288

SEQ ID NO: 551966 - RNA, 65 nt, Homo Sapiens; identical to SEQ ID NO: 192289

SEQ ID NO: 551967 - RNA, 65 nt, Homo Sapiens; identical to SEQ ID NO: 192290

SEQ ID NO: 551968 - RNA, 65 nt, Homo Sapiens; identical to SEQ ID NO: 192291

SEQ ID NO: 551969 - RNA, 65 nt, Homo Sapiens; identical to SEQ ID NO: 192292

SEQ ID NO: 551970 - RNA, 65 nt, Homo Sapiens; identical to SEQ ID NO: 192293

SEQ ID NO: 551971 - RNA, 65 nt, Homo Sapiens; identical to SEQ ID NO: 192294

SEQ ID NO: 551972 - RNA, 65 nt, Homo Sapiens; identical to SEQ ID NO: 192295

SEQ ID NO: 551973 - RNA, 65 nt, Homo Sapiens; identical to SEQ ID NO: 192296

SEQ ID NO: 551974 - RNA, 65 nt, Homo Sapiens; identical to SEQ ID NO: 192297

SEQ ID NO: 551975 - RNA, 65 nt, Homo Sapiens; identical to SEQ ID NO: 192298

SEQ ID NO: 551976 - RNA, 65 nt, Homo Sapiens; identical to SEQ ID NO: 192299

SEQ ID NO: 551977 - RNA, 65 nt, Homo Sapiens; identical to SEQ ID NO: 192300

SEQ ID NO: 551978 - RNA, 65 nt, Homo Sapiens; identical to SEQ ID NO: 192301

SEQ ID NO: 551979 - RNA, 65 nt, Homo Sapiens; identical to SEQ ID NO: 192302

SEQ ID NO: 551980 - RNA, 65 nt, Homo Sapiens; identical to SEQ ID NO: 192303

SEQ ID NO: 551981 - RNA, 65 nt, Homo Sapiens; identical to SEQ ID NO: 192304

SEQ ID NO: 551982 - RNA, 65 nt, Homo Sapiens; identical to SEQ ID NO: 192305

SEQ ID NO: 551983 - RNA, 65 nt, Homo Sapiens; identical to SEQ ID NO: 192306

SEQ ID NO: 551984 - RNA, 65 nt, Homo Sapiens; identical to SEQ ID NO: 192307

SEQ ID NO: 551985 - RNA, 65 nt, Homo Sapiens; identical to SEQ ID NO: 192308

SEQ ID NO: 551986 - RNA, 65 nt, Homo Sapiens; identical to SEQ ID NO: 192309

SEQ ID NO: 551987 - RNA, 65 nt, Homo Sapiens; identical to SEQ ID NO: 192310

SEQ ID NO: 551988 - RNA, 65 nt, Homo Sapiens; identical to SEQ ID NO: 192311

SEQ ID NO: 551989 - RNA, 65 nt, Homo Sapiens; identical to SEQ ID NO: 192312

SEQ ID NO: 551990 - RNA, 65 nt, Homo Sapiens; identical to SEQ ID NO: 192313

SEQ ID NO: 551991 - RNA, 65 nt, Homo Sapiens; identical to SEQ ID NO: 192314

SEQ ID NO: 551992 - RNA, 65 nt, Homo Sapiens; identical to SEQ ID NO: 192315

SEQ ID NO: 551993 - RNA, 65 nt, Homo Sapiens; identical to SEQ ID NO: 192316

SEQ ID NO: 551994 - RNA, 65 nt, Homo Sapiens; identical to SEQ ID NO: 192317

SEQ ID NO: 551995 - RNA, 65 nt, Homo Sapiens; identical to SEQ ID NO: 192318

SEQ ID NO: 551996 - RNA, 65 nt, Homo Sapiens; identical to SEQ ID NO: 192319

SEQ ID NO: 551997 - RNA, 65 nt, Homo Sapiens; identical to SEQ ID NO: 192320

SEQ ID NO: 551998 - RNA, 65 nt, Homo Sapiens; identical to SEQ ID NO: 192321

SEQ ID NO: 551999 - RNA, 65 nt, Homo Sapiens; identical to SEQ ID NO: 192322

SEQ ID NO: 552000 - RNA, 65 nt, Homo Sapiens; identical to SEQ ID NO: 192323

SEQ ID NO: 552001 - RNA, 65 nt, Homo Sapiens; identical to SEQ ID NO: 192324

SEQ ID NO: 552002 - RNA, 65 nt, Homo Sapiens; identical to SEQ ID NO: 192325

SEQ ID NO: 552003 - RNA, 65 nt, Homo Sapiens; identical to SEQ ID NO: 192326

SEQ ID NO: 552004 - RNA, 65 nt, Homo Sapiens; identical to SEQ ID NO: 192327

SEQ ID NO: 552005 - RNA, 65 nt, Homo Sapiens; identical to SEQ ID NO: 192328

SEQ ID NO: 552006 - RNA, 65 nt, Homo Sapiens; identical to SEQ ID NO: 192329

SEQ ID NO: 552007 - RNA, 65 nt, Homo Sapiens; identical to SEQ ID NO: 192330

SEQ ID NO: 552008 - RNA, 65 nt, Homo Sapiens; identical to SEQ ID NO: 192331

SEQ ID NO: 552009 - RNA, 65 nt, Homo Sapiens; identical to SEQ ID NO: 192332

SEQ ID NO: 552010 - RNA, 65 nt, Homo Sapiens; identical to SEQ ID NO: 192333

SEQ ID NO: 552011 - RNA, 65 nt, Homo Sapiens; identical to SEQ ID NO: 192334

SEQ ID NO: 552012 - RNA, 65 nt, Homo Sapiens; identical to SEQ ID NO: 192335

SEQ ID NO: 552013 - RNA, 65 nt, Homo Sapiens; identical to SEQ ID NO: 192336

SEQ ID NO: 552014 - RNA, 65 nt, Homo Sapiens; identical to SEQ ID NO: 192337

SEQ ID NO: 552015 - RNA, 65 nt, Homo Sapiens; identical to SEQ ID NO: 192338

SEQ ID NO: 552016 - RNA, 65 nt, Homo Sapiens; identical to SEQ ID NO: 192339

SEQ ID NO: 552017 - RNA, 65 nt, Homo Sapiens; identical to SEQ ID NO: 192340

SEQ ID NO: 552018 - RNA, 65 nt, Homo Sapiens; identical to SEQ ID NO: 192341

SEQ ID NO: 552019 - RNA, 65 nt, Homo Sapiens; identical to SEQ ID NO: 192342

SEQ ID NO: 552020 - RNA, 65 nt, Homo Sapiens; identical to SEQ ID NO: 192343

SEQ ID NO: 552021 - RNA, 65 nt, Homo Sapiens; identical to SEQ ID NO: 192344

SEQ ID NO: 552022 - RNA, 65 nt, Homo Sapiens; identical to SEQ ID NO: 192345

SEQ ID NO: 552023 - RNA, 65 nt, Homo Sapiens; identical to SEQ ID NO: 192346

SEQ ID NO: 552024 - RNA, 65 nt, Homo Sapiens; identical to SEQ ID NO: 192347

SEQ ID NO: 552025 - RNA, 65 nt, Homo Sapiens; identical to SEQ ID NO: 192348

SEQ ID NO: 552026 - RNA, 65 nt, Homo Sapiens; identical to SEQ ID NO: 192349

SEQ ID NO: 552027 - RNA, 65 nt, Homo Sapiens; identical to SEQ ID NO: 192350

SEQ ID NO: 552028 - RNA, 65 nt, Homo Sapiens; identical to SEQ ID NO: 192351

SEQ ID NO: 552029 - RNA, 65 nt, Homo Sapiens; identical to SEQ ID NO: 192352

SEQ ID NO: 552030 - RNA, 65 nt, Homo Sapiens; identical to SEQ ID NO: 192353

SEQ ID NO: 552031 - RNA, 65 nt, Homo Sapiens; identical to SEQ ID NO: 192354

SEQ ID NO: 552032 - RNA, 65 nt, Homo Sapiens; identical to SEQ ID NO: 192355

SEQ ID NO: 552033 - RNA, 65 nt, Homo Sapiens; identical to SEQ ID NO: 192356

SEQ ID NO: 552034 - RNA, 65 nt, Homo Sapiens; identical to SEQ ID NO: 192357

SEQ ID NO: 552035 - RNA, 65 nt, Homo Sapiens; identical to SEQ ID NO: 192358

SEQ ID NO: 552036 - RNA, 65 nt, Homo Sapiens; identical to SEQ ID NO: 192359

SEQ ID NO: 552037 - RNA, 65 nt, Homo Sapiens; identical to SEQ ID NO: 192360

SEQ ID NO: 552038 - RNA, 65 nt, Homo Sapiens; identical to SEQ ID NO: 192361

SEQ ID NO: 552039 - RNA, 65 nt, Homo Sapiens; identical to SEQ ID NO: 192362

SEQ ID NO: 552040 - RNA, 65 nt, Homo Sapiens; identical to SEQ ID NO: 192363

SEQ ID NO: 552041 - RNA, 65 nt, Homo Sapiens; identical to SEQ ID NO: 192364

SEQ ID NO: 552042 - RNA, 65 nt, Homo Sapiens; identical to SEQ ID NO: 192365

SEQ ID NO: 552043 - RNA, 65 nt, Homo Sapiens; identical to SEQ ID NO: 192366

SEQ ID NO: 552044 - RNA, 65 nt, Homo Sapiens; identical to SEQ ID NO: 192367

SEQ ID NO: 552045 - RNA, 65 nt, Homo Sapiens; identical to SEQ ID NO: 192368

SEQ ID NO: 552046 - RNA, 65 nt, Homo Sapiens; identical to SEQ ID NO: 192369

SEQ ID NO: 552047 - RNA, 65 nt, Homo Sapiens; identical to SEQ ID NO: 192370

SEQ ID NO: 552048 - RNA, 65 nt, Homo Sapiens; identical to SEQ ID NO: 192371

SEQ ID NO: 552049 - RNA, 65 nt, Homo Sapiens; identical to SEQ ID NO: 192372

SEQ ID NO: 552050 - RNA, 65 nt, Homo Sapiens; identical to SEQ ID NO: 192373

SEQ ID NO: 552051 - RNA, 65 nt, Homo Sapiens; identical to SEQ ID NO: 192374

SEQ ID NO: 552052 - RNA, 65 nt, Homo Sapiens; identical to SEQ ID NO: 192375

SEQ ID NO: 552053 - RNA, 65 nt, Homo Sapiens; identical to SEQ ID NO: 192376

SEQ ID NO: 552054 - RNA, 65 nt, Homo Sapiens; identical to SEQ ID NO: 192377

SEQ ID NO: 552055 - RNA, 65 nt, Homo Sapiens; identical to SEQ ID NO: 192378

SEQ ID NO: 552056 - RNA, 65 nt, Homo Sapiens; identical to SEQ ID NO: 192379

SEQ ID NO: 552057 - RNA, 65 nt, Homo Sapiens; identical to SEQ ID NO: 192380

SEQ ID NO: 552058 - RNA, 65 nt, Homo Sapiens; identical to SEQ ID NO: 192381

SEQ ID NO: 552059 - RNA, 65 nt, Homo Sapiens; identical to SEQ ID NO: 192382

SEQ ID NO: 552060 - RNA, 65 nt, Homo Sapiens; identical to SEQ ID NO: 192383

SEQ ID NO: 552061 - RNA, 65 nt, Homo Sapiens; identical to SEQ ID NO: 192384

SEQ ID NO: 552062 - RNA, 65 nt, Homo Sapiens; identical to SEQ ID NO: 192385

SEQ ID NO: 552063 - RNA, 65 nt, Homo Sapiens; identical to SEQ ID NO: 192386

SEQ ID NO: 552064 - RNA, 65 nt, Homo Sapiens; identical to SEQ ID NO: 192387

SEQ ID NO: 552065 - RNA, 65 nt, Homo Sapiens; identical to SEQ ID NO: 192388

SEQ ID NO: 552066 - RNA, 65 nt, Homo Sapiens; identical to SEQ ID NO: 192389

SEQ ID NO: 552067 - RNA, 65 nt, Homo Sapiens; identical to SEQ ID NO: 192390

SEQ ID NO: 552068 - RNA, 65 nt, Homo Sapiens; identical to SEQ ID NO: 192391

SEQ ID NO: 552069 - RNA, 65 nt, Homo Sapiens; identical to SEQ ID NO: 192392

SEQ ID NO: 552070 - RNA, 65 nt, Homo Sapiens; identical to SEQ ID NO: 192393

SEQ ID NO: 552071 - RNA, 65 nt, Homo Sapiens; identical to SEQ ID NO: 192394

SEQ ID NO: 552072 - RNA, 65 nt, Homo Sapiens; identical to SEQ ID NO: 192395

SEQ ID NO: 552073 - RNA, 65 nt, Homo Sapiens; identical to SEQ ID NO: 192396

SEQ ID NO: 552074 - RNA, 65 nt, Homo Sapiens; identical to SEQ ID NO: 192397

SEQ ID NO: 552075 - RNA, 65 nt, Homo Sapiens; identical to SEQ ID NO: 192398

SEQ ID NO: 552076 - RNA, 65 nt, Homo Sapiens; identical to SEQ ID NO: 192399

SEQ ID NO: 552077 - RNA, 65 nt, Homo Sapiens; identical to SEQ ID NO: 192400

SEQ ID NO: 552078 - RNA, 65 nt, Homo Sapiens; identical to SEQ ID NO: 192401

SEQ ID NO: 552079 - RNA, 65 nt, Homo Sapiens; identical to SEQ ID NO: 192402

SEQ ID NO: 552080 - RNA, 65 nt, Homo Sapiens; identical to SEQ ID NO: 192403

SEQ ID NO: 552081 - RNA, 65 nt, Homo Sapiens; identical to SEQ ID NO: 192404

SEQ ID NO: 552082 - RNA, 65 nt, Homo Sapiens; identical to SEQ ID NO: 192405

SEQ ID NO: 552083 - RNA, 65 nt, Homo Sapiens; identical to SEQ ID NO: 192406

SEQ ID NO: 552084 - RNA, 65 nt, Homo Sapiens; identical to SEQ ID NO: 192407

SEQ ID NO: 552085 - RNA, 65 nt, Homo Sapiens; identical to SEQ ID NO: 192408

SEQ ID NO: 552086 - RNA, 65 nt, Homo Sapiens; identical to SEQ ID NO: 192409

SEQ ID NO: 552087 - RNA, 65 nt, Homo Sapiens; identical to SEQ ID NO: 192410

SEQ ID NO: 552088 - RNA, 65 nt, Homo Sapiens; identical to SEQ ID NO: 192411

SEQ ID NO: 552089 - RNA, 65 nt, Homo Sapiens; identical to SEQ ID NO: 192412

SEQ ID NO: 552090 - RNA, 65 nt, Homo Sapiens; identical to SEQ ID NO: 192413

SEQ ID NO: 552091 - RNA, 65 nt, Homo Sapiens; identical to SEQ ID NO: 192414

SEQ ID NO: 552092 - RNA, 65 nt, Homo Sapiens; identical to SEQ ID NO: 192415

SEQ ID NO: 552093 - RNA, 65 nt, Homo Sapiens; identical to SEQ ID NO: 192416

SEQ ID NO: 552094 - RNA, 65 nt, Homo Sapiens; identical to SEQ ID NO: 192417

SEQ ID NO: 552095 - RNA, 65 nt, Homo Sapiens; identical to SEQ ID NO: 192418

SEQ ID NO: 552096 - RNA, 65 nt, Homo Sapiens; identical to SEQ ID NO: 192419

SEQ ID NO: 552097 - RNA, 65 nt, Homo Sapiens; identical to SEQ ID NO: 192420

SEQ ID NO: 552098 - RNA, 65 nt, Homo Sapiens; identical to SEQ ID NO: 192421

SEQ ID NO: 552099 - RNA, 65 nt, Homo Sapiens; identical to SEQ ID NO: 192422

SEQ ID NO: 552100 - RNA, 65 nt, Homo Sapiens; identical to SEQ ID NO: 192423

SEQ ID NO: 552101 - RNA, 65 nt, Homo Sapiens; identical to SEQ ID NO: 192424

SEQ ID NO: 552102 - RNA, 65 nt, Homo Sapiens; identical to SEQ ID NO: 192425

SEQ ID NO: 552103 - RNA, 65 nt, Homo Sapiens; identical to SEQ ID NO: 192426

SEQ ID NO: 552104 - RNA, 65 nt, Homo Sapiens; identical to SEQ ID NO: 192427

SEQ ID NO: 552105 - RNA, 65 nt, Homo Sapiens; identical to SEQ ID NO: 192428

SEQ ID NO: 552106 - RNA, 65 nt, Homo Sapiens; identical to SEQ ID NO: 192429

SEQ ID NO: 552107 - RNA, 65 nt, Homo Sapiens; identical to SEQ ID NO: 192430

SEQ ID NO: 552108 - RNA, 65 nt, Homo Sapiens; identical to SEQ ID NO: 192431

SEQ ID NO: 552109 - RNA, 65 nt, Homo Sapiens; identical to SEQ ID NO: 192432

SEQ ID NO: 552110 - RNA, 65 nt, Homo Sapiens; identical to SEQ ID NO: 192433

SEQ ID NO: 552111 - RNA, 65 nt, Homo Sapiens; identical to SEQ ID NO: 192434

SEQ ID NO: 552112 - RNA, 65 nt, Homo Sapiens; identical to SEQ ID NO: 192435

SEQ ID NO: 552113 - RNA, 65 nt, Homo Sapiens; identical to SEQ ID NO: 192436

SEQ ID NO: 552114 - RNA, 65 nt, Homo Sapiens; identical to SEQ ID NO: 192437

SEQ ID NO: 552115 - RNA, 65 nt, Homo Sapiens; identical to SEQ ID NO: 192438

SEQ ID NO: 552116 - RNA, 65 nt, Homo Sapiens; identical to SEQ ID NO: 192439

SEQ ID NO: 552117 - RNA, 65 nt, Homo Sapiens; identical to SEQ ID NO: 192440

SEQ ID NO: 552118 - RNA, 65 nt, Homo Sapiens; identical to SEQ ID NO: 192441

SEQ ID NO: 552119 - RNA, 65 nt, Homo Sapiens; identical to SEQ ID NO: 192442

SEQ ID NO: 552120 - RNA, 65 nt, Homo Sapiens; identical to SEQ ID NO: 192443

SEQ ID NO: 552121 - RNA, 65 nt, Homo Sapiens; identical to SEQ ID NO: 192444

SEQ ID NO: 552122 - RNA, 65 nt, Homo Sapiens; identical to SEQ ID NO: 192445

SEQ ID NO: 552123 - RNA, 65 nt, Homo Sapiens; identical to SEQ ID NO: 192446

SEQ ID NO: 552124 - RNA, 65 nt, Homo Sapiens; identical to SEQ ID NO: 192447

SEQ ID NO: 552125 - RNA, 65 nt, Homo Sapiens; identical to SEQ ID NO: 192448

SEQ ID NO: 552126 - RNA, 65 nt, Homo Sapiens; identical to SEQ ID NO: 192449

SEQ ID NO: 552127 - RNA, 65 nt, Homo Sapiens; identical to SEQ ID NO: 192450

SEQ ID NO: 552128 - RNA, 65 nt, Homo Sapiens; identical to SEQ ID NO: 192451

SEQ ID NO: 552129 - RNA, 65 nt, Homo Sapiens; identical to SEQ ID NO: 192452

SEQ ID NO: 552130 - RNA, 65 nt, Homo Sapiens; identical to SEQ ID NO: 192453

SEQ ID NO: 552131 - RNA, 65 nt, Homo Sapiens; identical to SEQ ID NO: 192454

SEQ ID NO: 552132 - RNA, 65 nt, Homo Sapiens; identical to SEQ ID NO: 192455

SEQ ID NO: 552133 - RNA, 65 nt, Homo Sapiens; identical to SEQ ID NO: 192456

SEQ ID NO: 552134 - RNA, 65 nt, Homo Sapiens; identical to SEQ ID NO: 192457

SEQ ID NO: 552135 - RNA, 65 nt, Homo Sapiens; identical to SEQ ID NO: 192458

SEQ ID NO: 552136 - RNA, 65 nt, Homo Sapiens; identical to SEQ ID NO: 192459

SEQ ID NO: 552137 - RNA, 65 nt, Homo Sapiens; identical to SEQ ID NO: 192460

SEQ ID NO: 552138 - RNA, 65 nt, Homo Sapiens; identical to SEQ ID NO: 192461

SEQ ID NO: 552139 - RNA, 65 nt, Homo Sapiens; identical to SEQ ID NO: 192462

SEQ ID NO: 552140 - RNA, 65 nt, Homo Sapiens; identical to SEQ ID NO: 192463

SEQ ID NO: 552141 - RNA, 51 nt, Homo Sapiens; identical to SEQ ID NO: 192464

SEQ ID NO: 552142 - RNA, 65 nt, Homo Sapiens; identical to SEQ ID NO: 192465

SEQ ID NO: 552143 - RNA, 65 nt, Homo Sapiens; identical to SEQ ID NO: 192466

SEQ ID NO: 552144 - RNA, 65 nt, Homo Sapiens; identical to SEQ ID NO: 192467

SEQ ID NO: 552145 - RNA, 65 nt, Homo Sapiens; identical to SEQ ID NO: 192468

SEQ ID NO: 552146 - RNA, 65 nt, Homo Sapiens; identical to SEQ ID NO: 192469

SEQ ID NO: 552147 - RNA, 65 nt, Homo Sapiens; identical to SEQ ID NO: 192470

SEQ ID NO: 552148 - RNA, 65 nt, Homo Sapiens; identical to SEQ ID NO: 192471

SEQ ID NO: 552149 - RNA, 65 nt, Homo Sapiens; identical to SEQ ID NO: 192472

SEQ ID NO: 552150 - RNA, 65 nt, Homo Sapiens; identical to SEQ ID NO: 192473

SEQ ID NO: 552151 - RNA, 65 nt, Homo Sapiens; identical to SEQ ID NO: 192474

SEQ ID NO: 552152 - RNA, 65 nt, Homo Sapiens; identical to SEQ ID NO: 192475

SEQ ID NO: 552153 - RNA, 65 nt, Homo Sapiens; identical to SEQ ID NO: 192476

SEQ ID NO: 552154 - RNA, 65 nt, Homo Sapiens; identical to SEQ ID NO: 192477

SEQ ID NO: 552155 - RNA, 65 nt, Homo Sapiens; identical to SEQ ID NO: 192478

SEQ ID NO: 552156 - RNA, 65 nt, Homo Sapiens; identical to SEQ ID NO: 192479

SEQ ID NO: 552157 - RNA, 65 nt, Homo Sapiens; identical to SEQ ID NO: 192480

SEQ ID NO: 552158 - RNA, 65 nt, Homo Sapiens; identical to SEQ ID NO: 192481

SEQ ID NO: 552159 - RNA, 65 nt, Homo Sapiens; identical to SEQ ID NO: 192482

SEQ ID NO: 552160 - RNA, 65 nt, Homo Sapiens; identical to SEQ ID NO: 192483

SEQ ID NO: 552161 - RNA, 65 nt, Homo Sapiens; identical to SEQ ID NO: 192484

SEQ ID NO: 552162 - RNA, 65 nt, Homo Sapiens; identical to SEQ ID NO: 192485

SEQ ID NO: 552163 - RNA, 65 nt, Homo Sapiens; identical to SEQ ID NO: 192486

SEQ ID NO: 552164 - RNA, 65 nt, Homo Sapiens; identical to SEQ ID NO: 192487

SEQ ID NO: 552165 - RNA, 65 nt, Homo Sapiens; identical to SEQ ID NO: 192488

SEQ ID NO: 552166 - RNA, 65 nt, Homo Sapiens; identical to SEQ ID NO: 192489

SEQ ID NO: 552167 - RNA, 65 nt, Homo Sapiens; identical to SEQ ID NO: 192490

SEQ ID NO: 552168 - RNA, 65 nt, Homo Sapiens; identical to SEQ ID NO: 192491

SEQ ID NO: 552169 - RNA, 65 nt, Homo Sapiens; identical to SEQ ID NO: 192492

SEQ ID NO: 552170 - RNA, 65 nt, Homo Sapiens; identical to SEQ ID NO: 192493

SEQ ID NO: 552171 - RNA, 65 nt, Homo Sapiens; identical to SEQ ID NO: 192494

SEQ ID NO: 552172 - RNA, 65 nt, Homo Sapiens; identical to SEQ ID NO: 192495

SEQ ID NO: 552173 - RNA, 65 nt, Homo Sapiens; identical to SEQ ID NO: 192496

SEQ ID NO: 552174 - RNA, 65 nt, Homo Sapiens; identical to SEQ ID NO: 192497

SEQ ID NO: 552175 - RNA, 65 nt, Homo Sapiens; identical to SEQ ID NO: 192498

SEQ ID NO: 552176 - RNA, 65 nt, Homo Sapiens; identical to SEQ ID NO: 192499

SEQ ID NO: 552177 - RNA, 65 nt, Homo Sapiens; identical to SEQ ID NO: 192500

SEQ ID NO: 552178 - RNA, 65 nt, Homo Sapiens; identical to SEQ ID NO: 192501

SEQ ID NO: 552179 - RNA, 65 nt, Homo Sapiens; identical to SEQ ID NO: 192502

SEQ ID NO: 552180 - RNA, 65 nt, Homo Sapiens; identical to SEQ ID NO: 192503

SEQ ID NO: 552181 - RNA, 65 nt, Homo Sapiens; identical to SEQ ID NO: 192504

SEQ ID NO: 552182 - RNA, 65 nt, Homo Sapiens; identical to SEQ ID NO: 192505

SEQ ID NO: 552183 - RNA, 65 nt, Homo Sapiens; identical to SEQ ID NO: 192506

SEQ ID NO: 552184 - RNA, 65 nt, Homo Sapiens; identical to SEQ ID NO: 192507

SEQ ID NO: 552185 - RNA, 65 nt, Homo Sapiens; identical to SEQ ID NO: 192508

SEQ ID NO: 552186 - RNA, 65 nt, Homo Sapiens; identical to SEQ ID NO: 192509

SEQ ID NO: 552187 - RNA, 65 nt, Homo Sapiens; identical to SEQ ID NO: 192510

SEQ ID NO: 552188 - RNA, 65 nt, Homo Sapiens; identical to SEQ ID NO: 192511

SEQ ID NO: 552189 - RNA, 65 nt, Homo Sapiens; identical to SEQ ID NO: 192512

SEQ ID NO: 552190 - RNA, 65 nt, Homo Sapiens; identical to SEQ ID NO: 192513

SEQ ID NO: 552191 - RNA, 65 nt, Homo Sapiens; identical to SEQ ID NO: 192514

SEQ ID NO: 552192 - RNA, 65 nt, Homo Sapiens; identical to SEQ ID NO: 192515

SEQ ID NO: 552193 - RNA, 65 nt, Homo Sapiens; identical to SEQ ID NO: 192516

SEQ ID NO: 552194 - RNA, 65 nt, Homo Sapiens; identical to SEQ ID NO: 192517

SEQ ID NO: 552195 - RNA, 65 nt, Homo Sapiens; identical to SEQ ID NO: 192518

SEQ ID NO: 552196 - RNA, 65 nt, Homo Sapiens; identical to SEQ ID NO: 192519

SEQ ID NO: 552197 - RNA, 65 nt, Homo Sapiens; identical to SEQ ID NO: 192520

SEQ ID NO: 552198 - RNA, 65 nt, Homo Sapiens; identical to SEQ ID NO: 192521

SEQ ID NO: 552199 - RNA, 65 nt, Homo Sapiens; identical to SEQ ID NO: 192522

SEQ ID NO: 552200 - RNA, 65 nt, Homo Sapiens; identical to SEQ ID NO: 192523

SEQ ID NO: 552201 - RNA, 65 nt, Homo Sapiens; identical to SEQ ID NO: 192524

SEQ ID NO: 552202 - RNA, 65 nt, Homo Sapiens; identical to SEQ ID NO: 192525

SEQ ID NO: 552203 - RNA, 65 nt, Homo Sapiens; identical to SEQ ID NO: 192526

SEQ ID NO: 552204 - RNA, 65 nt, Homo Sapiens; identical to SEQ ID NO: 192527

SEQ ID NO: 552205 - RNA, 65 nt, Homo Sapiens; identical to SEQ ID NO: 192528

SEQ ID NO: 552206 - RNA, 65 nt, Homo Sapiens; identical to SEQ ID NO: 192529

SEQ ID NO: 552207 - RNA, 65 nt, Homo Sapiens; identical to SEQ ID NO: 192530

SEQ ID NO: 552208 - RNA, 65 nt, Homo Sapiens; identical to SEQ ID NO: 192531

SEQ ID NO: 552209 - RNA, 53 nt, Homo Sapiens; identical to SEQ ID NO: 192532

SEQ ID NO: 552210 - RNA, 65 nt, Homo Sapiens; identical to SEQ ID NO: 192533

SEQ ID NO: 552211 - RNA, 65 nt, Homo Sapiens; identical to SEQ ID NO: 192534

SEQ ID NO: 552212 - RNA, 65 nt, Homo Sapiens; identical to SEQ ID NO: 192535

SEQ ID NO: 552213 - RNA, 65 nt, Homo Sapiens; identical to SEQ ID NO: 192536

SEQ ID NO: 552214 - RNA, 65 nt, Homo Sapiens; identical to SEQ ID NO: 192537

SEQ ID NO: 552215 - RNA, 65 nt, Homo Sapiens; identical to SEQ ID NO: 192538

SEQ ID NO: 552216 - RNA, 65 nt, Homo Sapiens; identical to SEQ ID NO: 192539

SEQ ID NO: 552217 - RNA, 65 nt, Homo Sapiens; identical to SEQ ID NO: 192540

SEQ ID NO: 552218 - RNA, 65 nt, Homo Sapiens; identical to SEQ ID NO: 192541

SEQ ID NO: 552219 - RNA, 65 nt, Homo Sapiens; identical to SEQ ID NO: 192542

SEQ ID NO: 552220 - RNA, 65 nt, Homo Sapiens; identical to SEQ ID NO: 192543

SEQ ID NO: 552221 - RNA, 65 nt, Homo Sapiens; identical to SEQ ID NO: 192544

SEQ ID NO: 552222 - RNA, 65 nt, Homo Sapiens; identical to SEQ ID NO: 192545

SEQ ID NO: 552223 - RNA, 65 nt, Homo Sapiens; identical to SEQ ID NO: 192546

SEQ ID NO: 552224 - RNA, 65 nt, Homo Sapiens; identical to SEQ ID NO: 192547

SEQ ID NO: 552225 - RNA, 65 nt, Homo Sapiens; identical to SEQ ID NO: 192548

SEQ ID NO: 552226 - RNA, 65 nt, Homo Sapiens; identical to SEQ ID NO: 192549

SEQ ID NO: 552227 - RNA, 65 nt, Homo Sapiens; identical to SEQ ID NO: 192550

SEQ ID NO: 552228 - RNA, 65 nt, Homo Sapiens; identical to SEQ ID NO: 192551

SEQ ID NO: 552229 - RNA, 65 nt, Homo Sapiens; identical to SEQ ID NO: 192552

SEQ ID NO: 552230 - RNA, 65 nt, Homo Sapiens; identical to SEQ ID NO: 192553

SEQ ID NO: 552231 - RNA, 65 nt, Homo Sapiens; identical to SEQ ID NO: 192554

SEQ ID NO: 552232 - RNA, 65 nt, Homo Sapiens; identical to SEQ ID NO: 192555

SEQ ID NO: 552233 - RNA, 65 nt, Homo Sapiens; identical to SEQ ID NO: 192556

SEQ ID NO: 552234 - RNA, 65 nt, Homo Sapiens; identical to SEQ ID NO: 192557

SEQ ID NO: 552235 - RNA, 65 nt, Homo Sapiens; identical to SEQ ID NO: 192558

SEQ ID NO: 552236 - RNA, 65 nt, Homo Sapiens; identical to SEQ ID NO: 192559

SEQ ID NO: 552237 - RNA, 65 nt, Homo Sapiens; identical to SEQ ID NO: 192560

SEQ ID NO: 552238 - RNA, 65 nt, Homo Sapiens; identical to SEQ ID NO: 192561

SEQ ID NO: 552239 - RNA, 65 nt, Homo Sapiens; identical to SEQ ID NO: 192562

SEQ ID NO: 552240 - RNA, 65 nt, Homo Sapiens; identical to SEQ ID NO: 192563

SEQ ID NO: 552241 - RNA, 65 nt, Homo Sapiens; identical to SEQ ID NO: 192564

SEQ ID NO: 552242 - RNA, 65 nt, Homo Sapiens; identical to SEQ ID NO: 192565

SEQ ID NO: 552243 - RNA, 65 nt, Homo Sapiens; identical to SEQ ID NO: 192566

SEQ ID NO: 552244 - RNA, 65 nt, Homo Sapiens; identical to SEQ ID NO: 192567

SEQ ID NO: 552245 - RNA, 65 nt, Homo Sapiens; identical to SEQ ID NO: 192568

SEQ ID NO: 552246 - RNA, 65 nt, Homo Sapiens; identical to SEQ ID NO: 192569

SEQ ID NO: 552247 - RNA, 65 nt, Homo Sapiens; identical to SEQ ID NO: 192570

SEQ ID NO: 552248 - RNA, 65 nt, Homo Sapiens; identical to SEQ ID NO: 192571

SEQ ID NO: 552249 - RNA, 65 nt, Homo Sapiens; identical to SEQ ID NO: 192572

SEQ ID NO: 552250 - RNA, 65 nt, Homo Sapiens; identical to SEQ ID NO: 192573

SEQ ID NO: 552251 - RNA, 65 nt, Homo Sapiens; identical to SEQ ID NO: 192574

SEQ ID NO: 552252 - RNA, 65 nt, Homo Sapiens; identical to SEQ ID NO: 192575

SEQ ID NO: 552253 - RNA, 65 nt, Homo Sapiens; identical to SEQ ID NO: 192576

SEQ ID NO: 552254 - RNA, 65 nt, Homo Sapiens; identical to SEQ ID NO: 192577

SEQ ID NO: 552255 - RNA, 65 nt, Homo Sapiens; identical to SEQ ID NO: 192578

SEQ ID NO: 552256 - RNA, 65 nt, Homo Sapiens; identical to SEQ ID NO: 192579

SEQ ID NO: 552257 - RNA, 65 nt, Homo Sapiens; identical to SEQ ID NO: 192580

SEQ ID NO: 552258 - RNA, 65 nt, Homo Sapiens; identical to SEQ ID NO: 192581

SEQ ID NO: 552259 - RNA, 65 nt, Homo Sapiens; identical to SEQ ID NO: 192582

SEQ ID NO: 552260 - RNA, 65 nt, Homo Sapiens; identical to SEQ ID NO: 192583

SEQ ID NO: 552261 - RNA, 65 nt, Homo Sapiens; identical to SEQ ID NO: 192584

SEQ ID NO: 552262 - RNA, 65 nt, Homo Sapiens; identical to SEQ ID NO: 192585

SEQ ID NO: 552263 - RNA, 65 nt, Homo Sapiens; identical to SEQ ID NO: 192586

SEQ ID NO: 552264 - RNA, 65 nt, Homo Sapiens; identical to SEQ ID NO: 192587

SEQ ID NO: 552265 - RNA, 65 nt, Homo Sapiens; identical to SEQ ID NO: 192588

SEQ ID NO: 552266 - RNA, 65 nt, Homo Sapiens; identical to SEQ ID NO: 192589

SEQ ID NO: 552267 - RNA, 65 nt, Homo Sapiens; identical to SEQ ID NO: 192590

SEQ ID NO: 552268 - RNA, 65 nt, Homo Sapiens; identical to SEQ ID NO: 192591

SEQ ID NO: 552269 - RNA, 65 nt, Homo Sapiens; identical to SEQ ID NO: 192592

SEQ ID NO: 552270 - RNA, 65 nt, Homo Sapiens; identical to SEQ ID NO: 192593

SEQ ID NO: 552271 - RNA, 65 nt, Homo Sapiens; identical to SEQ ID NO: 192594

SEQ ID NO: 552272 - RNA, 65 nt, Homo Sapiens; identical to SEQ ID NO: 192595

SEQ ID NO: 552273 - RNA, 65 nt, Homo Sapiens; identical to SEQ ID NO: 192596

SEQ ID NO: 552274 - RNA, 65 nt, Homo Sapiens; identical to SEQ ID NO: 192597

SEQ ID NO: 552275 - RNA, 65 nt, Homo Sapiens; identical to SEQ ID NO: 192598

SEQ ID NO: 552276 - RNA, 65 nt, Homo Sapiens; identical to SEQ ID NO: 192599

SEQ ID NO: 552277 - RNA, 65 nt, Homo Sapiens; identical to SEQ ID NO: 192600

SEQ ID NO: 552278 - RNA, 65 nt, Homo Sapiens; identical to SEQ ID NO: 192601

SEQ ID NO: 552279 - RNA, 65 nt, Homo Sapiens; identical to SEQ ID NO: 192602

SEQ ID NO: 552280 - RNA, 65 nt, Homo Sapiens; identical to SEQ ID NO: 192603

SEQ ID NO: 552281 - RNA, 65 nt, Homo Sapiens; identical to SEQ ID NO: 192604

SEQ ID NO: 552282 - RNA, 65 nt, Homo Sapiens; identical to SEQ ID NO: 192605

SEQ ID NO: 552283 - RNA, 65 nt, Homo Sapiens; identical to SEQ ID NO: 192606

SEQ ID NO: 552284 - RNA, 65 nt, Homo Sapiens; identical to SEQ ID NO: 192607

SEQ ID NO: 552285 - RNA, 65 nt, Homo Sapiens; identical to SEQ ID NO: 192608

SEQ ID NO: 552286 - RNA, 65 nt, Homo Sapiens; identical to SEQ ID NO: 192609

SEQ ID NO: 552287 - RNA, 65 nt, Homo Sapiens; identical to SEQ ID NO: 192610

SEQ ID NO: 552288 - RNA, 65 nt, Homo Sapiens; identical to SEQ ID NO: 192611

SEQ ID NO: 552289 - RNA, 65 nt, Homo Sapiens; identical to SEQ ID NO: 192612

SEQ ID NO: 552290 - RNA, 65 nt, Homo Sapiens; identical to SEQ ID NO: 192613

SEQ ID NO: 552291 - RNA, 65 nt, Homo Sapiens; identical to SEQ ID NO: 192614

SEQ ID NO: 552292 - RNA, 65 nt, Homo Sapiens; identical to SEQ ID NO: 192615

SEQ ID NO: 552293 - RNA, 65 nt, Homo Sapiens; identical to SEQ ID NO: 192616

SEQ ID NO: 552294 - RNA, 65 nt, Homo Sapiens; identical to SEQ ID NO: 192617

SEQ ID NO: 552295 - RNA, 65 nt, Homo Sapiens; identical to SEQ ID NO: 192618

SEQ ID NO: 552296 - RNA, 65 nt, Homo Sapiens; identical to SEQ ID NO: 192619

SEQ ID NO: 552297 - RNA, 65 nt, Homo Sapiens; identical to SEQ ID NO: 192620

SEQ ID NO: 552298 - RNA, 65 nt, Homo Sapiens; identical to SEQ ID NO: 192621

SEQ ID NO: 552299 - RNA, 65 nt, Homo Sapiens; identical to SEQ ID NO: 192622

SEQ ID NO: 552300 - RNA, 65 nt, Homo Sapiens; identical to SEQ ID NO: 192623

SEQ ID NO: 552301 - RNA, 65 nt, Homo Sapiens; identical to SEQ ID NO: 192624

SEQ ID NO: 552302 - RNA, 65 nt, Homo Sapiens; identical to SEQ ID NO: 192625

SEQ ID NO: 552303 - RNA, 65 nt, Homo Sapiens; identical to SEQ ID NO: 192626

SEQ ID NO: 552304 - RNA, 65 nt, Homo Sapiens; identical to SEQ ID NO: 192627

SEQ ID NO: 552305 - RNA, 65 nt, Homo Sapiens; identical to SEQ ID NO: 192628

SEQ ID NO: 552306 - RNA, 65 nt, Homo Sapiens; identical to SEQ ID NO: 192629

SEQ ID NO: 552307 - RNA, 65 nt, Homo Sapiens; identical to SEQ ID NO: 192630

SEQ ID NO: 552308 - RNA, 65 nt, Homo Sapiens; identical to SEQ ID NO: 192631

SEQ ID NO: 552309 - RNA, 65 nt, Homo Sapiens; identical to SEQ ID NO: 192632

SEQ ID NO: 552310 - RNA, 65 nt, Homo Sapiens; identical to SEQ ID NO: 192633

SEQ ID NO: 552311 - RNA, 65 nt, Homo Sapiens; identical to SEQ ID NO: 192634

SEQ ID NO: 552312 - RNA, 65 nt, Homo Sapiens; identical to SEQ ID NO: 192635

SEQ ID NO: 552313 - RNA, 65 nt, Homo Sapiens; identical to SEQ ID NO: 192636

SEQ ID NO: 552314 - RNA, 65 nt, Homo Sapiens; identical to SEQ ID NO: 192637

SEQ ID NO: 552315 - RNA, 65 nt, Homo Sapiens; identical to SEQ ID NO: 192638

SEQ ID NO: 552316 - RNA, 65 nt, Homo Sapiens; identical to SEQ ID NO: 192639

SEQ ID NO: 552317 - RNA, 65 nt, Homo Sapiens; identical to SEQ ID NO: 192640

SEQ ID NO: 552318 - RNA, 65 nt, Homo Sapiens; identical to SEQ ID NO: 192641

SEQ ID NO: 552319 - RNA, 65 nt, Homo Sapiens; identical to SEQ ID NO: 192642

SEQ ID NO: 552320 - RNA, 65 nt, Homo Sapiens; identical to SEQ ID NO: 192643

SEQ ID NO: 552321 - RNA, 65 nt, Homo Sapiens; identical to SEQ ID NO: 192644

SEQ ID NO: 552322 - RNA, 65 nt, Homo Sapiens; identical to SEQ ID NO: 192645

SEQ ID NO: 552323 - RNA, 65 nt, Homo Sapiens; identical to SEQ ID NO: 192646

SEQ ID NO: 552324 - RNA, 65 nt, Homo Sapiens; identical to SEQ ID NO: 192647

SEQ ID NO: 552325 - RNA, 65 nt, Homo Sapiens; identical to SEQ ID NO: 192648

SEQ ID NO: 552326 - RNA, 65 nt, Homo Sapiens; identical to SEQ ID NO: 192649

SEQ ID NO: 552327 - RNA, 51 nt, Homo Sapiens; identical to SEQ ID NO: 192650

SEQ ID NO: 552328 - RNA, 65 nt, Homo Sapiens; identical to SEQ ID NO: 192651

SEQ ID NO: 552329 - RNA, 65 nt, Homo Sapiens; identical to SEQ ID NO: 192652

SEQ ID NO: 552330 - RNA, 65 nt, Homo Sapiens; identical to SEQ ID NO: 192653

SEQ ID NO: 552331 - RNA, 65 nt, Homo Sapiens; identical to SEQ ID NO: 192654

SEQ ID NO: 552332 - RNA, 65 nt, Homo Sapiens; identical to SEQ ID NO: 192655

SEQ ID NO: 552333 - RNA, 65 nt, Homo Sapiens; identical to SEQ ID NO: 192656

SEQ ID NO: 552334 - RNA, 65 nt, Homo Sapiens; identical to SEQ ID NO: 192657

SEQ ID NO: 552335 - RNA, 65 nt, Homo Sapiens; identical to SEQ ID NO: 192658

SEQ ID NO: 552336 - RNA, 65 nt, Homo Sapiens; identical to SEQ ID NO: 192659

SEQ ID NO: 552337 - RNA, 65 nt, Homo Sapiens; identical to SEQ ID NO: 192660

SEQ ID NO: 552338 - RNA, 65 nt, Homo Sapiens; identical to SEQ ID NO: 192661

SEQ ID NO: 552339 - RNA, 65 nt, Homo Sapiens; identical to SEQ ID NO: 192662

SEQ ID NO: 552340 - RNA, 65 nt, Homo Sapiens; identical to SEQ ID NO: 192663

SEQ ID NO: 552341 - RNA, 65 nt, Homo Sapiens; identical to SEQ ID NO: 192664

SEQ ID NO: 552342 - RNA, 65 nt, Homo Sapiens; identical to SEQ ID NO: 192665

SEQ ID NO: 552343 - RNA, 65 nt, Homo Sapiens; identical to SEQ ID NO: 192666

SEQ ID NO: 552344 - RNA, 65 nt, Homo Sapiens; identical to SEQ ID NO: 192667

SEQ ID NO: 552345 - RNA, 65 nt, Homo Sapiens; identical to SEQ ID NO: 192668

SEQ ID NO: 552346 - RNA, 65 nt, Homo Sapiens; identical to SEQ ID NO: 192669

SEQ ID NO: 552347 - RNA, 65 nt, Homo Sapiens; identical to SEQ ID NO: 192670

SEQ ID NO: 552348 - RNA, 65 nt, Homo Sapiens; identical to SEQ ID NO: 192671

SEQ ID NO: 552349 - RNA, 65 nt, Homo Sapiens; identical to SEQ ID NO: 192672

SEQ ID NO: 552350 - RNA, 65 nt, Homo Sapiens; identical to SEQ ID NO: 192673

SEQ ID NO: 552351 - RNA, 65 nt, Homo Sapiens; identical to SEQ ID NO: 192674

SEQ ID NO: 552352 - RNA, 65 nt, Homo Sapiens; identical to SEQ ID NO: 192675

SEQ ID NO: 552353 - RNA, 65 nt, Homo Sapiens; identical to SEQ ID NO: 192676

SEQ ID NO: 552354 - RNA, 65 nt, Homo Sapiens; identical to SEQ ID NO: 192677

SEQ ID NO: 552355 - RNA, 65 nt, Homo Sapiens; identical to SEQ ID NO: 192678

SEQ ID NO: 552356 - RNA, 65 nt, Homo Sapiens; identical to SEQ ID NO: 192679

SEQ ID NO: 552357 - RNA, 65 nt, Homo Sapiens; identical to SEQ ID NO: 192680

SEQ ID NO: 552358 - RNA, 64 nt, Homo Sapiens; identical to SEQ ID NO: 165556

SEQ ID NO: 552359 - RNA, 64 nt, Homo Sapiens; identical to SEQ ID NO: 165557

SEQ ID NO: 552360 - RNA, 64 nt, Homo Sapiens; identical to SEQ ID NO: 165558

SEQ ID NO: 552361 - RNA, 64 nt, Homo Sapiens; identical to SEQ ID NO: 165559

SEQ ID NO: 552362 - RNA, 64 nt, Homo Sapiens; identical to SEQ ID NO: 165560

SEQ ID NO: 552363 - RNA, 64 nt, Homo Sapiens; identical to SEQ ID NO: 165561

SEQ ID NO: 552364 - RNA, 64 nt, Homo Sapiens; identical to SEQ ID NO: 165562

SEQ ID NO: 552365 - RNA, 64 nt, Homo Sapiens; identical to SEQ ID NO: 165563

SEQ ID NO: 552366 - RNA, 64 nt, Homo Sapiens; identical to SEQ ID NO: 165564

SEQ ID NO: 552367 - RNA, 64 nt, Homo Sapiens; identical to SEQ ID NO: 165565

SEQ ID NO: 552368 - RNA, 64 nt, Homo Sapiens; identical to SEQ ID NO: 165566

SEQ ID NO: 552369 - RNA, 64 nt, Homo Sapiens; identical to SEQ ID NO: 165567

SEQ ID NO: 552370 - RNA, 64 nt, Homo Sapiens; identical to SEQ ID NO: 165568

SEQ ID NO: 552371 - RNA, 64 nt, Homo Sapiens; identical to SEQ ID NO: 165569

SEQ ID NO: 552372 - RNA, 64 nt, Homo Sapiens; identical to SEQ ID NO: 165570

SEQ ID NO: 552373 - RNA, 64 nt, Homo Sapiens; identical to SEQ ID NO: 165571

SEQ ID NO: 552374 - RNA, 64 nt, Homo Sapiens; identical to SEQ ID NO: 165572

SEQ ID NO: 552375 - RNA, 64 nt, Homo Sapiens; identical to SEQ ID NO: 165573

SEQ ID NO: 552376 - RNA, 64 nt, Homo Sapiens; identical to SEQ ID NO: 165574

SEQ ID NO: 552377 - RNA, 64 nt, Homo Sapiens; identical to SEQ ID NO: 165575

SEQ ID NO: 552378 - RNA, 64 nt, Homo Sapiens; identical to SEQ ID NO: 165576

SEQ ID NO: 552379 - RNA, 64 nt, Homo Sapiens; identical to SEQ ID NO: 165577

SEQ ID NO: 552380 - RNA, 64 nt, Homo Sapiens; identical to SEQ ID NO: 165578

SEQ ID NO: 552381 - RNA, 64 nt, Homo Sapiens; identical to SEQ ID NO: 165579

SEQ ID NO: 552382 - RNA, 64 nt, Homo Sapiens; identical to SEQ ID NO: 165580

SEQ ID NO: 552383 - RNA, 64 nt, Homo Sapiens; identical to SEQ ID NO: 165581

SEQ ID NO: 552384 - RNA, 64 nt, Homo Sapiens; identical to SEQ ID NO: 94944

SEQ ID NO: 552385 - RNA, 64 nt, Homo Sapiens; identical to SEQ ID NO: 94945

SEQ ID NO: 552386 - RNA, 64 nt, Homo Sapiens; identical to SEQ ID NO: 94946

SEQ ID NO: 552387 - RNA, 64 nt, Homo Sapiens; identical to SEQ ID NO: 94947

SEQ ID NO: 552388 - RNA, 64 nt, Homo Sapiens; identical to SEQ ID NO: 94948

SEQ ID NO: 552389 - RNA, 64 nt, Homo Sapiens; identical to SEQ ID NO: 94949

SEQ ID NO: 552390 - RNA, 64 nt, Homo Sapiens; identical to SEQ ID NO: 94950

SEQ ID NO: 552391 - RNA, 59 nt, Homo Sapiens; identical to SEQ ID NO: 94951

SEQ ID NO: 552392 - RNA, 64 nt, Homo Sapiens; identical to SEQ ID NO: 94952

SEQ ID NO: 552393 - RNA, 64 nt, Homo Sapiens; identical to SEQ ID NO: 94953

SEQ ID NO: 552394 - RNA, 62 nt, Homo Sapiens; identical to SEQ ID NO: 94954

SEQ ID NO: 552395 - RNA, 64 nt, Homo Sapiens; identical to SEQ ID NO: 94955

SEQ ID NO: 552396 - RNA, 64 nt, Homo Sapiens
cauuccaugacgacauacaugcuacuuuuuuuuaguucaauacagugaaggucuuuguuaugac

SEQ ID NO: 552397 - RNA, 64 nt, Homo Sapiens
cuucaguccuccucuccuuuuuauuuuaggcacuguucaauacuguaugccuucuguauuuuaa

SEQ ID NO: 552398 - RNA, 64 nt, Homo Sapiens
augggaaaaauaagaugacucagcaacuuccccuguucaauaguuaaauauuggcauacguuau

SEQ ID NO: 552399 - RNA, 64 nt, Homo Sapiens
auucaaauauaaguuuccauugccauccaauuuaguucaauaaaauaaauaucaucucuagcac

SEQ ID NO: 552400 - RNA, 64 nt, Homo Sapiens
guuuuagucaaguaauggcuuuugaaaaaguaaaguucaauaauaacuaaggcugugauuuuuu

SEQ ID NO: 552401 - RNA, 64 nt, Homo Sapiens
uuauacaagggcugugcuaugcuaccauauucuuguucaauaauaauagguuuguuguuuuuuu

SEQ ID NO: 552402 - RNA, 64 nt, Homo Sapiens
aaacccagccauuccgcaugaggaagcauuucauguucaauaagcaaaacaguccaggccaaag

SEQ ID NO: 552403 - RNA, 64 nt, Homo Sapiens
gaaugaaaauucuggguguagugcaagccaaaugguucaauaauccacauuaucagagagcacu

SEQ ID NO: 552404 - RNA, 64 nt, Homo Sapiens; identical to SEQ ID NO: 54817

SEQ ID NO: 552405 - RNA, 64 nt, Homo Sapiens; identical to SEQ ID NO: 54818

SEQ ID NO: 552406 - RNA, 64 nt, Homo Sapiens; identical to SEQ ID NO: 54819

SEQ ID NO: 552407 - RNA, 64 nt, Homo Sapiens; identical to SEQ ID NO: 54820

SEQ ID NO: 552408 - RNA, 64 nt, Homo Sapiens; identical to SEQ ID NO: 54821

SEQ ID NO: 552409 - RNA, 64 nt, Homo Sapiens; identical to SEQ ID NO: 54822

SEQ ID NO: 552410 - RNA, 64 nt, Homo Sapiens; identical to SEQ ID NO: 54823

SEQ ID NO: 552411 - RNA, 64 nt, Homo Sapiens; identical to SEQ ID NO: 54824

SEQ ID NO: 552412 - RNA, 64 nt, Homo Sapiens; identical to SEQ ID NO: 54825

SEQ ID NO: 552413 - RNA, 64 nt, Homo Sapiens; identical to SEQ ID NO: 54826

SEQ ID NO: 552414 - RNA, 64 nt, Homo Sapiens; identical to SEQ ID NO: 54827

SEQ ID NO: 552415 - RNA, 64 nt, Homo Sapiens; identical to SEQ ID NO: 54828

SEQ ID NO: 552416 - RNA, 64 nt, Homo Sapiens; identical to SEQ ID NO: 54829

SEQ ID NO: 552417 - RNA, 64 nt, Homo Sapiens; identical to SEQ ID NO: 54830

SEQ ID NO: 552418 - RNA, 64 nt, Homo Sapiens; identical to SEQ ID NO: 54831

SEQ ID NO: 552419 - RNA, 64 nt, Homo Sapiens; identical to SEQ ID NO: 54832

SEQ ID NO: 552420 - RNA, 64 nt, Homo Sapiens; identical to SEQ ID NO: 54833

SEQ ID NO: 552421 - RNA, 64 nt, Homo Sapiens; identical to SEQ ID NO: 54834

SEQ ID NO: 552422 - RNA, 64 nt, Homo Sapiens; identical to SEQ ID NO: 54835

SEQ ID NO: 552423 - RNA, 64 nt, Homo Sapiens; identical to SEQ ID NO: 54836

SEQ ID NO: 552424 - RNA, 64 nt, Homo Sapiens; identical to SEQ ID NO: 54837

SEQ ID NO: 552425 - RNA, 64 nt, Homo Sapiens; identical to SEQ ID NO: 54838

SEQ ID NO: 552426 - RNA, 64 nt, Homo Sapiens; identical to SEQ ID NO: 54839

SEQ ID NO: 552427 - RNA, 64 nt, Homo Sapiens; identical to SEQ ID NO: 54840

SEQ ID NO: 552428 - RNA, 64 nt, Homo Sapiens; identical to SEQ ID NO: 54841

SEQ ID NO: 552429 - RNA, 64 nt, Homo Sapiens; identical to SEQ ID NO: 54842

SEQ ID NO: 552430 - RNA, 64 nt, Homo Sapiens; identical to SEQ ID NO: 54843

SEQ ID NO: 552431 - RNA, 64 nt, Homo Sapiens; identical to SEQ ID NO: 54844

SEQ ID NO: 552432 - RNA, 64 nt, Homo Sapiens; identical to SEQ ID NO: 54845

SEQ ID NO: 552433 - RNA, 64 nt, Homo Sapiens; identical to SEQ ID NO: 54846

SEQ ID NO: 552434 - RNA, 64 nt, Homo Sapiens; identical to SEQ ID NO: 54847

SEQ ID NO: 552435 - RNA, 64 nt, Homo Sapiens; identical to SEQ ID NO: 54848

SEQ ID NO: 552436 - RNA, 64 nt, Homo Sapiens; identical to SEQ ID NO: 54849

SEQ ID NO: 552437 - RNA, 64 nt, Homo Sapiens; identical to SEQ ID NO: 54850

SEQ ID NO: 552438 - RNA, 64 nt, Homo Sapiens; identical to SEQ ID NO: 54851

SEQ ID NO: 552439 - RNA, 64 nt, Homo Sapiens; identical to SEQ ID NO: 54852

SEQ ID NO: 552440 - RNA, 64 nt, Homo Sapiens; identical to SEQ ID NO: 54853

SEQ ID NO: 552441 - RNA, 64 nt, Homo Sapiens; identical to SEQ ID NO: 54854

SEQ ID NO: 552442 - RNA, 64 nt, Homo Sapiens; identical to SEQ ID NO: 54855

SEQ ID NO: 552443 - RNA, 64 nt, Homo Sapiens; identical to SEQ ID NO: 54856

SEQ ID NO: 552444 - RNA, 64 nt, Homo Sapiens; identical to SEQ ID NO: 54857

SEQ ID NO: 552445 - RNA, 64 nt, Homo Sapiens; identical to SEQ ID NO: 54858

SEQ ID NO: 552446 - RNA, 64 nt, Homo Sapiens; identical to SEQ ID NO: 54859

SEQ ID NO: 552447 - RNA, 64 nt, Homo Sapiens; identical to SEQ ID NO: 54860

SEQ ID NO: 552448 - RNA, 64 nt, Homo Sapiens; identical to SEQ ID NO: 54861

SEQ ID NO: 552449 - RNA, 64 nt, Homo Sapiens; identical to SEQ ID NO: 54862

SEQ ID NO: 552450 - RNA, 64 nt, Homo Sapiens; identical to SEQ ID NO: 54863

SEQ ID NO: 552451 - RNA, 64 nt, Homo Sapiens; identical to SEQ ID NO: 54864

SEQ ID NO: 552452 - RNA, 64 nt, Homo Sapiens; identical to SEQ ID NO: 54865

SEQ ID NO: 552453 - RNA, 64 nt, Homo Sapiens; identical to SEQ ID NO: 54866

SEQ ID NO: 552454 - RNA, 64 nt, Homo Sapiens; identical to SEQ ID NO: 54867

SEQ ID NO: 552455 - RNA, 64 nt, Homo Sapiens; identical to SEQ ID NO: 54868

SEQ ID NO: 552456 - RNA, 64 nt, Homo Sapiens; identical to SEQ ID NO: 54869

SEQ ID NO: 552457 - RNA, 64 nt, Homo Sapiens; identical to SEQ ID NO: 54870

SEQ ID NO: 552458 - RNA, 64 nt, Homo Sapiens; identical to SEQ ID NO: 54871

SEQ ID NO: 552459 - RNA, 64 nt, Homo Sapiens; identical to SEQ ID NO: 54872

SEQ ID NO: 552460 - RNA, 64 nt, Homo Sapiens; identical to SEQ ID NO: 54870

SEQ ID NO: 552461 - RNA, 64 nt, Homo Sapiens; identical to SEQ ID NO: 54871

SEQ ID NO: 552462 - RNA, 64 nt, Homo Sapiens; identical to SEQ ID NO: 54872

SEQ ID NO: 552463 - RNA, 64 nt, Homo Sapiens; identical to SEQ ID NO: 54870

SEQ ID NO: 552464 - RNA, 64 nt, Homo Sapiens; identical to SEQ ID NO: 54877

SEQ ID NO: 552465 - RNA, 64 nt, Homo Sapiens; identical to SEQ ID NO: 54878

SEQ ID NO: 552466 - RNA, 64 nt, Homo Sapiens; identical to SEQ ID NO: 54879

SEQ ID NO: 552467 - RNA, 64 nt, Homo Sapiens; identical to SEQ ID NO: 54880

SEQ ID NO: 552468 - RNA, 64 nt, Homo Sapiens; identical to SEQ ID NO: 54881

SEQ ID NO: 552469 - RNA, 64 nt, Homo Sapiens; identical to SEQ ID NO: 54882

SEQ ID NO: 552470 - RNA, 64 nt, Homo Sapiens; identical to SEQ ID NO: 54883

SEQ ID NO: 552471 - RNA, 64 nt, Homo Sapiens; identical to SEQ ID NO: 54884

SEQ ID NO: 552472 - RNA, 64 nt, Homo Sapiens; identical to SEQ ID NO: 54885

SEQ ID NO: 552473 - RNA, 64 nt, Homo Sapiens; identical to SEQ ID NO: 54886

SEQ ID NO: 552474 - RNA, 64 nt, Homo Sapiens; identical to SEQ ID NO: 54887

SEQ ID NO: 552475 - RNA, 64 nt, Homo Sapiens; identical to SEQ ID NO: 54888

SEQ ID NO: 552476 - RNA, 64 nt, Homo Sapiens; identical to SEQ ID NO: 54889

SEQ ID NO: 552477 - RNA, 64 nt, Homo Sapiens; identical to SEQ ID NO: 54890

SEQ ID NO: 552478 - RNA, 64 nt, Homo Sapiens; identical to SEQ ID NO: 54891

SEQ ID NO: 552479 - RNA, 64 nt, Homo Sapiens; identical to SEQ ID NO: 54892

SEQ ID NO: 552480 - RNA, 64 nt, Homo Sapiens; identical to SEQ ID NO: 54893

SEQ ID NO: 552481 - RNA, 64 nt, Homo Sapiens; identical to SEQ ID NO: 54894

SEQ ID NO: 552482 - RNA, 64 nt, Homo Sapiens; identical to SEQ ID NO: 54895

SEQ ID NO: 552483 - RNA, 64 nt, Homo Sapiens; identical to SEQ ID NO: 54896

SEQ ID NO: 552484 - RNA, 64 nt, Homo Sapiens; identical to SEQ ID NO: 485635

SEQ ID NO: 552485 - RNA, 64 nt, Homo Sapiens; identical to SEQ ID NO: 485636

SEQ ID NO: 552486 - RNA, 64 nt, Homo Sapiens; identical to SEQ ID NO: 485637

SEQ ID NO: 552487 - RNA, 64 nt, Homo Sapiens; identical to SEQ ID NO: 485638

SEQ ID NO: 552488 - RNA, 64 nt, Homo Sapiens; identical to SEQ ID NO: 485639

SEQ ID NO: 552489 - RNA, 64 nt, Homo Sapiens; identical to SEQ ID NO: 485640

SEQ ID NO: 552490 - RNA, 64 nt, Homo Sapiens; identical to SEQ ID NO: 485641

SEQ ID NO: 552491 - RNA, 64 nt, Homo Sapiens; identical to SEQ ID NO: 485642

SEQ ID NO: 552492 - RNA, 64 nt, Homo Sapiens; identical to SEQ ID NO: 485643

SEQ ID NO: 552493 - RNA, 64 nt, Homo Sapiens; identical to SEQ ID NO: 485644

SEQ ID NO: 552494 - RNA, 64 nt, Homo Sapiens; identical to SEQ ID NO: 485645

SEQ ID NO: 552495 - RNA, 64 nt, Homo Sapiens; identical to SEQ ID NO: 485646

SEQ ID NO: 552496 - RNA, 64 nt, Homo Sapiens; identical to SEQ ID NO: 485647

SEQ ID NO: 552497 - RNA, 64 nt, Homo Sapiens; identical to SEQ ID NO: 485648

SEQ ID NO: 552498 - RNA, 64 nt, Homo Sapiens; identical to SEQ ID NO: 485649

SEQ ID NO: 552499 - RNA, 64 nt, Homo Sapiens; identical to SEQ ID NO: 485650

SEQ ID NO: 552500 - RNA, 64 nt, Homo Sapiens; identical to SEQ ID NO: 485651

SEQ ID NO: 552501 - RNA, 64 nt, Homo Sapiens; identical to SEQ ID NO: 485652

SEQ ID NO: 552502 - RNA, 64 nt, Homo Sapiens; identical to SEQ ID NO: 485653

SEQ ID NO: 552503 - RNA, 64 nt, Homo Sapiens; identical to SEQ ID NO: 485654

SEQ ID NO: 552504 - RNA, 64 nt, Homo Sapiens; identical to SEQ ID NO: 485655

SEQ ID NO: 552505 - RNA, 64 nt, Homo Sapiens; identical to SEQ ID NO: 485656

SEQ ID NO: 552506 - RNA, 64 nt, Homo Sapiens; identical to SEQ ID NO: 485657

SEQ ID NO: 552507 - RNA, 64 nt, Homo Sapiens; identical to SEQ ID NO: 485658

SEQ ID NO: 552508 - RNA, 64 nt, Homo Sapiens; identical to SEQ ID NO: 485659

SEQ ID NO: 552509 - RNA, 64 nt, Homo Sapiens; identical to SEQ ID NO: 485660

SEQ ID NO: 552510 - RNA, 64 nt, Homo Sapiens; identical to SEQ ID NO: 485661

SEQ ID NO: 552511 - RNA, 64 nt, Homo Sapiens; identical to SEQ ID NO: 485662

SEQ ID NO: 552512 - RNA, 64 nt, Homo Sapiens; identical to SEQ ID NO: 485663

SEQ ID NO: 552513 - RNA, 64 nt, Homo Sapiens; identical to SEQ ID NO: 485664

SEQ ID NO: 552514 - RNA, 64 nt, Homo Sapiens; identical to SEQ ID NO: 485665

SEQ ID NO: 552515 - RNA, 64 nt, Homo Sapiens; identical to SEQ ID NO: 485666

SEQ ID NO: 552516 - RNA, 64 nt, Homo Sapiens; identical to SEQ ID NO: 485667

SEQ ID NO: 552517 - RNA, 64 nt, Homo Sapiens
cccuaaauauguuuacauaccauuaagauaugauucauguaacaauguuaaauuaauuauaaug

SEQ ID NO: 552518 - RNA, 64 nt, Homo Sapiens
caugaaauucaacuuuccaaauaaaaguucuacuucauguaauccaaaaauguuuguauucugu

SEQ ID NO: 552519 - RNA, 64 nt, Homo Sapiens
cauucaaaaaaagugaauugccaagauacuggugucauguaaauucccacuuuacauaaaaacc

SEQ ID NO: 552520 - RNA, 64 nt, Homo Sapiens
guuagauuuauugaaagauuucaucugucguguuucauguaaaugagaacagauuauuugcaug

SEQ ID NO: 552521 - RNA, 64 nt, Homo Sapiens
ugguaggggauuuuugagaauucuuuuaccacuuucauguaagcuucaagcuaagcuuauugaa

SEQ ID NO: 552522 - RNA, 64 nt, Homo Sapiens
agauagccaaaagcauaggauuuuaacucaaaauucauguaacaucaaacucauaaacucagua

SEQ ID NO: 552523 - RNA, 64 nt, Homo Sapiens
uaauucugguauugugaguggaugcccuaguuaaucauguaauuggaaagggcaaaauguguca

SEQ ID NO: 552524 - RNA, 64 nt, Homo Sapiens
aguugagcuaagcaagccccuuuggaauuuauugucauguaaauaaauguuuuauguuuugagu

SEQ ID NO: 552525 - RNA, 64 nt, Homo Sapiens
uagucuugguucugaaacuuuucucuacagcuuuucauguaaaugaauggacuuuucaacuacu

SEQ ID NO: 552526 - RNA, 64 nt, Homo Sapiens
ggaauaaaaguuuuaugaaucacguguauuaaauucauguaaguccaagcauaauuguuaagaa

SEQ ID NO: 552527 - RNA, 64 nt, Homo Sapiens
cucaguguauccuuccugugucaagccuuauaaaucauguaauuuagugccacucauguaaauc

SEQ ID NO: 552528 - RNA, 64 nt, Homo Sapiens
gucaagccuuauaaaucauguaauuuagugccacucauguaaaucaguaaaaucacaaaggucu

SEQ ID NO: 552529 - RNA, 64 nt, Homo Sapiens
ugaaaauauggcaauacuuguuguauaugcauagucauguaagcuuuguagauuccucuggauu

SEQ ID NO: 552530 - RNA, 64 nt, Homo Sapiens
agaauuucuuuaacuuaauucaucauguaucgcuucauguaacucugaaucucuaaucaauguu

SEQ ID NO: 552531 - RNA, 64 nt, Homo Sapiens
uuuaauaauacauauuauuuaccccacuguaacaucauguaaacuaaguauguuuuuaaacaau

SEQ ID NO: 552532 - RNA, 64 nt, Homo Sapiens
ugugaugugacuaaaagccacuuugugacucccuucauguaauccucuuuuccuccccacuccu

SEQ ID NO: 552533 - RNA, 64 nt, Homo Sapiens
cuaauuuugacaaguuuucauccuaagccucaaaucauguaauuaauaauuugccuguuuauuu

SEQ ID NO: 552534 - RNA, 64 nt, Homo Sapiens
aauacguuuuaggaugucaucauuuugaugugaaucauguaaauguugauaauaugcuguuuau

SEQ ID NO: 552535 - RNA, 64 nt, Homo Sapiens
cuguugagugcuuacucuuuuuaacuaauucaauucauguaacagaaauuaucugccuuauaca

SEQ ID NO: 552536 - RNA, 64 nt, Homo Sapiens
augacugauguuguguuaguuuaauguauuguucucauguaagaauuuuuucuuuguauuuauu

SEQ ID NO: 552537 - RNA, 64 nt, Homo Sapiens
aaauaucaaaaggaaaagggagugggaauugcuaucauguaaaauaucaaaguuaaaauacuaa

SEQ ID NO: 552538 - RNA, 64 nt, Homo Sapiens
augccagaggcaccaggccagaugugccgcacagucauguaauucaaucauguuuaauauguca

SEQ ID NO: 552539 - RNA, 64 nt, Homo Sapiens
auauuuuaggauuguaauuagcuagugaagauauucauguaaauuaaauuguugcaacucauua

SEQ ID NO: 552540 - RNA, 64 nt, Homo Sapiens
auuuuaaauguuaagaaguaaaauaugcuuccacucauguaacuuuuauuuugguggucaaaaa

SEQ ID NO: 552541 - RNA, 64 nt, Homo Sapiens
cuucuuuuuguaugaaaauuuugguauuuuguggucauguaaaacacuugauaaaaauaaauau

SEQ ID NO: 552542 - RNA, 64 nt, Homo Sapiens; identical to SEQ ID NO: 264315

SEQ ID NO: 552543 - RNA, 64 nt, Homo Sapiens; identical to SEQ ID NO: 264316

SEQ ID NO: 552544 - RNA, 64 nt, Homo Sapiens; identical to SEQ ID NO: 264317

SEQ ID NO: 552545 - RNA, 64 nt, Homo Sapiens; identical to SEQ ID NO: 264318

SEQ ID NO: 552546 - RNA, 64 nt, Homo Sapiens; identical to SEQ ID NO: 264319

SEQ ID NO: 552547 - RNA, 64 nt, Homo Sapiens; identical to SEQ ID NO: 264320

SEQ ID NO: 552548 - RNA, 64 nt, Homo Sapiens; identical to SEQ ID NO: 264321

SEQ ID NO: 552549 - RNA, 64 nt, Homo Sapiens; identical to SEQ ID NO: 264322

SEQ ID NO: 552550 - RNA, 64 nt, Homo Sapiens; identical to SEQ ID NO: 101929

SEQ ID NO: 552551 - RNA, 64 nt, Homo Sapiens; identical to SEQ ID NO: 101930

SEQ ID NO: 552552 - RNA, 64 nt, Homo Sapiens; identical to SEQ ID NO: 101931

SEQ ID NO: 552553 - RNA, 64 nt, Homo Sapiens; identical to SEQ ID NO: 101932

SEQ ID NO: 552554 - RNA, 64 nt, Homo Sapiens; identical to SEQ ID NO: 101933

SEQ ID NO: 552555 - RNA, 64 nt, Homo Sapiens; identical to SEQ ID NO: 101934

SEQ ID NO: 552556 - RNA, 64 nt, Homo Sapiens; identical to SEQ ID NO: 101935

SEQ ID NO: 552557 - RNA, 64 nt, Homo Sapiens; identical to SEQ ID NO: 101936

SEQ ID NO: 552558 - RNA, 64 nt, Homo Sapiens; identical to SEQ ID NO: 101937

SEQ ID NO: 552559 - RNA, 64 nt, Homo Sapiens; identical to SEQ ID NO: 101938

SEQ ID NO: 552560 - RNA, 64 nt, Homo Sapiens; identical to SEQ ID NO: 101939

SEQ ID NO: 552561 - RNA, 64 nt, Homo Sapiens; identical to SEQ ID NO: 101940

SEQ ID NO: 552562 - RNA, 64 nt, Homo Sapiens; identical to SEQ ID NO: 101941

SEQ ID NO: 552563 - RNA, 64 nt, Homo Sapiens; identical to SEQ ID NO: 101942

SEQ ID NO: 552564 - RNA, 64 nt, Homo Sapiens; identical to SEQ ID NO: 101943

SEQ ID NO: 552565 - RNA, 64 nt, Homo Sapiens; identical to SEQ ID NO: 101944

SEQ ID NO: 552566 - RNA, 64 nt, Homo Sapiens; identical to SEQ ID NO: 101945

SEQ ID NO: 552567 - RNA, 64 nt, Homo Sapiens; identical to SEQ ID NO: 101946

SEQ ID NO: 552568 - RNA, 64 nt, Homo Sapiens; identical to SEQ ID NO: 101947

SEQ ID NO: 552569 - RNA, 64 nt, Homo Sapiens; identical to SEQ ID NO: 43717

SEQ ID NO: 552570 - RNA, 64 nt, Homo Sapiens; identical to SEQ ID NO: 43718

SEQ ID NO: 552571 - RNA, 64 nt, Homo Sapiens; identical to SEQ ID NO: 43719

SEQ ID NO: 552572 - RNA, 64 nt, Homo Sapiens; identical to SEQ ID NO: 43720

SEQ ID NO: 552573 - RNA, 64 nt, Homo Sapiens; identical to SEQ ID NO: 43721

SEQ ID NO: 552574 - RNA, 64 nt, Homo Sapiens; identical to SEQ ID NO: 43722

SEQ ID NO: 552575 - RNA, 64 nt, Homo Sapiens; identical to SEQ ID NO: 43723

SEQ ID NO: 552576 - RNA, 64 nt, Homo Sapiens; identical to SEQ ID NO: 43724

SEQ ID NO: 552577 - RNA, 64 nt, Homo Sapiens; identical to SEQ ID NO: 43725

SEQ ID NO: 552578 - RNA, 64 nt, Homo Sapiens; identical to SEQ ID NO: 43726

SEQ ID NO: 552579 - RNA, 64 nt, Homo Sapiens; identical to SEQ ID NO: 43727

SEQ ID NO: 552580 - RNA, 64 nt, Homo Sapiens; identical to SEQ ID NO: 43728

SEQ ID NO: 552581 - RNA, 64 nt, Homo Sapiens; identical to SEQ ID NO: 43729

SEQ ID NO: 552582 - RNA, 64 nt, Homo Sapiens; identical to SEQ ID NO: 43730

SEQ ID NO: 552583 - RNA, 64 nt, Homo Sapiens; identical to SEQ ID NO: 43731

SEQ ID NO: 552584 - RNA, 64 nt, Homo Sapiens; identical to SEQ ID NO: 43732

SEQ ID NO: 552585 - RNA, 64 nt, Homo Sapiens; identical to SEQ ID NO: 43733

SEQ ID NO: 552586 - RNA, 64 nt, Homo Sapiens; identical to SEQ ID NO: 43734

SEQ ID NO: 552587 - RNA, 64 nt, Homo Sapiens; identical to SEQ ID NO: 43735

SEQ ID NO: 552588 - RNA, 64 nt, Homo Sapiens; identical to SEQ ID NO: 43736

SEQ ID NO: 552589 - RNA, 64 nt, Homo Sapiens; identical to SEQ ID NO: 43737

SEQ ID NO: 552590 - RNA, 64 nt, Homo Sapiens; identical to SEQ ID NO: 43738

SEQ ID NO: 552591 - RNA, 64 nt, Homo Sapiens; identical to SEQ ID NO: 43739

SEQ ID NO: 552592 - RNA, 64 nt, Homo Sapiens; identical to SEQ ID NO: 43740

SEQ ID NO: 552593 - RNA, 64 nt, Homo Sapiens; identical to SEQ ID NO: 43741

SEQ ID NO: 552594 - RNA, 64 nt, Homo Sapiens; identical to SEQ ID NO: 43742

SEQ ID NO: 552595 - RNA, 64 nt, Homo Sapiens; identical to SEQ ID NO: 43743

SEQ ID NO: 552596 - RNA, 64 nt, Homo Sapiens; identical to SEQ ID NO: 43744

SEQ ID NO: 552597 - RNA, 64 nt, Homo Sapiens; identical to SEQ ID NO: 43745

SEQ ID NO: 552598 - RNA, 64 nt, Homo Sapiens; identical to SEQ ID NO: 43746

SEQ ID NO: 552599 - RNA, 64 nt, Homo Sapiens
caucggaaucacccgaucacaucgcccgaucacagacgagcaguacagacgagcggucaccaga

SEQ ID NO: 552600 - RNA, 64 nt, Homo Sapiens
caucggacucacccgaucacaucacccgaucacagacgagcaguacagacgagcagucaucgga

SEQ ID NO: 552601 - RNA, 64 nt, Homo Sapiens
caucggaaucacccgaucaccucgcccgaucacagacgagcaguacagacgagcggucaccaga

SEQ ID NO: 552602 - RNA, 64 nt, Homo Sapiens
caucggacucacccgaucacaucacccgaucacagacgagcaguacagacaagcagucaucgga

SEQ ID NO: 552603 - RNA, 64 nt, Homo Sapiens
caucggacucacccgaucacaucgcccggucacagacgagcaguacagacgagcggucaccgga

SEQ ID NO: 552604 - RNA, 64 nt, Homo Sapiens; identical to SEQ ID NO: 189185

SEQ ID NO: 552605 - RNA, 64 nt, Homo Sapiens; identical to SEQ ID NO: 189186

SEQ ID NO: 552606 - RNA, 64 nt, Homo Sapiens; identical to SEQ ID NO: 189187

SEQ ID NO: 552607 - RNA, 64 nt, Homo Sapiens; identical to SEQ ID NO: 189188

SEQ ID NO: 552608 - RNA, 64 nt, Homo Sapiens; identical to SEQ ID NO: 189189

SEQ ID NO: 552609 - RNA, 64 nt, Homo Sapiens; identical to SEQ ID NO: 189190

SEQ ID NO: 552610 - RNA, 64 nt, Homo Sapiens; identical to SEQ ID NO: 189191

SEQ ID NO: 552611 - RNA, 64 nt, Homo Sapiens; identical to SEQ ID NO: 189192

SEQ ID NO: 552612 - RNA, 64 nt, Homo Sapiens; identical to SEQ ID NO: 189193

SEQ ID NO: 552613 - RNA, 64 nt, Homo Sapiens; identical to SEQ ID NO: 189194

SEQ ID NO: 552614 - RNA, 64 nt, Homo Sapiens; identical to SEQ ID NO: 189195

SEQ ID NO: 552615 - RNA, 64 nt, Homo Sapiens; identical to SEQ ID NO: 189196

SEQ ID NO: 552616 - RNA, 64 nt, Homo Sapiens; identical to SEQ ID NO: 189197

SEQ ID NO: 552617 - RNA, 64 nt, Homo Sapiens; identical to SEQ ID NO: 189198

SEQ ID NO: 552618 - RNA, 64 nt, Homo Sapiens; identical to SEQ ID NO: 189199

SEQ ID NO: 552619 - RNA, 64 nt, Homo Sapiens; identical to SEQ ID NO: 189200

SEQ ID NO: 552620 - RNA, 64 nt, Homo Sapiens; identical to SEQ ID NO: 189201

SEQ ID NO: 552621 - RNA, 64 nt, Homo Sapiens; identical to SEQ ID NO: 189202

SEQ ID NO: 552622 - RNA, 64 nt, Homo Sapiens; identical to SEQ ID NO: 189203

SEQ ID NO: 552623 - RNA, 64 nt, Homo Sapiens; identical to SEQ ID NO: 189204

SEQ ID NO: 552624 - RNA, 64 nt, Homo Sapiens; identical to SEQ ID NO: 189205

SEQ ID NO: 552625 - RNA, 64 nt, Homo Sapiens; identical to SEQ ID NO: 189206

SEQ ID NO: 552626 - RNA, 64 nt, Homo Sapiens; identical to SEQ ID NO: 189207

SEQ ID NO: 552627 - RNA, 64 nt, Homo Sapiens; identical to SEQ ID NO: 189208

SEQ ID NO: 552628 - RNA, 64 nt, Homo Sapiens; identical to SEQ ID NO: 189209

SEQ ID NO: 552629 - RNA, 64 nt, Homo Sapiens; identical to SEQ ID NO: 189210

SEQ ID NO: 552630 - RNA, 64 nt, Homo Sapiens; identical to SEQ ID NO: 189211

SEQ ID NO: 552631 - RNA, 64 nt, Homo Sapiens; identical to SEQ ID NO: 189212

SEQ ID NO: 552632 - RNA, 64 nt, Homo Sapiens; identical to SEQ ID NO: 189213

SEQ ID NO: 552633 - RNA, 50 nt, Homo Sapiens; identical to SEQ ID NO: 189214

SEQ ID NO: 552634 - RNA, 64 nt, Homo Sapiens; identical to SEQ ID NO: 189215

SEQ ID NO: 552635 - RNA, 64 nt, Homo Sapiens; identical to SEQ ID NO: 189216

SEQ ID NO: 552636 - RNA, 64 nt, Homo Sapiens; identical to SEQ ID NO: 189217

SEQ ID NO: 552637 - RNA, 64 nt, Homo Sapiens; identical to SEQ ID NO: 189218

SEQ ID NO: 552638 - RNA, 64 nt, Homo Sapiens; identical to SEQ ID NO: 189219

SEQ ID NO: 552639 - RNA, 64 nt, Homo Sapiens; identical to SEQ ID NO: 189220

SEQ ID NO: 552640 - RNA, 64 nt, Homo Sapiens; identical to SEQ ID NO: 189221

SEQ ID NO: 552641 - RNA, 64 nt, Homo Sapiens; identical to SEQ ID NO: 189222

SEQ ID NO: 552642 - RNA, 64 nt, Homo Sapiens; identical to SEQ ID NO: 189223

SEQ ID NO: 552643 - RNA, 64 nt, Homo Sapiens; identical to SEQ ID NO: 189224

SEQ ID NO: 552644 - RNA, 64 nt, Homo Sapiens; identical to SEQ ID NO: 189225

SEQ ID NO: 552645 - RNA, 64 nt, Homo Sapiens; identical to SEQ ID NO: 189226

SEQ ID NO: 552646 - RNA, 64 nt, Homo Sapiens; identical to SEQ ID NO: 189227

SEQ ID NO: 552647 - RNA, 64 nt, Homo Sapiens; identical to SEQ ID NO: 189228

SEQ ID NO: 552648 - RNA, 64 nt, Homo Sapiens; identical to SEQ ID NO: 189229

SEQ ID NO: 552649 - RNA, 64 nt, Homo Sapiens; identical to SEQ ID NO: 189230

SEQ ID NO: 552650 - RNA, 64 nt, Homo Sapiens; identical to SEQ ID NO: 189231

SEQ ID NO: 552651 - RNA, 64 nt, Homo Sapiens; identical to SEQ ID NO: 189232

SEQ ID NO: 552652 - RNA, 64 nt, Homo Sapiens; identical to SEQ ID NO: 189233

SEQ ID NO: 552653 - RNA, 64 nt, Homo Sapiens; identical to SEQ ID NO: 189234

SEQ ID NO: 552654 - RNA, 64 nt, Homo Sapiens; identical to SEQ ID NO: 189235

SEQ ID NO: 552655 - RNA, 64 nt, Homo Sapiens; identical to SEQ ID NO: 189236

SEQ ID NO: 552656 - RNA, 64 nt, Homo Sapiens; identical to SEQ ID NO: 189237

SEQ ID NO: 552657 - RNA, 64 nt, Homo Sapiens; identical to SEQ ID NO: 189238

SEQ ID NO: 552658 - RNA, 64 nt, Homo Sapiens; identical to SEQ ID NO: 189239

SEQ ID NO: 552659 - RNA, 64 nt, Homo Sapiens; identical to SEQ ID NO: 189240

SEQ ID NO: 552660 - RNA, 64 nt, Homo Sapiens; identical to SEQ ID NO: 189241

SEQ ID NO: 552661 - RNA, 64 nt, Homo Sapiens; identical to SEQ ID NO: 189242

SEQ ID NO: 552662 - RNA, 64 nt, Homo Sapiens; identical to SEQ ID NO: 189243

SEQ ID NO: 552663 - RNA, 64 nt, Homo Sapiens; identical to SEQ ID NO: 189244

SEQ ID NO: 552664 - RNA, 64 nt, Homo Sapiens; identical to SEQ ID NO: 189245

SEQ ID NO: 552665 - RNA, 64 nt, Homo Sapiens; identical to SEQ ID NO: 189246

SEQ ID NO: 552666 - RNA, 64 nt, Homo Sapiens; identical to SEQ ID NO: 189247

SEQ ID NO: 552667 - RNA, 64 nt, Homo Sapiens; identical to SEQ ID NO: 189248

SEQ ID NO: 552668 - RNA, 64 nt, Homo Sapiens; identical to SEQ ID NO: 189249

SEQ ID NO: 552669 - RNA, 64 nt, Homo Sapiens; identical to SEQ ID NO: 189250

SEQ ID NO: 552670 - RNA, 64 nt, Homo Sapiens; identical to SEQ ID NO: 189251

SEQ ID NO: 552671 - RNA, 64 nt, Homo Sapiens; identical to SEQ ID NO: 189252

SEQ ID NO: 552672 - RNA, 64 nt, Homo Sapiens; identical to SEQ ID NO: 189253

SEQ ID NO: 552673 - RNA, 64 nt, Homo Sapiens; identical to SEQ ID NO: 189254

SEQ ID NO: 552674 - RNA, 64 nt, Homo Sapiens; identical to SEQ ID NO: 189255

SEQ ID NO: 552675 - RNA, 64 nt, Homo Sapiens; identical to SEQ ID NO: 189256

SEQ ID NO: 552676 - RNA, 64 nt, Homo Sapiens; identical to SEQ ID NO: 189257

SEQ ID NO: 552677 - RNA, 64 nt, Homo Sapiens; identical to SEQ ID NO: 189258

SEQ ID NO: 552678 - RNA, 64 nt, Homo Sapiens
caccagacuuuuucuucuaaaaucuggaugucauugacgauaauguuuauggagauaaggucua

SEQ ID NO: 552679 - RNA, 64 nt, Homo Sapiens
gcuugggauauaccagaguuuaccacaaguguuuugacgauauacuccugagcuuucacucugc

SEQ ID NO: 552680 - RNA, 64 nt, Homo Sapiens
acuucuuuuccacaucucauagcaauaauaauaaugacgauaauaugauaucuaaguaguucuc

SEQ ID NO: 552681 - RNA, 64 nt, Homo Sapiens
caguguauuuaauugacauuucuuuuuuguaaugugacgauauguggacaaagaagaagaugca

SEQ ID NO: 552682 - RNA, 64 nt, Homo Sapiens
ucaacagucacaaacccaauggcaauaaaggcacugacgauagcuggcgcgcgcgacgucacac

SEQ ID NO: 552683 - RNA, 64 nt, Homo Sapiens
ccaaccauauggauauuaguaaucacuuccauagugacgauacuaacauaugcaaacauaacaa

SEQ ID NO: 552684 - RNA, 64 nt, Homo Sapiens
cuuugguaauugaauucugaagaauuuaucugcaugacgauaacuaggcauucuauccauuugu

SEQ ID NO: 552685 - RNA, 64 nt, Homo Sapiens
uccauuuaggauguguauuuaaugcauuuaguaaugacgauaaaguguuuuuaguaugcuuuua

SEQ ID NO: 552686 - RNA, 64 nt, Homo Sapiens
aaugccaaugaccagauguguugucuuuacagaaugacgauacacuucuuauauagguacucuu

SEQ ID NO: 552687 - RNA, 64 nt, Homo Sapiens
ucuauuuauagcuauugguaguuccccuaaauucugacgauagaaauuuuuauuugcuguuuag

SEQ ID NO: 552688 - RNA, 53 nt, Homo Sapiens
agggcucaguggaggucugagaaugacgauacccgugacucagcccuggacac

SEQ ID NO: 552689 - RNA, 64 nt, Homo Sapiens
uggcaaaaccuuaagauuguaggccguagcaguuugacgauaggauauaaauuucgcuccagaa

SEQ ID NO: 552690 - RNA, 64 nt, Homo Sapiens
uucccuguauauuauguucacuugugcauuaaucugacgauaauauuaaaaauuucuuguauuu

SEQ ID NO: 552691 - RNA, 64 nt, Homo Sapiens
uucaacuccaccagaaauuaccucgagucagcauugacgauauuggaggagcugccgugcugcu

SEQ ID NO: 552692 - RNA, 64 nt, Homo Sapiens
auaaauaauggagcaugcagugagcacaucuagcugacgauaaucacaccuuuucccccgucuu

SEQ ID NO: 552693 - RNA, 64 nt, Homo Sapiens
aggcugcaaaauucauuuuauaauggcuauuuugugacgauaagauguaguucauguuuuucug

SEQ ID NO: 552694 - RNA, 64 nt, Homo Sapiens
cuagaaauuaccuuuauauuaaaaguuuaguaugugacgauaaaugagaaaccagcugguuuag

SEQ ID NO: 552695 - RNA, 64 nt, Homo Sapiens
acuuaagugugaauuuuuaagaaguaaagugugaugacgauaacacguauuuggaguuuauuua

SEQ ID NO: 552696 - RNA, 64 nt, Homo Sapiens
acagcaaaaagcccacccaggacuuagccucaguugacgauaguaacaauggccuuaacaucua

SEQ ID NO: 552697 - RNA, 64 nt, Homo Sapiens
aguugucuguugaugauggugaugaugaugaugaugacgauagugaugccacacauucucucuc

SEQ ID NO: 552698 - RNA, 64 nt, Homo Sapiens
uucuugcuagguaagcacuaauaacucggcaucuugacgauagucccauuugggugguuucagc

SEQ ID NO: 552699 - RNA, 64 nt, Homo Sapiens
uugucauuccauuauauauccacaccaacaugggugacgauaauucaaagucauauuuugccuc

SEQ ID NO: 552700 - RNA, 64 nt, Homo Sapiens
uguuuugugaaagcuucugauuaauuuauuauauugacgauaaaacucaaaccuacccagccuu

SEQ ID NO: 552701 - RNA, 53 nt, Homo Sapiens
ugaaaacaaucuuccaguaguucugacgauacuuggagccugguccacgugca

SEQ ID NO: 552702 - RNA, 64 nt, Homo Sapiens
caggcacauuauguaaacauuuguaaagauaaacugacgauauacuuguuuccucccaccugug

SEQ ID NO: 552703 - RNA, 64 nt, Homo Sapiens
ggauucggaccacuuggggaucccagaaccucccugacgauauccuggaaggacugaggaaggg

SEQ ID NO: 552704 - RNA, 64 nt, Homo Sapiens
guauucaggaaguuaaaauguaauuacacuauaaugacgauaauacacauugggauuggaauau

SEQ ID NO: 552705 - RNA, 64 nt, Homo Sapiens
ccaccggccacccaggccugcugcacagucccuuugacgauaguuuggguguggagaacccugg

SEQ ID NO: 552706 - RNA, 64 nt, Homo Sapiens
aaccugaagcuuagaggaacggaaugacugcccgugacgauaccaucaggaaauuaucccagug

SEQ ID NO: 552707 - RNA, 64 nt, Homo Sapiens; identical to SEQ ID NO: 156671

SEQ ID NO: 552708 - RNA, 64 nt, Homo Sapiens; identical to SEQ ID NO: 156672

SEQ ID NO: 552709 - RNA, 64 nt, Homo Sapiens; identical to SEQ ID NO: 156673

SEQ ID NO: 552710 - RNA, 64 nt, Homo Sapiens; identical to SEQ ID NO: 156674

SEQ ID NO: 552711 - RNA, 64 nt, Homo Sapiens; identical to SEQ ID NO: 156675

SEQ ID NO: 552712 - RNA, 64 nt, Homo Sapiens; identical to SEQ ID NO: 156676

SEQ ID NO: 552713 - RNA, 64 nt, Homo Sapiens; identical to SEQ ID NO: 73323

SEQ ID NO: 552714 - RNA, 64 nt, Homo Sapiens; identical to SEQ ID NO: 73324

SEQ ID NO: 552715 - RNA, 64 nt, Homo Sapiens; identical to SEQ ID NO: 73325

SEQ ID NO: 552716 - RNA, 64 nt, Homo Sapiens; identical to SEQ ID NO: 73326

SEQ ID NO: 552717 - RNA, 64 nt, Homo Sapiens; identical to SEQ ID NO: 73327

SEQ ID NO: 552718 - RNA, 64 nt, Homo Sapiens; identical to SEQ ID NO: 73328

SEQ ID NO: 552719 - RNA, 64 nt, Homo Sapiens; identical to SEQ ID NO: 73329

SEQ ID NO: 552720 - RNA, 64 nt, Homo Sapiens; identical to SEQ ID NO: 73330

SEQ ID NO: 552721 - RNA, 64 nt, Homo Sapiens; identical to SEQ ID NO: 73331

SEQ ID NO: 552722 - RNA, 64 nt, Homo Sapiens; identical to SEQ ID NO: 73332

SEQ ID NO: 552723 - RNA, 64 nt, Homo Sapiens; identical to SEQ ID NO: 73333

SEQ ID NO: 552724 - RNA, 64 nt, Homo Sapiens; identical to SEQ ID NO: 73334

SEQ ID NO: 552725 - RNA, 64 nt, Homo Sapiens; identical to SEQ ID NO: 73335

SEQ ID NO: 552726 - RNA, 64 nt, Homo Sapiens; identical to SEQ ID NO: 73336

SEQ ID NO: 552727 - RNA, 64 nt, Homo Sapiens; identical to SEQ ID NO: 73337

SEQ ID NO: 552728 - RNA, 64 nt, Homo Sapiens; identical to SEQ ID NO: 73338

SEQ ID NO: 552729 - RNA, 64 nt, Homo Sapiens; identical to SEQ ID NO: 73339

SEQ ID NO: 552730 - RNA, 64 nt, Homo Sapiens; identical to SEQ ID NO: 73340

SEQ ID NO: 552731 - RNA, 64 nt, Homo Sapiens; identical to SEQ ID NO: 73341

SEQ ID NO: 552732 - RNA, 64 nt, Homo Sapiens; identical to SEQ ID NO: 73342

SEQ ID NO: 552733 - RNA, 64 nt, Homo Sapiens; identical to SEQ ID NO: 73343

SEQ ID NO: 552734 - RNA, 64 nt, Homo Sapiens; identical to SEQ ID NO: 73344

SEQ ID NO: 552735 - RNA, 64 nt, Homo Sapiens; identical to SEQ ID NO: 481796

SEQ ID NO: 552736 - RNA, 64 nt, Homo Sapiens; identical to SEQ ID NO: 481797

SEQ ID NO: 552737 - RNA, 64 nt, Homo Sapiens; identical to SEQ ID NO: 481798

SEQ ID NO: 552738 - RNA, 64 nt, Homo Sapiens; identical to SEQ ID NO: 481799

SEQ ID NO: 552739 - RNA, 64 nt, Homo Sapiens; identical to SEQ ID NO: 481800

SEQ ID NO: 552740 - RNA, 64 nt, Homo Sapiens; identical to SEQ ID NO: 481801

SEQ ID NO: 552741 - RNA, 64 nt, Homo Sapiens; identical to SEQ ID NO: 481802

SEQ ID NO: 552742 - RNA, 64 nt, Homo Sapiens; identical to SEQ ID NO: 481803

SEQ ID NO: 552743 - RNA, 64 nt, Homo Sapiens; identical to SEQ ID NO: 481804

SEQ ID NO: 552744 - RNA, 64 nt, Homo Sapiens; identical to SEQ ID NO: 481805

SEQ ID NO: 552745 - RNA, 64 nt, Homo Sapiens; identical to SEQ ID NO: 481806

SEQ ID NO: 552746 - RNA, 64 nt, Homo Sapiens; identical to SEQ ID NO: 481807

SEQ ID NO: 552747 - RNA, 64 nt, Homo Sapiens; identical to SEQ ID NO: 481808

SEQ ID NO: 552748 - RNA, 64 nt, Homo Sapiens; identical to SEQ ID NO: 481809

SEQ ID NO: 552749 - RNA, 64 nt, Homo Sapiens; identical to SEQ ID NO: 481810

SEQ ID NO: 552750 - RNA, 64 nt, Homo Sapiens; identical to SEQ ID NO: 481811

SEQ ID NO: 552751 - RNA, 64 nt, Homo Sapiens; identical to SEQ ID NO: 481812

SEQ ID NO: 552752 - RNA, 64 nt, Homo Sapiens; identical to SEQ ID NO: 481813

SEQ ID NO: 552753 - RNA, 64 nt, Homo Sapiens; identical to SEQ ID NO: 481814

SEQ ID NO: 552754 - RNA, 64 nt, Homo Sapiens; identical to SEQ ID NO: 481815

SEQ ID NO: 552755 - RNA, 64 nt, Homo Sapiens; identical to SEQ ID NO: 481816

SEQ ID NO: 552756 - RNA, 64 nt, Homo Sapiens; identical to SEQ ID NO: 481817

SEQ ID NO: 552757 - RNA, 64 nt, Homo Sapiens; identical to SEQ ID NO: 481818

SEQ ID NO: 552758 - RNA, 64 nt, Homo Sapiens; identical to SEQ ID NO: 481819

SEQ ID NO: 552759 - RNA, 64 nt, Homo Sapiens; identical to SEQ ID NO: 481820

SEQ ID NO: 552760 - RNA, 64 nt, Homo Sapiens; identical to SEQ ID NO: 481821

SEQ ID NO: 552761 - RNA, 64 nt, Homo Sapiens; identical to SEQ ID NO: 481822

SEQ ID NO: 552762 - RNA, 64 nt, Homo Sapiens; identical to SEQ ID NO: 481823

SEQ ID NO: 552763 - RNA, 64 nt, Homo Sapiens; identical to SEQ ID NO: 481824

SEQ ID NO: 552764 - RNA, 64 nt, Homo Sapiens; identical to SEQ ID NO: 481825

SEQ ID NO: 552765 - RNA, 64 nt, Homo Sapiens; identical to SEQ ID NO: 481826

SEQ ID NO: 552766 - RNA, 64 nt, Homo Sapiens; identical to SEQ ID NO: 481827

SEQ ID NO: 552767 - RNA, 64 nt, Homo Sapiens; identical to SEQ ID NO: 481828

SEQ ID NO: 552768 - RNA, 64 nt, Homo Sapiens; identical to SEQ ID NO: 481829

SEQ ID NO: 552769 - RNA, 64 nt, Homo Sapiens; identical to SEQ ID NO: 481830

SEQ ID NO: 552770 - RNA, 64 nt, Homo Sapiens; identical to SEQ ID NO: 481831

SEQ ID NO: 552771 - RNA, 64 nt, Homo Sapiens; identical to SEQ ID NO: 481832

SEQ ID NO: 552772 - RNA, 64 nt, Homo Sapiens; identical to SEQ ID NO: 481833

SEQ ID NO: 552773 - RNA, 64 nt, Homo Sapiens; identical to SEQ ID NO: 52917

SEQ ID NO: 552774 - RNA, 64 nt, Homo Sapiens; identical to SEQ ID NO: 52918

SEQ ID NO: 552775 - RNA, 64 nt, Homo Sapiens; identical to SEQ ID NO: 52919

SEQ ID NO: 552776 - RNA, 64 nt, Homo Sapiens; identical to SEQ ID NO: 52920

SEQ ID NO: 552777 - RNA, 64 nt, Homo Sapiens; identical to SEQ ID NO: 52921

SEQ ID NO: 552778 - RNA, 64 nt, Homo Sapiens; identical to SEQ ID NO: 52922

SEQ ID NO: 552779 - RNA, 64 nt, Homo Sapiens; identical to SEQ ID NO: 52923

SEQ ID NO: 552780 - RNA, 64 nt, Homo Sapiens; identical to SEQ ID NO: 52924

SEQ ID NO: 552781 - RNA, 64 nt, Homo Sapiens; identical to SEQ ID NO: 52925

SEQ ID NO: 552782 - RNA, 64 nt, Homo Sapiens; identical to SEQ ID NO: 52926

SEQ ID NO: 552783 - RNA, 64 nt, Homo Sapiens; identical to SEQ ID NO: 52927

SEQ ID NO: 552784 - RNA, 64 nt, Homo Sapiens; identical to SEQ ID NO: 52928

SEQ ID NO: 552785 - RNA, 64 nt, Homo Sapiens; identical to SEQ ID NO: 52929

SEQ ID NO: 552786 - RNA, 64 nt, Homo Sapiens; identical to SEQ ID NO: 52930

SEQ ID NO: 552787 - RNA, 64 nt, Homo Sapiens; identical to SEQ ID NO: 52931

SEQ ID NO: 552788 - RNA, 64 nt, Homo Sapiens; identical to SEQ ID NO: 52932

SEQ ID NO: 552789 - RNA, 64 nt, Homo Sapiens; identical to SEQ ID NO: 52933

SEQ ID NO: 552790 - RNA, 64 nt, Homo Sapiens; identical to SEQ ID NO: 52934

SEQ ID NO: 552791 - RNA, 64 nt, Homo Sapiens; identical to SEQ ID NO: 52935

SEQ ID NO: 552792 - RNA, 64 nt, Homo Sapiens; identical to SEQ ID NO: 52936

SEQ ID NO: 552793 - RNA, 64 nt, Homo Sapiens; identical to SEQ ID NO: 52937

SEQ ID NO: 552794 - RNA, 64 nt, Homo Sapiens; identical to SEQ ID NO: 52938

SEQ ID NO: 552795 - RNA, 64 nt, Homo Sapiens; identical to SEQ ID NO: 52939

SEQ ID NO: 552796 - RNA, 64 nt, Homo Sapiens; identical to SEQ ID NO: 52940

SEQ ID NO: 552797 - RNA, 64 nt, Homo Sapiens; identical to SEQ ID NO: 52941

SEQ ID NO: 552798 - RNA, 64 nt, Homo Sapiens; identical to SEQ ID NO: 52942

SEQ ID NO: 552799 - RNA, 64 nt, Homo Sapiens; identical to SEQ ID NO: 52943

SEQ ID NO: 552800 - RNA, 64 nt, Homo Sapiens; identical to SEQ ID NO: 52944

SEQ ID NO: 552801 - RNA, 64 nt, Homo Sapiens; identical to SEQ ID NO: 52945

SEQ ID NO: 552802 - RNA, 64 nt, Homo Sapiens; identical to SEQ ID NO: 52946

SEQ ID NO: 552803 - RNA, 64 nt, Homo Sapiens; identical to SEQ ID NO: 52947

SEQ ID NO: 552804 - RNA, 64 nt, Homo Sapiens; identical to SEQ ID NO: 52948

SEQ ID NO: 552805 - RNA, 64 nt, Homo Sapiens; identical to SEQ ID NO: 52949

SEQ ID NO: 552806 - RNA, 64 nt, Homo Sapiens; identical to SEQ ID NO: 52950

SEQ ID NO: 552807 - RNA, 64 nt, Homo Sapiens; identical to SEQ ID NO: 52951

SEQ ID NO: 552808 - RNA, 64 nt, Homo Sapiens; identical to SEQ ID NO: 52952

SEQ ID NO: 552809 - RNA, 64 nt, Homo Sapiens; identical to SEQ ID NO: 52953

SEQ ID NO: 552810 - RNA, 64 nt, Homo Sapiens; identical to SEQ ID NO: 52954

SEQ ID NO: 552811 - RNA, 64 nt, Homo Sapiens; identical to SEQ ID NO: 52955

SEQ ID NO: 552812 - RNA, 64 nt, Homo Sapiens; identical to SEQ ID NO: 52956

SEQ ID NO: 552813 - RNA, 64 nt, Homo Sapiens; identical to SEQ ID NO: 52957

SEQ ID NO: 552814 - RNA, 64 nt, Homo Sapiens; identical to SEQ ID NO: 52958

SEQ ID NO: 552815 - RNA, 64 nt, Homo Sapiens; identical to SEQ ID NO: 52959

SEQ ID NO: 552816 - RNA, 64 nt, Homo Sapiens; identical to SEQ ID NO: 52960

SEQ ID NO: 552817 - RNA, 64 nt, Homo Sapiens; identical to SEQ ID NO: 52961

SEQ ID NO: 552818 - RNA, 64 nt, Homo Sapiens; identical to SEQ ID NO: 52962

SEQ ID NO: 552819 - RNA, 64 nt, Homo Sapiens; identical to SEQ ID NO: 52963

SEQ ID NO: 552820 - RNA, 64 nt, Homo Sapiens; identical to SEQ ID NO: 52964

SEQ ID NO: 552821 - RNA, 64 nt, Homo Sapiens; identical to SEQ ID NO: 52965

SEQ ID NO: 552822 - RNA, 64 nt, Homo Sapiens; identical to SEQ ID NO: 52966

SEQ ID NO: 552823 - RNA, 64 nt, Homo Sapiens; identical to SEQ ID NO: 52967

SEQ ID NO: 552824 - RNA, 64 nt, Homo Sapiens; identical to SEQ ID NO: 52968

SEQ ID NO: 552825 - RNA, 64 nt, Homo Sapiens; identical to SEQ ID NO: 52969

SEQ ID NO: 552826 - RNA, 64 nt, Homo Sapiens; identical to SEQ ID NO: 52970

SEQ ID NO: 552827 - RNA, 64 nt, Homo Sapiens; identical to SEQ ID NO: 52971

SEQ ID NO: 552828 - RNA, 64 nt, Homo Sapiens; identical to SEQ ID NO: 52972

SEQ ID NO: 552829 - RNA, 64 nt, Homo Sapiens; identical to SEQ ID NO: 52973

SEQ ID NO: 552830 - RNA, 64 nt, Homo Sapiens; identical to SEQ ID NO: 52974

SEQ ID NO: 552831 - RNA, 64 nt, Homo Sapiens; identical to SEQ ID NO: 52975

SEQ ID NO: 552832 - RNA, 64 nt, Homo Sapiens; identical to SEQ ID NO: 52976

SEQ ID NO: 552833 - RNA, 64 nt, Homo Sapiens; identical to SEQ ID NO: 52977

SEQ ID NO: 552834 - RNA, 64 nt, Homo Sapiens; identical to SEQ ID NO: 52978

SEQ ID NO: 552835 - RNA, 64 nt, Homo Sapiens; identical to SEQ ID NO: 291354

SEQ ID NO: 552836 - RNA, 64 nt, Homo Sapiens; identical to SEQ ID NO: 291355

SEQ ID NO: 552837 - RNA, 64 nt, Homo Sapiens; identical to SEQ ID NO: 291356

SEQ ID NO: 552838 - RNA, 64 nt, Homo Sapiens; identical to SEQ ID NO: 291357

SEQ ID NO: 552839 - RNA, 64 nt, Homo Sapiens; identical to SEQ ID NO: 291358

SEQ ID NO: 552840 - RNA, 64 nt, Homo Sapiens; identical to SEQ ID NO: 291359

SEQ ID NO: 552841 - RNA, 64 nt, Homo Sapiens
cacugggaaguaauggggugacggauggagcuugccaugggaagccacuugccacggaugggcc

SEQ ID NO: 552842 - RNA, 64 nt, Homo Sapiens
cccucugcccccagccgcaggcaggggcuggcacccaugggacaccagccuccuccagcugcug

SEQ ID NO: 552843 - RNA, 64 nt, Homo Sapiens
guugaguaauugugacauggcuaugauuguucaaccaugggagacucauuuguuuaccuacuau

SEQ ID NO: 552844 - RNA, 64 nt, Homo Sapiens
cuguguugcuccucucacucagcucaguccccacccaugggagcacucauuacugugaccuucc

SEQ ID NO: 552845 - RNA, 64 nt, Homo Sapiens
cucagucuuuaagauauuagacaguuuuuuuaguccaugggauuguaaauauaaacauuaacuu

SEQ ID NO: 552846 - RNA, 64 nt, Homo Sapiens
uuaaauguggauguaucagauuugguuuauccagccaugggagagaaaacaaaccuaaguuuac

SEQ ID NO: 552847 - RNA, 64 nt, Homo Sapiens
aacaucugcuccaugacauucacaauaccagggaccaugggagacacaagaaaugugugucugc

SEQ ID NO: 552848 - RNA, 64 nt, Homo Sapiens
auuaagagcuuucuagccagaaucuggaccuauaccaugggaaaauuuaggggugcugggaauc

SEQ ID NO: 552849 - RNA, 64 nt, Homo Sapiens
agaaaaaaacuugaaaauaguaauaccugaguacccaugggaauaauagacacuggggagguag

SEQ ID NO: 552850 - RNA, 64 nt, Homo Sapiens
auuuuuuuaaaaaagaaaaagacaauaguauuacccaugggacaaaauuuguacuauuagcaag

SEQ ID NO: 552851 - RNA, 64 nt, Homo Sapiens
auuauggcugggggcgccagcccaagaauggggaccaugggacuccuccagccuggcucuuccc

SEQ ID NO: 552852 - RNA, 64 nt, Homo Sapiens
agugcuaaggcuggaaauggcccccucuuaguugccaugggaaccuaguaacagacucugcugg

SEQ ID NO: 552853 - RNA, 64 nt, Homo Sapiens
auggcgccagucuggcuggaggagcccugagaugccaugggaggccugagguuggccacggggg

SEQ ID NO: 552854 - RNA, 64 nt, Homo Sapiens
gugcugagcgacaagaggcucagagggcaugaccccaugggacuggaugcggccugagggcuga

SEQ ID NO: 552855 - RNA, 64 nt, Homo Sapiens
gagccaucuccacucuccuuucacaugcaggauaccaugggaaguuucaaucucugggccaaga

SEQ ID NO: 552856 - RNA, 64 nt, Homo Sapiens
gcaacaagcuaguuuaggaacuaggugccucgcuccaugggauucgggggccuggcacagaccc

SEQ ID NO: 552857 - RNA, 64 nt, Homo Sapiens; identical to SEQ ID NO: 291354

SEQ ID NO: 552858 - RNA, 64 nt, Homo Sapiens; identical to SEQ ID NO: 291355

SEQ ID NO: 552859 - RNA, 64 nt, Homo Sapiens; identical to SEQ ID NO: 291356

SEQ ID NO: 552860 - RNA, 64 nt, Homo Sapiens; identical to SEQ ID NO: 291357

SEQ ID NO: 552861 - RNA, 64 nt, Homo Sapiens; identical to SEQ ID NO: 291358

SEQ ID NO: 552862 - RNA, 64 nt, Homo Sapiens; identical to SEQ ID NO: 291359

SEQ ID NO: 552863 - RNA, 64 nt, Homo Sapiens; identical to SEQ ID NO: 552841

SEQ ID NO: 552864 - RNA, 64 nt, Homo Sapiens; identical to SEQ ID NO: 552842

SEQ ID NO: 552865 - RNA, 64 nt, Homo Sapiens; identical to SEQ ID NO: 552843

SEQ ID NO: 552866 - RNA, 64 nt, Homo Sapiens; identical to SEQ ID NO: 552844

SEQ ID NO: 552867 - RNA, 64 nt, Homo Sapiens; identical to SEQ ID NO: 552845

SEQ ID NO: 552868 - RNA, 64 nt, Homo Sapiens; identical to SEQ ID NO: 552846

SEQ ID NO: 552869 - RNA, 64 nt, Homo Sapiens; identical to SEQ ID NO: 552847

SEQ ID NO: 552870 - RNA, 64 nt, Homo Sapiens; identical to SEQ ID NO: 552848

SEQ ID NO: 552871 - RNA, 64 nt, Homo Sapiens; identical to SEQ ID NO: 552849

SEQ ID NO: 552872 - RNA, 64 nt, Homo Sapiens; identical to SEQ ID NO: 552850

SEQ ID NO: 552873 - RNA, 64 nt, Homo Sapiens; identical to SEQ ID NO: 552851

SEQ ID NO: 552874 - RNA, 64 nt, Homo Sapiens; identical to SEQ ID NO: 552852

SEQ ID NO: 552875 - RNA, 64 nt, Homo Sapiens; identical to SEQ ID NO: 552853

SEQ ID NO: 552876 - RNA, 64 nt, Homo Sapiens; identical to SEQ ID NO: 552854

SEQ ID NO: 552877 - RNA, 64 nt, Homo Sapiens; identical to SEQ ID NO: 552855

SEQ ID NO: 552878 - RNA, 64 nt, Homo Sapiens; identical to SEQ ID NO: 552856

SEQ ID NO: 552879 - RNA, 64 nt, Homo Sapiens; identical to SEQ ID NO: 531886

SEQ ID NO: 552880 - RNA, 64 nt, Homo Sapiens; identical to SEQ ID NO: 531887

SEQ ID NO: 552881 - RNA, 64 nt, Homo Sapiens; identical to SEQ ID NO: 531888

SEQ ID NO: 552882 - RNA, 64 nt, Homo Sapiens; identical to SEQ ID NO: 531889

SEQ ID NO: 552883 - RNA, 64 nt, Homo Sapiens; identical to SEQ ID NO: 531890

SEQ ID NO: 552884 - RNA, 64 nt, Homo Sapiens; identical to SEQ ID NO: 531891

SEQ ID NO: 552885 - RNA, 64 nt, Homo Sapiens; identical to SEQ ID NO: 531892

SEQ ID NO: 552886 - RNA, 64 nt, Homo Sapiens; identical to SEQ ID NO: 531893

SEQ ID NO: 552887 - RNA, 64 nt, Homo Sapiens; identical to SEQ ID NO: 531894

SEQ ID NO: 552888 - RNA, 64 nt, Homo Sapiens; identical to SEQ ID NO: 531895

SEQ ID NO: 552889 - RNA, 64 nt, Homo Sapiens; identical to SEQ ID NO: 531896

SEQ ID NO: 552890 - RNA, 64 nt, Homo Sapiens; identical to SEQ ID NO: 531897

SEQ ID NO: 552891 - RNA, 64 nt, Homo Sapiens; identical to SEQ ID NO: 531898

SEQ ID NO: 552892 - RNA, 64 nt, Homo Sapiens; identical to SEQ ID NO: 531899

SEQ ID NO: 552893 - RNA, 64 nt, Homo Sapiens; identical to SEQ ID NO: 531900

SEQ ID NO: 552894 - RNA, 64 nt, Homo Sapiens; identical to SEQ ID NO: 531901

SEQ ID NO: 552895 - RNA, 64 nt, Homo Sapiens; identical to SEQ ID NO: 531902

SEQ ID NO: 552896 - RNA, 64 nt, Homo Sapiens; identical to SEQ ID NO: 531903

SEQ ID NO: 552897 - RNA, 64 nt, Homo Sapiens; identical to SEQ ID NO: 531904

SEQ ID NO: 552898 - RNA, 64 nt, Homo Sapiens; identical to SEQ ID NO: 531905

SEQ ID NO: 552899 - RNA, 64 nt, Homo Sapiens; identical to SEQ ID NO: 531906

SEQ ID NO: 552900 - RNA, 64 nt, Homo Sapiens; identical to SEQ ID NO: 531907

SEQ ID NO: 552901 - RNA, 64 nt, Homo Sapiens; identical to SEQ ID NO: 531908

SEQ ID NO: 552902 - RNA, 64 nt, Homo Sapiens; identical to SEQ ID NO: 531909

SEQ ID NO: 552903 - RNA, 64 nt, Homo Sapiens; identical to SEQ ID NO: 531910

SEQ ID NO: 552904 - RNA, 64 nt, Homo Sapiens; identical to SEQ ID NO: 531911

SEQ ID NO: 552905 - RNA, 64 nt, Homo Sapiens; identical to SEQ ID NO: 531912

SEQ ID NO: 552906 - RNA, 64 nt, Homo Sapiens; identical to SEQ ID NO: 531913

SEQ ID NO: 552907 - RNA, 64 nt, Homo Sapiens; identical to SEQ ID NO: 531914

SEQ ID NO: 552908 - RNA, 64 nt, Homo Sapiens; identical to SEQ ID NO: 531915

SEQ ID NO: 552909 - RNA, 64 nt, Homo Sapiens; identical to SEQ ID NO: 531916

SEQ ID NO: 552910 - RNA, 64 nt, Homo Sapiens; identical to SEQ ID NO: 531917

SEQ ID NO: 552911 - RNA, 64 nt, Homo Sapiens; identical to SEQ ID NO: 531918

SEQ ID NO: 552912 - RNA, 64 nt, Homo Sapiens; identical to SEQ ID NO: 531919

SEQ ID NO: 552913 - RNA, 64 nt, Homo Sapiens; identical to SEQ ID NO: 531920

SEQ ID NO: 552914 - RNA, 64 nt, Homo Sapiens; identical to SEQ ID NO: 531921

SEQ ID NO: 552915 - RNA, 64 nt, Homo Sapiens; identical to SEQ ID NO: 531922

SEQ ID NO: 552916 - RNA, 64 nt, Homo Sapiens; identical to SEQ ID NO: 211201

SEQ ID NO: 552917 - RNA, 64 nt, Homo Sapiens; identical to SEQ ID NO: 211202

SEQ ID NO: 552918 - RNA, 64 nt, Homo Sapiens; identical to SEQ ID NO: 211203

SEQ ID NO: 552919 - RNA, 64 nt, Homo Sapiens; identical to SEQ ID NO: 211204

SEQ ID NO: 552920 - RNA, 64 nt, Homo Sapiens; identical to SEQ ID NO: 211205

SEQ ID NO: 552921 - RNA, 64 nt, Homo Sapiens; identical to SEQ ID NO: 211206

SEQ ID NO: 552922 - RNA, 64 nt, Homo Sapiens; identical to SEQ ID NO: 97018

SEQ ID NO: 552923 - RNA, 64 nt, Homo Sapiens; identical to SEQ ID NO: 97019

SEQ ID NO: 552924 - RNA, 64 nt, Homo Sapiens; identical to SEQ ID NO: 97020

SEQ ID NO: 552925 - RNA, 64 nt, Homo Sapiens; identical to SEQ ID NO: 97021

SEQ ID NO: 552926 - RNA, 64 nt, Homo Sapiens; identical to SEQ ID NO: 97022

SEQ ID NO: 552927 - RNA, 64 nt, Homo Sapiens; identical to SEQ ID NO: 97023

SEQ ID NO: 552928 - RNA, 64 nt, Homo Sapiens; identical to SEQ ID NO: 97024

SEQ ID NO: 552929 - RNA, 64 nt, Homo Sapiens; identical to SEQ ID NO: 97025

SEQ ID NO: 552930 - RNA, 64 nt, Homo Sapiens; identical to SEQ ID NO: 97026

SEQ ID NO: 552931 - RNA, 64 nt, Homo Sapiens; identical to SEQ ID NO: 97027

SEQ ID NO: 552932 - RNA, 64 nt, Homo Sapiens; identical to SEQ ID NO: 97028

SEQ ID NO: 552933 - RNA, 64 nt, Homo Sapiens; identical to SEQ ID NO: 219898

SEQ ID NO: 552934 - RNA, 64 nt, Homo Sapiens; identical to SEQ ID NO: 219899

SEQ ID NO: 552935 - RNA, 64 nt, Homo Sapiens; identical to SEQ ID NO: 219900

SEQ ID NO: 552936 - RNA, 64 nt, Homo Sapiens; identical to SEQ ID NO: 219901

SEQ ID NO: 552937 - RNA, 64 nt, Homo Sapiens; identical to SEQ ID NO: 219902

SEQ ID NO: 552938 - RNA, 64 nt, Homo Sapiens; identical to SEQ ID NO: 219903

SEQ ID NO: 552939 - RNA, 64 nt, Homo Sapiens
uuuuauuaacccuggcuuuggugguaagggaaacuuccagaaaugcuuguggguauauuggaua

SEQ ID NO: 552940 - RNA, 64 nt, Homo Sapiens
aacugugggugacuuuauccucacaucguguuucuuccagaaauucagacgcaacagagguuag

SEQ ID NO: 552941 - RNA, 64 nt, Homo Sapiens
ucuucaugacccuucaacccugauuacuacagaauuccagaauguuaggcucuccagggcuucu

SEQ ID NO: 552942 - RNA, 64 nt, Homo Sapiens
ucagaucccuaugggggcccagcuggcuccacgguuccagaauguucagguggucaguguucua

SEQ ID NO: 552943 - RNA, 64 nt, Homo Sapiens
cucagaaaugucucacagcccagcuggguugcaauuccagaaugcugggaguuuuacagugcca

SEQ ID NO: 552944 - RNA, 64 nt, Homo Sapiens
agcaacucaaagaggcagaagaggagaaugacuuuuccagaauagaaguggagcagugaucauu

SEQ ID NO: 552945 - RNA, 64 nt, Homo Sapiens
cgcaguguucagaaagcugguaaguccuagggauuuccagaaguagccugcagaagaagguaag

SEQ ID NO: 552946 - RNA, 64 nt, Homo Sapiens
ugaacucauauuucuaagguaggagauaauacaauuccagaaaguuauuuuuacucucuggaaa

SEQ ID NO: 552947 - RNA, 64 nt, Homo Sapiens
ccgugccuuagaaaugcuuugaagcacauuugucuuccagaacauaucuaacacaacgccaaca

SEQ ID NO: 552948 - RNA, 64 nt, Homo Sapiens
uuauuaauccgugcugcuugguaacucauaggaauuccagaaaaaauugcuacugguuggcauu

SEQ ID NO: 552949 - RNA, 64 nt, Homo Sapiens
uuagacauuauuacaggguucauauguauauuauuuccagaauuuucuauuucaucuuuugagu

SEQ ID NO: 552950 - RNA, 64 nt, Homo Sapiens
uguuuucucaguuuggagggugauggguagagcuuuccagaaccuucuccauuccagaaucucu

SEQ ID NO: 552951 - RNA, 64 nt, Homo Sapiens
gggugauggguagagcuuuccagaaccuucuccauuccagaaucucugccccuguguaaucuga

SEQ ID NO: 552952 - RNA, 64 nt, Homo Sapiens
aauuguuuacauaaguuccuaaagaaagaaugcauuccagaacauuacccaaauauaaccauuu

SEQ ID NO: 552953 - RNA, 64 nt, Homo Sapiens
aaucauuauguuuccuaacuucuccagcagcugauuccagaacauuuuuaaccacuugccucuu

SEQ ID NO: 552954 - RNA, 64 nt, Homo Sapiens
ucugggauucuacuuuaagcaugagcuauuuccauuccagaauaaaaaugaacugaaguuucac

SEQ ID NO: 552955 - RNA, 64 nt, Homo Sapiens
ucugaaaucauuggaccuguugacaaaaagccuuuuccagaagaguuguggaaauagaagcaaa

SEQ ID NO: 552956 - RNA, 64 nt, Homo Sapiens
uucugauguacacaaauaaccaagguuucucuccuuccagaauuugucauauuuaguaccuuca

SEQ ID NO: 552957 - RNA, 64 nt, Homo Sapiens
auuuauuccauaggguuucuuguugcugaaugcuuuccagaauugcacauuaggacguuucauu

SEQ ID NO: 552958 - RNA, 64 nt, Homo Sapiens
aaacucuuaccuccacauauuauccuacagauguuuccagaaaucccuguuguaacaucaagug

SEQ ID NO: 552959 - RNA, 64 nt, Homo Sapiens
cacauauuuuauauucagcauaaaggagaauaaauuccagaaaacacauauucugaaaauggag

SEQ ID NO: 552960 - RNA, 64 nt, Homo Sapiens
guagauccuauuuuuguuuaacccaaaccugugauuccagaaaaugauaaaacauauccaaagc

SEQ ID NO: 552961 - RNA, 64 nt, Homo Sapiens
aggccagggcauaaguuggagcuagguaaaagaauuccagaaggcagcugugggcucagaaacu

SEQ ID NO: 552962 - RNA, 64 nt, Homo Sapiens
ugcuugggucccacgugacucuauuagcaauggcuuccagaauggacagaaucuagcaucggga

SEQ ID NO: 552963 - RNA, 64 nt, Homo Sapiens
uccuggucucccaugcccaacucacggcugaagauuccagaaggccaucaugguggcuaugaag

SEQ ID NO: 552964 - RNA, 64 nt, Homo Sapiens
uauagaaauagucccuguccaugaaugccgacacuuccagaaugagugagccacaugcaggcug

SEQ ID NO: 552965 - RNA, 64 nt, Homo Sapiens
aaaagugagccacaugcagggaggucuccggcuauuccagaaaguagagcuggagugaggagua

SEQ ID NO: 552966 - RNA, 64 nt, Homo Sapiens
gacagcacaagucugaguugaugcagacuucuauuuccagaaguuccauugccgugcucuuuga

SEQ ID NO: 552967 - RNA, 64 nt, Homo Sapiens
cuguuuuuaguagcuuauugcuaauacaaucuuauuccagaagaaaaugcauguuuagugagca

SEQ ID NO: 552968 - RNA, 64 nt, Homo Sapiens
gagaaacaggaaagaagaaagauaaacauucccauuccagaaagcagugguuggagaggcauag

SEQ ID NO: 552969 - RNA, 64 nt, Homo Sapiens
guuuuuggcaacaggagagaaaccuggggugugguuccagaaaugaagagucaugugggguggg

SEQ ID NO: 552970 - RNA, 64 nt, Homo Sapiens
cccauuaucuggaauauugugauucuguuuauucuuccagaaugcugaacuccuuguuagcccu

SEQ ID NO: 552971 - RNA, 64 nt, Homo Sapiens
aucugcuagaaaguuaggggguucuuauuuugcauuccagaaucuugacuuucugauuggugau

SEQ ID NO: 552972 - RNA, 64 nt, Homo Sapiens
ucaaggguccacuugcuauuaaauaauuuauucauuccagaauggucuuaacacauuuuaucuu

SEQ ID NO: 552973 - RNA, 64 nt, Homo Sapiens
ugguaagguacucaggaaucaccaacauuuuuuuuuccagaaaaaucuuaaaauaaaauagcaa

SEQ ID NO: 552974 - RNA, 64 nt, Homo Sapiens
caaauuaaagguugccccugucaaaguuuuagucuuccagaaucggcggggcgggggagggauc

SEQ ID NO: 552975 - RNA, 64 nt, Homo Sapiens
auggauucugccuuuggaccaagcaucguggcauuuccagaaccgaaugcccagaaagugccag

SEQ ID NO: 552976 - RNA, 64 nt, Homo Sapiens
gaggaaugacuugaaggcaauaagugaagguuaauuccagaagaucugaugucuuggcacaggg

SEQ ID NO: 552977 - RNA, 64 nt, Homo Sapiens
cauuuuuuaccuucagggguuucuauuuuuuauuuuccagaacucucugaauuuugaauuguua

SEQ ID NO: 552978 - RNA, 64 nt, Homo Sapiens
uaauucuuaaguacucugcauaagggggaaaagcuuccagaaagcagccaugaaccaggcuguc

SEQ ID NO: 552979 - RNA, 64 nt, Homo Sapiens
caggccccucgcagcauaaggauguuuugcaacuuuccagaaucuggcccagaaauuagggcuc

SEQ ID NO: 552980 - RNA, 64 nt, Homo Sapiens
ucugucugugagacacagcgcaaugcuacugcccuuccagaaacugugcuaaaaagagaaaguc

SEQ ID NO: 552981 - RNA, 64 nt, Homo Sapiens
aacccggcaaccagaaggggacagauaaggaccguuccagaaaucccaacucucacacccagcc

SEQ ID NO: 552982 - RNA, 64 nt, Homo Sapiens
uguggggaaaaagggcuauugcuuuuguagaaccuuccagaauaccaggaaugaguaucuaaua

SEQ ID NO: 552983 - RNA, 64 nt, Homo Sapiens
aggaaugaguaucuaauagcuggcuuauuuaauuuuccagaaccuggaaaauccuaccaagaau

SEQ ID NO: 552984 - RNA, 64 nt, Homo Sapiens
ucccuagaugaugaauuuaacauccauagcauauuuccagaauauggacaguugauaaaaguuc

SEQ ID NO: 552985 - RNA, 64 nt, Homo Sapiens
gauuuuuuuuuuuagauaaaccauaaaaauaguuuuccagaauguuauccuaaguucugaggag

SEQ ID NO: 552986 - RNA, 64 nt, Homo Sapiens
uuacaagacugaagacccagaguauacuuuuucuuuccagaaauaauuucauaccgccuaugaa

SEQ ID NO: 552987 - RNA, 64 nt, Homo Sapiens
gaaucagaggaaucagacagaggaggauagcucuuuccagaauccacacuucugaccucagccu

SEQ ID NO: 552988 - RNA, 64 nt, Homo Sapiens
cuaaugggaaacugggccuguccccaggcucugcuuccagaacugaugggcaagugacagaccu

SEQ ID NO: 552989 - RNA, 64 nt, Homo Sapiens
cauucuugaccagccaugaaugcauugucgcugauuccagaagugauugcagucaguuccuggg

SEQ ID NO: 552990 - RNA, 64 nt, Homo Sapiens
gccauuugguuaagguuaccugcuuuuuauuuuauuccagaaauaagauaguuacagcauagca

SEQ ID NO: 552991 - RNA, 64 nt, Homo Sapiens
guuggagcuugcacauuuaaaccagcagcauacguuccagaagagcaucucaaguuaccaaauu

SEQ ID NO: 552992 - RNA, 64 nt, Homo Sapiens
acacuuacuuucaucuauguugguuucugucucguuccagaacccacagccuccacccguggcu

SEQ ID NO: 552993 - RNA, 64 nt, Homo Sapiens
agaaaccucaggccgugugaagagcagcaaagcuuuccagaaggcauaaaaggaaacuugaaua

SEQ ID NO: 552994 - RNA, 64 nt, Homo Sapiens
aaaugugaccaauuuagcacaaauucucucuuaguuccagaaaaaucaguaaaugcacaugccc

SEQ ID NO: 552995 - RNA, 64 nt, Homo Sapiens
uuccucuuuucucuguaauuuguuacuaaacaaauuccagaauuuguuuaguagcugaguguuc

SEQ ID NO: 552996 - RNA, 64 nt, Homo Sapiens
aaugauuguugacucuggucuguuucugacaccuuuccagaaaaaagucaauuguucagguaca

SEQ ID NO: 552997 - RNA, 64 nt, Homo Sapiens
uuauagaacuucuggaucuaacucacaaacaagcuuccagaagagacuagagaccuuaggccag

SEQ ID NO: 552998 - RNA, 64 nt, Homo Sapiens
cuccaagggccagggcaccugggagacgggaggauuccagaacagcagcacugagcucccaccc

SEQ ID NO: 552999 - RNA, 64 nt, Homo Sapiens
ugauuaauuuccuucucagcaaaccuccgggagguuccagaaugaguucuuccugacagguugu

SEQ ID NO: 553000 - RNA, 64 nt, Homo Sapiens
agugcgagcguccugcagagcuggccugggccccuuccagaaucacugagcccaaguguauucu

SEQ ID NO: 553001 - RNA, 64 nt, Homo Sapiens
gauuuugcaagcuucaagauugcuugccugcuuuuuccagaaucuccccccacaggcccugcuu

SEQ ID NO: 553002 - RNA, 64 nt, Homo Sapiens
gaauaacaauauuuuuccaaauugaaaguaaauauuccagaaguugauagccugguuaaaaguu

SEQ ID NO: 553003 - RNA, 64 nt, Homo Sapiens
aagaggucuucauuuagacaugugauuucuaaaauuccagaaagcaaaauugauaagauguuag

SEQ ID NO: 553004 - RNA, 64 nt, Homo Sapiens
agccagcccgccuccggggcggacccugcuccacuuccagaagccaggacuaggaccugggccu

SEQ ID NO: 553005 - RNA, 64 nt, Homo Sapiens
aaaaucaugugcuucuucugaucaauuuugguuguuccagaauuucuucauaccuuuuccacau

SEQ ID NO: 553006 - RNA, 64 nt, Homo Sapiens
uuuugccagguuuuucugacuugauuucuguaauuuccagaaacccagacuucucauuuccaca

SEQ ID NO: 553007 - RNA, 64 nt, Homo Sapiens
acacuuugauuuucuaagaggaagguacuuuaaguuccagaaugaacauguagcugcacuaugc

SEQ ID NO: 553008 - RNA, 64 nt, Homo Sapiens
uuaagugacuguagguacuguuuacauuauuguguuccagaacauuuucaaaagaaacuugccu

SEQ ID NO: 553009 - RNA, 64 nt, Homo Sapiens
aauuuuauaacagauuucaucucacugacaagcuuuccagaagcuaaagaaucuggaugcugga

SEQ ID NO: 553010 - RNA, 64 nt, Homo Sapiens; identical to SEQ ID NO: 86802

SEQ ID NO: 553011 - RNA, 64 nt, Homo Sapiens; identical to SEQ ID NO: 86803

SEQ ID NO: 553012 - RNA, 64 nt, Homo Sapiens; identical to SEQ ID NO: 299042

SEQ ID NO: 553013 - RNA, 64 nt, Homo Sapiens; identical to SEQ ID NO: 299043

SEQ ID NO: 553014 - RNA, 64 nt, Homo Sapiens; identical to SEQ ID NO: 299044

SEQ ID NO: 553015 - RNA, 64 nt, Homo Sapiens; identical to SEQ ID NO: 299045

SEQ ID NO: 553016 - RNA, 64 nt, Homo Sapiens; identical to SEQ ID NO: 299046

SEQ ID NO: 553017 - RNA, 64 nt, Homo Sapiens; identical to SEQ ID NO: 299047

SEQ ID NO: 553018 - RNA, 64 nt, Homo Sapiens; identical to SEQ ID NO: 299048

SEQ ID NO: 553019 - RNA, 64 nt, Homo Sapiens; identical to SEQ ID NO: 299049

SEQ ID NO: 553020 - RNA, 64 nt, Homo Sapiens; identical to SEQ ID NO: 299050

SEQ ID NO: 553021 - RNA, 64 nt, Homo Sapiens; identical to SEQ ID NO: 299051

SEQ ID NO: 553022 - RNA, 64 nt, Homo Sapiens; identical to SEQ ID NO: 299052

SEQ ID NO: 553023 - RNA, 64 nt, Homo Sapiens; identical to SEQ ID NO: 299053

SEQ ID NO: 553024 - RNA, 64 nt, Homo Sapiens; identical to SEQ ID NO: 299054

SEQ ID NO: 553025 - RNA, 64 nt, Homo Sapiens; identical to SEQ ID NO: 299055

SEQ ID NO: 553026 - RNA, 64 nt, Homo Sapiens; identical to SEQ ID NO: 299056

SEQ ID NO: 553027 - RNA, 64 nt, Homo Sapiens; identical to SEQ ID NO: 299057

SEQ ID NO: 553028 - RNA, 64 nt, Homo Sapiens; identical to SEQ ID NO: 299058

SEQ ID NO: 553029 - RNA, 64 nt, Homo Sapiens; identical to SEQ ID NO: 299059

SEQ ID NO: 553030 - RNA, 64 nt, Homo Sapiens; identical to SEQ ID NO: 299060

SEQ ID NO: 553031 - RNA, 64 nt, Homo Sapiens; identical to SEQ ID NO: 299061

SEQ ID NO: 553032 - RNA, 64 nt, Homo Sapiens; identical to SEQ ID NO: 299062

SEQ ID NO: 553033 - RNA, 64 nt, Homo Sapiens; identical to SEQ ID NO: 299063

SEQ ID NO: 553034 - RNA, 64 nt, Homo Sapiens; identical to SEQ ID NO: 299064

SEQ ID NO: 553035 - RNA, 64 nt, Homo Sapiens; identical to SEQ ID NO: 299065

SEQ ID NO: 553036 - RNA, 64 nt, Homo Sapiens; identical to SEQ ID NO: 299066

SEQ ID NO: 553037 - RNA, 64 nt, Homo Sapiens; identical to SEQ ID NO: 299067

SEQ ID NO: 553038 - RNA, 64 nt, Homo Sapiens; identical to SEQ ID NO: 299068

SEQ ID NO: 553039 - RNA, 64 nt, Homo Sapiens; identical to SEQ ID NO: 299069

SEQ ID NO: 553040 - RNA, 64 nt, Homo Sapiens; identical to SEQ ID NO: 299070

SEQ ID NO: 553041 - RNA, 64 nt, Homo Sapiens; identical to SEQ ID NO: 299071

SEQ ID NO: 553042 - RNA, 64 nt, Homo Sapiens; identical to SEQ ID NO: 299072

SEQ ID NO: 553043 - RNA, 64 nt, Homo Sapiens; identical to SEQ ID NO: 299073

SEQ ID NO: 553044 - RNA, 64 nt, Homo Sapiens; identical to SEQ ID NO: 299074

SEQ ID NO: 553045 - RNA, 64 nt, Homo Sapiens; identical to SEQ ID NO: 299075

SEQ ID NO: 553046 - RNA, 64 nt, Homo Sapiens; identical to SEQ ID NO: 299076

SEQ ID NO: 553047 - RNA, 64 nt, Homo Sapiens; identical to SEQ ID NO: 299077

SEQ ID NO: 553048 - RNA, 64 nt, Homo Sapiens; identical to SEQ ID NO: 299078

SEQ ID NO: 553049 - RNA, 64 nt, Homo Sapiens; identical to SEQ ID NO: 299079

SEQ ID NO: 553050 - RNA, 64 nt, Homo Sapiens; identical to SEQ ID NO: 299080

SEQ ID NO: 553051 - RNA, 64 nt, Homo Sapiens; identical to SEQ ID NO: 299081

SEQ ID NO: 553052 - RNA, 64 nt, Homo Sapiens; identical to SEQ ID NO: 299082

SEQ ID NO: 553053 - RNA, 64 nt, Homo Sapiens; identical to SEQ ID NO: 299083

SEQ ID NO: 553054 - RNA, 64 nt, Homo Sapiens; identical to SEQ ID NO: 299084

SEQ ID NO: 553055 - RNA, 64 nt, Homo Sapiens; identical to SEQ ID NO: 299085

SEQ ID NO: 553056 - RNA, 64 nt, Homo Sapiens; identical to SEQ ID NO: 299086

SEQ ID NO: 553057 - RNA, 64 nt, Homo Sapiens; identical to SEQ ID NO: 299087

SEQ ID NO: 553058 - RNA, 64 nt, Homo Sapiens; identical to SEQ ID NO: 299088

SEQ ID NO: 553059 - RNA, 64 nt, Homo Sapiens; identical to SEQ ID NO: 299089

SEQ ID NO: 553060 - RNA, 51 nt, Homo Sapiens; identical to SEQ ID NO: 299090

SEQ ID NO: 553061 - RNA, 64 nt, Homo Sapiens; identical to SEQ ID NO: 299091

SEQ ID NO: 553062 - RNA, 64 nt, Homo Sapiens; identical to SEQ ID NO: 299092

SEQ ID NO: 553063 - RNA, 64 nt, Homo Sapiens; identical to SEQ ID NO: 299093

SEQ ID NO: 553064 - RNA, 64 nt, Homo Sapiens; identical to SEQ ID NO: 299094

SEQ ID NO: 553065 - RNA, 64 nt, Homo Sapiens; identical to SEQ ID NO: 299095

SEQ ID NO: 553066 - RNA, 64 nt, Homo Sapiens; identical to SEQ ID NO: 299096

SEQ ID NO: 553067 - RNA, 64 nt, Homo Sapiens; identical to SEQ ID NO: 299097

SEQ ID NO: 553068 - RNA, 64 nt, Homo Sapiens; identical to SEQ ID NO: 299098

SEQ ID NO: 553069 - RNA, 64 nt, Homo Sapiens; identical to SEQ ID NO: 299099

SEQ ID NO: 553070 - RNA, 64 nt, Homo Sapiens; identical to SEQ ID NO: 299100

SEQ ID NO: 553071 - RNA, 64 nt, Homo Sapiens; identical to SEQ ID NO: 299101

SEQ ID NO: 553072 - RNA, 64 nt, Homo Sapiens; identical to SEQ ID NO: 299102

SEQ ID NO: 553073 - RNA, 64 nt, Homo Sapiens; identical to SEQ ID NO: 299103

SEQ ID NO: 553074 - RNA, 64 nt, Homo Sapiens; identical to SEQ ID NO: 299104

SEQ ID NO: 553075 - RNA, 64 nt, Homo Sapiens; identical to SEQ ID NO: 299105

SEQ ID NO: 553076 - RNA, 64 nt, Homo Sapiens; identical to SEQ ID NO: 299106

SEQ ID NO: 553077 - RNA, 64 nt, Homo Sapiens; identical to SEQ ID NO: 299107

SEQ ID NO: 553078 - RNA, 64 nt, Homo Sapiens; identical to SEQ ID NO: 299108

SEQ ID NO: 553079 - RNA, 64 nt, Homo Sapiens; identical to SEQ ID NO: 299109

SEQ ID NO: 553080 - RNA, 64 nt, Homo Sapiens; identical to SEQ ID NO: 299110

SEQ ID NO: 553081 - RNA, 64 nt, Homo Sapiens; identical to SEQ ID NO: 299111

SEQ ID NO: 553082 - RNA, 64 nt, Homo Sapiens; identical to SEQ ID NO: 299112

SEQ ID NO: 553083 - RNA, 64 nt, Homo Sapiens; identical to SEQ ID NO: 299113

SEQ ID NO: 553084 - RNA, 64 nt, Homo Sapiens; identical to SEQ ID NO: 299114

SEQ ID NO: 553085 - RNA, 64 nt, Homo Sapiens; identical to SEQ ID NO: 299115

SEQ ID NO: 553086 - RNA, 64 nt, Homo Sapiens; identical to SEQ ID NO: 299116

SEQ ID NO: 553087 - RNA, 64 nt, Homo Sapiens; identical to SEQ ID NO: 299117

SEQ ID NO: 553088 - RNA, 64 nt, Homo Sapiens; identical to SEQ ID NO: 299118

SEQ ID NO: 553089 - RNA, 64 nt, Homo Sapiens; identical to SEQ ID NO: 299119

SEQ ID NO: 553090 - RNA, 64 nt, Homo Sapiens; identical to SEQ ID NO: 299120

SEQ ID NO: 553091 - RNA, 64 nt, Homo Sapiens; identical to SEQ ID NO: 299121

SEQ ID NO: 553092 - RNA, 64 nt, Homo Sapiens; identical to SEQ ID NO: 299122

SEQ ID NO: 553093 - RNA, 64 nt, Homo Sapiens; identical to SEQ ID NO: 299123

SEQ ID NO: 553094 - RNA, 64 nt, Homo Sapiens; identical to SEQ ID NO: 299124

SEQ ID NO: 553095 - RNA, 64 nt, Homo Sapiens; identical to SEQ ID NO: 299125

SEQ ID NO: 553096 - RNA, 64 nt, Homo Sapiens; identical to SEQ ID NO: 299126

SEQ ID NO: 553097 - RNA, 64 nt, Homo Sapiens; identical to SEQ ID NO: 299127

SEQ ID NO: 553098 - RNA, 64 nt, Homo Sapiens; identical to SEQ ID NO: 299128

SEQ ID NO: 553099 - RNA, 64 nt, Homo Sapiens; identical to SEQ ID NO: 299129

SEQ ID NO: 553100 - RNA, 64 nt, Homo Sapiens; identical to SEQ ID NO: 299130

SEQ ID NO: 553101 - RNA, 64 nt, Homo Sapiens; identical to SEQ ID NO: 299131

SEQ ID NO: 553102 - RNA, 64 nt, Homo Sapiens; identical to SEQ ID NO: 299132

SEQ ID NO: 553103 - RNA, 64 nt, Homo Sapiens; identical to SEQ ID NO: 299133

SEQ ID NO: 553104 - RNA, 64 nt, Homo Sapiens; identical to SEQ ID NO: 299134

SEQ ID NO: 553105 - RNA, 64 nt, Homo Sapiens; identical to SEQ ID NO: 299135

SEQ ID NO: 553106 - RNA, 64 nt, Homo Sapiens; identical to SEQ ID NO: 299136

SEQ ID NO: 553107 - RNA, 64 nt, Homo Sapiens; identical to SEQ ID NO: 299137

SEQ ID NO: 553108 - RNA, 64 nt, Homo Sapiens; identical to SEQ ID NO: 299138

SEQ ID NO: 553109 - RNA, 64 nt, Homo Sapiens; identical to SEQ ID NO: 299139

SEQ ID NO: 553110 - RNA, 64 nt, Homo Sapiens; identical to SEQ ID NO: 299140

SEQ ID NO: 553111 - RNA, 64 nt, Homo Sapiens; identical to SEQ ID NO: 299141

SEQ ID NO: 553112 - RNA, 64 nt, Homo Sapiens; identical to SEQ ID NO: 299142

SEQ ID NO: 553113 - RNA, 64 nt, Homo Sapiens; identical to SEQ ID NO: 299143

SEQ ID NO: 553114 - RNA, 64 nt, Homo Sapiens; identical to SEQ ID NO: 299144

SEQ ID NO: 553115 - RNA, 64 nt, Homo Sapiens; identical to SEQ ID NO: 299145

SEQ ID NO: 553116 - RNA, 64 nt, Homo Sapiens; identical to SEQ ID NO: 299146

SEQ ID NO: 553117 - RNA, 64 nt, Homo Sapiens; identical to SEQ ID NO: 299147

SEQ ID NO: 553118 - RNA, 64 nt, Homo Sapiens; identical to SEQ ID NO: 299148

SEQ ID NO: 553119 - RNA, 64 nt, Homo Sapiens
cguacuacugccaucuuaguaaaaauuuugaaaggaugaccacucagaacaacucucuugauga

SEQ ID NO: 553120 - RNA, 64 nt, Homo Sapiens
uuuugaaaggaugaccacucagaacaacucucuugaugaccauucugucuggaucuacugacau

SEQ ID NO: 553121 - RNA, 64 nt, Homo Sapiens
guguuugcacaguacaguaaaaagugagugaacagcaaggaagacacgccuuuuaggaaaaaga

SEQ ID NO: 553122 - RNA, 64 nt, Homo Sapiens
acagcagugaugacacugucuaccccuugcccaggcaaggaaagaguuaccuucacaauggugc

SEQ ID NO: 553123 - RNA, 64 nt, Homo Sapiens
agaggcaaaaauucuaaagaagcccacuggaguugcaaggaauggaaaacuggaucaagauucu

SEQ ID NO: 553124 - RNA, 64 nt, Homo Sapiens
uucuuuuaaauucugaacugaagacauucuuucugcaaggaaauaauuaagaggggccaagagg

SEQ ID NO: 553125 - RNA, 64 nt, Homo Sapiens
ccagguuccccucuggugucaugucaggcauuuugcaaggaaaagccacuuggggaaagaugga

SEQ ID NO: 553126 - RNA, 62 nt, Homo Sapiens; identical to SEQ ID NO: 82022

SEQ ID NO: 553127 - RNA, 64 nt, Homo Sapiens
cggggcggggggacuuuuuuccuauagcccggcagcaaggaagugaugcaugcuuuaauauuug

SEQ ID NO: 553128 - RNA, 64 nt, Homo Sapiens
augauugacaacagucaagcguaccacuccaaaggcaaggaacccaaaugccugucauuucaca

SEQ ID NO: 553129 - RNA, 64 nt, Homo Sapiens
auuuuccagaaugacacccgaggagcaaggaacagcaaggaauucaggcaagcugugaucugaa

SEQ ID NO: 553130 - RNA, 64 nt, Homo Sapiens
gcaaggaauuauuuuccagagugaucugaaaggagcaaggaacaggggucugaccaggcaagcu

SEQ ID NO: 553131 - RNA, 64 nt, Homo Sapiens; identical to SEQ ID NO: 188922

SEQ ID NO: 553132 - RNA, 64 nt, Homo Sapiens; identical to SEQ ID NO: 188923

SEQ ID NO: 553133 - RNA, 64 nt, Homo Sapiens; identical to SEQ ID NO: 188924

SEQ ID NO: 553134 - RNA, 64 nt, Homo Sapiens; identical to SEQ ID NO: 188925

SEQ ID NO: 553135 - RNA, 64 nt, Homo Sapiens; identical to SEQ ID NO: 188926

SEQ ID NO: 553136 - RNA, 64 nt, Homo Sapiens; identical to SEQ ID NO: 188927

SEQ ID NO: 553137 - RNA, 64 nt, Homo Sapiens; identical to SEQ ID NO: 188928

SEQ ID NO: 553138 - RNA, 64 nt, Homo Sapiens; identical to SEQ ID NO: 188929

SEQ ID NO: 553139 - RNA, 64 nt, Homo Sapiens; identical to SEQ ID NO: 188930

SEQ ID NO: 553140 - RNA, 64 nt, Homo Sapiens; identical to SEQ ID NO: 188931

SEQ ID NO: 553141 - RNA, 64 nt, Homo Sapiens; identical to SEQ ID NO: 188932

SEQ ID NO: 553142 - RNA, 64 nt, Homo Sapiens; identical to SEQ ID NO: 188933

SEQ ID NO: 553143 - RNA, 64 nt, Homo Sapiens; identical to SEQ ID NO: 188934

SEQ ID NO: 553144 - RNA, 64 nt, Homo Sapiens; identical to SEQ ID NO: 188935

SEQ ID NO: 553145 - RNA, 64 nt, Homo Sapiens; identical to SEQ ID NO: 188936

SEQ ID NO: 553146 - RNA, 64 nt, Homo Sapiens; identical to SEQ ID NO: 188937

SEQ ID NO: 553147 - RNA, 64 nt, Homo Sapiens; identical to SEQ ID NO: 188938

SEQ ID NO: 553148 - RNA, 60 nt, Homo Sapiens; identical to SEQ ID NO: 188939

SEQ ID NO: 553149 - RNA, 64 nt, Homo Sapiens; identical to SEQ ID NO: 188940

SEQ ID NO: 553150 - RNA, 64 nt, Homo Sapiens; identical to SEQ ID NO: 188941

SEQ ID NO: 553151 - RNA, 64 nt, Homo Sapiens; identical to SEQ ID NO: 188942

SEQ ID NO: 553152 - RNA, 64 nt, Homo Sapiens; identical to SEQ ID NO: 188943

SEQ ID NO: 553153 - RNA, 64 nt, Homo Sapiens; identical to SEQ ID NO: 188944

SEQ ID NO: 553154 - RNA, 64 nt, Homo Sapiens; identical to SEQ ID NO: 188945

SEQ ID NO: 553155 - RNA, 64 nt, Homo Sapiens; identical to SEQ ID NO: 531886

SEQ ID NO: 553156 - RNA, 64 nt, Homo Sapiens; identical to SEQ ID NO: 531887

SEQ ID NO: 553157 - RNA, 64 nt, Homo Sapiens; identical to SEQ ID NO: 531888

SEQ ID NO: 553158 - RNA, 64 nt, Homo Sapiens; identical to SEQ ID NO: 531889

SEQ ID NO: 553159 - RNA, 64 nt, Homo Sapiens; identical to SEQ ID NO: 531890

SEQ ID NO: 553160 - RNA, 64 nt, Homo Sapiens; identical to SEQ ID NO: 531891

SEQ ID NO: 553161 - RNA, 64 nt, Homo Sapiens; identical to SEQ ID NO: 531892

SEQ ID NO: 553162 - RNA, 64 nt, Homo Sapiens; identical to SEQ ID NO: 531893

SEQ ID NO: 553163 - RNA, 64 nt, Homo Sapiens; identical to SEQ ID NO: 531894

SEQ ID NO: 553164 - RNA, 64 nt, Homo Sapiens; identical to SEQ ID NO: 531895

SEQ ID NO: 553165 - RNA, 64 nt, Homo Sapiens; identical to SEQ ID NO: 531896

SEQ ID NO: 553166 - RNA, 64 nt, Homo Sapiens; identical to SEQ ID NO: 531897

SEQ ID NO: 553167 - RNA, 64 nt, Homo Sapiens; identical to SEQ ID NO: 531898

SEQ ID NO: 553168 - RNA, 64 nt, Homo Sapiens; identical to SEQ ID NO: 531899

SEQ ID NO: 553169 - RNA, 64 nt, Homo Sapiens; identical to SEQ ID NO: 531900

SEQ ID NO: 553170 - RNA, 64 nt, Homo Sapiens; identical to SEQ ID NO: 531901

SEQ ID NO: 553171 - RNA, 64 nt, Homo Sapiens; identical to SEQ ID NO: 531902

SEQ ID NO: 553172 - RNA, 64 nt, Homo Sapiens; identical to SEQ ID NO: 531903

SEQ ID NO: 553173 - RNA, 64 nt, Homo Sapiens; identical to SEQ ID NO: 531904

SEQ ID NO: 553174 - RNA, 64 nt, Homo Sapiens; identical to SEQ ID NO: 531905

SEQ ID NO: 553175 - RNA, 64 nt, Homo Sapiens; identical to SEQ ID NO: 531906

SEQ ID NO: 553176 - RNA, 64 nt, Homo Sapiens; identical to SEQ ID NO: 531907

SEQ ID NO: 553177 - RNA, 64 nt, Homo Sapiens; identical to SEQ ID NO: 531908

SEQ ID NO: 553178 - RNA, 64 nt, Homo Sapiens; identical to SEQ ID NO: 531909

SEQ ID NO: 553179 - RNA, 64 nt, Homo Sapiens; identical to SEQ ID NO: 531910

SEQ ID NO: 553180 - RNA, 64 nt, Homo Sapiens; identical to SEQ ID NO: 531911

SEQ ID NO: 553181 - RNA, 64 nt, Homo Sapiens; identical to SEQ ID NO: 531912

SEQ ID NO: 553182 - RNA, 64 nt, Homo Sapiens; identical to SEQ ID NO: 531913

SEQ ID NO: 553183 - RNA, 64 nt, Homo Sapiens; identical to SEQ ID NO: 531914

SEQ ID NO: 553184 - RNA, 64 nt, Homo Sapiens; identical to SEQ ID NO: 531915

SEQ ID NO: 553185 - RNA, 64 nt, Homo Sapiens; identical to SEQ ID NO: 531916

SEQ ID NO: 553186 - RNA, 64 nt, Homo Sapiens; identical to SEQ ID NO: 531917

SEQ ID NO: 553187 - RNA, 64 nt, Homo Sapiens; identical to SEQ ID NO: 531918

SEQ ID NO: 553188 - RNA, 64 nt, Homo Sapiens; identical to SEQ ID NO: 531919

SEQ ID NO: 553189 - RNA, 64 nt, Homo Sapiens; identical to SEQ ID NO: 531920

SEQ ID NO: 553190 - RNA, 64 nt, Homo Sapiens; identical to SEQ ID NO: 531921

SEQ ID NO: 553191 - RNA, 64 nt, Homo Sapiens; identical to SEQ ID NO: 531922

SEQ ID NO: 553192 - RNA, 64 nt, Homo Sapiens; identical to SEQ ID NO: 211201

SEQ ID NO: 553193 - RNA, 64 nt, Homo Sapiens; identical to SEQ ID NO: 211202

SEQ ID NO: 553194 - RNA, 64 nt, Homo Sapiens; identical to SEQ ID NO: 211203

SEQ ID NO: 553195 - RNA, 64 nt, Homo Sapiens; identical to SEQ ID NO: 211204

SEQ ID NO: 553196 - RNA, 64 nt, Homo Sapiens; identical to SEQ ID NO: 211205

SEQ ID NO: 553197 - RNA, 64 nt, Homo Sapiens; identical to SEQ ID NO: 211206

SEQ ID NO: 553198 - RNA, 64 nt, Homo Sapiens; identical to SEQ ID NO: 267144

SEQ ID NO: 553199 - RNA, 64 nt, Homo Sapiens; identical to SEQ ID NO: 267145

SEQ ID NO: 553200 - RNA, 64 nt, Homo Sapiens; identical to SEQ ID NO: 267146

SEQ ID NO: 553201 - RNA, 64 nt, Homo Sapiens; identical to SEQ ID NO: 267147

SEQ ID NO: 553202 - RNA, 64 nt, Homo Sapiens; identical to SEQ ID NO: 267148

SEQ ID NO: 553203 - RNA, 64 nt, Homo Sapiens; identical to SEQ ID NO: 267149

SEQ ID NO: 553204 - RNA, 64 nt, Homo Sapiens; identical to SEQ ID NO: 267150

SEQ ID NO: 553205 - RNA, 64 nt, Homo Sapiens; identical to SEQ ID NO: 267151

SEQ ID NO: 553206 - RNA, 64 nt, Homo Sapiens; identical to SEQ ID NO: 267152

SEQ ID NO: 553207 - RNA, 64 nt, Homo Sapiens; identical to SEQ ID NO: 267153

SEQ ID NO: 553208 - RNA, 64 nt, Homo Sapiens; identical to SEQ ID NO: 267154

SEQ ID NO: 553209 - RNA, 64 nt, Homo Sapiens; identical to SEQ ID NO: 267155

SEQ ID NO: 553210 - RNA, 64 nt, Homo Sapiens; identical to SEQ ID NO: 267156

SEQ ID NO: 553211 - RNA, 64 nt, Homo Sapiens; identical to SEQ ID NO: 267157

SEQ ID NO: 553212 - RNA, 64 nt, Homo Sapiens; identical to SEQ ID NO: 267157

SEQ ID NO: 553213 - RNA, 64 nt, Homo Sapiens; identical to SEQ ID NO: 267159

SEQ ID NO: 553214 - RNA, 64 nt, Homo Sapiens; identical to SEQ ID NO: 267160

SEQ ID NO: 553215 - RNA, 64 nt, Homo Sapiens; identical to SEQ ID NO: 267161

SEQ ID NO: 553216 - RNA, 64 nt, Homo Sapiens; identical to SEQ ID NO: 267162

SEQ ID NO: 553217 - RNA, 64 nt, Homo Sapiens; identical to SEQ ID NO: 267163

SEQ ID NO: 553218 - RNA, 64 nt, Homo Sapiens; identical to SEQ ID NO: 267164

SEQ ID NO: 553219 - RNA, 64 nt, Homo Sapiens; identical to SEQ ID NO: 267165

SEQ ID NO: 553220 - RNA, 64 nt, Homo Sapiens; identical to SEQ ID NO: 267166

SEQ ID NO: 553221 - RNA, 64 nt, Homo Sapiens; identical to SEQ ID NO: 267167

SEQ ID NO: 553222 - RNA, 64 nt, Homo Sapiens; identical to SEQ ID NO: 267168

SEQ ID NO: 553223 - RNA, 64 nt, Homo Sapiens; identical to SEQ ID NO: 267169

SEQ ID NO: 553224 - RNA, 64 nt, Homo Sapiens; identical to SEQ ID NO: 267170

SEQ ID NO: 553225 - RNA, 64 nt, Homo Sapiens; identical to SEQ ID NO: 267171

SEQ ID NO: 553226 - RNA, 64 nt, Homo Sapiens; identical to SEQ ID NO: 267172

SEQ ID NO: 553227 - RNA, 64 nt, Homo Sapiens; identical to SEQ ID NO: 267173

SEQ ID NO: 553228 - RNA, 64 nt, Homo Sapiens; identical to SEQ ID NO: 267174

SEQ ID NO: 553229 - RNA, 64 nt, Homo Sapiens; identical to SEQ ID NO: 267175

SEQ ID NO: 553230 - RNA, 64 nt, Homo Sapiens; identical to SEQ ID NO: 267176

SEQ ID NO: 553231 - RNA, 64 nt, Homo Sapiens; identical to SEQ ID NO: 267177

SEQ ID NO: 553232 - RNA, 64 nt, Homo Sapiens; identical to SEQ ID NO: 267178

SEQ ID NO: 553233 - RNA, 64 nt, Homo Sapiens; identical to SEQ ID NO: 267179

SEQ ID NO: 553234 - RNA, 64 nt, Homo Sapiens; identical to SEQ ID NO: 267180

SEQ ID NO: 553235 - RNA, 64 nt, Homo Sapiens; identical to SEQ ID NO: 267181

SEQ ID NO: 553236 - RNA, 64 nt, Homo Sapiens; identical to SEQ ID NO: 267182

SEQ ID NO: 553237 - RNA, 64 nt, Homo Sapiens; identical to SEQ ID NO: 267183

SEQ ID NO: 553238 - RNA, 64 nt, Homo Sapiens; identical to SEQ ID NO: 267184

SEQ ID NO: 553239 - RNA, 64 nt, Homo Sapiens; identical to SEQ ID NO: 267185

SEQ ID NO: 553240 - RNA, 64 nt, Homo Sapiens; identical to SEQ ID NO: 267186

SEQ ID NO: 553241 - RNA, 64 nt, Homo Sapiens; identical to SEQ ID NO: 267187

SEQ ID NO: 553242 - RNA, 64 nt, Homo Sapiens; identical to SEQ ID NO: 267188

SEQ ID NO: 553243 - RNA, 64 nt, Homo Sapiens; identical to SEQ ID NO: 267189

SEQ ID NO: 553244 - RNA, 64 nt, Homo Sapiens; identical to SEQ ID NO: 267190

SEQ ID NO: 553245 - RNA, 64 nt, Homo Sapiens; identical to SEQ ID NO: 267191

SEQ ID NO: 553246 - RNA, 64 nt, Homo Sapiens; identical to SEQ ID NO: 267192

SEQ ID NO: 553247 - RNA, 64 nt, Homo Sapiens; identical to SEQ ID NO: 267193

SEQ ID NO: 553248 - RNA, 64 nt, Homo Sapiens; identical to SEQ ID NO: 267194

SEQ ID NO: 553249 - RNA, 64 nt, Homo Sapiens; identical to SEQ ID NO: 267195

SEQ ID NO: 553250 - RNA, 64 nt, Homo Sapiens; identical to SEQ ID NO: 267196

SEQ ID NO: 553251 - RNA, 64 nt, Homo Sapiens; identical to SEQ ID NO: 267197

SEQ ID NO: 553252 - RNA, 64 nt, Homo Sapiens; identical to SEQ ID NO: 267198

SEQ ID NO: 553253 - RNA, 64 nt, Homo Sapiens; identical to SEQ ID NO: 267199

SEQ ID NO: 553254 - RNA, 64 nt, Homo Sapiens; identical to SEQ ID NO: 267200

SEQ ID NO: 553255 - RNA, 64 nt, Homo Sapiens; identical to SEQ ID NO: 437590

SEQ ID NO: 553256 - RNA, 64 nt, Homo Sapiens; identical to SEQ ID NO: 437591

SEQ ID NO: 553257 - RNA, 64 nt, Homo Sapiens; identical to SEQ ID NO: 437592

SEQ ID NO: 553258 - RNA, 64 nt, Homo Sapiens; identical to SEQ ID NO: 437593

SEQ ID NO: 553259 - RNA, 64 nt, Homo Sapiens; identical to SEQ ID NO: 437594

SEQ ID NO: 553260 - RNA, 64 nt, Homo Sapiens; identical to SEQ ID NO: 437595

SEQ ID NO: 553261 - RNA, 64 nt, Homo Sapiens; identical to SEQ ID NO: 437596

SEQ ID NO: 553262 - RNA, 64 nt, Homo Sapiens; identical to SEQ ID NO: 437597

SEQ ID NO: 553263 - RNA, 64 nt, Homo Sapiens; identical to SEQ ID NO: 437598

SEQ ID NO: 553264 - RNA, 64 nt, Homo Sapiens; identical to SEQ ID NO: 437599

SEQ ID NO: 553265 - RNA, 64 nt, Homo Sapiens; identical to SEQ ID NO: 437600

SEQ ID NO: 553266 - RNA, 64 nt, Homo Sapiens; identical to SEQ ID NO: 437601

SEQ ID NO: 553267 - RNA, 64 nt, Homo Sapiens; identical to SEQ ID NO: 437602

SEQ ID NO: 553268 - RNA, 64 nt, Homo Sapiens; identical to SEQ ID NO: 300465

SEQ ID NO: 553269 - RNA, 64 nt, Homo Sapiens; identical to SEQ ID NO: 300466

SEQ ID NO: 553270 - RNA, 64 nt, Homo Sapiens; identical to SEQ ID NO: 300467

SEQ ID NO: 553271 - RNA, 64 nt, Homo Sapiens; identical to SEQ ID NO: 300468

SEQ ID NO: 553272 - RNA, 64 nt, Homo Sapiens; identical to SEQ ID NO: 300469

SEQ ID NO: 553273 - RNA, 64 nt, Homo Sapiens; identical to SEQ ID NO: 300470

SEQ ID NO: 553274 - RNA, 64 nt, Homo Sapiens; identical to SEQ ID NO: 300471

SEQ ID NO: 553275 - RNA, 64 nt, Homo Sapiens; identical to SEQ ID NO: 300472

SEQ ID NO: 553276 - RNA, 64 nt, Homo Sapiens; identical to SEQ ID NO: 313115

SEQ ID NO: 553277 - RNA, 64 nt, Homo Sapiens; identical to SEQ ID NO: 313116

SEQ ID NO: 553278 - RNA, 64 nt, Homo Sapiens; identical to SEQ ID NO: 313117

SEQ ID NO: 553279 - RNA, 64 nt, Homo Sapiens; identical to SEQ ID NO: 313118

SEQ ID NO: 553280 - RNA, 64 nt, Homo Sapiens; identical to SEQ ID NO: 313119

SEQ ID NO: 553281 - RNA, 64 nt, Homo Sapiens; identical to SEQ ID NO: 313120

SEQ ID NO: 553282 - RNA, 64 nt, Homo Sapiens; identical to SEQ ID NO: 313121

SEQ ID NO: 553283 - RNA, 64 nt, Homo Sapiens; identical to SEQ ID NO: 313122

SEQ ID NO: 553284 - RNA, 64 nt, Homo Sapiens; identical to SEQ ID NO: 313123

SEQ ID NO: 553285 - RNA, 64 nt, Homo Sapiens; identical to SEQ ID NO: 313124

SEQ ID NO: 553286 - RNA, 64 nt, Homo Sapiens; identical to SEQ ID NO: 263047

SEQ ID NO: 553287 - RNA, 64 nt, Homo Sapiens; identical to SEQ ID NO: 263048

SEQ ID NO: 553288 - RNA, 64 nt, Homo Sapiens; identical to SEQ ID NO: 263049

SEQ ID NO: 553289 - RNA, 64 nt, Homo Sapiens; identical to SEQ ID NO: 263050

SEQ ID NO: 553290 - RNA, 64 nt, Homo Sapiens; identical to SEQ ID NO: 263051

SEQ ID NO: 553291 - RNA, 64 nt, Homo Sapiens; identical to SEQ ID NO: 263052

SEQ ID NO: 553292 - RNA, 64 nt, Homo Sapiens; identical to SEQ ID NO: 263053

SEQ ID NO: 553293 - RNA, 64 nt, Homo Sapiens; identical to SEQ ID NO: 263054

SEQ ID NO: 553294 - RNA, 64 nt, Homo Sapiens; identical to SEQ ID NO: 263055

SEQ ID NO: 553295 - RNA, 64 nt, Homo Sapiens; identical to SEQ ID NO: 263056

SEQ ID NO: 553296 - RNA, 64 nt, Homo Sapiens; identical to SEQ ID NO: 263057

SEQ ID NO: 553297 - RNA, 64 nt, Homo Sapiens; identical to SEQ ID NO: 263058

SEQ ID NO: 553298 - RNA, 64 nt, Homo Sapiens; identical to SEQ ID NO: 263059

SEQ ID NO: 553299 - RNA, 64 nt, Homo Sapiens; identical to SEQ ID NO: 263060

SEQ ID NO: 553300 - RNA, 64 nt, Homo Sapiens; identical to SEQ ID NO: 263061

SEQ ID NO: 553301 - RNA, 64 nt, Homo Sapiens; identical to SEQ ID NO: 263062

SEQ ID NO: 553302 - RNA, 64 nt, Homo Sapiens; identical to SEQ ID NO: 263063

SEQ ID NO: 553303 - RNA, 64 nt, Homo Sapiens; identical to SEQ ID NO: 263064

SEQ ID NO: 553304 - RNA, 64 nt, Homo Sapiens; identical to SEQ ID NO: 263065

SEQ ID NO: 553305 - RNA, 64 nt, Homo Sapiens; identical to SEQ ID NO: 263066

SEQ ID NO: 553306 - RNA, 64 nt, Homo Sapiens; identical to SEQ ID NO: 263067

SEQ ID NO: 553307 - RNA, 64 nt, Homo Sapiens; identical to SEQ ID NO: 263068

SEQ ID NO: 553308 - RNA, 64 nt, Homo Sapiens; identical to SEQ ID NO: 263069

SEQ ID NO: 553309 - RNA, 64 nt, Homo Sapiens; identical to SEQ ID NO: 263070

SEQ ID NO: 553310 - RNA, 64 nt, Homo Sapiens; identical to SEQ ID NO: 263071

SEQ ID NO: 553311 - RNA, 64 nt, Homo Sapiens; identical to SEQ ID NO: 263072

SEQ ID NO: 553312 - RNA, 64 nt, Homo Sapiens; identical to SEQ ID NO: 263073

SEQ ID NO: 553313 - RNA, 64 nt, Homo Sapiens; identical to SEQ ID NO: 263074

SEQ ID NO: 553314 - RNA, 64 nt, Homo Sapiens; identical to SEQ ID NO: 263075

SEQ ID NO: 553315 - RNA, 64 nt, Homo Sapiens; identical to SEQ ID NO: 263076

SEQ ID NO: 553316 - RNA, 64 nt, Homo Sapiens; identical to SEQ ID NO: 263077

SEQ ID NO: 553317 - RNA, 64 nt, Homo Sapiens; identical to SEQ ID NO: 263078

SEQ ID NO: 553318 - RNA, 64 nt, Homo Sapiens; identical to SEQ ID NO: 263079

SEQ ID NO: 553319 - RNA, 64 nt, Homo Sapiens; identical to SEQ ID NO: 263080

SEQ ID NO: 553320 - RNA, 64 nt, Homo Sapiens; identical to SEQ ID NO: 263081

SEQ ID NO: 553321 - RNA, 64 nt, Homo Sapiens; identical to SEQ ID NO: 263082

SEQ ID NO: 553322 - RNA, 64 nt, Homo Sapiens; identical to SEQ ID NO: 263083

SEQ ID NO: 553323 - RNA, 64 nt, Homo Sapiens; identical to SEQ ID NO: 263084

SEQ ID NO: 553324 - RNA, 64 nt, Homo Sapiens; identical to SEQ ID NO: 263085

SEQ ID NO: 553325 - RNA, 64 nt, Homo Sapiens; identical to SEQ ID NO: 263086

SEQ ID NO: 553326 - RNA, 64 nt, Homo Sapiens; identical to SEQ ID NO: 263087

SEQ ID NO: 553327 - RNA, 64 nt, Homo Sapiens; identical to SEQ ID NO: 263088

SEQ ID NO: 553328 - RNA, 64 nt, Homo Sapiens; identical to SEQ ID NO: 263089

SEQ ID NO: 553329 - RNA, 64 nt, Homo Sapiens; identical to SEQ ID NO: 263090

SEQ ID NO: 553330 - RNA, 64 nt, Homo Sapiens; identical to SEQ ID NO: 263091

SEQ ID NO: 553331 - RNA, 64 nt, Homo Sapiens; identical to SEQ ID NO: 263092

SEQ ID NO: 553332 - RNA, 64 nt, Homo Sapiens; identical to SEQ ID NO: 263093

SEQ ID NO: 553333 - RNA, 64 nt, Homo Sapiens; identical to SEQ ID NO: 263094

SEQ ID NO: 553334 - RNA, 64 nt, Homo Sapiens; identical to SEQ ID NO: 263095

SEQ ID NO: 553335 - RNA, 64 nt, Homo Sapiens; identical to SEQ ID NO: 263096

SEQ ID NO: 553336 - RNA, 64 nt, Homo Sapiens; identical to SEQ ID NO: 263097

SEQ ID NO: 553337 - RNA, 64 nt, Homo Sapiens; identical to SEQ ID NO: 263098

SEQ ID NO: 553338 - RNA, 64 nt, Homo Sapiens
acuuaaugaaccacguguuuggcccugccccucuucccgggaucaagugagaaaccagccgacc

SEQ ID NO: 553339 - RNA, 64 nt, Homo Sapiens
ggagaucagggcgaccugcaugcgagcauuucccucccgggagacagggcaacucggagagggc

SEQ ID NO: 553340 - RNA, 64 nt, Homo Sapiens
ccacccucccagcucugaggagcaccaccaggucucccgggaagcgggacucacuggcagcccc

SEQ ID NO: 553341 - RNA, 64 nt, Homo Sapiens
cacuggcagccccagcaccacccaauauccucgcucccgggacucucugccggcucuggcucuc

SEQ ID NO: 553342 - RNA, 64 nt, Homo Sapiens
gccucgccugaaucccccauaaacaccagaugauugagucuaccuucuuuccuuggcccgcucc

SEQ ID NO: 553343 - RNA, 64 nt, Homo Sapiens
gccucacuugaaucccccguaaacaccagacgauugagucuaccuucuuuucuuggccaccucc

SEQ ID NO: 553344 - RNA, 64 nt, Homo Sapiens
ugugguuccagaaagcucauuaguugagauucugugagucuagguugaccacagaggcaagcac

SEQ ID NO: 553345 - RNA, 64 nt, Homo Sapiens
gugagucuagguugaccacagaggcaagcacuggugagucuaggacagauuuuacguggagagu

SEQ ID NO: 553346 - RNA, 64 nt, Homo Sapiens
uaguggacaagggaagggggaggcccagggcuggugagucuagaaugcucuggaacccuacacc

SEQ ID NO: 553347 - RNA, 64 nt, Homo Sapiens
cuaggauuuucaacuuuuuaacagugauuugggaugagucuacucucaagaaaagacagaagag

SEQ ID NO: 553348 - RNA, 64 nt, Homo Sapiens
cuuggguauugaacuuuuagucuguguuuuggaaugagucuauuuguuacagaaaagacaagaa

SEQ ID NO: 553349 - RNA, 64 nt, Homo Sapiens
cuuggauuuugaauguuuaggaaaugcuuugggaugagucuauuuugaagaaaggacagaagag

SEQ ID NO: 553350 - RNA, 64 nt, Homo Sapiens; identical to SEQ ID NO: 196058

SEQ ID NO: 553351 - RNA, 64 nt, Homo Sapiens; identical to SEQ ID NO: 196059

SEQ ID NO: 553352 - RNA, 64 nt, Homo Sapiens; identical to SEQ ID NO: 196060

SEQ ID NO: 553353 - RNA, 64 nt, Homo Sapiens; identical to SEQ ID NO: 196061

SEQ ID NO: 553354 - RNA, 64 nt, Homo Sapiens; identical to SEQ ID NO: 196062

SEQ ID NO: 553355 - RNA, 64 nt, Homo Sapiens; identical to SEQ ID NO: 196063

SEQ ID NO: 553356 - RNA, 64 nt, Homo Sapiens; identical to SEQ ID NO: 196064

SEQ ID NO: 553357 - RNA, 64 nt, Homo Sapiens; identical to SEQ ID NO: 196065

SEQ ID NO: 553358 - RNA, 64 nt, Homo Sapiens; identical to SEQ ID NO: 196066

SEQ ID NO: 553359 - RNA, 64 nt, Homo Sapiens; identical to SEQ ID NO: 485329

SEQ ID NO: 553360 - RNA, 64 nt, Homo Sapiens; identical to SEQ ID NO: 485330

SEQ ID NO: 553361 - RNA, 64 nt, Homo Sapiens; identical to SEQ ID NO: 485331

SEQ ID NO: 553362 - RNA, 64 nt, Homo Sapiens; identical to SEQ ID NO: 485332

SEQ ID NO: 553363 - RNA, 64 nt, Homo Sapiens; identical to SEQ ID NO: 485333

SEQ ID NO: 553364 - RNA, 64 nt, Homo Sapiens; identical to SEQ ID NO: 485334

SEQ ID NO: 553365 - RNA, 64 nt, Homo Sapiens; identical to SEQ ID NO: 485335

SEQ ID NO: 553366 - RNA, 64 nt, Homo Sapiens; identical to SEQ ID NO: 485336

SEQ ID NO: 553367 - RNA, 64 nt, Homo Sapiens; identical to SEQ ID NO: 485337

SEQ ID NO: 553368 - RNA, 64 nt, Homo Sapiens; identical to SEQ ID NO: 485338

SEQ ID NO: 553369 - RNA, 64 nt, Homo Sapiens; identical to SEQ ID NO: 485339

SEQ ID NO: 553370 - RNA, 64 nt, Homo Sapiens; identical to SEQ ID NO: 485340

SEQ ID NO: 553371 - RNA, 64 nt, Homo Sapiens; identical to SEQ ID NO: 485341

SEQ ID NO: 553372 - RNA, 64 nt, Homo Sapiens; identical to SEQ ID NO: 485342

SEQ ID NO: 553373 - RNA, 64 nt, Homo Sapiens; identical to SEQ ID NO: 485343

SEQ ID NO: 553374 - RNA, 64 nt, Homo Sapiens; identical to SEQ ID NO: 485344

SEQ ID NO: 553375 - RNA, 64 nt, Homo Sapiens; identical to SEQ ID NO: 485345

SEQ ID NO: 553376 - RNA, 64 nt, Homo Sapiens; identical to SEQ ID NO: 485346

SEQ ID NO: 553377 - RNA, 64 nt, Homo Sapiens; identical to SEQ ID NO: 485347

SEQ ID NO: 553378 - RNA, 64 nt, Homo Sapiens; identical to SEQ ID NO: 485348

SEQ ID NO: 553379 - RNA, 64 nt, Homo Sapiens; identical to SEQ ID NO: 485349

SEQ ID NO: 553380 - RNA, 64 nt, Homo Sapiens; identical to SEQ ID NO: 485350

SEQ ID NO: 553381 - RNA, 64 nt, Homo Sapiens; identical to SEQ ID NO: 485351

SEQ ID NO: 553382 - RNA, 64 nt, Homo Sapiens; identical to SEQ ID NO: 485352

SEQ ID NO: 553383 - RNA, 64 nt, Homo Sapiens; identical to SEQ ID NO: 485353

SEQ ID NO: 553384 - RNA, 64 nt, Homo Sapiens; identical to SEQ ID NO: 485354

SEQ ID NO: 553385 - RNA, 64 nt, Homo Sapiens; identical to SEQ ID NO: 485355

SEQ ID NO: 553386 - RNA, 64 nt, Homo Sapiens; identical to SEQ ID NO: 485356

SEQ ID NO: 553387 - RNA, 64 nt, Homo Sapiens; identical to SEQ ID NO: 485357

SEQ ID NO: 553388 - RNA, 64 nt, Homo Sapiens; identical to SEQ ID NO: 485358

SEQ ID NO: 553389 - RNA, 64 nt, Homo Sapiens; identical to SEQ ID NO: 485359

SEQ ID NO: 553390 - RNA, 64 nt, Homo Sapiens; identical to SEQ ID NO: 485360

SEQ ID NO: 553391 - RNA, 64 nt, Homo Sapiens; identical to SEQ ID NO: 485361

SEQ ID NO: 553392 - RNA, 64 nt, Homo Sapiens; identical to SEQ ID NO: 485362

SEQ ID NO: 553393 - RNA, 64 nt, Homo Sapiens; identical to SEQ ID NO: 485363

SEQ ID NO: 553394 - RNA, 64 nt, Homo Sapiens; identical to SEQ ID NO: 485364

SEQ ID NO: 553395 - RNA, 64 nt, Homo Sapiens; identical to SEQ ID NO: 485365

SEQ ID NO: 553396 - RNA, 64 nt, Homo Sapiens; identical to SEQ ID NO: 485366

SEQ ID NO: 553397 - RNA, 64 nt, Homo Sapiens; identical to SEQ ID NO: 485367

SEQ ID NO: 553398 - RNA, 64 nt, Homo Sapiens; identical to SEQ ID NO: 485368

SEQ ID NO: 553399 - RNA, 64 nt, Homo Sapiens; identical to SEQ ID NO: 485369

SEQ ID NO: 553400 - RNA, 64 nt, Homo Sapiens; identical to SEQ ID NO: 485370

SEQ ID NO: 553401 - RNA, 64 nt, Homo Sapiens; identical to SEQ ID NO: 485371

SEQ ID NO: 553402 - RNA, 64 nt, Homo Sapiens; identical to SEQ ID NO: 485372

SEQ ID NO: 553403 - RNA, 64 nt, Homo Sapiens; identical to SEQ ID NO: 485373

SEQ ID NO: 553404 - RNA, 64 nt, Homo Sapiens; identical to SEQ ID NO: 485374

SEQ ID NO: 553405 - RNA, 64 nt, Homo Sapiens; identical to SEQ ID NO: 485375

SEQ ID NO: 553406 - RNA, 64 nt, Homo Sapiens; identical to SEQ ID NO: 485376

SEQ ID NO: 553407 - RNA, 64 nt, Homo Sapiens; identical to SEQ ID NO: 485377

SEQ ID NO: 553408 - RNA, 64 nt, Homo Sapiens; identical to SEQ ID NO: 485378

SEQ ID NO: 553409 - RNA, 64 nt, Homo Sapiens; identical to SEQ ID NO: 121134

SEQ ID NO: 553410 - RNA, 64 nt, Homo Sapiens; identical to SEQ ID NO: 121135

SEQ ID NO: 553411 - RNA, 64 nt, Homo Sapiens; identical to SEQ ID NO: 121136

SEQ ID NO: 553412 - RNA, 64 nt, Homo Sapiens; identical to SEQ ID NO: 121137

SEQ ID NO: 553413 - RNA, 64 nt, Homo Sapiens; identical to SEQ ID NO: 121138

SEQ ID NO: 553414 - RNA, 64 nt, Homo Sapiens; identical to SEQ ID NO: 121139

SEQ ID NO: 553415 - RNA, 64 nt, Homo Sapiens; identical to SEQ ID NO: 121140

SEQ ID NO: 553416 - RNA, 64 nt, Homo Sapiens; identical to SEQ ID NO: 121141

SEQ ID NO: 553417 - RNA, 64 nt, Homo Sapiens; identical to SEQ ID NO: 121142

SEQ ID NO: 553418 - RNA, 64 nt, Homo Sapiens; identical to SEQ ID NO: 121143

SEQ ID NO: 553419 - RNA, 64 nt, Homo Sapiens; identical to SEQ ID NO: 121144

SEQ ID NO: 553420 - RNA, 64 nt, Homo Sapiens; identical to SEQ ID NO: 121145

SEQ ID NO: 553421 - RNA, 64 nt, Homo Sapiens; identical to SEQ ID NO: 121146

SEQ ID NO: 553422 - RNA, 64 nt, Homo Sapiens; identical to SEQ ID NO: 121147

SEQ ID NO: 553423 - RNA, 64 nt, Homo Sapiens; identical to SEQ ID NO: 176098

SEQ ID NO: 553424 - RNA, 64 nt, Homo Sapiens; identical to SEQ ID NO: 176099

SEQ ID NO: 553425 - RNA, 64 nt, Homo Sapiens; identical to SEQ ID NO: 176100

SEQ ID NO: 553426 - RNA, 64 nt, Homo Sapiens; identical to SEQ ID NO: 176101

SEQ ID NO: 553427 - RNA, 64 nt, Homo Sapiens; identical to SEQ ID NO: 176102

SEQ ID NO: 553428 - RNA, 64 nt, Homo Sapiens; identical to SEQ ID NO: 176103

SEQ ID NO: 553429 - RNA, 64 nt, Homo Sapiens; identical to SEQ ID NO: 176104

SEQ ID NO: 553430 - RNA, 64 nt, Homo Sapiens; identical to SEQ ID NO: 176105

SEQ ID NO: 553431 - RNA, 64 nt, Homo Sapiens; identical to SEQ ID NO: 176106

SEQ ID NO: 553432 - RNA, 64 nt, Homo Sapiens; identical to SEQ ID NO: 176107

SEQ ID NO: 553433 - RNA, 64 nt, Homo Sapiens; identical to SEQ ID NO: 176108

SEQ ID NO: 553434 - RNA, 64 nt, Homo Sapiens; identical to SEQ ID NO: 176109

SEQ ID NO: 553435 - RNA, 64 nt, Homo Sapiens; identical to SEQ ID NO: 176110

SEQ ID NO: 553436 - RNA, 64 nt, Homo Sapiens; identical to SEQ ID NO: 176111

SEQ ID NO: 553437 - RNA, 64 nt, Homo Sapiens; identical to SEQ ID NO: 176112

SEQ ID NO: 553438 - RNA, 64 nt, Homo Sapiens; identical to SEQ ID NO: 176113

SEQ ID NO: 553439 - RNA, 64 nt, Homo Sapiens; identical to SEQ ID NO: 43999

SEQ ID NO: 553440 - RNA, 64 nt, Homo Sapiens; identical to SEQ ID NO: 44000

SEQ ID NO: 553441 - RNA, 64 nt, Homo Sapiens; identical to SEQ ID NO: 44001

SEQ ID NO: 553442 - RNA, 64 nt, Homo Sapiens; identical to SEQ ID NO: 44002

SEQ ID NO: 553443 - RNA, 64 nt, Homo Sapiens; identical to SEQ ID NO: 44003

SEQ ID NO: 553444 - RNA, 64 nt, Homo Sapiens; identical to SEQ ID NO: 44004

SEQ ID NO: 553445 - RNA, 64 nt, Homo Sapiens; identical to SEQ ID NO: 44005

SEQ ID NO: 553446 - RNA, 64 nt, Homo Sapiens; identical to SEQ ID NO: 44006

SEQ ID NO: 553447 - RNA, 64 nt, Homo Sapiens; identical to SEQ ID NO: 44007

SEQ ID NO: 553448 - RNA, 64 nt, Homo Sapiens; identical to SEQ ID NO: 44008

SEQ ID NO: 553449 - RNA, 64 nt, Homo Sapiens; identical to SEQ ID NO: 44009

SEQ ID NO: 553450 - RNA, 64 nt, Homo Sapiens; identical to SEQ ID NO: 44010

SEQ ID NO: 553451 - RNA, 64 nt, Homo Sapiens; identical to SEQ ID NO: 44011

SEQ ID NO: 553452 - RNA, 64 nt, Homo Sapiens; identical to SEQ ID NO: 44012

SEQ ID NO: 553453 - RNA, 64 nt, Homo Sapiens; identical to SEQ ID NO: 44013

SEQ ID NO: 553454 - RNA, 64 nt, Homo Sapiens; identical to SEQ ID NO: 44014

SEQ ID NO: 553455 - RNA, 64 nt, Homo Sapiens; identical to SEQ ID NO: 44015

SEQ ID NO: 553456 - RNA, 64 nt, Homo Sapiens; identical to SEQ ID NO: 44016

SEQ ID NO: 553457 - RNA, 64 nt, Homo Sapiens; identical to SEQ ID NO: 44015

SEQ ID NO: 553458 - RNA, 64 nt, Homo Sapiens; identical to SEQ ID NO: 44016

SEQ ID NO: 553459 - RNA, 64 nt, Homo Sapiens; identical to SEQ ID NO: 195961

SEQ ID NO: 553460 - RNA, 64 nt, Homo Sapiens; identical to SEQ ID NO: 195962

SEQ ID NO: 553461 - RNA, 64 nt, Homo Sapiens; identical to SEQ ID NO: 195963

SEQ ID NO: 553462 - RNA, 64 nt, Homo Sapiens; identical to SEQ ID NO: 195964

SEQ ID NO: 553463 - RNA, 64 nt, Homo Sapiens; identical to SEQ ID NO: 195965

SEQ ID NO: 553464 - RNA, 64 nt, Homo Sapiens; identical to SEQ ID NO: 195966

SEQ ID NO: 553465 - RNA, 64 nt, Homo Sapiens; identical to SEQ ID NO: 195967

SEQ ID NO: 553466 - RNA, 64 nt, Homo Sapiens; identical to SEQ ID NO: 195968

SEQ ID NO: 553467 - RNA, 64 nt, Homo Sapiens; identical to SEQ ID NO: 195969

SEQ ID NO: 553468 - RNA, 64 nt, Homo Sapiens; identical to SEQ ID NO: 195970

SEQ ID NO: 553469 - RNA, 64 nt, Homo Sapiens; identical to SEQ ID NO: 195971

SEQ ID NO: 553470 - RNA, 64 nt, Homo Sapiens; identical to SEQ ID NO: 195972

SEQ ID NO: 553471 - RNA, 64 nt, Homo Sapiens; identical to SEQ ID NO: 195973

SEQ ID NO: 553472 - RNA, 64 nt, Homo Sapiens; identical to SEQ ID NO: 195974

SEQ ID NO: 553473 - RNA, 64 nt, Homo Sapiens; identical to SEQ ID NO: 195975

SEQ ID NO: 553474 - RNA, 64 nt, Homo Sapiens; identical to SEQ ID NO: 195976

SEQ ID NO: 553475 - RNA, 64 nt, Homo Sapiens; identical to SEQ ID NO: 195977

SEQ ID NO: 553476 - RNA, 64 nt, Homo Sapiens; identical to SEQ ID NO: 195978

SEQ ID NO: 553477 - RNA, 64 nt, Homo Sapiens; identical to SEQ ID NO: 195979

SEQ ID NO: 553478 - RNA, 64 nt, Homo Sapiens; identical to SEQ ID NO: 195980

SEQ ID NO: 553479 - RNA, 64 nt, Homo Sapiens; identical to SEQ ID NO: 195981

SEQ ID NO: 553480 - RNA, 64 nt, Homo Sapiens; identical to SEQ ID NO: 195982

SEQ ID NO: 553481 - RNA, 64 nt, Homo Sapiens; identical to SEQ ID NO: 195983

SEQ ID NO: 553482 - RNA, 64 nt, Homo Sapiens; identical to SEQ ID NO: 195984

SEQ ID NO: 553483 - RNA, 64 nt, Homo Sapiens; identical to SEQ ID NO: 195985

SEQ ID NO: 553484 - RNA, 64 nt, Homo Sapiens; identical to SEQ ID NO: 195986

SEQ ID NO: 553485 - RNA, 64 nt, Homo Sapiens; identical to SEQ ID NO: 195987

SEQ ID NO: 553486 - RNA, 64 nt, Homo Sapiens; identical to SEQ ID NO: 333488

SEQ ID NO: 553487 - RNA, 64 nt, Homo Sapiens; identical to SEQ ID NO: 333489

SEQ ID NO: 553488 - RNA, 64 nt, Homo Sapiens; identical to SEQ ID NO: 333490

SEQ ID NO: 553489 - RNA, 54 nt, Homo Sapiens; identical to SEQ ID NO: 333491

SEQ ID NO: 553490 - RNA, 64 nt, Homo Sapiens; identical to SEQ ID NO: 333492

SEQ ID NO: 553491 - RNA, 64 nt, Homo Sapiens; identical to SEQ ID NO: 333493

SEQ ID NO: 553492 - RNA, 64 nt, Homo Sapiens; identical to SEQ ID NO: 333494

SEQ ID NO: 553493 - RNA, 64 nt, Homo Sapiens; identical to SEQ ID NO: 333495

SEQ ID NO: 553494 - RNA, 64 nt, Homo Sapiens; identical to SEQ ID NO: 333496

SEQ ID NO: 553495 - RNA, 64 nt, Homo Sapiens; identical to SEQ ID NO: 333497

SEQ ID NO: 553496 - RNA, 64 nt, Homo Sapiens; identical to SEQ ID NO: 333498

SEQ ID NO: 553497 - RNA, 64 nt, Homo Sapiens; identical to SEQ ID NO: 333499

SEQ ID NO: 553498 - RNA, 64 nt, Homo Sapiens; identical to SEQ ID NO: 333500

SEQ ID NO: 553499 - RNA, 64 nt, Homo Sapiens; identical to SEQ ID NO: 333501

SEQ ID NO: 553500 - RNA, 64 nt, Homo Sapiens
uuuaacagcugagcaaaaacauugagucgcucucaaaggacacgaggcccuuggcagggaauau

SEQ ID NO: 553501 - RNA, 64 nt, Homo Sapiens
aaaccaggcauccaauuuguaaaccaauuaugauaaaggacaaaauaagcuguuugccaccuca

SEQ ID NO: 553502 - RNA, 64 nt, Homo Sapiens
aguuagaggggacaucacuuagaaguucuuauagaaaggacacaaguuuguuuccuggcuuuac

SEQ ID NO: 553503 - RNA, 64 nt, Homo Sapiens
ugguguuucuaaauaauuggagguacucuaauauaaaggacaggauuacaaagacaacuggggc

SEQ ID NO: 553504 - RNA, 64 nt, Homo Sapiens
uuauuuuuuuuacuuuagcaguuuggcuugaacuaaaggacauucugaaguggcaccaacagaa

SEQ ID NO: 553505 - RNA, 64 nt, Homo Sapiens
aucucuuuuucccuuguagaucaugcuaaagaggaaaggacagugugcuugguuagaguaaagg

SEQ ID NO: 553506 - RNA, 64 nt, Homo Sapiens
cacuuaucagcaacccuaccacuuucaucugcugaaaggacaaaugugcuugguuuuacuauua

SEQ ID NO: 553507 - RNA, 64 nt, Homo Sapiens
aaaaucucuuuaccuccuugugacuucuuaggcuaaaggacaaauuguggaggcucgaggaagc

SEQ ID NO: 553508 - RNA, 64 nt, Homo Sapiens
guaauggcacuccauucggggaaaggaaggcuguaaaggacaugccgucccagaugggucugag

SEQ ID NO: 553509 - RNA, 64 nt, Homo Sapiens
augaacuuuuugaacugacauaggcaggagugccaaaggacacuaaaauauugcagugacuuuu

SEQ ID NO: 553510 - RNA, 64 nt, Homo Sapiens
uuaccuaauggugccagccugcccugccugucugaaaggacaguuucagaacuagauuagcauu

SEQ ID NO: 553511 - RNA, 64 nt, Homo Sapiens
uuuuucguauccugcuuuucuuauauuggaguaaaaaggacaggguauagacaugaaugaugau

SEQ ID NO: 553512 - RNA, 64 nt, Homo Sapiens
aaugucccaugauuuaauauaugugguuugggggaaaggacaagaaaaaacuauaauuccacau

SEQ ID NO: 553513 - RNA, 64 nt, Homo Sapiens
gcuggccccagagaugaucuugcccuuccuaacuaaaggacagaagugcaauuuagcuuaaaug

SEQ ID NO: 553514 - RNA, 64 nt, Homo Sapiens
uguguguagcauuguguguccaucuguuauauguaaaggacaaggcaccagaaucaggcuuuau

SEQ ID NO: 553515 - RNA, 64 nt, Homo Sapiens
cuuuuuaugaguaacacacaguacaauauuagagaaaggacagguguagcuacaauuguguaau

SEQ ID NO: 553516 - RNA, 64 nt, Homo Sapiens
aauaaucauaauuguguauuacaagauuuaauugaaaggacaucguguuuuucauuuuaaacac

SEQ ID NO: 553517 - RNA, 64 nt, Homo Sapiens
cuagaaccuauaggaaacuacuuggagcaaacucaaaggacagauuagggaucgagauuggguc

SEQ ID NO: 553518 - RNA, 64 nt, Homo Sapiens
cuuuaggcaaguggaaaauucaaaaugugcugugaaaggacaaucucaggcugaaaucccauaa

SEQ ID NO: 553519 - RNA, 64 nt, Homo Sapiens
acuaaugacauuuugcagauaaccguguuuauagaaaggacauuuugugccuuuuuauuuugcc

SEQ ID NO: 553520 - RNA, 64 nt, Homo Sapiens
ggcuacagauggaguugcuuccacugagugguaaaaaggacagaguuuuauuggacauuuuacc

SEQ ID NO: 553521 - RNA, 64 nt, Homo Sapiens
acacuguuaugcccuguccucucuuauuugcaugaaaggacaaguaagcaaguauaaauuuuuc

SEQ ID NO: 553522 - RNA, 64 nt, Homo Sapiens
uuaauauaaauuucuguuuguuuuaaaaggagggaaaggacaaugcuauuaauagauucccaua

SEQ ID NO: 553523 - RNA, 64 nt, Homo Sapiens
uuugaggaaguaucuauuuguguucagaauguagaaaggacauaggaucuuauugcacuugggc

SEQ ID NO: 553524 - RNA, 64 nt, Homo Sapiens
aucaauucuuuucuagucaggcuaccaaagugaaaaaggacaaguuacugguauugagaaauca

SEQ ID NO: 553525 - RNA, 64 nt, Homo Sapiens
cuauuguuuaaagagaagguuaguuaaaucuaguaaaggacaguagaauuuggcauuuagcucu

SEQ ID NO: 553526 - RNA, 64 nt, Homo Sapiens
gugaaauguaucaagucaaaaaauagauggagacaaaggacaagcacuuauaaauuucucuuuu

SEQ ID NO: 553527 - RNA, 64 nt, Homo Sapiens
cacaggggggaagcccuacguguuauuacacaccaaaggacacagguuucagugauaagucaga

SEQ ID NO: 553528 - RNA, 64 nt, Homo Sapiens
uggggagcucuagagugggauuucuagcccacccaaaggacaaagagggagauuucaagggccu

SEQ ID NO: 553529 - RNA, 64 nt, Homo Sapiens
gcagagggagauuucaagggcaaacucuugaauaaaaggacaugcaagagaucaaagaaagguc

SEQ ID NO: 553530 - RNA, 64 nt, Homo Sapiens
gaucagaagucagaaguuuggaauguggugggucaaaggacaauaugggugggcauucuggaga

SEQ ID NO: 553531 - RNA, 64 nt, Homo Sapiens
uuuuucagcugaauucucauggugaaaacaggggaaaggacaaaggaaaccuuaaguuguauug

SEQ ID NO: 553532 - RNA, 64 nt, Homo Sapiens
uuaaaacuuggguaacacuuccaaauaugggaggaaaggacagauguguuuacaagggaggauu

SEQ ID NO: 553533 - RNA, 64 nt, Homo Sapiens
aaucuacauuuaucaauaaaauguaaauuaucugaaaggacagaauauaagauuuaaccauguu

SEQ ID NO: 553534 - RNA, 64 nt, Homo Sapiens
gccuucagaucugccucacaccuucaaauucaugaaaggacacaaacacacauaagaauacacu

SEQ ID NO: 553535 - RNA, 64 nt, Homo Sapiens
gccuucagaucugccaagaaccuucgaauucaugaaaggacacaaacacacguaagaaugcacu

SEQ ID NO: 553536 - RNA, 64 nt, Homo Sapiens
agaccaguuuauaggguuggaccugaaauuguguaaaggacaaauauguaauugcgugcaauga

SEQ ID NO: 553537 - RNA, 64 nt, Homo Sapiens
cccugguuggugccuccaaacugggcaguugaggaaaggacagcuccacagaauguuugcagag

SEQ ID NO: 553538 - RNA, 64 nt, Homo Sapiens
gucaucagcuauucaguugguaagcuuccaggaaaaaggacaggcagaaagaguuugagaccug

SEQ ID NO: 553539 - RNA, 64 nt, Homo Sapiens
gagggaaaauguuuuguaagaaaccaaucaagauaaaggacagugaaguaauccguaccuugug

SEQ ID NO: 553540 - RNA, 64 nt, Homo Sapiens
auuaccaagcguuacaaaauagauaauuuauuuuaaaggacagagugaauuauuuauucauggg

SEQ ID NO: 553541 - RNA, 64 nt, Homo Sapiens
agaggaaaugcuuugggauggaaaucuguugaagaaaggacagaaagcacaggaaagagaaaaa

SEQ ID NO: 553542 - RNA, 64 nt, Homo Sapiens
cucaauuuugagguccucauucccaagauugaggaggcaguaguuaaucugggaaggcaguaga

SEQ ID NO: 553543 - RNA, 64 nt, Homo Sapiens
ucccaagauugaggaggcaguaguuaaucugggaaggcaguagaauggccagcauuccugccug

SEQ ID NO: 553544 - RNA, 64 nt, Homo Sapiens
agaauuguugccugagcgugccaggcugcagggcaggcaguaaaaggcccccacauacccugca

SEQ ID NO: 553545 - RNA, 64 nt, Homo Sapiens
aucagcuuuuuuaccauugagccaggagugcggcaggcaguaccugccugacccuucaaggccu

SEQ ID NO: 553546 - RNA, 64 nt, Homo Sapiens
cuggaggggggccuggggcagaccuaucugggauaggcaguaccggccgggucccuggugcacu

SEQ ID NO: 553547 - RNA, 64 nt, Homo Sapiens
cauuccucugacuuuauacuguacgcuggggccaaggcaguauagguguuuuauacgcuuccuc

SEQ ID NO: 553548 - RNA, 64 nt, Homo Sapiens
gucugagggcucaggccuccguugucaagcuacuaggcaguaggaacuuguggggacaccacca

SEQ ID NO: 553549 - RNA, 64 nt, Homo Sapiens
ggggaucccaggcacccaucuccaugggagcuugaggcaguaaguuuaacuccccgcccacagg

SEQ ID NO: 553550 - RNA, 64 nt, Homo Sapiens
ccuagacagcucagcacagcuauugauauguuagaggcaguauccuuaauauucauucuaaaug

SEQ ID NO: 553551 - RNA, 64 nt, Homo Sapiens
agugucugaugaagggcagagugacccagacugcaggcaguaacugacuucacacagucccugg

SEQ ID NO: 553552 - RNA, 64 nt, Homo Sapiens; identical to SEQ ID NO: 317046

SEQ ID NO: 553553 - RNA, 64 nt, Homo Sapiens; identical to SEQ ID NO: 317047

SEQ ID NO: 553554 - RNA, 64 nt, Homo Sapiens; identical to SEQ ID NO: 317048

SEQ ID NO: 553555 - RNA, 64 nt, Homo Sapiens; identical to SEQ ID NO: 317049

SEQ ID NO: 553556 - RNA, 64 nt, Homo Sapiens; identical to SEQ ID NO: 317050

SEQ ID NO: 553557 - RNA, 64 nt, Homo Sapiens; identical to SEQ ID NO: 317051

SEQ ID NO: 553558 - RNA, 64 nt, Homo Sapiens; identical to SEQ ID NO: 317052

SEQ ID NO: 553559 - RNA, 64 nt, Homo Sapiens; identical to SEQ ID NO: 317053

SEQ ID NO: 553560 - RNA, 64 nt, Homo Sapiens; identical to SEQ ID NO: 317054

SEQ ID NO: 553561 - RNA, 64 nt, Homo Sapiens; identical to SEQ ID NO: 317055

SEQ ID NO: 553562 - RNA, 64 nt, Homo Sapiens; identical to SEQ ID NO: 317056

SEQ ID NO: 553563 - RNA, 64 nt, Homo Sapiens; identical to SEQ ID NO: 317057

SEQ ID NO: 553564 - RNA, 64 nt, Homo Sapiens; identical to SEQ ID NO: 317058

SEQ ID NO: 553565 - RNA, 64 nt, Homo Sapiens; identical to SEQ ID NO: 317059

SEQ ID NO: 553566 - RNA, 64 nt, Homo Sapiens; identical to SEQ ID NO: 317060

SEQ ID NO: 553567 - RNA, 64 nt, Homo Sapiens; identical to SEQ ID NO: 317061

SEQ ID NO: 553568 - RNA, 64 nt, Homo Sapiens; identical to SEQ ID NO: 317062

SEQ ID NO: 553569 - RNA, 64 nt, Homo Sapiens; identical to SEQ ID NO: 317063

SEQ ID NO: 553570 - RNA, 64 nt, Homo Sapiens; identical to SEQ ID NO: 317064

SEQ ID NO: 553571 - RNA, 55 nt, Homo Sapiens; identical to SEQ ID NO: 317065

SEQ ID NO: 553572 - RNA, 64 nt, Homo Sapiens; identical to SEQ ID NO: 317066

SEQ ID NO: 553573 - RNA, 63 nt, Homo Sapiens; identical to SEQ ID NO: 317067

SEQ ID NO: 553574 - RNA, 64 nt, Homo Sapiens; identical to SEQ ID NO: 317068

SEQ ID NO: 553575 - RNA, 64 nt, Homo Sapiens; identical to SEQ ID NO: 317069

SEQ ID NO: 553576 - RNA, 64 nt, Homo Sapiens; identical to SEQ ID NO: 317070

SEQ ID NO: 553577 - RNA, 64 nt, Homo Sapiens; identical to SEQ ID NO: 317071

SEQ ID NO: 553578 - RNA, 64 nt, Homo Sapiens; identical to SEQ ID NO: 317072

SEQ ID NO: 553579 - RNA, 64 nt, Homo Sapiens; identical to SEQ ID NO: 317073

SEQ ID NO: 553580 - RNA, 64 nt, Homo Sapiens; identical to SEQ ID NO: 317074

SEQ ID NO: 553581 - RNA, 64 nt, Homo Sapiens; identical to SEQ ID NO: 317075

SEQ ID NO: 553582 - RNA, 64 nt, Homo Sapiens; identical to SEQ ID NO: 317076

SEQ ID NO: 553583 - RNA, 64 nt, Homo Sapiens; identical to SEQ ID NO: 317077

SEQ ID NO: 553584 - RNA, 64 nt, Homo Sapiens; identical to SEQ ID NO: 317078

SEQ ID NO: 553585 - RNA, 64 nt, Homo Sapiens; identical to SEQ ID NO: 317079

SEQ ID NO: 553586 - RNA, 64 nt, Homo Sapiens; identical to SEQ ID NO: 317080

SEQ ID NO: 553587 - RNA, 64 nt, Homo Sapiens; identical to SEQ ID NO: 317081

SEQ ID NO: 553588 - RNA, 64 nt, Homo Sapiens; identical to SEQ ID NO: 317082

SEQ ID NO: 553589 - RNA, 64 nt, Homo Sapiens; identical to SEQ ID NO: 317083

SEQ ID NO: 553590 - RNA, 64 nt, Homo Sapiens; identical to SEQ ID NO: 317084

SEQ ID NO: 553591 - RNA, 64 nt, Homo Sapiens; identical to SEQ ID NO: 317085

SEQ ID NO: 553592 - RNA, 64 nt, Homo Sapiens; identical to SEQ ID NO: 317086

SEQ ID NO: 553593 - RNA, 64 nt, Homo Sapiens; identical to SEQ ID NO: 317087

SEQ ID NO: 553594 - RNA, 64 nt, Homo Sapiens; identical to SEQ ID NO: 317088

SEQ ID NO: 553595 - RNA, 64 nt, Homo Sapiens; identical to SEQ ID NO: 317089

SEQ ID NO: 553596 - RNA, 64 nt, Homo Sapiens; identical to SEQ ID NO: 317090

SEQ ID NO: 553597 - RNA, 64 nt, Homo Sapiens; identical to SEQ ID NO: 538261

SEQ ID NO: 553598 - RNA, 64 nt, Homo Sapiens; identical to SEQ ID NO: 538262

SEQ ID NO: 553599 - RNA, 64 nt, Homo Sapiens; identical to SEQ ID NO: 538263

SEQ ID NO: 553600 - RNA, 64 nt, Homo Sapiens; identical to SEQ ID NO: 538264

SEQ ID NO: 553601 - RNA, 64 nt, Homo Sapiens; identical to SEQ ID NO: 538265

SEQ ID NO: 553602 - RNA, 64 nt, Homo Sapiens; identical to SEQ ID NO: 538266

SEQ ID NO: 553603 - RNA, 64 nt, Homo Sapiens; identical to SEQ ID NO: 236311

SEQ ID NO: 553604 - RNA, 64 nt, Homo Sapiens; identical to SEQ ID NO: 236312

SEQ ID NO: 553605 - RNA, 64 nt, Homo Sapiens; identical to SEQ ID NO: 236313

SEQ ID NO: 553606 - RNA, 64 nt, Homo Sapiens; identical to SEQ ID NO: 236314

SEQ ID NO: 553607 - RNA, 64 nt, Homo Sapiens; identical to SEQ ID NO: 236315

SEQ ID NO: 553608 - RNA, 64 nt, Homo Sapiens; identical to SEQ ID NO: 236316

SEQ ID NO: 553609 - RNA, 64 nt, Homo Sapiens; identical to SEQ ID NO: 236317

SEQ ID NO: 553610 - RNA, 64 nt, Homo Sapiens; identical to SEQ ID NO: 236318

SEQ ID NO: 553611 - RNA, 64 nt, Homo Sapiens; identical to SEQ ID NO: 236319

SEQ ID NO: 553612 - RNA, 64 nt, Homo Sapiens; identical to SEQ ID NO: 236320

SEQ ID NO: 553613 - RNA, 64 nt, Homo Sapiens; identical to SEQ ID NO: 236321

SEQ ID NO: 553614 - RNA, 64 nt, Homo Sapiens; identical to SEQ ID NO: 236322

SEQ ID NO: 553615 - RNA, 64 nt, Homo Sapiens; identical to SEQ ID NO: 236323

SEQ ID NO: 553616 - RNA, 64 nt, Homo Sapiens; identical to SEQ ID NO: 236324

SEQ ID NO: 553617 - RNA, 64 nt, Homo Sapiens; identical to SEQ ID NO: 236325

SEQ ID NO: 553618 - RNA, 64 nt, Homo Sapiens; identical to SEQ ID NO: 236326

SEQ ID NO: 553619 - RNA, 64 nt, Homo Sapiens; identical to SEQ ID NO: 236327

SEQ ID NO: 553620 - RNA, 64 nt, Homo Sapiens; identical to SEQ ID NO: 236328

SEQ ID NO: 553621 - RNA, 64 nt, Homo Sapiens; identical to SEQ ID NO: 236329

SEQ ID NO: 553622 - RNA, 64 nt, Homo Sapiens; identical to SEQ ID NO: 236330

SEQ ID NO: 553623 - RNA, 64 nt, Homo Sapiens; identical to SEQ ID NO: 236331

SEQ ID NO: 553624 - RNA, 64 nt, Homo Sapiens; identical to SEQ ID NO: 236332

SEQ ID NO: 553625 - RNA, 64 nt, Homo Sapiens; identical to SEQ ID NO: 236333

SEQ ID NO: 553626 - RNA, 64 nt, Homo Sapiens; identical to SEQ ID NO: 236334

SEQ ID NO: 553627 - RNA, 64 nt, Homo Sapiens; identical to SEQ ID NO: 236335

SEQ ID NO: 553628 - RNA, 64 nt, Homo Sapiens; identical to SEQ ID NO: 236336

SEQ ID NO: 553629 - RNA, 64 nt, Homo Sapiens; identical to SEQ ID NO: 236337

SEQ ID NO: 553630 - RNA, 64 nt, Homo Sapiens; identical to SEQ ID NO: 236338

SEQ ID NO: 553631 - RNA, 64 nt, Homo Sapiens; identical to SEQ ID NO: 236339

SEQ ID NO: 553632 - RNA, 64 nt, Homo Sapiens; identical to SEQ ID NO: 236340

SEQ ID NO: 553633 - RNA, 64 nt, Homo Sapiens; identical to SEQ ID NO: 236341

SEQ ID NO: 553634 - RNA, 64 nt, Homo Sapiens; identical to SEQ ID NO: 236342

SEQ ID NO: 553635 - RNA, 64 nt, Homo Sapiens; identical to SEQ ID NO: 236343

SEQ ID NO: 553636 - RNA, 64 nt, Homo Sapiens; identical to SEQ ID NO: 236344

SEQ ID NO: 553637 - RNA, 64 nt, Homo Sapiens; identical to SEQ ID NO: 236345

SEQ ID NO: 553638 - RNA, 64 nt, Homo Sapiens; identical to SEQ ID NO: 236346

SEQ ID NO: 553639 - RNA, 64 nt, Homo Sapiens; identical to SEQ ID NO: 236347

SEQ ID NO: 553640 - RNA, 64 nt, Homo Sapiens; identical to SEQ ID NO: 236348

SEQ ID NO: 553641 - RNA, 64 nt, Homo Sapiens; identical to SEQ ID NO: 236349

SEQ ID NO: 553642 - RNA, 64 nt, Homo Sapiens; identical to SEQ ID NO: 236350

SEQ ID NO: 553643 - RNA, 64 nt, Homo Sapiens; identical to SEQ ID NO: 236351

SEQ ID NO: 553644 - RNA, 64 nt, Homo Sapiens; identical to SEQ ID NO: 236352

SEQ ID NO: 553645 - RNA, 64 nt, Homo Sapiens; identical to SEQ ID NO: 236353

SEQ ID NO: 553646 - RNA, 53 nt, Homo Sapiens; identical to SEQ ID NO: 236354

SEQ ID NO: 553647 - RNA, 64 nt, Homo Sapiens; identical to SEQ ID NO: 236355

SEQ ID NO: 553648 - RNA, 64 nt, Homo Sapiens; identical to SEQ ID NO: 236356

SEQ ID NO: 553649 - RNA, 64 nt, Homo Sapiens; identical to SEQ ID NO: 236357

SEQ ID NO: 553650 - RNA, 64 nt, Homo Sapiens; identical to SEQ ID NO: 236358

SEQ ID NO: 553651 - RNA, 64 nt, Homo Sapiens; identical to SEQ ID NO: 236359

SEQ ID NO: 553652 - RNA, 64 nt, Homo Sapiens; identical to SEQ ID NO: 236360

SEQ ID NO: 553653 - RNA, 64 nt, Homo Sapiens; identical to SEQ ID NO: 236361

SEQ ID NO: 553654 - RNA, 64 nt, Homo Sapiens; identical to SEQ ID NO: 236362

SEQ ID NO: 553655 - RNA, 64 nt, Homo Sapiens; identical to SEQ ID NO: 236363

SEQ ID NO: 553656 - RNA, 64 nt, Homo Sapiens; identical to SEQ ID NO: 236364

SEQ ID NO: 553657 - RNA, 50 nt, Homo Sapiens; identical to SEQ ID NO: 236365

SEQ ID NO: 553658 - RNA, 64 nt, Homo Sapiens; identical to SEQ ID NO: 236366

SEQ ID NO: 553659 - RNA, 64 nt, Homo Sapiens; identical to SEQ ID NO: 236367

SEQ ID NO: 553660 - RNA, 64 nt, Homo Sapiens; identical to SEQ ID NO: 236368

SEQ ID NO: 553661 - RNA, 64 nt, Homo Sapiens; identical to SEQ ID NO: 236369

SEQ ID NO: 553662 - RNA, 64 nt, Homo Sapiens; identical to SEQ ID NO: 236370

SEQ ID NO: 553663 - RNA, 64 nt, Homo Sapiens; identical to SEQ ID NO: 236371

SEQ ID NO: 553664 - RNA, 64 nt, Homo Sapiens; identical to SEQ ID NO: 236372

SEQ ID NO: 553665 - RNA, 64 nt, Homo Sapiens; identical to SEQ ID NO: 236373

SEQ ID NO: 553666 - RNA, 64 nt, Homo Sapiens; identical to SEQ ID NO: 236374

SEQ ID NO: 553667 - RNA, 64 nt, Homo Sapiens; identical to SEQ ID NO: 236375

SEQ ID NO: 553668 - RNA, 64 nt, Homo Sapiens; identical to SEQ ID NO: 236376

SEQ ID NO: 553669 - RNA, 64 nt, Homo Sapiens; identical to SEQ ID NO: 236377

SEQ ID NO: 553670 - RNA, 64 nt, Homo Sapiens; identical to SEQ ID NO: 236378

SEQ ID NO: 553671 - RNA, 64 nt, Homo Sapiens; identical to SEQ ID NO: 236379

SEQ ID NO: 553672 - RNA, 64 nt, Homo Sapiens; identical to SEQ ID NO: 236380

SEQ ID NO: 553673 - RNA, 64 nt, Homo Sapiens; identical to SEQ ID NO: 236381

SEQ ID NO: 553674 - RNA, 64 nt, Homo Sapiens; identical to SEQ ID NO: 89734

SEQ ID NO: 553675 - RNA, 64 nt, Homo Sapiens; identical to SEQ ID NO: 89735

SEQ ID NO: 553676 - RNA, 64 nt, Homo Sapiens; identical to SEQ ID NO: 270805

SEQ ID NO: 553677 - RNA, 64 nt, Homo Sapiens; identical to SEQ ID NO: 270806

SEQ ID NO: 553678 - RNA, 64 nt, Homo Sapiens; identical to SEQ ID NO: 270807

SEQ ID NO: 553679 - RNA, 64 nt, Homo Sapiens; identical to SEQ ID NO: 270808

SEQ ID NO: 553680 - RNA, 64 nt, Homo Sapiens; identical to SEQ ID NO: 270809

SEQ ID NO: 553681 - RNA, 64 nt, Homo Sapiens; identical to SEQ ID NO: 270810

SEQ ID NO: 553682 - RNA, 64 nt, Homo Sapiens; identical to SEQ ID NO: 270811

SEQ ID NO: 553683 - RNA, 64 nt, Homo Sapiens; identical to SEQ ID NO: 270812

SEQ ID NO: 553684 - RNA, 64 nt, Homo Sapiens; identical to SEQ ID NO: 270813

SEQ ID NO: 553685 - RNA, 64 nt, Homo Sapiens; identical to SEQ ID NO: 270814

SEQ ID NO: 553686 - RNA, 64 nt, Homo Sapiens; identical to SEQ ID NO: 270815

SEQ ID NO: 553687 - RNA, 64 nt, Homo Sapiens; identical to SEQ ID NO: 270816

SEQ ID NO: 553688 - RNA, 64 nt, Homo Sapiens; identical to SEQ ID NO: 144852

SEQ ID NO: 553689 - RNA, 64 nt, Homo Sapiens; identical to SEQ ID NO: 144853

SEQ ID NO: 553690 - RNA, 64 nt, Homo Sapiens; identical to SEQ ID NO: 144854

SEQ ID NO: 553691 - RNA, 64 nt, Homo Sapiens; identical to SEQ ID NO: 144855

SEQ ID NO: 553692 - RNA, 64 nt, Homo Sapiens; identical to SEQ ID NO: 144856

SEQ ID NO: 553693 - RNA, 64 nt, Homo Sapiens; identical to SEQ ID NO: 144857

SEQ ID NO: 553694 - RNA, 64 nt, Homo Sapiens; identical to SEQ ID NO: 144858

SEQ ID NO: 553695 - RNA, 64 nt, Homo Sapiens; identical to SEQ ID NO: 144859

SEQ ID NO: 553696 - RNA, 64 nt, Homo Sapiens; identical to SEQ ID NO: 144860

SEQ ID NO: 553697 - RNA, 64 nt, Homo Sapiens; identical to SEQ ID NO: 144861

SEQ ID NO: 553698 - RNA, 64 nt, Homo Sapiens; identical to SEQ ID NO: 97841

SEQ ID NO: 553699 - RNA, 64 nt, Homo Sapiens; identical to SEQ ID NO: 97842

SEQ ID NO: 553700 - RNA, 64 nt, Homo Sapiens; identical to SEQ ID NO: 97843

SEQ ID NO: 553701 - RNA, 64 nt, Homo Sapiens; identical to SEQ ID NO: 97844

SEQ ID NO: 553702 - RNA, 64 nt, Homo Sapiens; identical to SEQ ID NO: 97845

SEQ ID NO: 553703 - RNA, 64 nt, Homo Sapiens; identical to SEQ ID NO: 97846

SEQ ID NO: 553704 - RNA, 64 nt, Homo Sapiens; identical to SEQ ID NO: 97847

SEQ ID NO: 553705 - RNA, 64 nt, Homo Sapiens; identical to SEQ ID NO: 97848

SEQ ID NO: 553706 - RNA, 64 nt, Homo Sapiens; identical to SEQ ID NO: 84269

SEQ ID NO: 553707 - RNA, 64 nt, Homo Sapiens; identical to SEQ ID NO: 84270

SEQ ID NO: 553708 - RNA, 64 nt, Homo Sapiens; identical to SEQ ID NO: 84271

SEQ ID NO: 553709 - RNA, 64 nt, Homo Sapiens; identical to SEQ ID NO: 84272

SEQ ID NO: 553710 - RNA, 64 nt, Homo Sapiens; identical to SEQ ID NO: 84273

SEQ ID NO: 553711 - RNA, 64 nt, Homo Sapiens; identical to SEQ ID NO: 84274

SEQ ID NO: 553712 - RNA, 64 nt, Homo Sapiens; identical to SEQ ID NO: 84275

SEQ ID NO: 553713 - RNA, 64 nt, Homo Sapiens; identical to SEQ ID NO: 84276

SEQ ID NO: 553714 - RNA, 64 nt, Homo Sapiens; identical to SEQ ID NO: 84277

SEQ ID NO: 553715 - RNA, 64 nt, Homo Sapiens; identical to SEQ ID NO: 84278

SEQ ID NO: 553716 - RNA, 64 nt, Homo Sapiens; identical to SEQ ID NO: 84279

SEQ ID NO: 553717 - RNA, 64 nt, Homo Sapiens; identical to SEQ ID NO: 84280

SEQ ID NO: 553718 - RNA, 64 nt, Homo Sapiens; identical to SEQ ID NO: 84281

SEQ ID NO: 553719 - RNA, 64 nt, Homo Sapiens; identical to SEQ ID NO: 84282

SEQ ID NO: 553720 - RNA, 64 nt, Homo Sapiens; identical to SEQ ID NO: 84283

SEQ ID NO: 553721 - RNA, 64 nt, Homo Sapiens; identical to SEQ ID NO: 84284

SEQ ID NO: 553722 - RNA, 64 nt, Homo Sapiens; identical to SEQ ID NO: 84285

SEQ ID NO: 553723 - RNA, 64 nt, Homo Sapiens; identical to SEQ ID NO: 84286

SEQ ID NO: 553724 - RNA, 64 nt, Homo Sapiens; identical to SEQ ID NO: 84287

SEQ ID NO: 553725 - RNA, 64 nt, Homo Sapiens; identical to SEQ ID NO: 84288

SEQ ID NO: 553726 - RNA, 62 nt, Homo Sapiens
agcaaauacucauuuuaggaaaaaaaaaagcaugaucugaaaaauacuuuuggugguauguu

SEQ ID NO: 553727 - RNA, 62 nt, Homo Sapiens
gcaagacuguuagcccucaaacuugacucuacugaucugaccauuucccucucaucgccaga

SEQ ID NO: 553728 - RNA, 62 nt, Homo Sapiens
caugcugaugcuucaaggaggggucaagauuuugaucugagaaagaaaaaugcugaggccuc

SEQ ID NO: 553729 - RNA, 62 nt, Homo Sapiens
gguauuuagguugaaggaaacagaggagccacugaucugagucugcucgugagcaggaaaau

SEQ ID NO: 553730 - RNA, 64 nt, Homo Sapiens; identical to SEQ ID NO: 264274

SEQ ID NO: 553731 - RNA, 64 nt, Homo Sapiens; identical to SEQ ID NO: 264275

SEQ ID NO: 553732 - RNA, 64 nt, Homo Sapiens; identical to SEQ ID NO: 264276

SEQ ID NO: 553733 - RNA, 64 nt, Homo Sapiens; identical to SEQ ID NO: 264277

SEQ ID NO: 553734 - RNA, 64 nt, Homo Sapiens; identical to SEQ ID NO: 264278

SEQ ID NO: 553735 - RNA, 64 nt, Homo Sapiens; identical to SEQ ID NO: 264279

SEQ ID NO: 553736 - RNA, 64 nt, Homo Sapiens; identical to SEQ ID NO: 264280

SEQ ID NO: 553737 - RNA, 64 nt, Homo Sapiens; identical to SEQ ID NO: 264281

SEQ ID NO: 553738 - RNA, 64 nt, Homo Sapiens; identical to SEQ ID NO: 264282

SEQ ID NO: 553739 - RNA, 64 nt, Homo Sapiens; identical to SEQ ID NO: 264283

SEQ ID NO: 553740 - RNA, 64 nt, Homo Sapiens; identical to SEQ ID NO: 264284

SEQ ID NO: 553741 - RNA, 64 nt, Homo Sapiens; identical to SEQ ID NO: 264285

SEQ ID NO: 553742 - RNA, 64 nt, Homo Sapiens; identical to SEQ ID NO: 264286

SEQ ID NO: 553743 - RNA, 64 nt, Homo Sapiens; identical to SEQ ID NO: 264287

SEQ ID NO: 553744 - RNA, 64 nt, Homo Sapiens; identical to SEQ ID NO: 264288

SEQ ID NO: 553745 - RNA, 64 nt, Homo Sapiens; identical to SEQ ID NO: 264289

SEQ ID NO: 553746 - RNA, 64 nt, Homo Sapiens; identical to SEQ ID NO: 264290

SEQ ID NO: 553747 - RNA, 64 nt, Homo Sapiens; identical to SEQ ID NO: 264291

SEQ ID NO: 553748 - RNA, 64 nt, Homo Sapiens; identical to SEQ ID NO: 264292

SEQ ID NO: 553749 - RNA, 64 nt, Homo Sapiens; identical to SEQ ID NO: 264293

SEQ ID NO: 553750 - RNA, 64 nt, Homo Sapiens; identical to SEQ ID NO: 264294

SEQ ID NO: 553751 - RNA, 64 nt, Homo Sapiens; identical to SEQ ID NO: 264295

SEQ ID NO: 553752 - RNA, 64 nt, Homo Sapiens; identical to SEQ ID NO: 264296

SEQ ID NO: 553753 - RNA, 64 nt, Homo Sapiens; identical to SEQ ID NO: 264297

SEQ ID NO: 553754 - RNA, 64 nt, Homo Sapiens; identical to SEQ ID NO: 264298

SEQ ID NO: 553755 - RNA, 64 nt, Homo Sapiens; identical to SEQ ID NO: 264299

SEQ ID NO: 553756 - RNA, 64 nt, Homo Sapiens; identical to SEQ ID NO: 264300

SEQ ID NO: 553757 - RNA, 64 nt, Homo Sapiens; identical to SEQ ID NO: 264301

SEQ ID NO: 553758 - RNA, 64 nt, Homo Sapiens; identical to SEQ ID NO: 264274

SEQ ID NO: 553759 - RNA, 64 nt, Homo Sapiens; identical to SEQ ID NO: 264275

SEQ ID NO: 553760 - RNA, 64 nt, Homo Sapiens; identical to SEQ ID NO: 264276

SEQ ID NO: 553761 - RNA, 64 nt, Homo Sapiens; identical to SEQ ID NO: 264277

SEQ ID NO: 553762 - RNA, 64 nt, Homo Sapiens; identical to SEQ ID NO: 264278

SEQ ID NO: 553763 - RNA, 64 nt, Homo Sapiens; identical to SEQ ID NO: 264279

SEQ ID NO: 553764 - RNA, 64 nt, Homo Sapiens; identical to SEQ ID NO: 264280

SEQ ID NO: 553765 - RNA, 64 nt, Homo Sapiens; identical to SEQ ID NO: 264281

SEQ ID NO: 553766 - RNA, 64 nt, Homo Sapiens; identical to SEQ ID NO: 264282

SEQ ID NO: 553767 - RNA, 64 nt, Homo Sapiens; identical to SEQ ID NO: 264283

SEQ ID NO: 553768 - RNA, 64 nt, Homo Sapiens; identical to SEQ ID NO: 264284

SEQ ID NO: 553769 - RNA, 64 nt, Homo Sapiens; identical to SEQ ID NO: 264285

SEQ ID NO: 553770 - RNA, 64 nt, Homo Sapiens; identical to SEQ ID NO: 264286

SEQ ID NO: 553771 - RNA, 64 nt, Homo Sapiens; identical to SEQ ID NO: 264287

SEQ ID NO: 553772 - RNA, 64 nt, Homo Sapiens; identical to SEQ ID NO: 264288

SEQ ID NO: 553773 - RNA, 64 nt, Homo Sapiens; identical to SEQ ID NO: 264289

SEQ ID NO: 553774 - RNA, 64 nt, Homo Sapiens; identical to SEQ ID NO: 264290

SEQ ID NO: 553775 - RNA, 64 nt, Homo Sapiens; identical to SEQ ID NO: 264291

SEQ ID NO: 553776 - RNA, 64 nt, Homo Sapiens; identical to SEQ ID NO: 264292

SEQ ID NO: 553777 - RNA, 64 nt, Homo Sapiens; identical to SEQ ID NO: 264293

SEQ ID NO: 553778 - RNA, 64 nt, Homo Sapiens; identical to SEQ ID NO: 264294

SEQ ID NO: 553779 - RNA, 64 nt, Homo Sapiens; identical to SEQ ID NO: 264295

SEQ ID NO: 553780 - RNA, 64 nt, Homo Sapiens; identical to SEQ ID NO: 264296

SEQ ID NO: 553781 - RNA, 64 nt, Homo Sapiens; identical to SEQ ID NO: 264297

SEQ ID NO: 553782 - RNA, 64 nt, Homo Sapiens; identical to SEQ ID NO: 264298

SEQ ID NO: 553783 - RNA, 64 nt, Homo Sapiens; identical to SEQ ID NO: 264299

SEQ ID NO: 553784 - RNA, 64 nt, Homo Sapiens; identical to SEQ ID NO: 264300

SEQ ID NO: 553785 - RNA, 64 nt, Homo Sapiens; identical to SEQ ID NO: 264301

SEQ ID NO: 553786 - RNA, 64 nt, Homo Sapiens; identical to SEQ ID NO: 264274

SEQ ID NO: 553787 - RNA, 64 nt, Homo Sapiens; identical to SEQ ID NO: 264275

SEQ ID NO: 553788 - RNA, 64 nt, Homo Sapiens; identical to SEQ ID NO: 264276

SEQ ID NO: 553789 - RNA, 64 nt, Homo Sapiens; identical to SEQ ID NO: 264277

SEQ ID NO: 553790 - RNA, 64 nt, Homo Sapiens; identical to SEQ ID NO: 264278

SEQ ID NO: 553791 - RNA, 64 nt, Homo Sapiens; identical to SEQ ID NO: 264279

SEQ ID NO: 553792 - RNA, 64 nt, Homo Sapiens; identical to SEQ ID NO: 264280

SEQ ID NO: 553793 - RNA, 64 nt, Homo Sapiens; identical to SEQ ID NO: 264281

SEQ ID NO: 553794 - RNA, 64 nt, Homo Sapiens; identical to SEQ ID NO: 264282

SEQ ID NO: 553795 - RNA, 64 nt, Homo Sapiens; identical to SEQ ID NO: 264283

SEQ ID NO: 553796 - RNA, 64 nt, Homo Sapiens; identical to SEQ ID NO: 264284

SEQ ID NO: 553797 - RNA, 64 nt, Homo Sapiens; identical to SEQ ID NO: 264285

SEQ ID NO: 553798 - RNA, 64 nt, Homo Sapiens; identical to SEQ ID NO: 264286

SEQ ID NO: 553799 - RNA, 64 nt, Homo Sapiens; identical to SEQ ID NO: 264287

SEQ ID NO: 553800 - RNA, 64 nt, Homo Sapiens; identical to SEQ ID NO: 264288

SEQ ID NO: 553801 - RNA, 64 nt, Homo Sapiens; identical to SEQ ID NO: 264289

SEQ ID NO: 553802 - RNA, 64 nt, Homo Sapiens; identical to SEQ ID NO: 264290

SEQ ID NO: 553803 - RNA, 64 nt, Homo Sapiens; identical to SEQ ID NO: 264291

SEQ ID NO: 553804 - RNA, 64 nt, Homo Sapiens; identical to SEQ ID NO: 264292

SEQ ID NO: 553805 - RNA, 64 nt, Homo Sapiens; identical to SEQ ID NO: 264293

SEQ ID NO: 553806 - RNA, 64 nt, Homo Sapiens; identical to SEQ ID NO: 264294

SEQ ID NO: 553807 - RNA, 64 nt, Homo Sapiens; identical to SEQ ID NO: 264295

SEQ ID NO: 553808 - RNA, 64 nt, Homo Sapiens; identical to SEQ ID NO: 264296

SEQ ID NO: 553809 - RNA, 64 nt, Homo Sapiens; identical to SEQ ID NO: 264297

SEQ ID NO: 553810 - RNA, 64 nt, Homo Sapiens; identical to SEQ ID NO: 264298

SEQ ID NO: 553811 - RNA, 64 nt, Homo Sapiens; identical to SEQ ID NO: 264299

SEQ ID NO: 553812 - RNA, 64 nt, Homo Sapiens; identical to SEQ ID NO: 264300

SEQ ID NO: 553813 - RNA, 64 nt, Homo Sapiens; identical to SEQ ID NO: 264301

SEQ ID NO: 553814 - RNA, 64 nt, Homo Sapiens; identical to SEQ ID NO: 117299

SEQ ID NO: 553815 - RNA, 64 nt, Homo Sapiens; identical to SEQ ID NO: 117300

SEQ ID NO: 553816 - RNA, 64 nt, Homo Sapiens; identical to SEQ ID NO: 117301

SEQ ID NO: 553817 - RNA, 64 nt, Homo Sapiens; identical to SEQ ID NO: 117302

SEQ ID NO: 553818 - RNA, 64 nt, Homo Sapiens; identical to SEQ ID NO: 117303

SEQ ID NO: 553819 - RNA, 64 nt, Homo Sapiens; identical to SEQ ID NO: 117304

SEQ ID NO: 553820 - RNA, 64 nt, Homo Sapiens; identical to SEQ ID NO: 117305

SEQ ID NO: 553821 - RNA, 64 nt, Homo Sapiens; identical to SEQ ID NO: 117306

SEQ ID NO: 553822 - RNA, 64 nt, Homo Sapiens; identical to SEQ ID NO: 117307

SEQ ID NO: 553823 - RNA, 64 nt, Homo Sapiens; identical to SEQ ID NO: 117308

SEQ ID NO: 553824 - RNA, 64 nt, Homo Sapiens; identical to SEQ ID NO: 117309

SEQ ID NO: 553825 - RNA, 64 nt, Homo Sapiens; identical to SEQ ID NO: 117310

SEQ ID NO: 553826 - RNA, 64 nt, Homo Sapiens; identical to SEQ ID NO: 117311

SEQ ID NO: 553827 - RNA, 64 nt, Homo Sapiens; identical to SEQ ID NO: 117312

SEQ ID NO: 553828 - RNA, 64 nt, Homo Sapiens; identical to SEQ ID NO: 117313

SEQ ID NO: 553829 - RNA, 64 nt, Homo Sapiens; identical to SEQ ID NO: 117314

SEQ ID NO: 553830 - RNA, 64 nt, Homo Sapiens; identical to SEQ ID NO: 117315

SEQ ID NO: 553831 - RNA, 64 nt, Homo Sapiens; identical to SEQ ID NO: 117316

SEQ ID NO: 553832 - RNA, 64 nt, Homo Sapiens; identical to SEQ ID NO: 117317

SEQ ID NO: 553833 - RNA, 64 nt, Homo Sapiens; identical to SEQ ID NO: 117318

SEQ ID NO: 553834 - RNA, 64 nt, Homo Sapiens; identical to SEQ ID NO: 117319

SEQ ID NO: 553835 - RNA, 64 nt, Homo Sapiens; identical to SEQ ID NO: 117320

SEQ ID NO: 553836 - RNA, 64 nt, Homo Sapiens; identical to SEQ ID NO: 117321

SEQ ID NO: 553837 - RNA, 64 nt, Homo Sapiens; identical to SEQ ID NO: 117322

SEQ ID NO: 553838 - RNA, 64 nt, Homo Sapiens; identical to SEQ ID NO: 117323

SEQ ID NO: 553839 - RNA, 64 nt, Homo Sapiens; identical to SEQ ID NO: 117324

SEQ ID NO: 553840 - RNA, 64 nt, Homo Sapiens; identical to SEQ ID NO: 117325

SEQ ID NO: 553841 - RNA, 64 nt, Homo Sapiens; identical to SEQ ID NO: 117326

SEQ ID NO: 553842 - RNA, 64 nt, Homo Sapiens; identical to SEQ ID NO: 117327

SEQ ID NO: 553843 - RNA, 64 nt, Homo Sapiens; identical to SEQ ID NO: 117328

SEQ ID NO: 553844 - RNA, 64 nt, Homo Sapiens; identical to SEQ ID NO: 174092

SEQ ID NO: 553845 - RNA, 64 nt, Homo Sapiens; identical to SEQ ID NO: 174093

SEQ ID NO: 553846 - RNA, 64 nt, Homo Sapiens; identical to SEQ ID NO: 174095

SEQ ID NO: 553847 - RNA, 64 nt, Homo Sapiens; identical to SEQ ID NO: 174096

SEQ ID NO: 553848 - RNA, 64 nt, Homo Sapiens; identical to SEQ ID NO: 174127

SEQ ID NO: 553849 - RNA, 64 nt, Homo Sapiens; identical to SEQ ID NO: 174128

SEQ ID NO: 553850 - RNA, 64 nt, Homo Sapiens; identical to SEQ ID NO: 174147

SEQ ID NO: 553851 - RNA, 64 nt, Homo Sapiens; identical to SEQ ID NO: 174148

SEQ ID NO: 553852 - RNA, 64 nt, Homo Sapiens; identical to SEQ ID NO: 174171

SEQ ID NO: 553853 - RNA, 64 nt, Homo Sapiens; identical to SEQ ID NO: 174172

SEQ ID NO: 553854 - RNA, 64 nt, Homo Sapiens; identical to SEQ ID NO: 174194

SEQ ID NO: 553855 - RNA, 64 nt, Homo Sapiens; identical to SEQ ID NO: 174195

SEQ ID NO: 553856 - RNA, 64 nt, Homo Sapiens; identical to SEQ ID NO: 174204

SEQ ID NO: 553857 - RNA, 64 nt, Homo Sapiens; identical to SEQ ID NO: 174205

SEQ ID NO: 553858 - RNA, 64 nt, Homo Sapiens; identical to SEQ ID NO: 174212

SEQ ID NO: 553859 - RNA, 64 nt, Homo Sapiens; identical to SEQ ID NO: 174213

SEQ ID NO: 553860 - RNA, 64 nt, Homo Sapiens; identical to SEQ ID NO: 174220

SEQ ID NO: 553861 - RNA, 64 nt, Homo Sapiens; identical to SEQ ID NO: 174221

SEQ ID NO: 553862 - RNA, 64 nt, Homo Sapiens; identical to SEQ ID NO: 174227

SEQ ID NO: 553863 - RNA, 64 nt, Homo Sapiens; identical to SEQ ID NO: 174228

SEQ ID NO: 553864 - RNA, 64 nt, Homo Sapiens; identical to SEQ ID NO: 174230

SEQ ID NO: 553865 - RNA, 64 nt, Homo Sapiens; identical to SEQ ID NO: 174231

SEQ ID NO: 553866 - RNA, 64 nt, Homo Sapiens; identical to SEQ ID NO: 174233

SEQ ID NO: 553867 - RNA, 51 nt, Homo Sapiens; identical to SEQ ID NO: 173793

SEQ ID NO: 553868 - RNA, 64 nt, Homo Sapiens; identical to SEQ ID NO: 174312

SEQ ID NO: 553869 - RNA, 64 nt, Homo Sapiens; identical to SEQ ID NO: 174313

SEQ ID NO: 553870 - RNA, 57 nt, Homo Sapiens; identical to SEQ ID NO: 173883

SEQ ID NO: 553871 - RNA, 64 nt, Homo Sapiens; identical to SEQ ID NO: 174325

SEQ ID NO: 553872 - RNA, 64 nt, Homo Sapiens; identical to SEQ ID NO: 174358

SEQ ID NO: 553873 - RNA, 64 nt, Homo Sapiens; identical to SEQ ID NO: 174359

SEQ ID NO: 553874 - RNA, 64 nt, Homo Sapiens; identical to SEQ ID NO: 174369

SEQ ID NO: 553875 - RNA, 64 nt, Homo Sapiens; identical to SEQ ID NO: 174370

SEQ ID NO: 553876 - RNA, 64 nt, Homo Sapiens; identical to SEQ ID NO: 174388

SEQ ID NO: 553877 - RNA, 64 nt, Homo Sapiens; identical to SEQ ID NO: 174389

SEQ ID NO: 553878 - RNA, 64 nt, Homo Sapiens; identical to SEQ ID NO: 174405

SEQ ID NO: 553879 - RNA, 64 nt, Homo Sapiens; identical to SEQ ID NO: 174406

SEQ ID NO: 553880 - RNA, 64 nt, Homo Sapiens; identical to SEQ ID NO: 174416

SEQ ID NO: 553881 - RNA, 64 nt, Homo Sapiens; identical to SEQ ID NO: 174417

SEQ ID NO: 553882 - RNA, 64 nt, Homo Sapiens; identical to SEQ ID NO: 174427

SEQ ID NO: 553883 - RNA, 64 nt, Homo Sapiens; identical to SEQ ID NO: 174428

SEQ ID NO: 553884 - RNA, 64 nt, Homo Sapiens; identical to SEQ ID NO: 174434

SEQ ID NO: 553885 - RNA, 64 nt, Homo Sapiens; identical to SEQ ID NO: 174435

SEQ ID NO: 553886 - RNA, 64 nt, Homo Sapiens; identical to SEQ ID NO: 174516

SEQ ID NO: 553887 - RNA, 64 nt, Homo Sapiens; identical to SEQ ID NO: 174517

SEQ ID NO: 553888 - RNA, 63 nt, Homo Sapiens; identical to SEQ ID NO: 349836

SEQ ID NO: 553889 - RNA, 63 nt, Homo Sapiens; identical to SEQ ID NO: 349837

SEQ ID NO: 553890 - RNA, 63 nt, Homo Sapiens; identical to SEQ ID NO: 349838

SEQ ID NO: 553891 - RNA, 63 nt, Homo Sapiens; identical to SEQ ID NO: 349839

SEQ ID NO: 553892 - RNA, 63 nt, Homo Sapiens; identical to SEQ ID NO: 349840

SEQ ID NO: 553893 - RNA, 63 nt, Homo Sapiens; identical to SEQ ID NO: 349841

SEQ ID NO: 553894 - RNA, 63 nt, Homo Sapiens; identical to SEQ ID NO: 349842

SEQ ID NO: 553895 - RNA, 63 nt, Homo Sapiens; identical to SEQ ID NO: 349843

SEQ ID NO: 553896 - RNA, 63 nt, Homo Sapiens; identical to SEQ ID NO: 349844

SEQ ID NO: 553897 - RNA, 63 nt, Homo Sapiens; identical to SEQ ID NO: 349845

SEQ ID NO: 553898 - RNA, 63 nt, Homo Sapiens; identical to SEQ ID NO: 349846

SEQ ID NO: 553899 - RNA, 63 nt, Homo Sapiens; identical to SEQ ID NO: 349847

SEQ ID NO: 553900 - RNA, 63 nt, Homo Sapiens; identical to SEQ ID NO: 349848

SEQ ID NO: 553901 - RNA, 63 nt, Homo Sapiens; identical to SEQ ID NO: 349849

SEQ ID NO: 553902 - RNA, 63 nt, Homo Sapiens; identical to SEQ ID NO: 349850

SEQ ID NO: 553903 - RNA, 63 nt, Homo Sapiens; identical to SEQ ID NO: 349851

SEQ ID NO: 553904 - RNA, 63 nt, Homo Sapiens; identical to SEQ ID NO: 349852

SEQ ID NO: 553905 - RNA, 63 nt, Homo Sapiens; identical to SEQ ID NO: 349853

SEQ ID NO: 553906 - RNA, 63 nt, Homo Sapiens; identical to SEQ ID NO: 349854

SEQ ID NO: 553907 - RNA, 63 nt, Homo Sapiens; identical to SEQ ID NO: 349855

SEQ ID NO: 553908 - RNA, 63 nt, Homo Sapiens; identical to SEQ ID NO: 349856

SEQ ID NO: 553909 - RNA, 63 nt, Homo Sapiens; identical to SEQ ID NO: 349857

SEQ ID NO: 553910 - RNA, 63 nt, Homo Sapiens; identical to SEQ ID NO: 349858

SEQ ID NO: 553911 - RNA, 63 nt, Homo Sapiens; identical to SEQ ID NO: 349859

SEQ ID NO: 553912 - RNA, 63 nt, Homo Sapiens; identical to SEQ ID NO: 349860

SEQ ID NO: 553913 - RNA, 63 nt, Homo Sapiens; identical to SEQ ID NO: 349861

SEQ ID NO: 553914 - RNA, 63 nt, Homo Sapiens; identical to SEQ ID NO: 349862

SEQ ID NO: 553915 - RNA, 63 nt, Homo Sapiens; identical to SEQ ID NO: 349863

SEQ ID NO: 553916 - RNA, 63 nt, Homo Sapiens; identical to SEQ ID NO: 349864

SEQ ID NO: 553917 - RNA, 63 nt, Homo Sapiens; identical to SEQ ID NO: 349865

SEQ ID NO: 553918 - RNA, 63 nt, Homo Sapiens; identical to SEQ ID NO: 349866

SEQ ID NO: 553919 - RNA, 63 nt, Homo Sapiens; identical to SEQ ID NO: 349867

SEQ ID NO: 553920 - RNA, 63 nt, Homo Sapiens; identical to SEQ ID NO: 349868

SEQ ID NO: 553921 - RNA, 63 nt, Homo Sapiens; identical to SEQ ID NO: 349869

SEQ ID NO: 553922 - RNA, 63 nt, Homo Sapiens; identical to SEQ ID NO: 349870

SEQ ID NO: 553923 - RNA, 63 nt, Homo Sapiens; identical to SEQ ID NO: 349871

SEQ ID NO: 553924 - RNA, 63 nt, Homo Sapiens; identical to SEQ ID NO: 349872

SEQ ID NO: 553925 - RNA, 63 nt, Homo Sapiens; identical to SEQ ID NO: 349873

SEQ ID NO: 553926 - RNA, 63 nt, Homo Sapiens; identical to SEQ ID NO: 349874

SEQ ID NO: 553927 - RNA, 63 nt, Homo Sapiens; identical to SEQ ID NO: 349875

SEQ ID NO: 553928 - RNA, 63 nt, Homo Sapiens; identical to SEQ ID NO: 349876

SEQ ID NO: 553929 - RNA, 63 nt, Homo Sapiens; identical to SEQ ID NO: 349877

SEQ ID NO: 553930 - RNA, 63 nt, Homo Sapiens; identical to SEQ ID NO: 349878

SEQ ID NO: 553931 - RNA, 63 nt, Homo Sapiens; identical to SEQ ID NO: 349879

SEQ ID NO: 553932 - RNA, 63 nt, Homo Sapiens; identical to SEQ ID NO: 349880

SEQ ID NO: 553933 - RNA, 63 nt, Homo Sapiens; identical to SEQ ID NO: 349881

SEQ ID NO: 553934 - RNA, 63 nt, Homo Sapiens; identical to SEQ ID NO: 349882

SEQ ID NO: 553935 - RNA, 63 nt, Homo Sapiens; identical to SEQ ID NO: 349883

SEQ ID NO: 553936 - RNA, 63 nt, Homo Sapiens; identical to SEQ ID NO: 349884

SEQ ID NO: 553937 - RNA, 63 nt, Homo Sapiens; identical to SEQ ID NO: 349885

SEQ ID NO: 553938 - RNA, 63 nt, Homo Sapiens; identical to SEQ ID NO: 349886

SEQ ID NO: 553939 - RNA, 63 nt, Homo Sapiens; identical to SEQ ID NO: 349887

SEQ ID NO: 553940 - RNA, 63 nt, Homo Sapiens; identical to SEQ ID NO: 349888

SEQ ID NO: 553941 - RNA, 63 nt, Homo Sapiens; identical to SEQ ID NO: 349889

SEQ ID NO: 553942 - RNA, 63 nt, Homo Sapiens; identical to SEQ ID NO: 349890

SEQ ID NO: 553943 - RNA, 63 nt, Homo Sapiens; identical to SEQ ID NO: 349891

SEQ ID NO: 553944 - RNA, 63 nt, Homo Sapiens; identical to SEQ ID NO: 349892

SEQ ID NO: 553945 - RNA, 63 nt, Homo Sapiens; identical to SEQ ID NO: 349893

SEQ ID NO: 553946 - RNA, 63 nt, Homo Sapiens; identical to SEQ ID NO: 349894

SEQ ID NO: 553947 - RNA, 63 nt, Homo Sapiens; identical to SEQ ID NO: 349895

SEQ ID NO: 553948 - RNA, 63 nt, Homo Sapiens; identical to SEQ ID NO: 349896

SEQ ID NO: 553949 - RNA, 63 nt, Homo Sapiens; identical to SEQ ID NO: 349897

SEQ ID NO: 553950 - RNA, 63 nt, Homo Sapiens; identical to SEQ ID NO: 349898

SEQ ID NO: 553951 - RNA, 63 nt, Homo Sapiens; identical to SEQ ID NO: 349899

SEQ ID NO: 553952 - RNA, 63 nt, Homo Sapiens; identical to SEQ ID NO: 349900

SEQ ID NO: 553953 - RNA, 63 nt, Homo Sapiens; identical to SEQ ID NO: 349901

SEQ ID NO: 553954 - RNA, 63 nt, Homo Sapiens; identical to SEQ ID NO: 349902

SEQ ID NO: 553955 - RNA, 63 nt, Homo Sapiens; identical to SEQ ID NO: 349903

SEQ ID NO: 553956 - RNA, 63 nt, Homo Sapiens; identical to SEQ ID NO: 349904

SEQ ID NO: 553957 - RNA, 63 nt, Homo Sapiens; identical to SEQ ID NO: 349905

SEQ ID NO: 553958 - RNA, 63 nt, Homo Sapiens; identical to SEQ ID NO: 349906

SEQ ID NO: 553959 - RNA, 63 nt, Homo Sapiens; identical to SEQ ID NO: 349907

SEQ ID NO: 553960 - RNA, 63 nt, Homo Sapiens; identical to SEQ ID NO: 349908

SEQ ID NO: 553961 - RNA, 63 nt, Homo Sapiens; identical to SEQ ID NO: 349909

SEQ ID NO: 553962 - RNA, 63 nt, Homo Sapiens; identical to SEQ ID NO: 349910

SEQ ID NO: 553963 - RNA, 63 nt, Homo Sapiens; identical to SEQ ID NO: 349911

SEQ ID NO: 553964 - RNA, 63 nt, Homo Sapiens; identical to SEQ ID NO: 349912

SEQ ID NO: 553965 - RNA, 63 nt, Homo Sapiens; identical to SEQ ID NO: 349913

SEQ ID NO: 553966 - RNA, 63 nt, Homo Sapiens; identical to SEQ ID NO: 349914

SEQ ID NO: 553967 - RNA, 63 nt, Homo Sapiens; identical to SEQ ID NO: 349915

SEQ ID NO: 553968 - RNA, 63 nt, Homo Sapiens; identical to SEQ ID NO: 349916

SEQ ID NO: 553969 - RNA, 63 nt, Homo Sapiens; identical to SEQ ID NO: 349917

SEQ ID NO: 553970 - RNA, 63 nt, Homo Sapiens; identical to SEQ ID NO: 349918

SEQ ID NO: 553971 - RNA, 63 nt, Homo Sapiens; identical to SEQ ID NO: 349919

SEQ ID NO: 553972 - RNA, 63 nt, Homo Sapiens; identical to SEQ ID NO: 349920

SEQ ID NO: 553973 - RNA, 63 nt, Homo Sapiens; identical to SEQ ID NO: 349921

SEQ ID NO: 553974 - RNA, 63 nt, Homo Sapiens; identical to SEQ ID NO: 349922

SEQ ID NO: 553975 - RNA, 63 nt, Homo Sapiens; identical to SEQ ID NO: 349923

SEQ ID NO: 553976 - RNA, 63 nt, Homo Sapiens; identical to SEQ ID NO: 349924

SEQ ID NO: 553977 - RNA, 63 nt, Homo Sapiens; identical to SEQ ID NO: 349925

SEQ ID NO: 553978 - RNA, 63 nt, Homo Sapiens; identical to SEQ ID NO: 349926

SEQ ID NO: 553979 - RNA, 63 nt, Homo Sapiens; identical to SEQ ID NO: 349927

SEQ ID NO: 553980 - RNA, 63 nt, Homo Sapiens; identical to SEQ ID NO: 349928

SEQ ID NO: 553981 - RNA, 63 nt, Homo Sapiens; identical to SEQ ID NO: 349929

SEQ ID NO: 553982 - RNA, 63 nt, Homo Sapiens; identical to SEQ ID NO: 349930

SEQ ID NO: 553983 - RNA, 63 nt, Homo Sapiens; identical to SEQ ID NO: 349931

SEQ ID NO: 553984 - RNA, 63 nt, Homo Sapiens; identical to SEQ ID NO: 349932

SEQ ID NO: 553985 - RNA, 63 nt, Homo Sapiens; identical to SEQ ID NO: 349933

SEQ ID NO: 553986 - RNA, 63 nt, Homo Sapiens; identical to SEQ ID NO: 349934

SEQ ID NO: 553987 - RNA, 63 nt, Homo Sapiens; identical to SEQ ID NO: 349935

SEQ ID NO: 553988 - RNA, 63 nt, Homo Sapiens; identical to SEQ ID NO: 349936

SEQ ID NO: 553989 - RNA, 63 nt, Homo Sapiens; identical to SEQ ID NO: 349937

SEQ ID NO: 553990 - RNA, 63 nt, Homo Sapiens; identical to SEQ ID NO: 349938

SEQ ID NO: 553991 - RNA, 63 nt, Homo Sapiens; identical to SEQ ID NO: 349939

SEQ ID NO: 553992 - RNA, 63 nt, Homo Sapiens; identical to SEQ ID NO: 349940

SEQ ID NO: 553993 - RNA, 63 nt, Homo Sapiens; identical to SEQ ID NO: 349941

SEQ ID NO: 553994 - RNA, 63 nt, Homo Sapiens; identical to SEQ ID NO: 349942

SEQ ID NO: 553995 - RNA, 63 nt, Homo Sapiens; identical to SEQ ID NO: 349943

SEQ ID NO: 553996 - RNA, 63 nt, Homo Sapiens; identical to SEQ ID NO: 349944

SEQ ID NO: 553997 - RNA, 63 nt, Homo Sapiens; identical to SEQ ID NO: 349945

SEQ ID NO: 553998 - RNA, 63 nt, Homo Sapiens; identical to SEQ ID NO: 349946

SEQ ID NO: 553999 - RNA, 63 nt, Homo Sapiens; identical to SEQ ID NO: 349947

SEQ ID NO: 554000 - RNA, 63 nt, Homo Sapiens; identical to SEQ ID NO: 349948

SEQ ID NO: 554001 - RNA, 63 nt, Homo Sapiens; identical to SEQ ID NO: 349949

SEQ ID NO: 554002 - RNA, 63 nt, Homo Sapiens; identical to SEQ ID NO: 349950

SEQ ID NO: 554003 - RNA, 52 nt, Homo Sapiens; identical to SEQ ID NO: 349951

SEQ ID NO: 554004 - RNA, 63 nt, Homo Sapiens; identical to SEQ ID NO: 349952

SEQ ID NO: 554005 - RNA, 63 nt, Homo Sapiens; identical to SEQ ID NO: 349953

SEQ ID NO: 554006 - RNA, 63 nt, Homo Sapiens; identical to SEQ ID NO: 349954

SEQ ID NO: 554007 - RNA, 63 nt, Homo Sapiens; identical to SEQ ID NO: 349955

SEQ ID NO: 554008 - RNA, 63 nt, Homo Sapiens; identical to SEQ ID NO: 349956

SEQ ID NO: 554009 - RNA, 63 nt, Homo Sapiens; identical to SEQ ID NO: 349957

SEQ ID NO: 554010 - RNA, 63 nt, Homo Sapiens; identical to SEQ ID NO: 349958

SEQ ID NO: 554011 - RNA, 63 nt, Homo Sapiens; identical to SEQ ID NO: 349958

SEQ ID NO: 554012 - RNA, 63 nt, Homo Sapiens; identical to SEQ ID NO: 349960

SEQ ID NO: 554013 - RNA, 63 nt, Homo Sapiens; identical to SEQ ID NO: 349961

SEQ ID NO: 554014 - RNA, 63 nt, Homo Sapiens; identical to SEQ ID NO: 349962

SEQ ID NO: 554015 - RNA, 63 nt, Homo Sapiens; identical to SEQ ID NO: 349963

SEQ ID NO: 554016 - RNA, 63 nt, Homo Sapiens; identical to SEQ ID NO: 349964

SEQ ID NO: 554017 - RNA, 63 nt, Homo Sapiens; identical to SEQ ID NO: 349965

SEQ ID NO: 554018 - RNA, 63 nt, Homo Sapiens; identical to SEQ ID NO: 349966

SEQ ID NO: 554019 - RNA, 63 nt, Homo Sapiens; identical to SEQ ID NO: 349967

SEQ ID NO: 554020 - RNA, 63 nt, Homo Sapiens; identical to SEQ ID NO: 349968

SEQ ID NO: 554021 - RNA, 63 nt, Homo Sapiens; identical to SEQ ID NO: 349969

SEQ ID NO: 554022 - RNA, 63 nt, Homo Sapiens; identical to SEQ ID NO: 349970

SEQ ID NO: 554023 - RNA, 63 nt, Homo Sapiens; identical to SEQ ID NO: 349971

SEQ ID NO: 554024 - RNA, 63 nt, Homo Sapiens; identical to SEQ ID NO: 349972

SEQ ID NO: 554025 - RNA, 63 nt, Homo Sapiens; identical to SEQ ID NO: 349973

SEQ ID NO: 554026 - RNA, 63 nt, Homo Sapiens; identical to SEQ ID NO: 349974

SEQ ID NO: 554027 - RNA, 63 nt, Homo Sapiens; identical to SEQ ID NO: 349975

SEQ ID NO: 554028 - RNA, 63 nt, Homo Sapiens; identical to SEQ ID NO: 349976

SEQ ID NO: 554029 - RNA, 63 nt, Homo Sapiens; identical to SEQ ID NO: 349977

SEQ ID NO: 554030 - RNA, 63 nt, Homo Sapiens; identical to SEQ ID NO: 349978

SEQ ID NO: 554031 - RNA, 63 nt, Homo Sapiens; identical to SEQ ID NO: 349979

SEQ ID NO: 554032 - RNA, 63 nt, Homo Sapiens; identical to SEQ ID NO: 349980

SEQ ID NO: 554033 - RNA, 63 nt, Homo Sapiens; identical to SEQ ID NO: 349981

SEQ ID NO: 554034 - RNA, 63 nt, Homo Sapiens; identical to SEQ ID NO: 349982

SEQ ID NO: 554035 - RNA, 63 nt, Homo Sapiens; identical to SEQ ID NO: 349983

SEQ ID NO: 554036 - RNA, 63 nt, Homo Sapiens; identical to SEQ ID NO: 349984

SEQ ID NO: 554037 - RNA, 63 nt, Homo Sapiens; identical to SEQ ID NO: 349985

SEQ ID NO: 554038 - RNA, 63 nt, Homo Sapiens; identical to SEQ ID NO: 349986

SEQ ID NO: 554039 - RNA, 63 nt, Homo Sapiens; identical to SEQ ID NO: 349987

SEQ ID NO: 554040 - RNA, 63 nt, Homo Sapiens; identical to SEQ ID NO: 349988

SEQ ID NO: 554041 - RNA, 63 nt, Homo Sapiens; identical to SEQ ID NO: 349989

SEQ ID NO: 554042 - RNA, 63 nt, Homo Sapiens; identical to SEQ ID NO: 349990

SEQ ID NO: 554043 - RNA, 63 nt, Homo Sapiens; identical to SEQ ID NO: 349991

SEQ ID NO: 554044 - RNA, 63 nt, Homo Sapiens; identical to SEQ ID NO: 349992

SEQ ID NO: 554045 - RNA, 63 nt, Homo Sapiens; identical to SEQ ID NO: 349993

SEQ ID NO: 554046 - RNA, 63 nt, Homo Sapiens; identical to SEQ ID NO: 349994

SEQ ID NO: 554047 - RNA, 63 nt, Homo Sapiens; identical to SEQ ID NO: 349995

SEQ ID NO: 554048 - RNA, 63 nt, Homo Sapiens; identical to SEQ ID NO: 349996

SEQ ID NO: 554049 - RNA, 63 nt, Homo Sapiens; identical to SEQ ID NO: 349997

SEQ ID NO: 554050 - RNA, 63 nt, Homo Sapiens; identical to SEQ ID NO: 349998

SEQ ID NO: 554051 - RNA, 63 nt, Homo Sapiens; identical to SEQ ID NO: 349999

SEQ ID NO: 554052 - RNA, 63 nt, Homo Sapiens; identical to SEQ ID NO: 350000

SEQ ID NO: 554053 - RNA, 63 nt, Homo Sapiens; identical to SEQ ID NO: 350001

SEQ ID NO: 554054 - RNA, 63 nt, Homo Sapiens; identical to SEQ ID NO: 350002

SEQ ID NO: 554055 - RNA, 63 nt, Homo Sapiens; identical to SEQ ID NO: 350003

SEQ ID NO: 554056 - RNA, 63 nt, Homo Sapiens; identical to SEQ ID NO: 350004

SEQ ID NO: 554057 - RNA, 63 nt, Homo Sapiens; identical to SEQ ID NO: 350005

SEQ ID NO: 554058 - RNA, 63 nt, Homo Sapiens; identical to SEQ ID NO: 350006

SEQ ID NO: 554059 - RNA, 63 nt, Homo Sapiens; identical to SEQ ID NO: 350007

SEQ ID NO: 554060 - RNA, 63 nt, Homo Sapiens; identical to SEQ ID NO: 350008

SEQ ID NO: 554061 - RNA, 63 nt, Homo Sapiens; identical to SEQ ID NO: 350009

SEQ ID NO: 554062 - RNA, 63 nt, Homo Sapiens; identical to SEQ ID NO: 350010

SEQ ID NO: 554063 - RNA, 63 nt, Homo Sapiens; identical to SEQ ID NO: 350011

SEQ ID NO: 554064 - RNA, 63 nt, Homo Sapiens; identical to SEQ ID NO: 350012

SEQ ID NO: 554065 - RNA, 63 nt, Homo Sapiens; identical to SEQ ID NO: 350013

SEQ ID NO: 554066 - RNA, 63 nt, Homo Sapiens; identical to SEQ ID NO: 350014

SEQ ID NO: 554067 - RNA, 63 nt, Homo Sapiens; identical to SEQ ID NO: 350015

SEQ ID NO: 554068 - RNA, 63 nt, Homo Sapiens; identical to SEQ ID NO: 350016

SEQ ID NO: 554069 - RNA, 63 nt, Homo Sapiens; identical to SEQ ID NO: 350017

SEQ ID NO: 554070 - RNA, 63 nt, Homo Sapiens; identical to SEQ ID NO: 350018

SEQ ID NO: 554071 - RNA, 63 nt, Homo Sapiens; identical to SEQ ID NO: 350019

SEQ ID NO: 554072 - RNA, 63 nt, Homo Sapiens; identical to SEQ ID NO: 350020

SEQ ID NO: 554073 - RNA, 63 nt, Homo Sapiens; identical to SEQ ID NO: 350021

SEQ ID NO: 554074 - RNA, 63 nt, Homo Sapiens; identical to SEQ ID NO: 350022

SEQ ID NO: 554075 - RNA, 63 nt, Homo Sapiens; identical to SEQ ID NO: 350023

SEQ ID NO: 554076 - RNA, 63 nt, Homo Sapiens; identical to SEQ ID NO: 350024

SEQ ID NO: 554077 - RNA, 63 nt, Homo Sapiens; identical to SEQ ID NO: 350025

SEQ ID NO: 554078 - RNA, 63 nt, Homo Sapiens; identical to SEQ ID NO: 350026

SEQ ID NO: 554079 - RNA, 63 nt, Homo Sapiens; identical to SEQ ID NO: 350027

SEQ ID NO: 554080 - RNA, 63 nt, Homo Sapiens; identical to SEQ ID NO: 350028

SEQ ID NO: 554081 - RNA, 63 nt, Homo Sapiens; identical to SEQ ID NO: 350029

SEQ ID NO: 554082 - RNA, 63 nt, Homo Sapiens; identical to SEQ ID NO: 350030

SEQ ID NO: 554083 - RNA, 63 nt, Homo Sapiens; identical to SEQ ID NO: 350031

SEQ ID NO: 554084 - RNA, 63 nt, Homo Sapiens; identical to SEQ ID NO: 350032

SEQ ID NO: 554085 - RNA, 63 nt, Homo Sapiens; identical to SEQ ID NO: 350033

SEQ ID NO: 554086 - RNA, 63 nt, Homo Sapiens; identical to SEQ ID NO: 350034

SEQ ID NO: 554087 - RNA, 63 nt, Homo Sapiens; identical to SEQ ID NO: 350035

SEQ ID NO: 554088 - RNA, 63 nt, Homo Sapiens; identical to SEQ ID NO: 350036

SEQ ID NO: 554089 - RNA, 63 nt, Homo Sapiens; identical to SEQ ID NO: 350037

SEQ ID NO: 554090 - RNA, 63 nt, Homo Sapiens; identical to SEQ ID NO: 350038

SEQ ID NO: 554091 - RNA, 63 nt, Homo Sapiens; identical to SEQ ID NO: 350039

SEQ ID NO: 554092 - RNA, 63 nt, Homo Sapiens; identical to SEQ ID NO: 350040

SEQ ID NO: 554093 - RNA, 63 nt, Homo Sapiens; identical to SEQ ID NO: 350041

SEQ ID NO: 554094 - RNA, 63 nt, Homo Sapiens; identical to SEQ ID NO: 350042

SEQ ID NO: 554095 - RNA, 63 nt, Homo Sapiens; identical to SEQ ID NO: 350043

SEQ ID NO: 554096 - RNA, 63 nt, Homo Sapiens; identical to SEQ ID NO: 350044

SEQ ID NO: 554097 - RNA, 63 nt, Homo Sapiens; identical to SEQ ID NO: 350045

SEQ ID NO: 554098 - RNA, 63 nt, Homo Sapiens; identical to SEQ ID NO: 350046

SEQ ID NO: 554099 - RNA, 63 nt, Homo Sapiens; identical to SEQ ID NO: 350047

SEQ ID NO: 554100 - RNA, 63 nt, Homo Sapiens; identical to SEQ ID NO: 350048

SEQ ID NO: 554101 - RNA, 63 nt, Homo Sapiens; identical to SEQ ID NO: 350049

SEQ ID NO: 554102 - RNA, 63 nt, Homo Sapiens; identical to SEQ ID NO: 350050

SEQ ID NO: 554103 - RNA, 63 nt, Homo Sapiens; identical to SEQ ID NO: 350051

SEQ ID NO: 554104 - RNA, 63 nt, Homo Sapiens; identical to SEQ ID NO: 350052

SEQ ID NO: 554105 - RNA, 63 nt, Homo Sapiens; identical to SEQ ID NO: 350053

SEQ ID NO: 554106 - RNA, 63 nt, Homo Sapiens; identical to SEQ ID NO: 350054

SEQ ID NO: 554107 - RNA, 63 nt, Homo Sapiens; identical to SEQ ID NO: 350055

SEQ ID NO: 554108 - RNA, 63 nt, Homo Sapiens; identical to SEQ ID NO: 350056

SEQ ID NO: 554109 - RNA, 63 nt, Homo Sapiens; identical to SEQ ID NO: 350057

SEQ ID NO: 554110 - RNA, 63 nt, Homo Sapiens; identical to SEQ ID NO: 350058

SEQ ID NO: 554111 - RNA, 63 nt, Homo Sapiens; identical to SEQ ID NO: 350059

SEQ ID NO: 554112 - RNA, 63 nt, Homo Sapiens; identical to SEQ ID NO: 350060

SEQ ID NO: 554113 - RNA, 63 nt, Homo Sapiens; identical to SEQ ID NO: 350061

SEQ ID NO: 554114 - RNA, 63 nt, Homo Sapiens; identical to SEQ ID NO: 350062

SEQ ID NO: 554115 - RNA, 63 nt, Homo Sapiens; identical to SEQ ID NO: 350063

SEQ ID NO: 554116 - RNA, 63 nt, Homo Sapiens; identical to SEQ ID NO: 350064

SEQ ID NO: 554117 - RNA, 63 nt, Homo Sapiens; identical to SEQ ID NO: 350065

SEQ ID NO: 554118 - RNA, 63 nt, Homo Sapiens; identical to SEQ ID NO: 350066

SEQ ID NO: 554119 - RNA, 63 nt, Homo Sapiens; identical to SEQ ID NO: 350067

SEQ ID NO: 554120 - RNA, 63 nt, Homo Sapiens; identical to SEQ ID NO: 350068

SEQ ID NO: 554121 - RNA, 63 nt, Homo Sapiens; identical to SEQ ID NO: 350069

SEQ ID NO: 554122 - RNA, 63 nt, Homo Sapiens; identical to SEQ ID NO: 350070

SEQ ID NO: 554123 - RNA, 63 nt, Homo Sapiens; identical to SEQ ID NO: 350071

SEQ ID NO: 554124 - RNA, 63 nt, Homo Sapiens; identical to SEQ ID NO: 350072

SEQ ID NO: 554125 - RNA, 63 nt, Homo Sapiens; identical to SEQ ID NO: 350073

SEQ ID NO: 554126 - RNA, 63 nt, Homo Sapiens; identical to SEQ ID NO: 350074

SEQ ID NO: 554127 - RNA, 63 nt, Homo Sapiens; identical to SEQ ID NO: 350075

SEQ ID NO: 554128 - RNA, 62 nt, Homo Sapiens; identical to SEQ ID NO: 350076

SEQ ID NO: 554129 - RNA, 63 nt, Homo Sapiens; identical to SEQ ID NO: 350077

SEQ ID NO: 554130 - RNA, 63 nt, Homo Sapiens; identical to SEQ ID NO: 350078

SEQ ID NO: 554131 - RNA, 63 nt, Homo Sapiens; identical to SEQ ID NO: 350079

SEQ ID NO: 554132 - RNA, 63 nt, Homo Sapiens; identical to SEQ ID NO: 350080

SEQ ID NO: 554133 - RNA, 63 nt, Homo Sapiens; identical to SEQ ID NO: 350081

SEQ ID NO: 554134 - RNA, 63 nt, Homo Sapiens; identical to SEQ ID NO: 350082

SEQ ID NO: 554135 - RNA, 63 nt, Homo Sapiens; identical to SEQ ID NO: 350083

SEQ ID NO: 554136 - RNA, 63 nt, Homo Sapiens; identical to SEQ ID NO: 350084

SEQ ID NO: 554137 - RNA, 63 nt, Homo Sapiens; identical to SEQ ID NO: 350085

SEQ ID NO: 554138 - RNA, 63 nt, Homo Sapiens; identical to SEQ ID NO: 350086

SEQ ID NO: 554139 - RNA, 63 nt, Homo Sapiens; identical to SEQ ID NO: 350087

SEQ ID NO: 554140 - RNA, 63 nt, Homo Sapiens; identical to SEQ ID NO: 350088

SEQ ID NO: 554141 - RNA, 63 nt, Homo Sapiens; identical to SEQ ID NO: 350089

SEQ ID NO: 554142 - RNA, 63 nt, Homo Sapiens; identical to SEQ ID NO: 350090

SEQ ID NO: 554143 - RNA, 63 nt, Homo Sapiens; identical to SEQ ID NO: 350091

SEQ ID NO: 554144 - RNA, 63 nt, Homo Sapiens; identical to SEQ ID NO: 350092

SEQ ID NO: 554145 - RNA, 63 nt, Homo Sapiens; identical to SEQ ID NO: 350093

SEQ ID NO: 554146 - RNA, 63 nt, Homo Sapiens; identical to SEQ ID NO: 350094

SEQ ID NO: 554147 - RNA, 63 nt, Homo Sapiens; identical to SEQ ID NO: 350095

SEQ ID NO: 554148 - RNA, 63 nt, Homo Sapiens; identical to SEQ ID NO: 350096

SEQ ID NO: 554149 - RNA, 63 nt, Homo Sapiens; identical to SEQ ID NO: 350097

SEQ ID NO: 554150 - RNA, 63 nt, Homo Sapiens; identical to SEQ ID NO: 350098

SEQ ID NO: 554151 - RNA, 63 nt, Homo Sapiens; identical to SEQ ID NO: 350099

SEQ ID NO: 554152 - RNA, 63 nt, Homo Sapiens; identical to SEQ ID NO: 350100

SEQ ID NO: 554153 - RNA, 63 nt, Homo Sapiens; identical to SEQ ID NO: 350101

SEQ ID NO: 554154 - RNA, 63 nt, Homo Sapiens; identical to SEQ ID NO: 350102

SEQ ID NO: 554155 - RNA, 63 nt, Homo Sapiens; identical to SEQ ID NO: 350103

SEQ ID NO: 554156 - RNA, 63 nt, Homo Sapiens; identical to SEQ ID NO: 350104

SEQ ID NO: 554157 - RNA, 63 nt, Homo Sapiens; identical to SEQ ID NO: 350105

SEQ ID NO: 554158 - RNA, 63 nt, Homo Sapiens; identical to SEQ ID NO: 350106

SEQ ID NO: 554159 - RNA, 63 nt, Homo Sapiens; identical to SEQ ID NO: 350107

SEQ ID NO: 554160 - RNA, 63 nt, Homo Sapiens; identical to SEQ ID NO: 350108

SEQ ID NO: 554161 - RNA, 63 nt, Homo Sapiens; identical to SEQ ID NO: 350109

SEQ ID NO: 554162 - RNA, 63 nt, Homo Sapiens; identical to SEQ ID NO: 350110

SEQ ID NO: 554163 - RNA, 63 nt, Homo Sapiens; identical to SEQ ID NO: 350111

SEQ ID NO: 554164 - RNA, 63 nt, Homo Sapiens; identical to SEQ ID NO: 350112

SEQ ID NO: 554165 - RNA, 63 nt, Homo Sapiens; identical to SEQ ID NO: 350113

SEQ ID NO: 554166 - RNA, 63 nt, Homo Sapiens; identical to SEQ ID NO: 350114

SEQ ID NO: 554167 - RNA, 63 nt, Homo Sapiens; identical to SEQ ID NO: 350115

SEQ ID NO: 554168 - RNA, 63 nt, Homo Sapiens; identical to SEQ ID NO: 350116

SEQ ID NO: 554169 - RNA, 63 nt, Homo Sapiens; identical to SEQ ID NO: 350117

SEQ ID NO: 554170 - RNA, 63 nt, Homo Sapiens; identical to SEQ ID NO: 350118

SEQ ID NO: 554171 - RNA, 63 nt, Homo Sapiens; identical to SEQ ID NO: 350119

SEQ ID NO: 554172 - RNA, 63 nt, Homo Sapiens; identical to SEQ ID NO: 350120

SEQ ID NO: 554173 - RNA, 63 nt, Homo Sapiens; identical to SEQ ID NO: 350121

SEQ ID NO: 554174 - RNA, 63 nt, Homo Sapiens; identical to SEQ ID NO: 350122

SEQ ID NO: 554175 - RNA, 63 nt, Homo Sapiens; identical to SEQ ID NO: 350123

SEQ ID NO: 554176 - RNA, 63 nt, Homo Sapiens; identical to SEQ ID NO: 350124

SEQ ID NO: 554177 - RNA, 63 nt, Homo Sapiens; identical to SEQ ID NO: 350125

SEQ ID NO: 554178 - RNA, 63 nt, Homo Sapiens; identical to SEQ ID NO: 350126

SEQ ID NO: 554179 - RNA, 63 nt, Homo Sapiens; identical to SEQ ID NO: 350127

SEQ ID NO: 554180 - RNA, 63 nt, Homo Sapiens; identical to SEQ ID NO: 350128

SEQ ID NO: 554181 - RNA, 63 nt, Homo Sapiens; identical to SEQ ID NO: 350129

SEQ ID NO: 554182 - RNA, 63 nt, Homo Sapiens; identical to SEQ ID NO: 350130

SEQ ID NO: 554183 - RNA, 63 nt, Homo Sapiens; identical to SEQ ID NO: 350131

SEQ ID NO: 554184 - RNA, 63 nt, Homo Sapiens; identical to SEQ ID NO: 350132

SEQ ID NO: 554185 - RNA, 63 nt, Homo Sapiens; identical to SEQ ID NO: 350133

SEQ ID NO: 554186 - RNA, 63 nt, Homo Sapiens; identical to SEQ ID NO: 350134

SEQ ID NO: 554187 - RNA, 63 nt, Homo Sapiens; identical to SEQ ID NO: 350135

SEQ ID NO: 554188 - RNA, 63 nt, Homo Sapiens; identical to SEQ ID NO: 350136

SEQ ID NO: 554189 - RNA, 63 nt, Homo Sapiens; identical to SEQ ID NO: 350137

SEQ ID NO: 554190 - RNA, 63 nt, Homo Sapiens; identical to SEQ ID NO: 350138

SEQ ID NO: 554191 - RNA, 63 nt, Homo Sapiens; identical to SEQ ID NO: 350139

SEQ ID NO: 554192 - RNA, 63 nt, Homo Sapiens; identical to SEQ ID NO: 350140

SEQ ID NO: 554193 - RNA, 63 nt, Homo Sapiens; identical to SEQ ID NO: 350141

SEQ ID NO: 554194 - RNA, 63 nt, Homo Sapiens; identical to SEQ ID NO: 350142

SEQ ID NO: 554195 - RNA, 63 nt, Homo Sapiens; identical to SEQ ID NO: 350143

SEQ ID NO: 554196 - RNA, 63 nt, Homo Sapiens; identical to SEQ ID NO: 350144

SEQ ID NO: 554197 - RNA, 63 nt, Homo Sapiens; identical to SEQ ID NO: 350145

SEQ ID NO: 554198 - RNA, 63 nt, Homo Sapiens; identical to SEQ ID NO: 350146

SEQ ID NO: 554199 - RNA, 63 nt, Homo Sapiens; identical to SEQ ID NO: 350147

SEQ ID NO: 554200 - RNA, 63 nt, Homo Sapiens; identical to SEQ ID NO: 350148

SEQ ID NO: 554201 - RNA, 63 nt, Homo Sapiens; identical to SEQ ID NO: 350149

SEQ ID NO: 554202 - RNA, 63 nt, Homo Sapiens; identical to SEQ ID NO: 350150

SEQ ID NO: 554203 - RNA, 63 nt, Homo Sapiens; identical to SEQ ID NO: 350151

SEQ ID NO: 554204 - RNA, 63 nt, Homo Sapiens; identical to SEQ ID NO: 350152

SEQ ID NO: 554205 - RNA, 63 nt, Homo Sapiens; identical to SEQ ID NO: 350153

SEQ ID NO: 554206 - RNA, 60 nt, Homo Sapiens; identical to SEQ ID NO: 350154

SEQ ID NO: 554207 - RNA, 63 nt, Homo Sapiens; identical to SEQ ID NO: 350155

SEQ ID NO: 554208 - RNA, 63 nt, Homo Sapiens; identical to SEQ ID NO: 350156

SEQ ID NO: 554209 - RNA, 63 nt, Homo Sapiens; identical to SEQ ID NO: 350157

SEQ ID NO: 554210 - RNA, 63 nt, Homo Sapiens; identical to SEQ ID NO: 350158

SEQ ID NO: 554211 - RNA, 63 nt, Homo Sapiens; identical to SEQ ID NO: 350159

SEQ ID NO: 554212 - RNA, 63 nt, Homo Sapiens; identical to SEQ ID NO: 350160

SEQ ID NO: 554213 - RNA, 63 nt, Homo Sapiens; identical to SEQ ID NO: 350161

SEQ ID NO: 554214 - RNA, 63 nt, Homo Sapiens; identical to SEQ ID NO: 350162

SEQ ID NO: 554215 - RNA, 63 nt, Homo Sapiens; identical to SEQ ID NO: 350163

SEQ ID NO: 554216 - RNA, 63 nt, Homo Sapiens; identical to SEQ ID NO: 350164

SEQ ID NO: 554217 - RNA, 63 nt, Homo Sapiens; identical to SEQ ID NO: 350165

SEQ ID NO: 554218 - RNA, 63 nt, Homo Sapiens; identical to SEQ ID NO: 350166

SEQ ID NO: 554219 - RNA, 63 nt, Homo Sapiens; identical to SEQ ID NO: 350167

SEQ ID NO: 554220 - RNA, 63 nt, Homo Sapiens; identical to SEQ ID NO: 350168

SEQ ID NO: 554221 - RNA, 63 nt, Homo Sapiens; identical to SEQ ID NO: 350169

SEQ ID NO: 554222 - RNA, 63 nt, Homo Sapiens; identical to SEQ ID NO: 350170

SEQ ID NO: 554223 - RNA, 63 nt, Homo Sapiens; identical to SEQ ID NO: 350171

SEQ ID NO: 554224 - RNA, 63 nt, Homo Sapiens; identical to SEQ ID NO: 350172

SEQ ID NO: 554225 - RNA, 63 nt, Homo Sapiens; identical to SEQ ID NO: 350173

SEQ ID NO: 554226 - RNA, 63 nt, Homo Sapiens; identical to SEQ ID NO: 350174

SEQ ID NO: 554227 - RNA, 63 nt, Homo Sapiens; identical to SEQ ID NO: 350175

SEQ ID NO: 554228 - RNA, 63 nt, Homo Sapiens; identical to SEQ ID NO: 350176

SEQ ID NO: 554229 - RNA, 63 nt, Homo Sapiens; identical to SEQ ID NO: 350177

SEQ ID NO: 554230 - RNA, 63 nt, Homo Sapiens; identical to SEQ ID NO: 350178

SEQ ID NO: 554231 - RNA, 63 nt, Homo Sapiens; identical to SEQ ID NO: 350179

SEQ ID NO: 554232 - RNA, 63 nt, Homo Sapiens; identical to SEQ ID NO: 350180

SEQ ID NO: 554233 - RNA, 63 nt, Homo Sapiens; identical to SEQ ID NO: 350181

SEQ ID NO: 554234 - RNA, 63 nt, Homo Sapiens; identical to SEQ ID NO: 350182

SEQ ID NO: 554235 - RNA, 63 nt, Homo Sapiens; identical to SEQ ID NO: 350183

SEQ ID NO: 554236 - RNA, 63 nt, Homo Sapiens; identical to SEQ ID NO: 350184

SEQ ID NO: 554237 - RNA, 63 nt, Homo Sapiens; identical to SEQ ID NO: 350184

SEQ ID NO: 554238 - RNA, 63 nt, Homo Sapiens; identical to SEQ ID NO: 350186

SEQ ID NO: 554239 - RNA, 63 nt, Homo Sapiens; identical to SEQ ID NO: 350187

SEQ ID NO: 554240 - RNA, 63 nt, Homo Sapiens; identical to SEQ ID NO: 350188

SEQ ID NO: 554241 - RNA, 63 nt, Homo Sapiens; identical to SEQ ID NO: 350189

SEQ ID NO: 554242 - RNA, 63 nt, Homo Sapiens; identical to SEQ ID NO: 350190

SEQ ID NO: 554243 - RNA, 63 nt, Homo Sapiens; identical to SEQ ID NO: 350191

SEQ ID NO: 554244 - RNA, 63 nt, Homo Sapiens; identical to SEQ ID NO: 350192

SEQ ID NO: 554245 - RNA, 63 nt, Homo Sapiens; identical to SEQ ID NO: 350193

SEQ ID NO: 554246 - RNA, 63 nt, Homo Sapiens; identical to SEQ ID NO: 350194

SEQ ID NO: 554247 - RNA, 63 nt, Homo Sapiens; identical to SEQ ID NO: 350195

SEQ ID NO: 554248 - RNA, 63 nt, Homo Sapiens; identical to SEQ ID NO: 350196

SEQ ID NO: 554249 - RNA, 63 nt, Homo Sapiens; identical to SEQ ID NO: 350197

SEQ ID NO: 554250 - RNA, 63 nt, Homo Sapiens; identical to SEQ ID NO: 350198

SEQ ID NO: 554251 - RNA, 63 nt, Homo Sapiens; identical to SEQ ID NO: 350199

SEQ ID NO: 554252 - RNA, 63 nt, Homo Sapiens; identical to SEQ ID NO: 350200

SEQ ID NO: 554253 - RNA, 63 nt, Homo Sapiens; identical to SEQ ID NO: 350201

SEQ ID NO: 554254 - RNA, 63 nt, Homo Sapiens; identical to SEQ ID NO: 350202

SEQ ID NO: 554255 - RNA, 61 nt, Homo Sapiens; identical to SEQ ID NO: 350203

SEQ ID NO: 554256 - RNA, 63 nt, Homo Sapiens; identical to SEQ ID NO: 350204

SEQ ID NO: 554257 - RNA, 63 nt, Homo Sapiens; identical to SEQ ID NO: 350205

SEQ ID NO: 554258 - RNA, 63 nt, Homo Sapiens; identical to SEQ ID NO: 350206

SEQ ID NO: 554259 - RNA, 63 nt, Homo Sapiens; identical to SEQ ID NO: 350207

SEQ ID NO: 554260 - RNA, 63 nt, Homo Sapiens; identical to SEQ ID NO: 350208

SEQ ID NO: 554261 - RNA, 63 nt, Homo Sapiens; identical to SEQ ID NO: 350209

SEQ ID NO: 554262 - RNA, 63 nt, Homo Sapiens; identical to SEQ ID NO: 350210

SEQ ID NO: 554263 - RNA, 63 nt, Homo Sapiens; identical to SEQ ID NO: 350211

SEQ ID NO: 554264 - RNA, 63 nt, Homo Sapiens; identical to SEQ ID NO: 350212

SEQ ID NO: 554265 - RNA, 63 nt, Homo Sapiens; identical to SEQ ID NO: 350213

SEQ ID NO: 554266 - RNA, 63 nt, Homo Sapiens; identical to SEQ ID NO: 350214

SEQ ID NO: 554267 - RNA, 63 nt, Homo Sapiens; identical to SEQ ID NO: 350215

SEQ ID NO: 554268 - RNA, 63 nt, Homo Sapiens; identical to SEQ ID NO: 350216

SEQ ID NO: 554269 - RNA, 63 nt, Homo Sapiens; identical to SEQ ID NO: 350217

SEQ ID NO: 554270 - RNA, 63 nt, Homo Sapiens; identical to SEQ ID NO: 350218

SEQ ID NO: 554271 - RNA, 63 nt, Homo Sapiens; identical to SEQ ID NO: 350219

SEQ ID NO: 554272 - RNA, 63 nt, Homo Sapiens; identical to SEQ ID NO: 350220

SEQ ID NO: 554273 - RNA, 63 nt, Homo Sapiens; identical to SEQ ID NO: 350221

SEQ ID NO: 554274 - RNA, 63 nt, Homo Sapiens; identical to SEQ ID NO: 350222

SEQ ID NO: 554275 - RNA, 63 nt, Homo Sapiens; identical to SEQ ID NO: 350223

SEQ ID NO: 554276 - RNA, 63 nt, Homo Sapiens; identical to SEQ ID NO: 350224

SEQ ID NO: 554277 - RNA, 63 nt, Homo Sapiens; identical to SEQ ID NO: 350225

SEQ ID NO: 554278 - RNA, 63 nt, Homo Sapiens; identical to SEQ ID NO: 350226

SEQ ID NO: 554279 - RNA, 63 nt, Homo Sapiens; identical to SEQ ID NO: 350227

SEQ ID NO: 554280 - RNA, 63 nt, Homo Sapiens; identical to SEQ ID NO: 350228

SEQ ID NO: 554281 - RNA, 63 nt, Homo Sapiens; identical to SEQ ID NO: 350229

SEQ ID NO: 554282 - RNA, 63 nt, Homo Sapiens; identical to SEQ ID NO: 350230

SEQ ID NO: 554283 - RNA, 63 nt, Homo Sapiens; identical to SEQ ID NO: 350231

SEQ ID NO: 554284 - RNA, 63 nt, Homo Sapiens; identical to SEQ ID NO: 350232

SEQ ID NO: 554285 - RNA, 63 nt, Homo Sapiens; identical to SEQ ID NO: 350233

SEQ ID NO: 554286 - RNA, 63 nt, Homo Sapiens; identical to SEQ ID NO: 350234

SEQ ID NO: 554287 - RNA, 63 nt, Homo Sapiens; identical to SEQ ID NO: 350234

SEQ ID NO: 554288 - RNA, 63 nt, Homo Sapiens; identical to SEQ ID NO: 350236

SEQ ID NO: 554289 - RNA, 62 nt, Homo Sapiens; identical to SEQ ID NO: 350237

SEQ ID NO: 554290 - RNA, 62 nt, Homo Sapiens; identical to SEQ ID NO: 350238

SEQ ID NO: 554291 - RNA, 62 nt, Homo Sapiens; identical to SEQ ID NO: 350239

SEQ ID NO: 554292 - RNA, 62 nt, Homo Sapiens; identical to SEQ ID NO: 350240

SEQ ID NO: 554293 - RNA, 62 nt, Homo Sapiens; identical to SEQ ID NO: 350241

SEQ ID NO: 554294 - RNA, 62 nt, Homo Sapiens; identical to SEQ ID NO: 350242

SEQ ID NO: 554295 - RNA, 62 nt, Homo Sapiens; identical to SEQ ID NO: 350243

SEQ ID NO: 554296 - RNA, 62 nt, Homo Sapiens; identical to SEQ ID NO: 350244

SEQ ID NO: 554297 - RNA, 62 nt, Homo Sapiens; identical to SEQ ID NO: 350245

SEQ ID NO: 554298 - RNA, 62 nt, Homo Sapiens; identical to SEQ ID NO: 350246

SEQ ID NO: 554299 - RNA, 62 nt, Homo Sapiens; identical to SEQ ID NO: 350247

SEQ ID NO: 554300 - RNA, 62 nt, Homo Sapiens; identical to SEQ ID NO: 350248

SEQ ID NO: 554301 - RNA, 62 nt, Homo Sapiens; identical to SEQ ID NO: 350249

SEQ ID NO: 554302 - RNA, 62 nt, Homo Sapiens; identical to SEQ ID NO: 350250

SEQ ID NO: 554303 - RNA, 62 nt, Homo Sapiens; identical to SEQ ID NO: 350251

SEQ ID NO: 554304 - RNA, 62 nt, Homo Sapiens; identical to SEQ ID NO: 350252

SEQ ID NO: 554305 - RNA, 55 nt, Homo Sapiens; identical to SEQ ID NO: 174536

SEQ ID NO: 554306 - RNA, 62 nt, Homo Sapiens; identical to SEQ ID NO: 350254

SEQ ID NO: 554307 - RNA, 62 nt, Homo Sapiens; identical to SEQ ID NO: 350255

SEQ ID NO: 554308 - RNA, 62 nt, Homo Sapiens; identical to SEQ ID NO: 350256

SEQ ID NO: 554309 - RNA, 62 nt, Homo Sapiens; identical to SEQ ID NO: 350257

SEQ ID NO: 554310 - RNA, 62 nt, Homo Sapiens; identical to SEQ ID NO: 350258

SEQ ID NO: 554311 - RNA, 62 nt, Homo Sapiens; identical to SEQ ID NO: 350259

SEQ ID NO: 554312 - RNA, 62 nt, Homo Sapiens; identical to SEQ ID NO: 350260

SEQ ID NO: 554313 - RNA, 62 nt, Homo Sapiens; identical to SEQ ID NO: 350261

SEQ ID NO: 554314 - RNA, 62 nt, Homo Sapiens; identical to SEQ ID NO: 350262

SEQ ID NO: 554315 - RNA, 62 nt, Homo Sapiens; identical to SEQ ID NO: 350263

SEQ ID NO: 554316 - RNA, 62 nt, Homo Sapiens; identical to SEQ ID NO: 350264

SEQ ID NO: 554317 - RNA, 62 nt, Homo Sapiens; identical to SEQ ID NO: 350265

SEQ ID NO: 554318 - RNA, 62 nt, Homo Sapiens; identical to SEQ ID NO: 350266

SEQ ID NO: 554319 - RNA, 62 nt, Homo Sapiens; identical to SEQ ID NO: 350267

SEQ ID NO: 554320 - RNA, 62 nt, Homo Sapiens; identical to SEQ ID NO: 350268

SEQ ID NO: 554321 - RNA, 58 nt, Homo Sapiens; identical to SEQ ID NO: 174552

SEQ ID NO: 554322 - RNA, 62 nt, Homo Sapiens; identical to SEQ ID NO: 350270

SEQ ID NO: 554323 - RNA, 62 nt, Homo Sapiens; identical to SEQ ID NO: 350271

SEQ ID NO: 554324 - RNA, 62 nt, Homo Sapiens; identical to SEQ ID NO: 350272

SEQ ID NO: 554325 - RNA, 62 nt, Homo Sapiens; identical to SEQ ID NO: 350273

SEQ ID NO: 554326 - RNA, 62 nt, Homo Sapiens; identical to SEQ ID NO: 350274

SEQ ID NO: 554327 - RNA, 62 nt, Homo Sapiens; identical to SEQ ID NO: 350275

SEQ ID NO: 554328 - RNA, 62 nt, Homo Sapiens; identical to SEQ ID NO: 350276

SEQ ID NO: 554329 - RNA, 62 nt, Homo Sapiens; identical to SEQ ID NO: 350277

SEQ ID NO: 554330 - RNA, 62 nt, Homo Sapiens; identical to SEQ ID NO: 350278

SEQ ID NO: 554331 - RNA, 62 nt, Homo Sapiens; identical to SEQ ID NO: 350279

SEQ ID NO: 554332 - RNA, 62 nt, Homo Sapiens; identical to SEQ ID NO: 350280

SEQ ID NO: 554333 - RNA, 62 nt, Homo Sapiens; identical to SEQ ID NO: 350281

SEQ ID NO: 554334 - RNA, 62 nt, Homo Sapiens; identical to SEQ ID NO: 350282

SEQ ID NO: 554335 - RNA, 62 nt, Homo Sapiens; identical to SEQ ID NO: 350283

SEQ ID NO: 554336 - RNA, 62 nt, Homo Sapiens; identical to SEQ ID NO: 350284

SEQ ID NO: 554337 - RNA, 62 nt, Homo Sapiens; identical to SEQ ID NO: 350285

SEQ ID NO: 554338 - RNA, 62 nt, Homo Sapiens; identical to SEQ ID NO: 350286

SEQ ID NO: 554339 - RNA, 62 nt, Homo Sapiens; identical to SEQ ID NO: 350287

SEQ ID NO: 554340 - RNA, 62 nt, Homo Sapiens; identical to SEQ ID NO: 350288

SEQ ID NO: 554341 - RNA, 62 nt, Homo Sapiens; identical to SEQ ID NO: 350289

SEQ ID NO: 554342 - RNA, 62 nt, Homo Sapiens; identical to SEQ ID NO: 350290

SEQ ID NO: 554343 - RNA, 62 nt, Homo Sapiens; identical to SEQ ID NO: 350291

SEQ ID NO: 554344 - RNA, 62 nt, Homo Sapiens; identical to SEQ ID NO: 350292

SEQ ID NO: 554345 - RNA, 62 nt, Homo Sapiens; identical to SEQ ID NO: 350293

SEQ ID NO: 554346 - RNA, 62 nt, Homo Sapiens; identical to SEQ ID NO: 350294

SEQ ID NO: 554347 - RNA, 62 nt, Homo Sapiens; identical to SEQ ID NO: 350295

SEQ ID NO: 554348 - RNA, 62 nt, Homo Sapiens; identical to SEQ ID NO: 350296

SEQ ID NO: 554349 - RNA, 62 nt, Homo Sapiens; identical to SEQ ID NO: 350297

SEQ ID NO: 554350 - RNA, 62 nt, Homo Sapiens; identical to SEQ ID NO: 350298

SEQ ID NO: 554351 - RNA, 62 nt, Homo Sapiens; identical to SEQ ID NO: 350299

SEQ ID NO: 554352 - RNA, 62 nt, Homo Sapiens; identical to SEQ ID NO: 350300

SEQ ID NO: 554353 - RNA, 62 nt, Homo Sapiens; identical to SEQ ID NO: 350301

SEQ ID NO: 554354 - RNA, 62 nt, Homo Sapiens; identical to SEQ ID NO: 350302

SEQ ID NO: 554355 - RNA, 62 nt, Homo Sapiens; identical to SEQ ID NO: 350303

SEQ ID NO: 554356 - RNA, 62 nt, Homo Sapiens; identical to SEQ ID NO: 350304

SEQ ID NO: 554357 - RNA, 62 nt, Homo Sapiens; identical to SEQ ID NO: 350305

SEQ ID NO: 554358 - RNA, 62 nt, Homo Sapiens; identical to SEQ ID NO: 350306

SEQ ID NO: 554359 - RNA, 62 nt, Homo Sapiens; identical to SEQ ID NO: 350307

SEQ ID NO: 554360 - RNA, 62 nt, Homo Sapiens; identical to SEQ ID NO: 350308

SEQ ID NO: 554361 - RNA, 62 nt, Homo Sapiens; identical to SEQ ID NO: 350309

SEQ ID NO: 554362 - RNA, 62 nt, Homo Sapiens; identical to SEQ ID NO: 350310

SEQ ID NO: 554363 - RNA, 62 nt, Homo Sapiens; identical to SEQ ID NO: 350311

SEQ ID NO: 554364 - RNA, 62 nt, Homo Sapiens; identical to SEQ ID NO: 350312

SEQ ID NO: 554365 - RNA, 62 nt, Homo Sapiens; identical to SEQ ID NO: 350313

SEQ ID NO: 554366 - RNA, 62 nt, Homo Sapiens; identical to SEQ ID NO: 350314

SEQ ID NO: 554367 - RNA, 62 nt, Homo Sapiens; identical to SEQ ID NO: 350315

SEQ ID NO: 554368 - RNA, 62 nt, Homo Sapiens; identical to SEQ ID NO: 350316

SEQ ID NO: 554369 - RNA, 62 nt, Homo Sapiens; identical to SEQ ID NO: 350317

SEQ ID NO: 554370 - RNA, 62 nt, Homo Sapiens; identical to SEQ ID NO: 350318

SEQ ID NO: 554371 - RNA, 62 nt, Homo Sapiens; identical to SEQ ID NO: 350319

SEQ ID NO: 554372 - RNA, 62 nt, Homo Sapiens; identical to SEQ ID NO: 350320

SEQ ID NO: 554373 - RNA, 62 nt, Homo Sapiens; identical to SEQ ID NO: 350321

SEQ ID NO: 554374 - RNA, 62 nt, Homo Sapiens; identical to SEQ ID NO: 350322

SEQ ID NO: 554375 - RNA, 62 nt, Homo Sapiens; identical to SEQ ID NO: 350323

SEQ ID NO: 554376 - RNA, 62 nt, Homo Sapiens; identical to SEQ ID NO: 350324

SEQ ID NO: 554377 - RNA, 62 nt, Homo Sapiens; identical to SEQ ID NO: 350325

SEQ ID NO: 554378 - RNA, 62 nt, Homo Sapiens; identical to SEQ ID NO: 350326

SEQ ID NO: 554379 - RNA, 62 nt, Homo Sapiens; identical to SEQ ID NO: 350327

SEQ ID NO: 554380 - RNA, 62 nt, Homo Sapiens; identical to SEQ ID NO: 350328

SEQ ID NO: 554381 - RNA, 62 nt, Homo Sapiens; identical to SEQ ID NO: 350329

SEQ ID NO: 554382 - RNA, 62 nt, Homo Sapiens; identical to SEQ ID NO: 350330

SEQ ID NO: 554383 - RNA, 62 nt, Homo Sapiens; identical to SEQ ID NO: 350331

SEQ ID NO: 554384 - RNA, 62 nt, Homo Sapiens; identical to SEQ ID NO: 350332

SEQ ID NO: 554385 - RNA, 62 nt, Homo Sapiens; identical to SEQ ID NO: 350333

SEQ ID NO: 554386 - RNA, 62 nt, Homo Sapiens; identical to SEQ ID NO: 350334

SEQ ID NO: 554387 - RNA, 62 nt, Homo Sapiens; identical to SEQ ID NO: 350335

SEQ ID NO: 554388 - RNA, 62 nt, Homo Sapiens; identical to SEQ ID NO: 350336

SEQ ID NO: 554389 - RNA, 62 nt, Homo Sapiens; identical to SEQ ID NO: 350337

SEQ ID NO: 554390 - RNA, 62 nt, Homo Sapiens; identical to SEQ ID NO: 350338

SEQ ID NO: 554391 - RNA, 62 nt, Homo Sapiens; identical to SEQ ID NO: 350339

SEQ ID NO: 554392 - RNA, 62 nt, Homo Sapiens; identical to SEQ ID NO: 350340

SEQ ID NO: 554393 - RNA, 62 nt, Homo Sapiens; identical to SEQ ID NO: 350341

SEQ ID NO: 554394 - RNA, 62 nt, Homo Sapiens; identical to SEQ ID NO: 350342

SEQ ID NO: 554395 - RNA, 62 nt, Homo Sapiens; identical to SEQ ID NO: 350343

SEQ ID NO: 554396 - RNA, 62 nt, Homo Sapiens; identical to SEQ ID NO: 350344

SEQ ID NO: 554397 - RNA, 62 nt, Homo Sapiens; identical to SEQ ID NO: 350345

SEQ ID NO: 554398 - RNA, 62 nt, Homo Sapiens; identical to SEQ ID NO: 350346

SEQ ID NO: 554399 - RNA, 62 nt, Homo Sapiens; identical to SEQ ID NO: 350347

SEQ ID NO: 554400 - RNA, 62 nt, Homo Sapiens; identical to SEQ ID NO: 350348

SEQ ID NO: 554401 - RNA, 62 nt, Homo Sapiens; identical to SEQ ID NO: 350349

SEQ ID NO: 554402 - RNA, 62 nt, Homo Sapiens; identical to SEQ ID NO: 350350

SEQ ID NO: 554403 - RNA, 62 nt, Homo Sapiens; identical to SEQ ID NO: 350351

SEQ ID NO: 554404 - RNA, 62 nt, Homo Sapiens; identical to SEQ ID NO: 350352

SEQ ID NO: 554405 - RNA, 62 nt, Homo Sapiens; identical to SEQ ID NO: 350353

SEQ ID NO: 554406 - RNA, 62 nt, Homo Sapiens; identical to SEQ ID NO: 350354

SEQ ID NO: 554407 - RNA, 62 nt, Homo Sapiens; identical to SEQ ID NO: 350355

SEQ ID NO: 554408 - RNA, 62 nt, Homo Sapiens; identical to SEQ ID NO: 350356

SEQ ID NO: 554409 - RNA, 62 nt, Homo Sapiens; identical to SEQ ID NO: 350357

SEQ ID NO: 554410 - RNA, 62 nt, Homo Sapiens; identical to SEQ ID NO: 350358

SEQ ID NO: 554411 - RNA, 62 nt, Homo Sapiens; identical to SEQ ID NO: 350359

SEQ ID NO: 554412 - RNA, 62 nt, Homo Sapiens; identical to SEQ ID NO: 350360

SEQ ID NO: 554413 - RNA, 62 nt, Homo Sapiens; identical to SEQ ID NO: 350361

SEQ ID NO: 554414 - RNA, 62 nt, Homo Sapiens; identical to SEQ ID NO: 350362

SEQ ID NO: 554415 - RNA, 62 nt, Homo Sapiens; identical to SEQ ID NO: 350363

SEQ ID NO: 554416 - RNA, 62 nt, Homo Sapiens; identical to SEQ ID NO: 350364

SEQ ID NO: 554417 - RNA, 62 nt, Homo Sapiens; identical to SEQ ID NO: 350365

SEQ ID NO: 554418 - RNA, 62 nt, Homo Sapiens; identical to SEQ ID NO: 350366

SEQ ID NO: 554419 - RNA, 62 nt, Homo Sapiens; identical to SEQ ID NO: 350367

SEQ ID NO: 554420 - RNA, 62 nt, Homo Sapiens; identical to SEQ ID NO: 350368

SEQ ID NO: 554421 - RNA, 62 nt, Homo Sapiens; identical to SEQ ID NO: 350369

SEQ ID NO: 554422 - RNA, 62 nt, Homo Sapiens; identical to SEQ ID NO: 350370

SEQ ID NO: 554423 - RNA, 62 nt, Homo Sapiens; identical to SEQ ID NO: 350371

SEQ ID NO: 554424 - RNA, 62 nt, Homo Sapiens; identical to SEQ ID NO: 350372

SEQ ID NO: 554425 - RNA, 62 nt, Homo Sapiens; identical to SEQ ID NO: 350373

SEQ ID NO: 554426 - RNA, 62 nt, Homo Sapiens; identical to SEQ ID NO: 350374

SEQ ID NO: 554427 - RNA, 62 nt, Homo Sapiens; identical to SEQ ID NO: 350375

SEQ ID NO: 554428 - RNA, 62 nt, Homo Sapiens; identical to SEQ ID NO: 350376

SEQ ID NO: 554429 - RNA, 62 nt, Homo Sapiens; identical to SEQ ID NO: 350377

SEQ ID NO: 554430 - RNA, 62 nt, Homo Sapiens; identical to SEQ ID NO: 350378

SEQ ID NO: 554431 - RNA, 62 nt, Homo Sapiens; identical to SEQ ID NO: 350379

SEQ ID NO: 554432 - RNA, 62 nt, Homo Sapiens; identical to SEQ ID NO: 350380

SEQ ID NO: 554433 - RNA, 62 nt, Homo Sapiens; identical to SEQ ID NO: 350381

SEQ ID NO: 554434 - RNA, 62 nt, Homo Sapiens; identical to SEQ ID NO: 350382

SEQ ID NO: 554435 - RNA, 62 nt, Homo Sapiens; identical to SEQ ID NO: 350383

SEQ ID NO: 554436 - RNA, 62 nt, Homo Sapiens; identical to SEQ ID NO: 350384

SEQ ID NO: 554437 - RNA, 62 nt, Homo Sapiens; identical to SEQ ID NO: 350385

SEQ ID NO: 554438 - RNA, 62 nt, Homo Sapiens; identical to SEQ ID NO: 350386

SEQ ID NO: 554439 - RNA, 62 nt, Homo Sapiens; identical to SEQ ID NO: 350387

SEQ ID NO: 554440 - RNA, 62 nt, Homo Sapiens; identical to SEQ ID NO: 350388

SEQ ID NO: 554441 - RNA, 62 nt, Homo Sapiens; identical to SEQ ID NO: 350389

SEQ ID NO: 554442 - RNA, 62 nt, Homo Sapiens; identical to SEQ ID NO: 350390

SEQ ID NO: 554443 - RNA, 62 nt, Homo Sapiens; identical to SEQ ID NO: 350391

SEQ ID NO: 554444 - RNA, 62 nt, Homo Sapiens; identical to SEQ ID NO: 350392

SEQ ID NO: 554445 - RNA, 62 nt, Homo Sapiens; identical to SEQ ID NO: 350393

SEQ ID NO: 554446 - RNA, 62 nt, Homo Sapiens; identical to SEQ ID NO: 350394

SEQ ID NO: 554447 - RNA, 62 nt, Homo Sapiens; identical to SEQ ID NO: 350395

SEQ ID NO: 554448 - RNA, 62 nt, Homo Sapiens; identical to SEQ ID NO: 350396

SEQ ID NO: 554449 - RNA, 62 nt, Homo Sapiens; identical to SEQ ID NO: 350397

SEQ ID NO: 554450 - RNA, 62 nt, Homo Sapiens; identical to SEQ ID NO: 350398

SEQ ID NO: 554451 - RNA, 62 nt, Homo Sapiens; identical to SEQ ID NO: 350399

SEQ ID NO: 554452 - RNA, 62 nt, Homo Sapiens; identical to SEQ ID NO: 350400

SEQ ID NO: 554453 - RNA, 62 nt, Homo Sapiens; identical to SEQ ID NO: 350401

SEQ ID NO: 554454 - RNA, 62 nt, Homo Sapiens; identical to SEQ ID NO: 350402

SEQ ID NO: 554455 - RNA, 62 nt, Homo Sapiens; identical to SEQ ID NO: 350403

SEQ ID NO: 554456 - RNA, 62 nt, Homo Sapiens; identical to SEQ ID NO: 350404

SEQ ID NO: 554457 - RNA, 62 nt, Homo Sapiens; identical to SEQ ID NO: 350405

SEQ ID NO: 554458 - RNA, 62 nt, Homo Sapiens; identical to SEQ ID NO: 350406

SEQ ID NO: 554459 - RNA, 62 nt, Homo Sapiens; identical to SEQ ID NO: 350407

SEQ ID NO: 554460 - RNA, 62 nt, Homo Sapiens; identical to SEQ ID NO: 350408

SEQ ID NO: 554461 - RNA, 62 nt, Homo Sapiens; identical to SEQ ID NO: 350409

SEQ ID NO: 554462 - RNA, 62 nt, Homo Sapiens; identical to SEQ ID NO: 350410

SEQ ID NO: 554463 - RNA, 62 nt, Homo Sapiens; identical to SEQ ID NO: 350411

SEQ ID NO: 554464 - RNA, 62 nt, Homo Sapiens; identical to SEQ ID NO: 350412

SEQ ID NO: 554465 - RNA, 62 nt, Homo Sapiens; identical to SEQ ID NO: 350413

SEQ ID NO: 554466 - RNA, 62 nt, Homo Sapiens; identical to SEQ ID NO: 350414

SEQ ID NO: 554467 - RNA, 62 nt, Homo Sapiens; identical to SEQ ID NO: 350415

SEQ ID NO: 554468 - RNA, 62 nt, Homo Sapiens; identical to SEQ ID NO: 350416

SEQ ID NO: 554469 - RNA, 62 nt, Homo Sapiens; identical to SEQ ID NO: 350417

SEQ ID NO: 554470 - RNA, 62 nt, Homo Sapiens; identical to SEQ ID NO: 350418

SEQ ID NO: 554471 - RNA, 62 nt, Homo Sapiens; identical to SEQ ID NO: 350419

SEQ ID NO: 554472 - RNA, 62 nt, Homo Sapiens; identical to SEQ ID NO: 350420

SEQ ID NO: 554473 - RNA, 62 nt, Homo Sapiens; identical to SEQ ID NO: 350421

SEQ ID NO: 554474 - RNA, 62 nt, Homo Sapiens; identical to SEQ ID NO: 350422

SEQ ID NO: 554475 - RNA, 62 nt, Homo Sapiens; identical to SEQ ID NO: 350423

SEQ ID NO: 554476 - RNA, 62 nt, Homo Sapiens; identical to SEQ ID NO: 350424

SEQ ID NO: 554477 - RNA, 62 nt, Homo Sapiens; identical to SEQ ID NO: 350425

SEQ ID NO: 554478 - RNA, 62 nt, Homo Sapiens; identical to SEQ ID NO: 350426

SEQ ID NO: 554479 - RNA, 62 nt, Homo Sapiens; identical to SEQ ID NO: 350427

SEQ ID NO: 554480 - RNA, 62 nt, Homo Sapiens; identical to SEQ ID NO: 350428

SEQ ID NO: 554481 - RNA, 62 nt, Homo Sapiens; identical to SEQ ID NO: 350429

SEQ ID NO: 554482 - RNA, 62 nt, Homo Sapiens; identical to SEQ ID NO: 350430

SEQ ID NO: 554483 - RNA, 62 nt, Homo Sapiens; identical to SEQ ID NO: 350431

SEQ ID NO: 554484 - RNA, 62 nt, Homo Sapiens; identical to SEQ ID NO: 350432

SEQ ID NO: 554485 - RNA, 62 nt, Homo Sapiens; identical to SEQ ID NO: 350433

SEQ ID NO: 554486 - RNA, 62 nt, Homo Sapiens; identical to SEQ ID NO: 350434

SEQ ID NO: 554487 - RNA, 62 nt, Homo Sapiens; identical to SEQ ID NO: 350435

SEQ ID NO: 554488 - RNA, 62 nt, Homo Sapiens; identical to SEQ ID NO: 350436

SEQ ID NO: 554489 - RNA, 62 nt, Homo Sapiens; identical to SEQ ID NO: 350437

SEQ ID NO: 554490 - RNA, 62 nt, Homo Sapiens; identical to SEQ ID NO: 350438

SEQ ID NO: 554491 - RNA, 62 nt, Homo Sapiens; identical to SEQ ID NO: 350439

SEQ ID NO: 554492 - RNA, 62 nt, Homo Sapiens; identical to SEQ ID NO: 350440

SEQ ID NO: 554493 - RNA, 62 nt, Homo Sapiens; identical to SEQ ID NO: 350441

SEQ ID NO: 554494 - RNA, 62 nt, Homo Sapiens; identical to SEQ ID NO: 350442

SEQ ID NO: 554495 - RNA, 62 nt, Homo Sapiens; identical to SEQ ID NO: 350443

SEQ ID NO: 554496 - RNA, 62 nt, Homo Sapiens; identical to SEQ ID NO: 350444

SEQ ID NO: 554497 - RNA, 62 nt, Homo Sapiens; identical to SEQ ID NO: 350445

SEQ ID NO: 554498 - RNA, 62 nt, Homo Sapiens; identical to SEQ ID NO: 350446

SEQ ID NO: 554499 - RNA, 62 nt, Homo Sapiens; identical to SEQ ID NO: 350447

SEQ ID NO: 554500 - RNA, 62 nt, Homo Sapiens; identical to SEQ ID NO: 350448

SEQ ID NO: 554501 - RNA, 62 nt, Homo Sapiens; identical to SEQ ID NO: 350449

SEQ ID NO: 554502 - RNA, 62 nt, Homo Sapiens; identical to SEQ ID NO: 350450

SEQ ID NO: 554503 - RNA, 62 nt, Homo Sapiens; identical to SEQ ID NO: 350451

SEQ ID NO: 554504 - RNA, 62 nt, Homo Sapiens; identical to SEQ ID NO: 350452

SEQ ID NO: 554505 - RNA, 62 nt, Homo Sapiens; identical to SEQ ID NO: 350453

SEQ ID NO: 554506 - RNA, 62 nt, Homo Sapiens; identical to SEQ ID NO: 350454

SEQ ID NO: 554507 - RNA, 62 nt, Homo Sapiens; identical to SEQ ID NO: 350455

SEQ ID NO: 554508 - RNA, 62 nt, Homo Sapiens; identical to SEQ ID NO: 350456

SEQ ID NO: 554509 - RNA, 62 nt, Homo Sapiens; identical to SEQ ID NO: 350457

SEQ ID NO: 554510 - RNA, 62 nt, Homo Sapiens; identical to SEQ ID NO: 350458

SEQ ID NO: 554511 - RNA, 62 nt, Homo Sapiens; identical to SEQ ID NO: 350459

SEQ ID NO: 554512 - RNA, 62 nt, Homo Sapiens; identical to SEQ ID NO: 350460

SEQ ID NO: 554513 - RNA, 62 nt, Homo Sapiens; identical to SEQ ID NO: 350461

SEQ ID NO: 554514 - RNA, 62 nt, Homo Sapiens; identical to SEQ ID NO: 350462

SEQ ID NO: 554515 - RNA, 62 nt, Homo Sapiens; identical to SEQ ID NO: 350463

SEQ ID NO: 554516 - RNA, 62 nt, Homo Sapiens; identical to SEQ ID NO: 350464

SEQ ID NO: 554517 - RNA, 62 nt, Homo Sapiens; identical to SEQ ID NO: 350465

SEQ ID NO: 554518 - RNA, 62 nt, Homo Sapiens; identical to SEQ ID NO: 350466

SEQ ID NO: 554519 - RNA, 62 nt, Homo Sapiens; identical to SEQ ID NO: 350467

SEQ ID NO: 554520 - RNA, 62 nt, Homo Sapiens; identical to SEQ ID NO: 350468

SEQ ID NO: 554521 - RNA, 62 nt, Homo Sapiens; identical to SEQ ID NO: 350469

SEQ ID NO: 554522 - RNA, 62 nt, Homo Sapiens; identical to SEQ ID NO: 350470

SEQ ID NO: 554523 - RNA, 62 nt, Homo Sapiens; identical to SEQ ID NO: 350471

SEQ ID NO: 554524 - RNA, 62 nt, Homo Sapiens; identical to SEQ ID NO: 350472

SEQ ID NO: 554525 - RNA, 62 nt, Homo Sapiens; identical to SEQ ID NO: 350473

SEQ ID NO: 554526 - RNA, 62 nt, Homo Sapiens; identical to SEQ ID NO: 350474

SEQ ID NO: 554527 - RNA, 62 nt, Homo Sapiens; identical to SEQ ID NO: 350475

SEQ ID NO: 554528 - RNA, 62 nt, Homo Sapiens; identical to SEQ ID NO: 350476

SEQ ID NO: 554529 - RNA, 62 nt, Homo Sapiens; identical to SEQ ID NO: 350477

SEQ ID NO: 554530 - RNA, 62 nt, Homo Sapiens; identical to SEQ ID NO: 350478

SEQ ID NO: 554531 - RNA, 62 nt, Homo Sapiens; identical to SEQ ID NO: 350479

SEQ ID NO: 554532 - RNA, 62 nt, Homo Sapiens; identical to SEQ ID NO: 350480

SEQ ID NO: 554533 - RNA, 62 nt, Homo Sapiens; identical to SEQ ID NO: 350481

SEQ ID NO: 554534 - RNA, 62 nt, Homo Sapiens; identical to SEQ ID NO: 350482

SEQ ID NO: 554535 - RNA, 62 nt, Homo Sapiens; identical to SEQ ID NO: 350483

SEQ ID NO: 554536 - RNA, 62 nt, Homo Sapiens; identical to SEQ ID NO: 350484

SEQ ID NO: 554537 - RNA, 62 nt, Homo Sapiens; identical to SEQ ID NO: 350485

SEQ ID NO: 554538 - RNA, 62 nt, Homo Sapiens; identical to SEQ ID NO: 350486

SEQ ID NO: 554539 - RNA, 62 nt, Homo Sapiens; identical to SEQ ID NO: 350487

SEQ ID NO: 554540 - RNA, 62 nt, Homo Sapiens; identical to SEQ ID NO: 350488

SEQ ID NO: 554541 - RNA, 62 nt, Homo Sapiens; identical to SEQ ID NO: 350489

SEQ ID NO: 554542 - RNA, 62 nt, Homo Sapiens; identical to SEQ ID NO: 350490

SEQ ID NO: 554543 - RNA, 62 nt, Homo Sapiens; identical to SEQ ID NO: 350491

SEQ ID NO: 554544 - RNA, 62 nt, Homo Sapiens; identical to SEQ ID NO: 350492

SEQ ID NO: 554545 - RNA, 62 nt, Homo Sapiens; identical to SEQ ID NO: 350493

SEQ ID NO: 554546 - RNA, 62 nt, Homo Sapiens; identical to SEQ ID NO: 350494

SEQ ID NO: 554547 - RNA, 62 nt, Homo Sapiens; identical to SEQ ID NO: 350495

SEQ ID NO: 554548 - RNA, 62 nt, Homo Sapiens; identical to SEQ ID NO: 350496

SEQ ID NO: 554549 - RNA, 62 nt, Homo Sapiens; identical to SEQ ID NO: 350497

SEQ ID NO: 554550 - RNA, 62 nt, Homo Sapiens; identical to SEQ ID NO: 350498

SEQ ID NO: 554551 - RNA, 62 nt, Homo Sapiens; identical to SEQ ID NO: 350499

SEQ ID NO: 554552 - RNA, 62 nt, Homo Sapiens; identical to SEQ ID NO: 350500

SEQ ID NO: 554553 - RNA, 62 nt, Homo Sapiens; identical to SEQ ID NO: 350501

SEQ ID NO: 554554 - RNA, 62 nt, Homo Sapiens; identical to SEQ ID NO: 350502

SEQ ID NO: 554555 - RNA, 62 nt, Homo Sapiens; identical to SEQ ID NO: 350503

SEQ ID NO: 554556 - RNA, 62 nt, Homo Sapiens; identical to SEQ ID NO: 350504

SEQ ID NO: 554557 - RNA, 62 nt, Homo Sapiens; identical to SEQ ID NO: 350505

SEQ ID NO: 554558 - RNA, 62 nt, Homo Sapiens; identical to SEQ ID NO: 350506

SEQ ID NO: 554559 - RNA, 62 nt, Homo Sapiens; identical to SEQ ID NO: 350507

SEQ ID NO: 554560 - RNA, 62 nt, Homo Sapiens; identical to SEQ ID NO: 350508

SEQ ID NO: 554561 - RNA, 62 nt, Homo Sapiens; identical to SEQ ID NO: 350509

SEQ ID NO: 554562 - RNA, 62 nt, Homo Sapiens; identical to SEQ ID NO: 350510

SEQ ID NO: 554563 - RNA, 62 nt, Homo Sapiens; identical to SEQ ID NO: 350511

SEQ ID NO: 554564 - RNA, 62 nt, Homo Sapiens; identical to SEQ ID NO: 350512

SEQ ID NO: 554565 - RNA, 64 nt, Homo Sapiens; identical to SEQ ID NO: 257286

SEQ ID NO: 554566 - RNA, 64 nt, Homo Sapiens; identical to SEQ ID NO: 257287

SEQ ID NO: 554567 - RNA, 64 nt, Homo Sapiens; identical to SEQ ID NO: 257288

SEQ ID NO: 554568 - RNA, 64 nt, Homo Sapiens; identical to SEQ ID NO: 257289

SEQ ID NO: 554569 - RNA, 64 nt, Homo Sapiens; identical to SEQ ID NO: 257290

SEQ ID NO: 554570 - RNA, 64 nt, Homo Sapiens; identical to SEQ ID NO: 257291

SEQ ID NO: 554571 - RNA, 64 nt, Homo Sapiens; identical to SEQ ID NO: 257292

SEQ ID NO: 554572 - RNA, 64 nt, Homo Sapiens; identical to SEQ ID NO: 257293

SEQ ID NO: 554573 - RNA, 64 nt, Homo Sapiens; identical to SEQ ID NO: 257294

SEQ ID NO: 554574 - RNA, 64 nt, Homo Sapiens; identical to SEQ ID NO: 257295

SEQ ID NO: 554575 - RNA, 64 nt, Homo Sapiens; identical to SEQ ID NO: 257296

SEQ ID NO: 554576 - RNA, 64 nt, Homo Sapiens; identical to SEQ ID NO: 257297

SEQ ID NO: 554577 - RNA, 64 nt, Homo Sapiens; identical to SEQ ID NO: 257298

SEQ ID NO: 554578 - RNA, 64 nt, Homo Sapiens; identical to SEQ ID NO: 257299

SEQ ID NO: 554579 - RNA, 64 nt, Homo Sapiens; identical to SEQ ID NO: 257300

SEQ ID NO: 554580 - RNA, 64 nt, Homo Sapiens; identical to SEQ ID NO: 257301

SEQ ID NO: 554581 - RNA, 64 nt, Homo Sapiens; identical to SEQ ID NO: 257302

SEQ ID NO: 554582 - RNA, 64 nt, Homo Sapiens; identical to SEQ ID NO: 257303

SEQ ID NO: 554583 - RNA, 64 nt, Homo Sapiens; identical to SEQ ID NO: 257304

SEQ ID NO: 554584 - RNA, 64 nt, Homo Sapiens; identical to SEQ ID NO: 257305

SEQ ID NO: 554585 - RNA, 64 nt, Homo Sapiens; identical to SEQ ID NO: 257306

SEQ ID NO: 554586 - RNA, 64 nt, Homo Sapiens; identical to SEQ ID NO: 257307

SEQ ID NO: 554587 - RNA, 64 nt, Homo Sapiens; identical to SEQ ID NO: 257308

SEQ ID NO: 554588 - RNA, 64 nt, Homo Sapiens; identical to SEQ ID NO: 257309

SEQ ID NO: 554589 - RNA, 54 nt, Homo Sapiens; identical to SEQ ID NO: 257310

SEQ ID NO: 554590 - RNA, 64 nt, Homo Sapiens; identical to SEQ ID NO: 257311

SEQ ID NO: 554591 - RNA, 64 nt, Homo Sapiens; identical to SEQ ID NO: 257312

SEQ ID NO: 554592 - RNA, 64 nt, Homo Sapiens; identical to SEQ ID NO: 257313

SEQ ID NO: 554593 - RNA, 64 nt, Homo Sapiens; identical to SEQ ID NO: 257314

SEQ ID NO: 554594 - RNA, 64 nt, Homo Sapiens; identical to SEQ ID NO: 257315

SEQ ID NO: 554595 - RNA, 64 nt, Homo Sapiens; identical to SEQ ID NO: 257316

SEQ ID NO: 554596 - RNA, 64 nt, Homo Sapiens; identical to SEQ ID NO: 257317

SEQ ID NO: 554597 - RNA, 64 nt, Homo Sapiens; identical to SEQ ID NO: 257318

SEQ ID NO: 554598 - RNA, 64 nt, Homo Sapiens; identical to SEQ ID NO: 257319

SEQ ID NO: 554599 - RNA, 64 nt, Homo Sapiens; identical to SEQ ID NO: 75992

SEQ ID NO: 554600 - RNA, 64 nt, Homo Sapiens; identical to SEQ ID NO: 75993

SEQ ID NO: 554601 - RNA, 64 nt, Homo Sapiens; identical to SEQ ID NO: 75994

SEQ ID NO: 554602 - RNA, 64 nt, Homo Sapiens; identical to SEQ ID NO: 75995

SEQ ID NO: 554603 - RNA, 64 nt, Homo Sapiens; identical to SEQ ID NO: 75996

SEQ ID NO: 554604 - RNA, 64 nt, Homo Sapiens; identical to SEQ ID NO: 75997

SEQ ID NO: 554605 - RNA, 64 nt, Homo Sapiens; identical to SEQ ID NO: 75998

SEQ ID NO: 554606 - RNA, 64 nt, Homo Sapiens; identical to SEQ ID NO: 75999

SEQ ID NO: 554607 - RNA, 64 nt, Homo Sapiens; identical to SEQ ID NO: 76000

SEQ ID NO: 554608 - RNA, 64 nt, Homo Sapiens; identical to SEQ ID NO: 76001

SEQ ID NO: 554609 - RNA, 64 nt, Homo Sapiens; identical to SEQ ID NO: 76002

SEQ ID NO: 554610 - RNA, 64 nt, Homo Sapiens; identical to SEQ ID NO: 76003

SEQ ID NO: 554611 - RNA, 64 nt, Homo Sapiens; identical to SEQ ID NO: 76004

SEQ ID NO: 554612 - RNA, 64 nt, Homo Sapiens; identical to SEQ ID NO: 76005

SEQ ID NO: 554613 - RNA, 64 nt, Homo Sapiens; identical to SEQ ID NO: 76006

SEQ ID NO: 554614 - RNA, 64 nt, Homo Sapiens; identical to SEQ ID NO: 76007

SEQ ID NO: 554615 - RNA, 64 nt, Homo Sapiens; identical to SEQ ID NO: 76008

SEQ ID NO: 554616 - RNA, 64 nt, Homo Sapiens; identical to SEQ ID NO: 76009

SEQ ID NO: 554617 - RNA, 64 nt, Homo Sapiens; identical to SEQ ID NO: 76010

SEQ ID NO: 554618 - RNA, 64 nt, Homo Sapiens; identical to SEQ ID NO: 76011

SEQ ID NO: 554619 - RNA, 64 nt, Homo Sapiens; identical to SEQ ID NO: 76012

SEQ ID NO: 554620 - RNA, 64 nt, Homo Sapiens; identical to SEQ ID NO: 76013

SEQ ID NO: 554621 - RNA, 64 nt, Homo Sapiens; identical to SEQ ID NO: 76014

SEQ ID NO: 554622 - RNA, 64 nt, Homo Sapiens; identical to SEQ ID NO: 165778

SEQ ID NO: 554623 - RNA, 64 nt, Homo Sapiens; identical to SEQ ID NO: 165779

SEQ ID NO: 554624 - RNA, 64 nt, Homo Sapiens; identical to SEQ ID NO: 165780

SEQ ID NO: 554625 - RNA, 64 nt, Homo Sapiens; identical to SEQ ID NO: 165781

SEQ ID NO: 554626 - RNA, 64 nt, Homo Sapiens; identical to SEQ ID NO: 165782

SEQ ID NO: 554627 - RNA, 64 nt, Homo Sapiens; identical to SEQ ID NO: 165783

SEQ ID NO: 554628 - RNA, 64 nt, Homo Sapiens; identical to SEQ ID NO: 165784

SEQ ID NO: 554629 - RNA, 64 nt, Homo Sapiens; identical to SEQ ID NO: 165785

SEQ ID NO: 554630 - RNA, 64 nt, Homo Sapiens; identical to SEQ ID NO: 165786

SEQ ID NO: 554631 - RNA, 64 nt, Homo Sapiens; identical to SEQ ID NO: 165787

SEQ ID NO: 554632 - RNA, 64 nt, Homo Sapiens; identical to SEQ ID NO: 165788

SEQ ID NO: 554633 - RNA, 64 nt, Homo Sapiens; identical to SEQ ID NO: 165789

SEQ ID NO: 554634 - RNA, 64 nt, Homo Sapiens; identical to SEQ ID NO: 165790

SEQ ID NO: 554635 - RNA, 64 nt, Homo Sapiens; identical to SEQ ID NO: 165791

SEQ ID NO: 554636 - RNA, 64 nt, Homo Sapiens; identical to SEQ ID NO: 165792

SEQ ID NO: 554637 - RNA, 64 nt, Homo Sapiens; identical to SEQ ID NO: 165793

SEQ ID NO: 554638 - RNA, 64 nt, Homo Sapiens; identical to SEQ ID NO: 165794

SEQ ID NO: 554639 - RNA, 64 nt, Homo Sapiens; identical to SEQ ID NO: 165795

SEQ ID NO: 554640 - RNA, 64 nt, Homo Sapiens; identical to SEQ ID NO: 165796

SEQ ID NO: 554641 - RNA, 64 nt, Homo Sapiens; identical to SEQ ID NO: 165797

SEQ ID NO: 554642 - RNA, 64 nt, Homo Sapiens; identical to SEQ ID NO: 165798

SEQ ID NO: 554643 - RNA, 64 nt, Homo Sapiens; identical to SEQ ID NO: 165799

SEQ ID NO: 554644 - RNA, 64 nt, Homo Sapiens; identical to SEQ ID NO: 74062

SEQ ID NO: 554645 - RNA, 64 nt, Homo Sapiens; identical to SEQ ID NO: 74063

SEQ ID NO: 554646 - RNA, 64 nt, Homo Sapiens; identical to SEQ ID NO: 74064

SEQ ID NO: 554647 - RNA, 64 nt, Homo Sapiens; identical to SEQ ID NO: 74065

SEQ ID NO: 554648 - RNA, 64 nt, Homo Sapiens; identical to SEQ ID NO: 74066

SEQ ID NO: 554649 - RNA, 64 nt, Homo Sapiens; identical to SEQ ID NO: 74067

SEQ ID NO: 554650 - RNA, 64 nt, Homo Sapiens; identical to SEQ ID NO: 74068

SEQ ID NO: 554651 - RNA, 64 nt, Homo Sapiens; identical to SEQ ID NO: 74069

SEQ ID NO: 554652 - RNA, 64 nt, Homo Sapiens; identical to SEQ ID NO: 74070

SEQ ID NO: 554653 - RNA, 64 nt, Homo Sapiens; identical to SEQ ID NO: 74071

SEQ ID NO: 554654 - RNA, 64 nt, Homo Sapiens; identical to SEQ ID NO: 74072

SEQ ID NO: 554655 - RNA, 64 nt, Homo Sapiens; identical to SEQ ID NO: 74073

SEQ ID NO: 554656 - RNA, 64 nt, Homo Sapiens; identical to SEQ ID NO: 74074

SEQ ID NO: 554657 - RNA, 64 nt, Homo Sapiens; identical to SEQ ID NO: 74075

SEQ ID NO: 554658 - RNA, 64 nt, Homo Sapiens; identical to SEQ ID NO: 74076

SEQ ID NO: 554659 - RNA, 64 nt, Homo Sapiens; identical to SEQ ID NO: 74077

SEQ ID NO: 554660 - RNA, 64 nt, Homo Sapiens; identical to SEQ ID NO: 74078

SEQ ID NO: 554661 - RNA, 64 nt, Homo Sapiens; identical to SEQ ID NO: 74079

SEQ ID NO: 554662 - RNA, 64 nt, Homo Sapiens; identical to SEQ ID NO: 74080

SEQ ID NO: 554663 - RNA, 64 nt, Homo Sapiens; identical to SEQ ID NO: 74081

SEQ ID NO: 554664 - RNA, 64 nt, Homo Sapiens; identical to SEQ ID NO: 74082

SEQ ID NO: 554665 - RNA, 64 nt, Homo Sapiens; identical to SEQ ID NO: 74083

SEQ ID NO: 554666 - RNA, 64 nt, Homo Sapiens; identical to SEQ ID NO: 74084

SEQ ID NO: 554667 - RNA, 64 nt, Homo Sapiens; identical to SEQ ID NO: 74085

SEQ ID NO: 554668 - RNA, 64 nt, Homo Sapiens; identical to SEQ ID NO: 178768

SEQ ID NO: 554669 - RNA, 64 nt, Homo Sapiens; identical to SEQ ID NO: 178769

SEQ ID NO: 554670 - RNA, 64 nt, Homo Sapiens; identical to SEQ ID NO: 178770

SEQ ID NO: 554671 - RNA, 64 nt, Homo Sapiens; identical to SEQ ID NO: 178771

SEQ ID NO: 554672 - RNA, 64 nt, Homo Sapiens
guguguucccaaauccagcuggccccaccagcucagauuccauuuuuuuuguguguguguguga

SEQ ID NO: 554673 - RNA, 64 nt, Homo Sapiens
gggauuacaggcgugugccacugcgcucggccucagauuccauauuugaacaccagcugauuga

SEQ ID NO: 554674 - RNA, 64 nt, Homo Sapiens
uugcugcugaucauuuuuucuuuaaaacuuggauagauuccaaaaguuacaguaccuuuguggc

SEQ ID NO: 554675 - RNA, 64 nt, Homo Sapiens
ucauccuuuaacaauuuuuaaaaauuuagcuucuagauuccauuugguaaggaaaucaauauug

SEQ ID NO: 554676 - RNA, 64 nt, Homo Sapiens
agcugagggagaaagguagggcugugccuucuaaagauuccaacagagaugugagaagauaaua

SEQ ID NO: 554677 - RNA, 64 nt, Homo Sapiens
cugagccacauaauaaggugucaaaaugugcuugagauuccaaaaacuugcugaaacacuugau

SEQ ID NO: 554678 - RNA, 64 nt, Homo Sapiens
ucccuggacuaccuucaggaggggaaagguggguagauuccagucacaaacaucuccacuuuug

SEQ ID NO: 554679 - RNA, 64 nt, Homo Sapiens
cggagguccaaccuucgcagacaggggcuuuaggagauuccagcccgcugcagugagcucagcc

SEQ ID NO: 554680 - RNA, 64 nt, Homo Sapiens
gcacaucaccuuuaguagucaaaccaaaaaucuaagauuccaaaaagaacagcauucauugaaa

SEQ ID NO: 554681 - RNA, 64 nt, Homo Sapiens
ucaagugccguuguuaugugaaacucuuccauucagauuccagagagguucucaugcucccccc

SEQ ID NO: 554682 - RNA, 64 nt, Homo Sapiens
ugcacgaugaggaacacauuuuaaucuaggaaguagauuccagccucugcaggaaggcuccggc

SEQ ID NO: 554683 - RNA, 64 nt, Homo Sapiens
ggauucaaguucuaauuauauacaugcaacucccagauuccaaaccaaaccaguucuuaaaugc

SEQ ID NO: 554684 - RNA, 64 nt, Homo Sapiens
ugcacggcaacagagccuuaagucuuagaggaagagauuccacucucccuggcaugugaaaguc

SEQ ID NO: 554685 - RNA, 64 nt, Homo Sapiens
guacuagucauggaucuuucaauguagcaaaaccagauuccaguuucuuugggauugugaauag

SEQ ID NO: 554686 - RNA, 64 nt, Homo Sapiens
uuaaugaggaacacugaacuguugguguguagguagauuccauacacagaacaccagaaagagu

SEQ ID NO: 554687 - RNA, 64 nt, Homo Sapiens
uuagaauggggauucacaggguuucuucuggaacagauuccauuugcagugucuccaggccuga

SEQ ID NO: 554688 - RNA, 64 nt, Homo Sapiens
guccugagcccugacacucccacaccugagccucagauuccaauagcucacucccuagagccug

SEQ ID NO: 554689 - RNA, 64 nt, Homo Sapiens
agccugacgccggggccccugaccccugagccucagauuccaauaccucacuccccagagccug

SEQ ID NO: 554690 - RNA, 64 nt, Homo Sapiens
ucuaagucaagucagcacgggaagggcaucugacagauuccaggccugggguuagcagccugug

SEQ ID NO: 554691 - RNA, 64 nt, Homo Sapiens
ggcccacgugaccagcaaggucagaggcccagccagauuccauccuggggaagcaaaugaauuc

SEQ ID NO: 554692 - RNA, 64 nt, Homo Sapiens
cucaccacugcauuccagccugggugacagaguuagauuccacccucucccaccccggcaaaaa

SEQ ID NO: 554693 - RNA, 64 nt, Homo Sapiens
acaucagccaaaagaacaaaagagaugucaggacagauuccaggagugucggagcacaugugug

SEQ ID NO: 554694 - RNA, 64 nt, Homo Sapiens
ucauuucacagugagaugcuuuauggauugaaggauaugguaaaauguuuauaguuuacuuuga

SEQ ID NO: 554695 - RNA, 64 nt, Homo Sapiens
aaacacacguuuaucuuuuggcccaaugccauacauaugguaggcauuuaauuacugauugugu

SEQ ID NO: 554696 - RNA, 64 nt, Homo Sapiens
guccaguuuuaaaaauauugaauguucuaccuguauaugguaauuuugucacgucauuuuuaga

SEQ ID NO: 554697 - RNA, 64 nt, Homo Sapiens
caguuuuguauuuagaaaugcacagaaguaacaaauaugguaguaaaaugaacuucucccgcua

SEQ ID NO: 554698 - RNA, 64 nt, Homo Sapiens
auaacugcaugaacuuggauuuuuuuaaucacucauaugguagaauuuuauaaacacauacaug

SEQ ID NO: 554699 - RNA, 64 nt, Homo Sapiens
acauguaacuugugacuguacaauaaacauaagcauaugguaccacuuuuguguaugggguuua

SEQ ID NO: 554700 - RNA, 64 nt, Homo Sapiens
auuaaccuuguuguuuaccuuucacugauuucuuauaugguauaaauuaaaguucaggcauuua

SEQ ID NO: 554701 - RNA, 64 nt, Homo Sapiens
cucaaguuugcugucuuuagaaugguuugugaaaauaugguauaaagguguuuucauuuuccug

SEQ ID NO: 554702 - RNA, 64 nt, Homo Sapiens
uuacauugauggcacgauauuuuuuagucuguuaauaugguacagaugauaauaugguuuuacu

SEQ ID NO: 554703 - RNA, 64 nt, Homo Sapiens
aaaauuuuuuaaauuuccaacuguaccaggcuauauaugguauugggacuauaggugugagcca

SEQ ID NO: 554704 - RNA, 64 nt, Homo Sapiens
cucagagaucacuccuuagguuuuuuauuuaucuauaugguaaacucucuucuuugggucucaa

SEQ ID NO: 554705 - RNA, 64 nt, Homo Sapiens
ucaccucucuucuuugggucucugucauuaacugauaugguaaaaagauauccggagccuccag

SEQ ID NO: 554706 - RNA, 64 nt, Homo Sapiens; identical to SEQ ID NO: 226834

SEQ ID NO: 554707 - RNA, 64 nt, Homo Sapiens; identical to SEQ ID NO: 226835

SEQ ID NO: 554708 - RNA, 64 nt, Homo Sapiens; identical to SEQ ID NO: 226836

SEQ ID NO: 554709 - RNA, 64 nt, Homo Sapiens; identical to SEQ ID NO: 226837

SEQ ID NO: 554710 - RNA, 64 nt, Homo Sapiens; identical to SEQ ID NO: 226838

SEQ ID NO: 554711 - RNA, 64 nt, Homo Sapiens; identical to SEQ ID NO: 226839

SEQ ID NO: 554712 - RNA, 64 nt, Homo Sapiens; identical to SEQ ID NO: 226840

SEQ ID NO: 554713 - RNA, 64 nt, Homo Sapiens; identical to SEQ ID NO: 226841

SEQ ID NO: 554714 - RNA, 64 nt, Homo Sapiens; identical to SEQ ID NO: 226842

SEQ ID NO: 554715 - RNA, 64 nt, Homo Sapiens; identical to SEQ ID NO: 226843

SEQ ID NO: 554716 - RNA, 64 nt, Homo Sapiens; identical to SEQ ID NO: 226844

SEQ ID NO: 554717 - RNA, 64 nt, Homo Sapiens; identical to SEQ ID NO: 226845

SEQ ID NO: 554718 - RNA, 64 nt, Homo Sapiens; identical to SEQ ID NO: 226846

SEQ ID NO: 554719 - RNA, 64 nt, Homo Sapiens; identical to SEQ ID NO: 226847

SEQ ID NO: 554720 - RNA, 64 nt, Homo Sapiens; identical to SEQ ID NO: 226848

SEQ ID NO: 554721 - RNA, 64 nt, Homo Sapiens; identical to SEQ ID NO: 226849

SEQ ID NO: 554722 - RNA, 64 nt, Homo Sapiens; identical to SEQ ID NO: 226850

SEQ ID NO: 554723 - RNA, 64 nt, Homo Sapiens; identical to SEQ ID NO: 226851

SEQ ID NO: 554724 - RNA, 64 nt, Homo Sapiens; identical to SEQ ID NO: 226852

SEQ ID NO: 554725 - RNA, 64 nt, Homo Sapiens; identical to SEQ ID NO: 226853

SEQ ID NO: 554726 - RNA, 64 nt, Homo Sapiens; identical to SEQ ID NO: 226854

SEQ ID NO: 554727 - RNA, 64 nt, Homo Sapiens; identical to SEQ ID NO: 226855

SEQ ID NO: 554728 - RNA, 64 nt, Homo Sapiens; identical to SEQ ID NO: 226856

SEQ ID NO: 554729 - RNA, 64 nt, Homo Sapiens; identical to SEQ ID NO: 226857

SEQ ID NO: 554730 - RNA, 64 nt, Homo Sapiens; identical to SEQ ID NO: 226858

SEQ ID NO: 554731 - RNA, 64 nt, Homo Sapiens; identical to SEQ ID NO: 226859

SEQ ID NO: 554732 - RNA, 64 nt, Homo Sapiens; identical to SEQ ID NO: 226860

SEQ ID NO: 554733 - RNA, 64 nt, Homo Sapiens; identical to SEQ ID NO: 226861

SEQ ID NO: 554734 - RNA, 64 nt, Homo Sapiens; identical to SEQ ID NO: 226862

SEQ ID NO: 554735 - RNA, 64 nt, Homo Sapiens; identical to SEQ ID NO: 226863

SEQ ID NO: 554736 - RNA, 64 nt, Homo Sapiens; identical to SEQ ID NO: 226864

SEQ ID NO: 554737 - RNA, 64 nt, Homo Sapiens; identical to SEQ ID NO: 226865

SEQ ID NO: 554738 - RNA, 64 nt, Homo Sapiens; identical to SEQ ID NO: 226866

SEQ ID NO: 554739 - RNA, 64 nt, Homo Sapiens; identical to SEQ ID NO: 226867

SEQ ID NO: 554740 - RNA, 64 nt, Homo Sapiens; identical to SEQ ID NO: 226868

SEQ ID NO: 554741 - RNA, 64 nt, Homo Sapiens; identical to SEQ ID NO: 226869

SEQ ID NO: 554742 - RNA, 64 nt, Homo Sapiens; identical to SEQ ID NO: 226870

SEQ ID NO: 554743 - RNA, 64 nt, Homo Sapiens; identical to SEQ ID NO: 226871

SEQ ID NO: 554744 - RNA, 64 nt, Homo Sapiens; identical to SEQ ID NO: 226872

SEQ ID NO: 554745 - RNA, 64 nt, Homo Sapiens; identical to SEQ ID NO: 226873

SEQ ID NO: 554746 - RNA, 64 nt, Homo Sapiens; identical to SEQ ID NO: 226874

SEQ ID NO: 554747 - RNA, 64 nt, Homo Sapiens; identical to SEQ ID NO: 226875

SEQ ID NO: 554748 - RNA, 64 nt, Homo Sapiens; identical to SEQ ID NO: 226876

SEQ ID NO: 554749 - RNA, 64 nt, Homo Sapiens; identical to SEQ ID NO: 226877

SEQ ID NO: 554750 - RNA, 64 nt, Homo Sapiens; identical to SEQ ID NO: 226878

SEQ ID NO: 554751 - RNA, 64 nt, Homo Sapiens; identical to SEQ ID NO: 226879

SEQ ID NO: 554752 - RNA, 64 nt, Homo Sapiens; identical to SEQ ID NO: 226880

SEQ ID NO: 554753 - RNA, 64 nt, Homo Sapiens; identical to SEQ ID NO: 226881

SEQ ID NO: 554754 - RNA, 64 nt, Homo Sapiens; identical to SEQ ID NO: 226882

SEQ ID NO: 554755 - RNA, 64 nt, Homo Sapiens; identical to SEQ ID NO: 226883

SEQ ID NO: 554756 - RNA, 64 nt, Homo Sapiens; identical to SEQ ID NO: 226884

SEQ ID NO: 554757 - RNA, 64 nt, Homo Sapiens; identical to SEQ ID NO: 226885

SEQ ID NO: 554758 - RNA, 64 nt, Homo Sapiens; identical to SEQ ID NO: 226886

SEQ ID NO: 554759 - RNA, 64 nt, Homo Sapiens; identical to SEQ ID NO: 226887

SEQ ID NO: 554760 - RNA, 64 nt, Homo Sapiens; identical to SEQ ID NO: 226888

SEQ ID NO: 554761 - RNA, 64 nt, Homo Sapiens; identical to SEQ ID NO: 226889

SEQ ID NO: 554762 - RNA, 64 nt, Homo Sapiens; identical to SEQ ID NO: 226890

SEQ ID NO: 554763 - RNA, 63 nt, Homo Sapiens
ccuucacauaauugauaaugguaccaccuucuauaauaauaauauaaaauaaaaacaucugau

SEQ ID NO: 554764 - RNA, 63 nt, Homo Sapiens
ucacauaauugauaaugguaccaccuucuauaauaauaauauaaaauaaaaacaucugauguc

SEQ ID NO: 554765 - RNA, 63 nt, Homo Sapiens
cugggugacagagcgagacucuggcucauaaaauaauaauaauaauaaauaaauaaaaaauaa

SEQ ID NO: 554766 - RNA, 63 nt, Homo Sapiens
ggugacagagcgagacucuggcucauaaaauaauaauaauaauaaauaaauaaaaaauaaaug

SEQ ID NO: 554767 - RNA, 63 nt, Homo Sapiens
gacagagcgagacucuggcucauaaaauaauaauaauaauaaauaaauaaaaaauaaauguuu

SEQ ID NO: 554768 - RNA, 63 nt, Homo Sapiens
gaguucaagaccagccuggcuaacaugugaaacuaauaauaauacaaaaauuagcugggcgug

SEQ ID NO: 554769 - RNA, 63 nt, Homo Sapiens
uucaagaccagccuggcuaacaugugaaacuaauaauaauacaaaaauuagcugggcguggug

SEQ ID NO: 554770 - RNA, 63 nt, Homo Sapiens
auuuuguucucugcuaguuuaaaguaauucguuuaauaauagauguguuuuuagaggaaaugc

SEQ ID NO: 554771 - RNA, 63 nt, Homo Sapiens
aauuuuccaguuauacagucuucuauaacuuacuaauaauauucuauauguacuuuauguaau

SEQ ID NO: 554772 - RNA, 63 nt, Homo Sapiens
cuaauccaguccaauacuaauccaauccaauacuaauaauacuauugguacaauccaauacua

SEQ ID NO: 554773 - RNA, 63 nt, Homo Sapiens
aauacuaauaauacuauugguacaauccaauacuaauaauacuauugguacaauccaauacua

SEQ ID NO: 554774 - RNA, 63 nt, Homo Sapiens
aauacuaauaauacuauugguacaauccaauacuaauaauacuaacaguaguauugauacaau

SEQ ID NO: 554775 - RNA, 63 nt, Homo Sapiens
gugauuuugugagaucagcugaaccacuuaugauaauaauaauaaaaaagacugcuuugcccu

SEQ ID NO: 554776 - RNA, 63 nt, Homo Sapiens
auuuugugagaucagcugaaccacuuaugauaauaauaauaaaaaagacugcuuugcccucac

SEQ ID NO: 554777 - RNA, 63 nt, Homo Sapiens
gggugacagagcaagacuccaucucaaaaaaaauaauaauaauaaauaaauaaaaaaucccaa

SEQ ID NO: 554778 - RNA, 63 nt, Homo Sapiens
ugacagagcaagacuccaucucaaaaaaaauaauaauaauaaauaaauaaaaaaucccaauua

SEQ ID NO: 554779 - RNA, 63 nt, Homo Sapiens
aggaguuccucuaacauuugcaaaauggaaauguaauaauaaugaaugucaugcaccgcugca

SEQ ID NO: 554780 - RNA, 63 nt, Homo Sapiens
ccagauaguuauauuaaauuuauaucuuauauauaauaauaugugaugauuaauacaauauua

SEQ ID NO: 554781 - RNA, 63 nt, Homo Sapiens
cuggacaguuuacaaucguuccaucaaaaauaauaauaauaaaagagcccacauugucuguag

SEQ ID NO: 554782 - RNA, 63 nt, Homo Sapiens
aaacuggacaguuuacaaucuagccaucaaaaauaauaauaaugugagagcccacauugucug

SEQ ID NO: 554783 - RNA, 63 nt, Homo Sapiens
uguaggcucagcucuuucccguuuugauaguaauaauaauaaauucaugaaaaguauguuguu

SEQ ID NO: 554784 - RNA, 63 nt, Homo Sapiens
aaauguaggcucagcucuuuguuguuuugauaguaauaauaauuucuucaugaaaaguauguu

SEQ ID NO: 554785 - RNA, 63 nt, Homo Sapiens
aaccuauauaguauguucucauucauaaagcaauaauaauaaagauucaaagugguaacccaa

SEQ ID NO: 554786 - RNA, 63 nt, Homo Sapiens
guaggccuuuuguuuauuaaacuuucucuuaguuaauaauacaguuaacaugauucacauuau

SEQ ID NO: 554787 - RNA, 63 nt, Homo Sapiens
cuuucugaugaggcugccauuaaacuuagagaauaauaauaguccuaaacugaucacaacuau

SEQ ID NO: 554788 - RNA, 63 nt, Homo Sapiens
gacgauaauacuucuuuuccuaguucucagcaauaauaauaauaaaaccaaaugauaucuaag

SEQ ID NO: 554789 - RNA, 63 nt, Homo Sapiens
uauauuaaacuccuuauguuuaauuuaauuauuuaauaauauuuuuauaugaaccaugucuau

SEQ ID NO: 554790 - RNA, 63 nt, Homo Sapiens
auuguauuuaguuacuauugguaaagugaaauauaauaauauauuuuuggaauacaucucuua

SEQ ID NO: 554791 - RNA, 63 nt, Homo Sapiens
guccguccuaaugcuuuaaauuuaggguucuuuuaauaauaauugauuuuugaagguauuuac

SEQ ID NO: 554792 - RNA, 63 nt, Homo Sapiens
accaugucuauagcuguagaaaaauaauaauaauaauaauaaauugcauuauagccaguagua

SEQ ID NO: 554793 - RNA, 63 nt, Homo Sapiens
aaaaccaugucuauagcuguguaaaaauaauaauaauaauaaugaguugcauuauagccagua

SEQ ID NO: 554794 - RNA, 63 nt, Homo Sapiens
aauaaaaccaugucuauagcguaguaaaaauaauaauaauaaucaggaguugcauuauagcca

SEQ ID NO: 554795 - RNA, 63 nt, Homo Sapiens
aauaauaaaaccaugucuauccaguaguaaaaauaauaauaauauccaggaguugcauuauag

SEQ ID NO: 554796 - RNA, 63 nt, Homo Sapiens
uucaaaacaaggaauaauuucacaucaaaaucauaauaauauuguauucauuaugaacagaua

SEQ ID NO: 554797 - RNA, 63 nt, Homo Sapiens
uaagagauugaaacuccaaaauaagguucuuccuaauaauaauuauucuauuccuuaccagua

SEQ ID NO: 554798 - RNA, 63 nt, Homo Sapiens
ucuauuguguaauucuuggugggcucuguaguuuaauaauaagaaaaaggccauuucauuuua

SEQ ID NO: 554799 - RNA, 63 nt, Homo Sapiens
cgauuccugcucgggcuguuugcuguuggcugguaauaauauauuugauuuaaaugcuguuga

SEQ ID NO: 554800 - RNA, 63 nt, Homo Sapiens
acugcagcgccgauuugaggguggagauauagauaauaauaauauuaauaauaauaauggcca

SEQ ID NO: 554801 - RNA, 63 nt, Homo Sapiens
gcagcgccgauuugaggguggagauauagauaauaauaauauuaauaauaauaauggccacau

SEQ ID NO: 554802 - RNA, 63 nt, Homo Sapiens
auuugaggguggagauauagauaauaauaauauuaauaauaauaauggccacauggaucgaac

SEQ ID NO: 554803 - RNA, 63 nt, Homo Sapiens
ugaggguggagauauagauaauaauaauauuaauaauaauaauggccacauggaucgaacacu

SEQ ID NO: 554804 - RNA, 63 nt, Homo Sapiens
cuaaauuuuuuauauuuaauauuuguuuaauaauaauaauaucuucucuugauucuugguuaa

SEQ ID NO: 554805 - RNA, 63 nt, Homo Sapiens
auccuaaauuuuuuauauuuuaaauuuguuuaauaauaauaauuauuucucuugauucuuggu

SEQ ID NO: 554806 - RNA, 63 nt, Homo Sapiens
aauauccuaaauuuuuuauagguuaaauuuguuuaauaauaauaaguauuucucuugauucuu

SEQ ID NO: 554807 - RNA, 63 nt, Homo Sapiens
cauaguaacaauggcuaaugggauaauuauaauuaauaauaaucaugcucagauauguaucua

SEQ ID NO: 554808 - RNA, 63 nt, Homo Sapiens
uugaaucauguaauauuuaauuguaaaaaaaaauaauaauaauuccuuuacagguuuauuucu

SEQ ID NO: 554809 - RNA, 63 nt, Homo Sapiens
uauuuucauaaucacugcagcuuggacuuguaauaauaauaagcacuuccucaggugcagacc

SEQ ID NO: 554810 - RNA, 63 nt, Homo Sapiens
aaguauuuucauaaucacugacccuuggacuuguaauaauaauggacacuuccucaggugcag

SEQ ID NO: 554811 - RNA, 63 nt, Homo Sapiens
gccugcuguguaagcugacaaaaaaaauaauaauaauaauaagcuuggacuugucagcaaaaa

SEQ ID NO: 554812 - RNA, 63 nt, Homo Sapiens
aaggccugcuguguaagcugaaaaaaaaaauaauaauaauaaucaucuuggacuugucagcaa

SEQ ID NO: 554813 - RNA, 63 nt, Homo Sapiens
aauaaggccugcuguguaagcaaaaaaaaaaaauaauaauaauugccaucuuggacuugucag

SEQ ID NO: 554814 - RNA, 63 nt, Homo Sapiens
uagagaacagcaauaccagauauaaauacaaauuaauaauacagacuaauagccagaguuaaa

SEQ ID NO: 554815 - RNA, 63 nt, Homo Sapiens
aacccuugucucccucuucuacacaggaaugccuaauaauagcauugucuccaccauugucac

SEQ ID NO: 554816 - RNA, 63 nt, Homo Sapiens
acacaguaaacauucuauuucuacacagaguaauaauaauaaacaugauagauaaauauguau

SEQ ID NO: 554817 - RNA, 63 nt, Homo Sapiens
aaaacacaguaaacauucuauaucuacacagaguaauaauaauugacaugauagauaaauaug

SEQ ID NO: 554818 - RNA, 63 nt, Homo Sapiens
guaaaaauaaaaauaaaaaaaaaauaauaauaauaauaauaaacagagugagacuccaucuca

SEQ ID NO: 554819 - RNA, 63 nt, Homo Sapiens
aaaguaaaaauaaaaauaaaucaaaaauaauaauaauaauaauugacagagugagacuccauc

SEQ ID NO: 554820 - RNA, 63 nt, Homo Sapiens
aauaaaguaaaaauaaaaauaucucaaaaauaauaauaauaaugggugacagagugagacucc

SEQ ID NO: 554821 - RNA, 63 nt, Homo Sapiens
aauaauaaaguaaaaauaaauccaucucaaaaauaauaauaauccugggugacagagugagac

SEQ ID NO: 554822 - RNA, 63 nt, Homo Sapiens
auggcugcgguagccuaguaggaauggacuauauaauaauauagcaggugcucaauaacuguu

SEQ ID NO: 554823 - RNA, 63 nt, Homo Sapiens
gccugggcaacagagcaagacccugucucaaaauaauaauaauauauaauuuuacaccaaaag

SEQ ID NO: 554824 - RNA, 63 nt, Homo Sapiens
ugggcaacagagcaagacccugucucaaaauaauaauaauauauaauuuuacaccaaaaguuu

SEQ ID NO: 554825 - RNA, 63 nt, Homo Sapiens
acaacguguuucugaaaaacagauuuucauaaguaauaauaaaaauaauaauaaaaaaguuuu

SEQ ID NO: 554826 - RNA, 63 nt, Homo Sapiens
ugaaaaacagauuuucauaaguaauaauaaaaauaauaauaaaaaaguuuugguaugguaagc

SEQ ID NO: 554827 - RNA, 63 nt, Homo Sapiens
aaagggugauaaaguaauagauaacuuuuaguuuaauaauaauuauuguuauuauacuacuaa

SEQ ID NO: 554828 - RNA, 63 nt, Homo Sapiens
uuaguuuaauaauaauuauuguuauuauacuacuaauaauagagcacuuguaagcacuaaguu

SEQ ID NO: 554829 - RNA, 63 nt, Homo Sapiens
aauguuugucagacuuauuaacuggucauauuauaauaauacugauaaugaccaacugcucau

SEQ ID NO: 554830 - RNA, 63 nt, Homo Sapiens
acauuuuugcuuugcugccagaguaacccugacuaauaauacaauaacagcaauuuuuuuaaa

SEQ ID NO: 554831 - RNA, 63 nt, Homo Sapiens
uuguuugcuuuccuuaacugauaauaauaauaauaauaauauguaauaauaauaauaauaaua

SEQ ID NO: 554832 - RNA, 63 nt, Homo Sapiens
auguuguuugcuuuccuuaaauaauaauaauaauaauaauaauuaauaauaauaauaauaaua

SEQ ID NO: 554833 - RNA, 63 nt, Homo Sapiens
aauauguuguuugcuuuccuauaauaauaauaauaauaauaauugauaauaauaauaauaaua

SEQ ID NO: 554834 - RNA, 63 nt, Homo Sapiens
aauaauauguuguuugcuuuauaauaauaauaauaauaauaauugaugauaauaauaauaaua

SEQ ID NO: 554835 - RNA, 63 nt, Homo Sapiens
aauaauaauauguuguuugcauaauaauaauaauaauaauaauuaaugaugauaauaauaaua

SEQ ID NO: 554836 - RNA, 63 nt, Homo Sapiens
aauaauaauaauauguuguuauaauaauaauaauaauaauaauuaauaaugaugauaauaaua

SEQ ID NO: 554837 - RNA, 63 nt, Homo Sapiens
aauaauaauaauaauauguuauaauaauaauaauaauaauaauugauaauaaugaugauaaua

SEQ ID NO: 554838 - RNA, 63 nt, Homo Sapiens
aauaauaauaauaauaauauauaauaauaauaauaauaauaaucaaugauaauaaugaugaua

SEQ ID NO: 554839 - RNA, 63 nt, Homo Sapiens
aauaauaauaauaauaauaaauaauaauaauaauaauaauaauacacaaugauaauaaugaug

SEQ ID NO: 554840 - RNA, 63 nt, Homo Sapiens
aauaauaauaauaauaauaaaugauaauaauaauaauaauaauugcacacaaugauaauaaug

SEQ ID NO: 554841 - RNA, 63 nt, Homo Sapiens
aauaauaauaauaauaauaaaugaugauaauaauaauaauaauauuugcacacaaugauaaua

SEQ ID NO: 554842 - RNA, 63 nt, Homo Sapiens
aauaauaauaauaauaauaaauaaugaugauaauaauaauaauuucauuugcacacaaugaua

SEQ ID NO: 554843 - RNA, 63 nt, Homo Sapiens
aauaauaauaauaauaauaaauaauaaugaugauaauaauaauuauuucauuugcacacaaug

SEQ ID NO: 554844 - RNA, 63 nt, Homo Sapiens
uuguuccaaauacugcuuaguaauaauaauagcuaauaauacccucgcuagguagaacacugc

SEQ ID NO: 554845 - RNA, 63 nt, Homo Sapiens
uaauaauaccuuguuccaaaagaacacugcuaauaauaauagcguauuuugaucucgcuaggu

SEQ ID NO: 554846 - RNA, 63 nt, Homo Sapiens
agcuaauaauaccuuguuccgguagaacacugcuaauaauaauacaguauuuugaucucgcua

SEQ ID NO: 554847 - RNA, 63 nt, Homo Sapiens
uaguguuuaugaauagaauccuauguuaaauaauaauaauaacguuauauauaugaauauucc

SEQ ID NO: 554848 - RNA, 63 nt, Homo Sapiens
aacuaguguuuaugaauagaucccuauguuaaauaauaauaauccuguuauauauaugaauau

SEQ ID NO: 554849 - RNA, 63 nt, Homo Sapiens
cauugccuaaaguagaauguguaaguaaugcuguaauaauacauaucauaguauauuauaauc

SEQ ID NO: 554850 - RNA, 63 nt, Homo Sapiens
aacuuaaauauauuuuguuuaauaggaaauauauaauaauagcauuuuauguaauaaaauaug

SEQ ID NO: 554851 - RNA, 63 nt, Homo Sapiens
auaucuuuaaaaagcuuuucugauguuaaagcauaauaauaacugugccaagaauaaaugaaa

SEQ ID NO: 554852 - RNA, 63 nt, Homo Sapiens
uugcuaaaaggccuuuuagaaguuuggugcuguuaauaauaauacuauuuaguaaaaaguuuu

SEQ ID NO: 554853 - RNA, 63 nt, Homo Sapiens
uaaauaaauaaaaauccaaaauaauaauaauaauaauaauaaaaaacauccuuuagaugcaaa

SEQ ID NO: 554854 - RNA, 63 nt, Homo Sapiens
aaauaaauaaauaaaaauccaaaauaauaauaauaauaauaauccaaaacauccuuuagaugc

SEQ ID NO: 554855 - RNA, 63 nt, Homo Sapiens
aauaaauaaauaaauaaaaaugcaaaauaauaauaauaauaauccuccaaaacauccuuuaga

SEQ ID NO: 554856 - RNA, 63 nt, Homo Sapiens
aauaauaaauaaauaaauaaagaugcaaaauaauaauaauaaugcuccuccaaaacauccuuu

SEQ ID NO: 554857 - RNA, 63 nt, Homo Sapiens
aauaauaauaaauaaauaaauuuagaugcaaaauaauaauaauugugcuccuccaaaacaucc

SEQ ID NO: 554858 - RNA, 63 nt, Homo Sapiens
ugagccccugucaagugccagucaugauaguaguaauaauaauaauaaacaucuauuggacca

SEQ ID NO: 554859 - RNA, 63 nt, Homo Sapiens
gccccugucaagugccagucaugauaguaguaauaauaauaauaaacaucuauuggaccaggc

SEQ ID NO: 554860 - RNA, 63 nt, Homo Sapiens
ccugucaagugccagucaugauaguaguaauaauaauaauaaacaucuauuggaccaggcucu

SEQ ID NO: 554861 - RNA, 63 nt, Homo Sapiens
ccuccacauagauguuuuuauauuacaugaauuuaauaauaaacuaaacuuuuuuuugucucc

SEQ ID NO: 554862 - RNA, 63 nt, Homo Sapiens
acacauauaauauauaugcuaaaguauaaagaguaauaauaaugacaauaaacaaaccccugu

SEQ ID NO: 554863 - RNA, 63 nt, Homo Sapiens
aacagcgagacucugucuuaaaaauaauaacaauaauaauaauaauaaagacuuacuuaacca

SEQ ID NO: 554864 - RNA, 63 nt, Homo Sapiens
agcgagacucugucuuaaaaauaauaacaauaauaauaauaauaaagacuuacuuaaccaaua

SEQ ID NO: 554865 - RNA, 63 nt, Homo Sapiens
gagacucugucuuaaaaauaauaacaauaauaauaauaauaaagacuuacuuaaccaauauua

SEQ ID NO: 554866 - RNA, 63 nt, Homo Sapiens
aaaugagagugugagagaaaguaccuucuauuuuaauaauaauauuauuauaaaaauaauaaa

SEQ ID NO: 554867 - RNA, 63 nt, Homo Sapiens
ugagagugugagagaaaguaccuucuauuuuaauaauaauauuauuauaaaaauaauaaaucu

SEQ ID NO: 554868 - RNA, 63 nt, Homo Sapiens
uugcauucugaacaaauaacugccuugguguauuaauaauaugcuaaugacuugguaaauuau

SEQ ID NO: 554869 - RNA, 63 nt, Homo Sapiens
aaugcaguauugcaacagggauuuugaaaaauguaauaauauuccagauaauauuuucuacag

SEQ ID NO: 554870 - RNA, 63 nt, Homo Sapiens
cuuuuucagaaagaauugaguuuauuuccuuaauaauaauaaauuccuaugauccuuccacac

SEQ ID NO: 554871 - RNA, 63 nt, Homo Sapiens
aaacuuuuucagaaagaauucacuuuauuuccuuaauaauaauuauuuccuaugauccuucca

SEQ ID NO: 554872 - RNA, 63 nt, Homo Sapiens
uauauuucauaaucaggcaaaaauacuuacaguuaauaauauagauauaauguuaaaaacaau

SEQ ID NO: 554873 - RNA, 63 nt, Homo Sapiens
acuuucuaacugagcccucuauuuucuuuauuuuaauaauauuucuccccacuugagaaucac

SEQ ID NO: 554874 - RNA, 63 nt, Homo Sapiens
aagauacugauagcauugagucuugaaaugauuuaauaauaugagugaggauuugcuuucucc

SEQ ID NO: 554875 - RNA, 63 nt, Homo Sapiens
uuuuucuuccaaacuucauauaugucuaucagguaauaauaggcuugaaaauugauauccugu

SEQ ID NO: 554876 - RNA, 63 nt, Homo Sapiens
gaguauaaaggcuacacccuuauuguaaaaaaauaauaauaauaaaaugaaagaaacaaucac

SEQ ID NO: 554877 - RNA, 63 nt, Homo Sapiens
uauaaaggcuacacccuuauuguaaaaaaauaauaauaauaaaaugaaagaaacaaucaccac

SEQ ID NO: 554878 - RNA, 63 nt, Homo Sapiens
uaaaaacucugaagaaacuuguuauuaaaauaauaauaauaaugaaguucugggauucagguu

SEQ ID NO: 554879 - RNA, 63 nt, Homo Sapiens
aauuaaaaacucugaagaaaguuguuauuaaaauaauaauaaucuggaaguucugggauucag

SEQ ID NO: 554880 - RNA, 63 nt, Homo Sapiens
uuuuaaagaaacauaaccacaaaccuuuucaaauaauaauaauaauaauaauaaaaaauguau

SEQ ID NO: 554881 - RNA, 63 nt, Homo Sapiens
uaaagaaacauaaccacaaaccuuuucaaauaauaauaauaauaauaauaaaaaauguauuuu

SEQ ID NO: 554882 - RNA, 63 nt, Homo Sapiens
agaaacauaaccacaaaccuuuucaaauaauaauaauaauaauaauaaaaaauguauuuuaaa

SEQ ID NO: 554883 - RNA, 63 nt, Homo Sapiens
aacauaaccacaaaccuuuucaaauaauaauaauaauaauaauaaaaaauguauuuuaaagau

SEQ ID NO: 554884 - RNA, 63 nt, Homo Sapiens
auaaccacaaaccuuuucaaauaauaauaauaauaauaauaaaaaauguauuuuaaagauggc

SEQ ID NO: 554885 - RNA, 63 nt, Homo Sapiens
uuuaaacaaguuuuuuguagaucccuuguaaaauaauaauaauaauguugugaaucuccaugc

SEQ ID NO: 554886 - RNA, 63 nt, Homo Sapiens
aaacaaguuuuuuguagaucccuuguaaaauaauaauaauaauguugugaaucuccaugccaa

SEQ ID NO: 554887 - RNA, 63 nt, Homo Sapiens
uuaauaaaaauuuaugaauauuaaaauuaucauuaauaauauaaaacacuuauuugagauuaa

SEQ ID NO: 554888 - RNA, 63 nt, Homo Sapiens
uauauuuguuauucuaacucuauuuuuuaaaguuaauaauauaaaguggccauguaaaauauu

SEQ ID NO: 554889 - RNA, 63 nt, Homo Sapiens
acuauugcuaguacuaguacuuuaccuuuaaaauaauaauaguauuuuuauuuuaaaauaaaa

SEQ ID NO: 554890 - RNA, 63 nt, Homo Sapiens
acuauuacuauuacuauuuuguauuauuaacacuaauaauaguacuguuaguauuaacuauua

SEQ ID NO: 554891 - RNA, 63 nt, Homo Sapiens
gccauauucuaaguugaguaccaccauuuauaauaauaauagcaucuuaaugugaauuaaaaa

SEQ ID NO: 554892 - RNA, 63 nt, Homo Sapiens
agcgccauauucuaaguugaaaaccaccauuuauaauaauaauccuaucuuaaugugaauuaa

SEQ ID NO: 554893 - RNA, 63 nt, Homo Sapiens
auauuuaaucuuauuaaguguuuuuuaaaaaaauaauaauaaaccuuacgcugggaaagcugg

SEQ ID NO: 554894 - RNA, 63 nt, Homo Sapiens
ucuuuuuuaaaaucugcugaggagagcaaaacuuaauaauaaucugaagcacacggccauguu

SEQ ID NO: 554895 - RNA, 63 nt, Homo Sapiens
ggcaaacuuaacaccccacucacauaguaauaauaauaauaauucaaaagagacuuagacucc

SEQ ID NO: 554896 - RNA, 63 nt, Homo Sapiens
aauggcaaacuuaacaccccucccacauaguaauaauaauaauugaucaaaagagacuuagac

SEQ ID NO: 554897 - RNA, 63 nt, Homo Sapiens
aauaauggcaaacuuaacacgacucccacauaguaauaauaaugugugaucaaaagagacuua

SEQ ID NO: 554898 - RNA, 63 nt, Homo Sapiens
gaucuggcaguuuaugcauucuucagaguaauguaauaauaccuaugugaugcuguaauuuua

SEQ ID NO: 554899 - RNA, 63 nt, Homo Sapiens
cugggugacagagcgacccucugucucaaaaaauaauaauaauaauaaauaaaacaacaacaa

SEQ ID NO: 554900 - RNA, 63 nt, Homo Sapiens
ggugacagagcgacccucugucucaaaaaauaauaauaauaauaaauaaaacaacaacaaaau

SEQ ID NO: 554901 - RNA, 63 nt, Homo Sapiens
gacagagcgacccucugucucaaaaaauaauaauaauaauaaauaaaacaacaacaaaaugca

SEQ ID NO: 554902 - RNA, 63 nt, Homo Sapiens
ccuuuacuauuuccaauguauguuuguuaaaaauaauaauaauaaaaccaaaagccuuugugg

SEQ ID NO: 554903 - RNA, 63 nt, Homo Sapiens
uuacuauuuccaauguauguuuguuaaaaauaauaauaauaaaaccaaaagccuuuguggaaa

SEQ ID NO: 554904 - RNA, 63 nt, Homo Sapiens
augaaacaaucugauuggggacaguguugauaauaauaauaaauuacaggugccaaaaagggg

SEQ ID NO: 554905 - RNA, 63 nt, Homo Sapiens
aaaaugaaacaaucugauuggggacaguguugauaauaauaauauuuuacaggugccaaaaag

SEQ ID NO: 554906 - RNA, 63 nt, Homo Sapiens
agaggccucaggaaagucauuccuuuuuaaaaauaauaauaaauguaaggggguacagugcag

SEQ ID NO: 554907 - RNA, 63 nt, Homo Sapiens
gugaagucugggcuuuuaguguaaccaucacccuaauaauauacguuguacccauuaaguuau

SEQ ID NO: 554908 - RNA, 63 nt, Homo Sapiens
gauucuuuuucuuuugugcacauaagaaauaaauaauaauaauaaauaaagaauaaaauuuug

SEQ ID NO: 554909 - RNA, 63 nt, Homo Sapiens
ucuuuuucuuuugugcacauaagaaauaaauaauaauaauaaauaaagaauaaaauuuuguau

SEQ ID NO: 554910 - RNA, 63 nt, Homo Sapiens
uuugccaaugauagugaccacagcaaaagcaaauaauaauaauauuaauaauaauaaagagaa

SEQ ID NO: 554911 - RNA, 63 nt, Homo Sapiens
gccaaugauagugaccacagcaaaagcaaauaauaauaauauuaauaauaauaaagagaaaua

SEQ ID NO: 554912 - RNA, 63 nt, Homo Sapiens
agugaccacagcaaaagcaaauaauaauaauauuaauaauaauaaagagaaauaaaauaauaa

SEQ ID NO: 554913 - RNA, 63 nt, Homo Sapiens
gaccacagcaaaagcaaauaauaauaauauuaauaauaauaaagagaaauaaaauaauaaaau

SEQ ID NO: 554914 - RNA, 63 nt, Homo Sapiens
accuuccaaaaaaagugccgucaauaaaauuaauaauaauaaaugacagagugagacuccauc

SEQ ID NO: 554915 - RNA, 63 nt, Homo Sapiens
aaaaccuuccaaaaaaagugaucucaauaaaauuaauaauaaugggugacagagugagacucc

SEQ ID NO: 554916 - RNA, 63 nt, Homo Sapiens
ccuuggugaugcauuacaacuuguuuucuuauguaauaauaaugaugaugaugaugauaauaa

SEQ ID NO: 554917 - RNA, 63 nt, Homo Sapiens
uuucuuauguaauaauaaugaugaugaugaugauaauaauaaauauuuuugagugcuuacuau

SEQ ID NO: 554918 - RNA, 63 nt, Homo Sapiens
guuuucuaaacuccaaaauggucaucuuaucaauaauaauaauauugaccauuuccuaucugc

SEQ ID NO: 554919 - RNA, 63 nt, Homo Sapiens
uucuaaacuccaaaauggucaucuuaucaauaauaauaauauugaccauuuccuaucugccag

SEQ ID NO: 554920 - RNA, 63 nt, Homo Sapiens
aauauauguauuagaugaauaccaaaguaauaauaauaauauauucagaugaagaaauuuggu

SEQ ID NO: 554921 - RNA, 63 nt, Homo Sapiens
auaaauauauguauuagauggguaccaaaguaauaauaauaauuccuucagaugaagaaauuu

SEQ ID NO: 554922 - RNA, 63 nt, Homo Sapiens
aauauaaauauauguauuaguuugguaccaaaguaauaauaaucauuccuucagaugaagaaa

SEQ ID NO: 554923 - RNA, 63 nt, Homo Sapiens
agugcuuuagaaauuaaauccaaaaccaugccauaauaauauaggacuauaauaaccugucuc

SEQ ID NO: 554924 - RNA, 63 nt, Homo Sapiens
guuugagguuauauaugcacauaggauugcauuuaauaauagucaacuucuauaccuaagaau

SEQ ID NO: 554925 - RNA, 63 nt, Homo Sapiens
caauaauuauuaugaccccuggaacuggguuaauaauaauagaaucugauguccacaagaaca

SEQ ID NO: 554926 - RNA, 63 nt, Homo Sapiens
agacaauaauuauuaugaccacaggaacuggguuaauaauaauagaaucugauguccacaaga

SEQ ID NO: 554927 - RNA, 63 nt, Homo Sapiens
guuagugcucagaaaucaccauaaucacgaaaauaauaauaauaaaucuuuaacauacuaccu

SEQ ID NO: 554928 - RNA, 63 nt, Homo Sapiens
agugcucagaaaucaccauaaucacgaaaauaauaauaauaaaucuuuaacauacuaccuaaa

SEQ ID NO: 554929 - RNA, 63 nt, Homo Sapiens
gcucgaaagaaaaaaauguuaaaaauauaucuauaauaauaauuuuuugucauuugucuuuau

SEQ ID NO: 554930 - RNA, 63 nt, Homo Sapiens
gguccaaguacuuuguauuguauacgugagucauaauaauaaaaagaagaagaaaaauaauag

SEQ ID NO: 554931 - RNA, 63 nt, Homo Sapiens
cuacaugacaaugugacacuccaucucaaaaaauaauaauaauaacaauauaagaacuagcug

SEQ ID NO: 554932 - RNA, 63 nt, Homo Sapiens
caugacaaugugacacuccaucucaaaaaauaauaauaauaacaauauaagaacuagcugggc

SEQ ID NO: 554933 - RNA, 63 nt, Homo Sapiens
augacugcuaucauaggcauccauauuuaauauuaauaauaauaauuaauaauaauaauaaac

SEQ ID NO: 554934 - RNA, 63 nt, Homo Sapiens
acugcuaucauaggcauccauauuuaauauuaauaauaauaauuaauaauaauaauaaaccca

SEQ ID NO: 554935 - RNA, 63 nt, Homo Sapiens
uaggcauccauauuuaauauuaauaauaauaauuaauaauaauaauaaacccaacacccaucc

SEQ ID NO: 554936 - RNA, 63 nt, Homo Sapiens
gcauccauauuuaauauuaauaauaauaauuaauaauaauaauaaacccaacacccauccccc

SEQ ID NO: 554937 - RNA, 63 nt, Homo Sapiens
uccauauuuaauauuaauaauaauaauuaauaauaauaauaaacccaacacccaucccccaga

SEQ ID NO: 554938 - RNA, 63 nt, Homo Sapiens
gaaagugacuuucacgguuccuucauaaaacuauaauaauauccgacacuuugauagaaaaaa

SEQ ID NO: 554939 - RNA, 63 nt, Homo Sapiens
gcuguuguuuagggguaaauaacaguaaauaauuaauaauaauaauaauaauaauaaaggagc

SEQ ID NO: 554940 - RNA, 63 nt, Homo Sapiens
guuguuuagggguaaauaacaguaaauaauuaauaauaauaauaauaauaauaaaggagcuga

SEQ ID NO: 554941 - RNA, 63 nt, Homo Sapiens
guuuagggguaaauaacaguaaauaauuaauaauaauaauaauaauaauaaaggagcugacgu

SEQ ID NO: 554942 - RNA, 63 nt, Homo Sapiens
uagggguaaauaacaguaaauaauuaauaauaauaauaauaauaauaaaggagcugacguucu

SEQ ID NO: 554943 - RNA, 63 nt, Homo Sapiens
ggguaaauaacaguaaauaauuaauaauaauaauaauaauaauaaaggagcugacguucuuag

SEQ ID NO: 554944 - RNA, 63 nt, Homo Sapiens
uaaauaacaguaaauaauuaauaauaauaauaauaauaauaaaggagcugacguucuuagccu

SEQ ID NO: 554945 - RNA, 63 nt, Homo Sapiens
aacuuacugauauccucaucuguaaauuagcgauaauaauaguacuuaccugguaggauuaug

SEQ ID NO: 554946 - RNA, 63 nt, Homo Sapiens
auuauguucucuguaguuacuggcugugauuauuaauaauauugccgcacccuaauaucuguu

SEQ ID NO: 554947 - RNA, 63 nt, Homo Sapiens
auaaaagagugccuggcacauaguaggugccauuaauaauauuacuauuguuaacaccuuaag

SEQ ID NO: 554948 - RNA, 63 nt, Homo Sapiens
uguaaauacugugaagugugacugaagauuuaauaauaauaaacauauuuauaccuuucaggu

SEQ ID NO: 554949 - RNA, 63 nt, Homo Sapiens
aaauguaaauacugugaagugguacugaagauuuaauaauaauacccauauuuauaccuuuca

SEQ ID NO: 554950 - RNA, 63 nt, Homo Sapiens
caaauuaauucuaaaggccccuucaaugcuuaauaauaauaaauauaaauauuaauaauacaa

SEQ ID NO: 554951 - RNA, 63 nt, Homo Sapiens
aaacaaauuaauucuaaaggcaacuucaaugcuuaauaauaauuacuauaaauauuaauaaua

SEQ ID NO: 554952 - RNA, 63 nt, Homo Sapiens
acuucaaugcuuaauaauaaauacuauaaauauuaauaauacauuucagcaacauauagaaau

SEQ ID NO: 554953 - RNA, 63 nt, Homo Sapiens
ugaugauaaagauguuucuggucauaauaacaauaauaauaaacagcagcaauaguagaagua

SEQ ID NO: 554954 - RNA, 63 nt, Homo Sapiens
uccaacaaggaauucagaguaucauuaaguaguuaauaauaauuguuucuuaaagcucugaac

SEQ ID NO: 554955 - RNA, 63 nt, Homo Sapiens
gcucugaauuuuucgaaaggauuuaagaaggauuaauaauaaucaugcuuggcccugcauuua

SEQ ID NO: 554956 - RNA, 63 nt, Homo Sapiens
auaagugagcugaacucacccaaaaaaaaaaaauaauaauaaagacagagcaagacucugucu

SEQ ID NO: 554957 - RNA, 63 nt, Homo Sapiens
ugccaagggggagagagacaaagcaaaaaauaauaauaauaaaaccaccaaucugugaaagua

SEQ ID NO: 554958 - RNA, 63 nt, Homo Sapiens
aaaugccaagggggagagagguaaagcaaaaaauaauaauaauauuaccaccaaucugugaaa

SEQ ID NO: 554959 - RNA, 63 nt, Homo Sapiens
uugccaaccucacugacacagggucauaguguauaauaauauacuguacuauauaauauauca

SEQ ID NO: 554960 - RNA, 63 nt, Homo Sapiens
gaaguaauuuugcuccuugauaaaguauuauauuaauaauaaaucugccugcaacuuuuugcc

SEQ ID NO: 554961 - RNA, 63 nt, Homo Sapiens
gacagaccaguuauuagguauuagcaugugugguaauaauaauaguggaacuucacacuuaca

SEQ ID NO: 554962 - RNA, 63 nt, Homo Sapiens
agaccaguuauuagguauuagcaugugugguaauaauaauaguggaacuucacacuuacauca

SEQ ID NO: 554963 - RNA, 63 nt, Homo Sapiens
cagucugggcaacagagugagacccugucucaauaauaauaauaauaauaaugaugauacucu

SEQ ID NO: 554964 - RNA, 63 nt, Homo Sapiens
ucugggcaacagagugagacccugucucaauaauaauaauaauaauaaugaugauacucuaag

SEQ ID NO: 554965 - RNA, 63 nt, Homo Sapiens
gggcaacagagugagacccugucucaauaauaauaauaauaauaaugaugauacucuaagaaa

SEQ ID NO: 554966 - RNA, 63 nt, Homo Sapiens
caacagagugagacccugucucaauaauaauaauaauaauaaugaugauacucuaagaaaaaa

SEQ ID NO: 554967 - RNA, 63 nt, Homo Sapiens
caauaugucauaauagaguagccacugguugcauaauaauagagaccuaaauucucaaauagg

SEQ ID NO: 554968 - RNA, 63 nt, Homo Sapiens; identical to SEQ ID NO: 389138

SEQ ID NO: 554969 - RNA, 60 nt, Homo Sapiens; identical to SEQ ID NO: 389139

SEQ ID NO: 554970 - RNA, 63 nt, Homo Sapiens
aucuguuuuuucauuugauccuaucgacaaucauaauaauaauaaauuauauauauaacccau

SEQ ID NO: 554971 - RNA, 63 nt, Homo Sapiens
uguuuuuucauuugauccuaucgacaaucauaauaauaauaaauuauauauauaacccauaua

SEQ ID NO: 554972 - RNA, 63 nt, Homo Sapiens
uguuugugagcuuuuuguucccucauucugcauuaauaauagcuaauaauaaaugcauagagc

SEQ ID NO: 554973 - RNA, 63 nt, Homo Sapiens
cuuuuuguucccucauucugcauuaauaauagcuaauaauaaaugcauagagcaauuaaacug

SEQ ID NO: 554974 - RNA, 63 nt, Homo Sapiens
aaauauuccuaucugcuuauaaaauggcugcuauaauaauaauaauacagauguuguuauaua

SEQ ID NO: 554975 - RNA, 63 nt, Homo Sapiens
uauuccuaucugcuuauaaaauggcugcuauaauaauaauaauacagauguuguuauauaagg

SEQ ID NO: 554976 - RNA, 63 nt, Homo Sapiens
uccuaucugcuuauaaaauggcugcuauaauaauaauaauacagauguuguuauauaagguau

SEQ ID NO: 554977 - RNA, 63 nt, Homo Sapiens
gccugggcaacaagagcaaaacucagucucaaauaauaauaauaacaacaacuuaaugugcug

SEQ ID NO: 554978 - RNA, 63 nt, Homo Sapiens
ugggcaacaagagcaaaacucagucucaaauaauaauaauaacaacaacuuaaugugcugcug

SEQ ID NO: 554979 - RNA, 63 nt, Homo Sapiens
ugggcucauuuaguugccugcuauuaugaagguuaauaauaaaguaacaauccugugaguuuu

SEQ ID NO: 554980 - RNA, 63 nt, Homo Sapiens
aaacuacccauauuccaaaaagccaaagcuugcuaauaauagaaaacugacuuacuuuguucc

SEQ ID NO: 554981 - RNA, 63 nt, Homo Sapiens
uugcuuuuccucggcagcuuucaaaaaaccaaauaauaauaguuauccgucuucuacuucaug

SEQ ID NO: 554982 - RNA, 63 nt, Homo Sapiens
uugggaaccuuggguucuuagguuuggauucuuuaauaauaucuaaaaagcuaaauuuuaaau

SEQ ID NO: 554983 - RNA, 63 nt, Homo Sapiens
gguaauuccugcuccacaccccuauuuuccucuuaauaauacguuugggugaagacaaauuag

SEQ ID NO: 554984 - RNA, 63 nt, Homo Sapiens
ugggaaugcauuauuacauccauuucuguaacauaauaauauguugcaugcaguuauauuuuc

SEQ ID NO: 554985 - RNA, 63 nt, Homo Sapiens
caugcuugauuuaggagagaauaaagggcuauauaauaauaaauccagauuuccggauaagaa

SEQ ID NO: 554986 - RNA, 63 nt, Homo Sapiens
aagcaaacucuauugguguguguaaaacaauaauaauaauaaagcauagcuauuuguuuuuau

SEQ ID NO: 554987 - RNA, 63 nt, Homo Sapiens
aaaaagcaaacucuauugguuauuguaaaacaauaauaauaauagagcauagcuauuuguuuu

SEQ ID NO: 554988 - RNA, 63 nt, Homo Sapiens
ccuuauaaaauuggguucaucaaaugggaguaauaauaauaaugccucaguuuucucaucugc

SEQ ID NO: 554989 - RNA, 63 nt, Homo Sapiens
aauccuuauaaaauuggguuugccaaaugggaguaauaauaauugagccucaguuuucucauc

SEQ ID NO: 554990 - RNA, 63 nt, Homo Sapiens
aauauaauacugaaaaggauaauaauaacauaauaauaauaaaugauggcaaaaagacagugu

SEQ ID NO: 554991 - RNA, 63 nt, Homo Sapiens
aaaaauauaauacugaaaaguguaauaauaacauaauaauaauuuuugauggcaaaaagacag

SEQ ID NO: 554992 - RNA, 63 nt, Homo Sapiens
auaauaauaauaaaaauauacaaaaagacaguguaauaauaaccacaggccucauuuugaugg

SEQ ID NO: 554993 - RNA, 63 nt, Homo Sapiens
aacaacaacaacaauaauaaaugauaauaauaauaauaauaacugaugaugaugaugaugaug

SEQ ID NO: 554994 - RNA, 63 nt, Homo Sapiens
aacaacaacaacaacaauaaaugaugauaauaauaauaauaaucgaugaugaugaugaugaug

SEQ ID NO: 554995 - RNA, 63 nt, Homo Sapiens
aauaacaacaacaacaacaaaugaugaugauaauaauaauaaucuucgaugaugaugaugaug

SEQ ID NO: 554996 - RNA, 63 nt, Homo Sapiens
aauaauaacaacaacaacaaaugaugaugaugauaauaauaauauacuucgaugaugaugaug

SEQ ID NO: 554997 - RNA, 63 nt, Homo Sapiens
ucugguugcuuauuuuuagaaaaugaggacauuuaauaauaauaaaaaaaaagggauuaauag

SEQ ID NO: 554998 - RNA, 63 nt, Homo Sapiens
gguugcuuauuuuuagaaaaugaggacauuuaauaauaauaaaaaaaaagggauuaauagcuu

SEQ ID NO: 554999 - RNA, 63 nt, Homo Sapiens
uaauguuugaaucuaaaucauugggcaaacuucuaauaauaacaauuaauaauagguuacagg

SEQ ID NO: 555000 - RNA, 63 nt, Homo Sapiens
uaaaucauugggcaaacuucuaauaauaacaauuaauaauagguuacaggaaagccagccaga

SEQ ID NO: 555001 - RNA, 63 nt, Homo Sapiens
cucuguucacauuuacuggucuuaauuaacagguaauaauaauacauguacuuuuagccugaa

SEQ ID NO: 555002 - RNA, 63 nt, Homo Sapiens
uguucacauuuacuggucuuaauuaacagguaauaauaauacauguacuuuuagccugaaacc

SEQ ID NO: 555003 - RNA, 63 nt, Homo Sapiens
gcaaaauagaggccaaauccagggaccaggcccuaauaauagaaguuguaccaaaaugccugu

SEQ ID NO: 555004 - RNA, 63 nt, Homo Sapiens
auugaaauuuuaaaauuuugauugcuuuuauuauaauaauaggacauaggccuaauugagaua

SEQ ID NO: 555005 - RNA, 63 nt, Homo Sapiens
uaccaacccacuuuguggaucagaaauuugcacuaauaauacugacuaaaugcugcaggucag

SEQ ID NO: 555006 - RNA, 63 nt, Homo Sapiens
ccugggcaacagagugaaacucugucucaaaaauaauaauaauaaaaaaaagcuuccaucucc

SEQ ID NO: 555007 - RNA, 63 nt, Homo Sapiens
gggcaacagagugaaacucugucucaaaaauaauaauaauaaaaaaaagcuuccaucucccag

SEQ ID NO: 555008 - RNA, 63 nt, Homo Sapiens
cuucuuacuuugauaacucuucuuaguuuaaaauaauaauaauaacacaucuuuggucaucua

SEQ ID NO: 555009 - RNA, 63 nt, Homo Sapiens
cuuacuuugauaacucuucuuaguuuaaaauaauaauaauaacacaucuuuggucaucuaugu

SEQ ID NO: 555010 - RNA, 63 nt, Homo Sapiens
gcuggagacuuggccacacccaaauaauaauaauaauaauaaaaagagagcaagacucugucu

SEQ ID NO: 555011 - RNA, 63 nt, Homo Sapiens
aaagcuggagacuuggccacucucaaauaauaauaauaauaauggcaagagagcaagacucug

SEQ ID NO: 555012 - RNA, 63 nt, Homo Sapiens
aauaaagcuggagacuuggccugucucaaauaauaauaauaaucugggcaagagagcaagacu

SEQ ID NO: 555013 - RNA, 63 nt, Homo Sapiens
aauaauaaagcuggagacuuacucugucucaaauaauaauaauagccugggcaagagagcaag

SEQ ID NO: 555014 - RNA, 63 nt, Homo Sapiens
cgugugacucuuuccauauguauaacguggggauaauaauaauagcugcuucacaggaugaaa

SEQ ID NO: 555015 - RNA, 63 nt, Homo Sapiens
gugacucuuuccauauguauaacguggggauaauaauaauagcugcuucacaggaugaaauga

SEQ ID NO: 555016 - RNA, 63 nt, Homo Sapiens
aaagcauaauugaaaguucugaaaaaagaaaaauaauaauauguagaaaaauguaacuuagag

SEQ ID NO: 555017 - RNA, 63 nt, Homo Sapiens
uuacagacugucugaaauugaagaagaaugaacuaauaauagcauucauaaccaaacacaaug

SEQ ID NO: 555018 - RNA, 63 nt, Homo Sapiens
caucauugaaacuacuacaaugauacuaucauuuaauaauauuaauauuacuugaaauagacu

SEQ ID NO: 555019 - RNA, 63 nt, Homo Sapiens
uggugaauuaucucuacuaaaaauacaaaaaaauaauaauaauagccaggcgugguggcacau

SEQ ID NO: 555020 - RNA, 63 nt, Homo Sapiens
ugaauuaucucuacuaaaaauacaaaaaaauaauaauaauagccaggcgugguggcacaugcc

SEQ ID NO: 555021 - RNA, 63 nt, Homo Sapiens
aauauuaaaaagguauuauaaagguauuuaaaauaauaauaauaaaguguuauuuuccuggga

SEQ ID NO: 555022 - RNA, 63 nt, Homo Sapiens
auuaaaaagguauuauaaagguauuuaaaauaauaauaauaaaguguuauuuuccugggauuc

SEQ ID NO: 555023 - RNA, 63 nt, Homo Sapiens
uagcauggacauuugaucaaccuuuaguuggaauaauaauauucauauuugcuaugaauccuu

SEQ ID NO: 555024 - RNA, 63 nt, Homo Sapiens
uuguguguuuguguguuuuuuuaagugcuguauuaauaauacuuucugaaagaaaaggacacu

SEQ ID NO: 555025 - RNA, 63 nt, Homo Sapiens
gugucuuccauuguuaaaugugauuaaaaauaauaauaauaaaagaguugaaauguugagaga

SEQ ID NO: 555026 - RNA, 63 nt, Homo Sapiens
aaagugucuuccauuguuaaagaugauuaaaaauaauaauaauccaagaguugaaauguugag

SEQ ID NO: 555027 - RNA, 63 nt, Homo Sapiens
uucauagccaaacuuguauauuuaaauucuuuguaauaauaauauccaaaucaucaucuugug

SEQ ID NO: 555028 - RNA, 63 nt, Homo Sapiens
auagccaaacuuguauauuuaaauucuuuguaauaauaauauccaaaucaucaucuuguguca

SEQ ID NO: 555029 - RNA, 63 nt, Homo Sapiens
ggccaagugcaguccugucuugauuaaauuacuuaauaauauuauuaaauaauaauaggucug

SEQ ID NO: 555030 - RNA, 63 nt, Homo Sapiens
gucuugauuaaauuacuuaauaauauuauuaaauaauaauaggucugggcaguauuguuuuua

SEQ ID NO: 555031 - RNA, 63 nt, Homo Sapiens
auugacccagacauauuguacucuuucuaaaaauaauaauaauaaugcuaacagaaagaagag

SEQ ID NO: 555032 - RNA, 63 nt, Homo Sapiens
gacccagacauauuguacucuuucuaaaaauaauaauaauaaugcuaacagaaagaagagaac

SEQ ID NO: 555033 - RNA, 63 nt, Homo Sapiens
aaaaauaugauaaagugaaaacaguaauaauaauaauaauaacggaaagauaaugaugguaac

SEQ ID NO: 555034 - RNA, 63 nt, Homo Sapiens
aacaaaaauaugauaaagugaacacaguaauaauaauaauaauagaggaaagauaaugauggu

SEQ ID NO: 555035 - RNA, 63 nt, Homo Sapiens
aauaacaaaaauaugauaaagguaacacaguaauaauaauaauucuagaggaaagauaaugau

SEQ ID NO: 555036 - RNA, 63 nt, Homo Sapiens
aauaauaacaaaaauaugaugaugguaacacaguaauaauaauugcucuagaggaaagauaau

SEQ ID NO: 555037 - RNA, 51 nt, Homo Sapiens
cucauuucagacgaaaguaggcgguacgaacccuaauggaggcaguuuuga

SEQ ID NO: 555038 - RNA, 63 nt, Homo Sapiens
uuggcucagugcaaccuccgggcuggagugcaacgguacgaucgaaucucacucucucgccca

SEQ ID NO: 555039 - RNA, 63 nt, Homo Sapiens
agaaggaugggccccgugggguccccacugccccgguacgagggggcccaagacccuggcagg

SEQ ID NO: 555040 - RNA, 63 nt, Homo Sapiens
ucuuagugcccacggaggccuaaaaaacugucacgguacgaaaaggauucagucauaaagagg

SEQ ID NO: 555041 - RNA, 63 nt, Homo Sapiens
ugggagugacauuucuguaaccauaauagggcccgguacgauuuucuuccugcuggguuuuag

SEQ ID NO: 555042 - RNA, 63 nt, Homo Sapiens
cuuagaaggaaggagggggaagccaaaugcaaucgguacgaauugaacucacugagcagccag

SEQ ID NO: 555043 - RNA, 63 nt, Homo Sapiens
gucucaacaccuuucuucugaugggaggugaaacgguacgauguuguucaagaccagccucua

SEQ ID NO: 555044 - RNA, 63 nt, Homo Sapiens
ucuagccugcccugccugcccgugcucaaguaucgguacgagacuuucugcaccaggaggagg

SEQ ID NO: 555045 - RNA, 64 nt, Homo Sapiens; identical to SEQ ID NO: 243529

SEQ ID NO: 555046 - RNA, 64 nt, Homo Sapiens; identical to SEQ ID NO: 243530

SEQ ID NO: 555047 - RNA, 64 nt, Homo Sapiens; identical to SEQ ID NO: 243531

SEQ ID NO: 555048 - RNA, 64 nt, Homo Sapiens; identical to SEQ ID NO: 243532

SEQ ID NO: 555049 - RNA, 64 nt, Homo Sapiens; identical to SEQ ID NO: 243533

SEQ ID NO: 555050 - RNA, 64 nt, Homo Sapiens; identical to SEQ ID NO: 243534

SEQ ID NO: 555051 - RNA, 64 nt, Homo Sapiens; identical to SEQ ID NO: 243535

SEQ ID NO: 555052 - RNA, 64 nt, Homo Sapiens; identical to SEQ ID NO: 243536

SEQ ID NO: 555053 - RNA, 63 nt, Homo Sapiens
ugacuccugcucucuggaggacggucaguccaugucucggagaaacgggugagcugagcuugg

SEQ ID NO: 555054 - RNA, 63 nt, Homo Sapiens
auccauugacauuugcacuuucaaacaugacaagucucggagcugcugagaugacaggccccu

SEQ ID NO: 555055 - RNA, 63 nt, Homo Sapiens
guccccagucuuugccaccauugcaccaugguugucucggagucccuucaccugaccuuuuua

SEQ ID NO: 555056 - RNA, 63 nt, Homo Sapiens
cacccagggcuggccagucacugagggaacagcgucucggaacugcugguccucauuccuugc

SEQ ID NO: 555057 - RNA, 63 nt, Homo Sapiens
acacccuggccugaacugagcuuccgcugaggggucucggaugguucuuuccucccccugcaa

SEQ ID NO: 555058 - RNA, 63 nt, Homo Sapiens
uacaaccgcagcagccacuaccccuccaauauagucucggagcgcccccuuguccuuccucac

SEQ ID NO: 555059 - RNA, 63 nt, Homo Sapiens
augaccuuuagucuguggacuuugaaagcuucagucucggaaccuauauuggaacuaggguca

SEQ ID NO: 555060 - RNA, 63 nt, Homo Sapiens
gauuccccuaaccucauuccuucaccuuccagugucucggaggggagccccuuugaugauuaa

SEQ ID NO: 555061 - RNA, 63 nt, Homo Sapiens
acaugcaccuggcugaccuggcugaaagccgcugucucggagccccccacagcauuuuguucc

SEQ ID NO: 555062 - RNA, 63 nt, Homo Sapiens
ccgccuucucccugggggugauucaaggauuuggucucggaccagaccccccuccacagcugc

SEQ ID NO: 555063 - RNA, 63 nt, Homo Sapiens
ggaaaugagaaggcagccaccagcgaaugcuaggucucggacuaagccuaccugcucuccaag

SEQ ID NO: 555064 - RNA, 63 nt, Homo Sapiens
agcuauugcuauugguuuggaguugagauaucagucucggaaacuucugaaaaaugcuaauaa

SEQ ID NO: 555065 - RNA, 63 nt, Homo Sapiens
ccugauaugguaauauuauggugcauagcagaggucucggaaaaaaaauauuucuguucacuu

SEQ ID NO: 555066 - RNA, 63 nt, Homo Sapiens
ggagggcacgagagcugaaccugagccuggggcgucucggagcuggauccccgucagcucauc

SEQ ID NO: 555067 - RNA, 63 nt, Homo Sapiens
cacccuggaagccacugucaaugauuagaucgggucucggaagggaaguagccaucacaccau

SEQ ID NO: 555068 - RNA, 63 nt, Homo Sapiens
aggcgcuuucccccgauggaggcacaggcuucugucucggauguuuggcgcacgugaguuugu

SEQ ID NO: 555069 - RNA, 63 nt, Homo Sapiens
ucgccugcgccgcugugcccagccgcacaucuggucucggagcugaagaacaucuggaguugg

SEQ ID NO: 555070 - RNA, 63 nt, Homo Sapiens
uuuaaaaacugagaccaagacucccaucagcuggucucggauuuacaucggaacugcucagga

SEQ ID NO: 555071 - RNA, 63 nt, Homo Sapiens
gcggggcggggccggguguuccauagcaugugugucucggaugcggaaggcaguuuugcuugg

SEQ ID NO: 555072 - RNA, 63 nt, Homo Sapiens
agcacgggccgcuccgcuccccugcuccugucugucucggacagaaaacacgaggcuccuugu

SEQ ID NO: 555073 - RNA, 63 nt, Homo Sapiens
ucucucucucucucuguguuuccuccagcccuugucucggagacgguguuuuccucccuugcc

SEQ ID NO: 555074 - RNA, 63 nt, Homo Sapiens
aaaguccuggauuuuccauuagcaacuguagaugucucggauaugcgcucuaguaacugccuu

SEQ ID NO: 555075 - RNA, 63 nt, Homo Sapiens
ugaugcuccauuggaugauaaaauuggagcagagucucggaauuggagagcugguaagccagu

SEQ ID NO: 555076 - RNA, 63 nt, Homo Sapiens
uggguacuguauuugaaagcuuuccaaggaaaugucucggauagauagcucgagaaagaauuu

SEQ ID NO: 555077 - RNA, 63 nt, Homo Sapiens
cacagagccaggaauauagcgggauuaaaagcagucucggaaaaaucuaaauguagagaaguu

SEQ ID NO: 555078 - RNA, 63 nt, Homo Sapiens
ugguguuguuaggugggccagcuguacgagugugucucggaucgaccagaagagagaauugga

SEQ ID NO: 555079 - RNA, 63 nt, Homo Sapiens
gcggggcugacagcucaggagugucugcacacugucucggaagccaggauuccauuuguguug

SEQ ID NO: 555080 - RNA, 63 nt, Homo Sapiens
accaucagcagggggcacccaccaugcacaccugucucggaguaggcagcucuuccugggagc

SEQ ID NO: 555081 - RNA, 63 nt, Homo Sapiens
aagugacugacccagugcacggcaugugugacugucucggaugccagggacuuaccuggggcu

SEQ ID NO: 555082 - RNA, 63 nt, Homo Sapiens
guggcugcccacggccugggccccggcccaggugucucggaggcgcuucugcugagacccugc

SEQ ID NO: 555083 - RNA, 63 nt, Homo Sapiens
ggaggaggugcgaaguccuggaguauuguuugggucucggaaugggcgcauaaccugcgcuga

SEQ ID NO: 555084 - RNA, 63 nt, Homo Sapiens
aaggagggggggucuccugggggcagaccgagggucucggaggauagaaugagagguuuccag

SEQ ID NO: 555085 - RNA, 63 nt, Homo Sapiens
gcuuuguuggaucagagcagauuuuucacccuggucucggaaucuaaaaacccucgcuguguc

SEQ ID NO: 555086 - RNA, 63 nt, Homo Sapiens
agggucuacgggaccgaggaugcauuuggcaaagucucggaucauaaaaacaguaaaagcuua

SEQ ID NO: 555087 - RNA, 63 nt, Homo Sapiens
gaucugcucagaaaggaagaauuccgcuccacagucucggacgccccuccugccaggguggcg

SEQ ID NO: 555088 - RNA, 63 nt, Homo Sapiens
aggcucccaggagccugcccugcagccgacacggucucggaucacccugguuguguguccccu

SEQ ID NO: 555089 - RNA, 63 nt, Homo Sapiens
uucuuguccuguuuuuuuucgcugacgggcuccgucucggagagggcggggccacugcucugu

SEQ ID NO: 555090 - RNA, 63 nt, Homo Sapiens
cugccucccuuaggaggggacacugaugaugaggucucggagccggcauccuuccaucccugu

SEQ ID NO: 555091 - RNA, 63 nt, Homo Sapiens
cguguccugagccucagugaggcugggcagauggucucggagccuccauggggcguagcagga

SEQ ID NO: 555092 - RNA, 63 nt, Homo Sapiens
ggcaaaauaaacuuucuaaauuaacugagaccugucucggauuuucuggguucacauuuugga

SEQ ID NO: 555093 - RNA, 63 nt, Homo Sapiens
ucugucuuuugccucgaagcuaguguaaacugcgucucggaugcuuguccuuuuaagccagag

SEQ ID NO: 555094 - RNA, 63 nt, Homo Sapiens
uucuuuuuccgugugggugguuaauaaucgucagucucggagggcgaggcucguaggauauuu

SEQ ID NO: 555095 - RNA, 63 nt, Homo Sapiens
guggcaggacugcaccaguguauccacaguccugucucggaaucauacagacccucagcugac

SEQ ID NO: 555096 - RNA, 65 nt, Homo Sapiens
gcugacuccugcucucuggaggacggucaguccaugucucggagaaacgggugagcugagcuugg

SEQ ID NO: 555097 - RNA, 65 nt, Homo Sapiens
aaauccauugacauuugcacuuucaaacaugacaagucucggagcugcugagaugacaggccccu

SEQ ID NO: 555098 - RNA, 65 nt, Homo Sapiens
caguccccagucuuugccaccauugcaccaugguugucucggagucccuucaccugaccuuuuua

SEQ ID NO: 555099 - RNA, 65 nt, Homo Sapiens
agcacccagggcuggccagucacugagggaacagcgucucggaacugcugguccucauuccuugc

SEQ ID NO: 555100 - RNA, 65 nt, Homo Sapiens
acacccuggccugaacugagaacuuccgcugaggggucucggauguaguucuuuccucccccugc

SEQ ID NO: 555101 - RNA, 65 nt, Homo Sapiens
uacaaccgcagcagccacuaacccccuccaauauagucucggagcuggcccccuuguccuuccuc

SEQ ID NO: 555102 - RNA, 65 nt, Homo Sapiens
augaccuuuagucuguggaccauuugaaagcuucagucucggaacgucuauauuggaacuagggu

SEQ ID NO: 555103 - RNA, 65 nt, Homo Sapiens
gauuccccuaaccucauuccaauucaccuuccagugucucggaggagggagccccuuugaugauu

SEQ ID NO: 555104 - RNA, 65 nt, Homo Sapiens
ccacaugcaccuggcugaccuggcugaaagccgcugucucggagccccccacagcauuuuguucc

SEQ ID NO: 555105 - RNA, 65 nt, Homo Sapiens
ggccgccuucucccugggggugauucaaggauuuggucucggaccagaccccccuccacagcugc

SEQ ID NO: 555106 - RNA, 65 nt, Homo Sapiens
ugggaaaugagaaggcagccaccagcgaaugcuaggucucggacuaagccuaccugcucuccaag

SEQ ID NO: 555107 - RNA, 65 nt, Homo Sapiens
uaagcuauugcuauugguuuggaguugagauaucagucucggaaacuucugaaaaaugcuaauaa

SEQ ID NO: 555108 - RNA, 65 nt, Homo Sapiens
acccugauaugguaauauuauggugcauagcagaggucucggaaaaaaaauauuucuguucacuu

SEQ ID NO: 555109 - RNA, 65 nt, Homo Sapiens
ggggagggcacgagagcugaaccugagccuggggcgucucggagcuggauccccgucagcucauc

SEQ ID NO: 555110 - RNA, 65 nt, Homo Sapiens
aacacccuggaagccacugucaaugauuagaucgggucucggaagggaaguagccaucacaccau

SEQ ID NO: 555111 - RNA, 65 nt, Homo Sapiens
aaaggcgcuuucccccgauggaggcacaggcuucugucucggauguuuggcgcacgugaguuugu

SEQ ID NO: 555112 - RNA, 65 nt, Homo Sapiens
ucgccugcgccgcugugcccggagccgcacaucuggucucggagcgaugaagaacaucuggaguu

SEQ ID NO: 555113 - RNA, 65 nt, Homo Sapiens
cuuuuaaaaacugagaccaagacucccaucagcuggucucggauuuacaucggaacugcucagga

SEQ ID NO: 555114 - RNA, 65 nt, Homo Sapiens
gggcggggcggggccggguguuccauagcaugugugucucggaugcggaaggcaguuuugcuugg

SEQ ID NO: 555115 - RNA, 65 nt, Homo Sapiens
ugagcacgggccgcuccgcuccccugcuccugucugucucggacagaaaacacgaggcuccuugu

SEQ ID NO: 555116 - RNA, 65 nt, Homo Sapiens
ugucucucucucucucuguguuuccuccagcccuugucucggagacgguguuuuccucccuugcc

SEQ ID NO: 555117 - RNA, 65 nt, Homo Sapiens
aaaguccuggauuuuccauuuuagcaacuguagaugucucggauagcugcgcucuaguaacugcc

SEQ ID NO: 555118 - RNA, 65 nt, Homo Sapiens
ugugaugcuccauuggaugauaaaauuggagcagagucucggaauuggagagcugguaagccagu

SEQ ID NO: 555119 - RNA, 65 nt, Homo Sapiens
uggguacuguauuugaaagcuuuuuccaaggaaaugucucggauaucgauagcucgagaaagaau

SEQ ID NO: 555120 - RNA, 65 nt, Homo Sapiens
cacagagccaggaauauagcuugggauuaaaagcagucucggaaauuaaucuaaauguagagaag

SEQ ID NO: 555121 - RNA, 65 nt, Homo Sapiens
ugguguuguuaggugggccagagcuguacgagugugucucggaucaggaccagaagagagaauug

SEQ ID NO: 555122 - RNA, 65 nt, Homo Sapiens
aggcggggcugacagcucaggagugucugcacacugucucggaagccaggauuccauuuguguug

SEQ ID NO: 555123 - RNA, 65 nt, Homo Sapiens
acaccaucagcagggggcacccaccaugcacaccugucucggaguaggcagcucuuccugggagc

SEQ ID NO: 555124 - RNA, 65 nt, Homo Sapiens
aagugacugacccagugcaccuggcaugugugacugucucggaugccccagggacuuaccugggg

SEQ ID NO: 555125 - RNA, 65 nt, Homo Sapiens
guggcugcccacggccuggggcccccggcccaggugucucggaggggcgcuucugcugagacccu

SEQ ID NO: 555126 - RNA, 65 nt, Homo Sapiens
gaggaggaggugcgaaguccuggaguauuguuugggucucggaaugggcgcauaaccugcgcuga

SEQ ID NO: 555127 - RNA, 65 nt, Homo Sapiens
uaaaggagggggggucuccugggggcagaccgagggucucggaggauagaaugagagguuuccag

SEQ ID NO: 555128 - RNA, 65 nt, Homo Sapiens
gugcuuuguuggaucagagcagauuuuucacccuggucucggaaucuaaaaacccucgcuguguc

SEQ ID NO: 555129 - RNA, 65 nt, Homo Sapiens
agggucuacgggaccgaggauaugcauuuggcaaagucucggaucauauaaaaacaguaaaagcu

SEQ ID NO: 555130 - RNA, 65 nt, Homo Sapiens
gaucugcucagaaaggaagacgauuccgcuccacagucucggacggcccccuccugccagggugg

SEQ ID NO: 555131 - RNA, 65 nt, Homo Sapiens
aggcucccaggagccugccccuugcagccgacacggucucggaucguacccugguuguguguccc

SEQ ID NO: 555132 - RNA, 65 nt, Homo Sapiens
uucuuguccuguuuuuuuucgugcugacgggcuccgucucggagauggggcggggccacugcucu

SEQ ID NO: 555133 - RNA, 65 nt, Homo Sapiens
ugcugccucccuuaggaggggacacugaugaugaggucucggagccggcauccuuccaucccugu

SEQ ID NO: 555134 - RNA, 65 nt, Homo Sapiens
gccguguccugagccucagugaggcugggcagauggucucggagccuccauggggcguagcagga

SEQ ID NO: 555135 - RNA, 65 nt, Homo Sapiens
uuggcaaaauaaacuuucuaaauuaacugagaccugucucggauuuucuggguucacauuuugga

SEQ ID NO: 555136 - RNA, 65 nt, Homo Sapiens
ucugucuuuugccucgaagcaguaguguaaacugcgucucggaugaucuuguccuuuuaagccag

SEQ ID NO: 555137 - RNA, 65 nt, Homo Sapiens
guuucuuuuuccgugugggugguuaauaaucgucagucucggagggcgaggcucguaggauauuu

SEQ ID NO: 555138 - RNA, 65 nt, Homo Sapiens
ucguggcaggacugcaccaguguauccacaguccugucucggaaucauacagacccucagcugac

SEQ ID NO: 555139 - RNA, 64 nt, Homo Sapiens; identical to SEQ ID NO: 327679

SEQ ID NO: 555140 - RNA, 64 nt, Homo Sapiens; identical to SEQ ID NO: 327680

SEQ ID NO: 555141 - RNA, 64 nt, Homo Sapiens; identical to SEQ ID NO: 327681

SEQ ID NO: 555142 - RNA, 64 nt, Homo Sapiens; identical to SEQ ID NO: 327682

SEQ ID NO: 555143 - RNA, 64 nt, Homo Sapiens; identical to SEQ ID NO: 327683

SEQ ID NO: 555144 - RNA, 64 nt, Homo Sapiens; identical to SEQ ID NO: 327684

SEQ ID NO: 555145 - RNA, 64 nt, Homo Sapiens; identical to SEQ ID NO: 327685

SEQ ID NO: 555146 - RNA, 64 nt, Homo Sapiens; identical to SEQ ID NO: 327686

SEQ ID NO: 555147 - RNA, 64 nt, Homo Sapiens; identical to SEQ ID NO: 327687

SEQ ID NO: 555148 - RNA, 64 nt, Homo Sapiens; identical to SEQ ID NO: 327688

SEQ ID NO: 555149 - RNA, 64 nt, Homo Sapiens; identical to SEQ ID NO: 327689

SEQ ID NO: 555150 - RNA, 64 nt, Homo Sapiens; identical to SEQ ID NO: 327690

SEQ ID NO: 555151 - RNA, 64 nt, Homo Sapiens; identical to SEQ ID NO: 327691

SEQ ID NO: 555152 - RNA, 64 nt, Homo Sapiens; identical to SEQ ID NO: 327692

SEQ ID NO: 555153 - RNA, 64 nt, Homo Sapiens; identical to SEQ ID NO: 327693

SEQ ID NO: 555154 - RNA, 64 nt, Homo Sapiens; identical to SEQ ID NO: 327694

SEQ ID NO: 555155 - RNA, 64 nt, Homo Sapiens; identical to SEQ ID NO: 327695

SEQ ID NO: 555156 - RNA, 64 nt, Homo Sapiens; identical to SEQ ID NO: 327696

SEQ ID NO: 555157 - RNA, 64 nt, Homo Sapiens; identical to SEQ ID NO: 327697

SEQ ID NO: 555158 - RNA, 64 nt, Homo Sapiens; identical to SEQ ID NO: 327698

SEQ ID NO: 555159 - RNA, 64 nt, Homo Sapiens; identical to SEQ ID NO: 327699

SEQ ID NO: 555160 - RNA, 64 nt, Homo Sapiens; identical to SEQ ID NO: 327700

SEQ ID NO: 555161 - RNA, 64 nt, Homo Sapiens; identical to SEQ ID NO: 327701

SEQ ID NO: 555162 - RNA, 64 nt, Homo Sapiens; identical to SEQ ID NO: 327702

SEQ ID NO: 555163 - RNA, 64 nt, Homo Sapiens; identical to SEQ ID NO: 327703

SEQ ID NO: 555164 - RNA, 64 nt, Homo Sapiens; identical to SEQ ID NO: 327704

SEQ ID NO: 555165 - RNA, 64 nt, Homo Sapiens; identical to SEQ ID NO: 327705

SEQ ID NO: 555166 - RNA, 64 nt, Homo Sapiens; identical to SEQ ID NO: 327706

SEQ ID NO: 555167 - RNA, 64 nt, Homo Sapiens; identical to SEQ ID NO: 327707

SEQ ID NO: 555168 - RNA, 64 nt, Homo Sapiens; identical to SEQ ID NO: 327708

SEQ ID NO: 555169 - RNA, 64 nt, Homo Sapiens; identical to SEQ ID NO: 327709

SEQ ID NO: 555170 - RNA, 63 nt, Homo Sapiens; identical to SEQ ID NO: 327710

SEQ ID NO: 555171 - RNA, 64 nt, Homo Sapiens; identical to SEQ ID NO: 327711

SEQ ID NO: 555172 - RNA, 64 nt, Homo Sapiens; identical to SEQ ID NO: 327712

SEQ ID NO: 555173 - RNA, 64 nt, Homo Sapiens; identical to SEQ ID NO: 327713

SEQ ID NO: 555174 - RNA, 64 nt, Homo Sapiens; identical to SEQ ID NO: 327714

SEQ ID NO: 555175 - RNA, 64 nt, Homo Sapiens; identical to SEQ ID NO: 327715

SEQ ID NO: 555176 - RNA, 64 nt, Homo Sapiens; identical to SEQ ID NO: 327716

SEQ ID NO: 555177 - RNA, 64 nt, Homo Sapiens; identical to SEQ ID NO: 327717

SEQ ID NO: 555178 - RNA, 64 nt, Homo Sapiens; identical to SEQ ID NO: 327718

SEQ ID NO: 555179 - RNA, 64 nt, Homo Sapiens; identical to SEQ ID NO: 327719

SEQ ID NO: 555180 - RNA, 64 nt, Homo Sapiens; identical to SEQ ID NO: 327720

SEQ ID NO: 555181 - RNA, 64 nt, Homo Sapiens; identical to SEQ ID NO: 327721

SEQ ID NO: 555182 - RNA, 64 nt, Homo Sapiens; identical to SEQ ID NO: 327722

SEQ ID NO: 555183 - RNA, 64 nt, Homo Sapiens; identical to SEQ ID NO: 327723

SEQ ID NO: 555184 - RNA, 64 nt, Homo Sapiens; identical to SEQ ID NO: 327724

SEQ ID NO: 555185 - RNA, 64 nt, Homo Sapiens; identical to SEQ ID NO: 327725

SEQ ID NO: 555186 - RNA, 51 nt, Homo Sapiens; identical to SEQ ID NO: 327726

SEQ ID NO: 555187 - RNA, 64 nt, Homo Sapiens; identical to SEQ ID NO: 327727

SEQ ID NO: 555188 - RNA, 64 nt, Homo Sapiens; identical to SEQ ID NO: 327728

SEQ ID NO: 555189 - RNA, 64 nt, Homo Sapiens; identical to SEQ ID NO: 327729

SEQ ID NO: 555190 - RNA, 64 nt, Homo Sapiens; identical to SEQ ID NO: 327730

SEQ ID NO: 555191 - RNA, 64 nt, Homo Sapiens; identical to SEQ ID NO: 327731

SEQ ID NO: 555192 - RNA, 64 nt, Homo Sapiens; identical to SEQ ID NO: 327732

SEQ ID NO: 555193 - RNA, 64 nt, Homo Sapiens; identical to SEQ ID NO: 327733

SEQ ID NO: 555194 - RNA, 64 nt, Homo Sapiens; identical to SEQ ID NO: 327734

SEQ ID NO: 555195 - RNA, 64 nt, Homo Sapiens; identical to SEQ ID NO: 327735

SEQ ID NO: 555196 - RNA, 64 nt, Homo Sapiens; identical to SEQ ID NO: 327736

SEQ ID NO: 555197 - RNA, 64 nt, Homo Sapiens; identical to SEQ ID NO: 327737

SEQ ID NO: 555198 - RNA, 64 nt, Homo Sapiens; identical to SEQ ID NO: 327738

SEQ ID NO: 555199 - RNA, 64 nt, Homo Sapiens; identical to SEQ ID NO: 327739

SEQ ID NO: 555200 - RNA, 64 nt, Homo Sapiens; identical to SEQ ID NO: 327740

SEQ ID NO: 555201 - RNA, 64 nt, Homo Sapiens; identical to SEQ ID NO: 327741

SEQ ID NO: 555202 - RNA, 64 nt, Homo Sapiens; identical to SEQ ID NO: 327742

SEQ ID NO: 555203 - RNA, 64 nt, Homo Sapiens; identical to SEQ ID NO: 327743

SEQ ID NO: 555204 - RNA, 64 nt, Homo Sapiens; identical to SEQ ID NO: 327744

SEQ ID NO: 555205 - RNA, 64 nt, Homo Sapiens; identical to SEQ ID NO: 327745

SEQ ID NO: 555206 - RNA, 64 nt, Homo Sapiens; identical to SEQ ID NO: 327746

SEQ ID NO: 555207 - RNA, 64 nt, Homo Sapiens; identical to SEQ ID NO: 327747

SEQ ID NO: 555208 - RNA, 64 nt, Homo Sapiens; identical to SEQ ID NO: 327748

SEQ ID NO: 555209 - RNA, 64 nt, Homo Sapiens; identical to SEQ ID NO: 327749

SEQ ID NO: 555210 - RNA, 64 nt, Homo Sapiens; identical to SEQ ID NO: 327750

SEQ ID NO: 555211 - RNA, 64 nt, Homo Sapiens; identical to SEQ ID NO: 327751

SEQ ID NO: 555212 - RNA, 64 nt, Homo Sapiens; identical to SEQ ID NO: 327752

SEQ ID NO: 555213 - RNA, 64 nt, Homo Sapiens; identical to SEQ ID NO: 327753

SEQ ID NO: 555214 - RNA, 64 nt, Homo Sapiens; identical to SEQ ID NO: 327754

SEQ ID NO: 555215 - RNA, 64 nt, Homo Sapiens; identical to SEQ ID NO: 327755

SEQ ID NO: 555216 - RNA, 64 nt, Homo Sapiens; identical to SEQ ID NO: 327756

SEQ ID NO: 555217 - RNA, 64 nt, Homo Sapiens; identical to SEQ ID NO: 327757

SEQ ID NO: 555218 - RNA, 64 nt, Homo Sapiens; identical to SEQ ID NO: 327758

SEQ ID NO: 555219 - RNA, 64 nt, Homo Sapiens; identical to SEQ ID NO: 327759

SEQ ID NO: 555220 - RNA, 64 nt, Homo Sapiens; identical to SEQ ID NO: 327760

SEQ ID NO: 555221 - RNA, 64 nt, Homo Sapiens; identical to SEQ ID NO: 327761

SEQ ID NO: 555222 - RNA, 64 nt, Homo Sapiens; identical to SEQ ID NO: 327762

SEQ ID NO: 555223 - RNA, 64 nt, Homo Sapiens; identical to SEQ ID NO: 327763

SEQ ID NO: 555224 - RNA, 64 nt, Homo Sapiens; identical to SEQ ID NO: 327764

SEQ ID NO: 555225 - RNA, 64 nt, Homo Sapiens; identical to SEQ ID NO: 327765

SEQ ID NO: 555226 - RNA, 64 nt, Homo Sapiens; identical to SEQ ID NO: 327766

SEQ ID NO: 555227 - RNA, 64 nt, Homo Sapiens; identical to SEQ ID NO: 327767

SEQ ID NO: 555228 - RNA, 64 nt, Homo Sapiens; identical to SEQ ID NO: 327768

SEQ ID NO: 555229 - RNA, 64 nt, Homo Sapiens; identical to SEQ ID NO: 327769

SEQ ID NO: 555230 - RNA, 64 nt, Homo Sapiens; identical to SEQ ID NO: 327770

SEQ ID NO: 555231 - RNA, 64 nt, Homo Sapiens; identical to SEQ ID NO: 327771

SEQ ID NO: 555232 - RNA, 64 nt, Homo Sapiens; identical to SEQ ID NO: 327772

SEQ ID NO: 555233 - RNA, 64 nt, Homo Sapiens; identical to SEQ ID NO: 327773

SEQ ID NO: 555234 - RNA, 64 nt, Homo Sapiens; identical to SEQ ID NO: 327774

SEQ ID NO: 555235 - RNA, 64 nt, Homo Sapiens; identical to SEQ ID NO: 327775

SEQ ID NO: 555236 - RNA, 64 nt, Homo Sapiens; identical to SEQ ID NO: 327776

SEQ ID NO: 555237 - RNA, 64 nt, Homo Sapiens; identical to SEQ ID NO: 327777

SEQ ID NO: 555238 - RNA, 64 nt, Homo Sapiens; identical to SEQ ID NO: 327778

SEQ ID NO: 555239 - RNA, 64 nt, Homo Sapiens; identical to SEQ ID NO: 327779

SEQ ID NO: 555240 - RNA, 64 nt, Homo Sapiens; identical to SEQ ID NO: 327780

SEQ ID NO: 555241 - RNA, 64 nt, Homo Sapiens; identical to SEQ ID NO: 327781

SEQ ID NO: 555242 - RNA, 64 nt, Homo Sapiens; identical to SEQ ID NO: 327782

SEQ ID NO: 555243 - RNA, 64 nt, Homo Sapiens; identical to SEQ ID NO: 327783

SEQ ID NO: 555244 - RNA, 64 nt, Homo Sapiens; identical to SEQ ID NO: 327784

SEQ ID NO: 555245 - RNA, 64 nt, Homo Sapiens; identical to SEQ ID NO: 327785

SEQ ID NO: 555246 - RNA, 64 nt, Homo Sapiens; identical to SEQ ID NO: 327786

SEQ ID NO: 555247 - RNA, 64 nt, Homo Sapiens; identical to SEQ ID NO: 327787

SEQ ID NO: 555248 - RNA, 64 nt, Homo Sapiens; identical to SEQ ID NO: 327788

SEQ ID NO: 555249 - RNA, 64 nt, Homo Sapiens; identical to SEQ ID NO: 327789

SEQ ID NO: 555250 - RNA, 64 nt, Homo Sapiens; identical to SEQ ID NO: 327790

SEQ ID NO: 555251 - RNA, 64 nt, Homo Sapiens; identical to SEQ ID NO: 327791

SEQ ID NO: 555252 - RNA, 64 nt, Homo Sapiens; identical to SEQ ID NO: 327792

SEQ ID NO: 555253 - RNA, 64 nt, Homo Sapiens; identical to SEQ ID NO: 327793

SEQ ID NO: 555254 - RNA, 64 nt, Homo Sapiens; identical to SEQ ID NO: 327794

SEQ ID NO: 555255 - RNA, 64 nt, Homo Sapiens; identical to SEQ ID NO: 327795

SEQ ID NO: 555256 - RNA, 64 nt, Homo Sapiens; identical to SEQ ID NO: 327796

SEQ ID NO: 555257 - RNA, 64 nt, Homo Sapiens; identical to SEQ ID NO: 327797

SEQ ID NO: 555258 - RNA, 64 nt, Homo Sapiens; identical to SEQ ID NO: 327798

SEQ ID NO: 555259 - RNA, 64 nt, Homo Sapiens; identical to SEQ ID NO: 327799

SEQ ID NO: 555260 - RNA, 64 nt, Homo Sapiens; identical to SEQ ID NO: 327800

SEQ ID NO: 555261 - RNA, 64 nt, Homo Sapiens; identical to SEQ ID NO: 327801

SEQ ID NO: 555262 - RNA, 64 nt, Homo Sapiens; identical to SEQ ID NO: 327802

SEQ ID NO: 555263 - RNA, 64 nt, Homo Sapiens; identical to SEQ ID NO: 327803

SEQ ID NO: 555264 - RNA, 64 nt, Homo Sapiens; identical to SEQ ID NO: 327804

SEQ ID NO: 555265 - RNA, 64 nt, Homo Sapiens; identical to SEQ ID NO: 327805

SEQ ID NO: 555266 - RNA, 64 nt, Homo Sapiens; identical to SEQ ID NO: 327806

SEQ ID NO: 555267 - RNA, 64 nt, Homo Sapiens; identical to SEQ ID NO: 327807

SEQ ID NO: 555268 - RNA, 64 nt, Homo Sapiens; identical to SEQ ID NO: 327808

SEQ ID NO: 555269 - RNA, 64 nt, Homo Sapiens; identical to SEQ ID NO: 327809

SEQ ID NO: 555270 - RNA, 64 nt, Homo Sapiens; identical to SEQ ID NO: 327810

SEQ ID NO: 555271 - RNA, 64 nt, Homo Sapiens; identical to SEQ ID NO: 327811

SEQ ID NO: 555272 - RNA, 64 nt, Homo Sapiens; identical to SEQ ID NO: 327812

SEQ ID NO: 555273 - RNA, 64 nt, Homo Sapiens; identical to SEQ ID NO: 327813

SEQ ID NO: 555274 - RNA, 64 nt, Homo Sapiens; identical to SEQ ID NO: 327814

SEQ ID NO: 555275 - RNA, 64 nt, Homo Sapiens; identical to SEQ ID NO: 327815

SEQ ID NO: 555276 - RNA, 64 nt, Homo Sapiens; identical to SEQ ID NO: 327816

SEQ ID NO: 555277 - RNA, 64 nt, Homo Sapiens; identical to SEQ ID NO: 327817

SEQ ID NO: 555278 - RNA, 64 nt, Homo Sapiens; identical to SEQ ID NO: 327818

SEQ ID NO: 555279 - RNA, 64 nt, Homo Sapiens; identical to SEQ ID NO: 327819

SEQ ID NO: 555280 - RNA, 64 nt, Homo Sapiens; identical to SEQ ID NO: 327820

SEQ ID NO: 555281 - RNA, 64 nt, Homo Sapiens; identical to SEQ ID NO: 327821

SEQ ID NO: 555282 - RNA, 64 nt, Homo Sapiens; identical to SEQ ID NO: 327822

SEQ ID NO: 555283 - RNA, 64 nt, Homo Sapiens; identical to SEQ ID NO: 327823

SEQ ID NO: 555284 - RNA, 64 nt, Homo Sapiens; identical to SEQ ID NO: 327824

SEQ ID NO: 555285 - RNA, 64 nt, Homo Sapiens; identical to SEQ ID NO: 327825

SEQ ID NO: 555286 - RNA, 64 nt, Homo Sapiens; identical to SEQ ID NO: 327826

SEQ ID NO: 555287 - RNA, 64 nt, Homo Sapiens; identical to SEQ ID NO: 327827

SEQ ID NO: 555288 - RNA, 64 nt, Homo Sapiens; identical to SEQ ID NO: 327828

SEQ ID NO: 555289 - RNA, 64 nt, Homo Sapiens; identical to SEQ ID NO: 327829

SEQ ID NO: 555290 - RNA, 64 nt, Homo Sapiens; identical to SEQ ID NO: 327830

SEQ ID NO: 555291 - RNA, 64 nt, Homo Sapiens
uacuucuguuacauaauuaaucucaagacuaucuuaagcuaaugaaucacagaauugauauuua

SEQ ID NO: 555292 - RNA, 64 nt, Homo Sapiens
uagcuuguuuuguugaaauuguauaagcagaagauaagcuaauaaacauuugaguuuguuuaag

SEQ ID NO: 555293 - RNA, 64 nt, Homo Sapiens
gaauucaagguugguucaacaucuaaaaaucaaauaagcuaauauacagucaguucucauuauu

SEQ ID NO: 555294 - RNA, 64 nt, Homo Sapiens
gaauucaagguuuguucaacaucuaaaaaucaaauaagcuaauaaagaaaagagguuuauacug

SEQ ID NO: 555295 - RNA, 64 nt, Homo Sapiens
ucuagugacccaugugucaagccuuuguuguauauaagcuaaauuggugaguuuaguugugcau

SEQ ID NO: 555296 - RNA, 64 nt, Homo Sapiens
aagggcgaugauuauuauuacaucuggagaagcauaagcuaauuacucauuuuauucucggcaa

SEQ ID NO: 555297 - RNA, 64 nt, Homo Sapiens
ccaaaggccgcccaugcugacgugcaggcacacucagcgcuaagaggaaaggcaggagccaguc

SEQ ID NO: 555298 - RNA, 64 nt, Homo Sapiens
uuugaaugcccucacuauugauacaucuuguacccagcgcuaauuggcuucaguguuuugaaaa

SEQ ID NO: 555299 - RNA, 59 nt, Homo Sapiens; identical to SEQ ID NO: 97671

SEQ ID NO: 555300 - RNA, 59 nt, Homo Sapiens; identical to SEQ ID NO: 97672

SEQ ID NO: 555301 - RNA, 59 nt, Homo Sapiens; identical to SEQ ID NO: 97673

SEQ ID NO: 555302 - RNA, 59 nt, Homo Sapiens; identical to SEQ ID NO: 97674

SEQ ID NO: 555303 - RNA, 64 nt, Homo Sapiens; identical to SEQ ID NO: 69124

SEQ ID NO: 555304 - RNA, 64 nt, Homo Sapiens; identical to SEQ ID NO: 69125

SEQ ID NO: 555305 - RNA, 64 nt, Homo Sapiens; identical to SEQ ID NO: 69126

SEQ ID NO: 555306 - RNA, 64 nt, Homo Sapiens; identical to SEQ ID NO: 69127

SEQ ID NO: 555307 - RNA, 64 nt, Homo Sapiens; identical to SEQ ID NO: 69128

SEQ ID NO: 555308 - RNA, 64 nt, Homo Sapiens; identical to SEQ ID NO: 69129

SEQ ID NO: 555309 - RNA, 64 nt, Homo Sapiens; identical to SEQ ID NO: 257640

SEQ ID NO: 555310 - RNA, 64 nt, Homo Sapiens; identical to SEQ ID NO: 257641

SEQ ID NO: 555311 - RNA, 64 nt, Homo Sapiens; identical to SEQ ID NO: 257642

SEQ ID NO: 555312 - RNA, 64 nt, Homo Sapiens; identical to SEQ ID NO: 257642

SEQ ID NO: 555313 - RNA, 64 nt, Homo Sapiens; identical to SEQ ID NO: 257644

SEQ ID NO: 555314 - RNA, 64 nt, Homo Sapiens; identical to SEQ ID NO: 257645

SEQ ID NO: 555315 - RNA, 64 nt, Homo Sapiens; identical to SEQ ID NO: 257646

SEQ ID NO: 555316 - RNA, 64 nt, Homo Sapiens; identical to SEQ ID NO: 257647

SEQ ID NO: 555317 - RNA, 64 nt, Homo Sapiens; identical to SEQ ID NO: 216073

SEQ ID NO: 555318 - RNA, 64 nt, Homo Sapiens; identical to SEQ ID NO: 216074

SEQ ID NO: 555319 - RNA, 64 nt, Homo Sapiens; identical to SEQ ID NO: 216075

SEQ ID NO: 555320 - RNA, 64 nt, Homo Sapiens; identical to SEQ ID NO: 216076

SEQ ID NO: 555321 - RNA, 64 nt, Homo Sapiens; identical to SEQ ID NO: 216077

SEQ ID NO: 555322 - RNA, 64 nt, Homo Sapiens; identical to SEQ ID NO: 216078

SEQ ID NO: 555323 - RNA, 64 nt, Homo Sapiens; identical to SEQ ID NO: 216079

SEQ ID NO: 555324 - RNA, 64 nt, Homo Sapiens; identical to SEQ ID NO: 216080

SEQ ID NO: 555325 - RNA, 64 nt, Homo Sapiens; identical to SEQ ID NO: 216081

SEQ ID NO: 555326 - RNA, 64 nt, Homo Sapiens; identical to SEQ ID NO: 216082

SEQ ID NO: 555327 - RNA, 64 nt, Homo Sapiens; identical to SEQ ID NO: 216083

SEQ ID NO: 555328 - RNA, 64 nt, Homo Sapiens; identical to SEQ ID NO: 216084

SEQ ID NO: 555329 - RNA, 64 nt, Homo Sapiens; identical to SEQ ID NO: 216085

SEQ ID NO: 555330 - RNA, 64 nt, Homo Sapiens; identical to SEQ ID NO: 216086

SEQ ID NO: 555331 - RNA, 64 nt, Homo Sapiens; identical to SEQ ID NO: 216087

SEQ ID NO: 555332 - RNA, 64 nt, Homo Sapiens; identical to SEQ ID NO: 216088

SEQ ID NO: 555333 - RNA, 64 nt, Homo Sapiens; identical to SEQ ID NO: 216089

SEQ ID NO: 555334 - RNA, 64 nt, Homo Sapiens; identical to SEQ ID NO: 216090

SEQ ID NO: 555335 - RNA, 64 nt, Homo Sapiens; identical to SEQ ID NO: 216091

SEQ ID NO: 555336 - RNA, 64 nt, Homo Sapiens; identical to SEQ ID NO: 216092

SEQ ID NO: 555337 - RNA, 64 nt, Homo Sapiens; identical to SEQ ID NO: 216093

SEQ ID NO: 555338 - RNA, 64 nt, Homo Sapiens; identical to SEQ ID NO: 216094

SEQ ID NO: 555339 - RNA, 64 nt, Homo Sapiens; identical to SEQ ID NO: 216095

SEQ ID NO: 555340 - RNA, 64 nt, Homo Sapiens; identical to SEQ ID NO: 216096

SEQ ID NO: 555341 - RNA, 64 nt, Homo Sapiens; identical to SEQ ID NO: 216097

SEQ ID NO: 555342 - RNA, 64 nt, Homo Sapiens; identical to SEQ ID NO: 216098

SEQ ID NO: 555343 - RNA, 64 nt, Homo Sapiens; identical to SEQ ID NO: 216099

SEQ ID NO: 555344 - RNA, 64 nt, Homo Sapiens; identical to SEQ ID NO: 216100

SEQ ID NO: 555345 - RNA, 64 nt, Homo Sapiens; identical to SEQ ID NO: 216101

SEQ ID NO: 555346 - RNA, 64 nt, Homo Sapiens; identical to SEQ ID NO: 216102

SEQ ID NO: 555347 - RNA, 64 nt, Homo Sapiens; identical to SEQ ID NO: 216103

SEQ ID NO: 555348 - RNA, 64 nt, Homo Sapiens; identical to SEQ ID NO: 216104

SEQ ID NO: 555349 - RNA, 64 nt, Homo Sapiens; identical to SEQ ID NO: 216105

SEQ ID NO: 555350 - RNA, 64 nt, Homo Sapiens; identical to SEQ ID NO: 216106

SEQ ID NO: 555351 - RNA, 64 nt, Homo Sapiens; identical to SEQ ID NO: 216107

SEQ ID NO: 555352 - RNA, 64 nt, Homo Sapiens; identical to SEQ ID NO: 216108

SEQ ID NO: 555353 - RNA, 64 nt, Homo Sapiens; identical to SEQ ID NO: 216109

SEQ ID NO: 555354 - RNA, 64 nt, Homo Sapiens; identical to SEQ ID NO: 216110

SEQ ID NO: 555355 - RNA, 64 nt, Homo Sapiens; identical to SEQ ID NO: 216111

SEQ ID NO: 555356 - RNA, 64 nt, Homo Sapiens; identical to SEQ ID NO: 216112

SEQ ID NO: 555357 - RNA, 64 nt, Homo Sapiens; identical to SEQ ID NO: 216113

SEQ ID NO: 555358 - RNA, 64 nt, Homo Sapiens; identical to SEQ ID NO: 216114

SEQ ID NO: 555359 - RNA, 64 nt, Homo Sapiens; identical to SEQ ID NO: 216115

SEQ ID NO: 555360 - RNA, 64 nt, Homo Sapiens; identical to SEQ ID NO: 216116

SEQ ID NO: 555361 - RNA, 64 nt, Homo Sapiens; identical to SEQ ID NO: 216117

SEQ ID NO: 555362 - RNA, 64 nt, Homo Sapiens; identical to SEQ ID NO: 216118

SEQ ID NO: 555363 - RNA, 64 nt, Homo Sapiens; identical to SEQ ID NO: 216119

SEQ ID NO: 555364 - RNA, 64 nt, Homo Sapiens; identical to SEQ ID NO: 216120

SEQ ID NO: 555365 - RNA, 64 nt, Homo Sapiens; identical to SEQ ID NO: 216121

SEQ ID NO: 555366 - RNA, 64 nt, Homo Sapiens; identical to SEQ ID NO: 216121

SEQ ID NO: 555367 - RNA, 64 nt, Homo Sapiens; identical to SEQ ID NO: 216123

SEQ ID NO: 555368 - RNA, 64 nt, Homo Sapiens; identical to SEQ ID NO: 216124

SEQ ID NO: 555369 - RNA, 64 nt, Homo Sapiens; identical to SEQ ID NO: 216125

SEQ ID NO: 555370 - RNA, 64 nt, Homo Sapiens; identical to SEQ ID NO: 216126

SEQ ID NO: 555371 - RNA, 64 nt, Homo Sapiens; identical to SEQ ID NO: 216127

SEQ ID NO: 555372 - RNA, 64 nt, Homo Sapiens; identical to SEQ ID NO: 216128

SEQ ID NO: 555373 - RNA, 64 nt, Homo Sapiens; identical to SEQ ID NO: 216129

SEQ ID NO: 555374 - RNA, 64 nt, Homo Sapiens; identical to SEQ ID NO: 216130

SEQ ID NO: 555375 - RNA, 64 nt, Homo Sapiens; identical to SEQ ID NO: 216131

SEQ ID NO: 555376 - RNA, 64 nt, Homo Sapiens; identical to SEQ ID NO: 216132

SEQ ID NO: 555377 - RNA, 64 nt, Homo Sapiens; identical to SEQ ID NO: 216133

SEQ ID NO: 555378 - RNA, 64 nt, Homo Sapiens; identical to SEQ ID NO: 216134

SEQ ID NO: 555379 - RNA, 64 nt, Homo Sapiens; identical to SEQ ID NO: 216135

SEQ ID NO: 555380 - RNA, 64 nt, Homo Sapiens; identical to SEQ ID NO: 216136

SEQ ID NO: 555381 - RNA, 64 nt, Homo Sapiens; identical to SEQ ID NO: 216137

SEQ ID NO: 555382 - RNA, 64 nt, Homo Sapiens; identical to SEQ ID NO: 216138

SEQ ID NO: 555383 - RNA, 64 nt, Homo Sapiens; identical to SEQ ID NO: 216139

SEQ ID NO: 555384 - RNA, 64 nt, Homo Sapiens; identical to SEQ ID NO: 216140

SEQ ID NO: 555385 - RNA, 64 nt, Homo Sapiens; identical to SEQ ID NO: 216141

SEQ ID NO: 555386 - RNA, 64 nt, Homo Sapiens; identical to SEQ ID NO: 216142

SEQ ID NO: 555387 - RNA, 64 nt, Homo Sapiens; identical to SEQ ID NO: 216143

SEQ ID NO: 555388 - RNA, 64 nt, Homo Sapiens; identical to SEQ ID NO: 474199

SEQ ID NO: 555389 - RNA, 64 nt, Homo Sapiens; identical to SEQ ID NO: 474200

SEQ ID NO: 555390 - RNA, 64 nt, Homo Sapiens; identical to SEQ ID NO: 474201

SEQ ID NO: 555391 - RNA, 64 nt, Homo Sapiens; identical to SEQ ID NO: 474202

SEQ ID NO: 555392 - RNA, 64 nt, Homo Sapiens; identical to SEQ ID NO: 474203

SEQ ID NO: 555393 - RNA, 64 nt, Homo Sapiens; identical to SEQ ID NO: 474204

SEQ ID NO: 555394 - RNA, 64 nt, Homo Sapiens; identical to SEQ ID NO: 474205

SEQ ID NO: 555395 - RNA, 64 nt, Homo Sapiens; identical to SEQ ID NO: 474206

SEQ ID NO: 555396 - RNA, 64 nt, Homo Sapiens; identical to SEQ ID NO: 474207

SEQ ID NO: 555397 - RNA, 64 nt, Homo Sapiens; identical to SEQ ID NO: 474208

SEQ ID NO: 555398 - RNA, 64 nt, Homo Sapiens; identical to SEQ ID NO: 164108

SEQ ID NO: 555399 - RNA, 64 nt, Homo Sapiens; identical to SEQ ID NO: 164109

SEQ ID NO: 555400 - RNA, 64 nt, Homo Sapiens; identical to SEQ ID NO: 164110

SEQ ID NO: 555401 - RNA, 64 nt, Homo Sapiens; identical to SEQ ID NO: 164111

SEQ ID NO: 555402 - RNA, 64 nt, Homo Sapiens; identical to SEQ ID NO: 164112

SEQ ID NO: 555403 - RNA, 64 nt, Homo Sapiens; identical to SEQ ID NO: 164113

SEQ ID NO: 555404 - RNA, 64 nt, Homo Sapiens; identical to SEQ ID NO: 164114

SEQ ID NO: 555405 - RNA, 64 nt, Homo Sapiens; identical to SEQ ID NO: 164115

SEQ ID NO: 555406 - RNA, 64 nt, Homo Sapiens; identical to SEQ ID NO: 164116

SEQ ID NO: 555407 - RNA, 64 nt, Homo Sapiens; identical to SEQ ID NO: 164117

SEQ ID NO: 555408 - RNA, 64 nt, Homo Sapiens; identical to SEQ ID NO: 164118

SEQ ID NO: 555409 - RNA, 64 nt, Homo Sapiens; identical to SEQ ID NO: 164119

SEQ ID NO: 555410 - RNA, 64 nt, Homo Sapiens; identical to SEQ ID NO: 164120

SEQ ID NO: 555411 - RNA, 64 nt, Homo Sapiens; identical to SEQ ID NO: 164121

SEQ ID NO: 555412 - RNA, 64 nt, Homo Sapiens; identical to SEQ ID NO: 164122

SEQ ID NO: 555413 - RNA, 64 nt, Homo Sapiens; identical to SEQ ID NO: 164123

SEQ ID NO: 555414 - RNA, 64 nt, Homo Sapiens; identical to SEQ ID NO: 164124

SEQ ID NO: 555415 - RNA, 64 nt, Homo Sapiens; identical to SEQ ID NO: 164125

SEQ ID NO: 555416 - RNA, 64 nt, Homo Sapiens; identical to SEQ ID NO: 164126

SEQ ID NO: 555417 - RNA, 64 nt, Homo Sapiens; identical to SEQ ID NO: 164127

SEQ ID NO: 555418 - RNA, 64 nt, Homo Sapiens; identical to SEQ ID NO: 164128

SEQ ID NO: 555419 - RNA, 64 nt, Homo Sapiens; identical to SEQ ID NO: 164129

SEQ ID NO: 555420 - RNA, 64 nt, Homo Sapiens; identical to SEQ ID NO: 164130

SEQ ID NO: 555421 - RNA, 64 nt, Homo Sapiens; identical to SEQ ID NO: 247598

SEQ ID NO: 555422 - RNA, 64 nt, Homo Sapiens; identical to SEQ ID NO: 247599

SEQ ID NO: 555423 - RNA, 64 nt, Homo Sapiens; identical to SEQ ID NO: 247600

SEQ ID NO: 555424 - RNA, 64 nt, Homo Sapiens; identical to SEQ ID NO: 247601

SEQ ID NO: 555425 - RNA, 64 nt, Homo Sapiens; identical to SEQ ID NO: 247602

SEQ ID NO: 555426 - RNA, 64 nt, Homo Sapiens; identical to SEQ ID NO: 247603

SEQ ID NO: 555427 - RNA, 64 nt, Homo Sapiens; identical to SEQ ID NO: 247604

SEQ ID NO: 555428 - RNA, 64 nt, Homo Sapiens; identical to SEQ ID NO: 247605

SEQ ID NO: 555429 - RNA, 64 nt, Homo Sapiens; identical to SEQ ID NO: 247606

SEQ ID NO: 555430 - RNA, 64 nt, Homo Sapiens; identical to SEQ ID NO: 247607

SEQ ID NO: 555431 - RNA, 64 nt, Homo Sapiens; identical to SEQ ID NO: 247608

SEQ ID NO: 555432 - RNA, 64 nt, Homo Sapiens; identical to SEQ ID NO: 247609

SEQ ID NO: 555433 - RNA, 64 nt, Homo Sapiens; identical to SEQ ID NO: 247610

SEQ ID NO: 555434 - RNA, 64 nt, Homo Sapiens; identical to SEQ ID NO: 247611

SEQ ID NO: 555435 - RNA, 64 nt, Homo Sapiens; identical to SEQ ID NO: 247612

SEQ ID NO: 555436 - RNA, 64 nt, Homo Sapiens; identical to SEQ ID NO: 247613

SEQ ID NO: 555437 - RNA, 58 nt, Homo Sapiens; identical to SEQ ID NO: 244172

SEQ ID NO: 555438 - RNA, 64 nt, Homo Sapiens; identical to SEQ ID NO: 244173

SEQ ID NO: 555439 - RNA, 64 nt, Homo Sapiens; identical to SEQ ID NO: 244174

SEQ ID NO: 555440 - RNA, 64 nt, Homo Sapiens; identical to SEQ ID NO: 244175

SEQ ID NO: 555441 - RNA, 64 nt, Homo Sapiens; identical to SEQ ID NO: 244176

SEQ ID NO: 555442 - RNA, 64 nt, Homo Sapiens; identical to SEQ ID NO: 244177

SEQ ID NO: 555443 - RNA, 64 nt, Homo Sapiens; identical to SEQ ID NO: 244178

SEQ ID NO: 555444 - RNA, 64 nt, Homo Sapiens; identical to SEQ ID NO: 244179

SEQ ID NO: 555445 - RNA, 64 nt, Homo Sapiens; identical to SEQ ID NO: 244180

SEQ ID NO: 555446 - RNA, 64 nt, Homo Sapiens; identical to SEQ ID NO: 244181

SEQ ID NO: 555447 - RNA, 64 nt, Homo Sapiens; identical to SEQ ID NO: 244182

SEQ ID NO: 555448 - RNA, 64 nt, Homo Sapiens; identical to SEQ ID NO: 244183

SEQ ID NO: 555449 - RNA, 64 nt, Homo Sapiens; identical to SEQ ID NO: 244184

SEQ ID NO: 555450 - RNA, 64 nt, Homo Sapiens; identical to SEQ ID NO: 244185

SEQ ID NO: 555451 - RNA, 64 nt, Homo Sapiens; identical to SEQ ID NO: 244186

SEQ ID NO: 555452 - RNA, 64 nt, Homo Sapiens; identical to SEQ ID NO: 244187

SEQ ID NO: 555453 - RNA, 64 nt, Homo Sapiens; identical to SEQ ID NO: 244188

SEQ ID NO: 555454 - RNA, 64 nt, Homo Sapiens; identical to SEQ ID NO: 244189

SEQ ID NO: 555455 - RNA, 64 nt, Homo Sapiens; identical to SEQ ID NO: 244190

SEQ ID NO: 555456 - RNA, 64 nt, Homo Sapiens; identical to SEQ ID NO: 244191

SEQ ID NO: 555457 - RNA, 64 nt, Homo Sapiens; identical to SEQ ID NO: 244192

SEQ ID NO: 555458 - RNA, 64 nt, Homo Sapiens; identical to SEQ ID NO: 244193

SEQ ID NO: 555459 - RNA, 64 nt, Homo Sapiens; identical to SEQ ID NO: 244194

SEQ ID NO: 555460 - RNA, 64 nt, Homo Sapiens; identical to SEQ ID NO: 244195

SEQ ID NO: 555461 - RNA, 64 nt, Homo Sapiens
cuugcuuuucuaacuaagagggcauuuccaaguuaaggcuaagacuccaugguggaaguuaaag

SEQ ID NO: 555462 - RNA, 64 nt, Homo Sapiens
gggaaaaaggauauguggaguucucuuggguauaaaggcuaaaauuacugguguccagcugagu

SEQ ID NO: 555463 - RNA, 64 nt, Homo Sapiens
aaacaaacaagcuacauucuaccuggucaucuucaaggcuaagauggucucacucugucucucu

SEQ ID NO: 555464 - RNA, 64 nt, Homo Sapiens
uaacguaguugggaaagguaagguuuaacaucccaaggcuaaccagccuugggaauaguuuggc

SEQ ID NO: 555465 - RNA, 64 nt, Homo Sapiens
accugguguguuucuugggaggaaaugggcagugaaggcuaagagaacacaucuugaguauuua

SEQ ID NO: 555466 - RNA, 64 nt, Homo Sapiens
gagauacacugauucuagguuuuuucccucagugaaggcuaaauaucaucuuuugaucuuuuag

SEQ ID NO: 555467 - RNA, 64 nt, Homo Sapiens
ucaauaguuuauaagcaguaauaauggcuucuucaaggcuaauaaauuauucaacuaagaacca

SEQ ID NO: 555468 - RNA, 64 nt, Homo Sapiens
uguaccuaacagcuuuuuauuuuauacuuugaugaaggcuaagggcuucuuuuaugagguguac

SEQ ID NO: 555469 - RNA, 64 nt, Homo Sapiens
ggcauauaauccuuccacacagccccugcagggaaaggcuaaucuuacggauaauccacgugag

SEQ ID NO: 555470 - RNA, 64 nt, Homo Sapiens
gugggguauuuguuucuacuccagccuggcaggcaaggcuaaaaccugagauuaucgaucuaug

SEQ ID NO: 555471 - RNA, 64 nt, Homo Sapiens
uggaaucaucacaccuauccaugagcagugggaaaaggcuaauguaagcaguccccaccgggag

SEQ ID NO: 555472 - RNA, 64 nt, Homo Sapiens
gucaaaaagccaaggaaaaaacagagcagaccugaaggcuaaucuuauuuuugccacuaacuua

SEQ ID NO: 555473 - RNA, 64 nt, Homo Sapiens; identical to SEQ ID NO: 58764

SEQ ID NO: 555474 - RNA, 64 nt, Homo Sapiens; identical to SEQ ID NO: 58765

SEQ ID NO: 555475 - RNA, 64 nt, Homo Sapiens; identical to SEQ ID NO: 58766

SEQ ID NO: 555476 - RNA, 64 nt, Homo Sapiens; identical to SEQ ID NO: 58767

SEQ ID NO: 555477 - RNA, 64 nt, Homo Sapiens; identical to SEQ ID NO: 58768

SEQ ID NO: 555478 - RNA, 64 nt, Homo Sapiens; identical to SEQ ID NO: 58769

SEQ ID NO: 555479 - RNA, 64 nt, Homo Sapiens; identical to SEQ ID NO: 58770

SEQ ID NO: 555480 - RNA, 64 nt, Homo Sapiens; identical to SEQ ID NO: 58771

SEQ ID NO: 555481 - RNA, 64 nt, Homo Sapiens; identical to SEQ ID NO: 58772

SEQ ID NO: 555482 - RNA, 64 nt, Homo Sapiens; identical to SEQ ID NO: 58773

SEQ ID NO: 555483 - RNA, 64 nt, Homo Sapiens; identical to SEQ ID NO: 58774

SEQ ID NO: 555484 - RNA, 64 nt, Homo Sapiens; identical to SEQ ID NO: 58775

SEQ ID NO: 555485 - RNA, 64 nt, Homo Sapiens; identical to SEQ ID NO: 310971

SEQ ID NO: 555486 - RNA, 64 nt, Homo Sapiens; identical to SEQ ID NO: 310972

SEQ ID NO: 555487 - RNA, 64 nt, Homo Sapiens; identical to SEQ ID NO: 310973

SEQ ID NO: 555488 - RNA, 64 nt, Homo Sapiens; identical to SEQ ID NO: 310974

SEQ ID NO: 555489 - RNA, 64 nt, Homo Sapiens; identical to SEQ ID NO: 310975

SEQ ID NO: 555490 - RNA, 64 nt, Homo Sapiens; identical to SEQ ID NO: 310976

SEQ ID NO: 555491 - RNA, 64 nt, Homo Sapiens; identical to SEQ ID NO: 310977

SEQ ID NO: 555492 - RNA, 64 nt, Homo Sapiens; identical to SEQ ID NO: 310978

SEQ ID NO: 555493 - RNA, 64 nt, Homo Sapiens; identical to SEQ ID NO: 310979

SEQ ID NO: 555494 - RNA, 64 nt, Homo Sapiens; identical to SEQ ID NO: 310980

SEQ ID NO: 555495 - RNA, 64 nt, Homo Sapiens; identical to SEQ ID NO: 310981

SEQ ID NO: 555496 - RNA, 64 nt, Homo Sapiens; identical to SEQ ID NO: 310982

SEQ ID NO: 555497 - RNA, 53 nt, Homo Sapiens; identical to SEQ ID NO: 310983

SEQ ID NO: 555498 - RNA, 64 nt, Homo Sapiens; identical to SEQ ID NO: 310984

SEQ ID NO: 555499 - RNA, 64 nt, Homo Sapiens; identical to SEQ ID NO: 310985

SEQ ID NO: 555500 - RNA, 64 nt, Homo Sapiens; identical to SEQ ID NO: 310986

SEQ ID NO: 555501 - RNA, 64 nt, Homo Sapiens; identical to SEQ ID NO: 310987

SEQ ID NO: 555502 - RNA, 64 nt, Homo Sapiens; identical to SEQ ID NO: 310988

SEQ ID NO: 555503 - RNA, 64 nt, Homo Sapiens; identical to SEQ ID NO: 310989

SEQ ID NO: 555504 - RNA, 64 nt, Homo Sapiens; identical to SEQ ID NO: 310990

SEQ ID NO: 555505 - RNA, 64 nt, Homo Sapiens; identical to SEQ ID NO: 310991

SEQ ID NO: 555506 - RNA, 64 nt, Homo Sapiens; identical to SEQ ID NO: 310992

SEQ ID NO: 555507 - RNA, 64 nt, Homo Sapiens; identical to SEQ ID NO: 310993

SEQ ID NO: 555508 - RNA, 64 nt, Homo Sapiens; identical to SEQ ID NO: 310994

SEQ ID NO: 555509 - RNA, 63 nt, Homo Sapiens; identical to SEQ ID NO: 310995

SEQ ID NO: 555510 - RNA, 64 nt, Homo Sapiens; identical to SEQ ID NO: 310996

SEQ ID NO: 555511 - RNA, 64 nt, Homo Sapiens; identical to SEQ ID NO: 310997

SEQ ID NO: 555512 - RNA, 64 nt, Homo Sapiens; identical to SEQ ID NO: 310998

SEQ ID NO: 555513 - RNA, 64 nt, Homo Sapiens; identical to SEQ ID NO: 310999

SEQ ID NO: 555514 - RNA, 64 nt, Homo Sapiens; identical to SEQ ID NO: 311000

SEQ ID NO: 555515 - RNA, 64 nt, Homo Sapiens; identical to SEQ ID NO: 311001

SEQ ID NO: 555516 - RNA, 64 nt, Homo Sapiens; identical to SEQ ID NO: 311002

SEQ ID NO: 555517 - RNA, 64 nt, Homo Sapiens; identical to SEQ ID NO: 311003

SEQ ID NO: 555518 - RNA, 64 nt, Homo Sapiens; identical to SEQ ID NO: 311004

SEQ ID NO: 555519 - RNA, 64 nt, Homo Sapiens; identical to SEQ ID NO: 311005

SEQ ID NO: 555520 - RNA, 64 nt, Homo Sapiens; identical to SEQ ID NO: 311006

SEQ ID NO: 555521 - RNA, 64 nt, Homo Sapiens; identical to SEQ ID NO: 311007

SEQ ID NO: 555522 - RNA, 64 nt, Homo Sapiens; identical to SEQ ID NO: 311008

SEQ ID NO: 555523 - RNA, 64 nt, Homo Sapiens; identical to SEQ ID NO: 311009

SEQ ID NO: 555524 - RNA, 64 nt, Homo Sapiens; identical to SEQ ID NO: 311010

SEQ ID NO: 555525 - RNA, 64 nt, Homo Sapiens; identical to SEQ ID NO: 311011

SEQ ID NO: 555526 - RNA, 64 nt, Homo Sapiens; identical to SEQ ID NO: 311012

SEQ ID NO: 555527 - RNA, 64 nt, Homo Sapiens; identical to SEQ ID NO: 311013

SEQ ID NO: 555528 - RNA, 64 nt, Homo Sapiens; identical to SEQ ID NO: 311014

SEQ ID NO: 555529 - RNA, 64 nt, Homo Sapiens; identical to SEQ ID NO: 311015

SEQ ID NO: 555530 - RNA, 64 nt, Homo Sapiens
ggacuaacuguaucacuuaauuuuuaccuuauuuuggcucuaauuugaauaagcugaguaaaac

SEQ ID NO: 555531 - RNA, 64 nt, Homo Sapiens
ccuaaagauuuaucugcauauucuuuuucccauguggcucuacucauuugcaacugaauuuaau

SEQ ID NO: 555532 - RNA, 64 nt, Homo Sapiens
aaacugaggcaacacuaacagcuaaugacccagauggcucuauuuggguaauuuaccuacaacu

SEQ ID NO: 555533 - RNA, 64 nt, Homo Sapiens
auaguuaaugcugaauuuuuuuuuaaguuuccucuggcucuauuuauguuacuuuuugcgauaa

SEQ ID NO: 555534 - RNA, 61 nt, Homo Sapiens
aucccuggacucccugguccggaaggaauggagagagcaggggauaggagaaaguugguga

SEQ ID NO: 555535 - RNA, 61 nt, Homo Sapiens
auucuguaauccucuugcccacuaaugcucaagagagcaagcagagaggaccagggugaga

SEQ ID NO: 555536 - RNA, 61 nt, Homo Sapiens
gcacacacuggcucaagcaggcuagggaagcagagagcagagggaugagaaggauggcggg

SEQ ID NO: 555537 - RNA, 61 nt, Homo Sapiens
gcaugcagugauggaagaagaccagggaagcagagagcagaggaaacuuuuagguggugga

SEQ ID NO: 555538 - RNA, 61 nt, Homo Sapiens
gcauaugcugacccaugcagacagaggagguagagagcaggaggcugcaggcagugucagg

SEQ ID NO: 555539 - RNA, 61 nt, Homo Sapiens
ccaaucagucccucaggaaaaauugaauagcagagagcaaaaggaacaagugggcuugggg

SEQ ID NO: 555540 - RNA, 61 nt, Homo Sapiens
ccccccaaaaaaaagaaaaacaacugcagucagagagcaaggccaggacccuggggccccu

SEQ ID NO: 555541 - RNA, 61 nt, Homo Sapiens
agcuaacuuuuuuuuccuagugugacuaugaagagagcaaagaaaagucacaagaugagcu

SEQ ID NO: 555542 - RNA, 61 nt, Homo Sapiens
caggugggugguuucacaucagucaccaccgagagagcaccauuugaucccuugaacagaa

SEQ ID NO: 555543 - RNA, 61 nt, Homo Sapiens
aggucuauagaaacaucaugcauugucaccuagagagcaagacaccuuugcccuggcucug

SEQ ID NO: 555544 - RNA, 61 nt, Homo Sapiens
ccaguugauuuuuuaauucauucaggugggaagagagcaaauauuaaugcagucaucccuu

SEQ ID NO: 555545 - RNA, 61 nt, Homo Sapiens
uggcucaggcaucgucucccgcaaugggcagagagagcagagacagguggaccaacagaca

SEQ ID NO: 555546 - RNA, 61 nt, Homo Sapiens
ggccuagccucucuguccuucccugagucacagagagcaagccaagacauccagggaaaga

SEQ ID NO: 555547 - RNA, 61 nt, Homo Sapiens
uucccuuggcucuggggccguugcaacccagagagagcagcuugcugcaaaacugguuggc

SEQ ID NO: 555548 - RNA, 61 nt, Homo Sapiens
gcauccuggcaucugcgaucaccccauugggagagagcagggccccgaagguccugccuuc

SEQ ID NO: 555549 - RNA, 61 nt, Homo Sapiens
aaugacaucucaggggccagaggaacuguccagagagcaacucugagaucuaaggauguca

SEQ ID NO: 555550 - RNA, 61 nt, Homo Sapiens
ccaacuugagggcccagagcaggaagcauucagagagcagcuuuaaacucagggacagagc

SEQ ID NO: 555551 - RNA, 61 nt, Homo Sapiens
gggucugggaagagguaagaucugauaauucagagagcauuuuacuggguucuaaaugcuc

SEQ ID NO: 555552 - RNA, 61 nt, Homo Sapiens
agugccuggccaggucggucuggcaaggacuagagagcaggucuuggagacagaugaugac

SEQ ID NO: 555553 - RNA, 61 nt, Homo Sapiens
acuccgcaucaccucaccaaacgccugcaggagagagcagcaccugcucuguccccaaagg

SEQ ID NO: 555554 - RNA, 61 nt, Homo Sapiens
ucccuuucucaggagcuuggcuaaaggauccagagagcagcagacccccauuugucccaga

SEQ ID NO: 555555 - RNA, 61 nt, Homo Sapiens
cucucugggcccaccaccugcaucugcgacuagagagcacccggcccacguuggguucuca

SEQ ID NO: 555556 - RNA, 61 nt, Homo Sapiens
acugacauacuugauggaggauugauucgguagagagcaguagaaaucuuguucuaacugu

SEQ ID NO: 555557 - RNA, 61 nt, Homo Sapiens
cuggggccuccgugucgggggucagccuuggagagagcacccagggcaggggaagcgaaga

SEQ ID NO: 555558 - RNA, 61 nt, Homo Sapiens
guggucgcccucugcagccaggcgcgggaggagagagcacucacuugccccacugugcuag

SEQ ID NO: 555559 - RNA, 61 nt, Homo Sapiens
gaagcuucaaaacauugauaagguuuaccagagagagcaagucaucuaguaccuuuggagu

SEQ ID NO: 555560 - RNA, 61 nt, Homo Sapiens
uuucuaugguacccuguguuccucgugcuguagagagcagaaauucuagaaaguacuuugg

SEQ ID NO: 555561 - RNA, 61 nt, Homo Sapiens
ugucuaauacaauaaaaacucuucgauucucagagagcauugccugucuaccuuuagaagu

SEQ ID NO: 555562 - RNA, 61 nt, Homo Sapiens
gcccagacaagcagcugggugcugcggugugagagagcauggagucgccgcagaugaccua

SEQ ID NO: 555563 - RNA, 61 nt, Homo Sapiens
gcccaggccugcuggcaucagccagguagcaagagagcagcgucauccucccuugccccag

SEQ ID NO: 555564 - RNA, 61 nt, Homo Sapiens
caggggcaucugucugucugguagguuccccagagagcagggccaggcagaauggcugcac

SEQ ID NO: 555565 - RNA, 61 nt, Homo Sapiens
ucaauguguacuucagacaccaccuguagacagagagcagacagcaggcucaucugugguu

SEQ ID NO: 555566 - RNA, 61 nt, Homo Sapiens
agagcacaguagcccagccuaugugggagagagagagcaugggagcuauuuacaaaugucc

SEQ ID NO: 555567 - RNA, 61 nt, Homo Sapiens
uauucaauuuauugcaguuauagaauuggucagagagcauuuucauagugugcucauuucu

SEQ ID NO: 555568 - RNA, 61 nt, Homo Sapiens
uuacuaaggccuucagugaacagaaaggagcagagagcaagauuagaucugagaagaugcu

SEQ ID NO: 555569 - RNA, 61 nt, Homo Sapiens
aguaaggggcuuuguugaaagaggggguuagagagagcaagacagcacuugagugcacugg

SEQ ID NO: 555570 - RNA, 61 nt, Homo Sapiens
cagcaggugcucagcaauaucugagcaggacagagagcaugccuccauccagguacuggcu

SEQ ID NO: 555571 - RNA, 61 nt, Homo Sapiens
aguggauguugcagaaucucuugcaaggcucagagagcaaaagggacugauugugcagguu

SEQ ID NO: 555572 - RNA, 61 nt, Homo Sapiens
agaauagacuucaucaugugcuucagaagaaagagagcaugggcauguguuucaucgggaa

SEQ ID NO: 555573 - RNA, 61 nt, Homo Sapiens
ucuguagguugguuccuguauaccuugggccagagagcaaacauagguggccugagagagc

SEQ ID NO: 555574 - RNA, 61 nt, Homo Sapiens
uuccagcuucggaagccccugccuugccuccagagagcagaguacagaggcuguuugggca

SEQ ID NO: 555575 - RNA, 61 nt, Homo Sapiens
cccugugguggcaggagguggggggugggggagagagcagggggggacaaguauucuggcg

SEQ ID NO: 555576 - RNA, 61 nt, Homo Sapiens
gugaugaggagacugagcguaccuguaucccagagagcaaaaaaaugaacguccaggacac

SEQ ID NO: 555577 - RNA, 61 nt, Homo Sapiens
gccaggggucuuggugcuccgugacccacccagagagcaagccugcggcagaacagcaccc

SEQ ID NO: 555578 - RNA, 61 nt, Homo Sapiens
ugaaaguuucaaaaacuuugagcacuacuugagagagcaguucuagucuucacgcugagag

SEQ ID NO: 555579 - RNA, 61 nt, Homo Sapiens
acuugagagagcaguugaaaucuucacgcugagagagcacuuggguuuuaacaaauucuag

SEQ ID NO: 555580 - RNA, 64 nt, Homo Sapiens
cacuggccccaguccauagaggggucaacuaugcuggcuggacuggcugccuuguuccuggccu

SEQ ID NO: 555581 - RNA, 64 nt, Homo Sapiens
cccucagcugagcugaguaagggcuccuggggguuggcuggagauggguguggcaucuguccag

SEQ ID NO: 555582 - RNA, 64 nt, Homo Sapiens
cuucaagcugacuucauuguugcuuucucuccaguggcuggagaguaaugcugcuggcaucgcc

SEQ ID NO: 555583 - RNA, 64 nt, Homo Sapiens
acugugguagagccgggcugcaagacacaagccuuggcuggaaauccaaggccaguuaaccagg

SEQ ID NO: 555584 - RNA, 64 nt, Homo Sapiens
agugcgggccugggcccugcuccaccuccagaaguggcuggauguacccugccugaggccccga

SEQ ID NO: 555585 - RNA, 64 nt, Homo Sapiens
cccaccacuccccgacacuauugccuucccagcauggcuggagugggaagaggcuugggccccg

SEQ ID NO: 555586 - RNA, 64 nt, Homo Sapiens
ggccggagcggcggggcucagcccuucccagaccuggcuggagugccagcaccgacucaccaca

SEQ ID NO: 555587 - RNA, 64 nt, Homo Sapiens
gcgugugaaaggcagaacuagcccccgcugaaccuggcuggaccgugcccaagcccagcccugu

SEQ ID NO: 555588 - RNA, 64 nt, Homo Sapiens
acagcccugcuucugagggcugaacguugguugguggcuggaaacggccacauggugcuggcuc

SEQ ID NO: 555589 - RNA, 64 nt, Homo Sapiens
uacccagugguuagguugcagaaguucuuuuccuuggcuggauuagcccuugccuugguuucug

SEQ ID NO: 555590 - RNA, 64 nt, Homo Sapiens
auuuccuugcaucugagggcagcaaaucagggcguggcuggacguguucagccuuaacaggcuc

SEQ ID NO: 555591 - RNA, 64 nt, Homo Sapiens
uuuuaccaucaucgugaugccacuggagcuggaguggcuggauguggagcaccgcaccguggcu

SEQ ID NO: 555592 - RNA, 64 nt, Homo Sapiens
gagcuggaguggcuggauguggagcaccgcaccguggcuggaguccugagcagcaccuucugga

SEQ ID NO: 555593 - RNA, 64 nt, Homo Sapiens
ggauaggagggcuuuuaauuaaaggaacgaacccuggcuggaggugcccccuggggaguugggg

SEQ ID NO: 555594 - RNA, 64 nt, Homo Sapiens
cugauaccugaagcacucccgacuucucgcccucuggcuggaagacucauccauuugugaggag

SEQ ID NO: 555595 - RNA, 64 nt, Homo Sapiens
aaggugccaccagucaguugugccuaugucccuuuggcuggaaaugcagaauaugaauugauua

SEQ ID NO: 555596 - RNA, 64 nt, Homo Sapiens
guguggacauugaagcuugagcucucaaagcaguuggcuggaauacuuuugucagaauacggua

SEQ ID NO: 555597 - RNA, 64 nt, Homo Sapiens
cuccgucuccaucagaucaggcagggccucuguguggcuggaucguacaggaaauacaguuaau

SEQ ID NO: 555598 - RNA, 64 nt, Homo Sapiens
gccggauccggcaggaguuuagguggaggcugcauggcuggaagggccaucgccaagcacaauc

SEQ ID NO: 555599 - RNA, 64 nt, Homo Sapiens
cagaggccagaaagccuggcaaccaaauugaugcuggcuggaacuggacugagaauuuggccac

SEQ ID NO: 555600 - RNA, 64 nt, Homo Sapiens
gguccggagcuggcuuccuuaggcaggugggcuguggcuggacugacuggggcggaugccagag

SEQ ID NO: 555601 - RNA, 64 nt, Homo Sapiens
gggucuuugggaaacuuugggucucacuguugccuggcuggagcacuuugguuuauagcuggaa

SEQ ID NO: 555602 - RNA, 64 nt, Homo Sapiens
uguccagauguugcuggggccucacuuuuucucuuggcuggagguccaauugccagagccuccc

SEQ ID NO: 555603 - RNA, 64 nt, Homo Sapiens
uuaaggccaaggcuuucuccagauucagagcaccuggcuggagucaagaaucgaggggcacagg

SEQ ID NO: 555604 - RNA, 64 nt, Homo Sapiens
ggggcaccccccccauggaucagguagcaccaucuggcuggagguuccccuggcgaucagagcu

SEQ ID NO: 555605 - RNA, 64 nt, Homo Sapiens
uaguacugacugacauucauaugggcugagcagcuggcuggagcaucccccugagggauucuug

SEQ ID NO: 555606 - RNA, 64 nt, Homo Sapiens
gggcuguggcaauagaaaauacuccaggcccuccuggcuggagaaggcaaacagcaccccaggu

SEQ ID NO: 555607 - RNA, 64 nt, Homo Sapiens
aggccccugcagagggaugccuuaaagcugucccuggcuggaggagcacuccaccuuggggaua

SEQ ID NO: 555608 - RNA, 64 nt, Homo Sapiens
agucaagccgugguccagcaaacuccucugcagauggcuggaguguugacccaggcuuguggcc

SEQ ID NO: 555609 - RNA, 64 nt, Homo Sapiens
auugggacuuuaaaacgacccgugucaacacagcuggcuggauguuaaagaaaauaauuguaua

SEQ ID NO: 555610 - RNA, 64 nt, Homo Sapiens
cgggggacugugcuggucuguccaagggcaagaguggcuggagcgcugcccucccucugugugg

SEQ ID NO: 555611 - RNA, 64 nt, Homo Sapiens
agccugagugaugcuuucccaggagcagggcagcuggcuggaccagaaaguagagggcccaugg

SEQ ID NO: 555612 - RNA, 64 nt, Homo Sapiens
ccauuuggggugggcucuucaacaucucaggcuguggcuggaacaggacaggaugaucuaaaac

SEQ ID NO: 555613 - RNA, 64 nt, Homo Sapiens
ggaggcccuggcucugaucccaggcuggauggaguggcuggaaggaaugguuccaaacaacacc

SEQ ID NO: 555614 - RNA, 64 nt, Homo Sapiens
gauucuccuuggggcccagaggaagcugaugucauggcuggacaaagucacggaguaaagccag

SEQ ID NO: 555615 - RNA, 64 nt, Homo Sapiens
cugacaggucuuaggaacagcaaggagcucaguguggcuggagcagaaaaaaauugucaguacc

SEQ ID NO: 555616 - RNA, 64 nt, Homo Sapiens
cguacacacacaaacacaaaacuugcugaacaaauggcuggaugagugaaacaggaauggagca

SEQ ID NO: 555617 - RNA, 64 nt, Homo Sapiens
ggguccuggcucgggucagaugcucugcggugccuccuggcaaaucauccacaugcguguugug

SEQ ID NO: 555618 - RNA, 64 nt, Homo Sapiens
gcccuguggacucagcccagcagacccaagguaguccuggcacugucucuuuaccgauggguuc

SEQ ID NO: 555619 - RNA, 64 nt, Homo Sapiens
cacaaauaaacccagugucacugacuccccgucuuccuggcagauaguccauuuacgauucuca

SEQ ID NO: 555620 - RNA, 64 nt, Homo Sapiens
gccuuugagaauggggagaauauuucuauaguucuccuggcagaggcagagaccugggacucug

SEQ ID NO: 555621 - RNA, 64 nt, Homo Sapiens
cagcacugcuuagcauucucggggccccacgaguuccuggcauuccucuugcccuguccugcgg

SEQ ID NO: 555622 - RNA, 64 nt, Homo Sapiens
gcaugugccagcaggcaggaagggacuccuuggguccuggcaguugcccagcccucgucaccac

SEQ ID NO: 555623 - RNA, 64 nt, Homo Sapiens
auuuguuauugccucugaaagugccgcgguggccuccuggcauccaggcuucuggcuuccagag

SEQ ID NO: 555624 - RNA, 64 nt, Homo Sapiens
gguuuugauacuuggaauuucuuucagguuugacuccuggcacugcaccuucucugcuuuuaau

SEQ ID NO: 555625 - RNA, 64 nt, Homo Sapiens
uagucuuuccuuuuccguaaaggggagggcaugauccuggcaaauguggggcgggaaugaggaa

SEQ ID NO: 555626 - RNA, 64 nt, Homo Sapiens
cauagguuuucccagaccaccagacccugccuuguccuggcaaguuucauggcagaccuaagcu

SEQ ID NO: 555627 - RNA, 64 nt, Homo Sapiens
gccaguuuucuucauucagagggggcagguuaauuccuggcauucauuuuggacaugaguucaa

SEQ ID NO: 555628 - RNA, 64 nt, Homo Sapiens
ggaggcuggggaaaaccagcagggagcacuuggcuccuggcagagggagaggacaggaggagga

SEQ ID NO: 555629 - RNA, 64 nt, Homo Sapiens
aguccaacauugccaugggggagggaagaguguguccuggcaggaagccaccauuggagaaggu

SEQ ID NO: 555630 - RNA, 64 nt, Homo Sapiens
ugucucuugcuaccuaagccaggaagggccccucuccuggcaucgaaugggaggcuggacccug

SEQ ID NO: 555631 - RNA, 64 nt, Homo Sapiens
gagugggggauggcuggaggagacucgcuucccauccuggcauagaaaagcagccccaggccuc

SEQ ID NO: 555632 - RNA, 64 nt, Homo Sapiens
gagucagaaaccaaagugaccuccagagcuguccuccuggcaccugaguguccuugcucuagag

SEQ ID NO: 555633 - RNA, 64 nt, Homo Sapiens
gauggaacuccagggguggagggaaauuggcaguuccuggcaucucuuguguaccagcugcugu

SEQ ID NO: 555634 - RNA, 64 nt, Homo Sapiens
uucucacugaagagagaaagcagaagguucuagauccuggcacagacugcaucccauguuccca

SEQ ID NO: 555635 - RNA, 64 nt, Homo Sapiens
cccuggcccagaggcuccugaagaugcugggcgguccuggcacagggaggagcagcucuguaaa

SEQ ID NO: 555636 - RNA, 64 nt, Homo Sapiens
aucaccagccucaaggccugaggggugcaggggcuccuggcagcuacugggugagguuuccugg

SEQ ID NO: 555637 - RNA, 64 nt, Homo Sapiens
gugcaggggcuccuggcagcuacugggugagguuuccuggcacagacucacccuucuuucuggc

SEQ ID NO: 555638 - RNA, 64 nt, Homo Sapiens
aaaauaaaacaaagguuuucacaccuugauccucuccuggcaugcuggugcuaacacaggagcu

SEQ ID NO: 555639 - RNA, 64 nt, Homo Sapiens
cauugaguuauuuugagcugcugcugauguucgguccuggcaaauuugggagcagaggaaaacu

SEQ ID NO: 555640 - RNA, 64 nt, Homo Sapiens
ccagucacagaguaucccacgccccaagucuagauccuggcagcgccgggucccaaauguucag

SEQ ID NO: 555641 - RNA, 64 nt, Homo Sapiens
ugcagcugcuggauuccagagcacagcaaguggauccuggcaaccaagugcgggggccccagug

SEQ ID NO: 555642 - RNA, 64 nt, Homo Sapiens
cugugggcgacuaagugccacucacgcagcauguuccuggcaaggagcacauaccaucaagcca

SEQ ID NO: 555643 - RNA, 64 nt, Homo Sapiens
ugaagagcugucaugaaggagggagggagcacauuccuggcagagaaaacagcacgugcaaagg

SEQ ID NO: 555644 - RNA, 64 nt, Homo Sapiens
aaaaguagaaaaaugucacguuuccauaucuccugcuggaaaucagaaaauauaauaaaauugc

SEQ ID NO: 555645 - RNA, 64 nt, Homo Sapiens
cauugaaucaauggaucuguugaagaacucagcugcuggaaaccaugcaaaauguuuugaauug

SEQ ID NO: 555646 - RNA, 64 nt, Homo Sapiens
agggcaaagcaguggcucagggccagaaccugucgcuggaaaccuccaagcaugggaccaagga

SEQ ID NO: 555647 - RNA, 64 nt, Homo Sapiens
ugugguagagccgggcugugagacacaagccuuggcuggaaaaccaaggccaguuaaccaggca

SEQ ID NO: 555648 - RNA, 64 nt, Homo Sapiens
uuuuucagucauauaaaagcuauggugagaugcagcuggaaaagggucuugggaaauaugaaug

SEQ ID NO: 555649 - RNA, 64 nt, Homo Sapiens
gagggugacaagauagagagcuauuuaauggccggcuggaaaugcugggcugacggugcagucu

SEQ ID NO: 555650 - RNA, 64 nt, Homo Sapiens
ucuuuggggaaagcugguauugagucacuugguugcuggaaaaaagacagagucacuugguugc

SEQ ID NO: 555651 - RNA, 64 nt, Homo Sapiens
uaacagauggguuucugagccucugaaaccugaagcuggaaagaauuaugccauuuauaaacug

SEQ ID NO: 555652 - RNA, 64 nt, Homo Sapiens
gagugaguugcccauuaauugugaugacuaaaaugcuggaaagcggguuccugugauuaauuuu

SEQ ID NO: 555653 - RNA, 64 nt, Homo Sapiens
uuugaaccauuucaagucuccauggaacacauaugcuggaaaucuugaauuagcauaauugggc

SEQ ID NO: 555654 - RNA, 64 nt, Homo Sapiens
ggugccaccagucaguugugccuaugucccuuuggcuggaaaugcagaauaugaauugauuagu

SEQ ID NO: 555655 - RNA, 64 nt, Homo Sapiens
uuuugccucacuuaauuccagccuuuuguuuucugcuggaaaauaaguguggacauugaagcuu

SEQ ID NO: 555656 - RNA, 64 nt, Homo Sapiens
ucuaccuggagccccuggggcggugcuggccaaugcuggaaacauucacuuuccugcagccucu

SEQ ID NO: 555657 - RNA, 64 nt, Homo Sapiens
augugcucguacucccucggccugggauuucagagcuggaaauauagaaaauaucuagcccaaa

SEQ ID NO: 555658 - RNA, 64 nt, Homo Sapiens
gugucgggaaaugugugacuuaaccguggugagggcuggaaauccaaacucaccaccaugaucu

SEQ ID NO: 555659 - RNA, 64 nt, Homo Sapiens
guaucuccugacagagguacuuaacaauggcucugcuggaaauuucuauaaauaaaauguccaa

SEQ ID NO: 555660 - RNA, 64 nt, Homo Sapiens
gucauagagcugcaggguggauuguuacagcuucgcuggaaaccucuggaggucaucucggcug

SEQ ID NO: 555661 - RNA, 64 nt, Homo Sapiens
auaacuguugcuuaguaauuggcuuuguagagaagcuggaaaaaaaugguuuugucuucaacuc

SEQ ID NO: 555662 - RNA, 64 nt, Homo Sapiens
ucaugccaacaacuuacauccucuuaguuccucugcuggaaacagcugcguaauuacccuucag

SEQ ID NO: 555663 - RNA, 64 nt, Homo Sapiens
caaaguaaguuguuuacuuuuguaccaaccaacggcuggaaaugcuucaacgaauuaugaaauc

SEQ ID NO: 555664 - RNA, 64 nt, Homo Sapiens; identical to SEQ ID NO: 164727

SEQ ID NO: 555665 - RNA, 64 nt, Homo Sapiens; identical to SEQ ID NO: 164728

SEQ ID NO: 555666 - RNA, 64 nt, Homo Sapiens; identical to SEQ ID NO: 164729

SEQ ID NO: 555667 - RNA, 64 nt, Homo Sapiens; identical to SEQ ID NO: 164730

SEQ ID NO: 555668 - RNA, 64 nt, Homo Sapiens; identical to SEQ ID NO: 164731

SEQ ID NO: 555669 - RNA, 64 nt, Homo Sapiens; identical to SEQ ID NO: 164732

SEQ ID NO: 555670 - RNA, 64 nt, Homo Sapiens; identical to SEQ ID NO: 164733

SEQ ID NO: 555671 - RNA, 64 nt, Homo Sapiens; identical to SEQ ID NO: 164734

SEQ ID NO: 555672 - RNA, 64 nt, Homo Sapiens; identical to SEQ ID NO: 164735

SEQ ID NO: 555673 - RNA, 64 nt, Homo Sapiens; identical to SEQ ID NO: 164736

SEQ ID NO: 555674 - RNA, 64 nt, Homo Sapiens; identical to SEQ ID NO: 164737

SEQ ID NO: 555675 - RNA, 64 nt, Homo Sapiens; identical to SEQ ID NO: 164738

SEQ ID NO: 555676 - RNA, 64 nt, Homo Sapiens; identical to SEQ ID NO: 164739

SEQ ID NO: 555677 - RNA, 64 nt, Homo Sapiens; identical to SEQ ID NO: 164740

SEQ ID NO: 555678 - RNA, 64 nt, Homo Sapiens; identical to SEQ ID NO: 164741

SEQ ID NO: 555679 - RNA, 64 nt, Homo Sapiens; identical to SEQ ID NO: 164742

SEQ ID NO: 555680 - RNA, 52 nt, Homo Sapiens; identical to SEQ ID NO: 164743

SEQ ID NO: 555681 - RNA, 64 nt, Homo Sapiens; identical to SEQ ID NO: 164744

SEQ ID NO: 555682 - RNA, 64 nt, Homo Sapiens; identical to SEQ ID NO: 164745

SEQ ID NO: 555683 - RNA, 64 nt, Homo Sapiens; identical to SEQ ID NO: 164746

SEQ ID NO: 555684 - RNA, 64 nt, Homo Sapiens; identical to SEQ ID NO: 164747

SEQ ID NO: 555685 - RNA, 64 nt, Homo Sapiens; identical to SEQ ID NO: 164748

SEQ ID NO: 555686 - RNA, 64 nt, Homo Sapiens; identical to SEQ ID NO: 164749

SEQ ID NO: 555687 - RNA, 64 nt, Homo Sapiens; identical to SEQ ID NO: 164750

SEQ ID NO: 555688 - RNA, 64 nt, Homo Sapiens; identical to SEQ ID NO: 164751

SEQ ID NO: 555689 - RNA, 64 nt, Homo Sapiens; identical to SEQ ID NO: 164752

SEQ ID NO: 555690 - RNA, 64 nt, Homo Sapiens; identical to SEQ ID NO: 164753

SEQ ID NO: 555691 - RNA, 64 nt, Homo Sapiens; identical to SEQ ID NO: 164754

SEQ ID NO: 555692 - RNA, 64 nt, Homo Sapiens; identical to SEQ ID NO: 164755

SEQ ID NO: 555693 - RNA, 64 nt, Homo Sapiens; identical to SEQ ID NO: 164756

SEQ ID NO: 555694 - RNA, 64 nt, Homo Sapiens; identical to SEQ ID NO: 164757

SEQ ID NO: 555695 - RNA, 64 nt, Homo Sapiens; identical to SEQ ID NO: 164758

SEQ ID NO: 555696 - RNA, 64 nt, Homo Sapiens; identical to SEQ ID NO: 164759

SEQ ID NO: 555697 - RNA, 64 nt, Homo Sapiens; identical to SEQ ID NO: 164760

SEQ ID NO: 555698 - RNA, 64 nt, Homo Sapiens; identical to SEQ ID NO: 164761

SEQ ID NO: 555699 - RNA, 64 nt, Homo Sapiens; identical to SEQ ID NO: 164762

SEQ ID NO: 555700 - RNA, 64 nt, Homo Sapiens; identical to SEQ ID NO: 164763

SEQ ID NO: 555701 - RNA, 64 nt, Homo Sapiens; identical to SEQ ID NO: 164764

SEQ ID NO: 555702 - RNA, 64 nt, Homo Sapiens; identical to SEQ ID NO: 164765

SEQ ID NO: 555703 - RNA, 64 nt, Homo Sapiens; identical to SEQ ID NO: 164766

SEQ ID NO: 555704 - RNA, 64 nt, Homo Sapiens; identical to SEQ ID NO: 164767

SEQ ID NO: 555705 - RNA, 64 nt, Homo Sapiens; identical to SEQ ID NO: 164768

SEQ ID NO: 555706 - RNA, 64 nt, Homo Sapiens; identical to SEQ ID NO: 164769

SEQ ID NO: 555707 - RNA, 64 nt, Homo Sapiens; identical to SEQ ID NO: 164770

SEQ ID NO: 555708 - RNA, 64 nt, Homo Sapiens; identical to SEQ ID NO: 164771

SEQ ID NO: 555709 - RNA, 64 nt, Homo Sapiens; identical to SEQ ID NO: 164772

SEQ ID NO: 555710 - RNA, 64 nt, Homo Sapiens; identical to SEQ ID NO: 164773

SEQ ID NO: 555711 - RNA, 64 nt, Homo Sapiens; identical to SEQ ID NO: 164774

SEQ ID NO: 555712 - RNA, 64 nt, Homo Sapiens; identical to SEQ ID NO: 164775

SEQ ID NO: 555713 - RNA, 64 nt, Homo Sapiens; identical to SEQ ID NO: 164776

SEQ ID NO: 555714 - RNA, 64 nt, Homo Sapiens; identical to SEQ ID NO: 164777

SEQ ID NO: 555715 - RNA, 64 nt, Homo Sapiens; identical to SEQ ID NO: 164778

SEQ ID NO: 555716 - RNA, 64 nt, Homo Sapiens; identical to SEQ ID NO: 164779

SEQ ID NO: 555717 - RNA, 64 nt, Homo Sapiens; identical to SEQ ID NO: 506912

SEQ ID NO: 555718 - RNA, 64 nt, Homo Sapiens; identical to SEQ ID NO: 506913

SEQ ID NO: 555719 - RNA, 64 nt, Homo Sapiens; identical to SEQ ID NO: 506914

SEQ ID NO: 555720 - RNA, 64 nt, Homo Sapiens; identical to SEQ ID NO: 506915

SEQ ID NO: 555721 - RNA, 64 nt, Homo Sapiens; identical to SEQ ID NO: 506916

SEQ ID NO: 555722 - RNA, 64 nt, Homo Sapiens; identical to SEQ ID NO: 506917

SEQ ID NO: 555723 - RNA, 64 nt, Homo Sapiens; identical to SEQ ID NO: 506918

SEQ ID NO: 555724 - RNA, 64 nt, Homo Sapiens; identical to SEQ ID NO: 506919

SEQ ID NO: 555725 - RNA, 64 nt, Homo Sapiens; identical to SEQ ID NO: 506920

SEQ ID NO: 555726 - RNA, 64 nt, Homo Sapiens; identical to SEQ ID NO: 506921

SEQ ID NO: 555727 - RNA, 64 nt, Homo Sapiens
acucaugucuguugagugccaauuucuagguugaagcugguaaccugaacuaacuuggggaaac

SEQ ID NO: 555728 - RNA, 64 nt, Homo Sapiens
uagguagacugcugcucuaagcugcuccagcgagagcugguaaccugcuccauguccuugugug

SEQ ID NO: 555729 - RNA, 64 nt, Homo Sapiens; identical to SEQ ID NO: 133159

SEQ ID NO: 555730 - RNA, 64 nt, Homo Sapiens; identical to SEQ ID NO: 133160

SEQ ID NO: 555731 - RNA, 64 nt, Homo Sapiens; identical to SEQ ID NO: 133161

SEQ ID NO: 555732 - RNA, 64 nt, Homo Sapiens; identical to SEQ ID NO: 133162

SEQ ID NO: 555733 - RNA, 64 nt, Homo Sapiens; identical to SEQ ID NO: 133163

SEQ ID NO: 555734 - RNA, 64 nt, Homo Sapiens; identical to SEQ ID NO: 133164

SEQ ID NO: 555735 - RNA, 64 nt, Homo Sapiens; identical to SEQ ID NO: 133165

SEQ ID NO: 555736 - RNA, 64 nt, Homo Sapiens; identical to SEQ ID NO: 133166

SEQ ID NO: 555737 - RNA, 64 nt, Homo Sapiens; identical to SEQ ID NO: 133167

SEQ ID NO: 555738 - RNA, 64 nt, Homo Sapiens; identical to SEQ ID NO: 133168

SEQ ID NO: 555739 - RNA, 64 nt, Homo Sapiens; identical to SEQ ID NO: 133169

SEQ ID NO: 555740 - RNA, 64 nt, Homo Sapiens; identical to SEQ ID NO: 133170

SEQ ID NO: 555741 - RNA, 64 nt, Homo Sapiens; identical to SEQ ID NO: 133171

SEQ ID NO: 555742 - RNA, 64 nt, Homo Sapiens; identical to SEQ ID NO: 133172

SEQ ID NO: 555743 - RNA, 64 nt, Homo Sapiens; identical to SEQ ID NO: 133173

SEQ ID NO: 555744 - RNA, 64 nt, Homo Sapiens; identical to SEQ ID NO: 133174

SEQ ID NO: 555745 - RNA, 64 nt, Homo Sapiens; identical to SEQ ID NO: 133175

SEQ ID NO: 555746 - RNA, 64 nt, Homo Sapiens; identical to SEQ ID NO: 133176

SEQ ID NO: 555747 - RNA, 64 nt, Homo Sapiens; identical to SEQ ID NO: 133177

SEQ ID NO: 555748 - RNA, 64 nt, Homo Sapiens; identical to SEQ ID NO: 133178

SEQ ID NO: 555749 - RNA, 64 nt, Homo Sapiens; identical to SEQ ID NO: 133179

SEQ ID NO: 555750 - RNA, 64 nt, Homo Sapiens; identical to SEQ ID NO: 133180

SEQ ID NO: 555751 - RNA, 64 nt, Homo Sapiens; identical to SEQ ID NO: 133181

SEQ ID NO: 555752 - RNA, 64 nt, Homo Sapiens; identical to SEQ ID NO: 133182

SEQ ID NO: 555753 - RNA, 64 nt, Homo Sapiens; identical to SEQ ID NO: 133183

SEQ ID NO: 555754 - RNA, 64 nt, Homo Sapiens; identical to SEQ ID NO: 133184

SEQ ID NO: 555755 - RNA, 64 nt, Homo Sapiens; identical to SEQ ID NO: 133185

SEQ ID NO: 555756 - RNA, 64 nt, Homo Sapiens; identical to SEQ ID NO: 133186

SEQ ID NO: 555757 - RNA, 64 nt, Homo Sapiens; identical to SEQ ID NO: 133187

SEQ ID NO: 555758 - RNA, 64 nt, Homo Sapiens; identical to SEQ ID NO: 133188

SEQ ID NO: 555759 - RNA, 64 nt, Homo Sapiens; identical to SEQ ID NO: 133189

SEQ ID NO: 555760 - RNA, 64 nt, Homo Sapiens; identical to SEQ ID NO: 133190

SEQ ID NO: 555761 - RNA, 64 nt, Homo Sapiens; identical to SEQ ID NO: 133191

SEQ ID NO: 555762 - RNA, 64 nt, Homo Sapiens; identical to SEQ ID NO: 133192

SEQ ID NO: 555763 - RNA, 64 nt, Homo Sapiens; identical to SEQ ID NO: 133193

SEQ ID NO: 555764 - RNA, 64 nt, Homo Sapiens; identical to SEQ ID NO: 133194

SEQ ID NO: 555765 - RNA, 64 nt, Homo Sapiens; identical to SEQ ID NO: 133195

SEQ ID NO: 555766 - RNA, 64 nt, Homo Sapiens; identical to SEQ ID NO: 133196

SEQ ID NO: 555767 - RNA, 64 nt, Homo Sapiens; identical to SEQ ID NO: 133197

SEQ ID NO: 555768 - RNA, 64 nt, Homo Sapiens; identical to SEQ ID NO: 133198

SEQ ID NO: 555769 - RNA, 64 nt, Homo Sapiens; identical to SEQ ID NO: 133199

SEQ ID NO: 555770 - RNA, 64 nt, Homo Sapiens; identical to SEQ ID NO: 133200

SEQ ID NO: 555771 - RNA, 64 nt, Homo Sapiens; identical to SEQ ID NO: 133201

SEQ ID NO: 555772 - RNA, 64 nt, Homo Sapiens; identical to SEQ ID NO: 133202

SEQ ID NO: 555773 - RNA, 64 nt, Homo Sapiens; identical to SEQ ID NO: 133203

SEQ ID NO: 555774 - RNA, 64 nt, Homo Sapiens
caccacgaacucucugccugagacuggggaaguaagcggguaucuucucagugagcauagguug

SEQ ID NO: 555775 - RNA, 64 nt, Homo Sapiens
cucuccccgcuacaggcugcaggcacugcagggcagcggguauucuccuccccaccuaagucuc

SEQ ID NO: 555776 - RNA, 64 nt, Homo Sapiens
agauugacaagagaaaaacaaacauaaauuuauuagcggguauauguaauauauaugugggaaa

SEQ ID NO: 555777 - RNA, 64 nt, Homo Sapiens
aagcuagugugacccugcuccaggguggggacucagcggguauagccucccaucugacuacagc

SEQ ID NO: 555778 - RNA, 64 nt, Homo Sapiens
acagccggguagggcagauaagacccgcaggcugagcggguagacggccccaccagguacugaa

SEQ ID NO: 555779 - RNA, 64 nt, Homo Sapiens
uuucccugggcugagaggggaagugcauauguguagcggguacugguuccugugucuuagggca

SEQ ID NO: 555780 - RNA, 64 nt, Homo Sapiens
gcugcuauuuugauggugaccggagcuggcgggcagcggguacgcgguggcaccccguugugcc

SEQ ID NO: 555781 - RNA, 64 nt, Homo Sapiens
agcaagccuacuucgcauuucuuccucggccaucagcggguaacagugcugacugcugccaagg

SEQ ID NO: 555782 - RNA, 64 nt, Homo Sapiens
cccaaggcuauugucgucgccgggcgagugggcgagcggguaggcgggcgagccagggcccggg

SEQ ID NO: 555783 - RNA, 64 nt, Homo Sapiens
ugggguuuguuuuguuuugauuuuuuuuuuuuaaagcggguaaaagagaaaacacugaaaauug

SEQ ID NO: 555784 - RNA, 64 nt, Homo Sapiens
caaaaaacggguauucuagucaucuugggguaaaagcggguaaugaacauuccuauccccaaca

SEQ ID NO: 555785 - RNA, 64 nt, Homo Sapiens
gcacagggaagagggaggguccaacucaucaggcagcggguagggaauggggugggugguagac

SEQ ID NO: 555786 - RNA, 64 nt, Homo Sapiens
cucucuagcuccagcagguggcaccucgguacccagcggguagggcgauaauuuauauauuuuc

SEQ ID NO: 555787 - RNA, 64 nt, Homo Sapiens
aaaccuggguuaggguguguuggccaucuuaaaaagcggguaaagugggggggagaagaagaau

SEQ ID NO: 555788 - RNA, 64 nt, Homo Sapiens
agugaacuucaguuuuacaaucuguaugccuaaaagcggguacuaccguuuauuuuacugacuu

SEQ ID NO: 555789 - RNA, 64 nt, Homo Sapiens
cugccuuccucuagugcagccuggaagacauggcagcggguagcuccuggggcugagccagaag

SEQ ID NO: 555790 - RNA, 64 nt, Homo Sapiens
ugaaagauagaagcauuauuaaaugcauauauuuagcggguauuaaaaaaugcugcagaucuag

SEQ ID NO: 555791 - RNA, 64 nt, Homo Sapiens
acaauccaugcucuaagaucugggccaaacagggagcggguaagggcgagucucuuccccuguc

SEQ ID NO: 555792 - RNA, 64 nt, Homo Sapiens
agaguuucuugcagaacguggccccagucucccgagcggguaggaagcucaucccaagcaagga

SEQ ID NO: 555793 - RNA, 64 nt, Homo Sapiens
agagagauggcugauacugcgcaguaggcuguggagcggguagggcucacauacaggacagcca

SEQ ID NO: 555794 - RNA, 64 nt, Homo Sapiens
gcuuuugcugaggugugacauggcccccaagcagagcggguaaagugcaauggguaagggaggg

SEQ ID NO: 555795 - RNA, 64 nt, Homo Sapiens
cacccucugcagggcagccugugggagaagggacagcggguaaaaagagaaggcaagcuggcag

SEQ ID NO: 555796 - RNA, 64 nt, Homo Sapiens
cgccccgcugccuuucccaggcuccccucaccccagcggguaaugagcccuuaaucgcugccuc

SEQ ID NO: 555797 - RNA, 64 nt, Homo Sapiens
caagccgggcacccaacccuggaugccaccccccagcggguaccagaggaaagcuggcagcagg

SEQ ID NO: 555798 - RNA, 64 nt, Homo Sapiens
guucccaagccagccccaacgguguuggaagggcagcggguaaggaccgcugcccacagaucca

SEQ ID NO: 555799 - RNA, 64 nt, Homo Sapiens
ccagcuuguggcauucccauuuucaguguaucucagcggguacuuuguaauuuuuaauaugcuc

SEQ ID NO: 555800 - RNA, 64 nt, Homo Sapiens
ugguggggaaacagaggcccaggguggagaccuaagcggguauaagaccagguggccugcuccu

SEQ ID NO: 555801 - RNA, 64 nt, Homo Sapiens
aauuuccuucaggcagcugaaauucaccaagaacagcggguacuuauuucucagcugugccuuc

SEQ ID NO: 555802 - RNA, 64 nt, Homo Sapiens
gaagcuguggggcugccugcucuuucagaccaaggaacaucagaaaggacugacucaagcugug

SEQ ID NO: 555803 - RNA, 64 nt, Homo Sapiens
gaagcgugacugccugucugaacaagcccucagugaacaucauuuuuuuuccucccaguuucca

SEQ ID NO: 555804 - RNA, 64 nt, Homo Sapiens
gaacaucugauagagauaaaaaagacaaaguagugaacaucaauagauuuucauauaauguauu

SEQ ID NO: 555805 - RNA, 64 nt, Homo Sapiens
uuaaaggagauacuugaauuauuaauguucuucagaacaucauuuauaucugugcuucauaaau

SEQ ID NO: 555806 - RNA, 64 nt, Homo Sapiens
gagcucuuuauuuauaacagagacuaaauaaguggaacaucauacuuauuucccuaccuuauua

SEQ ID NO: 555807 - RNA, 64 nt, Homo Sapiens
uauuuuaaaguguagcccagcaccacaccuggcugaacaucagagcugggauuacaagcauaag

SEQ ID NO: 555808 - RNA, 64 nt, Homo Sapiens
uuagugaggaaacaaaaugucaaaggcaucucaggaacaucacccaguaaccagguaauauugg

SEQ ID NO: 555809 - RNA, 64 nt, Homo Sapiens
aacccaguaauaaugauuugauguaacaaauacugaacaucaucuugugaauuuucugagacgg

SEQ ID NO: 555810 - RNA, 64 nt, Homo Sapiens; identical to SEQ ID NO: 370212

SEQ ID NO: 555811 - RNA, 64 nt, Homo Sapiens; identical to SEQ ID NO: 370213

SEQ ID NO: 555812 - RNA, 64 nt, Homo Sapiens; identical to SEQ ID NO: 370214

SEQ ID NO: 555813 - RNA, 64 nt, Homo Sapiens; identical to SEQ ID NO: 370215

SEQ ID NO: 555814 - RNA, 64 nt, Homo Sapiens; identical to SEQ ID NO: 491481

SEQ ID NO: 555815 - RNA, 64 nt, Homo Sapiens; identical to SEQ ID NO: 491482

SEQ ID NO: 555816 - RNA, 64 nt, Homo Sapiens; identical to SEQ ID NO: 491483

SEQ ID NO: 555817 - RNA, 64 nt, Homo Sapiens; identical to SEQ ID NO: 491484

SEQ ID NO: 555818 - RNA, 64 nt, Homo Sapiens; identical to SEQ ID NO: 491485

SEQ ID NO: 555819 - RNA, 64 nt, Homo Sapiens; identical to SEQ ID NO: 491486

SEQ ID NO: 555820 - RNA, 64 nt, Homo Sapiens; identical to SEQ ID NO: 491487

SEQ ID NO: 555821 - RNA, 64 nt, Homo Sapiens; identical to SEQ ID NO: 491488

SEQ ID NO: 555822 - RNA, 64 nt, Homo Sapiens; identical to SEQ ID NO: 491489

SEQ ID NO: 555823 - RNA, 64 nt, Homo Sapiens; identical to SEQ ID NO: 491490

SEQ ID NO: 555824 - RNA, 64 nt, Homo Sapiens; identical to SEQ ID NO: 491491

SEQ ID NO: 555825 - RNA, 64 nt, Homo Sapiens; identical to SEQ ID NO: 491492

SEQ ID NO: 555826 - RNA, 64 nt, Homo Sapiens; identical to SEQ ID NO: 491493

SEQ ID NO: 555827 - RNA, 64 nt, Homo Sapiens; identical to SEQ ID NO: 491494

SEQ ID NO: 555828 - RNA, 64 nt, Homo Sapiens; identical to SEQ ID NO: 491495

SEQ ID NO: 555829 - RNA, 64 nt, Homo Sapiens; identical to SEQ ID NO: 491496

SEQ ID NO: 555830 - RNA, 64 nt, Homo Sapiens; identical to SEQ ID NO: 491497

SEQ ID NO: 555831 - RNA, 64 nt, Homo Sapiens; identical to SEQ ID NO: 491498

SEQ ID NO: 555832 - RNA, 64 nt, Homo Sapiens; identical to SEQ ID NO: 491499

SEQ ID NO: 555833 - RNA, 64 nt, Homo Sapiens; identical to SEQ ID NO: 491500

SEQ ID NO: 555834 - RNA, 64 nt, Homo Sapiens; identical to SEQ ID NO: 491501

SEQ ID NO: 555835 - RNA, 64 nt, Homo Sapiens; identical to SEQ ID NO: 491502

SEQ ID NO: 555836 - RNA, 64 nt, Homo Sapiens; identical to SEQ ID NO: 491503

SEQ ID NO: 555837 - RNA, 64 nt, Homo Sapiens; identical to SEQ ID NO: 491504

SEQ ID NO: 555838 - RNA, 64 nt, Homo Sapiens; identical to SEQ ID NO: 491505

SEQ ID NO: 555839 - RNA, 64 nt, Homo Sapiens; identical to SEQ ID NO: 491506

SEQ ID NO: 555840 - RNA, 64 nt, Homo Sapiens; identical to SEQ ID NO: 491507

SEQ ID NO: 555841 - RNA, 64 nt, Homo Sapiens; identical to SEQ ID NO: 491508

SEQ ID NO: 555842 - RNA, 64 nt, Homo Sapiens; identical to SEQ ID NO: 491509

SEQ ID NO: 555843 - RNA, 64 nt, Homo Sapiens; identical to SEQ ID NO: 491510

SEQ ID NO: 555844 - RNA, 64 nt, Homo Sapiens; identical to SEQ ID NO: 491511

SEQ ID NO: 555845 - RNA, 64 nt, Homo Sapiens; identical to SEQ ID NO: 491512

SEQ ID NO: 555846 - RNA, 64 nt, Homo Sapiens; identical to SEQ ID NO: 491513

SEQ ID NO: 555847 - RNA, 64 nt, Homo Sapiens; identical to SEQ ID NO: 491514

SEQ ID NO: 555848 - RNA, 64 nt, Homo Sapiens; identical to SEQ ID NO: 491515

SEQ ID NO: 555849 - RNA, 64 nt, Homo Sapiens; identical to SEQ ID NO: 491516

SEQ ID NO: 555850 - RNA, 64 nt, Homo Sapiens; identical to SEQ ID NO: 491517

SEQ ID NO: 555851 - RNA, 64 nt, Homo Sapiens; identical to SEQ ID NO: 491518

SEQ ID NO: 555852 - RNA, 64 nt, Homo Sapiens; identical to SEQ ID NO: 491519

SEQ ID NO: 555853 - RNA, 64 nt, Homo Sapiens; identical to SEQ ID NO: 491520

SEQ ID NO: 555854 - RNA, 64 nt, Homo Sapiens; identical to SEQ ID NO: 491521

SEQ ID NO: 555855 - RNA, 64 nt, Homo Sapiens; identical to SEQ ID NO: 491522

SEQ ID NO: 555856 - RNA, 64 nt, Homo Sapiens; identical to SEQ ID NO: 491523

SEQ ID NO: 555857 - RNA, 64 nt, Homo Sapiens
agcugagguuaagccuucuuuugggauuugcauuguaauugagggcccuggaagaucucugaga

SEQ ID NO: 555858 - RNA, 64 nt, Homo Sapiens
gcagagaacuacuuuggaaaacaguuuaucugcuguaauugaacauucagcuacccuauaaccc

SEQ ID NO: 555859 - RNA, 64 nt, Homo Sapiens
uguauuccuguuuuguauauauuuuuuagacacaguaauugaaccuugguuauguaaaaaugaa

SEQ ID NO: 555860 - RNA, 64 nt, Homo Sapiens
caugggcuaaagcaucagagaagaaaaucuguugguaauugauaguggucugcagacauugaug

SEQ ID NO: 555861 - RNA, 64 nt, Homo Sapiens
ugaauuucagucugcugcuuuguaaaaaauaacuguaauugauauuucauuuuuaaaauuuaua

SEQ ID NO: 555862 - RNA, 64 nt, Homo Sapiens
gccacaguuuacagugucauucuuccacgaauagguaauugauagaguuuaugggucuuagucu

SEQ ID NO: 555863 - RNA, 64 nt, Homo Sapiens; identical to SEQ ID NO: 126265

SEQ ID NO: 555864 - RNA, 64 nt, Homo Sapiens; identical to SEQ ID NO: 126266

SEQ ID NO: 555865 - RNA, 64 nt, Homo Sapiens; identical to SEQ ID NO: 126267

SEQ ID NO: 555866 - RNA, 64 nt, Homo Sapiens; identical to SEQ ID NO: 126268

SEQ ID NO: 555867 - RNA, 64 nt, Homo Sapiens; identical to SEQ ID NO: 126269

SEQ ID NO: 555868 - RNA, 64 nt, Homo Sapiens; identical to SEQ ID NO: 126270

SEQ ID NO: 555869 - RNA, 64 nt, Homo Sapiens; identical to SEQ ID NO: 126271

SEQ ID NO: 555870 - RNA, 64 nt, Homo Sapiens; identical to SEQ ID NO: 126272

SEQ ID NO: 555871 - RNA, 64 nt, Homo Sapiens; identical to SEQ ID NO: 126273

SEQ ID NO: 555872 - RNA, 64 nt, Homo Sapiens; identical to SEQ ID NO: 126274

SEQ ID NO: 555873 - RNA, 64 nt, Homo Sapiens; identical to SEQ ID NO: 126275

SEQ ID NO: 555874 - RNA, 64 nt, Homo Sapiens; identical to SEQ ID NO: 126276

SEQ ID NO: 555875 - RNA, 64 nt, Homo Sapiens; identical to SEQ ID NO: 126277

SEQ ID NO: 555876 - RNA, 64 nt, Homo Sapiens; identical to SEQ ID NO: 126278

SEQ ID NO: 555877 - RNA, 64 nt, Homo Sapiens; identical to SEQ ID NO: 126279

SEQ ID NO: 555878 - RNA, 64 nt, Homo Sapiens; identical to SEQ ID NO: 126280

SEQ ID NO: 555879 - RNA, 64 nt, Homo Sapiens
aaaagaaagaaaaagaaaagucaaauaaauaccuauuuaccaccuaaguaauuuuuuuuucauu

SEQ ID NO: 555880 - RNA, 64 nt, Homo Sapiens
aucuauugucaacauguacauuccauguaaauuuauuuaccaacucucuggauaucuuucugug

SEQ ID NO: 555881 - RNA, 64 nt, Homo Sapiens
auuuuguuucuuacgcuugcgcauauauauguauauuuaccaagaaaauauauuugcauaauau

SEQ ID NO: 555882 - RNA, 64 nt, Homo Sapiens
ggaugcauauuaaagaaaguugcagcuauggacaauuuaccacaacacauacauauauacauuu

SEQ ID NO: 555883 - RNA, 64 nt, Homo Sapiens
gugaaaguggcaagcucuucauugcacugcaguuauuuaccagaaguuuaaaucuuuguuaaaa

SEQ ID NO: 555884 - RNA, 64 nt, Homo Sapiens
aaagaaguccaugugauaauuguaaaggugaugaauuuaccaucaaacaaaucauuuugaugua

SEQ ID NO: 555885 - RNA, 64 nt, Homo Sapiens
uuauaaacuuuugugugugcuguggcagggaacaguuaacaaggaguuuauuuagagggguuuu

SEQ ID NO: 555886 - RNA, 64 nt, Homo Sapiens
aucuacuacuauccauaaaugcaauaauaugcauguuaacaacauuaaaaacagcaaacagcaa

SEQ ID NO: 555887 - RNA, 64 nt, Homo Sapiens
ucccuuuuuaauuuuuuuaacagcaauggaggaaguuaacaauuuuuaauggaaagagcauguu

SEQ ID NO: 555888 - RNA, 64 nt, Homo Sapiens
cgugcuguuccuacucaguaaacaggugugaugaguuaacaagaaauaacacuguuugagaacu

SEQ ID NO: 555889 - RNA, 64 nt, Homo Sapiens
uggccuguguaaaucuccauugggaagucaugccuucuaaaaagauucuuauuugggggagugg

SEQ ID NO: 555890 - RNA, 64 nt, Homo Sapiens
uuaaaaaucuauuuggucaaucuaaaugcauucauucuaaaaaauuuuuugaaccagauaaaua

SEQ ID NO: 555891 - RNA, 64 nt, Homo Sapiens
ucucuacucuagaugccuaaaagaguuuauauacuucuaaaagcuccuaacuuauauccaaaga

SEQ ID NO: 555892 - RNA, 64 nt, Homo Sapiens
uagacaaugauucuuuuuuaauaaaaucaaauaauucuaaaagugcuagagaauuuaacuaaaa

SEQ ID NO: 555893 - RNA, 64 nt, Homo Sapiens
uauaacuuacuaaagcagaacaaacagugaaacuuucuaaaauauucuaucuggaauagggaca

SEQ ID NO: 555894 - RNA, 64 nt, Homo Sapiens
uguaacuguagaagggaaaagggaaaguauuugguucuaaaaaauguuagccuuccucguaaaa

SEQ ID NO: 555895 - RNA, 64 nt, Homo Sapiens
ugaaaucuaaagcaaauuugcaauuucuuaagauuucuaaaauuuaccagaacaguuuagccug

SEQ ID NO: 555896 - RNA, 64 nt, Homo Sapiens
gaaauaguauugauuuagaaaaaguauauugcauuucuaaaaaacaucuaccaagguuacucgu

SEQ ID NO: 555897 - RNA, 64 nt, Homo Sapiens
gggaguggucugaaugaacacagccaccuucugguucuaaaacgcccucagccacuucgaaugc

SEQ ID NO: 555898 - RNA, 64 nt, Homo Sapiens
ugugcccucagccacuucgaauucaacuacagccuucuaaaaccgggcuucccuuaggagccau

SEQ ID NO: 555899 - RNA, 64 nt, Homo Sapiens
aacuuuuauguuauaagaguguucucacauauacuucuaaaagacauuucuauuuagcugauug

SEQ ID NO: 555900 - RNA, 64 nt, Homo Sapiens
aaaaccaaagggcgcugguuuuaacccuuccuuguucuaaaacacauccauaaucagccaccau

SEQ ID NO: 555901 - RNA, 64 nt, Homo Sapiens
ccuuuuuguuauacagugcuguucauuuaauagcuucuaaaagguugguuuaucuauaauguuu

SEQ ID NO: 555902 - RNA, 64 nt, Homo Sapiens
ugucagguuuuuaaaaucauaguuuuuuuuuuucuucuaaaaaaacaagugauggcucauagcu

SEQ ID NO: 555903 - RNA, 64 nt, Homo Sapiens
agcaaaauauugguauuacaugcauuuuauguaguucuaaaaucaacaccaaaaucuccagaaa

SEQ ID NO: 555904 - RNA, 64 nt, Homo Sapiens
uaaauauuugccacaauguaauacaaaguuuguuuucuaaaauguuaaaaauuauguugacuaa

SEQ ID NO: 555905 - RNA, 64 nt, Homo Sapiens
gaauagacaggaaaagauuggcacacccaccaguuucuaaaaugcaaugcccagacaaacguga

SEQ ID NO: 555906 - RNA, 64 nt, Homo Sapiens
auaacaugacuucuguuuuuacuaugucccauuguucuaaaaugauguuuuacagacuuuauuc

SEQ ID NO: 555907 - RNA, 64 nt, Homo Sapiens
aguggagaaaguguauucuuuaaagagaauuuacuucuaaaagccacaggugcuuuuacaaagc

SEQ ID NO: 555908 - RNA, 64 nt, Homo Sapiens
gcuuuuacaaagcaaacugcauugaauuuaaaacuucuaaaaauaacaggcaaauauuguagcu

SEQ ID NO: 555909 - RNA, 64 nt, Homo Sapiens
aggaguggugauaaagcccacugaccuucacacauucuaaaaauugguuggcaaugccaguaua

SEQ ID NO: 555910 - RNA, 64 nt, Homo Sapiens
aaugcagaguuggauaagaaauacauugcuggguuucuaaaaugcugccuuccugccucuacuc

SEQ ID NO: 555911 - RNA, 64 nt, Homo Sapiens
agacaggggcguauucaugggagcaucagccaguuucuaaaacccacaggccaucagcagcuag

SEQ ID NO: 555912 - RNA, 64 nt, Homo Sapiens
uguguaccagguugccuaaaucaugugcagaugguucuaaaaaaaaaaaaaaaaaaaaaaaaaa

SEQ ID NO: 555913 - RNA, 64 nt, Homo Sapiens
ggaaccuuuucuugggggugggggaguuucccuuuucuaaaaaugcaaugcacuaaaacuauuu

SEQ ID NO: 555914 - RNA, 64 nt, Homo Sapiens
aauguguaaaaucagucucggcugucagaauaacuucuaaaagguauuuuuauaagcaguucaa

SEQ ID NO: 555915 - RNA, 64 nt, Homo Sapiens
ucacccacauugggugagacagaaaaugaaucuguucuaaaauuuguaauuugcuaacuugauu

SEQ ID NO: 555916 - RNA, 64 nt, Homo Sapiens
ggaggaaacauaagaggaggccaaaaguuaaacguucuaaaaagaggcgaaaggaagcaagcag

SEQ ID NO: 555917 - RNA, 64 nt, Homo Sapiens
guuucugaaaacaaugaaaccauaaaagauaauauucuaaaaacugagaaauccagugaagagg

SEQ ID NO: 555918 - RNA, 64 nt, Homo Sapiens
uggaacugucguacacauucuagaaauggauuuauucuaaaauuuaucagauuuuguuagaugc

SEQ ID NO: 555919 - RNA, 64 nt, Homo Sapiens
aaaaauugguuugaguuuuccaacaagaauuuaauucuaaaagcuaguacaagauugaaaaacu

SEQ ID NO: 555920 - RNA, 64 nt, Homo Sapiens
uuaaaaccaacuaugccaagaaauucaaaaauauuucuaaaacccguuccuauuguuuaauaau

SEQ ID NO: 555921 - RNA, 64 nt, Homo Sapiens
gagaguaucacacccuaaauguaauuuuuccugcuucuaaaaguuuuucacauauuaauauuua

SEQ ID NO: 555922 - RNA, 64 nt, Homo Sapiens
uugucagaauauauaaaagcuuagauuguagcuguucuaaaaacguaaguacuccauuguaaua

SEQ ID NO: 555923 - RNA, 64 nt, Homo Sapiens
gagccauugggccaucaagccuuuauauaucugcuucuaaaauugccccaccugcucuagaugg

SEQ ID NO: 555924 - RNA, 64 nt, Homo Sapiens
aaaauacucacaaagcuguuauuggcuucuuaacuucuaaaauuuggggggucuugcauuuauu

SEQ ID NO: 555925 - RNA, 64 nt, Homo Sapiens
aaccuagagguaacuaccaugugaacuugaacucuucuaaaauaguucugugucucuuagacca

SEQ ID NO: 555926 - RNA, 64 nt, Homo Sapiens
uuuggaaggagugaucaaauaccgaaauugaacuuucuaaaaccuacacauagcaugcguuuaa

SEQ ID NO: 555927 - RNA, 64 nt, Homo Sapiens
aaauucuauuauauaaagccccaagugcuuuaccuucuaaaacaugcuucucuauaggugcaaa

SEQ ID NO: 555928 - RNA, 64 nt, Homo Sapiens
acuguguacuugagguuggcuuuggauauggauuuucuaaaaagugauguuuuauuguuuauca

SEQ ID NO: 555929 - RNA, 64 nt, Homo Sapiens
ccuugaccagaaauuuuucuucuaaagaauuuaauucuaaaaguuauagacauucccaaagaua

SEQ ID NO: 555930 - RNA, 64 nt, Homo Sapiens
gucuucauguaccuguauguaaaucccacuuuuauucuaaaauucuuugaauauuuuguuucuu

SEQ ID NO: 555931 - RNA, 64 nt, Homo Sapiens
uguuaaaauaaauaacauuuaauuugacggaaaauucuaaaaaucaacauuugguaacuuaaau

SEQ ID NO: 555932 - RNA, 64 nt, Homo Sapiens
uuuguugaaugcuauggaauauuaauauaauuaauucuaaaauaucaccuaaaauaugucaacu

SEQ ID NO: 555933 - RNA, 64 nt, Homo Sapiens
aaguaaaaaauacauagaauuaaacccaaguaaguucuaaaaaacucacuuaaauuaauuuuug

SEQ ID NO: 555934 - RNA, 64 nt, Homo Sapiens
aagaauaaaaagguaaaacuacaaaucuuauuauuucuaaaaaugugaucagaaagaauggcgu

SEQ ID NO: 555935 - RNA, 64 nt, Homo Sapiens
ucaaauauacuuguuaauaauaaaacacuuccauuucuaaaagugauuacauaucaaaauugau

SEQ ID NO: 555936 - RNA, 64 nt, Homo Sapiens
ccugugauuugaaaaauauaaacauuaugaacaauucuaaaagcauuuucagaaacuuagugau

SEQ ID NO: 555937 - RNA, 64 nt, Homo Sapiens
gucuuuucaacuuauguaaucaguuugugauaauuucuaaaacuauuucaguuccgugucuuaa

SEQ ID NO: 555938 - RNA, 64 nt, Homo Sapiens
auguagccugacaagacauuugcuguaaagugucuucuaaaauguauuucuaaugcuacaagaa

SEQ ID NO: 555939 - RNA, 64 nt, Homo Sapiens
ccuuuuuugggggagugacaggaugggguauggauucuaaaaugccuuuucccaaaauguugaa

SEQ ID NO: 555940 - RNA, 64 nt, Homo Sapiens
agcccuuuuauaccuccccagacuccuucaacaauucuaaaaugauuguaguaaucugcauuau

SEQ ID NO: 555941 - RNA, 64 nt, Homo Sapiens
uguuuccagaaauucuucaauuugaaaucaccuuuucuaaaaagucaauucaucuaguuaaguc

SEQ ID NO: 555942 - RNA, 64 nt, Homo Sapiens
uugucagucugagucaucaaaaagagucuuaauuuucuaaaacaaguuggcuagaagaaaguaa

SEQ ID NO: 555943 - RNA, 64 nt, Homo Sapiens
aaccucaucaaaagugugugaauuuuaaaacaaauucuaaaaaaacuauagugcuaaauuggua

SEQ ID NO: 555944 - RNA, 64 nt, Homo Sapiens
gaaauuauuugaagugauauauuugguuaaacauuucuaaaaauaaacuaccaauacuaaauag

SEQ ID NO: 555945 - RNA, 64 nt, Homo Sapiens
uagaauuuuuuuuugauaaaggaucacaaaacaauucuaaaaccuaacuguuuuuaccauugaa

SEQ ID NO: 555946 - RNA, 64 nt, Homo Sapiens
guaugucuuuuguuaacauauuuguuaugccuuauucuaaaauugagucucaaacuggaaugcc

SEQ ID NO: 555947 - RNA, 64 nt, Homo Sapiens
ggggauuacaauggcucaaauugguucauuugauuucuaaaaauaccaugaccuuuaaaaauuc

SEQ ID NO: 555948 - RNA, 64 nt, Homo Sapiens
aacauggauucugaguuguauauauuuccuaucauucuaaaaaagugaauuugugaagcaaagu

SEQ ID NO: 555949 - RNA, 64 nt, Homo Sapiens
gaguuggaaggaaacucuuacuaaaauguuaacuuucuaaaaaccuucuuuuagaucuuccuug

SEQ ID NO: 555950 - RNA, 64 nt, Homo Sapiens
uuaaugcauagcaguauguuugaaaaauagaccauucuaaaaagcccaugauaccuuacuguug

SEQ ID NO: 555951 - RNA, 64 nt, Homo Sapiens
uuucccaugagauaccauguucuaugccuucccauucuaaaaguguggacaacgcuugauuuga

SEQ ID NO: 555952 - RNA, 64 nt, Homo Sapiens
aauacgacgaaaauucauacuuuaugcaggagauuucuaaaaauuuaauguuuauuaauaguuu

SEQ ID NO: 555953 - RNA, 64 nt, Homo Sapiens
acuauuauauuauauaauucauaccacucugcuguucuaaaagggucauugguuugauuuuugg

SEQ ID NO: 555954 - RNA, 64 nt, Homo Sapiens
gggucccauuauuuucuuaaauaaaauuauuuuauucuaaaacuaaugcaguaggcuuuuuugu

SEQ ID NO: 555955 - RNA, 64 nt, Homo Sapiens
ucagauguuugagcaguggcguauguaaauagguuucuaaaaagucuacugauuugggcugaau

SEQ ID NO: 555956 - RNA, 64 nt, Homo Sapiens
gaguucuuccuguaaucuugcacauggauucaguuucuaaaauuuaccacuugcugcacucuug

SEQ ID NO: 555957 - RNA, 64 nt, Homo Sapiens
caaaguucauuauuuucauccaguaaaucaaauauucuaaaaccgcagcagaggaacccaaagg

SEQ ID NO: 555958 - RNA, 64 nt, Homo Sapiens
uucugcuccuuccuucccaaagacccauucuauauucuaaaagcaauauucaucucuugcuguc

SEQ ID NO: 555959 - RNA, 64 nt, Homo Sapiens
agagagauuagaacuguuagaaggaguugaaauuuucuaaaagacauaguauuuaguuuauaau

SEQ ID NO: 555960 - RNA, 64 nt, Homo Sapiens
ugaaguucacaauaggucauaaggucucuuccuuuucuaaaauugaaagacaagaaauuuagug

SEQ ID NO: 555961 - RNA, 64 nt, Homo Sapiens
acagauuccuucagugauauacuuguucguucauuucuaaaaugugaagcuuuaggaccaaauu

SEQ ID NO: 555962 - RNA, 64 nt, Homo Sapiens
caaguucccgugauugcaguaaaaauauuuacuauucuaaaaaaaugagaauugaagacuuagc

SEQ ID NO: 555963 - RNA, 64 nt, Homo Sapiens
cuuuucaugcuaccuucaaucuucaacuaaagauuucuaaaagggguaagaaaugaggcaguag

SEQ ID NO: 555964 - RNA, 64 nt, Homo Sapiens
gaaguccagccuacuuacuuguaacuauuaaccuuucuaaaaguuuucaucgccuugguaaagc

SEQ ID NO: 555965 - RNA, 64 nt, Homo Sapiens
uagacuaaaagccaaaauauaauuauugcugccuuucuaaaaacccaaaauguaguucucuauu

SEQ ID NO: 555966 - RNA, 64 nt, Homo Sapiens
auuuuuuagucaacacauaauggaaacuucuuucuucuaaaaguugccagugccacuuuuaaga

SEQ ID NO: 555967 - RNA, 64 nt, Homo Sapiens
aauguaaaugucuucuauuaaacaucgguggauuuucuaaaaauacaaauaugugccauugugc

SEQ ID NO: 555968 - RNA, 64 nt, Homo Sapiens
gucauguuacauuccugcauuuagaaacacacauuucuaaaaauuaguguauuuuuuuuucuuu

SEQ ID NO: 555969 - RNA, 64 nt, Homo Sapiens
ucucuguuggccuuucuuaguccucuuuaacugcuucuaaaauaaucuaacucucccuaaacca

SEQ ID NO: 555970 - RNA, 64 nt, Homo Sapiens
uauuuugugaagccccuucauuuugucucaugucuucuaaaaaugugccaccaagccuggcuaa

SEQ ID NO: 555971 - RNA, 64 nt, Homo Sapiens
acauuacauuucuuaacauuuuaaaaucuagaauuucuaaaauggaauuuaaugccaucacaau

SEQ ID NO: 555972 - RNA, 64 nt, Homo Sapiens
uuuuuuuuuuuuacuauagaaguuacaaaggaaguucuaaaauuaugccucccucuguuuuuau

SEQ ID NO: 555973 - RNA, 64 nt, Homo Sapiens
uaaaauuucauaauucugaagcacaaaacuacuuuucuaaaaucguuaauguaguaugguauau

SEQ ID NO: 555974 - RNA, 64 nt, Homo Sapiens
gcugcucacaaguucuauuucuaccuguguuuuuuucuaaaaaguaggcauuuuaaguaaaagu

SEQ ID NO: 555975 - RNA, 64 nt, Homo Sapiens
cauuuaaagcuaacugggucgacuagguaagucuuucuaaaaacaguucaaauuaaccacuuuu

SEQ ID NO: 555976 - RNA, 64 nt, Homo Sapiens
uucacuggauuucuuuagaccuagcuggcaauguuucuaaaacucaacucuaacucggagacgu

SEQ ID NO: 555977 - RNA, 64 nt, Homo Sapiens
ucuuauuucacuuaacucauuugauuaaacuguauucuaaaacauuugggguuuuucccccuau

SEQ ID NO: 555978 - RNA, 64 nt, Homo Sapiens
guauuaccuggaaugaggcagguuuuuuucuguuuucuaaaaagaguaaccaagauaccuccag

SEQ ID NO: 555979 - RNA, 54 nt, Homo Sapiens
uagaaagaaaaauaaaguagccaauucuaaaaguagcccucuuucuccuggauc

SEQ ID NO: 555980 - RNA, 64 nt, Homo Sapiens
guugauuuguuugugccuuuuauuaacugccauuuucuaaaauuuuuuucaauaaaaggaagga

SEQ ID NO: 555981 - RNA, 64 nt, Homo Sapiens
uccuccaaugugugcauggauucaauggaugaauuucuaaaauaaggugcucaauaaaaaugug

SEQ ID NO: 555982 - RNA, 64 nt, Homo Sapiens
cuuuaacuguagugccuccuuacuucucucucuuuucuaaaaagacugugccuacauuuaaaaa

SEQ ID NO: 555983 - RNA, 64 nt, Homo Sapiens
agaaucagcuuaggcuucuaugaauucagccuguuucuaaaagcugaaaaucucaguuuaaaaa

SEQ ID NO: 555984 - RNA, 64 nt, Homo Sapiens
ugauauaaauaagucuagcucuauaauccccaaguucuaaaaguuaugguuagaugcuauucug

SEQ ID NO: 555985 - RNA, 64 nt, Homo Sapiens
cuuuaaguuuuuauacuuucagaaacuuuuuguguucuaaaaguacaaugagccuuacuguauu

SEQ ID NO: 555986 - RNA, 64 nt, Homo Sapiens
ccaagguuuaaacugcccaguuagcauucugacauucuaaaagccggcaaagcagcuuuuagug

SEQ ID NO: 555987 - RNA, 64 nt, Homo Sapiens
auaggugcuuauuaaggagacucuuuuccuauacuucuaaaaugcaaacuguuucagauucuga

SEQ ID NO: 555988 - RNA, 64 nt, Homo Sapiens
ucagauucugagcaccucauuguaaauacgauuauucuaaaaacucaaagggcgagaacaacug

SEQ ID NO: 555989 - RNA, 64 nt, Homo Sapiens
uuuagagcaauaaauauucacaaagagugauaguuucuaaaacaaaacauuguuuguucacuuu

SEQ ID NO: 555990 - RNA, 64 nt, Homo Sapiens
uugaugcauuggaaaaauuugaaaauaaaaaggauucuaaaaguuuauucucuuuucagagaag

SEQ ID NO: 555991 - RNA, 64 nt, Homo Sapiens
uuagaaaauguuaucuuuuuaaugugaauauucuuucuaaaaaugugaaacccaugacaaaaug

SEQ ID NO: 555992 - RNA, 64 nt, Homo Sapiens
ugucuuagaauccugaaagcuuaggaauauguuguucuaaaauauuuugccaagguaguucagu

SEQ ID NO: 555993 - RNA, 64 nt, Homo Sapiens
ugcggggaggagaagucagauuauguacauaguuuucuaaaaagccuuucuucuaaaaacgaaa

SEQ ID NO: 555994 - RNA, 64 nt, Homo Sapiens
cagauuauguacauaguuuucuaaaaagccuuucuucuaaaaacgaaaaaagaccccccaccca

SEQ ID NO: 555995 - RNA, 64 nt, Homo Sapiens
aaaauguccaaauuaggcauuuuaaaaauugguuuucuaaaauuaaacacugcauuuaagaauu

SEQ ID NO: 555996 - RNA, 64 nt, Homo Sapiens
agagaauaaggaacugauuugguuuguuuguguuuucuaaaaccggaaccucgguacuucuuaa

SEQ ID NO: 555997 - RNA, 64 nt, Homo Sapiens
uuacuaaaugccuagugcaguucaaauugucuaguucuaaaaguuuuaauugacuucuaaaaug

SEQ ID NO: 555998 - RNA, 64 nt, Homo Sapiens
uucaaauugucuaguucuaauuuguuuaauugacuucuaaaaugaaaaaaguugguugacuguu

SEQ ID NO: 555999 - RNA, 64 nt, Homo Sapiens
ccauuaaagccacuuaaaugugccauaggugacauucuaaaauaaauccagauuugaagacuca

SEQ ID NO: 556000 - RNA, 64 nt, Homo Sapiens
aauuuguugcagcuuuguaaaauaaagcauccgguucuaaaauuccauccccauuagaccuacg

SEQ ID NO: 556001 - RNA, 64 nt, Homo Sapiens
uucugagaguugaugagguuuaagaacaugaagauucuaaaaggucaguuuuuagagauagauc

SEQ ID NO: 556002 - RNA, 64 nt, Homo Sapiens
uauuacauauguguuaagucauuucuuaagaauuuucuaaaaugccaacuaucacaggauuauu

SEQ ID NO: 556003 - RNA, 64 nt, Homo Sapiens
cuauuguguuuguuucauaugaauauuuuuguaauucuaaaagagaucuuauuuaaauuuccuu

SEQ ID NO: 556004 - RNA, 64 nt, Homo Sapiens
acaauauaugucaucuuauuaaagcucuuuugcguucuaaaacuuuguauauuugucuaaaaug

SEQ ID NO: 556005 - RNA, 64 nt, Homo Sapiens
ggauguauuagguuuugaacucugugaaggaaauuucuaaaauuagccaugguaaaaauaggga

SEQ ID NO: 556006 - RNA, 64 nt, Homo Sapiens
cuuauaggugaggaucauuuauuucucauuaaacuucuaaaauuaauggacuuuuuuuauuuua

SEQ ID NO: 556007 - RNA, 64 nt, Homo Sapiens
uugggaguuugggguuuuauguuuuguuuuucuuuucuaaaaugaagugagauuguucacacac

SEQ ID NO: 556008 - RNA, 64 nt, Homo Sapiens
uugauauuugagccauuccuaaagauuugggguuuucuaaaacuaaagaaucuaggaaccuugc

SEQ ID NO: 556009 - RNA, 64 nt, Homo Sapiens
auuuuucuguuuuugaccuuagguauaugaaguuuucuaaaauauuuuauuaauuuauguugaa

SEQ ID NO: 556010 - RNA, 64 nt, Homo Sapiens
gauagaauagagaauuugagaaaaaucugggucuuucuaaaaacugcuuuguaaguuacuuuuu

SEQ ID NO: 556011 - RNA, 64 nt, Homo Sapiens
ucauuucuacccugcaaaauaauccagaucugcuuucuaaaaugaaucaguuucuaaagugaaa

SEQ ID NO: 556012 - RNA, 64 nt, Homo Sapiens
aaaauuuuuuucugucagacauuuaccaacuauuuucuaaaacuaauuugacaaaucaugacac

SEQ ID NO: 556013 - RNA, 64 nt, Homo Sapiens
uucauauucugaaaaauguucuauauucucauuuuucuaaaagaaagaaaaaaggaaacccgau

SEQ ID NO: 556014 - RNA, 64 nt, Homo Sapiens
cuggcagaggcacucagguacuugguaagcaaauuucuaaaacuccaaguugcugcagcuuggc

SEQ ID NO: 556015 - RNA, 64 nt, Homo Sapiens
aaguaauugaaaaccugcaaguaaaccuuuguuuuucuaaaauauucugccuauggcacaaauu

SEQ ID NO: 556016 - RNA, 64 nt, Homo Sapiens
cggaauucuagauccuugcuguucucuuuauaacuucuaaaauuucucuuuuaauugcagugaa

SEQ ID NO: 556017 - RNA, 64 nt, Homo Sapiens
uguuugcucguaugcuguucauucacaaaacagauucuaaaauuuuuauuuacauugucagacu

SEQ ID NO: 556018 - RNA, 64 nt, Homo Sapiens
cagcaagaguuaagaaagggcuuuucaggaacuauucuaaaagucauaaaagggucacagucuu

SEQ ID NO: 556019 - RNA, 64 nt, Homo Sapiens
aguuaacaaugugucuaccaagaacaauugaguuuucuaaaaguaauaaugaagauuaugcaau

SEQ ID NO: 556020 - RNA, 64 nt, Homo Sapiens
auaguucuagacauggagguucuaaggccuaggauucuaaaaugugauguucuaaggcucugag

SEQ ID NO: 556021 - RNA, 64 nt, Homo Sapiens
cuaggaccaugguuaagaguccaagaauccacauuucuaaaaucuuauaguucuaggcacugua

SEQ ID NO: 556022 - RNA, 64 nt, Homo Sapiens
uuaucuuuaaaauaugaaauucuguagaagauauuucuaaaaucuccuagucagauacuaauau

SEQ ID NO: 556023 - RNA, 64 nt, Homo Sapiens
uuccagaauacccgguaguugggcaggaaagaacuucuaaaacaaagauguuuuuaaaaccuua

SEQ ID NO: 556024 - RNA, 64 nt, Homo Sapiens
uccauuuuguucucuauauuacuguauguaucaguucuaaaauuccaccuuuuaaauuuugguc

SEQ ID NO: 556025 - RNA, 64 nt, Homo Sapiens
acuuuuuauuagccugauuuguuuucagccuaauuucuaaaaaugucuuuuaccaaacuuagag

SEQ ID NO: 556026 - RNA, 64 nt, Homo Sapiens
gagaagcugcccggaauaaacugaauuucauauguucuaaaaugacuagcaaugguuuaaaaag

SEQ ID NO: 556027 - RNA, 64 nt, Homo Sapiens
gcagggaaaaaauauuuucacuuauuuuauuugcuucuaaaaugcaaagaugaauacuaaaguc

SEQ ID NO: 556028 - RNA, 64 nt, Homo Sapiens
guuauaaagauaaguuaggcagcuagacccugcguucuaaaaaaggauugcuugcaauguuggu

SEQ ID NO: 556029 - RNA, 64 nt, Homo Sapiens
aucuaaacauuuuuagccuuuaauccauuccauuuucuaaaacugucauaaacuauuuuuaauc

SEQ ID NO: 556030 - RNA, 64 nt, Homo Sapiens
guucuucuauuucaaacguuaauuuugcuucucuuucuaaaaaaaaaaaaaaaaaagaaagaga

SEQ ID NO: 556031 - RNA, 64 nt, Homo Sapiens
ugcccgggaggaaagguguugauuacauggauacuucuaaaagcuaaagccuuguugccuucuc

SEQ ID NO: 556032 - RNA, 64 nt, Homo Sapiens
aagugcaauagauuuucaaguguauugugccuuguucuaaaacuuuuauuaaguaggugcacuu

SEQ ID NO: 556033 - RNA, 64 nt, Homo Sapiens
aacgcagcuugucuaggaaggggaugggacuagauucuaaaauuuauuugggaccaugggaaug

SEQ ID NO: 556034 - RNA, 64 nt, Homo Sapiens
auaaagauucuuuuauuucuuugcucaaaauugcuucuaaaacauuagauauuugccugucugu

SEQ ID NO: 556035 - RNA, 64 nt, Homo Sapiens
uucuacauucagauuauaugaaugcuguuaauauuucuaaaagucaagugcauggcacugacug

SEQ ID NO: 556036 - RNA, 64 nt, Homo Sapiens
uucuaugucuagucuuccauaaaacagucucugcuucuaaaaacccugagguugguuuuugcag

SEQ ID NO: 556037 - RNA, 64 nt, Homo Sapiens
aaguguuuuaccauuaaugugguugccaugguguuucuaaaaauugcccucuaucauuauaaau

SEQ ID NO: 556038 - RNA, 64 nt, Homo Sapiens; identical to SEQ ID NO: 546408

SEQ ID NO: 556039 - RNA, 64 nt, Homo Sapiens; identical to SEQ ID NO: 546409

SEQ ID NO: 556040 - RNA, 64 nt, Homo Sapiens; identical to SEQ ID NO: 546410

SEQ ID NO: 556041 - RNA, 64 nt, Homo Sapiens; identical to SEQ ID NO: 546411

SEQ ID NO: 556042 - RNA, 64 nt, Homo Sapiens; identical to SEQ ID NO: 546412

SEQ ID NO: 556043 - RNA, 64 nt, Homo Sapiens; identical to SEQ ID NO: 546413

SEQ ID NO: 556044 - RNA, 64 nt, Homo Sapiens; identical to SEQ ID NO: 546414

SEQ ID NO: 556045 - RNA, 64 nt, Homo Sapiens; identical to SEQ ID NO: 546415

SEQ ID NO: 556046 - RNA, 64 nt, Homo Sapiens; identical to SEQ ID NO: 546416

SEQ ID NO: 556047 - RNA, 64 nt, Homo Sapiens; identical to SEQ ID NO: 546417

SEQ ID NO: 556048 - RNA, 64 nt, Homo Sapiens; identical to SEQ ID NO: 81987

SEQ ID NO: 556049 - RNA, 64 nt, Homo Sapiens; identical to SEQ ID NO: 81988

SEQ ID NO: 556050 - RNA, 64 nt, Homo Sapiens; identical to SEQ ID NO: 81989

SEQ ID NO: 556051 - RNA, 64 nt, Homo Sapiens; identical to SEQ ID NO: 81990

SEQ ID NO: 556052 - RNA, 64 nt, Homo Sapiens; identical to SEQ ID NO: 81991

SEQ ID NO: 556053 - RNA, 64 nt, Homo Sapiens; identical to SEQ ID NO: 81992

SEQ ID NO: 556054 - RNA, 64 nt, Homo Sapiens; identical to SEQ ID NO: 81993

SEQ ID NO: 556055 - RNA, 64 nt, Homo Sapiens; identical to SEQ ID NO: 81994

SEQ ID NO: 556056 - RNA, 64 nt, Homo Sapiens; identical to SEQ ID NO: 81995

SEQ ID NO: 556057 - RNA, 64 nt, Homo Sapiens; identical to SEQ ID NO: 81996

SEQ ID NO: 556058 - RNA, 64 nt, Homo Sapiens; identical to SEQ ID NO: 81997

SEQ ID NO: 556059 - RNA, 64 nt, Homo Sapiens; identical to SEQ ID NO: 81998

SEQ ID NO: 556060 - RNA, 64 nt, Homo Sapiens; identical to SEQ ID NO: 81999

SEQ ID NO: 556061 - RNA, 64 nt, Homo Sapiens; identical to SEQ ID NO: 82000

SEQ ID NO: 556062 - RNA, 64 nt, Homo Sapiens; identical to SEQ ID NO: 82001

SEQ ID NO: 556063 - RNA, 64 nt, Homo Sapiens; identical to SEQ ID NO: 82002

SEQ ID NO: 556064 - RNA, 64 nt, Homo Sapiens; identical to SEQ ID NO: 82003

SEQ ID NO: 556065 - RNA, 64 nt, Homo Sapiens; identical to SEQ ID NO: 82004

SEQ ID NO: 556066 - RNA, 64 nt, Homo Sapiens; identical to SEQ ID NO: 82005

SEQ ID NO: 556067 - RNA, 64 nt, Homo Sapiens; identical to SEQ ID NO: 82006

SEQ ID NO: 556068 - RNA, 64 nt, Homo Sapiens; identical to SEQ ID NO: 82007

SEQ ID NO: 556069 - RNA, 64 nt, Homo Sapiens; identical to SEQ ID NO: 82008

SEQ ID NO: 556070 - RNA, 58 nt, Homo Sapiens; identical to SEQ ID NO: 82009

SEQ ID NO: 556071 - RNA, 64 nt, Homo Sapiens; identical to SEQ ID NO: 82010

SEQ ID NO: 556072 - RNA, 64 nt, Homo Sapiens; identical to SEQ ID NO: 82011

SEQ ID NO: 556073 - RNA, 64 nt, Homo Sapiens; identical to SEQ ID NO: 82012

SEQ ID NO: 556074 - RNA, 64 nt, Homo Sapiens; identical to SEQ ID NO: 82013

SEQ ID NO: 556075 - RNA, 64 nt, Homo Sapiens; identical to SEQ ID NO: 82014

SEQ ID NO: 556076 - RNA, 64 nt, Homo Sapiens; identical to SEQ ID NO: 82015

SEQ ID NO: 556077 - RNA, 64 nt, Homo Sapiens; identical to SEQ ID NO: 82016

SEQ ID NO: 556078 - RNA, 64 nt, Homo Sapiens
ucaugcugcuccugucacccuccacgauuccacagaccaggacauuccaugugccucauggcac

SEQ ID NO: 556079 - RNA, 64 nt, Homo Sapiens
gccaccaugcccucugcccuugccucuugggacugaccaggagcugcucaugugcgugagagug

SEQ ID NO: 556080 - RNA, 64 nt, Homo Sapiens
ccgaggucucuaacucuuauccaagggcuccacugaccaggagguuagcccaccaggcaugagg

SEQ ID NO: 556081 - RNA, 64 nt, Homo Sapiens
agcagcagcugccugcucucccuccccuaccaaggaccaggaaauggcacgcaagccugaggac

SEQ ID NO: 556082 - RNA, 64 nt, Homo Sapiens
ucagggaagaucggaauucagggugguggguugagaccaggaaggucuccggaccaucagggua

SEQ ID NO: 556083 - RNA, 64 nt, Homo Sapiens
gagcggggucgggaucaccucuguccugggcggggaccaggagggacggcacccaggcugugau

SEQ ID NO: 556084 - RNA, 64 nt, Homo Sapiens
uuccuuugccauuaaggaauucaccuacugacaugaccaggauucuuugcuaauuuggccaccu

SEQ ID NO: 556085 - RNA, 64 nt, Homo Sapiens
aggggccucccucccgaacucggaagcagaggcugaccaggagcuuugcccugacggaguggcc

SEQ ID NO: 556086 - RNA, 64 nt, Homo Sapiens
cacuggggcauauaaaaaagaguugagcucccaagaccaggacccuguauccuuucggcuuccc

SEQ ID NO: 556087 - RNA, 64 nt, Homo Sapiens
cacuggggcauauaaaaucuaguugagcucccaagaccaggacccuguguccuuucggcuuccc

SEQ ID NO: 556088 - RNA, 64 nt, Homo Sapiens
cugcuugccucucccuagcccacacgcagacuuugaccaggaguauccagccaggggcacacau

SEQ ID NO: 556089 - RNA, 64 nt, Homo Sapiens
uuccagucaugaucgggugggggacaugugggcugaccaggaccucugacccuggagcuucuac

SEQ ID NO: 556090 - RNA, 64 nt, Homo Sapiens
accuaaauaucaaggccaggauuuucuaccuaaagaccaggacuuuuuaucuagagaccagcau

SEQ ID NO: 556091 - RNA, 64 nt, Homo Sapiens
ccccaaagacuggaauauucuacccaaaugucaggaccaggauuuucuacccagagaccaaggu

SEQ ID NO: 556092 - RNA, 64 nt, Homo Sapiens
ucccaaagaccaaaauauucuacccauaugucaggaccaggauuuucuacccagagaccaaggu

SEQ ID NO: 556093 - RNA, 64 nt, Homo Sapiens
ggcagacuaucaguguuugccucccaaaucccaggaccaggaugacaucaaaaaucagguagag

SEQ ID NO: 556094 - RNA, 64 nt, Homo Sapiens
cggucagagauggaccuggcgcucccuggggguugaccaggagcguuucgcuggcacucuucca

SEQ ID NO: 556095 - RNA, 64 nt, Homo Sapiens
ccagguagggcagggaaccuccagggcuccccuggaccaggacguaggggccgggggcuucugc

SEQ ID NO: 556096 - RNA, 64 nt, Homo Sapiens; identical to SEQ ID NO: 143348

SEQ ID NO: 556097 - RNA, 64 nt, Homo Sapiens; identical to SEQ ID NO: 143349

SEQ ID NO: 556098 - RNA, 64 nt, Homo Sapiens; identical to SEQ ID NO: 143350

SEQ ID NO: 556099 - RNA, 64 nt, Homo Sapiens; identical to SEQ ID NO: 143351

SEQ ID NO: 556100 - RNA, 64 nt, Homo Sapiens; identical to SEQ ID NO: 143352

SEQ ID NO: 556101 - RNA, 64 nt, Homo Sapiens; identical to SEQ ID NO: 143353

SEQ ID NO: 556102 - RNA, 64 nt, Homo Sapiens; identical to SEQ ID NO: 143354

SEQ ID NO: 556103 - RNA, 64 nt, Homo Sapiens; identical to SEQ ID NO: 143355

SEQ ID NO: 556104 - RNA, 64 nt, Homo Sapiens; identical to SEQ ID NO: 143356

SEQ ID NO: 556105 - RNA, 64 nt, Homo Sapiens; identical to SEQ ID NO: 143357

SEQ ID NO: 556106 - RNA, 64 nt, Homo Sapiens; identical to SEQ ID NO: 143358

SEQ ID NO: 556107 - RNA, 64 nt, Homo Sapiens; identical to SEQ ID NO: 143359

SEQ ID NO: 556108 - RNA, 64 nt, Homo Sapiens; identical to SEQ ID NO: 143360

SEQ ID NO: 556109 - RNA, 64 nt, Homo Sapiens; identical to SEQ ID NO: 143361

SEQ ID NO: 556110 - RNA, 64 nt, Homo Sapiens; identical to SEQ ID NO: 143362

SEQ ID NO: 556111 - RNA, 64 nt, Homo Sapiens; identical to SEQ ID NO: 143363

SEQ ID NO: 556112 - RNA, 64 nt, Homo Sapiens; identical to SEQ ID NO: 143364

SEQ ID NO: 556113 - RNA, 64 nt, Homo Sapiens; identical to SEQ ID NO: 143365

SEQ ID NO: 556114 - RNA, 61 nt, Homo Sapiens
acuaaacucuuaagccuccccuuccagucuuucuggacagcuauuaagcacuugcagccuu

SEQ ID NO: 556115 - RNA, 61 nt, Homo Sapiens
cuguuugagcccaacacuuuaauuuauucuuucuggacacuggagucacuaacuggcgugu

SEQ ID NO: 556116 - RNA, 61 nt, Homo Sapiens
cuggacauuggacauugcuagucacagugugucuggacagcagaucugagugccccacaga

SEQ ID NO: 556117 - RNA, 61 nt, Homo Sapiens
gccacauggagccacugucaggcauacagugucuggacacuucuggacgcugccacaucug

SEQ ID NO: 556118 - RNA, 61 nt, Homo Sapiens
gcuccacagauugauacauuguacacggaaaucuggacaguuuauugugcuuuucaaaaau

SEQ ID NO: 556119 - RNA, 61 nt, Homo Sapiens
agauuuuuuuguuuggggagccccaaaugauucuggacacuauuccagauuguaaaaagau

SEQ ID NO: 556120 - RNA, 61 nt, Homo Sapiens
cacacacacacacgugugcacagauaugcugucuggacacgcacacacaugcagauaugcu

SEQ ID NO: 556121 - RNA, 61 nt, Homo Sapiens
ccuggacacacacaugugcacagauaugcugucuggacaugcacacacgugcagauaugcu

SEQ ID NO: 556122 - RNA, 61 nt, Homo Sapiens
guuuccgaaaauggaggcauuccuuuccaaaucuggacagcgaucguuuuuaguguuucug

SEQ ID NO: 556123 - RNA, 61 nt, Homo Sapiens
uuuugagucuguucuuccaggaguaauaaauucuggacaucaucacuggacuggcuuacaa

SEQ ID NO: 556124 - RNA, 61 nt, Homo Sapiens
agaagccuccaagcacagaguggaaagaggcucuggacagccaugccagauucugccucuc

SEQ ID NO: 556125 - RNA, 61 nt, Homo Sapiens
cagugaccuuugaccucggugcugagcagccucuggacagcacugguucuugcaaauggga

SEQ ID NO: 556126 - RNA, 61 nt, Homo Sapiens
ugaauaccuuuucuucggcuuagggagaggcucuggacagaaagcuuguccaucacucuag

SEQ ID NO: 556127 - RNA, 61 nt, Homo Sapiens
gacuaccugagaucacuaaaggaaacuguauucuggacaaaggaguuuugggaaugcacuu

SEQ ID NO: 556128 - RNA, 61 nt, Homo Sapiens
ugguuacuaguacagguuuucauaggaggggucuggacaugcaagggacccugggugggag

SEQ ID NO: 556129 - RNA, 61 nt, Homo Sapiens
ugcucaugcccugccaagcacacagaccugcucuggacacugacagcucuucuacuacccc

SEQ ID NO: 556130 - RNA, 61 nt, Homo Sapiens
uguuucugucucauagcacaugugacaaucaucuggacaacagccacaagggggcgcucgg

SEQ ID NO: 556131 - RNA, 61 nt, Homo Sapiens
ccugggcuggggcuuacugggggcugaagguucuggacaugaacaagggucagguagaaga

SEQ ID NO: 556132 - RNA, 61 nt, Homo Sapiens
uaugagaagggccagcugacaaggcuguggcucuggacaccucaugagggagacugucaau

SEQ ID NO: 556133 - RNA, 61 nt, Homo Sapiens
cuccucaauaacugccuuuucaccagaagugucuggacaaauucuuggcuguccccuagag

SEQ ID NO: 556134 - RNA, 61 nt, Homo Sapiens
acgucugugguuuaagcuuuaguauuccauuucuggacauggauguucauccuaacaugac

SEQ ID NO: 556135 - RNA, 61 nt, Homo Sapiens
uguauagaauaaaccuuuuaacaguugcaagucuggacaaaaaaguugugcauguauguau

SEQ ID NO: 556136 - RNA, 63 nt, Homo Sapiens
uggggucuccaggcaggguagaaagaaaagaaagagaagaagcaggaauggcgugggaugggg

SEQ ID NO: 556137 - RNA, 63 nt, Homo Sapiens
ggagaaaagaccaugaaauuggggaaaaaaccugagaagaaaggagaaaauauuaauuuucaa

SEQ ID NO: 556138 - RNA, 63 nt, Homo Sapiens
aaagccaggaaagucaaaaaaacgaaagagaaggagaagaaaaaggaaaagggcaaauugaaa

SEQ ID NO: 556139 - RNA, 63 nt, Homo Sapiens
agcagaaagguacucugaaacaugguggccugagagaagaagagcuggagaaaaugaaagaag

SEQ ID NO: 556140 - RNA, 63 nt, Homo Sapiens
acuguaugugacaauuaccuugaagcagaaguagagaagaaagcuaaagugacacaaagagaa

SEQ ID NO: 556141 - RNA, 63 nt, Homo Sapiens
aaaagaaaaaagauagaaaaauuagaucgacuggagaagaaaauuauuucccaauuacaggaa

SEQ ID NO: 556142 - RNA, 63 nt, Homo Sapiens
uggauuccccuggguagauggagaaagauggaggagaagaacugagagagagagagagagaga

SEQ ID NO: 556143 - RNA, 63 nt, Homo Sapiens
ugcaacguggggagagggaacaauuucggaggagagaagaaagccagaaggaggacuuugggc

SEQ ID NO: 556144 - RNA, 63 nt, Homo Sapiens
uagugaggucauugaaccucauugaagagaugggagaagaagauagaagguggagaugaugau

SEQ ID NO: 556145 - RNA, 63 nt, Homo Sapiens
cagacaacucagaggacaguuaaaggugaugaugagaagaauaucuguauuugcaaaugcaga

SEQ ID NO: 556146 - RNA, 63 nt, Homo Sapiens
cauuuuguuuuuauuaaaugucaugacuggugagagaagaaaaaaaucuuaaaaguguuguua

SEQ ID NO: 556147 - RNA, 63 nt, Homo Sapiens
aagaaaaguaacugguugucauucacuguuggggagaagaaacuaagcaccauggccuugaug

SEQ ID NO: 556148 - RNA, 63 nt, Homo Sapiens
uuucugauaucucuaaaaugcuguuaaguucuggagaagaacuucaggagaagaagaucuauc

SEQ ID NO: 556149 - RNA, 63 nt, Homo Sapiens
aaaaugcuguuaaguucuggagaagaacuucaggagaagaagaucuaucagcuggcuuuuaaa

SEQ ID NO: 556150 - RNA, 63 nt, Homo Sapiens
uuguauuugcagcuagagguagucaaauguuaagagaagaaacacgauccaucucccuuugug

SEQ ID NO: 556151 - RNA, 63 nt, Homo Sapiens
ugaggcucugagcggaugcaccccucuguccacgagaagaagcuaagcgggaacccuuaggau

SEQ ID NO: 556152 - RNA, 63 nt, Homo Sapiens
ggagagcagcaauuggagcugcacccagcugaagagaagaaauaggguccucuguaugagugu

SEQ ID NO: 556153 - RNA, 63 nt, Homo Sapiens
aagucuuacauagaaaaaaacugaaauguauaagagaagaaccaaagguuagucuucaauaga

SEQ ID NO: 556154 - RNA, 63 nt, Homo Sapiens
cuaguaucucuaagcgguaacuuuaagaaagaagagaagaaaauggaagaguuguaauauaua

SEQ ID NO: 556155 - RNA, 63 nt, Homo Sapiens
gaauuuacuuuguuugcauuugcuuuaagaugugagaagaaaucauguaaacaaagauaucuu

SEQ ID NO: 556156 - RNA, 63 nt, Homo Sapiens
uuugaugacaauagcugcuuaguuuccuguuaagagaagaaacuuuaucuuuuaauuaugugc

SEQ ID NO: 556157 - RNA, 63 nt, Homo Sapiens
aguccuaguuccuuuguuacuccugugagcaccgagaagaacugggcgacucccagucccacc

SEQ ID NO: 556158 - RNA, 63 nt, Homo Sapiens
gaacauuuaauaaauguaugaccauucauauuugagaagaaaaaguaggcucucacuagaguu

SEQ ID NO: 556159 - RNA, 63 nt, Homo Sapiens
gaauuucugcacacuacacaaguuuacaggaaggagaagaacaugauuuuacagugcacugac

SEQ ID NO: 556160 - RNA, 63 nt, Homo Sapiens
cucaggggugugccugucuguuacacuggaggagagaagaaugagccuacgcugaagauggca

SEQ ID NO: 556161 - RNA, 63 nt, Homo Sapiens
ugugaacugacaggcagccuggacauagagagggagaagaagucagagagggugacaagauag

SEQ ID NO: 556162 - RNA, 63 nt, Homo Sapiens
cccgguacugacaagcuguuggaugaggaaaaagagaagaaacgcaugugugagcagaaggga

SEQ ID NO: 556163 - RNA, 63 nt, Homo Sapiens
aacaaaaauauuauuucuaucgagaggagaaaugagaagaagguggggagagccugugaggac

SEQ ID NO: 556164 - RNA, 63 nt, Homo Sapiens
gagcagcugacagggugggucucccuuaccaaagagaagaaccacucucuggcgcugggguga

SEQ ID NO: 556165 - RNA, 63 nt, Homo Sapiens
cagcggcuugugcucacucugucugccagguaugagaagaacacguaagaccgccaccacacu

SEQ ID NO: 556166 - RNA, 63 nt, Homo Sapiens
uuugagucucagucugaugacccacacuuccaugagaagaagcagauccccuguguggucucc

SEQ ID NO: 556167 - RNA, 63 nt, Homo Sapiens
aggaccuuggaagagcaagggacagugaggcaggagaagaacaagaaauggauguaagccugg

SEQ ID NO: 556168 - RNA, 63 nt, Homo Sapiens
cuccugcugaagaguuuagaaugaggcagcggugagaagaagggugggagggcgugggggccc

SEQ ID NO: 556169 - RNA, 63 nt, Homo Sapiens
uuuggacacaugaauuaaaucccaagggaaagugagaagaaaauuaauguauuagcaaccagu

SEQ ID NO: 556170 - RNA, 63 nt, Homo Sapiens
agagaaaugcaucacuuccaaacccauguauuagagaagaagggcgugaaauuuaucaccuaa

SEQ ID NO: 556171 - RNA, 63 nt, Homo Sapiens
ggauauguuuugguaaauguagacugugcacuugagaagaauguauuuugaguuguuggguac

SEQ ID NO: 556172 - RNA, 63 nt, Homo Sapiens
cgcuggcuguaugaaacuugugugacucucccagagaagaagcgucugaaaccgguuuuaaaa

SEQ ID NO: 556173 - RNA, 63 nt, Homo Sapiens
uaaaaguuugguggugggugaaauuccagaggggagaagaauggcuacaauugcugugcaaag

SEQ ID NO: 556174 - RNA, 63 nt, Homo Sapiens
auaaaaaaagaaagaaagaaaagaagaagaaaagagaagaaggagaaggagaugaaggaggag

SEQ ID NO: 556175 - RNA, 63 nt, Homo Sapiens
gagaaggagaugaaggaggaggaggaggagaaggagaagaagaagaagaagaagaccacaaaa

SEQ ID NO: 556176 - RNA, 63 nt, Homo Sapiens
cauggggugucccgugagugugaguguggcagugagaagaagcaucgagggcgaggggaauau

SEQ ID NO: 556177 - RNA, 63 nt, Homo Sapiens
gggagcuguuuugucagugucuuggggucacaggagaagaaagcgggacuuuggugggaagga

SEQ ID NO: 556178 - RNA, 63 nt, Homo Sapiens
auauguuucucaagcaaccugcaucuuuuaugagagaagaaagagugagagaagaauugccuc

SEQ ID NO: 556179 - RNA, 63 nt, Homo Sapiens
aaccugcaucuuuuaugagagaagaaagagugagagaagaauugccucuggacuaucaucaau

SEQ ID NO: 556180 - RNA, 63 nt, Homo Sapiens
uccuccaaaugcucuggagaggcccccacccuugagaagaacugacacagagaagaacauuuu

SEQ ID NO: 556181 - RNA, 63 nt, Homo Sapiens
gagaggcccccacccuugagaagaacugacacagagaagaacauuuucucaggcucguagaga

SEQ ID NO: 556182 - RNA, 63 nt, Homo Sapiens
ccagcaguugccccacccuguguaguuguugaggagaagaagccucaacuuacccaggaggag

SEQ ID NO: 556183 - RNA, 63 nt, Homo Sapiens
auaggccuucgagcaaaagcaaagauccaccgagagaagaagagaaagaaaagaaaaagaaaa

SEQ ID NO: 556184 - RNA, 63 nt, Homo Sapiens
aguaggaagcggacccgcuccagaaguccccacgagaagaagaagaagaggcggucccggucg

SEQ ID NO: 556185 - RNA, 63 nt, Homo Sapiens
ugacgaugaugaccagucguccaaaaaaaaaaagagaagaagauacauggauccaggcuucug

SEQ ID NO: 556186 - RNA, 63 nt, Homo Sapiens
uacuacaaggcaaggagccgauuggauucugaggagaagaaccuagaucagaaaucugacuag

SEQ ID NO: 556187 - RNA, 63 nt, Homo Sapiens
gggaugcaaggagcugccugguugacuggguuagagaagaaccgaaacagucuugagccuggg

SEQ ID NO: 556188 - RNA, 63 nt, Homo Sapiens
cgaaccuuaagacgccagauaauucacugugaagagaagaaccaggagacagaggcuuuuuug

SEQ ID NO: 556189 - RNA, 63 nt, Homo Sapiens
cauauccauugugguuaguuacucaguuauguugagaagaaucuggagcuaaaagcagagaug

SEQ ID NO: 556190 - RNA, 63 nt, Homo Sapiens
uucauuuucaaaaacuauuuaccaaaacaaauggagaagaaacauccaaaagcacauuucauu

SEQ ID NO: 556191 - RNA, 63 nt, Homo Sapiens
auuaaugaugcuuaaagagaaaagaaaaaaagagagaagaaaaaggagagaugaaaaaggagg

SEQ ID NO: 556192 - RNA, 63 nt, Homo Sapiens
gaagaaaaaggagagaugaaaaaggaggaugaggagaagaauuaccuuuugacaaucuguuag

SEQ ID NO: 556193 - RNA, 63 nt, Homo Sapiens
cauugggugacuaugacuaauuucugguaguaugagaagaaauuccgacuuuauagcaggaac

SEQ ID NO: 556194 - RNA, 63 nt, Homo Sapiens
aaagagcaaaaaugagaccuuagaggcuauacagagaagaaaagcauuggcaggaaaaagcuc

SEQ ID NO: 556195 - RNA, 63 nt, Homo Sapiens
ggaaguagggcagugcaugauuaaccugcaauagagaagaaagaaacugccuacaggccauag

SEQ ID NO: 556196 - RNA, 63 nt, Homo Sapiens
acugccuacaggccauaguuaaaaaaaaaaaaagagaagaaaaugacagaacaagacugucuc

SEQ ID NO: 556197 - RNA, 63 nt, Homo Sapiens
cauuuggggugguugggucaugacagcuaccaugagaagaagugucccguuuuguccaguggc

SEQ ID NO: 556198 - RNA, 63 nt, Homo Sapiens
aggaggugggagguggaugguucuuauucuguggagaagaagggcgggaagaacuuccuuuca

SEQ ID NO: 556199 - RNA, 63 nt, Homo Sapiens
cucugauaagaucgacaaaagaaacaacaaaaugagaagaagagguuccucgaaaggggggag

SEQ ID NO: 556200 - RNA, 63 nt, Homo Sapiens
caaaaugagaagaagagguuccucgaaaggggggagaagaaauuuugagaauggaaaaauccc

SEQ ID NO: 556201 - RNA, 63 nt, Homo Sapiens
ccagcuggcacuugacagggugcagucauuggugagaagaaucagaaaaagaagacccaucag

SEQ ID NO: 556202 - RNA, 63 nt, Homo Sapiens
uccaaaaaaagaaaauagagcuuuauaagcagagagaagaaaauaaucaucuaagaccaucuc

SEQ ID NO: 556203 - RNA, 63 nt, Homo Sapiens
cuucucuuucuaaaaaaaaaaaaaaaaaagaaagagaagaaagaagugauuccuacccccuac

SEQ ID NO: 556204 - RNA, 63 nt, Homo Sapiens
uuucuuagcucaagagagaggcugagaaaugcagagaagaauaagacauaaaauagcuccgac

SEQ ID NO: 556205 - RNA, 63 nt, Homo Sapiens
aaauauuuaaguaaaaacaaaaugaugcauuuugagaagaacaaagugugcacucagcggcug

SEQ ID NO: 556206 - RNA, 63 nt, Homo Sapiens
uaaauguguaagucacccccaccaaaaacaaaagagaagaaaaagaauagaaagaauuaucca

SEQ ID NO: 556207 - RNA, 63 nt, Homo Sapiens
cuacucauucaaagcacauuguagauauucagagagaagaacaaauggcuggcuuggcaaauc

SEQ ID NO: 556208 - RNA, 64 nt, Homo Sapiens
gaaacaguuuauguauaggauagcuauaaguaaauacugaaacacauuaugccucuguaauugg

SEQ ID NO: 556209 - RNA, 64 nt, Homo Sapiens
agaccaucuggccaacauggugaaacccugucucuacugaaaauaaaaaaaacuagcugggcau

SEQ ID NO: 556210 - RNA, 64 nt, Homo Sapiens
uccucuuggguuucaucuugucguuuaagaaauguacugaaauaaucauuggaauauuugcauu

SEQ ID NO: 556211 - RNA, 64 nt, Homo Sapiens
uuuggcuguuuguaggaucacguuguccuuacgauacugaaacuuuacagcugcuguaaauuuu

SEQ ID NO: 556212 - RNA, 64 nt, Homo Sapiens
gagaaaauccccaacuaugcauuuaaccccuugguacugaaaauuugggagaagagaugcugcc

SEQ ID NO: 556213 - RNA, 64 nt, Homo Sapiens
gauuccuggacaucaccagucaucuucaauuuauuacugaaaauucauucugcuacuucacugu

SEQ ID NO: 556214 - RNA, 64 nt, Homo Sapiens
ccaagugauuguuauuuccauuuucuguuaugauuacugaaaccugauuuauugcuuugucacu

SEQ ID NO: 556215 - RNA, 64 nt, Homo Sapiens
ucuauuacuacuuagcguguuucuaaugagaaguuacugaaaucuauuacuguccuuaauaaaa

SEQ ID NO: 556216 - RNA, 64 nt, Homo Sapiens
uuaucagggagcccaaacacccagcauagccaacuacugaaaugauuuuguuaauucuguauaa

SEQ ID NO: 556217 - RNA, 64 nt, Homo Sapiens
uuuggcuaaaacaggaugauugcuuuugucuguuuacugaaaaaugaguuuagaaaggcuagcc

SEQ ID NO: 556218 - RNA, 64 nt, Homo Sapiens
gugcuuuucacaccaucucagagguugaggagcauacugaaaauugcccuggggggugcugggu

SEQ ID NO: 556219 - RNA, 64 nt, Homo Sapiens
uuuccuucucccuuucuucuuugccuucuaaauauacugaaaugauuuagauaugugucaacaa

SEQ ID NO: 556220 - RNA, 64 nt, Homo Sapiens
aauuggcaagcaguuugaguuuauacucaugacauacugaaagcaucucuuuggggucaagaaa

SEQ ID NO: 556221 - RNA, 64 nt, Homo Sapiens
aggaucuccuaggucauugcuucgcagcugugauuacugaaauccuccucauaggagauaaagu

SEQ ID NO: 556222 - RNA, 64 nt, Homo Sapiens
ccuauguguuuuuuuaauugaaucuaggccaaaauacugaaaaguuuggacucauuugaacaaa

SEQ ID NO: 556223 - RNA, 64 nt, Homo Sapiens
aaugaauuucaagauucucauuauuguuuuauucuacugaaaaaacuuuacguuuucaugcugc

SEQ ID NO: 556224 - RNA, 64 nt, Homo Sapiens
aagcaguggccuauaaagaagaaaauguuauuuuuacugaaagcaucagauugaaaaguuuuga

SEQ ID NO: 556225 - RNA, 64 nt, Homo Sapiens
aaguagaaaauuguuacguauauguugaaaauuguacugaaauaucuugagaaauaguagacug

SEQ ID NO: 556226 - RNA, 64 nt, Homo Sapiens
aauguggcacagcuuuuaacuaaucuucaaaccuuacugaaaguugagaaaauucguacuggag

SEQ ID NO: 556227 - RNA, 64 nt, Homo Sapiens
aaccaauccucaaaccucacuaaacauaagauaauacugaaaacuuuacaaaccugaaugaugu

SEQ ID NO: 556228 - RNA, 64 nt, Homo Sapiens
uauuuuuaacucuuauguuccgcauauaggguuuuacugaaaucuauacuguguacacauaaga

SEQ ID NO: 556229 - RNA, 64 nt, Homo Sapiens
ccgagugaugauguugugaaggggcgagugaaacuacugaaaauacguuagcuacugaauccug

SEQ ID NO: 556230 - RNA, 64 nt, Homo Sapiens
augaucuuggaauauuugcugggaaacgagaagguacugaaauauuuuauguauagauuuagag

SEQ ID NO: 556231 - RNA, 64 nt, Homo Sapiens
uuguaaguauuuaagugaucauaaguuacgcaguuacugaaauccccaaaauacgcaauuucag

SEQ ID NO: 556232 - RNA, 64 nt, Homo Sapiens
auuuucuccaaauaaaaauuuuagaauaauuucauacugaaauuuguauguuagaauaauuuua

SEQ ID NO: 556233 - RNA, 64 nt, Homo Sapiens
ggugauuacuccugaagugauuaccaaggggaauuacugaaaaaugagcaaagaaacuugugcu

SEQ ID NO: 556234 - RNA, 64 nt, Homo Sapiens
gugguguugguauccaacuacacgaacuucgaccuacugaaaagccaagcucuuagcgguuauc

SEQ ID NO: 556235 - RNA, 64 nt, Homo Sapiens
gagucaggaaaacuacagguaacccucuccuguuuacugaaaagguguguuuccugcugacuac

SEQ ID NO: 556236 - RNA, 64 nt, Homo Sapiens
aggacuucuugucagaaacacucauacugaagaguacugaaacacucaguccugcaaguaagga

SEQ ID NO: 556237 - RNA, 64 nt, Homo Sapiens
cacuuauauuagucuuuauguucaccagugauuuuacugaaaugaagaaugaucauaaauguac

SEQ ID NO: 556238 - RNA, 64 nt, Homo Sapiens
ucagugcauaguuagauaaaaugguaaaauguuuuacugaaagcauacuuuuuuggaaaauaga

SEQ ID NO: 556239 - RNA, 64 nt, Homo Sapiens
aauaccacagcauuuguacuguuccuuuuuaauauacugaaaauauaaaaggaagggugugugu

SEQ ID NO: 556240 - RNA, 64 nt, Homo Sapiens
aaaucacuuccuugaaaauuaggauccaauggaauacugaaaagacacacacacauucacccua

SEQ ID NO: 556241 - RNA, 64 nt, Homo Sapiens
accauccauuugggaaagaacacaaggggaaggguacugaaaacaagccuggagccaaagauga

SEQ ID NO: 556242 - RNA, 64 nt, Homo Sapiens
acagcaagccugaugguuugucuuauuucauucauacugaaaauucuuugcauauuuuuuuucu

SEQ ID NO: 556243 - RNA, 64 nt, Homo Sapiens
agccuagaguaucuugugccacagaaaaaugaaguacugaaauuaaaaaaaaaaaaucauagug

SEQ ID NO: 556244 - RNA, 64 nt, Homo Sapiens
aaaagaggaaaggcuggaaguuaucauugaugccuacugaaauaaaauuguacauaagauugau

SEQ ID NO: 556245 - RNA, 64 nt, Homo Sapiens
uaaaacacaacaggaagcaaauuccaagcacauuuacugaaaugguaucugaacaagaaucuau

SEQ ID NO: 556246 - RNA, 64 nt, Homo Sapiens
aaaaauuuuaaaaaaggcuggaguaaauuuaauguacugaaaaucauuuuuagaauguuuuuau

SEQ ID NO: 556247 - RNA, 64 nt, Homo Sapiens
ggacaccuuguguacucgauagagaaggcuuugguacugaaacuugagucuuacgugcacaaaa

SEQ ID NO: 556248 - RNA, 64 nt, Homo Sapiens
uuccccaaacaauagcaaauuucuuaauucaacuuacugaaaauugagaacuaaaaauagaugg

SEQ ID NO: 556249 - RNA, 64 nt, Homo Sapiens
cuuaaugagcaauuacuugaugauuuaguucaaauacugaaauaccugccagaauguucucaaa

SEQ ID NO: 556250 - RNA, 64 nt, Homo Sapiens
cccacuguguuuugcucacuuuuuaucuaacggcuacugaaacacugcuguauccagaagccag

SEQ ID NO: 556251 - RNA, 64 nt, Homo Sapiens
acccuggggagauugauuguugaggggaggaucuuacugaaagcguuuagaggcuagagggagc

SEQ ID NO: 556252 - RNA, 64 nt, Homo Sapiens
gcuuugaaaauuuggaauuuauauauacugaaaauacugaaacuaaccauuauaaaaucccaac

SEQ ID NO: 556253 - RNA, 64 nt, Homo Sapiens
acugaaacugcuuugaaaauaaucccaacauauauacugaaaaucuggccaugaaccauuauaa

SEQ ID NO: 556254 - RNA, 64 nt, Homo Sapiens
cacuuuuaugagcaucugccuauacugaaaauguuacugaaaguaugaaauguaaauccauuuu

SEQ ID NO: 556255 - RNA, 64 nt, Homo Sapiens
guuacugaaagucacuuuuauaaauccauuuuuauacugaaaaugguuuuccagaaaugaaaug

SEQ ID NO: 556256 - RNA, 64 nt, Homo Sapiens
acuuuaaaacucuggcuggaaaacaccuuaacuucuaaccaaagccaggcagacagaaccuugc

SEQ ID NO: 556257 - RNA, 64 nt, Homo Sapiens
aacaagaaucucacuaucagcugcgccaggaagucuaaccaaggucagucuuccgcaggcuuac

SEQ ID NO: 556258 - RNA, 64 nt, Homo Sapiens
gaauauaugaggacugcaugaauacuuuaguuugcuaaccaacuuguacaucccauaaauaaaa

SEQ ID NO: 556259 - RNA, 64 nt, Homo Sapiens
uggacauggugaauaaaucauacugcauaacaagcuaaccaaacaaaaccugauauuucacuua

SEQ ID NO: 556260 - RNA, 64 nt, Homo Sapiens
gcaaaucuuacagccggucaagaagcaggagcaggagccggagccggagcaagucccguucugu

SEQ ID NO: 556261 - RNA, 64 nt, Homo Sapiens
cuuacagccggucaagaagcaggagcaggagccggagccggagcaagucccguucuguuaguag

SEQ ID NO: 556262 - RNA, 64 nt, Homo Sapiens
cucagagcaugaucacauugcagaaagauucuggaagguccauguagagggcagacauugaaga

SEQ ID NO: 556263 - RNA, 64 nt, Homo Sapiens
uuuucacaucauaaaacaucuauuacauaaaauaaagguccaggcauaguggcucuugccugua

SEQ ID NO: 556264 - RNA, 64 nt, Homo Sapiens
cuaaacccagaacucaaacuuaacauuagaaaauaagguccagggccggacacaguggcccaug

SEQ ID NO: 556265 - RNA, 64 nt, Homo Sapiens
aagagugaaacuccaucucaaaaaaaaagaaaagaagguccagcuuuuggauucaaugaguggg

SEQ ID NO: 556266 - RNA, 64 nt, Homo Sapiens; identical to SEQ ID NO: 88546

SEQ ID NO: 556267 - RNA, 64 nt, Homo Sapiens; identical to SEQ ID NO: 88547

SEQ ID NO: 556268 - RNA, 51 nt, Homo Sapiens; identical to SEQ ID NO: 88548

SEQ ID NO: 556269 - RNA, 64 nt, Homo Sapiens; identical to SEQ ID NO: 88549

SEQ ID NO: 556270 - RNA, 64 nt, Homo Sapiens; identical to SEQ ID NO: 88550

SEQ ID NO: 556271 - RNA, 64 nt, Homo Sapiens; identical to SEQ ID NO: 88551

SEQ ID NO: 556272 - RNA, 64 nt, Homo Sapiens; identical to SEQ ID NO: 88552

SEQ ID NO: 556273 - RNA, 64 nt, Homo Sapiens; identical to SEQ ID NO: 88553

SEQ ID NO: 556274 - RNA, 64 nt, Homo Sapiens; identical to SEQ ID NO: 88554

SEQ ID NO: 556275 - RNA, 64 nt, Homo Sapiens; identical to SEQ ID NO: 88555

SEQ ID NO: 556276 - RNA, 64 nt, Homo Sapiens; identical to SEQ ID NO: 88556

SEQ ID NO: 556277 - RNA, 64 nt, Homo Sapiens; identical to SEQ ID NO: 88557

SEQ ID NO: 556278 - RNA, 64 nt, Homo Sapiens; identical to SEQ ID NO: 88558

SEQ ID NO: 556279 - RNA, 64 nt, Homo Sapiens; identical to SEQ ID NO: 88559

SEQ ID NO: 556280 - RNA, 64 nt, Homo Sapiens; identical to SEQ ID NO: 88560

SEQ ID NO: 556281 - RNA, 64 nt, Homo Sapiens; identical to SEQ ID NO: 88561

SEQ ID NO: 556282 - RNA, 64 nt, Homo Sapiens; identical to SEQ ID NO: 88562

SEQ ID NO: 556283 - RNA, 64 nt, Homo Sapiens; identical to SEQ ID NO: 88563

SEQ ID NO: 556284 - RNA, 64 nt, Homo Sapiens; identical to SEQ ID NO: 88564

SEQ ID NO: 556285 - RNA, 64 nt, Homo Sapiens; identical to SEQ ID NO: 88565

SEQ ID NO: 556286 - RNA, 64 nt, Homo Sapiens; identical to SEQ ID NO: 88566

SEQ ID NO: 556287 - RNA, 64 nt, Homo Sapiens; identical to SEQ ID NO: 88567

SEQ ID NO: 556288 - RNA, 64 nt, Homo Sapiens; identical to SEQ ID NO: 88568

SEQ ID NO: 556289 - RNA, 64 nt, Homo Sapiens; identical to SEQ ID NO: 88569

SEQ ID NO: 556290 - RNA, 64 nt, Homo Sapiens; identical to SEQ ID NO: 88570

SEQ ID NO: 556291 - RNA, 64 nt, Homo Sapiens; identical to SEQ ID NO: 88571

SEQ ID NO: 556292 - RNA, 64 nt, Homo Sapiens; identical to SEQ ID NO: 88572

SEQ ID NO: 556293 - RNA, 64 nt, Homo Sapiens; identical to SEQ ID NO: 88573

SEQ ID NO: 556294 - RNA, 64 nt, Homo Sapiens; identical to SEQ ID NO: 88574

SEQ ID NO: 556295 - RNA, 64 nt, Homo Sapiens; identical to SEQ ID NO: 88575

SEQ ID NO: 556296 - RNA, 64 nt, Homo Sapiens; identical to SEQ ID NO: 88576

SEQ ID NO: 556297 - RNA, 64 nt, Homo Sapiens; identical to SEQ ID NO: 88577

SEQ ID NO: 556298 - RNA, 64 nt, Homo Sapiens; identical to SEQ ID NO: 88578

SEQ ID NO: 556299 - RNA, 64 nt, Homo Sapiens; identical to SEQ ID NO: 88579

SEQ ID NO: 556300 - RNA, 64 nt, Homo Sapiens; identical to SEQ ID NO: 88580

SEQ ID NO: 556301 - RNA, 64 nt, Homo Sapiens; identical to SEQ ID NO: 88581

SEQ ID NO: 556302 - RNA, 64 nt, Homo Sapiens; identical to SEQ ID NO: 88582

SEQ ID NO: 556303 - RNA, 64 nt, Homo Sapiens; identical to SEQ ID NO: 88583

SEQ ID NO: 556304 - RNA, 64 nt, Homo Sapiens; identical to SEQ ID NO: 88584

SEQ ID NO: 556305 - RNA, 64 nt, Homo Sapiens; identical to SEQ ID NO: 88585

SEQ ID NO: 556306 - RNA, 64 nt, Homo Sapiens; identical to SEQ ID NO: 88586

SEQ ID NO: 556307 - RNA, 64 nt, Homo Sapiens; identical to SEQ ID NO: 88587

SEQ ID NO: 556308 - RNA, 64 nt, Homo Sapiens; identical to SEQ ID NO: 88588

SEQ ID NO: 556309 - RNA, 64 nt, Homo Sapiens; identical to SEQ ID NO: 88589

SEQ ID NO: 556310 - RNA, 64 nt, Homo Sapiens; identical to SEQ ID NO: 88590

SEQ ID NO: 556311 - RNA, 64 nt, Homo Sapiens; identical to SEQ ID NO: 88591

SEQ ID NO: 556312 - RNA, 64 nt, Homo Sapiens; identical to SEQ ID NO: 88592

SEQ ID NO: 556313 - RNA, 64 nt, Homo Sapiens; identical to SEQ ID NO: 88593

SEQ ID NO: 556314 - RNA, 64 nt, Homo Sapiens; identical to SEQ ID NO: 239468

SEQ ID NO: 556315 - RNA, 64 nt, Homo Sapiens; identical to SEQ ID NO: 239469

SEQ ID NO: 556316 - RNA, 64 nt, Homo Sapiens; identical to SEQ ID NO: 239470

SEQ ID NO: 556317 - RNA, 64 nt, Homo Sapiens; identical to SEQ ID NO: 239471

SEQ ID NO: 556318 - RNA, 64 nt, Homo Sapiens; identical to SEQ ID NO: 239472

SEQ ID NO: 556319 - RNA, 64 nt, Homo Sapiens; identical to SEQ ID NO: 239473

SEQ ID NO: 556320 - RNA, 64 nt, Homo Sapiens; identical to SEQ ID NO: 239474

SEQ ID NO: 556321 - RNA, 64 nt, Homo Sapiens; identical to SEQ ID NO: 239475

SEQ ID NO: 556322 - RNA, 64 nt, Homo Sapiens; identical to SEQ ID NO: 239476

SEQ ID NO: 556323 - RNA, 64 nt, Homo Sapiens; identical to SEQ ID NO: 239477

SEQ ID NO: 556324 - RNA, 64 nt, Homo Sapiens; identical to SEQ ID NO: 239478

SEQ ID NO: 556325 - RNA, 64 nt, Homo Sapiens; identical to SEQ ID NO: 239479

SEQ ID NO: 556326 - RNA, 64 nt, Homo Sapiens; identical to SEQ ID NO: 239480

SEQ ID NO: 556327 - RNA, 64 nt, Homo Sapiens; identical to SEQ ID NO: 239481

SEQ ID NO: 556328 - RNA, 64 nt, Homo Sapiens; identical to SEQ ID NO: 239482

SEQ ID NO: 556329 - RNA, 64 nt, Homo Sapiens; identical to SEQ ID NO: 239483

SEQ ID NO: 556330 - RNA, 64 nt, Homo Sapiens; identical to SEQ ID NO: 239484

SEQ ID NO: 556331 - RNA, 64 nt, Homo Sapiens; identical to SEQ ID NO: 239485

SEQ ID NO: 556332 - RNA, 64 nt, Homo Sapiens; identical to SEQ ID NO: 239486

SEQ ID NO: 556333 - RNA, 64 nt, Homo Sapiens; identical to SEQ ID NO: 239487

SEQ ID NO: 556334 - RNA, 64 nt, Homo Sapiens; identical to SEQ ID NO: 239488

SEQ ID NO: 556335 - RNA, 64 nt, Homo Sapiens; identical to SEQ ID NO: 239489

SEQ ID NO: 556336 - RNA, 64 nt, Homo Sapiens; identical to SEQ ID NO: 239490

SEQ ID NO: 556337 - RNA, 64 nt, Homo Sapiens; identical to SEQ ID NO: 239491

SEQ ID NO: 556338 - RNA, 64 nt, Homo Sapiens; identical to SEQ ID NO: 239492

SEQ ID NO: 556339 - RNA, 64 nt, Homo Sapiens; identical to SEQ ID NO: 239493

SEQ ID NO: 556340 - RNA, 64 nt, Homo Sapiens; identical to SEQ ID NO: 239494

SEQ ID NO: 556341 - RNA, 64 nt, Homo Sapiens; identical to SEQ ID NO: 239495

SEQ ID NO: 556342 - RNA, 64 nt, Homo Sapiens; identical to SEQ ID NO: 239496

SEQ ID NO: 556343 - RNA, 64 nt, Homo Sapiens; identical to SEQ ID NO: 239497

SEQ ID NO: 556344 - RNA, 64 nt, Homo Sapiens; identical to SEQ ID NO: 239498

SEQ ID NO: 556345 - RNA, 64 nt, Homo Sapiens; identical to SEQ ID NO: 239499

SEQ ID NO: 556346 - RNA, 64 nt, Homo Sapiens; identical to SEQ ID NO: 239500

SEQ ID NO: 556347 - RNA, 64 nt, Homo Sapiens; identical to SEQ ID NO: 239501

SEQ ID NO: 556348 - RNA, 64 nt, Homo Sapiens; identical to SEQ ID NO: 239502

SEQ ID NO: 556349 - RNA, 64 nt, Homo Sapiens; identical to SEQ ID NO: 239503

SEQ ID NO: 556350 - RNA, 64 nt, Homo Sapiens; identical to SEQ ID NO: 239504

SEQ ID NO: 556351 - RNA, 64 nt, Homo Sapiens; identical to SEQ ID NO: 239505

SEQ ID NO: 556352 - RNA, 64 nt, Homo Sapiens; identical to SEQ ID NO: 239506

SEQ ID NO: 556353 - RNA, 64 nt, Homo Sapiens; identical to SEQ ID NO: 239507

SEQ ID NO: 556354 - RNA, 64 nt, Homo Sapiens; identical to SEQ ID NO: 239508

SEQ ID NO: 556355 - RNA, 64 nt, Homo Sapiens; identical to SEQ ID NO: 239509

SEQ ID NO: 556356 - RNA, 64 nt, Homo Sapiens; identical to SEQ ID NO: 239510

SEQ ID NO: 556357 - RNA, 64 nt, Homo Sapiens; identical to SEQ ID NO: 239511

SEQ ID NO: 556358 - RNA, 64 nt, Homo Sapiens; identical to SEQ ID NO: 239512

SEQ ID NO: 556359 - RNA, 64 nt, Homo Sapiens; identical to SEQ ID NO: 239513

SEQ ID NO: 556360 - RNA, 64 nt, Homo Sapiens; identical to SEQ ID NO: 239514

SEQ ID NO: 556361 - RNA, 64 nt, Homo Sapiens
gucugcuugucuuagauguugguggugcagccccaggaccaagcuuaaggagaggagagcaucu

SEQ ID NO: 556362 - RNA, 64 nt, Homo Sapiens
uguccgggggucuaggacuuuagggaucuggggaaggaccaacccaugcccugccaagccugga

SEQ ID NO: 556363 - RNA, 64 nt, Homo Sapiens
gucuuuuaaucuuaaccccagcuaaaugacucugaggaccaacaguacauuucuuuuauguuuu

SEQ ID NO: 556364 - RNA, 64 nt, Homo Sapiens
uggcaucagagccagaaaugcccucccuagguccaggaccaaagauaaaacaaacacgaggaac

SEQ ID NO: 556365 - RNA, 64 nt, Homo Sapiens
aaauguuggggaaucuauacgaaagaaauugcaaaggaccaaaaugguuucuucaaccaaaaaa

SEQ ID NO: 556366 - RNA, 64 nt, Homo Sapiens
agucuucugaaggucaugccaucuuccaaaacagaggaccaacccaugugcuuggcacucaagg

SEQ ID NO: 556367 - RNA, 64 nt, Homo Sapiens
cucuccaacgaccagaauauucuacccaaaugucaggaccaagauuuucuaccaaaauaucagg

SEQ ID NO: 556368 - RNA, 64 nt, Homo Sapiens
cuggacuaucaucaauauguuguaccuaaaauccaggaccaagacuccccuagagaacagguag

SEQ ID NO: 556369 - RNA, 64 nt, Homo Sapiens
ugacucucuccccuacacccacuaccuggcauccaggaccaaauaccuggacuaucaaccuugu

SEQ ID NO: 556370 - RNA, 64 nt, Homo Sapiens
aaacuuuaccacuuggaggacacgggguuaguccaggaccaaagaggccaauggauuuuucaaa

SEQ ID NO: 556371 - RNA, 64 nt, Homo Sapiens
cccaggggaucagugaaggauaauuucuaaagguaggaccaacacugggggaggggugcuguuu

SEQ ID NO: 556372 - RNA, 64 nt, Homo Sapiens
cauagaacaauuucacugcauucuuagacuccacaggaccaaacaugaccaaagacugucagau

SEQ ID NO: 556373 - RNA, 64 nt, Homo Sapiens
uuuugguacauauccauaaauucuccauaaaaguaggaccaacuuacauuaccaccaauagugu

SEQ ID NO: 556374 - RNA, 64 nt, Homo Sapiens
cuucucuuuuccuacuuuacauguaaugguugcgaggaccaacuuucaaaugagcuaacuuggg

SEQ ID NO: 556375 - RNA, 64 nt, Homo Sapiens; identical to SEQ ID NO: 189259

SEQ ID NO: 556376 - RNA, 64 nt, Homo Sapiens; identical to SEQ ID NO: 189260

SEQ ID NO: 556377 - RNA, 64 nt, Homo Sapiens; identical to SEQ ID NO: 189261

SEQ ID NO: 556378 - RNA, 64 nt, Homo Sapiens; identical to SEQ ID NO: 189262

SEQ ID NO: 556379 - RNA, 56 nt, Homo Sapiens; identical to SEQ ID NO: 189263

SEQ ID NO: 556380 - RNA, 64 nt, Homo Sapiens; identical to SEQ ID NO: 189264

SEQ ID NO: 556381 - RNA, 64 nt, Homo Sapiens; identical to SEQ ID NO: 189265

SEQ ID NO: 556382 - RNA, 64 nt, Homo Sapiens; identical to SEQ ID NO: 189266

SEQ ID NO: 556383 - RNA, 64 nt, Homo Sapiens; identical to SEQ ID NO: 189267

SEQ ID NO: 556384 - RNA, 64 nt, Homo Sapiens; identical to SEQ ID NO: 189268

SEQ ID NO: 556385 - RNA, 64 nt, Homo Sapiens; identical to SEQ ID NO: 189269

SEQ ID NO: 556386 - RNA, 64 nt, Homo Sapiens; identical to SEQ ID NO: 189270

SEQ ID NO: 556387 - RNA, 64 nt, Homo Sapiens; identical to SEQ ID NO: 189271

SEQ ID NO: 556388 - RNA, 64 nt, Homo Sapiens; identical to SEQ ID NO: 189272

SEQ ID NO: 556389 - RNA, 64 nt, Homo Sapiens; identical to SEQ ID NO: 189273

SEQ ID NO: 556390 - RNA, 64 nt, Homo Sapiens; identical to SEQ ID NO: 189274

SEQ ID NO: 556391 - RNA, 64 nt, Homo Sapiens; identical to SEQ ID NO: 189275

SEQ ID NO: 556392 - RNA, 64 nt, Homo Sapiens; identical to SEQ ID NO: 189276

SEQ ID NO: 556393 - RNA, 64 nt, Homo Sapiens; identical to SEQ ID NO: 189277

SEQ ID NO: 556394 - RNA, 64 nt, Homo Sapiens; identical to SEQ ID NO: 189278

SEQ ID NO: 556395 - RNA, 64 nt, Homo Sapiens; identical to SEQ ID NO: 189279

SEQ ID NO: 556396 - RNA, 64 nt, Homo Sapiens; identical to SEQ ID NO: 189280

SEQ ID NO: 556397 - RNA, 64 nt, Homo Sapiens
cuauaugaaacauaaguuguguuauaacuuaucagccguauauggaacauaaauaguuucuacc

SEQ ID NO: 556398 - RNA, 64 nt, Homo Sapiens
aucaauuaccuuaauuggccaaaaugagguaaaugccguauaugcccuacuggcaagguuuuua

SEQ ID NO: 556399 - RNA, 64 nt, Homo Sapiens
acaaccugccucauauauuucuaaaggguacagugccguauaaaucacugaaauguuagguuuc

SEQ ID NO: 556400 - RNA, 63 nt, Homo Sapiens
ccaggauucccggcagaagaaccccaugacugcagccguauagcugagugccaccgaggccag

SEQ ID NO: 556401 - RNA, 64 nt, Homo Sapiens
acccugcaaucugguugucuauaauaaaguaguugccguauacacaaagaguuugcauuugaaa

SEQ ID NO: 556402 - RNA, 61 nt, Homo Sapiens
ucauuccuucccuuuauuccuaaggcagucugccguauagaggcucuuggaacugggauaa

SEQ ID NO: 556403 - RNA, 64 nt, Homo Sapiens
aaauuuacaucagaaguuugcaucucgcguauaugccguauaaaagaauuuuuuugucuuucaa

SEQ ID NO: 556404 - RNA, 64 nt, Homo Sapiens
aaaaccuagauacugcagucagauuuuggaaacugccguauagucacuguuuuaaaaaccccgg

SEQ ID NO: 556405 - RNA, 64 nt, Homo Sapiens
auuuguauucaugaacuuggcuguaaucaguuaugccguauaggaugucagacaauaccacugg

SEQ ID NO: 556406 - RNA, 64 nt, Homo Sapiens
ggauccacuuuuuuuuuuuucaaaauguguuucagccguauaguagcauuuagauaaucuugug

SEQ ID NO: 556407 - RNA, 64 nt, Homo Sapiens
ugauacugacuugaauuauuuucuaaaauuaagagccguauaccuaccuguaagucuuuucaca

SEQ ID NO: 556408 - RNA, 64 nt, Homo Sapiens
auaaauaaguguagcaucagaagcaguaggaauggccguauacaaccauccuguuaaacauuua

SEQ ID NO: 556409 - RNA, 64 nt, Homo Sapiens
augcaugcugcucacccuagacaaugacauauaagccguauauagaucaauguccacauauaua

SEQ ID NO: 556410 - RNA, 64 nt, Homo Sapiens
uaauguacucgcaguuuugucaaaagcuccaccggccguauagauugggaagggaaggccaggc

SEQ ID NO: 556411 - RNA, 64 nt, Homo Sapiens
auguguccaauauugugccagggauacaaauauggccguauagccucaggccuucauuucugaa

SEQ ID NO: 556412 - RNA, 64 nt, Homo Sapiens
guuuuuggauaaucuaguucaugugcauuaggcugccguauauacuacuaugauauuuagcugc

SEQ ID NO: 556413 - RNA, 64 nt, Homo Sapiens
gccaucacgucaagcuuuggauaacgaugaaugagccguauacaaggaauaugacauacagugc

SEQ ID NO: 556414 - RNA, 64 nt, Homo Sapiens
auuucucuuacguugaauccccaaucauaauuaagccguauacacagauuaaauuaacagaagc

SEQ ID NO: 556415 - RNA, 64 nt, Homo Sapiens
aggaccauguaugagacacuuuuuuacaaaaagugccguauauacauauguaacaggugagugu

SEQ ID NO: 556416 - RNA, 64 nt, Homo Sapiens
cucagguccugaugagggcguggaccuggcgcaggccguauagaccggccuccccacugggucc

SEQ ID NO: 556417 - RNA, 64 nt, Homo Sapiens
ucaggagucauuagcagugaugauuuuggguccugccguauaaucuguucuucuauucccacgu

SEQ ID NO: 556418 - RNA, 64 nt, Homo Sapiens
cucaccggccagagaagaccacugugagcauuuugccguauauccugcccugccauuuguucac

SEQ ID NO: 556419 - RNA, 64 nt, Homo Sapiens
gaguuagcguccuguagauacacacagagacuaggccguauauuaacuagaagcagcuuuaugu

SEQ ID NO: 556420 - RNA, 64 nt, Homo Sapiens
ucuccucuggucugccccuuuucaaauccuaauggccguauaucuccuuuggcaagagcugggu

SEQ ID NO: 556421 - RNA, 64 nt, Homo Sapiens
uugaaaauaaacaucugguuuaaacuugguguaggccguauauucuggauauuaucucccuuua

SEQ ID NO: 556422 - RNA, 64 nt, Homo Sapiens
uauauacaacuauauauacaccuuugugucuacugccguauacaacugaucugugauugcucuc

SEQ ID NO: 556423 - RNA, 63 nt, Homo Sapiens; identical to SEQ ID NO: 354303

SEQ ID NO: 556424 - RNA, 63 nt, Homo Sapiens; identical to SEQ ID NO: 354304

SEQ ID NO: 556425 - RNA, 63 nt, Homo Sapiens; identical to SEQ ID NO: 354305

SEQ ID NO: 556426 - RNA, 63 nt, Homo Sapiens; identical to SEQ ID NO: 354306

SEQ ID NO: 556427 - RNA, 63 nt, Homo Sapiens; identical to SEQ ID NO: 354307

SEQ ID NO: 556428 - RNA, 63 nt, Homo Sapiens; identical to SEQ ID NO: 354308

SEQ ID NO: 556429 - RNA, 63 nt, Homo Sapiens; identical to SEQ ID NO: 354309

SEQ ID NO: 556430 - RNA, 63 nt, Homo Sapiens; identical to SEQ ID NO: 354310

SEQ ID NO: 556431 - RNA, 62 nt, Homo Sapiens
gcaacaggaggcugggaaaugguggggaguggggccguaacuggguacaauagggggaaccu

SEQ ID NO: 556432 - RNA, 62 nt, Homo Sapiens
ugaaagagaccggaccagcugaccccagccucggccguaaagcaguuuggcuucacuucucu

SEQ ID NO: 556433 - RNA, 62 nt, Homo Sapiens
gucauggcuguuucccagacagcugaucaagaggccguaaugagcuacugaguggaacaugg

SEQ ID NO: 556434 - RNA, 62 nt, Homo Sapiens
cauucagaggaggaggggauuucucucuucaaggccguaacaguggaagaacagucauaugc

SEQ ID NO: 556435 - RNA, 62 nt, Homo Sapiens
cucugggggggccggaaagucucccuggagaaggccguaauaucugggccuuggaaggaagg

SEQ ID NO: 556436 - RNA, 62 nt, Homo Sapiens
ugagcguucaguugacacaugcucccagcagaggccguaaauaaguccuuucccgaugcgug

SEQ ID NO: 556437 - RNA, 62 nt, Homo Sapiens
ggaauuucguugccauuuuuucucagacaccuggccguaaaaucaguuuguuacagcauucu

SEQ ID NO: 556438 - RNA, 62 nt, Homo Sapiens
cagaguuaauccauacagaagagguuauuacuggccguaagguggauacgggaccuggcccu

SEQ ID NO: 556439 - RNA, 62 nt, Homo Sapiens
gauagucaccagggccagaaagcucauggaguggccguaaugagaauauguuugaagaucaa

SEQ ID NO: 556440 - RNA, 62 nt, Homo Sapiens
ccaguggggaguguucuguuccggcauauccuggccguaacgauuuuuauaguuauggacua

SEQ ID NO: 556441 - RNA, 62 nt, Homo Sapiens
guauuucuuuguaucaugguuaugcuuugacuggccguaaguucucucagcuuuuguuuguc

SEQ ID NO: 556442 - RNA, 62 nt, Homo Sapiens
cuucuaagggaaacacuaaacaaguucaccauggccguaaucuauagcauuguuuacucagu

SEQ ID NO: 556443 - RNA, 62 nt, Homo Sapiens
cggggacagccacacugcgcgcggggcccgcaggccguaauaaagaguggcucgaccucgcu

SEQ ID NO: 556444 - RNA, 62 nt, Homo Sapiens
auggauuucuaaacccacugagcuucucuggaggccguaaagugucugggaaccugaucacc

SEQ ID NO: 556445 - RNA, 62 nt, Homo Sapiens
uggugcaggagggacuggacagaucugaggaaggccguaaaauggggacaggaggauucagc

SEQ ID NO: 556446 - RNA, 62 nt, Homo Sapiens
ccuguuugcagaccccaugcaccagcuggaggggccguaacugcaggacugcgccuacugag

SEQ ID NO: 556447 - RNA, 62 nt, Homo Sapiens
ucucuaccagauaacugaggaggggagaggugggccguaacgggcacggaucacgauguaaa

SEQ ID NO: 556448 - RNA, 62 nt, Homo Sapiens
gugaauuuggcaaguaaccaagccacaguuuuggccguaaauugcaugaaugucgacacugu

SEQ ID NO: 556449 - RNA, 64 nt, Homo Sapiens
caaccugccucauauauuucuaaaggguacagugccguauaaaacacugaaauguuagguuucc

SEQ ID NO: 556450 - RNA, 64 nt, Homo Sapiens
aguaccuguguaauaaugcucaaccuucaugucuccguauaaacgaaacuuuccaugagagcuc

SEQ ID NO: 556451 - RNA, 64 nt, Homo Sapiens
gcauuguggaagcaauaacucuuuguggaacauuccguauaacgacugugacuagguucacagc

SEQ ID NO: 556452 - RNA, 64 nt, Homo Sapiens
uuuuucucuucuuguagucuucuccucuacgugaccguauaaugguuaauaucagugcagacug

SEQ ID NO: 556453 - RNA, 64 nt, Homo Sapiens
aauuuacaucagaaguuugcaucucgcguauaugccguauaaaagaauuuuuuugucuuucaau

SEQ ID NO: 556454 - RNA, 64 nt, Homo Sapiens
ccauuuuuuguuuugaagagaauuaacccuuuuuccguauaaaugugcugauaaaccccaagua

SEQ ID NO: 556455 - RNA, 64 nt, Homo Sapiens
gcgagccugccacgcuugugacuggggaggggcuccguauaaucucaccuuugcaagcguuuau

SEQ ID NO: 556456 - RNA, 64 nt, Homo Sapiens
caaaguuguuuaacuagacugcguguuguuuuucccguauaauaaaaccaaagaauaguuuggu

SEQ ID NO: 556457 - RNA, 64 nt, Homo Sapiens
caggagucauuagcagugaugauuuuggguccugccguauaaucuguucuucuauucccacguu

SEQ ID NO: 556458 - RNA, 64 nt, Homo Sapiens
gcuguuaccucagauuuaaucacugguugaaacuccguauaaucuguagagccuccauggcucu

SEQ ID NO: 556459 - RNA, 64 nt, Homo Sapiens
uguaagcuccuugagagcagggaaucuugucuuuccguauaaguguuugcaguuguuuuugugu

SEQ ID NO: 556460 - RNA, 64 nt, Homo Sapiens
agagagacauaucacgcugcugcuaucgacauucccguauaaagguguuacauaagaauuuauu

SEQ ID NO: 556461 - RNA, 64 nt, Homo Sapiens
ucaaugaguauugauuuaggugcucugugccuguccguauaagcgugcaacucacauuuuucac

SEQ ID NO: 556462 - RNA, 64 nt, Homo Sapiens
uggauuaggcguguuggcuacaucuuucccacaaccguauaacgaccgauggucauuucuccaa

SEQ ID NO: 556463 - RNA, 64 nt, Homo Sapiens
uucaaauguaagcaaaccacugaugaccacugguccguauaacacauuuuaccaacagcuccuu

SEQ ID NO: 556464 - RNA, 66 nt, Homo Sapiens
caaccugccucauauauuucccuaaaggguacagugccguauaaaauucacugaaauguuagguuu

SEQ ID NO: 556465 - RNA, 66 nt, Homo Sapiens
cgaguaccuguguaauaaugcucaaccuucaugucuccguauaaacgaaacuuuccaugagagcuc

SEQ ID NO: 556466 - RNA, 66 nt, Homo Sapiens
gcauuguggaagcaauaacugccuuuguggaacauuccguauaacgagacugugacuagguucaca

SEQ ID NO: 556467 - RNA, 66 nt, Homo Sapiens
uuuuucucuucuuguagucuugucuccucuacgugaccguauaaugguguuaauaucagugcagac

SEQ ID NO: 556468 - RNA, 66 nt, Homo Sapiens
caaauuuacaucagaaguuugcaucucgcguauaugccguauaaaagaauuuuuuugucuuucaau

SEQ ID NO: 556469 - RNA, 66 nt, Homo Sapiens
ccauuuuuuguuuugaagaguaaauuaacccuuuuuccguauaaaugugugcugauaaaccccaag

SEQ ID NO: 556470 - RNA, 66 nt, Homo Sapiens
uagcgagccugccacgcuugugacuggggaggggcuccguauaaucucaccuuugcaagcguuuau

SEQ ID NO: 556471 - RNA, 66 nt, Homo Sapiens
cacaaaguuguuuaacuagacugcguguuguuuuucccguauaauaaaaccaaagaauaguuuggu

SEQ ID NO: 556472 - RNA, 66 nt, Homo Sapiens
uucaggagucauuagcagugaugauuuuggguccugccguauaaucuguucuucuauucccacguu

SEQ ID NO: 556473 - RNA, 66 nt, Homo Sapiens
augcuguuaccucagauuuaaucacugguugaaacuccguauaaucuguagagccuccauggcucu

SEQ ID NO: 556474 - RNA, 66 nt, Homo Sapiens
uguaagcuccuugagagcagguggaaucuugucuuuccguauaaguugguuugcaguuguuuuugu

SEQ ID NO: 556475 - RNA, 66 nt, Homo Sapiens
agagagacauaucacgcugcuuugcuaucgacauucccguauaaagauguguuacauaagaauuua

SEQ ID NO: 556476 - RNA, 66 nt, Homo Sapiens
ucaaugaguauugauuuaggacugcucugugccuguccguauaagccagugcaacucacauuuuuc

SEQ ID NO: 556477 - RNA, 66 nt, Homo Sapiens
gcuggauuaggcguguuggcuacaucuuucccacaaccguauaacgaccgauggucauuucuccaa

SEQ ID NO: 556478 - RNA, 66 nt, Homo Sapiens
gauucaaauguaagcaaaccacugaugaccacugguccguauaacacauuuuaccaacagcuccuu

SEQ ID NO: 556479 - RNA, 64 nt, Homo Sapiens; identical to SEQ ID NO: 503217

SEQ ID NO: 556480 - RNA, 64 nt, Homo Sapiens; identical to SEQ ID NO: 503218

SEQ ID NO: 556481 - RNA, 64 nt, Homo Sapiens; identical to SEQ ID NO: 503219

SEQ ID NO: 556482 - RNA, 64 nt, Homo Sapiens; identical to SEQ ID NO: 503220

SEQ ID NO: 556483 - RNA, 64 nt, Homo Sapiens
gaauggauggggagaaugguaacagcugaaacauuccgaagaggaaugcaaaguguuuucucag

SEQ ID NO: 556484 - RNA, 64 nt, Homo Sapiens
caccagcucacaaaugaaaaaaauuaaaaauaauuccgaagauaauucauuuugcaugguuuua

SEQ ID NO: 556485 - RNA, 64 nt, Homo Sapiens
auuuuccauacacauccccagccagaaguuaguguccgaagaccgaauuuuauuuuacagagcu

SEQ ID NO: 556486 - RNA, 64 nt, Homo Sapiens
gcgacagauucaugccacggauaaaugaggcaaauccgaagaaaaggaaaaucgaauaaaaaau

SEQ ID NO: 556487 - RNA, 64 nt, Homo Sapiens
ugugacucgcuuagcugaaaccuaaggcaacauuuccgaagaccuucugaagaucucagauaaa

SEQ ID NO: 556488 - RNA, 64 nt, Homo Sapiens
aauggcccauuagauacaacagcaagcccaagauuccgaagaagacagacaacucccccuagua

SEQ ID NO: 556489 - RNA, 64 nt, Homo Sapiens
cugugcccaagggacucugauuauccaagcaucuuccgaagaguguuguggucaccuuaaagag

SEQ ID NO: 556490 - RNA, 64 nt, Homo Sapiens
gagaggagggaaauggggccggugggaucgcagcuccgaagacgguuuaagcccuuggacugag

SEQ ID NO: 556491 - RNA, 64 nt, Homo Sapiens
agccugugaugucuuaugaaccuuaugagaaaacuccgaagaggugugagcaggauucuucuga

SEQ ID NO: 556492 - RNA, 64 nt, Homo Sapiens
aaauuucccauaggaagacuucaccuccuacaacuccgaagaaaacccuuacuguccaagaccg

SEQ ID NO: 556493 - RNA, 64 nt, Homo Sapiens
ugaaaauaggauccaaaacauuucugaagaugcuuccgaagauuaacaaacaauaugcacuucu

SEQ ID NO: 556494 - RNA, 64 nt, Homo Sapiens
gcugugagcaaaguggccgccggggaacgggugguccgaagaccuucauaccuagaccuguucc

SEQ ID NO: 556495 - RNA, 64 nt, Homo Sapiens
gaacauguugcgauugaauucuaaccucuuugacuccgaagaugaaugaaguguauaacugucu

SEQ ID NO: 556496 - RNA, 64 nt, Homo Sapiens
ggaauacauguuugggauuuuuauuuuuuacguguccgaagauaagcuccaggucuuaucguau

SEQ ID NO: 556497 - RNA, 64 nt, Homo Sapiens
cccuugcuucagaggccugauggcgucggacuauuccgaagaaguggccaccuccgaaaaauuc

SEQ ID NO: 556498 - RNA, 55 nt, Homo Sapiens
uccauaguggaccacuuggaaacauuccgaagaaucuagcuacagccaaucuuaa

SEQ ID NO: 556499 - RNA, 64 nt, Homo Sapiens
guucggacuauaaguauuuauaaugcucuauaaauccgaagagacacuugagacuaugguugac

SEQ ID NO: 556500 - RNA, 64 nt, Homo Sapiens
caucgcaguguguuauaugauguuagaugccacauccgaagacuccaugugcagcuuucuuuuu

SEQ ID NO: 556501 - RNA, 64 nt, Homo Sapiens
uuuggaguuuucuguuggaaccgccggcguuggcuccgaagacuuagcgacgccacuggcggca

SEQ ID NO: 556502 - RNA, 64 nt, Homo Sapiens
gaccuccauuuugauacuuguagaccagaucuaauccgaagauuaaucuuuagguaacagaugg

SEQ ID NO: 556503 - RNA, 64 nt, Homo Sapiens
gacaaaacuggagaugcaucgggaaagaagaaacuccgaagaaaagaauuuuaguguuaaugac

SEQ ID NO: 556504 - RNA, 64 nt, Homo Sapiens
cccgucuuccagagaaccugugggcugacugcccuccgaagagaguucuggaugucuggcucaa

SEQ ID NO: 556505 - RNA, 64 nt, Homo Sapiens
uuauuuuuccaaaggaauuuuggucuggaaguccuccgaagacaacuguuggacucuaccucac

SEQ ID NO: 556506 - RNA, 58 nt, Homo Sapiens
auuuuucaggaagcuacuaaagugcuguuccgaagaauaggcugaaacaaaaauauaa

SEQ ID NO: 556507 - RNA, 64 nt, Homo Sapiens
agauauguauucuaauuggcagugagaucccgucuccgaagaaaaagaccagccuggacagcuu

SEQ ID NO: 556508 - RNA, 64 nt, Homo Sapiens
augcuccagcaacacagccuagugucccccagguuccgaagaagcccagcaccucagccugcac

SEQ ID NO: 556509 - RNA, 64 nt, Homo Sapiens
aguugauuuuguuuuuagcuuacugcugccuuuguccgaagaaacuguuccuccauuauuugaa

SEQ ID NO: 556510 - RNA, 64 nt, Homo Sapiens
uuaaaagacuucuuaaucuucuagaagaaaaaucuccgaagagcucucucuagaaguccaaaau

SEQ ID NO: 556511 - RNA, 64 nt, Homo Sapiens
uuaggaagaaacaaggacaaauuuagaccuugaauccgaagagauaaagcuuacuugacuuuca

SEQ ID NO: 556512 - RNA, 64 nt, Homo Sapiens
ggcagggacaguggcucaaacagcaguaagugguuccgaagacacauccuagggaacaaggaac

SEQ ID NO: 556513 - RNA, 64 nt, Homo Sapiens
aaggauucuuuacugugccagcacggggauuggauccgaagaaacuggcuacugggguuuggcc

SEQ ID NO: 556514 - RNA, 64 nt, Homo Sapiens
ugcuuucaagagcauuucguaggaucuguccccauccgaagaggcuuugugaacugccugcuga

SEQ ID NO: 556515 - RNA, 64 nt, Homo Sapiens
cccacuugcuguuuccagccauucuucccuuucauccgaagaaacccuccugcaguuggacuga

SEQ ID NO: 556516 - RNA, 64 nt, Homo Sapiens
ucggagcauuuauuuuguuagauuuaccuuuuauuccgaagaacggaggacaggcuguauguca

SEQ ID NO: 556517 - RNA, 64 nt, Homo Sapiens
aaagccacguagagugguuggagcccaccaccucuccgaagagggaggggcacagugaagaagg

SEQ ID NO: 556518 - RNA, 64 nt, Homo Sapiens
aagacgcucuccaaagggcaggaaguacagcacuuccgaagaguuuaguuggcccuuugcuggu

SEQ ID NO: 556519 - RNA, 64 nt, Homo Sapiens
ccagcugcugccgcuggaggauccggaaagaguuuccgaagagugaagggcaguacaguggcuu

SEQ ID NO: 556520 - RNA, 64 nt, Homo Sapiens
aggauuugugacgucacuuaucugggcuggucacuccgaagaaggccacacgagagcuccaggc

SEQ ID NO: 556521 - RNA, 64 nt, Homo Sapiens
acaagaucccguccuccagguuucccagccaucuuccgaagaaucuacguaauggagggaagaa

SEQ ID NO: 556522 - RNA, 64 nt, Homo Sapiens
gucccuccuuuuugggggaaagugugcuggggucuccgaagagguggccuccuggcagaagccg

SEQ ID NO: 556523 - RNA, 64 nt, Homo Sapiens
gcacuugaccucggguggaagugaguggacgccauccgaagacagcuccuaagggggcaggcgu

SEQ ID NO: 556524 - RNA, 64 nt, Homo Sapiens
guggccacagacugacccccgcuccacuuucucauccgaagaugacagcucuuccagggcagcg

SEQ ID NO: 556525 - RNA, 64 nt, Homo Sapiens
aaaugaggugcaccccaggaaggccccguagaccuccgaagacuccacaagaaacuaauggauc

SEQ ID NO: 556526 - RNA, 64 nt, Homo Sapiens
gaugcaggcauuaccagcagggagcagacuuaccuccgaagauggagacaggugacugagagcu

SEQ ID NO: 556527 - RNA, 64 nt, Homo Sapiens
cugcaacgaagacacuccuucuguccccaccugcuccgaagacaaaccaaccuccguuucuuuu

SEQ ID NO: 556528 - RNA, 64 nt, Homo Sapiens
gucccuagccugcaacauuuaugucgcaugucaauccgaagagugaugcccacccaagaaguuc

SEQ ID NO: 556529 - RNA, 64 nt, Homo Sapiens
aaaacuaaaggaacucccuccccaccugcaggacuccgaagacagugcgacuucuggcugcaga

SEQ ID NO: 556530 - RNA, 64 nt, Homo Sapiens
agugaaagguucaaggacacuuuuaaagucaccuuccgaagagaucccccgacccauagccaug

SEQ ID NO: 556531 - RNA, 64 nt, Homo Sapiens
aaggcauggcgaugcccguccuuuuuugagaguguccgaagaugguuucugggcagaagcuuau

SEQ ID NO: 556532 - RNA, 64 nt, Homo Sapiens
acgggcggcucgcccgccucuggaucagcuggccuccgaagagccguggacuguccuacccgag

SEQ ID NO: 556533 - RNA, 64 nt, Homo Sapiens
cgagccuguacucugccugacgaggaacgcuggcuccgaagaggcccuguguagaaggcuguca

SEQ ID NO: 556534 - RNA, 64 nt, Homo Sapiens
aaauuuuuauacuaaaaucuuuaagagagcucccuccgaagagaccacuacuuaagaucggaag

SEQ ID NO: 556535 - RNA, 64 nt, Homo Sapiens
uggcaggggcagaaaacucugccaucgggucgucuccgaagauugacagcugacagggucuaug

SEQ ID NO: 556536 - RNA, 64 nt, Homo Sapiens
cccccugagccauugugggggucgaucaugaauguccgaagaguggccuuuucccguagcccug

SEQ ID NO: 556537 - RNA, 64 nt, Homo Sapiens
aaagcaauacugaacaaaacauuuguaccuguuuuccgaagaaagagugaguuuguguguauga

SEQ ID NO: 556538 - RNA, 64 nt, Homo Sapiens
ugggauuguuuuguggggggagggaagggaguguuccgaagaugcuguaguaacugccucagug

SEQ ID NO: 556539 - RNA, 64 nt, Homo Sapiens
ugagcuucagugaggugccaccagcacccgugccuccgaagaccgcucgggcauuccgccugcg

SEQ ID NO: 556540 - RNA, 64 nt, Homo Sapiens
acuucacuaaagugucauccaccaguguguugaauccgaagaaugacaauuuucuaccacuggu

SEQ ID NO: 556541 - RNA, 64 nt, Homo Sapiens
guggcugugaugaccuugggccagaaggucaaacuccgaagacugaaacucugccugcagcagg

SEQ ID NO: 556542 - RNA, 64 nt, Homo Sapiens
cuccacuacagacccagccccagguucaauguccuccgaagaaugaagucuuucccuggugaug

SEQ ID NO: 556543 - RNA, 64 nt, Homo Sapiens
cucaagagggagguuuccucuucccaugaaaaauuccgaagaugcacaccaacacugagacgcc

SEQ ID NO: 556544 - RNA, 64 nt, Homo Sapiens
agacuuuuccuauacccagaaaucccuuugcauuuccgaagaucagauauuuugcuuaaagguc

SEQ ID NO: 556545 - RNA, 64 nt, Homo Sapiens
uuauaaagcacagugaauucauacugcagacauuuccgaagaguagaauagacagaauuggaaa

SEQ ID NO: 556546 - RNA, 64 nt, Homo Sapiens; identical to SEQ ID NO: 147946

SEQ ID NO: 556547 - RNA, 64 nt, Homo Sapiens; identical to SEQ ID NO: 147947

SEQ ID NO: 556548 - RNA, 64 nt, Homo Sapiens; identical to SEQ ID NO: 196485

SEQ ID NO: 556549 - RNA, 64 nt, Homo Sapiens; identical to SEQ ID NO: 196486

SEQ ID NO: 556550 - RNA, 64 nt, Homo Sapiens; identical to SEQ ID NO: 196487

SEQ ID NO: 556551 - RNA, 64 nt, Homo Sapiens; identical to SEQ ID NO: 196488

SEQ ID NO: 556552 - RNA, 64 nt, Homo Sapiens; identical to SEQ ID NO: 196489

SEQ ID NO: 556553 - RNA, 64 nt, Homo Sapiens; identical to SEQ ID NO: 196490

SEQ ID NO: 556554 - RNA, 64 nt, Homo Sapiens; identical to SEQ ID NO: 196491

SEQ ID NO: 556555 - RNA, 64 nt, Homo Sapiens; identical to SEQ ID NO: 196492

SEQ ID NO: 556556 - RNA, 64 nt, Homo Sapiens; identical to SEQ ID NO: 196493

SEQ ID NO: 556557 - RNA, 64 nt, Homo Sapiens; identical to SEQ ID NO: 196494

SEQ ID NO: 556558 - RNA, 64 nt, Homo Sapiens; identical to SEQ ID NO: 196495

SEQ ID NO: 556559 - RNA, 64 nt, Homo Sapiens; identical to SEQ ID NO: 196496

SEQ ID NO: 556560 - RNA, 64 nt, Homo Sapiens; identical to SEQ ID NO: 196497

SEQ ID NO: 556561 - RNA, 64 nt, Homo Sapiens; identical to SEQ ID NO: 196498

SEQ ID NO: 556562 - RNA, 64 nt, Homo Sapiens; identical to SEQ ID NO: 196499

SEQ ID NO: 556563 - RNA, 64 nt, Homo Sapiens; identical to SEQ ID NO: 196500

SEQ ID NO: 556564 - RNA, 64 nt, Homo Sapiens; identical to SEQ ID NO: 196501

SEQ ID NO: 556565 - RNA, 64 nt, Homo Sapiens; identical to SEQ ID NO: 196502

SEQ ID NO: 556566 - RNA, 64 nt, Homo Sapiens; identical to SEQ ID NO: 196503

SEQ ID NO: 556567 - RNA, 64 nt, Homo Sapiens; identical to SEQ ID NO: 196504

SEQ ID NO: 556568 - RNA, 64 nt, Homo Sapiens; identical to SEQ ID NO: 196505

SEQ ID NO: 556569 - RNA, 64 nt, Homo Sapiens; identical to SEQ ID NO: 196506

SEQ ID NO: 556570 - RNA, 64 nt, Homo Sapiens; identical to SEQ ID NO: 196507

SEQ ID NO: 556571 - RNA, 64 nt, Homo Sapiens; identical to SEQ ID NO: 196508

SEQ ID NO: 556572 - RNA, 64 nt, Homo Sapiens; identical to SEQ ID NO: 196509

SEQ ID NO: 556573 - RNA, 64 nt, Homo Sapiens; identical to SEQ ID NO: 196510

SEQ ID NO: 556574 - RNA, 64 nt, Homo Sapiens; identical to SEQ ID NO: 196511

SEQ ID NO: 556575 - RNA, 64 nt, Homo Sapiens; identical to SEQ ID NO: 196512

SEQ ID NO: 556576 - RNA, 64 nt, Homo Sapiens; identical to SEQ ID NO: 196513

SEQ ID NO: 556577 - RNA, 64 nt, Homo Sapiens; identical to SEQ ID NO: 196514

SEQ ID NO: 556578 - RNA, 64 nt, Homo Sapiens; identical to SEQ ID NO: 196515

SEQ ID NO: 556579 - RNA, 64 nt, Homo Sapiens; identical to SEQ ID NO: 196516

SEQ ID NO: 556580 - RNA, 64 nt, Homo Sapiens; identical to SEQ ID NO: 196517

SEQ ID NO: 556581 - RNA, 64 nt, Homo Sapiens; identical to SEQ ID NO: 196518

SEQ ID NO: 556582 - RNA, 64 nt, Homo Sapiens; identical to SEQ ID NO: 196519

SEQ ID NO: 556583 - RNA, 64 nt, Homo Sapiens; identical to SEQ ID NO: 196520

SEQ ID NO: 556584 - RNA, 64 nt, Homo Sapiens; identical to SEQ ID NO: 196521

SEQ ID NO: 556585 - RNA, 64 nt, Homo Sapiens; identical to SEQ ID NO: 196522

SEQ ID NO: 556586 - RNA, 64 nt, Homo Sapiens; identical to SEQ ID NO: 196523

SEQ ID NO: 556587 - RNA, 64 nt, Homo Sapiens; identical to SEQ ID NO: 196524

SEQ ID NO: 556588 - RNA, 64 nt, Homo Sapiens; identical to SEQ ID NO: 196525

SEQ ID NO: 556589 - RNA, 64 nt, Homo Sapiens; identical to SEQ ID NO: 196526

SEQ ID NO: 556590 - RNA, 64 nt, Homo Sapiens; identical to SEQ ID NO: 196527

SEQ ID NO: 556591 - RNA, 64 nt, Homo Sapiens; identical to SEQ ID NO: 196528

SEQ ID NO: 556592 - RNA, 64 nt, Homo Sapiens; identical to SEQ ID NO: 196529

SEQ ID NO: 556593 - RNA, 64 nt, Homo Sapiens; identical to SEQ ID NO: 196530

SEQ ID NO: 556594 - RNA, 64 nt, Homo Sapiens; identical to SEQ ID NO: 196531

SEQ ID NO: 556595 - RNA, 64 nt, Homo Sapiens; identical to SEQ ID NO: 196532

SEQ ID NO: 556596 - RNA, 64 nt, Homo Sapiens; identical to SEQ ID NO: 196533

SEQ ID NO: 556597 - RNA, 64 nt, Homo Sapiens; identical to SEQ ID NO: 196534

SEQ ID NO: 556598 - RNA, 64 nt, Homo Sapiens; identical to SEQ ID NO: 196535

SEQ ID NO: 556599 - RNA, 64 nt, Homo Sapiens; identical to SEQ ID NO: 196536

SEQ ID NO: 556600 - RNA, 64 nt, Homo Sapiens; identical to SEQ ID NO: 196537

SEQ ID NO: 556601 - RNA, 64 nt, Homo Sapiens; identical to SEQ ID NO: 196538

SEQ ID NO: 556602 - RNA, 64 nt, Homo Sapiens; identical to SEQ ID NO: 196539

SEQ ID NO: 556603 - RNA, 64 nt, Homo Sapiens; identical to SEQ ID NO: 196540

SEQ ID NO: 556604 - RNA, 64 nt, Homo Sapiens; identical to SEQ ID NO: 196541

SEQ ID NO: 556605 - RNA, 64 nt, Homo Sapiens; identical to SEQ ID NO: 196542

SEQ ID NO: 556606 - RNA, 64 nt, Homo Sapiens; identical to SEQ ID NO: 196543

SEQ ID NO: 556607 - RNA, 64 nt, Homo Sapiens; identical to SEQ ID NO: 196544

SEQ ID NO: 556608 - RNA, 64 nt, Homo Sapiens; identical to SEQ ID NO: 196545

SEQ ID NO: 556609 - RNA, 64 nt, Homo Sapiens; identical to SEQ ID NO: 196546

SEQ ID NO: 556610 - RNA, 64 nt, Homo Sapiens; identical to SEQ ID NO: 196547

SEQ ID NO: 556611 - RNA, 64 nt, Homo Sapiens; identical to SEQ ID NO: 196548

SEQ ID NO: 556612 - RNA, 64 nt, Homo Sapiens; identical to SEQ ID NO: 196549

SEQ ID NO: 556613 - RNA, 64 nt, Homo Sapiens; identical to SEQ ID NO: 196550

SEQ ID NO: 556614 - RNA, 64 nt, Homo Sapiens; identical to SEQ ID NO: 196551

SEQ ID NO: 556615 - RNA, 64 nt, Homo Sapiens; identical to SEQ ID NO: 196551

SEQ ID NO: 556616 - RNA, 64 nt, Homo Sapiens; identical to SEQ ID NO: 196553

SEQ ID NO: 556617 - RNA, 64 nt, Homo Sapiens; identical to SEQ ID NO: 196554

SEQ ID NO: 556618 - RNA, 64 nt, Homo Sapiens; identical to SEQ ID NO: 196555

SEQ ID NO: 556619 - RNA, 64 nt, Homo Sapiens; identical to SEQ ID NO: 196556

SEQ ID NO: 556620 - RNA, 64 nt, Homo Sapiens; identical to SEQ ID NO: 196557

SEQ ID NO: 556621 - RNA, 64 nt, Homo Sapiens; identical to SEQ ID NO: 196558

SEQ ID NO: 556622 - RNA, 64 nt, Homo Sapiens; identical to SEQ ID NO: 196559

SEQ ID NO: 556623 - RNA, 64 nt, Homo Sapiens; identical to SEQ ID NO: 196560

SEQ ID NO: 556624 - RNA, 64 nt, Homo Sapiens; identical to SEQ ID NO: 196561

SEQ ID NO: 556625 - RNA, 64 nt, Homo Sapiens; identical to SEQ ID NO: 196562

SEQ ID NO: 556626 - RNA, 64 nt, Homo Sapiens; identical to SEQ ID NO: 196563

SEQ ID NO: 556627 - RNA, 64 nt, Homo Sapiens; identical to SEQ ID NO: 196564

SEQ ID NO: 556628 - RNA, 64 nt, Homo Sapiens; identical to SEQ ID NO: 196565

SEQ ID NO: 556629 - RNA, 64 nt, Homo Sapiens; identical to SEQ ID NO: 196566

SEQ ID NO: 556630 - RNA, 64 nt, Homo Sapiens; identical to SEQ ID NO: 196567

SEQ ID NO: 556631 - RNA, 64 nt, Homo Sapiens; identical to SEQ ID NO: 196568

SEQ ID NO: 556632 - RNA, 64 nt, Homo Sapiens; identical to SEQ ID NO: 196569

SEQ ID NO: 556633 - RNA, 64 nt, Homo Sapiens; identical to SEQ ID NO: 196570

SEQ ID NO: 556634 - RNA, 64 nt, Homo Sapiens; identical to SEQ ID NO: 196571

SEQ ID NO: 556635 - RNA, 64 nt, Homo Sapiens; identical to SEQ ID NO: 196572

SEQ ID NO: 556636 - RNA, 64 nt, Homo Sapiens; identical to SEQ ID NO: 223465

SEQ ID NO: 556637 - RNA, 64 nt, Homo Sapiens; identical to SEQ ID NO: 223466

SEQ ID NO: 556638 - RNA, 64 nt, Homo Sapiens; identical to SEQ ID NO: 223467

SEQ ID NO: 556639 - RNA, 64 nt, Homo Sapiens; identical to SEQ ID NO: 223468

SEQ ID NO: 556640 - RNA, 64 nt, Homo Sapiens; identical to SEQ ID NO: 223469

SEQ ID NO: 556641 - RNA, 64 nt, Homo Sapiens; identical to SEQ ID NO: 223470

SEQ ID NO: 556642 - RNA, 64 nt, Homo Sapiens; identical to SEQ ID NO: 223471

SEQ ID NO: 556643 - RNA, 64 nt, Homo Sapiens; identical to SEQ ID NO: 223472

SEQ ID NO: 556644 - RNA, 64 nt, Homo Sapiens; identical to SEQ ID NO: 223473

SEQ ID NO: 556645 - RNA, 64 nt, Homo Sapiens; identical to SEQ ID NO: 223474

SEQ ID NO: 556646 - RNA, 64 nt, Homo Sapiens; identical to SEQ ID NO: 223475

SEQ ID NO: 556647 - RNA, 64 nt, Homo Sapiens; identical to SEQ ID NO: 223476

SEQ ID NO: 556648 - RNA, 64 nt, Homo Sapiens; identical to SEQ ID NO: 223477

SEQ ID NO: 556649 - RNA, 64 nt, Homo Sapiens; identical to SEQ ID NO: 223478

SEQ ID NO: 556650 - RNA, 64 nt, Homo Sapiens; identical to SEQ ID NO: 223479

SEQ ID NO: 556651 - RNA, 64 nt, Homo Sapiens; identical to SEQ ID NO: 223480

SEQ ID NO: 556652 - RNA, 64 nt, Homo Sapiens; identical to SEQ ID NO: 223481

SEQ ID NO: 556653 - RNA, 64 nt, Homo Sapiens; identical to SEQ ID NO: 223482

SEQ ID NO: 556654 - RNA, 64 nt, Homo Sapiens; identical to SEQ ID NO: 223483

SEQ ID NO: 556655 - RNA, 64 nt, Homo Sapiens; identical to SEQ ID NO: 223484

SEQ ID NO: 556656 - RNA, 64 nt, Homo Sapiens; identical to SEQ ID NO: 223485

SEQ ID NO: 556657 - RNA, 64 nt, Homo Sapiens; identical to SEQ ID NO: 223486

SEQ ID NO: 556658 - RNA, 64 nt, Homo Sapiens; identical to SEQ ID NO: 223487

SEQ ID NO: 556659 - RNA, 64 nt, Homo Sapiens; identical to SEQ ID NO: 223488

SEQ ID NO: 556660 - RNA, 64 nt, Homo Sapiens; identical to SEQ ID NO: 223489

SEQ ID NO: 556661 - RNA, 64 nt, Homo Sapiens; identical to SEQ ID NO: 223490

SEQ ID NO: 556662 - RNA, 64 nt, Homo Sapiens; identical to SEQ ID NO: 223491

SEQ ID NO: 556663 - RNA, 64 nt, Homo Sapiens; identical to SEQ ID NO: 223492

SEQ ID NO: 556664 - RNA, 64 nt, Homo Sapiens; identical to SEQ ID NO: 223493

SEQ ID NO: 556665 - RNA, 64 nt, Homo Sapiens; identical to SEQ ID NO: 223494

SEQ ID NO: 556666 - RNA, 64 nt, Homo Sapiens; identical to SEQ ID NO: 223495

SEQ ID NO: 556667 - RNA, 64 nt, Homo Sapiens; identical to SEQ ID NO: 223496

SEQ ID NO: 556668 - RNA, 64 nt, Homo Sapiens; identical to SEQ ID NO: 223497

SEQ ID NO: 556669 - RNA, 64 nt, Homo Sapiens; identical to SEQ ID NO: 223498

SEQ ID NO: 556670 - RNA, 64 nt, Homo Sapiens; identical to SEQ ID NO: 223499

SEQ ID NO: 556671 - RNA, 64 nt, Homo Sapiens; identical to SEQ ID NO: 223500

SEQ ID NO: 556672 - RNA, 64 nt, Homo Sapiens; identical to SEQ ID NO: 223501

SEQ ID NO: 556673 - RNA, 64 nt, Homo Sapiens; identical to SEQ ID NO: 223502

SEQ ID NO: 556674 - RNA, 64 nt, Homo Sapiens; identical to SEQ ID NO: 223503

SEQ ID NO: 556675 - RNA, 64 nt, Homo Sapiens; identical to SEQ ID NO: 223504

SEQ ID NO: 556676 - RNA, 64 nt, Homo Sapiens; identical to SEQ ID NO: 223505

SEQ ID NO: 556677 - RNA, 64 nt, Homo Sapiens; identical to SEQ ID NO: 223506

SEQ ID NO: 556678 - RNA, 64 nt, Homo Sapiens; identical to SEQ ID NO: 223507

SEQ ID NO: 556679 - RNA, 64 nt, Homo Sapiens; identical to SEQ ID NO: 223508

SEQ ID NO: 556680 - RNA, 64 nt, Homo Sapiens; identical to SEQ ID NO: 223509

SEQ ID NO: 556681 - RNA, 64 nt, Homo Sapiens; identical to SEQ ID NO: 223510

SEQ ID NO: 556682 - RNA, 64 nt, Homo Sapiens; identical to SEQ ID NO: 223511

SEQ ID NO: 556683 - RNA, 64 nt, Homo Sapiens; identical to SEQ ID NO: 223512

SEQ ID NO: 556684 - RNA, 64 nt, Homo Sapiens; identical to SEQ ID NO: 223513

SEQ ID NO: 556685 - RNA, 64 nt, Homo Sapiens; identical to SEQ ID NO: 223514

SEQ ID NO: 556686 - RNA, 64 nt, Homo Sapiens; identical to SEQ ID NO: 223515

SEQ ID NO: 556687 - RNA, 64 nt, Homo Sapiens; identical to SEQ ID NO: 223516

SEQ ID NO: 556688 - RNA, 64 nt, Homo Sapiens; identical to SEQ ID NO: 223517

SEQ ID NO: 556689 - RNA, 64 nt, Homo Sapiens; identical to SEQ ID NO: 223518

SEQ ID NO: 556690 - RNA, 64 nt, Homo Sapiens; identical to SEQ ID NO: 223519

SEQ ID NO: 556691 - RNA, 64 nt, Homo Sapiens; identical to SEQ ID NO: 223520

SEQ ID NO: 556692 - RNA, 64 nt, Homo Sapiens; identical to SEQ ID NO: 223521

SEQ ID NO: 556693 - RNA, 64 nt, Homo Sapiens; identical to SEQ ID NO: 223522

SEQ ID NO: 556694 - RNA, 64 nt, Homo Sapiens; identical to SEQ ID NO: 223523

SEQ ID NO: 556695 - RNA, 64 nt, Homo Sapiens; identical to SEQ ID NO: 223524

SEQ ID NO: 556696 - RNA, 64 nt, Homo Sapiens; identical to SEQ ID NO: 223525

SEQ ID NO: 556697 - RNA, 64 nt, Homo Sapiens; identical to SEQ ID NO: 223526

SEQ ID NO: 556698 - RNA, 64 nt, Homo Sapiens; identical to SEQ ID NO: 223527

SEQ ID NO: 556699 - RNA, 64 nt, Homo Sapiens; identical to SEQ ID NO: 223528

SEQ ID NO: 556700 - RNA, 64 nt, Homo Sapiens; identical to SEQ ID NO: 223529

SEQ ID NO: 556701 - RNA, 64 nt, Homo Sapiens; identical to SEQ ID NO: 223530

SEQ ID NO: 556702 - RNA, 64 nt, Homo Sapiens; identical to SEQ ID NO: 223531

SEQ ID NO: 556703 - RNA, 64 nt, Homo Sapiens; identical to SEQ ID NO: 223532

SEQ ID NO: 556704 - RNA, 64 nt, Homo Sapiens; identical to SEQ ID NO: 223533

SEQ ID NO: 556705 - RNA, 64 nt, Homo Sapiens; identical to SEQ ID NO: 223534

SEQ ID NO: 556706 - RNA, 64 nt, Homo Sapiens; identical to SEQ ID NO: 223535

SEQ ID NO: 556707 - RNA, 64 nt, Homo Sapiens; identical to SEQ ID NO: 223536

SEQ ID NO: 556708 - RNA, 64 nt, Homo Sapiens; identical to SEQ ID NO: 223537

SEQ ID NO: 556709 - RNA, 64 nt, Homo Sapiens; identical to SEQ ID NO: 223538

SEQ ID NO: 556710 - RNA, 64 nt, Homo Sapiens; identical to SEQ ID NO: 223539

SEQ ID NO: 556711 - RNA, 64 nt, Homo Sapiens; identical to SEQ ID NO: 223540

SEQ ID NO: 556712 - RNA, 64 nt, Homo Sapiens; identical to SEQ ID NO: 223541

SEQ ID NO: 556713 - RNA, 64 nt, Homo Sapiens; identical to SEQ ID NO: 223542

SEQ ID NO: 556714 - RNA, 64 nt, Homo Sapiens; identical to SEQ ID NO: 223543

SEQ ID NO: 556715 - RNA, 64 nt, Homo Sapiens; identical to SEQ ID NO: 223544

SEQ ID NO: 556716 - RNA, 64 nt, Homo Sapiens; identical to SEQ ID NO: 223545

SEQ ID NO: 556717 - RNA, 64 nt, Homo Sapiens; identical to SEQ ID NO: 223546

SEQ ID NO: 556718 - RNA, 64 nt, Homo Sapiens; identical to SEQ ID NO: 223547

SEQ ID NO: 556719 - RNA, 64 nt, Homo Sapiens; identical to SEQ ID NO: 223548

SEQ ID NO: 556720 - RNA, 64 nt, Homo Sapiens; identical to SEQ ID NO: 223549

SEQ ID NO: 556721 - RNA, 64 nt, Homo Sapiens; identical to SEQ ID NO: 223550

SEQ ID NO: 556722 - RNA, 64 nt, Homo Sapiens; identical to SEQ ID NO: 223551

SEQ ID NO: 556723 - RNA, 64 nt, Homo Sapiens; identical to SEQ ID NO: 223552

SEQ ID NO: 556724 - RNA, 64 nt, Homo Sapiens; identical to SEQ ID NO: 223553

SEQ ID NO: 556725 - RNA, 64 nt, Homo Sapiens; identical to SEQ ID NO: 223554

SEQ ID NO: 556726 - RNA, 64 nt, Homo Sapiens; identical to SEQ ID NO: 223555

SEQ ID NO: 556727 - RNA, 64 nt, Homo Sapiens; identical to SEQ ID NO: 223556

SEQ ID NO: 556728 - RNA, 64 nt, Homo Sapiens; identical to SEQ ID NO: 223557

SEQ ID NO: 556729 - RNA, 64 nt, Homo Sapiens; identical to SEQ ID NO: 223558

SEQ ID NO: 556730 - RNA, 64 nt, Homo Sapiens; identical to SEQ ID NO: 223559

SEQ ID NO: 556731 - RNA, 64 nt, Homo Sapiens; identical to SEQ ID NO: 223560

SEQ ID NO: 556732 - RNA, 64 nt, Homo Sapiens; identical to SEQ ID NO: 223561

SEQ ID NO: 556733 - RNA, 64 nt, Homo Sapiens; identical to SEQ ID NO: 223562

SEQ ID NO: 556734 - RNA, 64 nt, Homo Sapiens; identical to SEQ ID NO: 223563

SEQ ID NO: 556735 - RNA, 64 nt, Homo Sapiens; identical to SEQ ID NO: 223564

SEQ ID NO: 556736 - RNA, 64 nt, Homo Sapiens; identical to SEQ ID NO: 223565

SEQ ID NO: 556737 - RNA, 64 nt, Homo Sapiens; identical to SEQ ID NO: 223566

SEQ ID NO: 556738 - RNA, 64 nt, Homo Sapiens; identical to SEQ ID NO: 223567

SEQ ID NO: 556739 - RNA, 64 nt, Homo Sapiens; identical to SEQ ID NO: 223568

SEQ ID NO: 556740 - RNA, 64 nt, Homo Sapiens; identical to SEQ ID NO: 223569

SEQ ID NO: 556741 - RNA, 64 nt, Homo Sapiens; identical to SEQ ID NO: 223570

SEQ ID NO: 556742 - RNA, 64 nt, Homo Sapiens; identical to SEQ ID NO: 223571

SEQ ID NO: 556743 - RNA, 64 nt, Homo Sapiens; identical to SEQ ID NO: 164305

SEQ ID NO: 556744 - RNA, 64 nt, Homo Sapiens; identical to SEQ ID NO: 164306

SEQ ID NO: 556745 - RNA, 64 nt, Homo Sapiens; identical to SEQ ID NO: 164307

SEQ ID NO: 556746 - RNA, 64 nt, Homo Sapiens; identical to SEQ ID NO: 164308

SEQ ID NO: 556747 - RNA, 64 nt, Homo Sapiens
ggugaaagcaaccaugcaaaauuuuguauucuggaccacuuacuaaacaguucucuguuaccau

SEQ ID NO: 556748 - RNA, 64 nt, Homo Sapiens
uaguaguuuuuucauaaaugacaagucaguguaaaccacuuagacuaacucacuagaucagcgc

SEQ ID NO: 556749 - RNA, 64 nt, Homo Sapiens
uugcuagcuacauuaagaauaaacaaaaaacaaaaccacuuauagcaagacccugucugucuca

SEQ ID NO: 556750 - RNA, 64 nt, Homo Sapiens
acugggugcgguggcucacacauuuguuuagaaaaccacuuaugcaguauguaugguguggucu

SEQ ID NO: 556751 - RNA, 64 nt, Homo Sapiens
guuggaucuuuugaagggagaagacacugcagugaccacuuauucuguauugccauggucuuuc

SEQ ID NO: 556752 - RNA, 64 nt, Homo Sapiens
ucauuguguaucaguuuccaugaaagaccugaauaccacuuaccucaaauuaagcauauguguu

SEQ ID NO: 556753 - RNA, 64 nt, Homo Sapiens
guggcucaggguuguaaaaugugaaaccuaaaguaguugccaaaacuaagacugugaaaauuau

SEQ ID NO: 556754 - RNA, 64 nt, Homo Sapiens
uuuuagcugccaccgcuucagggacacuggcagcaguugccaggauaauaagcaagacacauug

SEQ ID NO: 556755 - RNA, 64 nt, Homo Sapiens
gaaucuaggaaauuaguuguauaguauucugaucaguugccaaauuucuauagcgagacauaga

SEQ ID NO: 556756 - RNA, 64 nt, Homo Sapiens
ggaggaaauaagguuagaagugcgugagcuggucaguugccaaagauuucaucacuaguaugug

SEQ ID NO: 556757 - RNA, 64 nt, Homo Sapiens
cuggacauugugcaauaaagacagcauagcugaaaguugccaaacuuugcuuuuguuuagcuuc

SEQ ID NO: 556758 - RNA, 64 nt, Homo Sapiens
guuaaugauuauucuuuuuaaccuuccuaguggcaguugccaaucaguaguauguggcauauac

SEQ ID NO: 556759 - RNA, 64 nt, Homo Sapiens
caggaucaauacguuguauccuuugauccaaucaaguugccacucaguauuaaccaugacaccu

SEQ ID NO: 556760 - RNA, 64 nt, Homo Sapiens
agguggguuagaaacuagugccuaucccucacuaaguugccagauggauuuaacagcaccucaa

SEQ ID NO: 556761 - RNA, 64 nt, Homo Sapiens
aacuuaaaagucauugccauucaucauuaauaaaaguugccauuucaacuacgucccaacauuc

SEQ ID NO: 556762 - RNA, 64 nt, Homo Sapiens
agcaucuuguaaauccuagggcuuccuggaaguuaguugccaaagucaugcaagcaucaccugu

SEQ ID NO: 556763 - RNA, 64 nt, Homo Sapiens
aguuugucgaauugagguuuuagguaaagcauagaguugccagaguaccccgcauucccaugaa

SEQ ID NO: 556764 - RNA, 64 nt, Homo Sapiens
gauggcuuggaguggggaaggcuguuucuuugaaaguugccaaauguguuauguugugucucag

SEQ ID NO: 556765 - RNA, 64 nt, Homo Sapiens
ccugcagcccccuuccccagcucgagguccucacaguugccagcgccacaaccuaugguggggu

SEQ ID NO: 556766 - RNA, 64 nt, Homo Sapiens
accuaugguggggucucgagcaaaaugaauugcaaguugccacagggggcuccucuccccagac

SEQ ID NO: 556767 - RNA, 64 nt, Homo Sapiens; identical to SEQ ID NO: 424699

SEQ ID NO: 556768 - RNA, 64 nt, Homo Sapiens; identical to SEQ ID NO: 424700

SEQ ID NO: 556769 - RNA, 64 nt, Homo Sapiens; identical to SEQ ID NO: 424701

SEQ ID NO: 556770 - RNA, 64 nt, Homo Sapiens; identical to SEQ ID NO: 424702

SEQ ID NO: 556771 - RNA, 64 nt, Homo Sapiens; identical to SEQ ID NO: 424703

SEQ ID NO: 556772 - RNA, 64 nt, Homo Sapiens; identical to SEQ ID NO: 424704

SEQ ID NO: 556773 - RNA, 64 nt, Homo Sapiens; identical to SEQ ID NO: 424705

SEQ ID NO: 556774 - RNA, 64 nt, Homo Sapiens; identical to SEQ ID NO: 424706

SEQ ID NO: 556775 - RNA, 64 nt, Homo Sapiens; identical to SEQ ID NO: 424707

SEQ ID NO: 556776 - RNA, 64 nt, Homo Sapiens; identical to SEQ ID NO: 424708

SEQ ID NO: 556777 - RNA, 64 nt, Homo Sapiens; identical to SEQ ID NO: 424709

SEQ ID NO: 556778 - RNA, 64 nt, Homo Sapiens; identical to SEQ ID NO: 424710

SEQ ID NO: 556779 - RNA, 64 nt, Homo Sapiens; identical to SEQ ID NO: 424711

SEQ ID NO: 556780 - RNA, 64 nt, Homo Sapiens; identical to SEQ ID NO: 424712

SEQ ID NO: 556781 - RNA, 64 nt, Homo Sapiens; identical to SEQ ID NO: 424713

SEQ ID NO: 556782 - RNA, 64 nt, Homo Sapiens; identical to SEQ ID NO: 424714

SEQ ID NO: 556783 - RNA, 64 nt, Homo Sapiens; identical to SEQ ID NO: 424715

SEQ ID NO: 556784 - RNA, 64 nt, Homo Sapiens; identical to SEQ ID NO: 424716

SEQ ID NO: 556785 - RNA, 64 nt, Homo Sapiens; identical to SEQ ID NO: 424717

SEQ ID NO: 556786 - RNA, 64 nt, Homo Sapiens; identical to SEQ ID NO: 424718

SEQ ID NO: 556787 - RNA, 64 nt, Homo Sapiens; identical to SEQ ID NO: 424719

SEQ ID NO: 556788 - RNA, 64 nt, Homo Sapiens; identical to SEQ ID NO: 424720

SEQ ID NO: 556789 - RNA, 64 nt, Homo Sapiens; identical to SEQ ID NO: 424721

SEQ ID NO: 556790 - RNA, 64 nt, Homo Sapiens; identical to SEQ ID NO: 424722

SEQ ID NO: 556791 - RNA, 51 nt, Homo Sapiens; identical to SEQ ID NO: 424723

SEQ ID NO: 556792 - RNA, 64 nt, Homo Sapiens; identical to SEQ ID NO: 424724

SEQ ID NO: 556793 - RNA, 64 nt, Homo Sapiens; identical to SEQ ID NO: 424725

SEQ ID NO: 556794 - RNA, 64 nt, Homo Sapiens; identical to SEQ ID NO: 424726

SEQ ID NO: 556795 - RNA, 64 nt, Homo Sapiens; identical to SEQ ID NO: 424727

SEQ ID NO: 556796 - RNA, 64 nt, Homo Sapiens; identical to SEQ ID NO: 424728

SEQ ID NO: 556797 - RNA, 64 nt, Homo Sapiens; identical to SEQ ID NO: 424729

SEQ ID NO: 556798 - RNA, 64 nt, Homo Sapiens; identical to SEQ ID NO: 424730

SEQ ID NO: 556799 - RNA, 64 nt, Homo Sapiens; identical to SEQ ID NO: 424731

SEQ ID NO: 556800 - RNA, 64 nt, Homo Sapiens; identical to SEQ ID NO: 424732

SEQ ID NO: 556801 - RNA, 64 nt, Homo Sapiens; identical to SEQ ID NO: 424733

SEQ ID NO: 556802 - RNA, 64 nt, Homo Sapiens; identical to SEQ ID NO: 424734

SEQ ID NO: 556803 - RNA, 64 nt, Homo Sapiens; identical to SEQ ID NO: 424735

SEQ ID NO: 556804 - RNA, 64 nt, Homo Sapiens; identical to SEQ ID NO: 424736

SEQ ID NO: 556805 - RNA, 64 nt, Homo Sapiens; identical to SEQ ID NO: 424737

SEQ ID NO: 556806 - RNA, 64 nt, Homo Sapiens; identical to SEQ ID NO: 424738

SEQ ID NO: 556807 - RNA, 63 nt, Homo Sapiens; identical to SEQ ID NO: 120315

SEQ ID NO: 556808 - RNA, 63 nt, Homo Sapiens; identical to SEQ ID NO: 120316

SEQ ID NO: 556809 - RNA, 63 nt, Homo Sapiens; identical to SEQ ID NO: 120346

SEQ ID NO: 556810 - RNA, 63 nt, Homo Sapiens; identical to SEQ ID NO: 120347

SEQ ID NO: 556811 - RNA, 63 nt, Homo Sapiens; identical to SEQ ID NO: 120370

SEQ ID NO: 556812 - RNA, 63 nt, Homo Sapiens; identical to SEQ ID NO: 120371

SEQ ID NO: 556813 - RNA, 63 nt, Homo Sapiens; identical to SEQ ID NO: 120380

SEQ ID NO: 556814 - RNA, 63 nt, Homo Sapiens; identical to SEQ ID NO: 120381

SEQ ID NO: 556815 - RNA, 63 nt, Homo Sapiens; identical to SEQ ID NO: 120400

SEQ ID NO: 556816 - RNA, 63 nt, Homo Sapiens; identical to SEQ ID NO: 120401

SEQ ID NO: 556817 - RNA, 63 nt, Homo Sapiens; identical to SEQ ID NO: 120470

SEQ ID NO: 556818 - RNA, 63 nt, Homo Sapiens; identical to SEQ ID NO: 120471

SEQ ID NO: 556819 - RNA, 63 nt, Homo Sapiens; identical to SEQ ID NO: 120522

SEQ ID NO: 556820 - RNA, 63 nt, Homo Sapiens; identical to SEQ ID NO: 120523

SEQ ID NO: 556821 - RNA, 64 nt, Homo Sapiens; identical to SEQ ID NO: 79907

SEQ ID NO: 556822 - RNA, 64 nt, Homo Sapiens; identical to SEQ ID NO: 79908

SEQ ID NO: 556823 - RNA, 64 nt, Homo Sapiens; identical to SEQ ID NO: 180799

SEQ ID NO: 556824 - RNA, 64 nt, Homo Sapiens; identical to SEQ ID NO: 180800

SEQ ID NO: 556825 - RNA, 64 nt, Homo Sapiens; identical to SEQ ID NO: 180801

SEQ ID NO: 556826 - RNA, 64 nt, Homo Sapiens; identical to SEQ ID NO: 180802

SEQ ID NO: 556827 - RNA, 64 nt, Homo Sapiens; identical to SEQ ID NO: 180803

SEQ ID NO: 556828 - RNA, 64 nt, Homo Sapiens; identical to SEQ ID NO: 180804

SEQ ID NO: 556829 - RNA, 64 nt, Homo Sapiens; identical to SEQ ID NO: 180805

SEQ ID NO: 556830 - RNA, 64 nt, Homo Sapiens; identical to SEQ ID NO: 180806

SEQ ID NO: 556831 - RNA, 64 nt, Homo Sapiens; identical to SEQ ID NO: 180807

SEQ ID NO: 556832 - RNA, 64 nt, Homo Sapiens; identical to SEQ ID NO: 180808

SEQ ID NO: 556833 - RNA, 64 nt, Homo Sapiens; identical to SEQ ID NO: 180809

SEQ ID NO: 556834 - RNA, 64 nt, Homo Sapiens; identical to SEQ ID NO: 180810

SEQ ID NO: 556835 - RNA, 64 nt, Homo Sapiens; identical to SEQ ID NO: 180811

SEQ ID NO: 556836 - RNA, 64 nt, Homo Sapiens; identical to SEQ ID NO: 180812

SEQ ID NO: 556837 - RNA, 64 nt, Homo Sapiens; identical to SEQ ID NO: 180813

SEQ ID NO: 556838 - RNA, 64 nt, Homo Sapiens
acagcuuccggcccgaggccacuacccaagcccccugaacaaaccaauguguacacgacuacuu

SEQ ID NO: 556839 - RNA, 64 nt, Homo Sapiens
auaacuugaucccugaugacuggaauucaagacccugaacaagagaaugaaaaguacacaccca

SEQ ID NO: 556840 - RNA, 64 nt, Homo Sapiens
ccuacgcacauaccuucaugccagucuauuuccacugaacaaaaucagugccuuccucucucua

SEQ ID NO: 556841 - RNA, 64 nt, Homo Sapiens
ccuacacacauaccuucaugccagucuauuuccacugaacaaaaucacugccuuccucucucua

SEQ ID NO: 556842 - RNA, 64 nt, Homo Sapiens
ccuacacacguaccuucaugcacugaagaagucacugaacaaaaauuugcucagcuggcugaga

SEQ ID NO: 556843 - RNA, 64 nt, Homo Sapiens
ugcuagacuuucuggagugauguggucuguuugucugaacaaaguuuauaucuuccuaauaagg

SEQ ID NO: 556844 - RNA, 64 nt, Homo Sapiens
aagagugugaaaugaaaauauugccuugccauuucugaacaaaagaaaacugaauuguaaagau

SEQ ID NO: 556845 - RNA, 64 nt, Homo Sapiens
aagcaauuuagacuuaaguggugcuuugugguaucugaacaauucauaacauguaaauaaugug

SEQ ID NO: 556846 - RNA, 64 nt, Homo Sapiens
gucuccauuuuucaaguguguuucccuuucuauucugaacaacuagcuuaaacucuaauagcug

SEQ ID NO: 556847 - RNA, 64 nt, Homo Sapiens
cuuguaaaguuccauuguauaacuuuauuuuggucugaacaaacaugugacugaauguaagauu

SEQ ID NO: 556848 - RNA, 64 nt, Homo Sapiens
aggugaucagauaaaauauauuuugggaaauuaacugaacaaauaaaaaguuuuugauauaacu

SEQ ID NO: 556849 - RNA, 64 nt, Homo Sapiens
uucauuucagucaaaucacugcagucaugaaauacugaacaauugccuuaagucuuugcuugac

SEQ ID NO: 556850 - RNA, 64 nt, Homo Sapiens
ggggaccaucaacauuguaguuauuaaaacuugacugaacaaaaacuguagaacaguuuuauuu

SEQ ID NO: 556851 - RNA, 64 nt, Homo Sapiens
ugcaauuaacuguagaacagauuggaaauuuacacugaacaaagcguuuaaccugcucuugguc

SEQ ID NO: 556852 - RNA, 64 nt, Homo Sapiens
ugacaguguaacagauaaggcaccugugugccugcugaacaacuaaauacagugugugugugug

SEQ ID NO: 556853 - RNA, 64 nt, Homo Sapiens
ggcuuacuauccauggucuugaauucugagucuccugaacaaaacaguauuauucuuguuuucu

SEQ ID NO: 556854 - RNA, 64 nt, Homo Sapiens
uuucuguggcuccagugagaacaaggcuuugaaacugaacaagauaacuucuagaaaugaacug

SEQ ID NO: 556855 - RNA, 64 nt, Homo Sapiens
aaggauccaggaguauuuucuucuugggugggcccugaacaaagccaaaaauuguagaaaccag

SEQ ID NO: 556856 - RNA, 64 nt, Homo Sapiens
caccaugacaacccugcaggugcucacccugcugcugaacaaauuuaggguaagccuggucagg

SEQ ID NO: 556857 - RNA, 64 nt, Homo Sapiens
uguuuugaggaaagggcuuugaauuccccagauacugaacaauuuguguuugugacugauggag

SEQ ID NO: 556858 - RNA, 64 nt, Homo Sapiens
uuuccacuuuccacgugcuuaaaaaaugacaugccugaacaacuuuuuaaaagcaucauuuaaa

SEQ ID NO: 556859 - RNA, 64 nt, Homo Sapiens
uguugcaugcucuugaggccaaugaagacuaaaacugaacaagacuaaaggguaguuguuuuac

SEQ ID NO: 556860 - RNA, 64 nt, Homo Sapiens
auauuucccagauagcuggcuauugcuguuggaacugaacaauaugugucaaguuacucaaagu

SEQ ID NO: 556861 - RNA, 64 nt, Homo Sapiens
cacuuuggaguaaauagcuacuauagggaaagcacugaacaaacacauaauuaaagcaguugaa

SEQ ID NO: 556862 - RNA, 64 nt, Homo Sapiens
cuuuuaaggguauuuuaaaaauuaguaaauuugaaugaacuaaagauauaucucuaccuucuca

SEQ ID NO: 556863 - RNA, 64 nt, Homo Sapiens
guucauucagauuuacuaauuuugguaaaucugaaugaacuaaagauguaucuguaccuucuca

SEQ ID NO: 556864 - RNA, 64 nt, Homo Sapiens
caauucagagagaguucuuuacaaagccaugaauaugaacuauggggaaucaugguucuuuuaa

SEQ ID NO: 556865 - RNA, 64 nt, Homo Sapiens
gauuuuucuucugcugcuugacugcuucaucuggaugaacuacaaaaaacccaugauuaagguu

SEQ ID NO: 556866 - RNA, 64 nt, Homo Sapiens
aaaauucugagugauccaggguaugaccuagggaaugaacuagcuaugaaauacucaggguuag

SEQ ID NO: 556867 - RNA, 64 nt, Homo Sapiens
ucgcccuacagaaaacccagcuagacuauuggguaugaacuaaaaagagacugugccaugguga

SEQ ID NO: 556868 - RNA, 64 nt, Homo Sapiens
gcaggaauccagaugccgauaugauggccugacaaugaacuacugaccccagaaaacuacccaa

SEQ ID NO: 556869 - RNA, 64 nt, Homo Sapiens
gcaggaauccagauccugugaugcugacuugaucaugaacuacugaccucagaaaaguacccaa

SEQ ID NO: 556870 - RNA, 64 nt, Homo Sapiens
cauugccuugcuauauucacauauuacaggccaaaugaacuaaaguauauaacaucuaauauau

SEQ ID NO: 556871 - RNA, 64 nt, Homo Sapiens
cauugccuugcuauauucacuccgcauuauaaaaaugaacuaaaaagcaccauguaucaggauu

SEQ ID NO: 556872 - RNA, 64 nt, Homo Sapiens
augcaacuugaaaggaaacaguuuaaugguggaaaugaacuaccauuuauaacuucuguuuuuu

SEQ ID NO: 556873 - RNA, 64 nt, Homo Sapiens
uaugggagaaaccagagaugggaaugaggaaaauaugaacuacagcagaagccccugggcagcu

SEQ ID NO: 556874 - RNA, 64 nt, Homo Sapiens
accacugcacugucugagaauuuccaaaacuuuaaugaacuaacugacagcuucaugaaacugu

SEQ ID NO: 556875 - RNA, 64 nt, Homo Sapiens
caagcagagaaaauaauuaauuucaugggacuaaaugaacuaaugaggauaauauuuucauaau

SEQ ID NO: 556876 - RNA, 64 nt, Homo Sapiens
cgagaggcccuggcccauucccuccagcggugcaaugaacuaucaugcuguggaccgucaaccc

SEQ ID NO: 556877 - RNA, 64 nt, Homo Sapiens
cagguuggugacuuugcaaaugcacuuccuacagaugaacuauuaaaagaccugcaacauugaa

SEQ ID NO: 556878 - RNA, 64 nt, Homo Sapiens
uaaauuacccagguucuguuuuaagccucagaaaaugaacuaagacaaugcccuagaugagcug

SEQ ID NO: 556879 - RNA, 64 nt, Homo Sapiens
gagcaucuccccucuugucuguggaagauaucacaugaacuaccuaauuuucaagcauggaucu

SEQ ID NO: 556880 - RNA, 64 nt, Homo Sapiens; identical to SEQ ID NO: 249485

SEQ ID NO: 556881 - RNA, 64 nt, Homo Sapiens; identical to SEQ ID NO: 249486

SEQ ID NO: 556882 - RNA, 64 nt, Homo Sapiens; identical to SEQ ID NO: 249487

SEQ ID NO: 556883 - RNA, 64 nt, Homo Sapiens; identical to SEQ ID NO: 249488

SEQ ID NO: 556884 - RNA, 64 nt, Homo Sapiens; identical to SEQ ID NO: 249489

SEQ ID NO: 556885 - RNA, 64 nt, Homo Sapiens; identical to SEQ ID NO: 249490

SEQ ID NO: 556886 - RNA, 64 nt, Homo Sapiens; identical to SEQ ID NO: 249491

SEQ ID NO: 556887 - RNA, 64 nt, Homo Sapiens; identical to SEQ ID NO: 249492

SEQ ID NO: 556888 - RNA, 64 nt, Homo Sapiens; identical to SEQ ID NO: 249493

SEQ ID NO: 556889 - RNA, 64 nt, Homo Sapiens; identical to SEQ ID NO: 249494

SEQ ID NO: 556890 - RNA, 64 nt, Homo Sapiens; identical to SEQ ID NO: 249495

SEQ ID NO: 556891 - RNA, 64 nt, Homo Sapiens; identical to SEQ ID NO: 249496

SEQ ID NO: 556892 - RNA, 64 nt, Homo Sapiens; identical to SEQ ID NO: 249497

SEQ ID NO: 556893 - RNA, 64 nt, Homo Sapiens; identical to SEQ ID NO: 249498

SEQ ID NO: 556894 - RNA, 64 nt, Homo Sapiens; identical to SEQ ID NO: 249499

SEQ ID NO: 556895 - RNA, 64 nt, Homo Sapiens; identical to SEQ ID NO: 249500

SEQ ID NO: 556896 - RNA, 64 nt, Homo Sapiens; identical to SEQ ID NO: 249501

SEQ ID NO: 556897 - RNA, 64 nt, Homo Sapiens; identical to SEQ ID NO: 249502

SEQ ID NO: 556898 - RNA, 64 nt, Homo Sapiens; identical to SEQ ID NO: 249503

SEQ ID NO: 556899 - RNA, 64 nt, Homo Sapiens; identical to SEQ ID NO: 249504

SEQ ID NO: 556900 - RNA, 64 nt, Homo Sapiens; identical to SEQ ID NO: 249505

SEQ ID NO: 556901 - RNA, 64 nt, Homo Sapiens; identical to SEQ ID NO: 45744

SEQ ID NO: 556902 - RNA, 64 nt, Homo Sapiens; identical to SEQ ID NO: 45745

SEQ ID NO: 556903 - RNA, 64 nt, Homo Sapiens; identical to SEQ ID NO: 45746

SEQ ID NO: 556904 - RNA, 64 nt, Homo Sapiens; identical to SEQ ID NO: 45747

SEQ ID NO: 556905 - RNA, 64 nt, Homo Sapiens; identical to SEQ ID NO: 45748

SEQ ID NO: 556906 - RNA, 64 nt, Homo Sapiens; identical to SEQ ID NO: 45749

SEQ ID NO: 556907 - RNA, 64 nt, Homo Sapiens; identical to SEQ ID NO: 45750

SEQ ID NO: 556908 - RNA, 64 nt, Homo Sapiens; identical to SEQ ID NO: 45751

SEQ ID NO: 556909 - RNA, 64 nt, Homo Sapiens; identical to SEQ ID NO: 45752

SEQ ID NO: 556910 - RNA, 64 nt, Homo Sapiens; identical to SEQ ID NO: 45753

SEQ ID NO: 556911 - RNA, 64 nt, Homo Sapiens; identical to SEQ ID NO: 45754

SEQ ID NO: 556912 - RNA, 64 nt, Homo Sapiens; identical to SEQ ID NO: 45755

SEQ ID NO: 556913 - RNA, 64 nt, Homo Sapiens; identical to SEQ ID NO: 45756

SEQ ID NO: 556914 - RNA, 64 nt, Homo Sapiens; identical to SEQ ID NO: 45757

SEQ ID NO: 556915 - RNA, 64 nt, Homo Sapiens; identical to SEQ ID NO: 45758

SEQ ID NO: 556916 - RNA, 64 nt, Homo Sapiens; identical to SEQ ID NO: 45759

SEQ ID NO: 556917 - RNA, 64 nt, Homo Sapiens; identical to SEQ ID NO: 45760

SEQ ID NO: 556918 - RNA, 64 nt, Homo Sapiens; identical to SEQ ID NO: 45761

SEQ ID NO: 556919 - RNA, 64 nt, Homo Sapiens; identical to SEQ ID NO: 45762

SEQ ID NO: 556920 - RNA, 64 nt, Homo Sapiens; identical to SEQ ID NO: 45763

SEQ ID NO: 556921 - RNA, 64 nt, Homo Sapiens; identical to SEQ ID NO: 45764

SEQ ID NO: 556922 - RNA, 64 nt, Homo Sapiens; identical to SEQ ID NO: 45765

SEQ ID NO: 556923 - RNA, 64 nt, Homo Sapiens; identical to SEQ ID NO: 45766

SEQ ID NO: 556924 - RNA, 64 nt, Homo Sapiens; identical to SEQ ID NO: 45767

SEQ ID NO: 556925 - RNA, 64 nt, Homo Sapiens; identical to SEQ ID NO: 45768

SEQ ID NO: 556926 - RNA, 64 nt, Homo Sapiens; identical to SEQ ID NO: 45769

SEQ ID NO: 556927 - RNA, 64 nt, Homo Sapiens; identical to SEQ ID NO: 45770

SEQ ID NO: 556928 - RNA, 64 nt, Homo Sapiens; identical to SEQ ID NO: 45771

SEQ ID NO: 556929 - RNA, 64 nt, Homo Sapiens; identical to SEQ ID NO: 45772

SEQ ID NO: 556930 - RNA, 64 nt, Homo Sapiens; identical to SEQ ID NO: 45773

SEQ ID NO: 556931 - RNA, 64 nt, Homo Sapiens; identical to SEQ ID NO: 45774

SEQ ID NO: 556932 - RNA, 64 nt, Homo Sapiens; identical to SEQ ID NO: 45775

SEQ ID NO: 556933 - RNA, 64 nt, Homo Sapiens; identical to SEQ ID NO: 45776

SEQ ID NO: 556934 - RNA, 64 nt, Homo Sapiens; identical to SEQ ID NO: 45777

SEQ ID NO: 556935 - RNA, 64 nt, Homo Sapiens; identical to SEQ ID NO: 45778

SEQ ID NO: 556936 - RNA, 64 nt, Homo Sapiens; identical to SEQ ID NO: 45779

SEQ ID NO: 556937 - RNA, 64 nt, Homo Sapiens; identical to SEQ ID NO: 224102

SEQ ID NO: 556938 - RNA, 64 nt, Homo Sapiens; identical to SEQ ID NO: 224103

SEQ ID NO: 556939 - RNA, 64 nt, Homo Sapiens; identical to SEQ ID NO: 224104

SEQ ID NO: 556940 - RNA, 64 nt, Homo Sapiens; identical to SEQ ID NO: 224105

SEQ ID NO: 556941 - RNA, 63 nt, Homo Sapiens; identical to SEQ ID NO: 224106

SEQ ID NO: 556942 - RNA, 64 nt, Homo Sapiens; identical to SEQ ID NO: 224107

SEQ ID NO: 556943 - RNA, 64 nt, Homo Sapiens
aagcuggggucuccaggcagugggggaaagaaaagaaagagaagagagaaggaauggcguggga

SEQ ID NO: 556944 - RNA, 64 nt, Homo Sapiens
cagcaugcuccucacuccugaauugcaucugcaggaaagagaugugcugagcccggggcagggg

SEQ ID NO: 556945 - RNA, 64 nt, Homo Sapiens
uuguaugggcacuguaucuaguugaaaauugugggaaagagaaucuaaagcaagagaucuggca

SEQ ID NO: 556946 - RNA, 64 nt, Homo Sapiens
ucacacagacaaucaugugcaaagucuuccucuggaaagagaaguccuagaauuuaaaaauaaa

SEQ ID NO: 556947 - RNA, 64 nt, Homo Sapiens
cugagaauuaaaauauuuuaggaaagguaugagggaaagagaguucuuaugugagguggggaag

SEQ ID NO: 556948 - RNA, 64 nt, Homo Sapiens
auguucuuauucagauaauggcuucuagagguaggaaagagaagugaagaaaucucuggagcca

SEQ ID NO: 556949 - RNA, 64 nt, Homo Sapiens
uugccucucuuuuacuuuucaguaucucaugaaggaaagagauugagaaagagauaaaaauaaa

SEQ ID NO: 556950 - RNA, 64 nt, Homo Sapiens
aaaauaaaaguaucucaugaagcacaugaguagagaaagagauacagaaucauuucaccaguua

SEQ ID NO: 556951 - RNA, 64 nt, Homo Sapiens
aaguggguauguguaaaagcugggaaaguuaugggaaagagaaugcauagaccuaucuaggguc

SEQ ID NO: 556952 - RNA, 64 nt, Homo Sapiens
uaucuagggucaucauagaagccuuuauaauuuagaaagagacugcguugagacaugaaggauc

SEQ ID NO: 556953 - RNA, 64 nt, Homo Sapiens
acauggaaaauaaagccaggaaagucaaaaaaacgaaagagaaggagaagaaaaaggaaaaggg

SEQ ID NO: 556954 - RNA, 64 nt, Homo Sapiens
ugguuacccucgggauggccauccacugucuccagaaagagaccacuuagagggucucuaugcc

SEQ ID NO: 556955 - RNA, 64 nt, Homo Sapiens
gagagaaaagagguaaaggaggagguucuggaaagaaagagagacccauuuuccuguucgacug

SEQ ID NO: 556956 - RNA, 64 nt, Homo Sapiens
gagaccaugucaacaaggcuagcagaagaauugagaaagagaauucuaaguccaaaaacuauag

SEQ ID NO: 556957 - RNA, 64 nt, Homo Sapiens
ucaaaguccagaucuaguuccaagucugggcaccgaaagagagcaucaaaaucaccaagaaaaa

SEQ ID NO: 556958 - RNA, 64 nt, Homo Sapiens
aacgggaaugcccucauucaaaaaaaagaacuuugaaagagaaucuuucugaucaccuuagaaa

SEQ ID NO: 556959 - RNA, 64 nt, Homo Sapiens
aggaaaaucuuaaaagagaacacaccaaaaaagugaaagagaaauugaaagggaaaaaagacaa

SEQ ID NO: 556960 - RNA, 58 nt, Homo Sapiens
uuccauagugcaaguggugacccaggaugaaagagagcagcuguacacaccugcuucc

SEQ ID NO: 556961 - RNA, 64 nt, Homo Sapiens
aaaaaaaaagggaauaagcaaagggggaagaauugaaagagagagagaagaaagaauacagaga

SEQ ID NO: 556962 - RNA, 64 nt, Homo Sapiens
ugcuccuucaucguaaauuucuauugcaaccugagaaagagaacggcaaaugacaagcgauagg

SEQ ID NO: 556963 - RNA, 64 nt, Homo Sapiens
gaaugacagaaaaaaaaaaggugacguccugccagaaagagaaugaaggcccucucacacagac

SEQ ID NO: 556964 - RNA, 64 nt, Homo Sapiens
gagucaaggucacuguccccgcuucggccugaaggaaagagaagacauuucuauggccuugcuc

SEQ ID NO: 556965 - RNA, 64 nt, Homo Sapiens
guguauuucuugguacccccaagauaucaggccagaaagagaugagucaguugcugugcucuuu

SEQ ID NO: 556966 - RNA, 64 nt, Homo Sapiens
cagacgcaggaagaugaaagucuuuucugccugagaaagagaacaaaugcaauaaggaaucaau

SEQ ID NO: 556967 - RNA, 64 nt, Homo Sapiens
uauauauauauccacccccauuaauacauuaagagaaagagaaagcaauguccuuugauuuuuu

SEQ ID NO: 556968 - RNA, 64 nt, Homo Sapiens
uggguugucguuuucuugcucuggaaccacaccagaaagagaccgaaccugcaguccacccucc

SEQ ID NO: 556969 - RNA, 64 nt, Homo Sapiens
ucugagcaggugagggggucaccugacccucacagaaagagagcucucucuggucacugcccuu

SEQ ID NO: 556970 - RNA, 64 nt, Homo Sapiens
cugggacauagaaccucuuaggccacacuuugcugaaagagaugagcauugcucagaucacugu

SEQ ID NO: 556971 - RNA, 64 nt, Homo Sapiens
gagaaaagagcagauuuuaaugcauuccacuggggaaagagagaagacucaucagcuccauauc

SEQ ID NO: 556972 - RNA, 64 nt, Homo Sapiens
gagacuggcauuuuccucucaagaaugggaaagagaaagagacaauaaugcuuaauaauaauug

SEQ ID NO: 556973 - RNA, 64 nt, Homo Sapiens
gagacagagacuggcauuuuuaauugaagaaugggaaagagaaaaugauaauaaugcuuaauaa

SEQ ID NO: 556974 - RNA, 64 nt, Homo Sapiens
auguaaaucaucuggcaucacugauagaauuucugaaagagaaagagaaguagauggucaacca

SEQ ID NO: 556975 - RNA, 64 nt, Homo Sapiens
aucaucuggcaucacugauagaauuucugaaagagaaagagaaguagauggucaaccagucacu

SEQ ID NO: 556976 - RNA, 64 nt, Homo Sapiens
aauaugugccugucacaacacaaauaccccucuugaaagagauuuacucaucuauccaagcacu

SEQ ID NO: 556977 - RNA, 64 nt, Homo Sapiens
aagaggcucuguuuuccacugaagcuuuguuggagaaagagaauaugaaaauuacacauuuuau

SEQ ID NO: 556978 - RNA, 64 nt, Homo Sapiens
acauuaaaucguagguagggcaauguaguaaaaugaaagagaauuaagaaagguuuugaauucu

SEQ ID NO: 556979 - RNA, 64 nt, Homo Sapiens
agaucucuauucuauaaauguguaaugugaugaagaaagagaucuuucuuuuuuaaugaaaaca

SEQ ID NO: 556980 - RNA, 64 nt, Homo Sapiens
aauaaagggagagagcaguggguauacagggcaggaaagagaggugcaggcuucuuaugccguu

SEQ ID NO: 556981 - RNA, 64 nt, Homo Sapiens
gaacggaaacacggaguuugccucagcagaaaccgaaagagaaagaggccagugugucaccagc

SEQ ID NO: 556982 - RNA, 64 nt, Homo Sapiens
aaaauuuauuauaacacuaagguugggcuuuuuugaaagagacaacauauuuugguggagaaga

SEQ ID NO: 556983 - RNA, 64 nt, Homo Sapiens
aaaacugucuagaauuugaaaauauauuuauaaagaaagagaccgauaucaccagacuagaauu

SEQ ID NO: 556984 - RNA, 64 nt, Homo Sapiens
acucuggggucagggagagacauuuuaaggagaggaaagagaaaggaccagaagaggcacuagc

SEQ ID NO: 556985 - RNA, 64 nt, Homo Sapiens
agacagugaccaacccugaggucaaguuaauucagaaagagaagauuuccaucugucugguuau

SEQ ID NO: 556986 - RNA, 64 nt, Homo Sapiens
gaaagaauaaaagcuggagagcauuggaccuagggaaagagaaagcaugugaguugggucaagu

SEQ ID NO: 556987 - RNA, 64 nt, Homo Sapiens
guuucagcgucauccuugaacagaucccaugugagaaagagagaaguugugagggcccagauca

SEQ ID NO: 556988 - RNA, 64 nt, Homo Sapiens
cacagagagaaggagaaagagggagggagagagagaaagagagagaaagagagagagagagaga

SEQ ID NO: 556989 - RNA, 64 nt, Homo Sapiens
aggagaaagagggagggagagagagaaagagagagaaagagagagagagagagagagagagaaa

SEQ ID NO: 556990 - RNA, 64 nt, Homo Sapiens
caccuaccuuuucaggauuuagaaccuaaaauuagaaagagaaucccagcugucauuguuccuu

SEQ ID NO: 556991 - RNA, 64 nt, Homo Sapiens
ggggcuucccuguucccucagccccagucgagaggaaagagaaucgggccacugccagaaagag

SEQ ID NO: 556992 - RNA, 64 nt, Homo Sapiens
ccagucgagaggaaagagaaucgggccacugccagaaagagagucaagcaaaccuggaagggca

SEQ ID NO: 556993 - RNA, 64 nt, Homo Sapiens
aauauuugggagagaaggauaagagagagagagagaaagagaacucucagaaaaaaaaaaaaaa

SEQ ID NO: 556994 - RNA, 64 nt, Homo Sapiens
gggccgggcgugguggcucaaaaaaaaaaaaaaagaaagagagaagauccugucucucaaaaaa

SEQ ID NO: 556995 - RNA, 64 nt, Homo Sapiens
gagugcugaggggcacucucgagguuuuucuugggaaagagacauaaugggagacagugguaga

SEQ ID NO: 556996 - RNA, 64 nt, Homo Sapiens
acccacuccuauguacuaucaagaucuguaucuagaaagagauccaggcacuguuuggagccau

SEQ ID NO: 556997 - RNA, 64 nt, Homo Sapiens
gaaggagagagacaguagccagagagagagaggagaaagagagacagacauuuccuagagaaag

SEQ ID NO: 556998 - RNA, 64 nt, Homo Sapiens
gagagaggagaaagagagagagacauuuccuagagaaagagagaagugaggccugcuucacaac

SEQ ID NO: 556999 - RNA, 64 nt, Homo Sapiens
gggauuuggccccuggcuccuuaagcaguuacuagaaagagaugcuucauagcaagggaaggcu

SEQ ID NO: 557000 - RNA, 64 nt, Homo Sapiens
gaaugucuuucauuugaagaaauguggcagguuagaaagagagagucacuucaaggccuguuug

SEQ ID NO: 557001 - RNA, 64 nt, Homo Sapiens
aacucagaaggcaacaacagaacggauugcucgagaaagagaggggaacgucguaaggaagcug

SEQ ID NO: 557002 - RNA, 64 nt, Homo Sapiens
uugccuuuugaaaagaugaaaaagacuacagaaggaaagagaucgucuagauaaaaaaagagau

SEQ ID NO: 557003 - RNA, 64 nt, Homo Sapiens
gagagaugcuguugaaucaggugagagagagagagaaagagagagagugagagagagaaagaga

SEQ ID NO: 557004 - RNA, 64 nt, Homo Sapiens
gagagagagagagaaagagagagagugagagagagaaagagaguaaccaguuuccagagagcca

SEQ ID NO: 557005 - RNA, 64 nt, Homo Sapiens
ggcagagaaggagagaggcaaagaggcagagaaggaaagagacaggaagagaggcagagaggga

SEQ ID NO: 557006 - RNA, 64 nt, Homo Sapiens
uggggagaggggagagagaugaggaggggagagagaaagagaggggaggagggagagagaugga

SEQ ID NO: 557007 - RNA, 64 nt, Homo Sapiens
cgauguaucucacuuuuucaauacuguauaauaugaaagagaauuugauauuguuauaauguau

SEQ ID NO: 557008 - RNA, 64 nt, Homo Sapiens
cauuuuguaugcuuucuuuucauguauuuuggaagaaagagauaccaaaacguagaacugaaag

SEQ ID NO: 557009 - RNA, 64 nt, Homo Sapiens
aggcucgggaggcccugcccugugcgcuaagugagaaagagagcguguguguguugugugugug

SEQ ID NO: 557010 - RNA, 64 nt, Homo Sapiens
agguguaaaaaagauguuucacuaauguaacggugaaagagaaucccuguuguacuuuaucuuu

SEQ ID NO: 557011 - RNA, 64 nt, Homo Sapiens
augcuuucuuuaaaauaacuagaagaacauaaaagaaagagaaucucagaaguaguuugcugcu

SEQ ID NO: 557012 - RNA, 64 nt, Homo Sapiens
uugccucacuuuuacauucagccacagccacacggaaagagacucaucccuuucagaccuaaca

SEQ ID NO: 557013 - RNA, 64 nt, Homo Sapiens
agugugcgcuccauucucaguaauauaggcacaggaaagagaaaagauuagggggacuuaaaau

SEQ ID NO: 557014 - RNA, 64 nt, Homo Sapiens
cagccugcgggacagagugagacccugucugaaagaaagagagaaagaaagaaagaaagagaga

SEQ ID NO: 557015 - RNA, 64 nt, Homo Sapiens
gacccugucugaaagaaagagagaaagaaagaaagaaagagagagaaagaaagaaagaaagaaa

SEQ ID NO: 557016 - RNA, 64 nt, Homo Sapiens
aagaaagggaaagauggaaggaaggaaggaaaaagaaagagaaagagagagagagagaaagaaa

SEQ ID NO: 557017 - RNA, 64 nt, Homo Sapiens
gggaaagauggaaggaaggaaggaaaaagaaagagaaagagagagagagagaaagaaaaagaaa

SEQ ID NO: 557018 - RNA, 64 nt, Homo Sapiens
aagaauucagcugacaggaguuccuguguuggaugaaagagaauuccaugugcuuuucgcagcc

SEQ ID NO: 557019 - RNA, 64 nt, Homo Sapiens
gccugugaaauaggcagggccccggaggaagggugaaagagaaagguggcuuuuaaaccaggag

SEQ ID NO: 557020 - RNA, 64 nt, Homo Sapiens
gaagcuggggcuacguccaugacagggauagacagaaagagacauggccaaacucagacacgug

SEQ ID NO: 557021 - RNA, 64 nt, Homo Sapiens
gagagagagagaaggggcccgagagagagagagagaaagagagacacccccuccccgggcagca

SEQ ID NO: 557022 - RNA, 64 nt, Homo Sapiens
cacaauagaaaaaggcagaaaacagagucucagggaaagagaaccccagaguuggagacagaac

SEQ ID NO: 557023 - RNA, 64 nt, Homo Sapiens
cagaaaaaggaagagguggagccaaaaggauagagaaagagaccagacaugauagagggacaga

SEQ ID NO: 557024 - RNA, 64 nt, Homo Sapiens
gagaaagaaagucuccagacaggaaagagagaaggaaagagagaucagcaacauagaagaggga

SEQ ID NO: 557025 - RNA, 64 nt, Homo Sapiens
aggaaagagagagagaaagaauagaagagggaaggaaagagagaugcccuacccgcucagcaac

SEQ ID NO: 557026 - RNA, 64 nt, Homo Sapiens
ccggcaccuuuuguuugucccauugguggcagaugugagcgacaucaggcgcuuccucagugca

SEQ ID NO: 557027 - RNA, 64 nt, Homo Sapiens
ccacgugaaacugcuguuuucuaggccaaaaauggugagcgaucauuuauuucaugauucaacc

SEQ ID NO: 557028 - RNA, 64 nt, Homo Sapiens
gcagccggagugagcccuucgccccugagugccuggcucgcaccucucgagcugugcccugggc

SEQ ID NO: 557029 - RNA, 64 nt, Homo Sapiens
ugacacuggugccaggcugaccucagcucccgaaggcucgcacagccuccccauccuuccuucc

SEQ ID NO: 557030 - RNA, 64 nt, Homo Sapiens
cugcugcccccagccuguagauuuguagugccggggcucgcacagccgcccgggguucuaugau

SEQ ID NO: 557031 - RNA, 64 nt, Homo Sapiens
ggggccucccagcgccucagucuggccgccauccggcucgcacacgaggagcugacacguccuc

SEQ ID NO: 557032 - RNA, 64 nt, Homo Sapiens
ggggauuuuccaggccaggacuggcgagcccgggggcucgcaggacgcaggcaggugggguugu

SEQ ID NO: 557033 - RNA, 64 nt, Homo Sapiens
caagaaguggggaggcuugguugagucuugcuuaggcucgcaaauagugaaaucaaugaaacuc

SEQ ID NO: 557034 - RNA, 64 nt, Homo Sapiens
ccgcccggccgcuagacugacuucgcgcagcgguggcucgcaccugugggaccucagggcaccg

SEQ ID NO: 557035 - RNA, 64 nt, Homo Sapiens
aaaagcauuugcugcaagucucuuggauuauauaggcucgcaggcccaauacuugcacacauuc

SEQ ID NO: 557036 - RNA, 64 nt, Homo Sapiens
guacuccccuugcuuuuggugacuuuaaacaucuggcucgcaaggaagaauuaccacaacugaa

SEQ ID NO: 557037 - RNA, 64 nt, Homo Sapiens
aucaauaaagcaguucucugggcagccaagcccaggcucgcaguucuacaggaccacuugagug

SEQ ID NO: 557038 - RNA, 64 nt, Homo Sapiens
agcgcagcgcugugucugcugucagaaauagccaggcucgcagcggagccccuaacuagggcaa

SEQ ID NO: 557039 - RNA, 64 nt, Homo Sapiens
cacagggucugcugccacguuguaucaguaaccaggcucgcacauaaauauauucuuuacuuuu

SEQ ID NO: 557040 - RNA, 64 nt, Homo Sapiens
ccccagcucaccgcgccgcggcacgcggggccccggcucgcaagcgggcgcgggcgcggaggac

SEQ ID NO: 557041 - RNA, 64 nt, Homo Sapiens
guaccgccuguuguaucugggagccucguacagaggcucgcacagcagugaucaagugucaucc

SEQ ID NO: 557042 - RNA, 64 nt, Homo Sapiens
uguauucccagccacugggguaaccaggcaugguggcucgcaccacaaagaaagauuuaaaaau

SEQ ID NO: 557043 - RNA, 64 nt, Homo Sapiens
aaaaugugggcuuccuuuaacuucagaggaguucggcucgcagguuccaaaggucugccauacu

SEQ ID NO: 557044 - RNA, 64 nt, Homo Sapiens
aagagcacagcccucaacuaccugcgacuagcaaggcucgcagccuaagggugcugugcccaac

SEQ ID NO: 557045 - RNA, 64 nt, Homo Sapiens
aaugccuuuacuuuauucucuggggagggccagcggcucgcaucccccucaucuccagcugcag

SEQ ID NO: 557046 - RNA, 64 nt, Homo Sapiens
gcugucugugggccgccccuggccaccuuguccuggcucgcagggugcaggagcgccucguucu

SEQ ID NO: 557047 - RNA, 64 nt, Homo Sapiens
ccugggagguggcccuuggggugucuucucacagggcucgcacggcccugccugcugggcuccc

SEQ ID NO: 557048 - RNA, 64 nt, Homo Sapiens
gcuguggccacugcugaccagccgcuuuugcaguggcucgcacugugaggaugggggaguagau

SEQ ID NO: 557049 - RNA, 64 nt, Homo Sapiens
ccagguuguaucacccccgaguuagcauaucccaggcucgcagacucaacacagcaaggguggg

SEQ ID NO: 557050 - RNA, 64 nt, Homo Sapiens
cgggccuccagguggaccaaagggaugcacaggcggcucgcaugccccagggccagcuaagagu

SEQ ID NO: 557051 - RNA, 64 nt, Homo Sapiens
gaauccacgcgcuccagggaaaaaagugcugcauggcucgcauguuugacuucugacaaaaaac

SEQ ID NO: 557052 - RNA, 64 nt, Homo Sapiens
guugugccacauucccacucaaggcucagaacuuggcucgcauugguagcuggaggugguagaa

SEQ ID NO: 557053 - RNA, 64 nt, Homo Sapiens
acaccgcgcguggcguggguguguguggcagcguggcucgcauucaguccuguguaggagagga

SEQ ID NO: 557054 - RNA, 64 nt, Homo Sapiens
cuguguaguguuuuacgucucgcauggacccgauggcucgcauuacagcacucaagcuucuggc

SEQ ID NO: 557055 - RNA, 64 nt, Homo Sapiens
auuccuggaaagugguggcuucagaagugaucuuggcucgcaggcaccagugccaccuaccaag

SEQ ID NO: 557056 - RNA, 64 nt, Homo Sapiens
gcccuucugcuggcccuguccgggcauaacagaaggcucgcacucuugucuucuggucacaccu

SEQ ID NO: 557057 - RNA, 64 nt, Homo Sapiens
cuccgccucccagguucaagaguggugcaaucuuggcucgcaacugucacccaggcuggagugc

SEQ ID NO: 557058 - RNA, 64 nt, Homo Sapiens
ugguacccauggccaccuccuugggugucugccuggcucgcacucagcugugugcugcaugggg

SEQ ID NO: 557059 - RNA, 64 nt, Homo Sapiens
ugacaggaaacuggauugccgcaucaacuuggauggcucgcauaagcugggcaaaucuuacuug

SEQ ID NO: 557060 - RNA, 64 nt, Homo Sapiens
ccaccacuuccagagccagaaagggugccaguugggcucgcacugcccacaugggaccuggccc

SEQ ID NO: 557061 - RNA, 64 nt, Homo Sapiens
cccgcccgagcucaggcugccccucuccuuccccggcucgcaggagagcagagcagagaacugu

SEQ ID NO: 557062 - RNA, 64 nt, Homo Sapiens
cggagccacuggggugggagggggcagggggcuuggcucgcacccccacuuucgccuccuccag

SEQ ID NO: 557063 - RNA, 64 nt, Homo Sapiens
ccaggggccacagccaagcccagagucccccagcggcucgcaugucagcccagaccccaggguc

SEQ ID NO: 557064 - RNA, 64 nt, Homo Sapiens
gggggcauauuugcaagcgcgcucggugcgggcaggcucgcauugcacccagggagcuggaguu

SEQ ID NO: 557065 - RNA, 64 nt, Homo Sapiens
uauggcugcuuuagacaacugugacagacuauauggcucgcaaaacugcaaauauuuccuaucc

SEQ ID NO: 557066 - RNA, 64 nt, Homo Sapiens
gccucauggccgcgcagccucugggcgccgcuugggcucgcaaccgccagugcgcgcggagcug

SEQ ID NO: 557067 - RNA, 64 nt, Homo Sapiens
agcuacagcucgcuccccuuggccucugugccuuggcucgcacuguuccuacugaaggccuagc

SEQ ID NO: 557068 - RNA, 64 nt, Homo Sapiens
ugcauccugcaucccaguccgccaacagucauguggcucgcagagucuggccgcuggucaagaa

SEQ ID NO: 557069 - RNA, 64 nt, Homo Sapiens; identical to SEQ ID NO: 206768

SEQ ID NO: 557070 - RNA, 64 nt, Homo Sapiens; identical to SEQ ID NO: 206769

SEQ ID NO: 557071 - RNA, 64 nt, Homo Sapiens; identical to SEQ ID NO: 206770

SEQ ID NO: 557072 - RNA, 64 nt, Homo Sapiens; identical to SEQ ID NO: 206771

SEQ ID NO: 557073 - RNA, 64 nt, Homo Sapiens; identical to SEQ ID NO: 206772

SEQ ID NO: 557074 - RNA, 64 nt, Homo Sapiens; identical to SEQ ID NO: 206773

SEQ ID NO: 557075 - RNA, 64 nt, Homo Sapiens; identical to SEQ ID NO: 206774

SEQ ID NO: 557076 - RNA, 64 nt, Homo Sapiens; identical to SEQ ID NO: 206775

SEQ ID NO: 557077 - RNA, 64 nt, Homo Sapiens; identical to SEQ ID NO: 206776

SEQ ID NO: 557078 - RNA, 64 nt, Homo Sapiens; identical to SEQ ID NO: 206777

SEQ ID NO: 557079 - RNA, 64 nt, Homo Sapiens
cccagucuuuucugcauugagcucuuugacaguguccuuuuauaaugucagauuuugagcagua

SEQ ID NO: 557080 - RNA, 64 nt, Homo Sapiens
cgauggcaggucaugaaauauuuauuaggugacuuccuuuuaggauaugguuuuaaauuggugc

SEQ ID NO: 557081 - RNA, 64 nt, Homo Sapiens
caaaaguguuagaauuugcuuuugugccaucuauuccuuuuauggcaucuaucuugaaaguaau

SEQ ID NO: 557082 - RNA, 64 nt, Homo Sapiens
gaaauuacuuaauacucaguguuuuggagaguauuccuuuuaguuuguugguuggcugguuuga

SEQ ID NO: 557083 - RNA, 64 nt, Homo Sapiens
uacaaaagcuuauuuucauuguaaccauauaguauccuuuuagaaugcgauagguaacauguuu

SEQ ID NO: 557084 - RNA, 64 nt, Homo Sapiens
ucucuucuccaauauuaaaauaucuguuacggccuccuuuuaucgaccuuuaauacagugugcu

SEQ ID NO: 557085 - RNA, 64 nt, Homo Sapiens
ggcaagagcguuacuguagaccuuucucccuccuuccuuuuacuaccauuuuuuuuuaacacug

SEQ ID NO: 557086 - RNA, 64 nt, Homo Sapiens
uuucaagauuuccaaagagaugaaauuuucuuaauccuuuuaaguuuucauaguaaacaguaug

SEQ ID NO: 557087 - RNA, 64 nt, Homo Sapiens
uacuuacuaggaagccuggaauucauuauuuuuuuccuuuuaugugccacuguggcuacuuuaa

SEQ ID NO: 557088 - RNA, 64 nt, Homo Sapiens
guuguuuaggaagagucaacagacuuuagcaaaauccuuuuauuugauucaugcauaacuccug

SEQ ID NO: 557089 - RNA, 64 nt, Homo Sapiens
cauauuuucacaugacguaagggcucaaaaaguuuccuuuuauucauacauugccaauuuucca

SEQ ID NO: 557090 - RNA, 64 nt, Homo Sapiens
aacauugguauauuuccauuuacugauugauugguccuuuuauacaccccaucaaguauaaggu

SEQ ID NO: 557091 - RNA, 64 nt, Homo Sapiens
gaaaauugguacugugauaaauuugaauccaaaauccuuuuaacuauggguuuucaacuacaug

SEQ ID NO: 557092 - RNA, 64 nt, Homo Sapiens
gauuuucaggacuuuaccuuuuguuuuguuuuuuuccuuuuagccaucuuuuguucuuguaauc

SEQ ID NO: 557093 - RNA, 64 nt, Homo Sapiens
aaguaauuguaugugcuugccgcuauuuuuuucuuccuuuuaggaugauagaucauaacagaac

SEQ ID NO: 557094 - RNA, 64 nt, Homo Sapiens
aucuucaaaaaauuauuuuaggcaaaguccauacuccuuuuaaaacaauauuuauguccuaugu

SEQ ID NO: 557095 - RNA, 64 nt, Homo Sapiens
uacuguugaucaguugugacgauuuuuguuuguuuccuuuuaaguggaaauuuguggcuagugu

SEQ ID NO: 557096 - RNA, 64 nt, Homo Sapiens
gguaaaacaaaagugaacaucaaaauacuguguauccuuuuaugaaugugucugguauuuacag

SEQ ID NO: 557097 - RNA, 64 nt, Homo Sapiens
aacugcacucugucuugucuugucaaauaaauccuccuuuuaaaauauugcgcuaagugaaacu

SEQ ID NO: 557098 - RNA, 64 nt, Homo Sapiens
uauauugcgcuaagugaaacauuguauugugauuuccuuuuaggggccuugauuuaaaucuuuc

SEQ ID NO: 557099 - RNA, 64 nt, Homo Sapiens
aucgagcuacuucccauaauuagauagguguuuguccuuuuaccuacaggcuuaagcucuaaga

SEQ ID NO: 557100 - RNA, 64 nt, Homo Sapiens
ggcuugcuauacuuggucugcuguuucucaguaguccuuuuagagaguucuagaguuucugauu

SEQ ID NO: 557101 - RNA, 64 nt, Homo Sapiens
auacuuuucuuccccauggaaaaaucaaguuauuuccuuuuauaugggacccccuucaaaccua

SEQ ID NO: 557102 - RNA, 64 nt, Homo Sapiens
gaauaauauucaauacacagcuccccuccucuauuccuuuuaggcaaucagaauugugcuuuuu

SEQ ID NO: 557103 - RNA, 64 nt, Homo Sapiens
gacauucuuuaucaagagguugcacgguaagaauuccuuuuacauuuaccaugauaauauauuc

SEQ ID NO: 557104 - RNA, 64 nt, Homo Sapiens
gguugugagguagauuggaggaagguacacguuguccuuuuaaauucccagccuauaaaaaaag

SEQ ID NO: 557105 - RNA, 64 nt, Homo Sapiens
uuucuccaccauccagagcccauuauucucauuuuccuuuuaccuaaccugucuucuucccucc

SEQ ID NO: 557106 - RNA, 64 nt, Homo Sapiens
ugaagccuuugguauccaggaugguuccucaggauccuuuuauuuccaaaaccagcauuucaga

SEQ ID NO: 557107 - RNA, 64 nt, Homo Sapiens
auuuuguguuccuuuuugcaaauucuuccuucccuccuuuuaaauguauccugaaaggcaacau

SEQ ID NO: 557108 - RNA, 64 nt, Homo Sapiens
augguaugccaacuuaaguauuauuccuuuuuauuccuuuuaaagaugaaaauaucagcuuuuc

SEQ ID NO: 557109 - RNA, 64 nt, Homo Sapiens
ugugacaugaacucaaaauccugcauuuuuagauuccuuuuaguucuaauugaggccucacuag

SEQ ID NO: 557110 - RNA, 64 nt, Homo Sapiens
uucugcuguugauucuuucagucuuccccccuucuccuuuuaucaaucauuccagaguuauuuu

SEQ ID NO: 557111 - RNA, 64 nt, Homo Sapiens
uaguuuugaaaguaaggaacccaugcuaacauuuuccuuuuagcaaaagucuacuguucauaaa

SEQ ID NO: 557112 - RNA, 64 nt, Homo Sapiens
ugugcugcaacguuuuuaaauuuaaaauaaccuuuccuuuuaaaauuuucuuuuucaaauccaa

SEQ ID NO: 557113 - RNA, 64 nt, Homo Sapiens
uucucaguguuuuagcuguuuuuuucauuagguuuccuuuuauucuguaccuugcagccaugac

SEQ ID NO: 557114 - RNA, 64 nt, Homo Sapiens
ccaggagcuggaggagcaggcagugggugggagcuccuuuuagguagaauuuaacaugacuucu

SEQ ID NO: 557115 - RNA, 64 nt, Homo Sapiens
uccuuccuuaauaaagagaccgcucagguuauguuccuuuuaccaugaaacuagauuuuuauug

SEQ ID NO: 557116 - RNA, 64 nt, Homo Sapiens
cuuccaucugaagccccacuccauguuccuuguuuccuuuuauuucuuucauuacuuuuaguaa

SEQ ID NO: 557117 - RNA, 64 nt, Homo Sapiens
gagaaaccaaccugauacacaguucagcuauaauuccuuuuauagguuaugcuccuccagcucu

SEQ ID NO: 557118 - RNA, 64 nt, Homo Sapiens
gaaccuugaauugauccuaaaauuccagauacauuccuuuuacuuuuucaugucuauaaucaag

SEQ ID NO: 557119 - RNA, 64 nt, Homo Sapiens
gaucacaugcuacaacuagaaagauuuaaacugauccuuuuaagacgggaaggaaauccuuuua

SEQ ID NO: 557120 - RNA, 64 nt, Homo Sapiens
gauuuaaacugauccuuuuauaacgggaaggaaauccuuuuaaaaauggaaugcuauuaagccu

SEQ ID NO: 557121 - RNA, 64 nt, Homo Sapiens
uacuaacauuuguagcacuugaugauuuacaaaguccuuuuacaucuguuuuuucauuugaucc

SEQ ID NO: 557122 - RNA, 64 nt, Homo Sapiens
agaagagcaucucaaguuaccaaauuuuuuguaauccuuuuacuagaaaaaucuuuuuugaaga

SEQ ID NO: 557123 - RNA, 64 nt, Homo Sapiens
gaccuguuuuagugcugcauucgacauggaaaaguccuuuuaaccugugcuugcauccuccuuu

SEQ ID NO: 557124 - RNA, 64 nt, Homo Sapiens
auagcagauaaugaugacuaguucacacauaaaguccuuuuaaggagaaaaucuaaaaugaaaa

SEQ ID NO: 557125 - RNA, 64 nt, Homo Sapiens
uguucaagaucaauaugucuaauaagugcugguguccuuuuaaaguauuuaaauauauauguug

SEQ ID NO: 557126 - RNA, 64 nt, Homo Sapiens
uagcaaccaaaagagguuguuaauuagcacauauuccuuuuagaaaaauguuucagaaaccuca

SEQ ID NO: 557127 - RNA, 64 nt, Homo Sapiens
gaauuuaucuaauuauuguuuuucaaaguuucuuuccuuuuaauguuucccugcuaugcaaaac

SEQ ID NO: 557128 - RNA, 64 nt, Homo Sapiens
uuaagauggaaguaguuaaauauggguuauuuuguccuuuuacuuuuuuaaaaaauguuacaua

SEQ ID NO: 557129 - RNA, 64 nt, Homo Sapiens
uaaaauaaucugaacucuuuuccuuuuauuuuaauccuuuuacaaaaccauucaccaauuuuaa

SEQ ID NO: 557130 - RNA, 64 nt, Homo Sapiens
uuaauccuuuuacauaaaauuucaccaauuuuaauccuuuuauuuugaauacuugaauaaacca

SEQ ID NO: 557131 - RNA, 64 nt, Homo Sapiens
aaaaaugacaagugaaggcaaauacauccuuuuauccuuuuaugcuuauuguuugcaagaacag

SEQ ID NO: 557132 - RNA, 64 nt, Homo Sapiens
cuuuuaugaaaaaugacaagaagaacagaauacauccuuuuaucuguuagcacuuauuguuugc

SEQ ID NO: 557133 - RNA, 64 nt, Homo Sapiens
ccucauucaucaugcuggaucuaggagaccagauuccuuuuauaguaagagaauccaucuuuua

SEQ ID NO: 557134 - RNA, 64 nt, Homo Sapiens
uaauuccccaacccauaugcgagaaagagcagauuccuuuuagccuugacugaauuaugggcag

SEQ ID NO: 557135 - RNA, 64 nt, Homo Sapiens
uuccguauuuccugaugagaucuguucagcaguuuccuuuuagcauuuuuaguugacauuguuu

SEQ ID NO: 557136 - RNA, 64 nt, Homo Sapiens
uuuaaucuguuuaaaacaagcacacauauuuccauccuuuuauguuugauuaauguuuucgugg

SEQ ID NO: 557137 - RNA, 64 nt, Homo Sapiens
uuuuuuccaaccauugcuuggaagguaguaauauuccuuuuaaauuuccucaagaaugucugaa

SEQ ID NO: 557138 - RNA, 64 nt, Homo Sapiens
ucaacacgucgggaguauguguguuagaagcaauuccuuuuauuucuuucaccuuucauaaguu

SEQ ID NO: 557139 - RNA, 64 nt, Homo Sapiens
guuguaacucucuggucuucauaugucccugugcuccuuuuaaccaaauaaagaguucuuguuu

SEQ ID NO: 557140 - RNA, 64 nt, Homo Sapiens
gacagucuuuugggaaccaaguguuuuuaaaaauuccuuuuagaaaaaugaguuacaaugucag

SEQ ID NO: 557141 - RNA, 64 nt, Homo Sapiens
aaaguaauaccaauuuagacacgaaacuacaaaauccuuuuaaggaguuagauguauuaaaaaa

SEQ ID NO: 557142 - RNA, 64 nt, Homo Sapiens
gaacuuaacucucgcuggcaagagucuagcccucuccuuuuaauuugcuaauuuugugaaauaa

SEQ ID NO: 557143 - RNA, 64 nt, Homo Sapiens
aaaaauuucugguuuuuauucccugagggaaaaauccuuuuaaaggccaguuuuuacuuguuug

SEQ ID NO: 557144 - RNA, 64 nt, Homo Sapiens
auuuuguuggaugacuuggagauuuaucucuguuuccuuuuacaauuguugaaauguuccuuuu

SEQ ID NO: 557145 - RNA, 64 nt, Homo Sapiens
uuaucucuguuuccuuuuacaauuguugaaauguuccuuuuaauggaugguugaauuaacuuca

SEQ ID NO: 557146 - RNA, 64 nt, Homo Sapiens
aguuccuuuagaccugugaaaucuacuuuauccuuccuuuuaauauucuguuuuauaguauaga

SEQ ID NO: 557147 - RNA, 64 nt, Homo Sapiens
gugucuuguauuaaguacggacaagagauuccucuccuuuuacucggcucagauagggcucaaa

SEQ ID NO: 557148 - RNA, 64 nt, Homo Sapiens; identical to SEQ ID NO: 308467

SEQ ID NO: 557149 - RNA, 64 nt, Homo Sapiens; identical to SEQ ID NO: 308468

SEQ ID NO: 557150 - RNA, 64 nt, Homo Sapiens; identical to SEQ ID NO: 308469

SEQ ID NO: 557151 - RNA, 64 nt, Homo Sapiens; identical to SEQ ID NO: 308470

SEQ ID NO: 557152 - RNA, 64 nt, Homo Sapiens; identical to SEQ ID NO: 60210

SEQ ID NO: 557153 - RNA, 64 nt, Homo Sapiens; identical to SEQ ID NO: 60211

SEQ ID NO: 557154 - RNA, 64 nt, Homo Sapiens; identical to SEQ ID NO: 60212

SEQ ID NO: 557155 - RNA, 64 nt, Homo Sapiens; identical to SEQ ID NO: 60213

SEQ ID NO: 557156 - RNA, 64 nt, Homo Sapiens; identical to SEQ ID NO: 60214

SEQ ID NO: 557157 - RNA, 64 nt, Homo Sapiens; identical to SEQ ID NO: 60215

SEQ ID NO: 557158 - RNA, 64 nt, Homo Sapiens; identical to SEQ ID NO: 60216

SEQ ID NO: 557159 - RNA, 64 nt, Homo Sapiens; identical to SEQ ID NO: 60217

SEQ ID NO: 557160 - RNA, 64 nt, Homo Sapiens; identical to SEQ ID NO: 60218

SEQ ID NO: 557161 - RNA, 64 nt, Homo Sapiens; identical to SEQ ID NO: 60219

SEQ ID NO: 557162 - RNA, 64 nt, Homo Sapiens; identical to SEQ ID NO: 60220

SEQ ID NO: 557163 - RNA, 64 nt, Homo Sapiens; identical to SEQ ID NO: 60221

SEQ ID NO: 557164 - RNA, 64 nt, Homo Sapiens; identical to SEQ ID NO: 60222

SEQ ID NO: 557165 - RNA, 64 nt, Homo Sapiens; identical to SEQ ID NO: 60223

SEQ ID NO: 557166 - RNA, 64 nt, Homo Sapiens; identical to SEQ ID NO: 60224

SEQ ID NO: 557167 - RNA, 64 nt, Homo Sapiens; identical to SEQ ID NO: 60225

SEQ ID NO: 557168 - RNA, 64 nt, Homo Sapiens; identical to SEQ ID NO: 60226

SEQ ID NO: 557169 - RNA, 64 nt, Homo Sapiens; identical to SEQ ID NO: 60227

SEQ ID NO: 557170 - RNA, 64 nt, Homo Sapiens; identical to SEQ ID NO: 60228

SEQ ID NO: 557171 - RNA, 64 nt, Homo Sapiens; identical to SEQ ID NO: 60229

SEQ ID NO: 557172 - RNA, 64 nt, Homo Sapiens; identical to SEQ ID NO: 60230

SEQ ID NO: 557173 - RNA, 64 nt, Homo Sapiens; identical to SEQ ID NO: 60231

SEQ ID NO: 557174 - RNA, 64 nt, Homo Sapiens; identical to SEQ ID NO: 60232

SEQ ID NO: 557175 - RNA, 64 nt, Homo Sapiens; identical to SEQ ID NO: 60233

SEQ ID NO: 557176 - RNA, 64 nt, Homo Sapiens; identical to SEQ ID NO: 60234

SEQ ID NO: 557177 - RNA, 64 nt, Homo Sapiens; identical to SEQ ID NO: 60235

SEQ ID NO: 557178 - RNA, 64 nt, Homo Sapiens; identical to SEQ ID NO: 60236

SEQ ID NO: 557179 - RNA, 64 nt, Homo Sapiens; identical to SEQ ID NO: 60237

SEQ ID NO: 557180 - RNA, 64 nt, Homo Sapiens; identical to SEQ ID NO: 60238

SEQ ID NO: 557181 - RNA, 64 nt, Homo Sapiens; identical to SEQ ID NO: 60239

SEQ ID NO: 557182 - RNA, 64 nt, Homo Sapiens; identical to SEQ ID NO: 60240

SEQ ID NO: 557183 - RNA, 64 nt, Homo Sapiens; identical to SEQ ID NO: 60241

SEQ ID NO: 557184 - RNA, 64 nt, Homo Sapiens; identical to SEQ ID NO: 60242

SEQ ID NO: 557185 - RNA, 64 nt, Homo Sapiens; identical to SEQ ID NO: 60243

SEQ ID NO: 557186 - RNA, 64 nt, Homo Sapiens; identical to SEQ ID NO: 60244

SEQ ID NO: 557187 - RNA, 64 nt, Homo Sapiens; identical to SEQ ID NO: 60245

SEQ ID NO: 557188 - RNA, 64 nt, Homo Sapiens; identical to SEQ ID NO: 60246

SEQ ID NO: 557189 - RNA, 64 nt, Homo Sapiens; identical to SEQ ID NO: 60247

SEQ ID NO: 557190 - RNA, 64 nt, Homo Sapiens; identical to SEQ ID NO: 60248

SEQ ID NO: 557191 - RNA, 64 nt, Homo Sapiens; identical to SEQ ID NO: 60249

SEQ ID NO: 557192 - RNA, 64 nt, Homo Sapiens; identical to SEQ ID NO: 60250

SEQ ID NO: 557193 - RNA, 64 nt, Homo Sapiens; identical to SEQ ID NO: 60251

SEQ ID NO: 557194 - RNA, 64 nt, Homo Sapiens; identical to SEQ ID NO: 60252

SEQ ID NO: 557195 - RNA, 64 nt, Homo Sapiens; identical to SEQ ID NO: 60253

SEQ ID NO: 557196 - RNA, 64 nt, Homo Sapiens; identical to SEQ ID NO: 60254

SEQ ID NO: 557197 - RNA, 64 nt, Homo Sapiens; identical to SEQ ID NO: 60255

SEQ ID NO: 557198 - RNA, 64 nt, Homo Sapiens; identical to SEQ ID NO: 60256

SEQ ID NO: 557199 - RNA, 64 nt, Homo Sapiens; identical to SEQ ID NO: 379884

SEQ ID NO: 557200 - RNA, 64 nt, Homo Sapiens; identical to SEQ ID NO: 379885

SEQ ID NO: 557201 - RNA, 64 nt, Homo Sapiens; identical to SEQ ID NO: 379886

SEQ ID NO: 557202 - RNA, 64 nt, Homo Sapiens; identical to SEQ ID NO: 379887

SEQ ID NO: 557203 - RNA, 64 nt, Homo Sapiens; identical to SEQ ID NO: 379888

SEQ ID NO: 557204 - RNA, 64 nt, Homo Sapiens; identical to SEQ ID NO: 379889

SEQ ID NO: 557205 - RNA, 64 nt, Homo Sapiens; identical to SEQ ID NO: 379890

SEQ ID NO: 557206 - RNA, 64 nt, Homo Sapiens; identical to SEQ ID NO: 379891

SEQ ID NO: 557207 - RNA, 64 nt, Homo Sapiens; identical to SEQ ID NO: 379892

SEQ ID NO: 557208 - RNA, 64 nt, Homo Sapiens; identical to SEQ ID NO: 379893

SEQ ID NO: 557209 - RNA, 64 nt, Homo Sapiens; identical to SEQ ID NO: 379894

SEQ ID NO: 557210 - RNA, 64 nt, Homo Sapiens; identical to SEQ ID NO: 379895

SEQ ID NO: 557211 - RNA, 64 nt, Homo Sapiens; identical to SEQ ID NO: 79450

SEQ ID NO: 557212 - RNA, 64 nt, Homo Sapiens; identical to SEQ ID NO: 79451

SEQ ID NO: 557213 - RNA, 64 nt, Homo Sapiens; identical to SEQ ID NO: 79452

SEQ ID NO: 557214 - RNA, 64 nt, Homo Sapiens; identical to SEQ ID NO: 79453

SEQ ID NO: 557215 - RNA, 64 nt, Homo Sapiens; identical to SEQ ID NO: 79454

SEQ ID NO: 557216 - RNA, 64 nt, Homo Sapiens; identical to SEQ ID NO: 79455

SEQ ID NO: 557217 - RNA, 64 nt, Homo Sapiens; identical to SEQ ID NO: 79456

SEQ ID NO: 557218 - RNA, 64 nt, Homo Sapiens; identical to SEQ ID NO: 79457

SEQ ID NO: 557219 - RNA, 64 nt, Homo Sapiens; identical to SEQ ID NO: 79458

SEQ ID NO: 557220 - RNA, 64 nt, Homo Sapiens; identical to SEQ ID NO: 79459

SEQ ID NO: 557221 - RNA, 64 nt, Homo Sapiens
agcuucggccuccacaucguccccgucugaccccaccccggagggagggaggaccgacgcgacg

SEQ ID NO: 557222 - RNA, 64 nt, Homo Sapiens
cccaucccaguccuguggggcuggccgggcagagaccccggacccaggcccaggccuaaccugc

SEQ ID NO: 557223 - RNA, 64 nt, Homo Sapiens
cuugguggggaacucuaagggggacggagucaguaccccggacagggccacauuugcaugagac

SEQ ID NO: 557224 - RNA, 64 nt, Homo Sapiens
cgggguuucuccuuguuggucaggcuggucucaaaccccggaccucaggugauccccccaccuu

SEQ ID NO: 557225 - RNA, 64 nt, Homo Sapiens
uaguguuucuguauaauaaagugucugccggcucgcgggccaggauccucucggugggaugggc

SEQ ID NO: 557226 - RNA, 64 nt, Homo Sapiens
ugggcaccacagacaggaggccccucaggcccgugcgggccacugucugcugccgccugccggg

SEQ ID NO: 557227 - RNA, 64 nt, Homo Sapiens; identical to SEQ ID NO: 159617

SEQ ID NO: 557228 - RNA, 64 nt, Homo Sapiens; identical to SEQ ID NO: 159618

SEQ ID NO: 557229 - RNA, 64 nt, Homo Sapiens; identical to SEQ ID NO: 159619

SEQ ID NO: 557230 - RNA, 64 nt, Homo Sapiens; identical to SEQ ID NO: 159620

SEQ ID NO: 557231 - RNA, 64 nt, Homo Sapiens; identical to SEQ ID NO: 159621

SEQ ID NO: 557232 - RNA, 64 nt, Homo Sapiens; identical to SEQ ID NO: 159622

SEQ ID NO: 557233 - RNA, 64 nt, Homo Sapiens; identical to SEQ ID NO: 159623

SEQ ID NO: 557234 - RNA, 64 nt, Homo Sapiens; identical to SEQ ID NO: 159624

SEQ ID NO: 557235 - RNA, 64 nt, Homo Sapiens; identical to SEQ ID NO: 159625

SEQ ID NO: 557236 - RNA, 64 nt, Homo Sapiens; identical to SEQ ID NO: 159626

SEQ ID NO: 557237 - RNA, 64 nt, Homo Sapiens; identical to SEQ ID NO: 159627

SEQ ID NO: 557238 - RNA, 64 nt, Homo Sapiens; identical to SEQ ID NO: 159628

SEQ ID NO: 557239 - RNA, 64 nt, Homo Sapiens; identical to SEQ ID NO: 159629

SEQ ID NO: 557240 - RNA, 64 nt, Homo Sapiens; identical to SEQ ID NO: 159630

SEQ ID NO: 557241 - RNA, 64 nt, Homo Sapiens; identical to SEQ ID NO: 159631

SEQ ID NO: 557242 - RNA, 64 nt, Homo Sapiens; identical to SEQ ID NO: 159632

SEQ ID NO: 557243 - RNA, 64 nt, Homo Sapiens; identical to SEQ ID NO: 159633

SEQ ID NO: 557244 - RNA, 64 nt, Homo Sapiens; identical to SEQ ID NO: 159634

SEQ ID NO: 557245 - RNA, 64 nt, Homo Sapiens; identical to SEQ ID NO: 159635

SEQ ID NO: 557246 - RNA, 64 nt, Homo Sapiens; identical to SEQ ID NO: 159636

SEQ ID NO: 557247 - RNA, 64 nt, Homo Sapiens; identical to SEQ ID NO: 159637

SEQ ID NO: 557248 - RNA, 64 nt, Homo Sapiens; identical to SEQ ID NO: 159638

SEQ ID NO: 557249 - RNA, 64 nt, Homo Sapiens; identical to SEQ ID NO: 159639

SEQ ID NO: 557250 - RNA, 64 nt, Homo Sapiens; identical to SEQ ID NO: 159640

SEQ ID NO: 557251 - RNA, 64 nt, Homo Sapiens; identical to SEQ ID NO: 159641

SEQ ID NO: 557252 - RNA, 64 nt, Homo Sapiens; identical to SEQ ID NO: 159642

SEQ ID NO: 557253 - RNA, 64 nt, Homo Sapiens; identical to SEQ ID NO: 159643

SEQ ID NO: 557254 - RNA, 64 nt, Homo Sapiens; identical to SEQ ID NO: 159644

SEQ ID NO: 557255 - RNA, 64 nt, Homo Sapiens; identical to SEQ ID NO: 159645

SEQ ID NO: 557256 - RNA, 64 nt, Homo Sapiens; identical to SEQ ID NO: 159646

SEQ ID NO: 557257 - RNA, 64 nt, Homo Sapiens; identical to SEQ ID NO: 159647

SEQ ID NO: 557258 - RNA, 64 nt, Homo Sapiens; identical to SEQ ID NO: 159648

SEQ ID NO: 557259 - RNA, 64 nt, Homo Sapiens; identical to SEQ ID NO: 159649

SEQ ID NO: 557260 - RNA, 64 nt, Homo Sapiens; identical to SEQ ID NO: 159650

SEQ ID NO: 557261 - RNA, 64 nt, Homo Sapiens; identical to SEQ ID NO: 159651

SEQ ID NO: 557262 - RNA, 64 nt, Homo Sapiens; identical to SEQ ID NO: 159652

SEQ ID NO: 557263 - RNA, 64 nt, Homo Sapiens; identical to SEQ ID NO: 159653

SEQ ID NO: 557264 - RNA, 64 nt, Homo Sapiens; identical to SEQ ID NO: 159654

SEQ ID NO: 557265 - RNA, 64 nt, Homo Sapiens; identical to SEQ ID NO: 159655

SEQ ID NO: 557266 - RNA, 64 nt, Homo Sapiens; identical to SEQ ID NO: 159656

SEQ ID NO: 557267 - RNA, 64 nt, Homo Sapiens; identical to SEQ ID NO: 159657

SEQ ID NO: 557268 - RNA, 64 nt, Homo Sapiens; identical to SEQ ID NO: 159658

SEQ ID NO: 557269 - RNA, 64 nt, Homo Sapiens; identical to SEQ ID NO: 194820

SEQ ID NO: 557270 - RNA, 64 nt, Homo Sapiens; identical to SEQ ID NO: 194821

SEQ ID NO: 557271 - RNA, 64 nt, Homo Sapiens; identical to SEQ ID NO: 194822

SEQ ID NO: 557272 - RNA, 64 nt, Homo Sapiens; identical to SEQ ID NO: 194823

SEQ ID NO: 557273 - RNA, 64 nt, Homo Sapiens; identical to SEQ ID NO: 194824

SEQ ID NO: 557274 - RNA, 64 nt, Homo Sapiens; identical to SEQ ID NO: 194825

SEQ ID NO: 557275 - RNA, 50 nt, Homo Sapiens; identical to SEQ ID NO: 57621

SEQ ID NO: 557276 - RNA, 64 nt, Homo Sapiens; identical to SEQ ID NO: 194827

SEQ ID NO: 557277 - RNA, 64 nt, Homo Sapiens; identical to SEQ ID NO: 194828

SEQ ID NO: 557278 - RNA, 64 nt, Homo Sapiens; identical to SEQ ID NO: 194829

SEQ ID NO: 557279 - RNA, 64 nt, Homo Sapiens; identical to SEQ ID NO: 194830

SEQ ID NO: 557280 - RNA, 64 nt, Homo Sapiens; identical to SEQ ID NO: 194831

SEQ ID NO: 557281 - RNA, 64 nt, Homo Sapiens; identical to SEQ ID NO: 194832

SEQ ID NO: 557282 - RNA, 64 nt, Homo Sapiens; identical to SEQ ID NO: 194833

SEQ ID NO: 557283 - RNA, 64 nt, Homo Sapiens; identical to SEQ ID NO: 194834

SEQ ID NO: 557284 - RNA, 64 nt, Homo Sapiens; identical to SEQ ID NO: 194835

SEQ ID NO: 557285 - RNA, 64 nt, Homo Sapiens; identical to SEQ ID NO: 194836

SEQ ID NO: 557286 - RNA, 64 nt, Homo Sapiens; identical to SEQ ID NO: 194837

SEQ ID NO: 557287 - RNA, 64 nt, Homo Sapiens; identical to SEQ ID NO: 194838

SEQ ID NO: 557288 - RNA, 64 nt, Homo Sapiens; identical to SEQ ID NO: 200782

SEQ ID NO: 557289 - RNA, 64 nt, Homo Sapiens; identical to SEQ ID NO: 200783

SEQ ID NO: 557290 - RNA, 64 nt, Homo Sapiens; identical to SEQ ID NO: 200784

SEQ ID NO: 557291 - RNA, 64 nt, Homo Sapiens; identical to SEQ ID NO: 200785

SEQ ID NO: 557292 - RNA, 64 nt, Homo Sapiens; identical to SEQ ID NO: 200786

SEQ ID NO: 557293 - RNA, 64 nt, Homo Sapiens; identical to SEQ ID NO: 200787

SEQ ID NO: 557294 - RNA, 64 nt, Homo Sapiens; identical to SEQ ID NO: 200788

SEQ ID NO: 557295 - RNA, 64 nt, Homo Sapiens; identical to SEQ ID NO: 200789

SEQ ID NO: 557296 - RNA, 64 nt, Homo Sapiens; identical to SEQ ID NO: 200790

SEQ ID NO: 557297 - RNA, 64 nt, Homo Sapiens; identical to SEQ ID NO: 200791

SEQ ID NO: 557298 - RNA, 64 nt, Homo Sapiens; identical to SEQ ID NO: 200792

SEQ ID NO: 557299 - RNA, 64 nt, Homo Sapiens; identical to SEQ ID NO: 200793

SEQ ID NO: 557300 - RNA, 64 nt, Homo Sapiens; identical to SEQ ID NO: 200794

SEQ ID NO: 557301 - RNA, 64 nt, Homo Sapiens; identical to SEQ ID NO: 200795

SEQ ID NO: 557302 - RNA, 64 nt, Homo Sapiens; identical to SEQ ID NO: 200796

SEQ ID NO: 557303 - RNA, 64 nt, Homo Sapiens; identical to SEQ ID NO: 200797

SEQ ID NO: 557304 - RNA, 64 nt, Homo Sapiens
cacccaagguuucugauucugacccagcagugguccugaagagagcugauggcaagucuuguag

SEQ ID NO: 557305 - RNA, 64 nt, Homo Sapiens
gcucugggcacauuuccuguucuugaauucugcuccugaagagggugaacaaauggggcauuca

SEQ ID NO: 557306 - RNA, 64 nt, Homo Sapiens
aagccuucccguccuugccucauaccacguugugccugaagaacaaaaccagguuucuucuccc

SEQ ID NO: 557307 - RNA, 64 nt, Homo Sapiens
ugagauuuuauuaucccucuuggauccucuggugccugaagaaaagaaucaaagccuugucaca

SEQ ID NO: 557308 - RNA, 64 nt, Homo Sapiens
accuggcacgugcacugcuugagaucaugcacgcccugaagaugugacugggaccuccuuccag

SEQ ID NO: 557309 - RNA, 64 nt, Homo Sapiens
ucaagguacagggacgggcaccggaugaggagcaccugaagaaacugcccucucagugcaagac

SEQ ID NO: 557310 - RNA, 64 nt, Homo Sapiens
ucuggccucccaugucagguagggugagagaggcccugaagauagaagccaggcccgaaggcca

SEQ ID NO: 557311 - RNA, 64 nt, Homo Sapiens
aggacggggcugugucugccucagacugggaaucccugaagauggggccgugucucccucaaag

SEQ ID NO: 557312 - RNA, 64 nt, Homo Sapiens
aggacggggcugugucucccucagacuggggcucccugaagaaagggcugcuucucccucagac

SEQ ID NO: 557313 - RNA, 64 nt, Homo Sapiens
aagaaagggcugcuucucccucagacuggagcucccugaagauggggcugugucccccucagac

SEQ ID NO: 557314 - RNA, 64 nt, Homo Sapiens
uaaaaugccaacaccaaaccacaaugaccagaagccugaagaauaauuuaugcuacaacuggua

SEQ ID NO: 557315 - RNA, 64 nt, Homo Sapiens
uuuugaccguuccaagucuucaacuuugugaaccccugaagauugucauuuuuuaaacaacacu

SEQ ID NO: 557316 - RNA, 64 nt, Homo Sapiens
ugacucugggagggcccggcaagagccugggugcccugaagaagcccaggcccaagagacccug

SEQ ID NO: 557317 - RNA, 64 nt, Homo Sapiens
cugggugcccugaagaagugcaggcccaagagacccugaagagcggcugcagcagcagcugacc

SEQ ID NO: 557318 - RNA, 64 nt, Homo Sapiens
cagguugacaguuggaggacuucaccguaccaacccugaagagauuguauuacacauuaaggac

SEQ ID NO: 557319 - RNA, 64 nt, Homo Sapiens
ccuaccauccaauguggaaggaaaacaagaacugccugaagaagaguccaagcuacagauacac

SEQ ID NO: 557320 - RNA, 64 nt, Homo Sapiens
acccaaauuggauuguauuugagaacuuagaaaaccugaagagucuagucuuauuauucagaug

SEQ ID NO: 557321 - RNA, 64 nt, Homo Sapiens
ccuuugacuucuaggaagaaccugaccuuuccuaccugaagagcgcaagcuugaugcaaaaccu

SEQ ID NO: 557322 - RNA, 64 nt, Homo Sapiens
acuguucauucuuaucuucugcuaguuaauauagccugaagacagaggauaaauaguugucaau

SEQ ID NO: 557323 - RNA, 64 nt, Homo Sapiens
agaaauccuguccucuuggugggagguuaccuuaccugaagaccaucucucccaagcacuguag

SEQ ID NO: 557324 - RNA, 64 nt, Homo Sapiens
ugaacccuacagaaauaugggccugcugccauuuccugaagaccggggcaucggggugggguga

SEQ ID NO: 557325 - RNA, 64 nt, Homo Sapiens
ggaaguuauuaaagaggcugcaaaguccagccacccugaagauacuccccagugcuccccuccu

SEQ ID NO: 557326 - RNA, 64 nt, Homo Sapiens
ggccacgccuccugagaccaagaacccgcaggcuccugaagacugaggaccucaggaggccagc

SEQ ID NO: 557327 - RNA, 64 nt, Homo Sapiens
ggcuaguccuggcagaacaggugccccuggggucccugaagacuuggucccuuacaaacuaacu

SEQ ID NO: 557328 - RNA, 64 nt, Homo Sapiens
gcugggggguggugaugauugucucagcacucacgcacugcacaagauggcagcaggauacagc

SEQ ID NO: 557329 - RNA, 64 nt, Homo Sapiens
acucacgcacugcacaagauggcagcaggauacagcacugcacaagauggcagcuccucugcag

SEQ ID NO: 557330 - RNA, 64 nt, Homo Sapiens
gacagcugcgaccagagacucaggacgucagccagcacugcacaacugcacagacagcugcgac

SEQ ID NO: 557331 - RNA, 64 nt, Homo Sapiens
gacagcugcgaccaggacguguggacaucagccagcacugcacaccugugaggccgugguuagc

SEQ ID NO: 557332 - RNA, 64 nt, Homo Sapiens
cugagugacagagugagacugagaucgcaucauugcacugcaguggcagagguugcagugagcu

SEQ ID NO: 557333 - RNA, 64 nt, Homo Sapiens
uuuguuacugcugcccaccuuggguuggcagcaugcacugcauaccuugugaggaacaaacucc

SEQ ID NO: 557334 - RNA, 64 nt, Homo Sapiens
ugagagccaugagcuggaggaaccaugcauaccugcacugcauugcccagaaugcccagaagag

SEQ ID NO: 557335 - RNA, 64 nt, Homo Sapiens
uaacuguggcuccugcaggggugucucauuaguugcacugcagucaaguggucccugaugugca

SEQ ID NO: 557336 - RNA, 64 nt, Homo Sapiens
augcacaggcacacacauguacgcacacacacaugcacugcacacauauccaugcacacaaaca

SEQ ID NO: 557337 - RNA, 64 nt, Homo Sapiens
acccuccugacuguccuggaugugcaacugguuugcacugcacaccccacggccauguaacucu

SEQ ID NO: 557338 - RNA, 64 nt, Homo Sapiens
ccaacaggcagcaccgcaccucugcccgccucccgcacugcagcuccgcccgccgggcucugcg

SEQ ID NO: 557339 - RNA, 64 nt, Homo Sapiens
ugccacaaacaagugcacacuguccugguguccugcacugcauccugccuccuugcugaggggc

SEQ ID NO: 557340 - RNA, 64 nt, Homo Sapiens
ccucacaccacagcacaccucaccacaccacaccgcacugcaccauaccucaccacaucucacc

SEQ ID NO: 557341 - RNA, 64 nt, Homo Sapiens
acaccucaccacacaacacaccacaccccacaccgcacugcaccgcaccgcaccgcaccguacc

SEQ ID NO: 557342 - RNA, 64 nt, Homo Sapiens
auugcuugggccccacauucauccugccacaucugcacugcagcggaugaccaccaggcucuca

SEQ ID NO: 557343 - RNA, 64 nt, Homo Sapiens
ugugguugccucuccugcauuugccacuggauuugcacugcaucguuuggagauacaaagcgag

SEQ ID NO: 557344 - RNA, 64 nt, Homo Sapiens
gcuaugcugcaaaguggguuggccaaggcccuuugcacugcaucacccuggugcccagcaacau

SEQ ID NO: 557345 - RNA, 64 nt, Homo Sapiens
cagugaaagaggaaaagaacauuccaggcagacagcacugcaagagggugagcucuugguguau

SEQ ID NO: 557346 - RNA, 64 nt, Homo Sapiens
acccacagaucacaccuccauccccaaagagguagcacugcagcaacaucagggggaggacgug

SEQ ID NO: 557347 - RNA, 64 nt, Homo Sapiens
acuauucagagccaguaggaggccgacagucacagcacugcacuguggugcggcuucaugugau

SEQ ID NO: 557348 - RNA, 64 nt, Homo Sapiens
uuuuagaaagagaaaaugagcugagaguuuacaggcacugcagaagcuguucaguauuauaugu

SEQ ID NO: 557349 - RNA, 64 nt, Homo Sapiens
auuguaaauggaauauuccucauuuaaaauuuuugcacugcauuuucuacuguaaaccaaaaga

SEQ ID NO: 557350 - RNA, 64 nt, Homo Sapiens
aggaggucaaggcugcagugagccaugauucacagcacugcacugcagccugggugacaaagca

SEQ ID NO: 557351 - RNA, 64 nt, Homo Sapiens
gucaaggcugcagugagccaugauucacagcacugcacugcagccugggugacaaagcaagacc

SEQ ID NO: 557352 - RNA, 64 nt, Homo Sapiens
gaguguggcacaggcaccguuguccugccaucuggcacugcacuaccacgauggagcccguguu

SEQ ID NO: 557353 - RNA, 64 nt, Homo Sapiens
ggaguugucucuuaccccacagccugcccaccuggcacugcacucgucucaagugaacaguggg

SEQ ID NO: 557354 - RNA, 64 nt, Homo Sapiens
ggcaccggugaggaagggucuuuauuccucccaggcacugcagaguggggaagggucuccaggc

SEQ ID NO: 557355 - RNA, 64 nt, Homo Sapiens
ggcccgguggggaagggucuugcguugcucccaggcacugcagaagagguucagggagaacagc

SEQ ID NO: 557356 - RNA, 64 nt, Homo Sapiens
gggaauuugcucauucuuuuggguaaaaguaagggugggauaugucaacggcauuuguguuaug

SEQ ID NO: 557357 - RNA, 61 nt, Homo Sapiens
acaacaggcugacaaaccaaccacagucauggugggauaagagccgaguuuuuucaucuga

SEQ ID NO: 557358 - RNA, 64 nt, Homo Sapiens
uuuggugacuucacagugaagucuugcccucucugugggauaucacaucagugguuccaagauu

SEQ ID NO: 557359 - RNA, 64 nt, Homo Sapiens
ucuuauacagacccucauuacuggggcccaagaugugggauacuacuguuaguauuauuuaacu

SEQ ID NO: 557360 - RNA, 64 nt, Homo Sapiens; identical to SEQ ID NO: 138555

SEQ ID NO: 557361 - RNA, 64 nt, Homo Sapiens; identical to SEQ ID NO: 138556

SEQ ID NO: 557362 - RNA, 64 nt, Homo Sapiens; identical to SEQ ID NO: 138557

SEQ ID NO: 557363 - RNA, 64 nt, Homo Sapiens; identical to SEQ ID NO: 138558

SEQ ID NO: 557364 - RNA, 64 nt, Homo Sapiens; identical to SEQ ID NO: 138559

SEQ ID NO: 557365 - RNA, 64 nt, Homo Sapiens; identical to SEQ ID NO: 138560

SEQ ID NO: 557366 - RNA, 64 nt, Homo Sapiens; identical to SEQ ID NO: 138561

SEQ ID NO: 557367 - RNA, 64 nt, Homo Sapiens; identical to SEQ ID NO: 138562

SEQ ID NO: 557368 - RNA, 64 nt, Homo Sapiens; identical to SEQ ID NO: 138563

SEQ ID NO: 557369 - RNA, 64 nt, Homo Sapiens; identical to SEQ ID NO: 138564

SEQ ID NO: 557370 - RNA, 64 nt, Homo Sapiens; identical to SEQ ID NO: 138565

SEQ ID NO: 557371 - RNA, 64 nt, Homo Sapiens; identical to SEQ ID NO: 138566

SEQ ID NO: 557372 - RNA, 64 nt, Homo Sapiens; identical to SEQ ID NO: 138567

SEQ ID NO: 557373 - RNA, 64 nt, Homo Sapiens; identical to SEQ ID NO: 138568

SEQ ID NO: 557374 - RNA, 64 nt, Homo Sapiens; identical to SEQ ID NO: 138569

SEQ ID NO: 557375 - RNA, 64 nt, Homo Sapiens; identical to SEQ ID NO: 138570

SEQ ID NO: 557376 - RNA, 64 nt, Homo Sapiens; identical to SEQ ID NO: 138571

SEQ ID NO: 557377 - RNA, 64 nt, Homo Sapiens; identical to SEQ ID NO: 138572

SEQ ID NO: 557378 - RNA, 55 nt, Homo Sapiens; identical to SEQ ID NO: 138573

SEQ ID NO: 557379 - RNA, 64 nt, Homo Sapiens; identical to SEQ ID NO: 138574

SEQ ID NO: 557380 - RNA, 64 nt, Homo Sapiens; identical to SEQ ID NO: 138575

SEQ ID NO: 557381 - RNA, 64 nt, Homo Sapiens; identical to SEQ ID NO: 138576

SEQ ID NO: 557382 - RNA, 64 nt, Homo Sapiens; identical to SEQ ID NO: 138577

SEQ ID NO: 557383 - RNA, 64 nt, Homo Sapiens; identical to SEQ ID NO: 138578

SEQ ID NO: 557384 - RNA, 64 nt, Homo Sapiens; identical to SEQ ID NO: 138579

SEQ ID NO: 557385 - RNA, 64 nt, Homo Sapiens; identical to SEQ ID NO: 138580

SEQ ID NO: 557386 - RNA, 64 nt, Homo Sapiens; identical to SEQ ID NO: 138581

SEQ ID NO: 557387 - RNA, 64 nt, Homo Sapiens; identical to SEQ ID NO: 138582

SEQ ID NO: 557388 - RNA, 64 nt, Homo Sapiens; identical to SEQ ID NO: 138583

SEQ ID NO: 557389 - RNA, 64 nt, Homo Sapiens; identical to SEQ ID NO: 138584

SEQ ID NO: 557390 - RNA, 64 nt, Homo Sapiens; identical to SEQ ID NO: 100733

SEQ ID NO: 557391 - RNA, 64 nt, Homo Sapiens; identical to SEQ ID NO: 100734

SEQ ID NO: 557392 - RNA, 64 nt, Homo Sapiens; identical to SEQ ID NO: 100735

SEQ ID NO: 557393 - RNA, 64 nt, Homo Sapiens; identical to SEQ ID NO: 100736

SEQ ID NO: 557394 - RNA, 64 nt, Homo Sapiens; identical to SEQ ID NO: 100737

SEQ ID NO: 557395 - RNA, 64 nt, Homo Sapiens; identical to SEQ ID NO: 100738

SEQ ID NO: 557396 - RNA, 64 nt, Homo Sapiens; identical to SEQ ID NO: 100739

SEQ ID NO: 557397 - RNA, 64 nt, Homo Sapiens; identical to SEQ ID NO: 100740

SEQ ID NO: 557398 - RNA, 64 nt, Homo Sapiens; identical to SEQ ID NO: 100741

SEQ ID NO: 557399 - RNA, 64 nt, Homo Sapiens; identical to SEQ ID NO: 100742

SEQ ID NO: 557400 - RNA, 64 nt, Homo Sapiens; identical to SEQ ID NO: 100743

SEQ ID NO: 557401 - RNA, 64 nt, Homo Sapiens; identical to SEQ ID NO: 100744

SEQ ID NO: 557402 - RNA, 64 nt, Homo Sapiens; identical to SEQ ID NO: 100745

SEQ ID NO: 557403 - RNA, 64 nt, Homo Sapiens; identical to SEQ ID NO: 100746

SEQ ID NO: 557404 - RNA, 64 nt, Homo Sapiens; identical to SEQ ID NO: 100747

SEQ ID NO: 557405 - RNA, 64 nt, Homo Sapiens; identical to SEQ ID NO: 100748

SEQ ID NO: 557406 - RNA, 64 nt, Homo Sapiens; identical to SEQ ID NO: 100749

SEQ ID NO: 557407 - RNA, 64 nt, Homo Sapiens; identical to SEQ ID NO: 100750

SEQ ID NO: 557408 - RNA, 64 nt, Homo Sapiens; identical to SEQ ID NO: 100751

SEQ ID NO: 557409 - RNA, 64 nt, Homo Sapiens; identical to SEQ ID NO: 100752

SEQ ID NO: 557410 - RNA, 64 nt, Homo Sapiens; identical to SEQ ID NO: 100753

SEQ ID NO: 557411 - RNA, 64 nt, Homo Sapiens; identical to SEQ ID NO: 100754

SEQ ID NO: 557412 - RNA, 64 nt, Homo Sapiens; identical to SEQ ID NO: 100755

SEQ ID NO: 557413 - RNA, 64 nt, Homo Sapiens; identical to SEQ ID NO: 100756

SEQ ID NO: 557414 - RNA, 64 nt, Homo Sapiens; identical to SEQ ID NO: 100757

SEQ ID NO: 557415 - RNA, 64 nt, Homo Sapiens; identical to SEQ ID NO: 100758

SEQ ID NO: 557416 - RNA, 64 nt, Homo Sapiens; identical to SEQ ID NO: 100759

SEQ ID NO: 557417 - RNA, 64 nt, Homo Sapiens; identical to SEQ ID NO: 100760

SEQ ID NO: 557418 - RNA, 64 nt, Homo Sapiens; identical to SEQ ID NO: 100761

SEQ ID NO: 557419 - RNA, 64 nt, Homo Sapiens; identical to SEQ ID NO: 100762

SEQ ID NO: 557420 - RNA, 64 nt, Homo Sapiens; identical to SEQ ID NO: 100763

SEQ ID NO: 557421 - RNA, 64 nt, Homo Sapiens; identical to SEQ ID NO: 100764

SEQ ID NO: 557422 - RNA, 64 nt, Homo Sapiens; identical to SEQ ID NO: 100765

SEQ ID NO: 557423 - RNA, 64 nt, Homo Sapiens; identical to SEQ ID NO: 100766

SEQ ID NO: 557424 - RNA, 64 nt, Homo Sapiens; identical to SEQ ID NO: 100767

SEQ ID NO: 557425 - RNA, 64 nt, Homo Sapiens; identical to SEQ ID NO: 100768

SEQ ID NO: 557426 - RNA, 64 nt, Homo Sapiens; identical to SEQ ID NO: 100769

SEQ ID NO: 557427 - RNA, 64 nt, Homo Sapiens; identical to SEQ ID NO: 100770

SEQ ID NO: 557428 - RNA, 64 nt, Homo Sapiens; identical to SEQ ID NO: 100771

SEQ ID NO: 557429 - RNA, 64 nt, Homo Sapiens; identical to SEQ ID NO: 100772

SEQ ID NO: 557430 - RNA, 64 nt, Homo Sapiens; identical to SEQ ID NO: 100773

SEQ ID NO: 557431 - RNA, 64 nt, Homo Sapiens; identical to SEQ ID NO: 100774

SEQ ID NO: 557432 - RNA, 64 nt, Homo Sapiens; identical to SEQ ID NO: 100775

SEQ ID NO: 557433 - RNA, 64 nt, Homo Sapiens; identical to SEQ ID NO: 100776

SEQ ID NO: 557434 - RNA, 64 nt, Homo Sapiens; identical to SEQ ID NO: 100777

SEQ ID NO: 557435 - RNA, 64 nt, Homo Sapiens; identical to SEQ ID NO: 55217

SEQ ID NO: 557436 - RNA, 64 nt, Homo Sapiens; identical to SEQ ID NO: 55218

SEQ ID NO: 557437 - RNA, 64 nt, Homo Sapiens; identical to SEQ ID NO: 55219

SEQ ID NO: 557438 - RNA, 64 nt, Homo Sapiens; identical to SEQ ID NO: 55220

SEQ ID NO: 557439 - RNA, 64 nt, Homo Sapiens
uuaacaagccuuuggaucagagagaugcuuaguguaauuauaaggccacauuacuuggcauagg

SEQ ID NO: 557440 - RNA, 64 nt, Homo Sapiens
caucucugucccuccagacagaugguugugacuuuaauuauauaucuccugaguccuccuuacc

SEQ ID NO: 557441 - RNA, 64 nt, Homo Sapiens
acucuaaauuuaaugcucuacaucuuaucagucauaauuauauauacuguggaacaguaucugu

SEQ ID NO: 557442 - RNA, 64 nt, Homo Sapiens
uuaaagcauuaugugcaauuaaguuguuaugacauaauuauauugccuaauuguugggucuuuu

SEQ ID NO: 557443 - RNA, 64 nt, Homo Sapiens
cuuuguacagguuauuuaauagcuuuguuaaagauaauuauaauaauuauaacauuaauaaaaa

SEQ ID NO: 557444 - RNA, 64 nt, Homo Sapiens
gguuauuuaauagcuuuguuaaagauaauuauaauaauuauaacauuaauaaaaauguugcuuu

SEQ ID NO: 557445 - RNA, 64 nt, Homo Sapiens
cacaugccguacucuuauauguaccauugguugauaauuauaaugauucauuuggacuugaaga

SEQ ID NO: 557446 - RNA, 64 nt, Homo Sapiens
uagaaaugaguuguauggugaaucuguguagugauaauuauauaauuuauuuauuuugaaugca

SEQ ID NO: 557447 - RNA, 64 nt, Homo Sapiens
gaaaaugaguaacagaguccacggcgugcaaugguaauuauaaauuggugaugcuuguuugcaa

SEQ ID NO: 557448 - RNA, 64 nt, Homo Sapiens
ccauuaagauaugauucauguaacaauguuaaauuaauuauaaugggauuggguuuguuaucug

SEQ ID NO: 557449 - RNA, 64 nt, Homo Sapiens
aauauuaaugaauucagauuuucuauaaguacuauaauuauauagaguuuucaaauaauuuuag

SEQ ID NO: 557450 - RNA, 64 nt, Homo Sapiens
cauuguggaguaacuuugauugcuagagaacccuuaauuauagggggguggguucucagucccc

SEQ ID NO: 557451 - RNA, 64 nt, Homo Sapiens
guugaaauguaaaagaaaguucucauggaaaaauuaauuauaugagauuauguguccuacccug

SEQ ID NO: 557452 - RNA, 64 nt, Homo Sapiens
auguuuaaacuuucugagaaccagugguuucuucuaauuauaaaauggaccaucuucaucauca

SEQ ID NO: 557453 - RNA, 64 nt, Homo Sapiens
aauuuuguuauaauguacaauuuagaaguuugauuaauuauauuaucuauuuaggcauuaauau

SEQ ID NO: 557454 - RNA, 64 nt, Homo Sapiens
aacuaggagaaucgggcuaauuuauuaaugaugauaauuauaauguaucuguacagcacuuuuu

SEQ ID NO: 557455 - RNA, 64 nt, Homo Sapiens
auacauguuauguaauauaaauuuauucuuuguauaauuauagcuuuuaugcuucauuucaugu

SEQ ID NO: 557456 - RNA, 64 nt, Homo Sapiens
cauuaauucauucugugcuauaauauauuuugauuaauuauauacgcccuaguaucuauacuga

SEQ ID NO: 557457 - RNA, 64 nt, Homo Sapiens
accccaaacuaagaugcacacagggucaucuuuguaauuauauaggaaggucugaaaacuugca

SEQ ID NO: 557458 - RNA, 64 nt, Homo Sapiens
uaaauauauuuaaaaaugcuauuucaugugcaaauaauuauauaaaucugcaaauuccuucuaa

SEQ ID NO: 557459 - RNA, 64 nt, Homo Sapiens
uuaagaacauaguaucaugauuuuccuuugaaaguaauuauaucaaaauauggauaucgcuuug

SEQ ID NO: 557460 - RNA, 64 nt, Homo Sapiens
cuaaauacaggguauguucuuuacaacaaaauguuaauuauauuuuuuguucagauuaaaaugu

SEQ ID NO: 557461 - RNA, 64 nt, Homo Sapiens
cuauuucuauauuuucauuccacucuccauuuaauaauuauaugaggacuuguuagaucuaguu

SEQ ID NO: 557462 - RNA, 64 nt, Homo Sapiens
ugaggaauucuguauagauuacgcguugaaauuguaauuauauccgcugauaagcguucaugga

SEQ ID NO: 557463 - RNA, 64 nt, Homo Sapiens
aguguuuucuauuuuguaaaauauuuuuguugguuaauuauauucauuucaucggaacugcagu

SEQ ID NO: 557464 - RNA, 64 nt, Homo Sapiens
uugauuugacugcaaaacuuuagcgaugaccucuuaauuauaauuuaaacugaauagaauugua

SEQ ID NO: 557465 - RNA, 64 nt, Homo Sapiens
acuaugguuuacucuaauaagauagcuauauugauaauuauauuuuuguuacugugcccuugca

SEQ ID NO: 557466 - RNA, 64 nt, Homo Sapiens
agcaguauuucuuucccuugguugugagaguaacuaauuauauaaauauuaccucaaaaauaca

SEQ ID NO: 557467 - RNA, 64 nt, Homo Sapiens
cauuuguaaaauuuguaaaaguaaaucuucauaguaauuauaaagcuauagguuuuaggguuuu

SEQ ID NO: 557468 - RNA, 64 nt, Homo Sapiens
cacacauauguacauauauacuaaauuuuacauauaauuauacauccacaauuuggugagacca

SEQ ID NO: 557469 - RNA, 64 nt, Homo Sapiens
ccaaaaauauauuugauguuucucauuguaaaaauaauuauauguugguugaauaauuaauaau

SEQ ID NO: 557470 - RNA, 64 nt, Homo Sapiens
cuauaaaacaauagauaugaugacaagcuauaccuaauuauaaguuuuggacaaggaguucugg

SEQ ID NO: 557471 - RNA, 64 nt, Homo Sapiens
aguaugaccuuuuuaaaucacuauuucuguggaauaauuauaaaacuuuugugauuuaauaaua

SEQ ID NO: 557472 - RNA, 64 nt, Homo Sapiens
acaugguuuuguuuuuuuuugcucagcccaucucuaauuauaaauuauuauuauuucagaacua

SEQ ID NO: 557473 - RNA, 64 nt, Homo Sapiens
aaccacucuugagaaguaauuacuuuaucccauuuaauuauaaaacugugauaacuacuuuuua

SEQ ID NO: 557474 - RNA, 64 nt, Homo Sapiens
cuuuccuuauuucaacaagagugaaaucuaagguuaauuauaauaauaaaaacaguguuuuaua

SEQ ID NO: 557475 - RNA, 64 nt, Homo Sapiens
uaacauauucaguauuaauguauaaaaagcacucuaauuauauaauucaguuuuuguaaaggua

SEQ ID NO: 557476 - RNA, 64 nt, Homo Sapiens
ggggcaccuccucugguacuuuuaaguguuuuguuaauuauauuuacuuuuuggaaugguguaa

SEQ ID NO: 557477 - RNA, 64 nt, Homo Sapiens
aaugaagugucaaaaaaucuuaauaauuucuugauaauuauaaagcuuuuaauaauuauaaaau

SEQ ID NO: 557478 - RNA, 64 nt, Homo Sapiens
auuaauaauuucuugauaaucugguagcuuuuaauaauuauaaaagaugcaaagccugaagaca

SEQ ID NO: 557479 - RNA, 64 nt, Homo Sapiens
aguaaugccaaaaaccaaguucauuggaaugauauaauuauacaaauggauuaccuguagugac

SEQ ID NO: 557480 - RNA, 64 nt, Homo Sapiens
ucaaaauauuugacaucugcuuaauccuucccuauaauuauacucccuggauaaagaguuaauu

SEQ ID NO: 557481 - RNA, 64 nt, Homo Sapiens
aaaaugguucuagcacaacauuggcagauauguauaauuauauuuaaaccuuuucuuccuggau

SEQ ID NO: 557482 - RNA, 64 nt, Homo Sapiens
caaaauucagagcaacugaggauuaaauagguuauaauuauaagcucugcagggguucuucugu

SEQ ID NO: 557483 - RNA, 64 nt, Homo Sapiens
gcauucauauuuuuaggacuacuuauuuugaaauuaauuauaagucaugaaacacuuguaagau

SEQ ID NO: 557484 - RNA, 64 nt, Homo Sapiens
aauuccaaagaacagcacaucuguguuuauuuuuuaauuauagauauuuucuuacgaaauaguu

SEQ ID NO: 557485 - RNA, 64 nt, Homo Sapiens
uuuccaaccacugauuacuuuaauuacauuugaauaauuauauuuauuaccuauaugguuguuu

SEQ ID NO: 557486 - RNA, 64 nt, Homo Sapiens
gccugcaaugugucauauacgaauuugaaaaagauaauuauaauugcugcuguuuugauuuaug

SEQ ID NO: 557487 - RNA, 64 nt, Homo Sapiens
uaucuuuaagcuauaaauguagaguuaagcaaauuaauuauagccuuucuuaaaaauauuaguc

SEQ ID NO: 557488 - RNA, 64 nt, Homo Sapiens
uauuaaaccauuuuucaauauaacauuuauuuaauaauuauauuuggguuaguauuuaaagucu

SEQ ID NO: 557489 - RNA, 64 nt, Homo Sapiens
gcaagugcuaugccaagccaugucuaaauggcuuuaauuauauaguaaugcacucucaguaaug

SEQ ID NO: 557490 - RNA, 64 nt, Homo Sapiens
agccuauuuauuugaaaguccuuguuuuugcuacuaauuauauaguauaccauacauuaucauu

SEQ ID NO: 557491 - RNA, 64 nt, Homo Sapiens
cauaaauuuccuguagcuccauaaaugaauuaaguaauuauaaagacugaagaacuaaaaauac

SEQ ID NO: 557492 - RNA, 64 nt, Homo Sapiens
aucuuuuucgauaauuuauuauauuaaaagauuauaauuauauauaaauguuauuuuauauaug

SEQ ID NO: 557493 - RNA, 64 nt, Homo Sapiens
auguuuguguaauguacucauaauaaaaauauuuuaauuauagcauaauuauaauuauucuuua

SEQ ID NO: 557494 - RNA, 64 nt, Homo Sapiens
uauucuuuauaauaaaaauacaguguuucuugaauaauuauaauuuuguuuaaagacacuuuau

SEQ ID NO: 557495 - RNA, 64 nt, Homo Sapiens
cuaauauugcaaauauuaccugauuuauuuaaccuaauuauauuuuucuucuggauuccuuauu

SEQ ID NO: 557496 - RNA, 64 nt, Homo Sapiens
agcauauuuaaugcugaguucaucauuaacagcguaauuauacaaccggcaucaucacugcuau

SEQ ID NO: 557497 - RNA, 60 nt, Homo Sapiens
agcaacuuaauggaaacuagguaugaaaguuaauuauaugggaucuguugucaggauaca

SEQ ID NO: 557498 - RNA, 64 nt, Homo Sapiens
auggaaggugccggggguaaucauggccagucaauaauuauauaaaggaguucaaauacuauag

SEQ ID NO: 557499 - RNA, 64 nt, Homo Sapiens
guagugugcagauaacaaaauuuuccccuuuacuuaauuauauuagaggucuauauaaaguuac

SEQ ID NO: 557500 - RNA, 64 nt, Homo Sapiens
ugcauguguauauauaugcauaugcaugucuauauaauuauaaaugguuugaaaugugcauaga

SEQ ID NO: 557501 - RNA, 64 nt, Homo Sapiens; identical to SEQ ID NO: 189516

SEQ ID NO: 557502 - RNA, 64 nt, Homo Sapiens; identical to SEQ ID NO: 189517

SEQ ID NO: 557503 - RNA, 62 nt, Homo Sapiens
cgcgggacuguguucguacgugcauaguuucgauaucacaucgcggggcuguguucguagcu

SEQ ID NO: 557504 - RNA, 62 nt, Homo Sapiens
cgcggggcuguguucguagcugcgucguuucgauaucacacccucugugugccgccuuacuu

SEQ ID NO: 557505 - RNA, 62 nt, Homo Sapiens
ucacaguuucugaaaauguauauaauccauuuauaucacagccacaacucaaaggacuguga

SEQ ID NO: 557506 - RNA, 62 nt, Homo Sapiens
ucaaaggacugugauauaauuauaauccauuuauaucacaaccacagcucaaaggacuguga

SEQ ID NO: 557507 - RNA, 62 nt, Homo Sapiens
uaaagaauucaauucuuuaccaacguuuauggauaucacaaauggauagaaauagagaauag

SEQ ID NO: 557508 - RNA, 62 nt, Homo Sapiens
agcccuuucuauaugagguuaguugccaguucauaucacaaugaugggcuucacaggaaugu

SEQ ID NO: 557509 - RNA, 62 nt, Homo Sapiens
aauucucaugcuaaaaauacgaugcagauguuauaucacagcaaggugcacaguuagcaaaa

SEQ ID NO: 557510 - RNA, 62 nt, Homo Sapiens
cacccccaaaauauguacaaacagguagcaaaauaucacauagugacaauuacacauuguag

SEQ ID NO: 557511 - RNA, 62 nt, Homo Sapiens
aaauauucuugaauaaaucuguuauuuuaagaauaucacauuauucaaugcauauaaaacua

SEQ ID NO: 557512 - RNA, 62 nt, Homo Sapiens
aacagaaauuuuagcucuuuucuuugcaagauauaucacagcugcuuugggcaguagcugaa

SEQ ID NO: 557513 - RNA, 62 nt, Homo Sapiens
acagucaagaaaaacauuauugaggaaaauuaauaucacagcauaaccccacccuuuacauu

SEQ ID NO: 557514 - RNA, 62 nt, Homo Sapiens
uguauaacccauaucugugcaauggaauauaaauaucacaaaguuguuuaacuagacugcgu

SEQ ID NO: 557515 - RNA, 62 nt, Homo Sapiens
uuuugcaccaagauaaacugaaauugugcaugauaucacauugaaaaauacauauuaugaga

SEQ ID NO: 557516 - RNA, 62 nt, Homo Sapiens
gauuugcuugacuauguugauguucaagugguauaucacauugugguuuucaucuuucauua

SEQ ID NO: 557517 - RNA, 62 nt, Homo Sapiens
cauucucaagguaguuauauuuaaauuuucacauaucacaucgaugugcuuuuguauuaaau

SEQ ID NO: 557518 - RNA, 62 nt, Homo Sapiens
ccaaguggauaaaggcaacuuuuucaguucagauaucacaccauccucagauuggugcagcu

SEQ ID NO: 557519 - RNA, 64 nt, Homo Sapiens; identical to SEQ ID NO: 171243

SEQ ID NO: 557520 - RNA, 64 nt, Homo Sapiens; identical to SEQ ID NO: 171244

SEQ ID NO: 557521 - RNA, 64 nt, Homo Sapiens; identical to SEQ ID NO: 171245

SEQ ID NO: 557522 - RNA, 64 nt, Homo Sapiens; identical to SEQ ID NO: 171246

SEQ ID NO: 557523 - RNA, 64 nt, Homo Sapiens; identical to SEQ ID NO: 171247

SEQ ID NO: 557524 - RNA, 64 nt, Homo Sapiens; identical to SEQ ID NO: 171248

SEQ ID NO: 557525 - RNA, 64 nt, Homo Sapiens; identical to SEQ ID NO: 171249

SEQ ID NO: 557526 - RNA, 64 nt, Homo Sapiens; identical to SEQ ID NO: 171250

SEQ ID NO: 557527 - RNA, 64 nt, Homo Sapiens; identical to SEQ ID NO: 171251

SEQ ID NO: 557528 - RNA, 64 nt, Homo Sapiens; identical to SEQ ID NO: 171252

SEQ ID NO: 557529 - RNA, 64 nt, Homo Sapiens; identical to SEQ ID NO: 171253

SEQ ID NO: 557530 - RNA, 64 nt, Homo Sapiens; identical to SEQ ID NO: 171254

SEQ ID NO: 557531 - RNA, 64 nt, Homo Sapiens; identical to SEQ ID NO: 171255

SEQ ID NO: 557532 - RNA, 64 nt, Homo Sapiens; identical to SEQ ID NO: 171256

SEQ ID NO: 557533 - RNA, 64 nt, Homo Sapiens; identical to SEQ ID NO: 171257

SEQ ID NO: 557534 - RNA, 64 nt, Homo Sapiens; identical to SEQ ID NO: 171258

SEQ ID NO: 557535 - RNA, 64 nt, Homo Sapiens; identical to SEQ ID NO: 171259

SEQ ID NO: 557536 - RNA, 64 nt, Homo Sapiens; identical to SEQ ID NO: 171260

SEQ ID NO: 557537 - RNA, 64 nt, Homo Sapiens; identical to SEQ ID NO: 171261

SEQ ID NO: 557538 - RNA, 64 nt, Homo Sapiens; identical to SEQ ID NO: 171262

SEQ ID NO: 557539 - RNA, 64 nt, Homo Sapiens; identical to SEQ ID NO: 171263

SEQ ID NO: 557540 - RNA, 64 nt, Homo Sapiens; identical to SEQ ID NO: 171264

SEQ ID NO: 557541 - RNA, 64 nt, Homo Sapiens; identical to SEQ ID NO: 171265

SEQ ID NO: 557542 - RNA, 64 nt, Homo Sapiens; identical to SEQ ID NO: 171266

SEQ ID NO: 557543 - RNA, 64 nt, Homo Sapiens; identical to SEQ ID NO: 171267

SEQ ID NO: 557544 - RNA, 64 nt, Homo Sapiens; identical to SEQ ID NO: 171268

SEQ ID NO: 557545 - RNA, 64 nt, Homo Sapiens; identical to SEQ ID NO: 171269

SEQ ID NO: 557546 - RNA, 64 nt, Homo Sapiens; identical to SEQ ID NO: 171270

SEQ ID NO: 557547 - RNA, 64 nt, Homo Sapiens; identical to SEQ ID NO: 171271

SEQ ID NO: 557548 - RNA, 64 nt, Homo Sapiens; identical to SEQ ID NO: 171272

SEQ ID NO: 557549 - RNA, 64 nt, Homo Sapiens; identical to SEQ ID NO: 171273

SEQ ID NO: 557550 - RNA, 64 nt, Homo Sapiens; identical to SEQ ID NO: 171274

SEQ ID NO: 557551 - RNA, 64 nt, Homo Sapiens; identical to SEQ ID NO: 171275

SEQ ID NO: 557552 - RNA, 64 nt, Homo Sapiens; identical to SEQ ID NO: 171276

SEQ ID NO: 557553 - RNA, 64 nt, Homo Sapiens; identical to SEQ ID NO: 171277

SEQ ID NO: 557554 - RNA, 64 nt, Homo Sapiens; identical to SEQ ID NO: 171278

SEQ ID NO: 557555 - RNA, 64 nt, Homo Sapiens; identical to SEQ ID NO: 171279

SEQ ID NO: 557556 - RNA, 64 nt, Homo Sapiens; identical to SEQ ID NO: 171280

SEQ ID NO: 557557 - RNA, 64 nt, Homo Sapiens; identical to SEQ ID NO: 171281

SEQ ID NO: 557558 - RNA, 64 nt, Homo Sapiens; identical to SEQ ID NO: 171282

SEQ ID NO: 557559 - RNA, 64 nt, Homo Sapiens; identical to SEQ ID NO: 171283

SEQ ID NO: 557560 - RNA, 64 nt, Homo Sapiens; identical to SEQ ID NO: 171284

SEQ ID NO: 557561 - RNA, 64 nt, Homo Sapiens; identical to SEQ ID NO: 171285

SEQ ID NO: 557562 - RNA, 64 nt, Homo Sapiens; identical to SEQ ID NO: 171286

SEQ ID NO: 557563 - RNA, 64 nt, Homo Sapiens; identical to SEQ ID NO: 171287

SEQ ID NO: 557564 - RNA, 64 nt, Homo Sapiens; identical to SEQ ID NO: 171288

SEQ ID NO: 557565 - RNA, 64 nt, Homo Sapiens; identical to SEQ ID NO: 171289

SEQ ID NO: 557566 - RNA, 64 nt, Homo Sapiens; identical to SEQ ID NO: 171290

SEQ ID NO: 557567 - RNA, 64 nt, Homo Sapiens; identical to SEQ ID NO: 171291

SEQ ID NO: 557568 - RNA, 64 nt, Homo Sapiens; identical to SEQ ID NO: 171292

SEQ ID NO: 557569 - RNA, 64 nt, Homo Sapiens; identical to SEQ ID NO: 171293

SEQ ID NO: 557570 - RNA, 64 nt, Homo Sapiens; identical to SEQ ID NO: 171294

SEQ ID NO: 557571 - RNA, 64 nt, Homo Sapiens; identical to SEQ ID NO: 171295

SEQ ID NO: 557572 - RNA, 64 nt, Homo Sapiens; identical to SEQ ID NO: 171296

SEQ ID NO: 557573 - RNA, 64 nt, Homo Sapiens; identical to SEQ ID NO: 171297

SEQ ID NO: 557574 - RNA, 64 nt, Homo Sapiens; identical to SEQ ID NO: 171298

SEQ ID NO: 557575 - RNA, 64 nt, Homo Sapiens; identical to SEQ ID NO: 171299

SEQ ID NO: 557576 - RNA, 64 nt, Homo Sapiens; identical to SEQ ID NO: 171300

SEQ ID NO: 557577 - RNA, 64 nt, Homo Sapiens; identical to SEQ ID NO: 171301

SEQ ID NO: 557578 - RNA, 64 nt, Homo Sapiens; identical to SEQ ID NO: 171302

SEQ ID NO: 557579 - RNA, 64 nt, Homo Sapiens; identical to SEQ ID NO: 171303

SEQ ID NO: 557580 - RNA, 64 nt, Homo Sapiens; identical to SEQ ID NO: 171304

SEQ ID NO: 557581 - RNA, 64 nt, Homo Sapiens; identical to SEQ ID NO: 171305

SEQ ID NO: 557582 - RNA, 64 nt, Homo Sapiens; identical to SEQ ID NO: 171306

SEQ ID NO: 557583 - RNA, 64 nt, Homo Sapiens; identical to SEQ ID NO: 171307

SEQ ID NO: 557584 - RNA, 64 nt, Homo Sapiens; identical to SEQ ID NO: 171308

SEQ ID NO: 557585 - RNA, 64 nt, Homo Sapiens; identical to SEQ ID NO: 171309

SEQ ID NO: 557586 - RNA, 64 nt, Homo Sapiens; identical to SEQ ID NO: 171310

SEQ ID NO: 557587 - RNA, 64 nt, Homo Sapiens; identical to SEQ ID NO: 171311

SEQ ID NO: 557588 - RNA, 64 nt, Homo Sapiens; identical to SEQ ID NO: 171312

SEQ ID NO: 557589 - RNA, 64 nt, Homo Sapiens; identical to SEQ ID NO: 171313

SEQ ID NO: 557590 - RNA, 64 nt, Homo Sapiens; identical to SEQ ID NO: 171314

SEQ ID NO: 557591 - RNA, 64 nt, Homo Sapiens; identical to SEQ ID NO: 171315

SEQ ID NO: 557592 - RNA, 64 nt, Homo Sapiens; identical to SEQ ID NO: 171316

SEQ ID NO: 557593 - RNA, 64 nt, Homo Sapiens; identical to SEQ ID NO: 171317

SEQ ID NO: 557594 - RNA, 64 nt, Homo Sapiens; identical to SEQ ID NO: 171318

SEQ ID NO: 557595 - RNA, 64 nt, Homo Sapiens; identical to SEQ ID NO: 171319

SEQ ID NO: 557596 - RNA, 64 nt, Homo Sapiens; identical to SEQ ID NO: 171320

SEQ ID NO: 557597 - RNA, 64 nt, Homo Sapiens; identical to SEQ ID NO: 171321

SEQ ID NO: 557598 - RNA, 64 nt, Homo Sapiens; identical to SEQ ID NO: 171322

SEQ ID NO: 557599 - RNA, 64 nt, Homo Sapiens; identical to SEQ ID NO: 171323

SEQ ID NO: 557600 - RNA, 64 nt, Homo Sapiens; identical to SEQ ID NO: 171324

SEQ ID NO: 557601 - RNA, 64 nt, Homo Sapiens; identical to SEQ ID NO: 171325

SEQ ID NO: 557602 - RNA, 64 nt, Homo Sapiens; identical to SEQ ID NO: 171326

SEQ ID NO: 557603 - RNA, 64 nt, Homo Sapiens; identical to SEQ ID NO: 171327

SEQ ID NO: 557604 - RNA, 64 nt, Homo Sapiens; identical to SEQ ID NO: 171328

SEQ ID NO: 557605 - RNA, 64 nt, Homo Sapiens; identical to SEQ ID NO: 171329

SEQ ID NO: 557606 - RNA, 64 nt, Homo Sapiens; identical to SEQ ID NO: 171330

SEQ ID NO: 557607 - RNA, 64 nt, Homo Sapiens; identical to SEQ ID NO: 171331

SEQ ID NO: 557608 - RNA, 64 nt, Homo Sapiens; identical to SEQ ID NO: 171332

SEQ ID NO: 557609 - RNA, 64 nt, Homo Sapiens; identical to SEQ ID NO: 171333

SEQ ID NO: 557610 - RNA, 64 nt, Homo Sapiens; identical to SEQ ID NO: 171334

SEQ ID NO: 557611 - RNA, 64 nt, Homo Sapiens; identical to SEQ ID NO: 171335

SEQ ID NO: 557612 - RNA, 64 nt, Homo Sapiens; identical to SEQ ID NO: 171336

SEQ ID NO: 557613 - RNA, 64 nt, Homo Sapiens; identical to SEQ ID NO: 171337

SEQ ID NO: 557614 - RNA, 64 nt, Homo Sapiens; identical to SEQ ID NO: 171338

SEQ ID NO: 557615 - RNA, 64 nt, Homo Sapiens; identical to SEQ ID NO: 171339

SEQ ID NO: 557616 - RNA, 64 nt, Homo Sapiens; identical to SEQ ID NO: 171340

SEQ ID NO: 557617 - RNA, 64 nt, Homo Sapiens; identical to SEQ ID NO: 171341

SEQ ID NO: 557618 - RNA, 64 nt, Homo Sapiens; identical to SEQ ID NO: 171342

SEQ ID NO: 557619 - RNA, 64 nt, Homo Sapiens; identical to SEQ ID NO: 171343

SEQ ID NO: 557620 - RNA, 64 nt, Homo Sapiens; identical to SEQ ID NO: 171344

SEQ ID NO: 557621 - RNA, 64 nt, Homo Sapiens; identical to SEQ ID NO: 171345

SEQ ID NO: 557622 - RNA, 64 nt, Homo Sapiens; identical to SEQ ID NO: 171346

SEQ ID NO: 557623 - RNA, 64 nt, Homo Sapiens; identical to SEQ ID NO: 171347

SEQ ID NO: 557624 - RNA, 64 nt, Homo Sapiens; identical to SEQ ID NO: 171348

SEQ ID NO: 557625 - RNA, 64 nt, Homo Sapiens; identical to SEQ ID NO: 171349

SEQ ID NO: 557626 - RNA, 64 nt, Homo Sapiens; identical to SEQ ID NO: 171350

SEQ ID NO: 557627 - RNA, 64 nt, Homo Sapiens; identical to SEQ ID NO: 171351

SEQ ID NO: 557628 - RNA, 64 nt, Homo Sapiens; identical to SEQ ID NO: 171352

SEQ ID NO: 557629 - RNA, 64 nt, Homo Sapiens; identical to SEQ ID NO: 171353

SEQ ID NO: 557630 - RNA, 64 nt, Homo Sapiens; identical to SEQ ID NO: 171354

SEQ ID NO: 557631 - RNA, 64 nt, Homo Sapiens; identical to SEQ ID NO: 171355

SEQ ID NO: 557632 - RNA, 64 nt, Homo Sapiens; identical to SEQ ID NO: 171356

SEQ ID NO: 557633 - RNA, 64 nt, Homo Sapiens; identical to SEQ ID NO: 171357

SEQ ID NO: 557634 - RNA, 64 nt, Homo Sapiens; identical to SEQ ID NO: 171358

SEQ ID NO: 557635 - RNA, 64 nt, Homo Sapiens; identical to SEQ ID NO: 171359

SEQ ID NO: 557636 - RNA, 64 nt, Homo Sapiens; identical to SEQ ID NO: 171360

SEQ ID NO: 557637 - RNA, 64 nt, Homo Sapiens; identical to SEQ ID NO: 171361

SEQ ID NO: 557638 - RNA, 64 nt, Homo Sapiens; identical to SEQ ID NO: 171362

SEQ ID NO: 557639 - RNA, 64 nt, Homo Sapiens; identical to SEQ ID NO: 171363

SEQ ID NO: 557640 - RNA, 64 nt, Homo Sapiens; identical to SEQ ID NO: 171364

SEQ ID NO: 557641 - RNA, 64 nt, Homo Sapiens; identical to SEQ ID NO: 171365

SEQ ID NO: 557642 - RNA, 64 nt, Homo Sapiens; identical to SEQ ID NO: 171366

SEQ ID NO: 557643 - RNA, 64 nt, Homo Sapiens; identical to SEQ ID NO: 171367

SEQ ID NO: 557644 - RNA, 64 nt, Homo Sapiens; identical to SEQ ID NO: 171368

SEQ ID NO: 557645 - RNA, 64 nt, Homo Sapiens; identical to SEQ ID NO: 171369

SEQ ID NO: 557646 - RNA, 64 nt, Homo Sapiens; identical to SEQ ID NO: 171370

SEQ ID NO: 557647 - RNA, 64 nt, Homo Sapiens; identical to SEQ ID NO: 171371

SEQ ID NO: 557648 - RNA, 64 nt, Homo Sapiens; identical to SEQ ID NO: 171372

SEQ ID NO: 557649 - RNA, 64 nt, Homo Sapiens; identical to SEQ ID NO: 171373

SEQ ID NO: 557650 - RNA, 64 nt, Homo Sapiens; identical to SEQ ID NO: 171374

SEQ ID NO: 557651 - RNA, 64 nt, Homo Sapiens; identical to SEQ ID NO: 171375

SEQ ID NO: 557652 - RNA, 64 nt, Homo Sapiens; identical to SEQ ID NO: 171376

SEQ ID NO: 557653 - RNA, 64 nt, Homo Sapiens; identical to SEQ ID NO: 171377

SEQ ID NO: 557654 - RNA, 64 nt, Homo Sapiens; identical to SEQ ID NO: 171378

SEQ ID NO: 557655 - RNA, 64 nt, Homo Sapiens; identical to SEQ ID NO: 171379

SEQ ID NO: 557656 - RNA, 64 nt, Homo Sapiens; identical to SEQ ID NO: 171380

SEQ ID NO: 557657 - RNA, 64 nt, Homo Sapiens; identical to SEQ ID NO: 171381

SEQ ID NO: 557658 - RNA, 64 nt, Homo Sapiens; identical to SEQ ID NO: 171382

SEQ ID NO: 557659 - RNA, 64 nt, Homo Sapiens; identical to SEQ ID NO: 171383

SEQ ID NO: 557660 - RNA, 64 nt, Homo Sapiens; identical to SEQ ID NO: 171384

SEQ ID NO: 557661 - RNA, 64 nt, Homo Sapiens; identical to SEQ ID NO: 171385

SEQ ID NO: 557662 - RNA, 64 nt, Homo Sapiens; identical to SEQ ID NO: 171386

SEQ ID NO: 557663 - RNA, 64 nt, Homo Sapiens; identical to SEQ ID NO: 171387

SEQ ID NO: 557664 - RNA, 64 nt, Homo Sapiens; identical to SEQ ID NO: 171388

SEQ ID NO: 557665 - RNA, 64 nt, Homo Sapiens; identical to SEQ ID NO: 171389

SEQ ID NO: 557666 - RNA, 64 nt, Homo Sapiens; identical to SEQ ID NO: 171390

SEQ ID NO: 557667 - RNA, 64 nt, Homo Sapiens; identical to SEQ ID NO: 171391

SEQ ID NO: 557668 - RNA, 64 nt, Homo Sapiens; identical to SEQ ID NO: 171392

SEQ ID NO: 557669 - RNA, 64 nt, Homo Sapiens; identical to SEQ ID NO: 171393

SEQ ID NO: 557670 - RNA, 64 nt, Homo Sapiens; identical to SEQ ID NO: 171394

SEQ ID NO: 557671 - RNA, 64 nt, Homo Sapiens; identical to SEQ ID NO: 171395

SEQ ID NO: 557672 - RNA, 64 nt, Homo Sapiens; identical to SEQ ID NO: 171396

SEQ ID NO: 557673 - RNA, 64 nt, Homo Sapiens; identical to SEQ ID NO: 171397

SEQ ID NO: 557674 - RNA, 64 nt, Homo Sapiens; identical to SEQ ID NO: 171398

SEQ ID NO: 557675 - RNA, 64 nt, Homo Sapiens; identical to SEQ ID NO: 171399

SEQ ID NO: 557676 - RNA, 64 nt, Homo Sapiens; identical to SEQ ID NO: 171400

SEQ ID NO: 557677 - RNA, 64 nt, Homo Sapiens; identical to SEQ ID NO: 171401

SEQ ID NO: 557678 - RNA, 64 nt, Homo Sapiens; identical to SEQ ID NO: 171402

SEQ ID NO: 557679 - RNA, 64 nt, Homo Sapiens; identical to SEQ ID NO: 171403

SEQ ID NO: 557680 - RNA, 64 nt, Homo Sapiens; identical to SEQ ID NO: 171404

SEQ ID NO: 557681 - RNA, 64 nt, Homo Sapiens; identical to SEQ ID NO: 171405

SEQ ID NO: 557682 - RNA, 64 nt, Homo Sapiens; identical to SEQ ID NO: 171406

SEQ ID NO: 557683 - RNA, 64 nt, Homo Sapiens; identical to SEQ ID NO: 171407

SEQ ID NO: 557684 - RNA, 64 nt, Homo Sapiens; identical to SEQ ID NO: 171408

SEQ ID NO: 557685 - RNA, 64 nt, Homo Sapiens; identical to SEQ ID NO: 171409

SEQ ID NO: 557686 - RNA, 64 nt, Homo Sapiens; identical to SEQ ID NO: 171410

SEQ ID NO: 557687 - RNA, 64 nt, Homo Sapiens; identical to SEQ ID NO: 171411

SEQ ID NO: 557688 - RNA, 64 nt, Homo Sapiens; identical to SEQ ID NO: 171412

SEQ ID NO: 557689 - RNA, 64 nt, Homo Sapiens; identical to SEQ ID NO: 171413

SEQ ID NO: 557690 - RNA, 64 nt, Homo Sapiens; identical to SEQ ID NO: 171414

SEQ ID NO: 557691 - RNA, 64 nt, Homo Sapiens; identical to SEQ ID NO: 171415

SEQ ID NO: 557692 - RNA, 64 nt, Homo Sapiens; identical to SEQ ID NO: 171416

SEQ ID NO: 557693 - RNA, 64 nt, Homo Sapiens; identical to SEQ ID NO: 171417

SEQ ID NO: 557694 - RNA, 64 nt, Homo Sapiens; identical to SEQ ID NO: 171418

SEQ ID NO: 557695 - RNA, 64 nt, Homo Sapiens; identical to SEQ ID NO: 171419

SEQ ID NO: 557696 - RNA, 64 nt, Homo Sapiens; identical to SEQ ID NO: 171420

SEQ ID NO: 557697 - RNA, 64 nt, Homo Sapiens; identical to SEQ ID NO: 171421

SEQ ID NO: 557698 - RNA, 64 nt, Homo Sapiens; identical to SEQ ID NO: 171422

SEQ ID NO: 557699 - RNA, 64 nt, Homo Sapiens; identical to SEQ ID NO: 171423

SEQ ID NO: 557700 - RNA, 64 nt, Homo Sapiens; identical to SEQ ID NO: 171424

SEQ ID NO: 557701 - RNA, 64 nt, Homo Sapiens; identical to SEQ ID NO: 171425

SEQ ID NO: 557702 - RNA, 64 nt, Homo Sapiens; identical to SEQ ID NO: 171426

SEQ ID NO: 557703 - RNA, 64 nt, Homo Sapiens; identical to SEQ ID NO: 171427

SEQ ID NO: 557704 - RNA, 64 nt, Homo Sapiens; identical to SEQ ID NO: 171428

SEQ ID NO: 557705 - RNA, 64 nt, Homo Sapiens; identical to SEQ ID NO: 171429

SEQ ID NO: 557706 - RNA, 50 nt, Homo Sapiens; identical to SEQ ID NO: 171430

SEQ ID NO: 557707 - RNA, 64 nt, Homo Sapiens; identical to SEQ ID NO: 171431

SEQ ID NO: 557708 - RNA, 64 nt, Homo Sapiens; identical to SEQ ID NO: 171432

SEQ ID NO: 557709 - RNA, 64 nt, Homo Sapiens; identical to SEQ ID NO: 171433

SEQ ID NO: 557710 - RNA, 64 nt, Homo Sapiens; identical to SEQ ID NO: 171434

SEQ ID NO: 557711 - RNA, 64 nt, Homo Sapiens; identical to SEQ ID NO: 171435

SEQ ID NO: 557712 - RNA, 64 nt, Homo Sapiens; identical to SEQ ID NO: 171436

SEQ ID NO: 557713 - RNA, 64 nt, Homo Sapiens; identical to SEQ ID NO: 171437

SEQ ID NO: 557714 - RNA, 64 nt, Homo Sapiens; identical to SEQ ID NO: 171438

SEQ ID NO: 557715 - RNA, 64 nt, Homo Sapiens; identical to SEQ ID NO: 171439

SEQ ID NO: 557716 - RNA, 64 nt, Homo Sapiens; identical to SEQ ID NO: 171440

SEQ ID NO: 557717 - RNA, 64 nt, Homo Sapiens; identical to SEQ ID NO: 171441

SEQ ID NO: 557718 - RNA, 64 nt, Homo Sapiens; identical to SEQ ID NO: 171442

SEQ ID NO: 557719 - RNA, 64 nt, Homo Sapiens; identical to SEQ ID NO: 171443

SEQ ID NO: 557720 - RNA, 64 nt, Homo Sapiens; identical to SEQ ID NO: 171444

SEQ ID NO: 557721 - RNA, 64 nt, Homo Sapiens; identical to SEQ ID NO: 171445

SEQ ID NO: 557722 - RNA, 64 nt, Homo Sapiens; identical to SEQ ID NO: 171446

SEQ ID NO: 557723 - RNA, 64 nt, Homo Sapiens; identical to SEQ ID NO: 171447

SEQ ID NO: 557724 - RNA, 64 nt, Homo Sapiens; identical to SEQ ID NO: 171448

SEQ ID NO: 557725 - RNA, 64 nt, Homo Sapiens; identical to SEQ ID NO: 171449

SEQ ID NO: 557726 - RNA, 64 nt, Homo Sapiens; identical to SEQ ID NO: 171450

SEQ ID NO: 557727 - RNA, 64 nt, Homo Sapiens; identical to SEQ ID NO: 171451

SEQ ID NO: 557728 - RNA, 64 nt, Homo Sapiens; identical to SEQ ID NO: 171452

SEQ ID NO: 557729 - RNA, 64 nt, Homo Sapiens; identical to SEQ ID NO: 171453

SEQ ID NO: 557730 - RNA, 64 nt, Homo Sapiens; identical to SEQ ID NO: 171454

SEQ ID NO: 557731 - RNA, 64 nt, Homo Sapiens; identical to SEQ ID NO: 171455

SEQ ID NO: 557732 - RNA, 64 nt, Homo Sapiens; identical to SEQ ID NO: 171456

SEQ ID NO: 557733 - RNA, 64 nt, Homo Sapiens; identical to SEQ ID NO: 171457

SEQ ID NO: 557734 - RNA, 64 nt, Homo Sapiens; identical to SEQ ID NO: 171458

SEQ ID NO: 557735 - RNA, 64 nt, Homo Sapiens; identical to SEQ ID NO: 171459

SEQ ID NO: 557736 - RNA, 64 nt, Homo Sapiens; identical to SEQ ID NO: 171460

SEQ ID NO: 557737 - RNA, 64 nt, Homo Sapiens; identical to SEQ ID NO: 171461

SEQ ID NO: 557738 - RNA, 64 nt, Homo Sapiens; identical to SEQ ID NO: 171462

SEQ ID NO: 557739 - RNA, 64 nt, Homo Sapiens; identical to SEQ ID NO: 171463

SEQ ID NO: 557740 - RNA, 64 nt, Homo Sapiens; identical to SEQ ID NO: 171464

SEQ ID NO: 557741 - RNA, 64 nt, Homo Sapiens; identical to SEQ ID NO: 171465

SEQ ID NO: 557742 - RNA, 64 nt, Homo Sapiens; identical to SEQ ID NO: 171466

SEQ ID NO: 557743 - RNA, 64 nt, Homo Sapiens; identical to SEQ ID NO: 171467

SEQ ID NO: 557744 - RNA, 64 nt, Homo Sapiens; identical to SEQ ID NO: 171468

SEQ ID NO: 557745 - RNA, 64 nt, Homo Sapiens; identical to SEQ ID NO: 171469

SEQ ID NO: 557746 - RNA, 64 nt, Homo Sapiens; identical to SEQ ID NO: 171470

SEQ ID NO: 557747 - RNA, 64 nt, Homo Sapiens; identical to SEQ ID NO: 171471

SEQ ID NO: 557748 - RNA, 64 nt, Homo Sapiens; identical to SEQ ID NO: 171472

SEQ ID NO: 557749 - RNA, 64 nt, Homo Sapiens; identical to SEQ ID NO: 171473

SEQ ID NO: 557750 - RNA, 64 nt, Homo Sapiens; identical to SEQ ID NO: 171474

SEQ ID NO: 557751 - RNA, 64 nt, Homo Sapiens; identical to SEQ ID NO: 171475

SEQ ID NO: 557752 - RNA, 64 nt, Homo Sapiens; identical to SEQ ID NO: 171476

SEQ ID NO: 557753 - RNA, 64 nt, Homo Sapiens; identical to SEQ ID NO: 171477

SEQ ID NO: 557754 - RNA, 64 nt, Homo Sapiens; identical to SEQ ID NO: 171478

SEQ ID NO: 557755 - RNA, 64 nt, Homo Sapiens; identical to SEQ ID NO: 171479

SEQ ID NO: 557756 - RNA, 64 nt, Homo Sapiens; identical to SEQ ID NO: 171480

SEQ ID NO: 557757 - RNA, 64 nt, Homo Sapiens; identical to SEQ ID NO: 171481

SEQ ID NO: 557758 - RNA, 64 nt, Homo Sapiens; identical to SEQ ID NO: 171482

SEQ ID NO: 557759 - RNA, 64 nt, Homo Sapiens; identical to SEQ ID NO: 171483

SEQ ID NO: 557760 - RNA, 64 nt, Homo Sapiens; identical to SEQ ID NO: 171484

SEQ ID NO: 557761 - RNA, 64 nt, Homo Sapiens; identical to SEQ ID NO: 171485

SEQ ID NO: 557762 - RNA, 64 nt, Homo Sapiens; identical to SEQ ID NO: 171486

SEQ ID NO: 557763 - RNA, 64 nt, Homo Sapiens; identical to SEQ ID NO: 171487

SEQ ID NO: 557764 - RNA, 64 nt, Homo Sapiens; identical to SEQ ID NO: 171488

SEQ ID NO: 557765 - RNA, 64 nt, Homo Sapiens; identical to SEQ ID NO: 171489

SEQ ID NO: 557766 - RNA, 64 nt, Homo Sapiens; identical to SEQ ID NO: 171490

SEQ ID NO: 557767 - RNA, 64 nt, Homo Sapiens; identical to SEQ ID NO: 171491

SEQ ID NO: 557768 - RNA, 64 nt, Homo Sapiens; identical to SEQ ID NO: 171492

SEQ ID NO: 557769 - RNA, 64 nt, Homo Sapiens; identical to SEQ ID NO: 171493

SEQ ID NO: 557770 - RNA, 64 nt, Homo Sapiens; identical to SEQ ID NO: 171494

SEQ ID NO: 557771 - RNA, 64 nt, Homo Sapiens; identical to SEQ ID NO: 171495

SEQ ID NO: 557772 - RNA, 64 nt, Homo Sapiens; identical to SEQ ID NO: 171496

SEQ ID NO: 557773 - RNA, 64 nt, Homo Sapiens; identical to SEQ ID NO: 171497

SEQ ID NO: 557774 - RNA, 64 nt, Homo Sapiens; identical to SEQ ID NO: 171498

SEQ ID NO: 557775 - RNA, 64 nt, Homo Sapiens; identical to SEQ ID NO: 171499

SEQ ID NO: 557776 - RNA, 64 nt, Homo Sapiens
ugaauacaaaccucaauagcaaaauguuuuuccuacagucuacacuaucuaaauauuuauuacu

SEQ ID NO: 557777 - RNA, 64 nt, Homo Sapiens
guuuuuguugagucugccauaaaauauauuaauaacagucuaguuagugaaacacaaacaaagg

SEQ ID NO: 557778 - RNA, 64 nt, Homo Sapiens
gaagccucagagauuacacaguuaggaugcugacacagucuagaauccauaaugcucccuacau

SEQ ID NO: 557779 - RNA, 64 nt, Homo Sapiens
ucacuaaagucuuauuuuauguuuuagaacaguuacagucuaauugucuuggacauuuugggaa

SEQ ID NO: 557780 - RNA, 64 nt, Homo Sapiens
aaaauuguuauuaugggauucaaggcucugcuauacagucuauagauuuucaaaaagccguuga

SEQ ID NO: 557781 - RNA, 64 nt, Homo Sapiens
uuccugguuccguuuuagaagcuuaaaacccaauacagucuaguucagcuuuguccaaaggaaa

SEQ ID NO: 557782 - RNA, 64 nt, Homo Sapiens
aggcacaagucggaguuacauuuaaaaaaaauuaacagucuacaacaacuguuuucacaagaga

SEQ ID NO: 557783 - RNA, 64 nt, Homo Sapiens
uugguuuucuuuuuaccuaguugcuauagugucuacagucuauacucaauaccuauaaaaugca

SEQ ID NO: 557784 - RNA, 64 nt, Homo Sapiens
uuuuaccaugaagagauugcacuuauccuugagaacagucuaaauauaaaugaagauauuuuac

SEQ ID NO: 557785 - RNA, 64 nt, Homo Sapiens
uuuuaccaugaagagauugcacuuauccuugagaacagucuaaugauacuuuuuuuacuuucag

SEQ ID NO: 557786 - RNA, 64 nt, Homo Sapiens
auaaacagcaaauuuuaaaggggagcaccauuguacagucuagcaaauuuuuaaaaaucauaaa

SEQ ID NO: 557787 - RNA, 64 nt, Homo Sapiens
ggaaacaaaaccuauauguuguauuaaacaguuuacagucuaaaugugaaauaaccaguuauac

SEQ ID NO: 557788 - RNA, 64 nt, Homo Sapiens
ugcuuucgcagcugauaauauaaaaggaaaucccacagucuagauauagccccauuacuacaaa

SEQ ID NO: 557789 - RNA, 64 nt, Homo Sapiens
guuaccaguaaaauauuacuguaauuucauauacacagucuauacaaugaaauaaugaauauuu

SEQ ID NO: 557790 - RNA, 64 nt, Homo Sapiens; identical to SEQ ID NO: 557221

SEQ ID NO: 557791 - RNA, 64 nt, Homo Sapiens; identical to SEQ ID NO: 557222

SEQ ID NO: 557792 - RNA, 64 nt, Homo Sapiens; identical to SEQ ID NO: 557223

SEQ ID NO: 557793 - RNA, 64 nt, Homo Sapiens; identical to SEQ ID NO: 557224

SEQ ID NO: 557794 - RNA, 64 nt, Homo Sapiens; identical to SEQ ID NO: 557225

SEQ ID NO: 557795 - RNA, 64 nt, Homo Sapiens; identical to SEQ ID NO: 557226

SEQ ID NO: 557796 - RNA, 64 nt, Homo Sapiens; identical to SEQ ID NO: 224266

SEQ ID NO: 557797 - RNA, 64 nt, Homo Sapiens; identical to SEQ ID NO: 224267

SEQ ID NO: 557798 - RNA, 64 nt, Homo Sapiens; identical to SEQ ID NO: 224268

SEQ ID NO: 557799 - RNA, 64 nt, Homo Sapiens; identical to SEQ ID NO: 224269

SEQ ID NO: 557800 - RNA, 64 nt, Homo Sapiens; identical to SEQ ID NO: 224270

SEQ ID NO: 557801 - RNA, 64 nt, Homo Sapiens; identical to SEQ ID NO: 224271

SEQ ID NO: 557802 - RNA, 64 nt, Homo Sapiens; identical to SEQ ID NO: 224272

SEQ ID NO: 557803 - RNA, 64 nt, Homo Sapiens; identical to SEQ ID NO: 224273

SEQ ID NO: 557804 - RNA, 64 nt, Homo Sapiens; identical to SEQ ID NO: 224274

SEQ ID NO: 557805 - RNA, 64 nt, Homo Sapiens; identical to SEQ ID NO: 224275

SEQ ID NO: 557806 - RNA, 64 nt, Homo Sapiens; identical to SEQ ID NO: 224276

SEQ ID NO: 557807 - RNA, 64 nt, Homo Sapiens; identical to SEQ ID NO: 224277

SEQ ID NO: 557808 - RNA, 64 nt, Homo Sapiens; identical to SEQ ID NO: 224278

SEQ ID NO: 557809 - RNA, 64 nt, Homo Sapiens; identical to SEQ ID NO: 224279

SEQ ID NO: 557810 - RNA, 64 nt, Homo Sapiens
ucucaaugcacaugauauaauuaaacacuaauaauaccaugacugcauagcuaauauuagcugc

SEQ ID NO: 557811 - RNA, 64 nt, Homo Sapiens
aaagcaacacuguuuuuauguaguucauauauauuaccaugacauuuaacaucaauaucguaua

SEQ ID NO: 557812 - RNA, 64 nt, Homo Sapiens
uugcuuaaccguuucuucuuuuaagcagauuuaauaccaugaccccaguuuucuugauuagagu

SEQ ID NO: 557813 - RNA, 64 nt, Homo Sapiens
aguguguugcuucagacuauuaaaauagaguguuuaccaugaacguccucauauauuuaucuac

SEQ ID NO: 557814 - RNA, 64 nt, Homo Sapiens
aacaaagcagugaaguuuaacagaguucugagaauaccaugaaagacauuaugccugccuaaac

SEQ ID NO: 557815 - RNA, 64 nt, Homo Sapiens
cggucuucauuuuaaaauuggcaucaggaaggauuaccaugaacuuauuuuaaauccauauugu

SEQ ID NO: 557816 - RNA, 64 nt, Homo Sapiens
auauuuuuguaacaaaauauaaaugaagauauuuuaccaugaagagauugcacuuauccuugag

SEQ ID NO: 557817 - RNA, 64 nt, Homo Sapiens
cuugagaacagucuaaauauaaaugaagauauuuuaccaugaagagauugcacuuauccuugag

SEQ ID NO: 557818 - RNA, 64 nt, Homo Sapiens
guuuauggaaaguaucuuuauguccugccugaaauaccaugauuuguuaaugacugucugccca

SEQ ID NO: 557819 - RNA, 64 nt, Homo Sapiens
aaaagcuuccugaggcuuccccuauuuugccuucuaccaugagucgccaugugaagugccuucu

SEQ ID NO: 557820 - RNA, 64 nt, Homo Sapiens
ugucugcuaagaagacggguauucucaggguguguaccaugauucucuucuuggucagaauucu

SEQ ID NO: 557821 - RNA, 64 nt, Homo Sapiens
gucagccguaggggaccccauaugguggccacccuaccaugagauuugcaguggggccggaaaa

SEQ ID NO: 557822 - RNA, 64 nt, Homo Sapiens; identical to SEQ ID NO: 265087

SEQ ID NO: 557823 - RNA, 64 nt, Homo Sapiens; identical to SEQ ID NO: 265088

SEQ ID NO: 557824 - RNA, 64 nt, Homo Sapiens; identical to SEQ ID NO: 265089

SEQ ID NO: 557825 - RNA, 64 nt, Homo Sapiens; identical to SEQ ID NO: 265090

SEQ ID NO: 557826 - RNA, 64 nt, Homo Sapiens; identical to SEQ ID NO: 265091

SEQ ID NO: 557827 - RNA, 64 nt, Homo Sapiens; identical to SEQ ID NO: 265092

SEQ ID NO: 557828 - RNA, 64 nt, Homo Sapiens; identical to SEQ ID NO: 265093

SEQ ID NO: 557829 - RNA, 61 nt, Homo Sapiens; identical to SEQ ID NO: 265094

SEQ ID NO: 557830 - RNA, 64 nt, Homo Sapiens; identical to SEQ ID NO: 265095

SEQ ID NO: 557831 - RNA, 64 nt, Homo Sapiens; identical to SEQ ID NO: 265096

SEQ ID NO: 557832 - RNA, 64 nt, Homo Sapiens; identical to SEQ ID NO: 265097

SEQ ID NO: 557833 - RNA, 64 nt, Homo Sapiens; identical to SEQ ID NO: 265098

SEQ ID NO: 557834 - RNA, 64 nt, Homo Sapiens; identical to SEQ ID NO: 265099

SEQ ID NO: 557835 - RNA, 64 nt, Homo Sapiens; identical to SEQ ID NO: 265100

SEQ ID NO: 557836 - RNA, 64 nt, Homo Sapiens; identical to SEQ ID NO: 265101

SEQ ID NO: 557837 - RNA, 64 nt, Homo Sapiens; identical to SEQ ID NO: 265102

SEQ ID NO: 557838 - RNA, 64 nt, Homo Sapiens; identical to SEQ ID NO: 265103

SEQ ID NO: 557839 - RNA, 64 nt, Homo Sapiens; identical to SEQ ID NO: 265104

SEQ ID NO: 557840 - RNA, 64 nt, Homo Sapiens; identical to SEQ ID NO: 265105

SEQ ID NO: 557841 - RNA, 64 nt, Homo Sapiens; identical to SEQ ID NO: 265106

SEQ ID NO: 557842 - RNA, 64 nt, Homo Sapiens; identical to SEQ ID NO: 265107

SEQ ID NO: 557843 - RNA, 64 nt, Homo Sapiens; identical to SEQ ID NO: 265108

SEQ ID NO: 557844 - RNA, 64 nt, Homo Sapiens; identical to SEQ ID NO: 265109

SEQ ID NO: 557845 - RNA, 64 nt, Homo Sapiens; identical to SEQ ID NO: 265110

SEQ ID NO: 557846 - RNA, 62 nt, Homo Sapiens
cuuggccuggcacagugguuauuaagcuguuuaaagaucaccagaguccaagcuggugaacu

SEQ ID NO: 557847 - RNA, 62 nt, Homo Sapiens
ucagagugugcgaaauaauacucggaauggaaaaagaucauucuguuaauuuaugacaugau

SEQ ID NO: 557848 - RNA, 62 nt, Homo Sapiens
ccaacuaaaggauauuaaaguuaggggaaagaaaagaucauugaaagucaugauaauuucug

SEQ ID NO: 557849 - RNA, 62 nt, Homo Sapiens
aaauuauaguauauguaaguagcuaaugaaguaaagaucaugaagaaagaaauugauaggug

SEQ ID NO: 557850 - RNA, 62 nt, Homo Sapiens
ucaacacaagauggcaaaucaggaucaggugaaaagaucaagaaacgugugaaaacucccua

SEQ ID NO: 557851 - RNA, 62 nt, Homo Sapiens
uuauauguagaaaagugggguccuuuugaauaaaagaucauucaacuaaaaauauuaaaauu

SEQ ID NO: 557852 - RNA, 62 nt, Homo Sapiens
uccacuuuaaccucuucuaaaauacccaaccaaaagaucacuguuucucucaacacuauuua

SEQ ID NO: 557853 - RNA, 62 nt, Homo Sapiens
ugaacauuguuauuuauauuuuuuaaaauggaaaagaucacuauguuuguugugcuaaccac

SEQ ID NO: 557854 - RNA, 62 nt, Homo Sapiens
aauggaaaauaaucuaacucgaaggcgccugaaaagaucaaauucuauaucccagauaccuu

SEQ ID NO: 557855 - RNA, 62 nt, Homo Sapiens
uuggauuuguagguccugugccaccaaaacccaaagaucaaagguccaucaucaaaacacca

SEQ ID NO: 557856 - RNA, 62 nt, Homo Sapiens
aaaaagauaaggaaagaagagagaagagagacaaagaucacuacagaccaaaacagaagaag

SEQ ID NO: 557857 - RNA, 62 nt, Homo Sapiens
cuuuugagauucuccaacuugacaaaugugccaaagaucaacagacagaaaauaucauccug

SEQ ID NO: 557858 - RNA, 62 nt, Homo Sapiens
uugauauuauuccagguuuuaacugcucaucuaaagaucauguaaugguggaacaaauguua

SEQ ID NO: 557859 - RNA, 62 nt, Homo Sapiens
gcaggugagcauccacuuugcuugagcucugcaaagaucagauucuuuuuaauugaagaugu

SEQ ID NO: 557860 - RNA, 62 nt, Homo Sapiens
gaccauguuauuccugaccaaagauuaaucugaaagaucagaaccauuaaauucacacauga

SEQ ID NO: 557861 - RNA, 62 nt, Homo Sapiens
uauauauauauauuuguaaucauuuguaauguaaagaucaguaacacagucacugcuguggu

SEQ ID NO: 557862 - RNA, 62 nt, Homo Sapiens
gacacauuauaucuccaacaagguguggguggaaagaucaaauuaaccugcuuuuuugaaag

SEQ ID NO: 557863 - RNA, 62 nt, Homo Sapiens
uucuaggaacccccaaaaggagaauaguaaaaaaagaucauacuuaaaauuuguauuacaau

SEQ ID NO: 557864 - RNA, 62 nt, Homo Sapiens
auuuuggaauucgugcaggaagccaugaaaggaaagaucagugaagacagcaaucacgguuc

SEQ ID NO: 557865 - RNA, 62 nt, Homo Sapiens
cacuccagcgucaucggacucucucuuauuacaaagaucacugcccaggaccaucuucccga

SEQ ID NO: 557866 - RNA, 62 nt, Homo Sapiens
ugaaagcgaaauacuugaaaagaggugaccauaaagaucacaccaauuuagaaugaauauua

SEQ ID NO: 557867 - RNA, 62 nt, Homo Sapiens
cccuuuuccaaccuaccucacaagguuaucagaaagaucaaauuaaauaauagaugugaaaa

SEQ ID NO: 557868 - RNA, 64 nt, Homo Sapiens; identical to SEQ ID NO: 54328

SEQ ID NO: 557869 - RNA, 64 nt, Homo Sapiens; identical to SEQ ID NO: 54329

SEQ ID NO: 557870 - RNA, 64 nt, Homo Sapiens; identical to SEQ ID NO: 54330

SEQ ID NO: 557871 - RNA, 64 nt, Homo Sapiens; identical to SEQ ID NO: 54331

SEQ ID NO: 557872 - RNA, 64 nt, Homo Sapiens; identical to SEQ ID NO: 54332

SEQ ID NO: 557873 - RNA, 64 nt, Homo Sapiens; identical to SEQ ID NO: 54333

SEQ ID NO: 557874 - RNA, 64 nt, Homo Sapiens; identical to SEQ ID NO: 54334

SEQ ID NO: 557875 - RNA, 64 nt, Homo Sapiens; identical to SEQ ID NO: 54335

SEQ ID NO: 557876 - RNA, 64 nt, Homo Sapiens; identical to SEQ ID NO: 54336

SEQ ID NO: 557877 - RNA, 64 nt, Homo Sapiens; identical to SEQ ID NO: 54337

SEQ ID NO: 557878 - RNA, 64 nt, Homo Sapiens; identical to SEQ ID NO: 54338

SEQ ID NO: 557879 - RNA, 64 nt, Homo Sapiens; identical to SEQ ID NO: 54339

SEQ ID NO: 557880 - RNA, 64 nt, Homo Sapiens; identical to SEQ ID NO: 54340

SEQ ID NO: 557881 - RNA, 64 nt, Homo Sapiens; identical to SEQ ID NO: 54341

SEQ ID NO: 557882 - RNA, 64 nt, Homo Sapiens; identical to SEQ ID NO: 54342

SEQ ID NO: 557883 - RNA, 64 nt, Homo Sapiens; identical to SEQ ID NO: 54343

SEQ ID NO: 557884 - RNA, 64 nt, Homo Sapiens; identical to SEQ ID NO: 54344

SEQ ID NO: 557885 - RNA, 64 nt, Homo Sapiens; identical to SEQ ID NO: 54345

SEQ ID NO: 557886 - RNA, 64 nt, Homo Sapiens; identical to SEQ ID NO: 54346

SEQ ID NO: 557887 - RNA, 64 nt, Homo Sapiens; identical to SEQ ID NO: 54347

SEQ ID NO: 557888 - RNA, 64 nt, Homo Sapiens; identical to SEQ ID NO: 54348

SEQ ID NO: 557889 - RNA, 64 nt, Homo Sapiens; identical to SEQ ID NO: 54349

SEQ ID NO: 557890 - RNA, 64 nt, Homo Sapiens; identical to SEQ ID NO: 54350

SEQ ID NO: 557891 - RNA, 64 nt, Homo Sapiens; identical to SEQ ID NO: 54351

SEQ ID NO: 557892 - RNA, 64 nt, Homo Sapiens; identical to SEQ ID NO: 54352

SEQ ID NO: 557893 - RNA, 64 nt, Homo Sapiens; identical to SEQ ID NO: 54353

SEQ ID NO: 557894 - RNA, 64 nt, Homo Sapiens; identical to SEQ ID NO: 54354

SEQ ID NO: 557895 - RNA, 64 nt, Homo Sapiens; identical to SEQ ID NO: 54355

SEQ ID NO: 557896 - RNA, 64 nt, Homo Sapiens; identical to SEQ ID NO: 54356

SEQ ID NO: 557897 - RNA, 64 nt, Homo Sapiens; identical to SEQ ID NO: 54357

SEQ ID NO: 557898 - RNA, 64 nt, Homo Sapiens; identical to SEQ ID NO: 54358

SEQ ID NO: 557899 - RNA, 64 nt, Homo Sapiens; identical to SEQ ID NO: 54359

SEQ ID NO: 557900 - RNA, 64 nt, Homo Sapiens; identical to SEQ ID NO: 54360

SEQ ID NO: 557901 - RNA, 64 nt, Homo Sapiens; identical to SEQ ID NO: 54361

SEQ ID NO: 557902 - RNA, 64 nt, Homo Sapiens; identical to SEQ ID NO: 54362

SEQ ID NO: 557903 - RNA, 64 nt, Homo Sapiens; identical to SEQ ID NO: 54363

SEQ ID NO: 557904 - RNA, 64 nt, Homo Sapiens; identical to SEQ ID NO: 54364

SEQ ID NO: 557905 - RNA, 64 nt, Homo Sapiens; identical to SEQ ID NO: 54365

SEQ ID NO: 557906 - RNA, 64 nt, Homo Sapiens; identical to SEQ ID NO: 54366

SEQ ID NO: 557907 - RNA, 64 nt, Homo Sapiens; identical to SEQ ID NO: 54367

SEQ ID NO: 557908 - RNA, 64 nt, Homo Sapiens; identical to SEQ ID NO: 54368

SEQ ID NO: 557909 - RNA, 64 nt, Homo Sapiens; identical to SEQ ID NO: 54369

SEQ ID NO: 557910 - RNA, 64 nt, Homo Sapiens; identical to SEQ ID NO: 54370

SEQ ID NO: 557911 - RNA, 64 nt, Homo Sapiens; identical to SEQ ID NO: 54371

SEQ ID NO: 557912 - RNA, 64 nt, Homo Sapiens; identical to SEQ ID NO: 54372

SEQ ID NO: 557913 - RNA, 64 nt, Homo Sapiens; identical to SEQ ID NO: 54373

SEQ ID NO: 557914 - RNA, 64 nt, Homo Sapiens; identical to SEQ ID NO: 54374

SEQ ID NO: 557915 - RNA, 64 nt, Homo Sapiens; identical to SEQ ID NO: 54375

SEQ ID NO: 557916 - RNA, 64 nt, Homo Sapiens; identical to SEQ ID NO: 54376

SEQ ID NO: 557917 - RNA, 64 nt, Homo Sapiens; identical to SEQ ID NO: 54377

SEQ ID NO: 557918 - RNA, 64 nt, Homo Sapiens; identical to SEQ ID NO: 54378

SEQ ID NO: 557919 - RNA, 64 nt, Homo Sapiens; identical to SEQ ID NO: 54379

SEQ ID NO: 557920 - RNA, 64 nt, Homo Sapiens; identical to SEQ ID NO: 54380

SEQ ID NO: 557921 - RNA, 64 nt, Homo Sapiens; identical to SEQ ID NO: 54381

SEQ ID NO: 557922 - RNA, 64 nt, Homo Sapiens; identical to SEQ ID NO: 54382

SEQ ID NO: 557923 - RNA, 64 nt, Homo Sapiens; identical to SEQ ID NO: 54383

SEQ ID NO: 557924 - RNA, 64 nt, Homo Sapiens; identical to SEQ ID NO: 54384

SEQ ID NO: 557925 - RNA, 64 nt, Homo Sapiens; identical to SEQ ID NO: 54385

SEQ ID NO: 557926 - RNA, 64 nt, Homo Sapiens; identical to SEQ ID NO: 54386

SEQ ID NO: 557927 - RNA, 64 nt, Homo Sapiens; identical to SEQ ID NO: 54387

SEQ ID NO: 557928 - RNA, 64 nt, Homo Sapiens; identical to SEQ ID NO: 54388

SEQ ID NO: 557929 - RNA, 64 nt, Homo Sapiens; identical to SEQ ID NO: 54389

SEQ ID NO: 557930 - RNA, 64 nt, Homo Sapiens; identical to SEQ ID NO: 54390

SEQ ID NO: 557931 - RNA, 64 nt, Homo Sapiens; identical to SEQ ID NO: 54391

SEQ ID NO: 557932 - RNA, 64 nt, Homo Sapiens; identical to SEQ ID NO: 54392

SEQ ID NO: 557933 - RNA, 64 nt, Homo Sapiens; identical to SEQ ID NO: 54393

SEQ ID NO: 557934 - RNA, 64 nt, Homo Sapiens; identical to SEQ ID NO: 54394

SEQ ID NO: 557935 - RNA, 64 nt, Homo Sapiens; identical to SEQ ID NO: 54395

SEQ ID NO: 557936 - RNA, 64 nt, Homo Sapiens; identical to SEQ ID NO: 54396

SEQ ID NO: 557937 - RNA, 64 nt, Homo Sapiens; identical to SEQ ID NO: 54397

SEQ ID NO: 557938 - RNA, 64 nt, Homo Sapiens; identical to SEQ ID NO: 54398

SEQ ID NO: 557939 - RNA, 64 nt, Homo Sapiens; identical to SEQ ID NO: 54399

SEQ ID NO: 557940 - RNA, 64 nt, Homo Sapiens; identical to SEQ ID NO: 54400

SEQ ID NO: 557941 - RNA, 64 nt, Homo Sapiens; identical to SEQ ID NO: 54401

SEQ ID NO: 557942 - RNA, 64 nt, Homo Sapiens; identical to SEQ ID NO: 54402

SEQ ID NO: 557943 - RNA, 64 nt, Homo Sapiens; identical to SEQ ID NO: 54403

SEQ ID NO: 557944 - RNA, 64 nt, Homo Sapiens; identical to SEQ ID NO: 54404

SEQ ID NO: 557945 - RNA, 64 nt, Homo Sapiens; identical to SEQ ID NO: 54405

SEQ ID NO: 557946 - RNA, 64 nt, Homo Sapiens; identical to SEQ ID NO: 54406

SEQ ID NO: 557947 - RNA, 64 nt, Homo Sapiens; identical to SEQ ID NO: 54407

SEQ ID NO: 557948 - RNA, 64 nt, Homo Sapiens; identical to SEQ ID NO: 54408

SEQ ID NO: 557949 - RNA, 64 nt, Homo Sapiens; identical to SEQ ID NO: 54409

SEQ ID NO: 557950 - RNA, 64 nt, Homo Sapiens; identical to SEQ ID NO: 54410

SEQ ID NO: 557951 - RNA, 64 nt, Homo Sapiens; identical to SEQ ID NO: 54411

SEQ ID NO: 557952 - RNA, 64 nt, Homo Sapiens; identical to SEQ ID NO: 54412

SEQ ID NO: 557953 - RNA, 64 nt, Homo Sapiens; identical to SEQ ID NO: 54413

SEQ ID NO: 557954 - RNA, 64 nt, Homo Sapiens; identical to SEQ ID NO: 54414

SEQ ID NO: 557955 - RNA, 64 nt, Homo Sapiens; identical to SEQ ID NO: 54415

SEQ ID NO: 557956 - RNA, 64 nt, Homo Sapiens; identical to SEQ ID NO: 54416

SEQ ID NO: 557957 - RNA, 64 nt, Homo Sapiens; identical to SEQ ID NO: 54417

SEQ ID NO: 557958 - RNA, 64 nt, Homo Sapiens; identical to SEQ ID NO: 54418

SEQ ID NO: 557959 - RNA, 64 nt, Homo Sapiens; identical to SEQ ID NO: 54419

SEQ ID NO: 557960 - RNA, 64 nt, Homo Sapiens; identical to SEQ ID NO: 54420

SEQ ID NO: 557961 - RNA, 64 nt, Homo Sapiens; identical to SEQ ID NO: 54421

SEQ ID NO: 557962 - RNA, 64 nt, Homo Sapiens; identical to SEQ ID NO: 54422

SEQ ID NO: 557963 - RNA, 64 nt, Homo Sapiens; identical to SEQ ID NO: 54423

SEQ ID NO: 557964 - RNA, 64 nt, Homo Sapiens; identical to SEQ ID NO: 54424

SEQ ID NO: 557965 - RNA, 64 nt, Homo Sapiens; identical to SEQ ID NO: 54425

SEQ ID NO: 557966 - RNA, 64 nt, Homo Sapiens; identical to SEQ ID NO: 54426

SEQ ID NO: 557967 - RNA, 64 nt, Homo Sapiens; identical to SEQ ID NO: 54427

SEQ ID NO: 557968 - RNA, 64 nt, Homo Sapiens; identical to SEQ ID NO: 54428

SEQ ID NO: 557969 - RNA, 64 nt, Homo Sapiens; identical to SEQ ID NO: 54429

SEQ ID NO: 557970 - RNA, 64 nt, Homo Sapiens; identical to SEQ ID NO: 54430

SEQ ID NO: 557971 - RNA, 64 nt, Homo Sapiens; identical to SEQ ID NO: 54431

SEQ ID NO: 557972 - RNA, 64 nt, Homo Sapiens; identical to SEQ ID NO: 54432

SEQ ID NO: 557973 - RNA, 64 nt, Homo Sapiens; identical to SEQ ID NO: 54433

SEQ ID NO: 557974 - RNA, 64 nt, Homo Sapiens; identical to SEQ ID NO: 54434

SEQ ID NO: 557975 - RNA, 64 nt, Homo Sapiens; identical to SEQ ID NO: 54435

SEQ ID NO: 557976 - RNA, 64 nt, Homo Sapiens; identical to SEQ ID NO: 54436

SEQ ID NO: 557977 - RNA, 64 nt, Homo Sapiens; identical to SEQ ID NO: 54437

SEQ ID NO: 557978 - RNA, 64 nt, Homo Sapiens; identical to SEQ ID NO: 54438

SEQ ID NO: 557979 - RNA, 64 nt, Homo Sapiens; identical to SEQ ID NO: 54439

SEQ ID NO: 557980 - RNA, 64 nt, Homo Sapiens; identical to SEQ ID NO: 54440

SEQ ID NO: 557981 - RNA, 64 nt, Homo Sapiens; identical to SEQ ID NO: 54441

SEQ ID NO: 557982 - RNA, 64 nt, Homo Sapiens; identical to SEQ ID NO: 54442

SEQ ID NO: 557983 - RNA, 64 nt, Homo Sapiens; identical to SEQ ID NO: 54443

SEQ ID NO: 557984 - RNA, 64 nt, Homo Sapiens; identical to SEQ ID NO: 54444

SEQ ID NO: 557985 - RNA, 64 nt, Homo Sapiens; identical to SEQ ID NO: 54445

SEQ ID NO: 557986 - RNA, 64 nt, Homo Sapiens; identical to SEQ ID NO: 54446

SEQ ID NO: 557987 - RNA, 64 nt, Homo Sapiens; identical to SEQ ID NO: 54447

SEQ ID NO: 557988 - RNA, 64 nt, Homo Sapiens; identical to SEQ ID NO: 54448

SEQ ID NO: 557989 - RNA, 64 nt, Homo Sapiens; identical to SEQ ID NO: 54449

SEQ ID NO: 557990 - RNA, 64 nt, Homo Sapiens; identical to SEQ ID NO: 54450

SEQ ID NO: 557991 - RNA, 64 nt, Homo Sapiens; identical to SEQ ID NO: 54451

SEQ ID NO: 557992 - RNA, 64 nt, Homo Sapiens; identical to SEQ ID NO: 54452

SEQ ID NO: 557993 - RNA, 58 nt, Homo Sapiens; identical to SEQ ID NO: 54453

SEQ ID NO: 557994 - RNA, 64 nt, Homo Sapiens; identical to SEQ ID NO: 54454

SEQ ID NO: 557995 - RNA, 64 nt, Homo Sapiens; identical to SEQ ID NO: 54455

SEQ ID NO: 557996 - RNA, 64 nt, Homo Sapiens; identical to SEQ ID NO: 54456

SEQ ID NO: 557997 - RNA, 64 nt, Homo Sapiens; identical to SEQ ID NO: 54457

SEQ ID NO: 557998 - RNA, 64 nt, Homo Sapiens; identical to SEQ ID NO: 54458

SEQ ID NO: 557999 - RNA, 64 nt, Homo Sapiens; identical to SEQ ID NO: 54459

SEQ ID NO: 558000 - RNA, 64 nt, Homo Sapiens; identical to SEQ ID NO: 54460

SEQ ID NO: 558001 - RNA, 64 nt, Homo Sapiens; identical to SEQ ID NO: 54461

SEQ ID NO: 558002 - RNA, 64 nt, Homo Sapiens; identical to SEQ ID NO: 54462

SEQ ID NO: 558003 - RNA, 64 nt, Homo Sapiens; identical to SEQ ID NO: 54463

SEQ ID NO: 558004 - RNA, 64 nt, Homo Sapiens; identical to SEQ ID NO: 54464

SEQ ID NO: 558005 - RNA, 53 nt, Homo Sapiens; identical to SEQ ID NO: 54465

SEQ ID NO: 558006 - RNA, 64 nt, Homo Sapiens; identical to SEQ ID NO: 54466

SEQ ID NO: 558007 - RNA, 64 nt, Homo Sapiens; identical to SEQ ID NO: 54467

SEQ ID NO: 558008 - RNA, 64 nt, Homo Sapiens; identical to SEQ ID NO: 54468

SEQ ID NO: 558009 - RNA, 64 nt, Homo Sapiens; identical to SEQ ID NO: 54469

SEQ ID NO: 558010 - RNA, 64 nt, Homo Sapiens; identical to SEQ ID NO: 54470

SEQ ID NO: 558011 - RNA, 64 nt, Homo Sapiens; identical to SEQ ID NO: 54471

SEQ ID NO: 558012 - RNA, 64 nt, Homo Sapiens; identical to SEQ ID NO: 54472

SEQ ID NO: 558013 - RNA, 64 nt, Homo Sapiens; identical to SEQ ID NO: 54473

SEQ ID NO: 558014 - RNA, 64 nt, Homo Sapiens; identical to SEQ ID NO: 54474

SEQ ID NO: 558015 - RNA, 64 nt, Homo Sapiens; identical to SEQ ID NO: 54475

SEQ ID NO: 558016 - RNA, 64 nt, Homo Sapiens; identical to SEQ ID NO: 54476

SEQ ID NO: 558017 - RNA, 64 nt, Homo Sapiens; identical to SEQ ID NO: 54477

SEQ ID NO: 558018 - RNA, 64 nt, Homo Sapiens; identical to SEQ ID NO: 54478

SEQ ID NO: 558019 - RNA, 64 nt, Homo Sapiens; identical to SEQ ID NO: 54479

SEQ ID NO: 558020 - RNA, 64 nt, Homo Sapiens; identical to SEQ ID NO: 54480

SEQ ID NO: 558021 - RNA, 64 nt, Homo Sapiens; identical to SEQ ID NO: 54481

SEQ ID NO: 558022 - RNA, 64 nt, Homo Sapiens; identical to SEQ ID NO: 54482

SEQ ID NO: 558023 - RNA, 64 nt, Homo Sapiens; identical to SEQ ID NO: 54483

SEQ ID NO: 558024 - RNA, 64 nt, Homo Sapiens; identical to SEQ ID NO: 54484

SEQ ID NO: 558025 - RNA, 64 nt, Homo Sapiens; identical to SEQ ID NO: 54485

SEQ ID NO: 558026 - RNA, 64 nt, Homo Sapiens; identical to SEQ ID NO: 54486

SEQ ID NO: 558027 - RNA, 64 nt, Homo Sapiens; identical to SEQ ID NO: 54487

SEQ ID NO: 558028 - RNA, 64 nt, Homo Sapiens; identical to SEQ ID NO: 54488

SEQ ID NO: 558029 - RNA, 64 nt, Homo Sapiens; identical to SEQ ID NO: 54489

SEQ ID NO: 558030 - RNA, 64 nt, Homo Sapiens; identical to SEQ ID NO: 54490

SEQ ID NO: 558031 - RNA, 64 nt, Homo Sapiens; identical to SEQ ID NO: 54491

SEQ ID NO: 558032 - RNA, 64 nt, Homo Sapiens; identical to SEQ ID NO: 54492

SEQ ID NO: 558033 - RNA, 64 nt, Homo Sapiens; identical to SEQ ID NO: 54493

SEQ ID NO: 558034 - RNA, 64 nt, Homo Sapiens; identical to SEQ ID NO: 54494

SEQ ID NO: 558035 - RNA, 64 nt, Homo Sapiens; identical to SEQ ID NO: 54495

SEQ ID NO: 558036 - RNA, 64 nt, Homo Sapiens; identical to SEQ ID NO: 54496

SEQ ID NO: 558037 - RNA, 64 nt, Homo Sapiens; identical to SEQ ID NO: 54497

SEQ ID NO: 558038 - RNA, 64 nt, Homo Sapiens; identical to SEQ ID NO: 54498

SEQ ID NO: 558039 - RNA, 64 nt, Homo Sapiens; identical to SEQ ID NO: 54499

SEQ ID NO: 558040 - RNA, 64 nt, Homo Sapiens; identical to SEQ ID NO: 54500

SEQ ID NO: 558041 - RNA, 64 nt, Homo Sapiens; identical to SEQ ID NO: 54501

SEQ ID NO: 558042 - RNA, 64 nt, Homo Sapiens; identical to SEQ ID NO: 54502

SEQ ID NO: 558043 - RNA, 64 nt, Homo Sapiens; identical to SEQ ID NO: 54503

SEQ ID NO: 558044 - RNA, 64 nt, Homo Sapiens; identical to SEQ ID NO: 54504

SEQ ID NO: 558045 - RNA, 64 nt, Homo Sapiens; identical to SEQ ID NO: 54505

SEQ ID NO: 558046 - RNA, 64 nt, Homo Sapiens; identical to SEQ ID NO: 54506

SEQ ID NO: 558047 - RNA, 64 nt, Homo Sapiens; identical to SEQ ID NO: 54507

SEQ ID NO: 558048 - RNA, 64 nt, Homo Sapiens; identical to SEQ ID NO: 54508

SEQ ID NO: 558049 - RNA, 64 nt, Homo Sapiens; identical to SEQ ID NO: 54509

SEQ ID NO: 558050 - RNA, 64 nt, Homo Sapiens; identical to SEQ ID NO: 54510

SEQ ID NO: 558051 - RNA, 64 nt, Homo Sapiens; identical to SEQ ID NO: 54511

SEQ ID NO: 558052 - RNA, 64 nt, Homo Sapiens; identical to SEQ ID NO: 54512

SEQ ID NO: 558053 - RNA, 64 nt, Homo Sapiens; identical to SEQ ID NO: 54513

SEQ ID NO: 558054 - RNA, 64 nt, Homo Sapiens; identical to SEQ ID NO: 54514

SEQ ID NO: 558055 - RNA, 64 nt, Homo Sapiens; identical to SEQ ID NO: 54515

SEQ ID NO: 558056 - RNA, 64 nt, Homo Sapiens; identical to SEQ ID NO: 54516

SEQ ID NO: 558057 - RNA, 64 nt, Homo Sapiens; identical to SEQ ID NO: 54517

SEQ ID NO: 558058 - RNA, 64 nt, Homo Sapiens; identical to SEQ ID NO: 54518

SEQ ID NO: 558059 - RNA, 64 nt, Homo Sapiens; identical to SEQ ID NO: 54519

SEQ ID NO: 558060 - RNA, 64 nt, Homo Sapiens; identical to SEQ ID NO: 54520

SEQ ID NO: 558061 - RNA, 64 nt, Homo Sapiens; identical to SEQ ID NO: 54521

SEQ ID NO: 558062 - RNA, 64 nt, Homo Sapiens; identical to SEQ ID NO: 54522

SEQ ID NO: 558063 - RNA, 64 nt, Homo Sapiens; identical to SEQ ID NO: 54523

SEQ ID NO: 558064 - RNA, 64 nt, Homo Sapiens; identical to SEQ ID NO: 54524

SEQ ID NO: 558065 - RNA, 64 nt, Homo Sapiens; identical to SEQ ID NO: 54525

SEQ ID NO: 558066 - RNA, 64 nt, Homo Sapiens; identical to SEQ ID NO: 54526

SEQ ID NO: 558067 - RNA, 64 nt, Homo Sapiens; identical to SEQ ID NO: 54527

SEQ ID NO: 558068 - RNA, 64 nt, Homo Sapiens; identical to SEQ ID NO: 54528

SEQ ID NO: 558069 - RNA, 64 nt, Homo Sapiens; identical to SEQ ID NO: 54529

SEQ ID NO: 558070 - RNA, 64 nt, Homo Sapiens; identical to SEQ ID NO: 54530

SEQ ID NO: 558071 - RNA, 64 nt, Homo Sapiens; identical to SEQ ID NO: 54531

SEQ ID NO: 558072 - RNA, 64 nt, Homo Sapiens; identical to SEQ ID NO: 54532

SEQ ID NO: 558073 - RNA, 64 nt, Homo Sapiens; identical to SEQ ID NO: 54533

SEQ ID NO: 558074 - RNA, 64 nt, Homo Sapiens; identical to SEQ ID NO: 54534

SEQ ID NO: 558075 - RNA, 64 nt, Homo Sapiens; identical to SEQ ID NO: 54535

SEQ ID NO: 558076 - RNA, 64 nt, Homo Sapiens; identical to SEQ ID NO: 54536

SEQ ID NO: 558077 - RNA, 64 nt, Homo Sapiens; identical to SEQ ID NO: 54537

SEQ ID NO: 558078 - RNA, 64 nt, Homo Sapiens; identical to SEQ ID NO: 54538

SEQ ID NO: 558079 - RNA, 64 nt, Homo Sapiens; identical to SEQ ID NO: 54539

SEQ ID NO: 558080 - RNA, 64 nt, Homo Sapiens; identical to SEQ ID NO: 54540

SEQ ID NO: 558081 - RNA, 64 nt, Homo Sapiens; identical to SEQ ID NO: 54541

SEQ ID NO: 558082 - RNA, 64 nt, Homo Sapiens; identical to SEQ ID NO: 54542

SEQ ID NO: 558083 - RNA, 64 nt, Homo Sapiens; identical to SEQ ID NO: 54543

SEQ ID NO: 558084 - RNA, 64 nt, Homo Sapiens; identical to SEQ ID NO: 54544

SEQ ID NO: 558085 - RNA, 64 nt, Homo Sapiens; identical to SEQ ID NO: 54545

SEQ ID NO: 558086 - RNA, 64 nt, Homo Sapiens; identical to SEQ ID NO: 54546

SEQ ID NO: 558087 - RNA, 64 nt, Homo Sapiens; identical to SEQ ID NO: 54547

SEQ ID NO: 558088 - RNA, 64 nt, Homo Sapiens; identical to SEQ ID NO: 54548

SEQ ID NO: 558089 - RNA, 64 nt, Homo Sapiens; identical to SEQ ID NO: 54549

SEQ ID NO: 558090 - RNA, 64 nt, Homo Sapiens; identical to SEQ ID NO: 54550

SEQ ID NO: 558091 - RNA, 64 nt, Homo Sapiens; identical to SEQ ID NO: 54551

SEQ ID NO: 558092 - RNA, 64 nt, Homo Sapiens; identical to SEQ ID NO: 54552

SEQ ID NO: 558093 - RNA, 64 nt, Homo Sapiens; identical to SEQ ID NO: 54553

SEQ ID NO: 558094 - RNA, 64 nt, Homo Sapiens; identical to SEQ ID NO: 54554

SEQ ID NO: 558095 - RNA, 64 nt, Homo Sapiens; identical to SEQ ID NO: 54555

SEQ ID NO: 558096 - RNA, 64 nt, Homo Sapiens; identical to SEQ ID NO: 54556

SEQ ID NO: 558097 - RNA, 64 nt, Homo Sapiens; identical to SEQ ID NO: 54557

SEQ ID NO: 558098 - RNA, 64 nt, Homo Sapiens; identical to SEQ ID NO: 54558

SEQ ID NO: 558099 - RNA, 64 nt, Homo Sapiens; identical to SEQ ID NO: 54559

SEQ ID NO: 558100 - RNA, 64 nt, Homo Sapiens; identical to SEQ ID NO: 54560

SEQ ID NO: 558101 - RNA, 64 nt, Homo Sapiens; identical to SEQ ID NO: 54561

SEQ ID NO: 558102 - RNA, 64 nt, Homo Sapiens; identical to SEQ ID NO: 54562

SEQ ID NO: 558103 - RNA, 64 nt, Homo Sapiens; identical to SEQ ID NO: 54563

SEQ ID NO: 558104 - RNA, 64 nt, Homo Sapiens; identical to SEQ ID NO: 54564

SEQ ID NO: 558105 - RNA, 64 nt, Homo Sapiens; identical to SEQ ID NO: 54565

SEQ ID NO: 558106 - RNA, 64 nt, Homo Sapiens; identical to SEQ ID NO: 54566

SEQ ID NO: 558107 - RNA, 64 nt, Homo Sapiens; identical to SEQ ID NO: 54567

SEQ ID NO: 558108 - RNA, 64 nt, Homo Sapiens; identical to SEQ ID NO: 54568

SEQ ID NO: 558109 - RNA, 64 nt, Homo Sapiens; identical to SEQ ID NO: 54569

SEQ ID NO: 558110 - RNA, 64 nt, Homo Sapiens; identical to SEQ ID NO: 54570

SEQ ID NO: 558111 - RNA, 64 nt, Homo Sapiens; identical to SEQ ID NO: 54571

SEQ ID NO: 558112 - RNA, 64 nt, Homo Sapiens; identical to SEQ ID NO: 54572

SEQ ID NO: 558113 - RNA, 64 nt, Homo Sapiens; identical to SEQ ID NO: 54573

SEQ ID NO: 558114 - RNA, 64 nt, Homo Sapiens; identical to SEQ ID NO: 54574

SEQ ID NO: 558115 - RNA, 64 nt, Homo Sapiens; identical to SEQ ID NO: 54575

SEQ ID NO: 558116 - RNA, 64 nt, Homo Sapiens; identical to SEQ ID NO: 54576

SEQ ID NO: 558117 - RNA, 64 nt, Homo Sapiens; identical to SEQ ID NO: 54577

SEQ ID NO: 558118 - RNA, 64 nt, Homo Sapiens; identical to SEQ ID NO: 54578

SEQ ID NO: 558119 - RNA, 64 nt, Homo Sapiens; identical to SEQ ID NO: 54579

SEQ ID NO: 558120 - RNA, 64 nt, Homo Sapiens; identical to SEQ ID NO: 54580

SEQ ID NO: 558121 - RNA, 64 nt, Homo Sapiens; identical to SEQ ID NO: 54581

SEQ ID NO: 558122 - RNA, 64 nt, Homo Sapiens; identical to SEQ ID NO: 54582

SEQ ID NO: 558123 - RNA, 64 nt, Homo Sapiens; identical to SEQ ID NO: 54583

SEQ ID NO: 558124 - RNA, 64 nt, Homo Sapiens
uuuuuuuuuuuuuuuuuuuugagauguagucuuacucugucacccaggcuagagugcaauggca

SEQ ID NO: 558125 - RNA, 64 nt, Homo Sapiens
uuuuuauacuuuuuuuuuuugaaacggagucucacucugucaccaggcuggagugcagugccgc

SEQ ID NO: 558126 - RNA, 64 nt, Homo Sapiens
ucaagauucuauaaaaaggaaaccaagcauaagacucugucaucauaccuguuacacguuccua

SEQ ID NO: 558127 - RNA, 64 nt, Homo Sapiens
gaaauuucauuuuuuuuuuugagauggagucucucucugucacccaaguuggagugcaguggcc

SEQ ID NO: 558128 - RNA, 64 nt, Homo Sapiens
guauuguuguuguuguuuuugagacagggucuugcucugucacccaagcuggaauacaguggca

SEQ ID NO: 558129 - RNA, 64 nt, Homo Sapiens
cagcuucagaauuguucuuugaauccuaaggaaccucugucaacaguugagguugcuguugaaa

SEQ ID NO: 558130 - RNA, 64 nt, Homo Sapiens
uuuucuuuuuuuuuuuuuucgagacagggucuugcucugucaccuaggcuagaguggaguggca

SEQ ID NO: 558131 - RNA, 64 nt, Homo Sapiens
auauguuuauugcacuucccauggggauaaaucacucugucauuccuaguuauuuuaaaaaaag

SEQ ID NO: 558132 - RNA, 64 nt, Homo Sapiens
guauguuaauuuuuuuuuuugagacggagucuugcucugucacccaggcuggagagcaguggcg

SEQ ID NO: 558133 - RNA, 64 nt, Homo Sapiens
guuuuuuguuuuguguuuuugaaacggaguuuugcucugucacccaggcuggaaugcaauggca

SEQ ID NO: 558134 - RNA, 64 nt, Homo Sapiens
ccuuccuuccuucugacagggucuugcucuauugcucugucacccaggcuggaaugcaguggcg

SEQ ID NO: 558135 - RNA, 64 nt, Homo Sapiens
agauugauuuuuuuuuuuuugagacaggaucucacucugucauccaggcugaaguccaauccca

SEQ ID NO: 558136 - RNA, 64 nt, Homo Sapiens
uuuuuuguuuguuauuuguuuuuuguagacagcacucugucacccaggcuggagugcaguggca

SEQ ID NO: 558137 - RNA, 64 nt, Homo Sapiens
caaggcaaaacuuuuuuauugagauggagucuugcucugucacccaggccgugcaaucucggcu

SEQ ID NO: 558138 - RNA, 64 nt, Homo Sapiens
augaaaguauuccagucuuugcgugugcgucuaccucugucagcuuguaacugcauauaccagu

SEQ ID NO: 558139 - RNA, 64 nt, Homo Sapiens
caggcuggagugcaguggcagagauacaguuucacucugucaccaaauuuuuguuguugucguu

SEQ ID NO: 558140 - RNA, 64 nt, Homo Sapiens
uagccaggagggguagcaaacacucggcucccaucucugucaccagcgaaucuuugaaaacacc

SEQ ID NO: 558141 - RNA, 64 nt, Homo Sapiens
ucgcacuucauuacauuccuccccagagcagggacucugucaccccucgcggcacugccggugu

SEQ ID NO: 558142 - RNA, 64 nt, Homo Sapiens
caggcuggagugcagugguggagauggagucucgcucugucaccuuuuuuuuuuuuuuuuuuuu

SEQ ID NO: 558143 - RNA, 64 nt, Homo Sapiens
agguuggaguacagugguacaugagacgaucucacucugucaccuuuuaauuuuuuauaucuuu

SEQ ID NO: 558144 - RNA, 64 nt, Homo Sapiens
aggcuggagugcaguggcccuagacggagucucgcucugucacguauucuuuguuuuuuuuuuu

SEQ ID NO: 558145 - RNA, 64 nt, Homo Sapiens
uugauuuggucuguggucaccuuaguuucacagacucugucauucucccaugcacccuuggaga

SEQ ID NO: 558146 - RNA, 64 nt, Homo Sapiens
uuaaaggugauuguuuuuuugagacagagucuugcucugucacccagaguggagugcagugucc

SEQ ID NO: 558147 - RNA, 64 nt, Homo Sapiens
uauuuauuuacuuuuuaagagagagacaggcucacucugucacccaggccagagugcaguggca

SEQ ID NO: 558148 - RNA, 64 nt, Homo Sapiens
gauggaccacuaccugcagcauugauguaaaauacucugucauucuuugguugaaugagcuggu

SEQ ID NO: 558149 - RNA, 64 nt, Homo Sapiens
ugaaauuuuaaccacuuaauuuaccaguuaucggcucugucaucauaugaacuucaagaagcug

SEQ ID NO: 558150 - RNA, 64 nt, Homo Sapiens
uaggcuggagugcaguggcggagacagagucucgcucugucaccuuuuauuuuaguuuuauuuu

SEQ ID NO: 558151 - RNA, 64 nt, Homo Sapiens
caggcuggagugcaaugguguuuuuuucgagacacucugucaccaggucccauuuuauuauuuu

SEQ ID NO: 558152 - RNA, 64 nt, Homo Sapiens
ugcccagcucugcuucugguuuccuggacaauuucucugucagauacggcccauuguaaaccca

SEQ ID NO: 558153 - RNA, 64 nt, Homo Sapiens
auucgcuauaaucagccuauuugagcugcugggucucugucacuguggacuccagucauucaag

SEQ ID NO: 558154 - RNA, 64 nt, Homo Sapiens
ggaaagagaagaccagaugugcauagaagccagucucugucacauacaccgcagguggucaccg

SEQ ID NO: 558155 - RNA, 64 nt, Homo Sapiens
uuucuacacacacaucuaaagacggugcggcucgcucugucauggguuccgucucucuguggag

SEQ ID NO: 558156 - RNA, 64 nt, Homo Sapiens
cggugucuuguagcgggcggcagcgccagcgccccucugucaggcuggggcaaucuugguuuug

SEQ ID NO: 558157 - RNA, 64 nt, Homo Sapiens
gugaguggcuucaguaggaucacccuaaaaauggcucugucacuguuaguugauccaugucaug

SEQ ID NO: 558158 - RNA, 64 nt, Homo Sapiens
caagcuggagggcaauggcguuugaggaguuucccucugucacauuuguuuugguuuuuuguuu

SEQ ID NO: 558159 - RNA, 64 nt, Homo Sapiens
gaggcuggagugcaguggcguuuuuugagucuugcucugucacuccgcgcccagcugccuuuuu

SEQ ID NO: 558160 - RNA, 64 nt, Homo Sapiens
cagacuggagugcaguggcggagacagagucucacucugucaccuuuuaaucuuuuauuuuuuu

SEQ ID NO: 558161 - RNA, 64 nt, Homo Sapiens
cucucagaaguaugagaccauccucugcacucugcucugucaucaaaggcugcuggguggagau

SEQ ID NO: 558162 - RNA, 64 nt, Homo Sapiens
uuuuuuuuuuuuuuuuuuuugagacagagucuugcucugucacccaggcuggagugcaguggug

SEQ ID NO: 558163 - RNA, 64 nt, Homo Sapiens
ugcacaaaauucuuuuuuuugagauggagucucacucugucacccaggcuggagugcaguggcg

SEQ ID NO: 558164 - RNA, 64 nt, Homo Sapiens
ccuguuagaaugucacgagggacuguacuguccccucugucaccagggaagccacaaugagagc

SEQ ID NO: 558165 - RNA, 64 nt, Homo Sapiens
acccucagccagcccucacugcugacaggcaccccucugucaccuccugccaccugucagauac

SEQ ID NO: 558166 - RNA, 64 nt, Homo Sapiens
augccucaaaagacauggaaccucggugcuggcucucugucacaagggaggggcugguccuucc

SEQ ID NO: 558167 - RNA, 64 nt, Homo Sapiens
guaagaaggcugaccagccaaugccaccaugcuucucugucaccgggcccugaggggcagggag

SEQ ID NO: 558168 - RNA, 64 nt, Homo Sapiens
cagaucauggcauccaagagugcgccgagucugucucugucaugguagagaccgagccucuguc

SEQ ID NO: 558169 - RNA, 64 nt, Homo Sapiens
gccgagucugucucugucaugguagagaccgagccucugucacugcaggcacucaaugcagcca

SEQ ID NO: 558170 - RNA, 64 nt, Homo Sapiens
uucuguaaaggugucuucucuucucagacucuuccucugucacacgucugacuccuucacguca

SEQ ID NO: 558171 - RNA, 64 nt, Homo Sapiens
ggcugggcccuggaggcaacgugcugcaggcgcacucugucagagugaacagcaccgcgagaca

SEQ ID NO: 558172 - RNA, 64 nt, Homo Sapiens
uuuuucuuuuccuuuuuuuugagaccaagucucacucugucacccacgcuggagugcugugaug

SEQ ID NO: 558173 - RNA, 64 nt, Homo Sapiens
uuuuuuuuuuuuuuuuuaaagagacagagucucacucugucacccaggcuggagugcaguggca

SEQ ID NO: 558174 - RNA, 64 nt, Homo Sapiens
uaggcuggagugcagugguggagauggagucucgcucugucaucuuuuuuuuuuuuuuuuuuuu

SEQ ID NO: 558175 - RNA, 64 nt, Homo Sapiens
uuguagccauuucagcugucgauucuaccauagacucugucauuuaagccaacucugacauuug

SEQ ID NO: 558176 - RNA, 64 nt, Homo Sapiens
cuccuccucugucucucauccuccuuucucccaucaaagcaaaauauggccucaccaccagccc

SEQ ID NO: 558177 - RNA, 64 nt, Homo Sapiens
cuaaaaacaagaugacuuuuccuggcacauauuccaaagcaaagacuuuguugccugcugcuua

SEQ ID NO: 558178 - RNA, 64 nt, Homo Sapiens
ccaucucuaaguagaaaaaugagaguagauggugcaaagcaagccagggggagugggcugaagg

SEQ ID NO: 558179 - RNA, 64 nt, Homo Sapiens
ggaaggaaugauaauggugaccaggcccaucuuccaaagcaagaauuucuagacucucgccggc

SEQ ID NO: 558180 - RNA, 64 nt, Homo Sapiens
ggcccauuuacagagagacaauaugugauauuuacaaagcaauugcacucugagggcuuaaguc

SEQ ID NO: 558181 - RNA, 64 nt, Homo Sapiens
ccguuuuuggaggaacucaaaugaugaacucccccaaagcaacgaauccccagaaguggucccu

SEQ ID NO: 558182 - RNA, 64 nt, Homo Sapiens
cuaaucaggguucuccauggagaccgacuuugugcaaagcaaugucaacaaauauauuuauugg

SEQ ID NO: 558183 - RNA, 64 nt, Homo Sapiens
gaugaagcagaguggaugucagaagagaugucagcaaagcaaguauuccgaggaguagagaggc

SEQ ID NO: 558184 - RNA, 64 nt, Homo Sapiens
cuguuuacauuuauuuucuucagccugugcaaaacaaagcaauggaaaaggaaacuaaaaaaua

SEQ ID NO: 558185 - RNA, 64 nt, Homo Sapiens
uaaaaugucagcaagaaggccugccucaucuuaacaaagcaaaaaaaaaugcuuuaauucaaau

SEQ ID NO: 558186 - RNA, 64 nt, Homo Sapiens
aacaacaccugggucaacucuuuuaauuuauauacaaagcaaagaacaacauuaauggagaugc

SEQ ID NO: 558187 - RNA, 64 nt, Homo Sapiens
caagaauuagaaugacuugagaacgggcaaauaacaaagcaaaccaauauaauuauauggucau

SEQ ID NO: 558188 - RNA, 64 nt, Homo Sapiens
caguggccugugggugagggaagccagaaugacacaaagcaaugcaaagacaagauugccaugc

SEQ ID NO: 558189 - RNA, 64 nt, Homo Sapiens
uaauagggaaucuagauuucaccaagauucaaaucaaagcaacauuuaaaggaauaagaccugu

SEQ ID NO: 558190 - RNA, 64 nt, Homo Sapiens
acuccuuaucguuaguguccugauccacuaccgccaaagcaaauaagcaagauaagcagaugug

SEQ ID NO: 558191 - RNA, 64 nt, Homo Sapiens
uaagcagaugugugauccacuauguaaaaaauaucaaagcaagaucuguaucacucagaaacau

SEQ ID NO: 558192 - RNA, 64 nt, Homo Sapiens
ccccaguguuggagugcaaggaggcggggccauccaaagcaacgcugaaggccuuuuccagcag

SEQ ID NO: 558193 - RNA, 64 nt, Homo Sapiens
ucgccgcaagaagcccauuccuauggaagucuagcaaagcaauacgacucagcccagcacucuc

SEQ ID NO: 558194 - RNA, 64 nt, Homo Sapiens
aagaagccucaacuuacccaggaggagcuagaagcaaagcaagcaaagcaaaagcuggaagauc

SEQ ID NO: 558195 - RNA, 64 nt, Homo Sapiens
caacuuacccaggaggagcuagaagcaaagcaagcaaagcaaaagcuggaagaucgccucgcag

SEQ ID NO: 558196 - RNA, 64 nt, Homo Sapiens
gaaaugcauugcucuggaucacuuagccauuuuucaaagcaauuuaguggugguauguaaugga

SEQ ID NO: 558197 - RNA, 64 nt, Homo Sapiens
ccagaacaguaugaauuugauggacaaagaauuccaaagcaaaaguuaugaagagcuaauuuac

SEQ ID NO: 558198 - RNA, 64 nt, Homo Sapiens
uuuguuucauuuuacuuuccugcaaaauuuucuucaaagcaacaaguccuaggagcacacaaag

SEQ ID NO: 558199 - RNA, 64 nt, Homo Sapiens
aauuuucuucaaagcaacaaguccuaggagcacacaaagcaacccaaaggcuuuucccuggaaa

SEQ ID NO: 558200 - RNA, 64 nt, Homo Sapiens
ggaacggucagaaacugggcucaucacaccaaggcaaagcaacgggcgagucuuccuccuuguc

SEQ ID NO: 558201 - RNA, 64 nt, Homo Sapiens
gaagaaucaauauuguuaaaauggccauacuacccaaagcaauuuauagauucaaugcuauucc

SEQ ID NO: 558202 - RNA, 64 nt, Homo Sapiens
aauuuauuugaaaccaaaaaagagcccaaaaagccaaagcaauccuaagcaaaaagaacaaagc

SEQ ID NO: 558203 - RNA, 64 nt, Homo Sapiens
gcagcuugcugauauuuuauauaaaaaagaaaagcaaagcaaaagagaagcugauagucuugaa

SEQ ID NO: 558204 - RNA, 64 nt, Homo Sapiens
gacagacagaggcugagagaggcuguuccugaaucaaagcaauagccagcuuucgacacauacc

SEQ ID NO: 558205 - RNA, 64 nt, Homo Sapiens
ggauaggaagaaucaguauuguuaaaauacugcccaaagcaauuuacagagccaaugcuauuuc

SEQ ID NO: 558206 - RNA, 64 nt, Homo Sapiens
auaagugcuggaaaagacuuaaugaugaacaccccaaagcaauugcaacaaaaacaaaaauuga

SEQ ID NO: 558207 - RNA, 64 nt, Homo Sapiens
gacagauugaauuugccuaauugguucuggacuaaaacuacauuaauuccuaacuaucacuggu

SEQ ID NO: 558208 - RNA, 64 nt, Homo Sapiens
agguugugaaugcagguuuuaaaaaauuuacuuuaaacuacauuaauagcagcccucaauugug

SEQ ID NO: 558209 - RNA, 64 nt, Homo Sapiens
uugacuuaaacugcuauaguuaaaacugcuuucaaaacuacaaauuuuguggaagauaaaauau

SEQ ID NO: 558210 - RNA, 64 nt, Homo Sapiens
uaauuuauuuuaggaguuggcaccucuaccuucaaaacuacauauauacagccuacuuuuaugu

SEQ ID NO: 558211 - RNA, 64 nt, Homo Sapiens
gcuuacuacacauaggaaaauucauacuggagagaaacuacaaaugugaagaauguguuaaagc

SEQ ID NO: 558212 - RNA, 64 nt, Homo Sapiens
uaaauguaaugcauuugugaaaacauuuuuuaaaaaacuacagcuuagaaaauaccagaggccu

SEQ ID NO: 558213 - RNA, 64 nt, Homo Sapiens
ucaauauuuccagugaacacauuacaagaaaggaaaacuacagauaccaaagccaggcaaaaac

SEQ ID NO: 558214 - RNA, 64 nt, Homo Sapiens
uaggauuauguuagcauuuagaaaguuuuuggcaaaacuacaaaacagauuuuuuugaauuugu

SEQ ID NO: 558215 - RNA, 64 nt, Homo Sapiens
uguuauuccucaguuuuuaaggugaaauacaggaaaacuacauuucuguuuuccauuaauaaua

SEQ ID NO: 558216 - RNA, 64 nt, Homo Sapiens
ucacuguuuuuauccuagaauuucagauucucuaaaacuacauguccauucuugaauguagaaa

SEQ ID NO: 558217 - RNA, 64 nt, Homo Sapiens
uuagacaacaccagaggguuaaaaaaguuuuccaaaacuacaacgcaaauguaauaaauuugaa

SEQ ID NO: 558218 - RNA, 64 nt, Homo Sapiens
gcuggaagacaucacaguaacuuaaacuggagagaaacuacaaaucuuacuaaacauaaaaaaa

SEQ ID NO: 558219 - RNA, 64 nt, Homo Sapiens
aauguaaaccuucauuugccgcucuaaaacaaacaaacuacagagcuaaaaaacuacaaauuaa

SEQ ID NO: 558220 - RNA, 64 nt, Homo Sapiens
uuaagcucuaaaacaaacaauuuuaauagcuaaaaaacuacaaagucguuaaaaauucaaaugg

SEQ ID NO: 558221 - RNA, 64 nt, Homo Sapiens
caucugcaaauugcugcaauauuauaguaaucagaaacuacauaaggaauguuauauaggcuug

SEQ ID NO: 558222 - RNA, 64 nt, Homo Sapiens
auuuguuaaaagauaugacaaaaugaaaaugcuuaaacuacagaaauuuaaaaaugccauaaca

SEQ ID NO: 558223 - RNA, 64 nt, Homo Sapiens
acacuaaaacauugucuacacggaagccaggaggaaacuacaccgaauggauuuuucccggagc

SEQ ID NO: 558224 - RNA, 64 nt, Homo Sapiens
uaaaaucuugauagcuaaauaaaaaguuauaagaaaacuacaugcacgucuaugcaauuguaca

SEQ ID NO: 558225 - RNA, 64 nt, Homo Sapiens
aauaggcugauucaaucaaguguauguagaccuaaaacuacaccguagguugauucaaucaaga

SEQ ID NO: 558226 - RNA, 64 nt, Homo Sapiens
aguagguugauucaaucaagacugauagaccaaaaaacuacaccgagaacugacaacacuacuu

SEQ ID NO: 558227 - RNA, 64 nt, Homo Sapiens
agaacaaacagaucgaaccguuuccaucuuuacaaaacuacauguugaugaccaaaguccuuuu

SEQ ID NO: 558228 - RNA, 64 nt, Homo Sapiens
ucaaguauuugggaagugaaauguaaaggagucaaaacuacaaauugaaauuaagaaggcaaaa

SEQ ID NO: 558229 - RNA, 64 nt, Homo Sapiens; identical to SEQ ID NO: 93583

SEQ ID NO: 558230 - RNA, 64 nt, Homo Sapiens; identical to SEQ ID NO: 93584

SEQ ID NO: 558231 - RNA, 64 nt, Homo Sapiens; identical to SEQ ID NO: 93585

SEQ ID NO: 558232 - RNA, 64 nt, Homo Sapiens; identical to SEQ ID NO: 93586

SEQ ID NO: 558233 - RNA, 64 nt, Homo Sapiens; identical to SEQ ID NO: 93587

SEQ ID NO: 558234 - RNA, 64 nt, Homo Sapiens; identical to SEQ ID NO: 93588

SEQ ID NO: 558235 - RNA, 64 nt, Homo Sapiens; identical to SEQ ID NO: 93589

SEQ ID NO: 558236 - RNA, 64 nt, Homo Sapiens; identical to SEQ ID NO: 93590

SEQ ID NO: 558237 - RNA, 64 nt, Homo Sapiens; identical to SEQ ID NO: 93591

SEQ ID NO: 558238 - RNA, 64 nt, Homo Sapiens; identical to SEQ ID NO: 93592

SEQ ID NO: 558239 - RNA, 64 nt, Homo Sapiens; identical to SEQ ID NO: 93593

SEQ ID NO: 558240 - RNA, 64 nt, Homo Sapiens; identical to SEQ ID NO: 93594

SEQ ID NO: 558241 - RNA, 64 nt, Homo Sapiens; identical to SEQ ID NO: 93595

SEQ ID NO: 558242 - RNA, 64 nt, Homo Sapiens; identical to SEQ ID NO: 93596

SEQ ID NO: 558243 - RNA, 64 nt, Homo Sapiens; identical to SEQ ID NO: 145127

SEQ ID NO: 558244 - RNA, 64 nt, Homo Sapiens; identical to SEQ ID NO: 145128

SEQ ID NO: 558245 - RNA, 64 nt, Homo Sapiens; identical to SEQ ID NO: 266463

SEQ ID NO: 558246 - RNA, 64 nt, Homo Sapiens; identical to SEQ ID NO: 266464

SEQ ID NO: 558247 - RNA, 64 nt, Homo Sapiens; identical to SEQ ID NO: 266465

SEQ ID NO: 558248 - RNA, 64 nt, Homo Sapiens; identical to SEQ ID NO: 266466

SEQ ID NO: 558249 - RNA, 64 nt, Homo Sapiens; identical to SEQ ID NO: 266467

SEQ ID NO: 558250 - RNA, 64 nt, Homo Sapiens; identical to SEQ ID NO: 266468

SEQ ID NO: 558251 - RNA, 64 nt, Homo Sapiens; identical to SEQ ID NO: 266469

SEQ ID NO: 558252 - RNA, 64 nt, Homo Sapiens; identical to SEQ ID NO: 266470

SEQ ID NO: 558253 - RNA, 64 nt, Homo Sapiens; identical to SEQ ID NO: 266471

SEQ ID NO: 558254 - RNA, 64 nt, Homo Sapiens; identical to SEQ ID NO: 266472

SEQ ID NO: 558255 - RNA, 64 nt, Homo Sapiens; identical to SEQ ID NO: 266473

SEQ ID NO: 558256 - RNA, 64 nt, Homo Sapiens; identical to SEQ ID NO: 266474

SEQ ID NO: 558257 - RNA, 64 nt, Homo Sapiens; identical to SEQ ID NO: 266475

SEQ ID NO: 558258 - RNA, 64 nt, Homo Sapiens; identical to SEQ ID NO: 266476

SEQ ID NO: 558259 - RNA, 64 nt, Homo Sapiens; identical to SEQ ID NO: 266477

SEQ ID NO: 558260 - RNA, 64 nt, Homo Sapiens; identical to SEQ ID NO: 266478

SEQ ID NO: 558261 - RNA, 64 nt, Homo Sapiens; identical to SEQ ID NO: 266479

SEQ ID NO: 558262 - RNA, 64 nt, Homo Sapiens; identical to SEQ ID NO: 266480

SEQ ID NO: 558263 - RNA, 64 nt, Homo Sapiens; identical to SEQ ID NO: 266481

SEQ ID NO: 558264 - RNA, 64 nt, Homo Sapiens; identical to SEQ ID NO: 266482

SEQ ID NO: 558265 - RNA, 64 nt, Homo Sapiens; identical to SEQ ID NO: 266483

SEQ ID NO: 558266 - RNA, 64 nt, Homo Sapiens; identical to SEQ ID NO: 266484

SEQ ID NO: 558267 - RNA, 64 nt, Homo Sapiens; identical to SEQ ID NO: 266485

SEQ ID NO: 558268 - RNA, 64 nt, Homo Sapiens; identical to SEQ ID NO: 266486

SEQ ID NO: 558269 - RNA, 64 nt, Homo Sapiens; identical to SEQ ID NO: 266487

SEQ ID NO: 558270 - RNA, 64 nt, Homo Sapiens; identical to SEQ ID NO: 266488

SEQ ID NO: 558271 - RNA, 64 nt, Homo Sapiens; identical to SEQ ID NO: 266489

SEQ ID NO: 558272 - RNA, 64 nt, Homo Sapiens; identical to SEQ ID NO: 266490

SEQ ID NO: 558273 - RNA, 64 nt, Homo Sapiens; identical to SEQ ID NO: 266491

SEQ ID NO: 558274 - RNA, 64 nt, Homo Sapiens; identical to SEQ ID NO: 266492

SEQ ID NO: 558275 - RNA, 64 nt, Homo Sapiens; identical to SEQ ID NO: 266493

SEQ ID NO: 558276 - RNA, 64 nt, Homo Sapiens; identical to SEQ ID NO: 266494

SEQ ID NO: 558277 - RNA, 64 nt, Homo Sapiens; identical to SEQ ID NO: 266495

SEQ ID NO: 558278 - RNA, 64 nt, Homo Sapiens; identical to SEQ ID NO: 266496

SEQ ID NO: 558279 - RNA, 64 nt, Homo Sapiens; identical to SEQ ID NO: 266497

SEQ ID NO: 558280 - RNA, 64 nt, Homo Sapiens; identical to SEQ ID NO: 266498

SEQ ID NO: 558281 - RNA, 64 nt, Homo Sapiens; identical to SEQ ID NO: 266499

SEQ ID NO: 558282 - RNA, 64 nt, Homo Sapiens; identical to SEQ ID NO: 266500

SEQ ID NO: 558283 - RNA, 64 nt, Homo Sapiens; identical to SEQ ID NO: 266501

SEQ ID NO: 558284 - RNA, 64 nt, Homo Sapiens; identical to SEQ ID NO: 266502

SEQ ID NO: 558285 - RNA, 64 nt, Homo Sapiens; identical to SEQ ID NO: 266503

SEQ ID NO: 558286 - RNA, 64 nt, Homo Sapiens; identical to SEQ ID NO: 266504

SEQ ID NO: 558287 - RNA, 64 nt, Homo Sapiens; identical to SEQ ID NO: 266505

SEQ ID NO: 558288 - RNA, 64 nt, Homo Sapiens; identical to SEQ ID NO: 266506

SEQ ID NO: 558289 - RNA, 64 nt, Homo Sapiens; identical to SEQ ID NO: 266507

SEQ ID NO: 558290 - RNA, 64 nt, Homo Sapiens; identical to SEQ ID NO: 266508

SEQ ID NO: 558291 - RNA, 64 nt, Homo Sapiens; identical to SEQ ID NO: 266509

SEQ ID NO: 558292 - RNA, 64 nt, Homo Sapiens; identical to SEQ ID NO: 266510

SEQ ID NO: 558293 - RNA, 64 nt, Homo Sapiens; identical to SEQ ID NO: 266511

SEQ ID NO: 558294 - RNA, 64 nt, Homo Sapiens; identical to SEQ ID NO: 266512

SEQ ID NO: 558295 - RNA, 64 nt, Homo Sapiens; identical to SEQ ID NO: 266513

SEQ ID NO: 558296 - RNA, 64 nt, Homo Sapiens; identical to SEQ ID NO: 266514

SEQ ID NO: 558297 - RNA, 64 nt, Homo Sapiens; identical to SEQ ID NO: 266515

SEQ ID NO: 558298 - RNA, 64 nt, Homo Sapiens; identical to SEQ ID NO: 266516

SEQ ID NO: 558299 - RNA, 64 nt, Homo Sapiens; identical to SEQ ID NO: 266517

SEQ ID NO: 558300 - RNA, 64 nt, Homo Sapiens; identical to SEQ ID NO: 266518

SEQ ID NO: 558301 - RNA, 64 nt, Homo Sapiens; identical to SEQ ID NO: 266519

SEQ ID NO: 558302 - RNA, 64 nt, Homo Sapiens; identical to SEQ ID NO: 266520

SEQ ID NO: 558303 - RNA, 64 nt, Homo Sapiens; identical to SEQ ID NO: 266521

SEQ ID NO: 558304 - RNA, 64 nt, Homo Sapiens; identical to SEQ ID NO: 266522

SEQ ID NO: 558305 - RNA, 64 nt, Homo Sapiens; identical to SEQ ID NO: 266523

SEQ ID NO: 558306 - RNA, 64 nt, Homo Sapiens; identical to SEQ ID NO: 266524

SEQ ID NO: 558307 - RNA, 64 nt, Homo Sapiens; identical to SEQ ID NO: 266525

SEQ ID NO: 558308 - RNA, 64 nt, Homo Sapiens; identical to SEQ ID NO: 266526

SEQ ID NO: 558309 - RNA, 64 nt, Homo Sapiens; identical to SEQ ID NO: 266527

SEQ ID NO: 558310 - RNA, 64 nt, Homo Sapiens; identical to SEQ ID NO: 266528

SEQ ID NO: 558311 - RNA, 64 nt, Homo Sapiens; identical to SEQ ID NO: 266529

SEQ ID NO: 558312 - RNA, 64 nt, Homo Sapiens; identical to SEQ ID NO: 266530

SEQ ID NO: 558313 - RNA, 64 nt, Homo Sapiens; identical to SEQ ID NO: 266531

SEQ ID NO: 558314 - RNA, 64 nt, Homo Sapiens; identical to SEQ ID NO: 266532

SEQ ID NO: 558315 - RNA, 64 nt, Homo Sapiens; identical to SEQ ID NO: 266533

SEQ ID NO: 558316 - RNA, 64 nt, Homo Sapiens; identical to SEQ ID NO: 266534

SEQ ID NO: 558317 - RNA, 64 nt, Homo Sapiens; identical to SEQ ID NO: 266535

SEQ ID NO: 558318 - RNA, 64 nt, Homo Sapiens; identical to SEQ ID NO: 266536

SEQ ID NO: 558319 - RNA, 64 nt, Homo Sapiens; identical to SEQ ID NO: 266537

SEQ ID NO: 558320 - RNA, 64 nt, Homo Sapiens; identical to SEQ ID NO: 266538

SEQ ID NO: 558321 - RNA, 64 nt, Homo Sapiens; identical to SEQ ID NO: 266539

SEQ ID NO: 558322 - RNA, 64 nt, Homo Sapiens; identical to SEQ ID NO: 266540

SEQ ID NO: 558323 - RNA, 64 nt, Homo Sapiens; identical to SEQ ID NO: 266541

SEQ ID NO: 558324 - RNA, 64 nt, Homo Sapiens; identical to SEQ ID NO: 266542

SEQ ID NO: 558325 - RNA, 64 nt, Homo Sapiens; identical to SEQ ID NO: 266543

SEQ ID NO: 558326 - RNA, 64 nt, Homo Sapiens; identical to SEQ ID NO: 266544

SEQ ID NO: 558327 - RNA, 64 nt, Homo Sapiens; identical to SEQ ID NO: 266545

SEQ ID NO: 558328 - RNA, 64 nt, Homo Sapiens; identical to SEQ ID NO: 266546

SEQ ID NO: 558329 - RNA, 64 nt, Homo Sapiens; identical to SEQ ID NO: 266547

SEQ ID NO: 558330 - RNA, 64 nt, Homo Sapiens; identical to SEQ ID NO: 266548

SEQ ID NO: 558331 - RNA, 64 nt, Homo Sapiens; identical to SEQ ID NO: 266549

SEQ ID NO: 558332 - RNA, 64 nt, Homo Sapiens; identical to SEQ ID NO: 266550

SEQ ID NO: 558333 - RNA, 64 nt, Homo Sapiens; identical to SEQ ID NO: 266551

SEQ ID NO: 558334 - RNA, 64 nt, Homo Sapiens; identical to SEQ ID NO: 266552

SEQ ID NO: 558335 - RNA, 64 nt, Homo Sapiens; identical to SEQ ID NO: 266553

SEQ ID NO: 558336 - RNA, 64 nt, Homo Sapiens; identical to SEQ ID NO: 266554

SEQ ID NO: 558337 - RNA, 64 nt, Homo Sapiens; identical to SEQ ID NO: 266555

SEQ ID NO: 558338 - RNA, 64 nt, Homo Sapiens; identical to SEQ ID NO: 266556

SEQ ID NO: 558339 - RNA, 64 nt, Homo Sapiens; identical to SEQ ID NO: 266557

SEQ ID NO: 558340 - RNA, 64 nt, Homo Sapiens; identical to SEQ ID NO: 266558

SEQ ID NO: 558341 - RNA, 64 nt, Homo Sapiens; identical to SEQ ID NO: 266559

SEQ ID NO: 558342 - RNA, 64 nt, Homo Sapiens; identical to SEQ ID NO: 266560

SEQ ID NO: 558343 - RNA, 55 nt, Homo Sapiens; identical to SEQ ID NO: 266561

SEQ ID NO: 558344 - RNA, 64 nt, Homo Sapiens; identical to SEQ ID NO: 266562

SEQ ID NO: 558345 - RNA, 64 nt, Homo Sapiens; identical to SEQ ID NO: 266563

SEQ ID NO: 558346 - RNA, 64 nt, Homo Sapiens; identical to SEQ ID NO: 266564

SEQ ID NO: 558347 - RNA, 64 nt, Homo Sapiens; identical to SEQ ID NO: 266565

SEQ ID NO: 558348 - RNA, 64 nt, Homo Sapiens; identical to SEQ ID NO: 266566

SEQ ID NO: 558349 - RNA, 64 nt, Homo Sapiens; identical to SEQ ID NO: 266567

SEQ ID NO: 558350 - RNA, 64 nt, Homo Sapiens; identical to SEQ ID NO: 266568

SEQ ID NO: 558351 - RNA, 64 nt, Homo Sapiens; identical to SEQ ID NO: 266569

SEQ ID NO: 558352 - RNA, 64 nt, Homo Sapiens; identical to SEQ ID NO: 266570

SEQ ID NO: 558353 - RNA, 64 nt, Homo Sapiens; identical to SEQ ID NO: 266571

SEQ ID NO: 558354 - RNA, 64 nt, Homo Sapiens; identical to SEQ ID NO: 266572

SEQ ID NO: 558355 - RNA, 64 nt, Homo Sapiens; identical to SEQ ID NO: 266573

SEQ ID NO: 558356 - RNA, 64 nt, Homo Sapiens; identical to SEQ ID NO: 266574

SEQ ID NO: 558357 - RNA, 64 nt, Homo Sapiens; identical to SEQ ID NO: 266575

SEQ ID NO: 558358 - RNA, 60 nt, Homo Sapiens; identical to SEQ ID NO: 266576

SEQ ID NO: 558359 - RNA, 64 nt, Homo Sapiens; identical to SEQ ID NO: 266577

SEQ ID NO: 558360 - RNA, 64 nt, Homo Sapiens; identical to SEQ ID NO: 266578

SEQ ID NO: 558361 - RNA, 64 nt, Homo Sapiens; identical to SEQ ID NO: 266579

SEQ ID NO: 558362 - RNA, 64 nt, Homo Sapiens; identical to SEQ ID NO: 266580

SEQ ID NO: 558363 - RNA, 64 nt, Homo Sapiens; identical to SEQ ID NO: 266581

SEQ ID NO: 558364 - RNA, 64 nt, Homo Sapiens; identical to SEQ ID NO: 266582

SEQ ID NO: 558365 - RNA, 64 nt, Homo Sapiens; identical to SEQ ID NO: 266583

SEQ ID NO: 558366 - RNA, 64 nt, Homo Sapiens; identical to SEQ ID NO: 266584

SEQ ID NO: 558367 - RNA, 64 nt, Homo Sapiens; identical to SEQ ID NO: 266585

SEQ ID NO: 558368 - RNA, 64 nt, Homo Sapiens; identical to SEQ ID NO: 266586

SEQ ID NO: 558369 - RNA, 64 nt, Homo Sapiens; identical to SEQ ID NO: 266587

SEQ ID NO: 558370 - RNA, 64 nt, Homo Sapiens; identical to SEQ ID NO: 266588

SEQ ID NO: 558371 - RNA, 64 nt, Homo Sapiens; identical to SEQ ID NO: 266589

SEQ ID NO: 558372 - RNA, 64 nt, Homo Sapiens; identical to SEQ ID NO: 266590

SEQ ID NO: 558373 - RNA, 54 nt, Homo Sapiens; identical to SEQ ID NO: 266591

SEQ ID NO: 558374 - RNA, 64 nt, Homo Sapiens; identical to SEQ ID NO: 266592

SEQ ID NO: 558375 - RNA, 64 nt, Homo Sapiens; identical to SEQ ID NO: 266593

SEQ ID NO: 558376 - RNA, 64 nt, Homo Sapiens; identical to SEQ ID NO: 266594

SEQ ID NO: 558377 - RNA, 64 nt, Homo Sapiens; identical to SEQ ID NO: 266595

SEQ ID NO: 558378 - RNA, 64 nt, Homo Sapiens; identical to SEQ ID NO: 266596

SEQ ID NO: 558379 - RNA, 64 nt, Homo Sapiens; identical to SEQ ID NO: 266597

SEQ ID NO: 558380 - RNA, 64 nt, Homo Sapiens; identical to SEQ ID NO: 266598

SEQ ID NO: 558381 - RNA, 64 nt, Homo Sapiens; identical to SEQ ID NO: 266599

SEQ ID NO: 558382 - RNA, 64 nt, Homo Sapiens; identical to SEQ ID NO: 266600

SEQ ID NO: 558383 - RNA, 64 nt, Homo Sapiens; identical to SEQ ID NO: 266601

SEQ ID NO: 558384 - RNA, 64 nt, Homo Sapiens; identical to SEQ ID NO: 266602

SEQ ID NO: 558385 - RNA, 64 nt, Homo Sapiens; identical to SEQ ID NO: 266603

SEQ ID NO: 558386 - RNA, 64 nt, Homo Sapiens; identical to SEQ ID NO: 266604

SEQ ID NO: 558387 - RNA, 64 nt, Homo Sapiens; identical to SEQ ID NO: 266605

SEQ ID NO: 558388 - RNA, 64 nt, Homo Sapiens; identical to SEQ ID NO: 266606

SEQ ID NO: 558389 - RNA, 64 nt, Homo Sapiens; identical to SEQ ID NO: 266607

SEQ ID NO: 558390 - RNA, 64 nt, Homo Sapiens; identical to SEQ ID NO: 266608

SEQ ID NO: 558391 - RNA, 64 nt, Homo Sapiens; identical to SEQ ID NO: 266609

SEQ ID NO: 558392 - RNA, 64 nt, Homo Sapiens; identical to SEQ ID NO: 266610

SEQ ID NO: 558393 - RNA, 64 nt, Homo Sapiens; identical to SEQ ID NO: 266611

SEQ ID NO: 558394 - RNA, 64 nt, Homo Sapiens; identical to SEQ ID NO: 266612

SEQ ID NO: 558395 - RNA, 64 nt, Homo Sapiens; identical to SEQ ID NO: 266613

SEQ ID NO: 558396 - RNA, 64 nt, Homo Sapiens; identical to SEQ ID NO: 266614

SEQ ID NO: 558397 - RNA, 64 nt, Homo Sapiens; identical to SEQ ID NO: 266615

SEQ ID NO: 558398 - RNA, 64 nt, Homo Sapiens; identical to SEQ ID NO: 266616

SEQ ID NO: 558399 - RNA, 64 nt, Homo Sapiens; identical to SEQ ID NO: 266617

SEQ ID NO: 558400 - RNA, 64 nt, Homo Sapiens; identical to SEQ ID NO: 266618

SEQ ID NO: 558401 - RNA, 64 nt, Homo Sapiens; identical to SEQ ID NO: 266619

SEQ ID NO: 558402 - RNA, 64 nt, Homo Sapiens; identical to SEQ ID NO: 266620

SEQ ID NO: 558403 - RNA, 64 nt, Homo Sapiens; identical to SEQ ID NO: 266621

SEQ ID NO: 558404 - RNA, 64 nt, Homo Sapiens; identical to SEQ ID NO: 266622

SEQ ID NO: 558405 - RNA, 64 nt, Homo Sapiens; identical to SEQ ID NO: 266623

SEQ ID NO: 558406 - RNA, 64 nt, Homo Sapiens; identical to SEQ ID NO: 266624

SEQ ID NO: 558407 - RNA, 64 nt, Homo Sapiens; identical to SEQ ID NO: 266625

SEQ ID NO: 558408 - RNA, 64 nt, Homo Sapiens; identical to SEQ ID NO: 266626

SEQ ID NO: 558409 - RNA, 64 nt, Homo Sapiens; identical to SEQ ID NO: 266627

SEQ ID NO: 558410 - RNA, 64 nt, Homo Sapiens; identical to SEQ ID NO: 266628

SEQ ID NO: 558411 - RNA, 64 nt, Homo Sapiens; identical to SEQ ID NO: 266629

SEQ ID NO: 558412 - RNA, 64 nt, Homo Sapiens; identical to SEQ ID NO: 266630

SEQ ID NO: 558413 - RNA, 64 nt, Homo Sapiens; identical to SEQ ID NO: 266631

SEQ ID NO: 558414 - RNA, 64 nt, Homo Sapiens; identical to SEQ ID NO: 266632

SEQ ID NO: 558415 - RNA, 64 nt, Homo Sapiens
uaaauuaauagcagccucucaaguccauugaggccucauguaaaauucccauuuuucaucuuua

SEQ ID NO: 558416 - RNA, 64 nt, Homo Sapiens
uuacuuaaguugaaaaagcuucaacucucaaggacucauguauaccauauguuccacuuauugc

SEQ ID NO: 558417 - RNA, 64 nt, Homo Sapiens
ucauuggucuuuauauguagccacaaacacugaccucauguaggcaccuuaccaauauaugaca

SEQ ID NO: 558418 - RNA, 64 nt, Homo Sapiens
guuuuguuguuucaaccauaguuagagacaaauucucauguacuuucagaaaucaauaucugca

SEQ ID NO: 558419 - RNA, 64 nt, Homo Sapiens; identical to SEQ ID NO: 321937

SEQ ID NO: 558420 - RNA, 64 nt, Homo Sapiens; identical to SEQ ID NO: 321938

SEQ ID NO: 558421 - RNA, 64 nt, Homo Sapiens; identical to SEQ ID NO: 321939

SEQ ID NO: 558422 - RNA, 64 nt, Homo Sapiens; identical to SEQ ID NO: 321940

SEQ ID NO: 558423 - RNA, 64 nt, Homo Sapiens
acccuacuugcacugcuguggauuuuuuuaagagaagcaaaaacaaaaguaaacuccuuucccu

SEQ ID NO: 558424 - RNA, 64 nt, Homo Sapiens
cagggucauuugugugauguguuuggccuuaccaaagcaaaagagggugcaagaaugugggagu

SEQ ID NO: 558425 - RNA, 64 nt, Homo Sapiens
ccuuuauguauuuucuuaaagcacgccuuuaaauaagcaaaaacuuuaaaaggcaggaaagaga

SEQ ID NO: 558426 - RNA, 64 nt, Homo Sapiens
ccuccucugucucucauccuccuuucucccaucaaagcaaaauauggccucaccaccagcccca

SEQ ID NO: 558427 - RNA, 64 nt, Homo Sapiens
ugccaaagcuaguuuuagagaaugagaaagucuuaagcaaaauacucccaggucucacuccaga

SEQ ID NO: 558428 - RNA, 64 nt, Homo Sapiens
auugugugagcaauuaaacaugguugacuuuuucaagcaaaaaucaguucaucuuuugauguaa

SEQ ID NO: 558429 - RNA, 64 nt, Homo Sapiens
gaauuuuaucaaguccuuguauucuaaaauagccaagcaaaaugauaguaaauucuuugucuuu

SEQ ID NO: 558430 - RNA, 64 nt, Homo Sapiens
ggaaauaccuggauauuugcuagaggaaaaaugaaagcaaaacuucguacacagugccuugccc

SEQ ID NO: 558431 - RNA, 64 nt, Homo Sapiens
gaaauagcuuuaacuuugcuuaaacuacaaacacaagcaaaacuucacggggucauacuacaua

SEQ ID NO: 558432 - RNA, 64 nt, Homo Sapiens
caaaacuucacggggucauacuacauacaagcauaagcaaaacuuaacuuggaucauuucuggu

SEQ ID NO: 558433 - RNA, 64 nt, Homo Sapiens
cuuaagccagcaauuggcugggguccaggaaacaaagcaaaagcacaauaugugaaugugcuga

SEQ ID NO: 558434 - RNA, 64 nt, Homo Sapiens
cauggcacuuggaauccuugaguuaauuccagugaagcaaaacuugggaagagucaggauuggc

SEQ ID NO: 558435 - RNA, 64 nt, Homo Sapiens
aauggaaauuuauguuggcgauagccaagaccacaagcaaaagcacauacuggaaaugaugagu

SEQ ID NO: 558436 - RNA, 64 nt, Homo Sapiens
uaaguuccaaauauguuaagggcuuuaauacaaaaagcaaaaauugucaguguuuggaugaaaa

SEQ ID NO: 558437 - RNA, 64 nt, Homo Sapiens
cauggggcguacuauuuuuauugagcccaaaaacaagcaaaaccaaagaauauguagucuaagc

SEQ ID NO: 558438 - RNA, 64 nt, Homo Sapiens
uuguucgccuaucaucuggccacaugaggcugucaagcaaaagaauaggaguguaguugaguag

SEQ ID NO: 558439 - RNA, 64 nt, Homo Sapiens
gccuaaaaaaaaauuucuuaucauuguuucaaaaaagcaaaaucauggaaaauuuuuguugucc

SEQ ID NO: 558440 - RNA, 64 nt, Homo Sapiens
cuaaaccagaacaagcaacaaacuguauuuaugcaagcaaaauugaugagaaaauuauauucaa

SEQ ID NO: 558441 - RNA, 64 nt, Homo Sapiens
caagcaaaauugaugagaaaauuauauucaaauaaagcaaaaauuaaaaaaaaaaggcuauugc

SEQ ID NO: 558442 - RNA, 52 nt, Homo Sapiens
caacaucaacaaauaaauaagaaagcaaaaagaucugggauauguguuggaa

SEQ ID NO: 558443 - RNA, 64 nt, Homo Sapiens
uucucaucaucucuguuauacaccuguaucaugaaagcaaaaagaaguaaacaucaggagucag

SEQ ID NO: 558444 - RNA, 64 nt, Homo Sapiens
caaaaguggucucaaaauauuuuuuuaagaaaaaaagcaaaaacaauguauugcugauaaucag

SEQ ID NO: 558445 - RNA, 64 nt, Homo Sapiens
uacaucagacuuuuaaaaucuguaauauacaagcaagcaaaauuauuuuaaaugacuuaauugu

SEQ ID NO: 558446 - RNA, 64 nt, Homo Sapiens
agaaaccccugauaaacugaaaaaaaugaggaagaagcaaaagcacuucuuacauuguggcaag

SEQ ID NO: 558447 - RNA, 64 nt, Homo Sapiens
ggaaaccccugauaagccauagaaaaugaggaagaagcaaaaguacuucuuacauggcagcaag

SEQ ID NO: 558448 - RNA, 64 nt, Homo Sapiens
uugccaacugcuuaaccuagaaaaccagacagugaagcaaaauguugucacaagaaagcuuugu

SEQ ID NO: 558449 - RNA, 64 nt, Homo Sapiens
uacccuagggaagagccgguacgugggagaaagcaagcaaaagcgucagagagagagaggaugg

SEQ ID NO: 558450 - RNA, 64 nt, Homo Sapiens
gcuaacuaaaaccaaaaaaaccuguccagugugcaagcaaaaaguuguuccuucucaaggcgau

SEQ ID NO: 558451 - RNA, 64 nt, Homo Sapiens
uuucaguguccuuaaggguucuguaguguuaucaaagcaaaaagaaaaugcugcauaaaaauac

SEQ ID NO: 558452 - RNA, 64 nt, Homo Sapiens
aaaaguacaagcugggcaaacagauuaccauuagaagcaaaauuuuuuauuucaagggauaggg

SEQ ID NO: 558453 - RNA, 64 nt, Homo Sapiens
ugguuugaguuuucaaguuugaauuuaauucuaaaagcaaaaauaagauugaaaaacucaacaa

SEQ ID NO: 558454 - RNA, 64 nt, Homo Sapiens
uuauaaaaguaauuuuaauuacaaacauuaaugaaagcaaaacaaaucuuacauuuuugcaaua

SEQ ID NO: 558455 - RNA, 64 nt, Homo Sapiens
uuuaauauugcagggagccuaauaucuucagagaaagcaaaaucuaaagaugaucaugguucag

SEQ ID NO: 558456 - RNA, 64 nt, Homo Sapiens
cugaaaguuuuuauccaacaauuauguucauuuuaagcaaaauuuuaagaaaguuuugaaauuc

SEQ ID NO: 558457 - RNA, 64 nt, Homo Sapiens
aaauguugaguaaggugacauuuugagcgcuaauaagcaaaagagcaugcagugcuguugaaua

SEQ ID NO: 558458 - RNA, 64 nt, Homo Sapiens
gaggaagaguguuuacuaaauaaaugacuggggcaagcaaaauugaggaggaaauuagaaacug

SEQ ID NO: 558459 - RNA, 64 nt, Homo Sapiens
ugugaaugaucauuucaaauauauugaauaaaauaagcaaaagcuauuguuauuuacugauccu

SEQ ID NO: 558460 - RNA, 64 nt, Homo Sapiens
aagaagaagaaacagcagaaaaaaagcaaaagaaaagcaaaaaacaagcaaaaaucaggcugag

SEQ ID NO: 558461 - RNA, 64 nt, Homo Sapiens
aaagcaaaaaaaagaagaagaucaggcugagaaaaagcaaaagagaaaaagaagccaagcaaaa

SEQ ID NO: 558462 - RNA, 64 nt, Homo Sapiens
caggcugagaaaaagcaaaaaagaaaaagaagccaagcaaaaaucaugguauaaagaggaaacc

SEQ ID NO: 558463 - RNA, 64 nt, Homo Sapiens
guaagaugaagagagaggaacaaagcagcaaggcaagcaaaagcaccuucuuacugcaugauaa

SEQ ID NO: 558464 - RNA, 64 nt, Homo Sapiens
aaaaaacaaaaaagaccuucuaguaaaacuuaaaaagcaaaaacauacagcugucacucauuug

SEQ ID NO: 558465 - RNA, 64 nt, Homo Sapiens
agaucguucugccacuugcacugugcuugcuccuaagcaaaagggaaaaggagcgcgcgugaua

SEQ ID NO: 558466 - RNA, 64 nt, Homo Sapiens
aaaguagagcaaucguguauaagcuaauguuuaaaagcaaaacugcaaauuguagcccaguugg

SEQ ID NO: 558467 - RNA, 64 nt, Homo Sapiens
uuaggcugagcucaggaauuguccaaaaaggaaaaagcaaaauaauuaauugagaguauuuuuu

SEQ ID NO: 558468 - RNA, 64 nt, Homo Sapiens
cccucgccaacaaacaguugaaauuuaagggaagaagcaaaagcuaaacugucuuugacccuaa

SEQ ID NO: 558469 - RNA, 64 nt, Homo Sapiens
ggaaugauauuuuaggaauaacggacuuuuaaagaagcaaaaaaaaagacugaauuuccuugcu

SEQ ID NO: 558470 - RNA, 64 nt, Homo Sapiens
uuucauguuuaauuuguauuuguaaaaaaacaaaaagcaaaaaaauucccaaaacccagauaac

SEQ ID NO: 558471 - RNA, 64 nt, Homo Sapiens
cacaucucuuuucuggauccauuuucuuuuguaaaagcaaaagcaaaauaaacguguaagcaaa

SEQ ID NO: 558472 - RNA, 64 nt, Homo Sapiens
uucuuuuguaaaagcaaaaguaaaauaaacguguaagcaaaauuuaagucuuuauaaggaagaa

SEQ ID NO: 558473 - RNA, 64 nt, Homo Sapiens
cugagaaggaacagggaacaagaagguauuagcaaagcaaaaggugcagcagaggacagucugg

SEQ ID NO: 558474 - RNA, 64 nt, Homo Sapiens
aagggaccuucaugcccuucucuggguaagaagaaagcaaaagcacagaguauguccgauggua

SEQ ID NO: 558475 - RNA, 64 nt, Homo Sapiens
cuuguaaaccacaucuuuuuugcacuuuuuuuauaagcaaaaacgugccguuuaaaccacugga

SEQ ID NO: 558476 - RNA, 64 nt, Homo Sapiens
aaacaucuuuguacauuuaagucuguauuauaauaagcaaaaagauuguguguauguauguuua

SEQ ID NO: 558477 - RNA, 64 nt, Homo Sapiens
uugaugaucaggcagauuugaacaaaacaaaacaaagcaaaauagacuccagaaccauuaauaa

SEQ ID NO: 558478 - RNA, 64 nt, Homo Sapiens
uccagggguagggacugggaaccccauauuacuaaagcaaaauuaaaaugaaauuucugaucuc

SEQ ID NO: 558479 - RNA, 64 nt, Homo Sapiens
aaacaaaaagcaagccuguguauaugacaggacaaagcaaaaacgaagacucaucgcagugugu

SEQ ID NO: 558480 - RNA, 64 nt, Homo Sapiens
uugauugagauuuuuuacagcccaugcaaucaaaaagcaaaauuuuguuuucuguggguugcga

SEQ ID NO: 558481 - RNA, 64 nt, Homo Sapiens
augacuuggauauaugguugaagaaucaaaacaaaagcaaaaaaaaaaagcaaaaaaagaaaag

SEQ ID NO: 558482 - RNA, 64 nt, Homo Sapiens
augguugaagaaucaaaacaaaagcaaaaaaaaaaagcaaaaaaagaaaagagaaaaaaagaaa

SEQ ID NO: 558483 - RNA, 64 nt, Homo Sapiens
ucacaaaugggaucuaauuaaacaauugcaacagaagcaaaaauuucaugacgaagacgccaaa

SEQ ID NO: 558484 - RNA, 64 nt, Homo Sapiens
aacaaagcuggaggcaucacaguaaggcaauccuaagcaaaaagaaaucuaaagaaauauugau

SEQ ID NO: 558485 - RNA, 64 nt, Homo Sapiens
uuguaaaacucguuuguuuucaaaggucuggacuaagcaaaacaacagugucaguuuaggaaau

SEQ ID NO: 558486 - RNA, 64 nt, Homo Sapiens
gaaugcucccccaacauuccuuugguuuuccuauaagcaaaaccaaauaccacuauaaauacaa

SEQ ID NO: 558487 - RNA, 64 nt, Homo Sapiens
ugagugacagagagagauucaaaaaacaaaaaaaaagcaaaaauauacuuugcuauuggguaag

SEQ ID NO: 558488 - RNA, 64 nt, Homo Sapiens
auuucuuguguaauaccugacaaacaggcaaccaaagcaaaaguggacaaaugggaucacauca

SEQ ID NO: 558489 - RNA, 64 nt, Homo Sapiens
ucuuacauggcggcagcaagagaaaaugagaaagaagcaaaaguggaaaccccuaauaaaccua

SEQ ID NO: 558490 - RNA, 64 nt, Homo Sapiens
ucguacauggugguggcaagagaaaaugaagaagaagcaaaaguggaaaccccugauaaaccca

SEQ ID NO: 558491 - RNA, 64 nt, Homo Sapiens
gcaaaaaaguacuaagauguugacaaaaccgaaaaagcaaaacuagggucugacuucacagcua

SEQ ID NO: 558492 - RNA, 64 nt, Homo Sapiens
ggugacugauaccuaaaagccguuccuauuauugaagcaaaaagacauaggcagcugcacugcg

SEQ ID NO: 558493 - RNA, 64 nt, Homo Sapiens
caaaaacaagucccaugucccaaaaaaaaccaaaaagcaaaaaaggggccauaucauucauggc

SEQ ID NO: 558494 - RNA, 64 nt, Homo Sapiens
gaaggaacaggaaugaaagguaaaaacuguucaaaagcaaaagagacuuagcuauuaguauauu

SEQ ID NO: 558495 - RNA, 64 nt, Homo Sapiens
ggcaguggugcagcauuccuaccuagugucauaaaagcaaaauacuuacauagcuuucuuaaaa

SEQ ID NO: 558496 - RNA, 64 nt, Homo Sapiens
ugucuucauuaccauuaccucuacacugcagaagaagcaaaacuccuuuauuagaauuacugca

SEQ ID NO: 558497 - RNA, 64 nt, Homo Sapiens
ggauguucaccauaacccagguagggugagggauaagcaaaagacaagcaauugcugcaucuua

SEQ ID NO: 558498 - RNA, 64 nt, Homo Sapiens
uagagcccuguaucaacccauaacaaugucuuguaagcaaaaggaaaaaacucauggugaggcu

SEQ ID NO: 558499 - RNA, 64 nt, Homo Sapiens
cuaagccuggaagccauccugcccuucugacccaaagcaaaacaucacauuccagucugaagug

SEQ ID NO: 558500 - RNA, 64 nt, Homo Sapiens
uaggugaugggcagaucuuuucuuuaaaauaaaaaagcaaaaacucuugugguaccuagucaga

SEQ ID NO: 558501 - RNA, 64 nt, Homo Sapiens
caguagucagggcagcagggcugccucucaucuaaagcaaaacuaccuuccucacagaaaacgc

SEQ ID NO: 558502 - RNA, 64 nt, Homo Sapiens
uugacagugucuccuuacuuugaaguuuucaccaaagcaaaaagguccauauccaauaguaucc

SEQ ID NO: 558503 - RNA, 64 nt, Homo Sapiens
cauaguacuuaauuuguuuacuuugucacuuuauaagcaaaaugauuauauaaugcuuaaaaua

SEQ ID NO: 558504 - RNA, 64 nt, Homo Sapiens
ugauuuucuacauaauuuuuccuucuuaagaauaaagcaaaaggucuacuuuuaaaacggaugg

SEQ ID NO: 558505 - RNA, 64 nt, Homo Sapiens
acacuaauucaucuguaauugagucagagaagagaagcaaaaggaaaaugucucuggacaaaga

SEQ ID NO: 558506 - RNA, 64 nt, Homo Sapiens
cagagcaacugaguacugauuagguuauaauuauaagcaaaauugggguucuucugugauuaaa

SEQ ID NO: 558507 - RNA, 64 nt, Homo Sapiens
aaaaaaaaaaaacaaaaaaauuauauucuggggaaagcaaaaacuucugaaaaaacacuccaug

SEQ ID NO: 558508 - RNA, 64 nt, Homo Sapiens
cuuuggguuuauuuugggauuuucuuaaccgugaaagcaaaagcuugaagaaaacguauaaauc

SEQ ID NO: 558509 - RNA, 64 nt, Homo Sapiens
accaaaaaagagcccaaaaagccaaagcaauccuaagcaaaaagaacaaagcuggaggcaucgc

SEQ ID NO: 558510 - RNA, 64 nt, Homo Sapiens
uucaugacaaagaucccaaaaauaauuguaacgaaagcaaaaauugacaaaugggacaugauua

SEQ ID NO: 558511 - RNA, 64 nt, Homo Sapiens
agcuugcugauauuuuauauaaaaaagaaaagcaaagcaaaagagaagcugauagucuugaaua

SEQ ID NO: 558512 - RNA, 64 nt, Homo Sapiens
ccagcaggaaaaucauguaaguuauaccaccagaaagcaaaaggagcaugguuuggugguuaag

SEQ ID NO: 558513 - RNA, 64 nt, Homo Sapiens
uaaaaaaucaaucaauggugcaaaaaaaaacuuaaagcaaaauaguauugcugaacucuuaggc

SEQ ID NO: 558514 - RNA, 64 nt, Homo Sapiens
acucaaaugagaugggaugaaauccuaugacaguaagcaaaaacagaaccaugaaaaaugauug

SEQ ID NO: 558515 - RNA, 64 nt, Homo Sapiens
cuaugcuggacucacagccaaauuaauacugaacaagcaaaagcuggaagcauuccccuugaga

SEQ ID NO: 558516 - RNA, 64 nt, Homo Sapiens
agaaaagcccaaccuaaauagcaaaagcaauccuaagcaaaaagagcaauguuugagguaucac

SEQ ID NO: 558517 - RNA, 64 nt, Homo Sapiens
ccacaauuagacugacagcucaaaacaaacaaacaagcaaaaaaccaacucagaaaaagcaaaa

SEQ ID NO: 558518 - RNA, 64 nt, Homo Sapiens
aaacaaacaaacaagcaaaacuccaacucagaaaaagcaaaacagccugggcaacagagcgaga

SEQ ID NO: 558519 - RNA, 64 nt, Homo Sapiens
acaggaaaugugggaaaauauaagaggaacaaagaagcaaaacauuaaaaaaaagaacaaaaua

SEQ ID NO: 558520 - RNA, 64 nt, Homo Sapiens
aaaaaacaaaaaaaacaaaagggagaccuuccaaaagcaaaaacggagacccagacccuccgcu

SEQ ID NO: 558521 - RNA, 64 nt, Homo Sapiens
uuucguaaucuucaucaagaaguuuuuaaaaggcaagcaaaaacagaagcaaaucauaucaaac

SEQ ID NO: 558522 - RNA, 64 nt, Homo Sapiens
auggaaagaaacguaaaaagcugugccaaaaaaaaagcaaaaugcugugauaaaccaaacaggg

SEQ ID NO: 558523 - RNA, 64 nt, Homo Sapiens
ggcuccaucccuggcuuccccagccugcggccgcaagcaaaaccaagcgcgagaugcagcuagc

SEQ ID NO: 558524 - RNA, 64 nt, Homo Sapiens
uuauaaaagccagcaggcuucaaacuaggggacaaagcaaaaagugaugauagugguggaguua

SEQ ID NO: 558525 - RNA, 64 nt, Homo Sapiens
auuaauuccuuuccagguauuuuauaauucugggaagcaaaacccaugccucccccuagccauu

SEQ ID NO: 558526 - RNA, 64 nt, Homo Sapiens
aagaacaaaaacaccaaaucuugcuuugaagaaaaagcaaaaacuuaaagaccaaaucauuugu

SEQ ID NO: 558527 - RNA, 64 nt, Homo Sapiens
ucuucuucacggcauaaggaccuaagcagaccagaagcaaaauggccuggaacaaagaacugca

SEQ ID NO: 558528 - RNA, 64 nt, Homo Sapiens
cccaccccuccuggucuguauccaggcuggaccagacccccaucacucagaguccugcugccgc

SEQ ID NO: 558529 - RNA, 64 nt, Homo Sapiens
ugaaguagaacuuaagagagaggaaccugagcaggacccccaccggaggggauaagguggcaga

SEQ ID NO: 558530 - RNA, 64 nt, Homo Sapiens
uccuccgcuccgcccggcccugugaccccggcgggacccccauggcaggaucgcugcucagacc

SEQ ID NO: 558531 - RNA, 64 nt, Homo Sapiens
ccuuuguuguuugaauggaaccacccuucucagggacccccacgggaggagggggccgugccuc

SEQ ID NO: 558532 - RNA, 64 nt, Homo Sapiens
ugccgcagcccuggucucuggccuggcacucagggacccccagccccacaggacgugugguggc

SEQ ID NO: 558533 - RNA, 64 nt, Homo Sapiens
cccccuccccugcugcuuugaucccccaccccaggacccccaggaggaugggcccaggccuggg

SEQ ID NO: 558534 - RNA, 64 nt, Homo Sapiens
cugggggaugcugggagugaugagugaaggaggggacccccaucucugcggaggggaagugucc

SEQ ID NO: 558535 - RNA, 64 nt, Homo Sapiens
augcccuaugaccccccaucuuuccuccgccccugacccccaccacccugcugcucggacuaug

SEQ ID NO: 558536 - RNA, 64 nt, Homo Sapiens
cuccuggcugcuucagcagguggauccauucuucgacccccagaugugacucuaaagaaggcug

SEQ ID NO: 558537 - RNA, 64 nt, Homo Sapiens
ggugccugcccccugccgggcagcuuuaaggacagacccccaggggcaguuuagccucaggcac

SEQ ID NO: 558538 - RNA, 64 nt, Homo Sapiens
ugagcuggggguccgcaucccuaccucagcuuaggacccccagagccaagguggcugggaucug

SEQ ID NO: 558539 - RNA, 64 nt, Homo Sapiens
gagccaccccccucagccccguucggcucagaccgacccccacuccauccccagaccugcagca

SEQ ID NO: 558540 - RNA, 64 nt, Homo Sapiens
cuccgccagccccuccaccccugggaggugggcggacccccaggaugggcaagugcaaggugua

SEQ ID NO: 558541 - RNA, 64 nt, Homo Sapiens
agguagcauuccccagcccucuguccgggccacagacccccagcauacggccccccagacccag

SEQ ID NO: 558542 - RNA, 54 nt, Homo Sapiens
cccgggccccagcccgcggcagacgacccccagcgcuguacgggugggcaguag

SEQ ID NO: 558543 - RNA, 64 nt, Homo Sapiens
accaccuguccagcuucuuccuggucagggcugggacccccaggaauauuauguugccgugugu

SEQ ID NO: 558544 - RNA, 64 nt, Homo Sapiens
ugcugcuuaccccuagccuugaugccugcccagggacccccagcccccucccguugcccugcag

SEQ ID NO: 558545 - RNA, 64 nt, Homo Sapiens
agccaagucagcuuugccuuccacgcugucuccagacccccaccccuuccccacugccugccca

SEQ ID NO: 558546 - RNA, 64 nt, Homo Sapiens
cuuuuggcccccgagcugggggccaugagcuccagacccccagcaacccuccuaucaccucccc

SEQ ID NO: 558547 - RNA, 64 nt, Homo Sapiens
uuuggagauucaaaacuucugcccgguccaccuagacccccacgcagggcgcccccccaccccc

SEQ ID NO: 558548 - RNA, 64 nt, Homo Sapiens
gaccaccccucagggcgccccuuacaaccggcgggacccccaggugccgccuuccuucacggca

SEQ ID NO: 558549 - RNA, 64 nt, Homo Sapiens
cccgacccucgcgaauaaaacuguccccaccuaggacccccacccauuccucgguauuuauugu

SEQ ID NO: 558550 - RNA, 64 nt, Homo Sapiens
aaccccaauccacguuuuggcugacaggcuacaggacccccaacugaccucguccuccgacucg

SEQ ID NO: 558551 - RNA, 64 nt, Homo Sapiens
agggcuucaggcccgaaggucucucuggcucuaggacccccagugcucacacaaucagaccaag

SEQ ID NO: 558552 - RNA, 64 nt, Homo Sapiens
cccccagugcucacacaaucagaccaaggaacaagacccccaggaaggaaacagauuuaagcaa

SEQ ID NO: 558553 - RNA, 64 nt, Homo Sapiens
uuuccuucccuuggaugcuuaggccaaguggacugacccccagaucccucucaggcagaugccg

SEQ ID NO: 558554 - RNA, 64 nt, Homo Sapiens
agagguucaccugccaacagaccuucuggagcgagacccccagaagccaaagacuucauccggc

SEQ ID NO: 558555 - RNA, 64 nt, Homo Sapiens
uauccccuuggcagcagagaaaacccacugaaagaucguagaguggcacaugcuuacagggcau

SEQ ID NO: 558556 - RNA, 64 nt, Homo Sapiens
aauauauauucagaauaauaaccaauuaguuacuaucguagaguuagaccauagcugcagguua

SEQ ID NO: 558557 - RNA, 64 nt, Homo Sapiens
agauguggcaaagugcuguacaggcacugguggcaucguagaagggcaaaacacgcaagggcau

SEQ ID NO: 558558 - RNA, 64 nt, Homo Sapiens
cagggaugauucccacccaagucuccuugagaugaucguagacaguugugccuucccuucucug

SEQ ID NO: 558559 - RNA, 64 nt, Homo Sapiens
uuuuugcuguuccauucuguugugcuuucaaccaaucguagaugacaaacaugugguuuuucug

SEQ ID NO: 558560 - RNA, 64 nt, Homo Sapiens
aacaaaugaaccaccguagcugacagagaaccguaucguagagguuuguaguuagugcuuauuu

SEQ ID NO: 558561 - RNA, 64 nt, Homo Sapiens
uguaaaccagaauagcuuuaaaaagacaaaaaggaucguagaucugauuuuuaaaugguugguu

SEQ ID NO: 558562 - RNA, 64 nt, Homo Sapiens
auugaaugucaaaaaaagcuuauaugagacuugaaucguagaaauacuugcauuuauacgaaca

SEQ ID NO: 558563 - RNA, 64 nt, Homo Sapiens
uaacucccccugaaauaaaguacaaaaguuuuaaaucguagacguaaaauuuuggccagaacau

SEQ ID NO: 558564 - RNA, 64 nt, Homo Sapiens
auuugcuuuaauuaauuaagaaagcucacugcugaucguagaaaaacacuuagugaucauuuaa

SEQ ID NO: 558565 - RNA, 64 nt, Homo Sapiens
cugaaauaaacaggaacaaacauuuucaguccuaaucguagaaucauguccucacaggccugcu

SEQ ID NO: 558566 - RNA, 64 nt, Homo Sapiens
cccaugagcauuugacuucccuuacucuuugaugaucguagagaaagacuugguaauuuaucua

SEQ ID NO: 558567 - RNA, 64 nt, Homo Sapiens
cugguuggacuuggcuuccuuuaauugcucugccaucguagagccugggaagagcccacucagc

SEQ ID NO: 558568 - RNA, 64 nt, Homo Sapiens
aaguguagcuccucuggagauggagagcucuuucaucguagaacugaaggaguuucucacauuu

SEQ ID NO: 558569 - RNA, 64 nt, Homo Sapiens
cucuguaaaucugcaauuucuaccaaaaugugugaucguagaucucaaaggaucuugcuuuaac

SEQ ID NO: 558570 - RNA, 64 nt, Homo Sapiens
gcagaucuguggaagaacaauccagggcugagaaaucguagagcagugaggcaggcugggagca

SEQ ID NO: 558571 - RNA, 64 nt, Homo Sapiens
cacagaaugggacuggggaacagcgccuggagcgaucguagaaaaaggaaguggagaguaaaga

SEQ ID NO: 558572 - RNA, 64 nt, Homo Sapiens
uggucaaagucgaauuacuaucuauuuaucuuauaucguagaucugauaacccuaucuaaaaga

SEQ ID NO: 558573 - RNA, 64 nt, Homo Sapiens
aauuuguauaauaaagcuuucagguguuacagaaaucguagacaagcaagugcacaugauaaac

SEQ ID NO: 558574 - RNA, 64 nt, Homo Sapiens
cccagggucgugagguuucuggugaaaagguuaaaucguagaagcuaguauauuuuuuauauuu

SEQ ID NO: 558575 - RNA, 64 nt, Homo Sapiens
gccacguggguggcccgaccucugaccugcugucaucguagagguagaaagcaaacaaucuggg

SEQ ID NO: 558576 - RNA, 64 nt, Homo Sapiens
ugcugcugaugaaaauacuccggaggaaggggagaucguagauuguucuuucucuugcagcugu

SEQ ID NO: 558577 - RNA, 64 nt, Homo Sapiens
augagauuuuauuuuuugugagugagacugagggaucguagauuuuuacaaucuguaucuuuga

SEQ ID NO: 558578 - RNA, 64 nt, Homo Sapiens
guuugucucucuguaccuggccaaauauagugagaucguagagugaggucgacuauuuuagguu

SEQ ID NO: 558579 - RNA, 64 nt, Homo Sapiens
ggauauuaacauaaaauuauauuaauaaguagauaucguagaaauaguguuguuaccugccaag

SEQ ID NO: 558580 - RNA, 64 nt, Homo Sapiens; identical to SEQ ID NO: 80199

SEQ ID NO: 558581 - RNA, 64 nt, Homo Sapiens; identical to SEQ ID NO: 80200

SEQ ID NO: 558582 - RNA, 64 nt, Homo Sapiens; identical to SEQ ID NO: 80201

SEQ ID NO: 558583 - RNA, 64 nt, Homo Sapiens; identical to SEQ ID NO: 80202

SEQ ID NO: 558584 - RNA, 64 nt, Homo Sapiens; identical to SEQ ID NO: 80203

SEQ ID NO: 558585 - RNA, 64 nt, Homo Sapiens; identical to SEQ ID NO: 80204

SEQ ID NO: 558586 - RNA, 64 nt, Homo Sapiens; identical to SEQ ID NO: 80205

SEQ ID NO: 558587 - RNA, 64 nt, Homo Sapiens; identical to SEQ ID NO: 80206

SEQ ID NO: 558588 - RNA, 64 nt, Homo Sapiens; identical to SEQ ID NO: 80207

SEQ ID NO: 558589 - RNA, 64 nt, Homo Sapiens; identical to SEQ ID NO: 80208

SEQ ID NO: 558590 - RNA, 64 nt, Homo Sapiens; identical to SEQ ID NO: 80209

SEQ ID NO: 558591 - RNA, 64 nt, Homo Sapiens; identical to SEQ ID NO: 80210

SEQ ID NO: 558592 - RNA, 64 nt, Homo Sapiens; identical to SEQ ID NO: 80211

SEQ ID NO: 558593 - RNA, 64 nt, Homo Sapiens; identical to SEQ ID NO: 80212

SEQ ID NO: 558594 - RNA, 64 nt, Homo Sapiens; identical to SEQ ID NO: 80213

SEQ ID NO: 558595 - RNA, 64 nt, Homo Sapiens; identical to SEQ ID NO: 80214

SEQ ID NO: 558596 - RNA, 64 nt, Homo Sapiens; identical to SEQ ID NO: 80215

SEQ ID NO: 558597 - RNA, 64 nt, Homo Sapiens; identical to SEQ ID NO: 80216

SEQ ID NO: 558598 - RNA, 64 nt, Homo Sapiens; identical to SEQ ID NO: 80217

SEQ ID NO: 558599 - RNA, 64 nt, Homo Sapiens; identical to SEQ ID NO: 80218

SEQ ID NO: 558600 - RNA, 64 nt, Homo Sapiens; identical to SEQ ID NO: 80219

SEQ ID NO: 558601 - RNA, 64 nt, Homo Sapiens; identical to SEQ ID NO: 80220

SEQ ID NO: 558602 - RNA, 64 nt, Homo Sapiens; identical to SEQ ID NO: 80221

SEQ ID NO: 558603 - RNA, 64 nt, Homo Sapiens; identical to SEQ ID NO: 80222

SEQ ID NO: 558604 - RNA, 64 nt, Homo Sapiens; identical to SEQ ID NO: 80223

SEQ ID NO: 558605 - RNA, 64 nt, Homo Sapiens; identical to SEQ ID NO: 80224

SEQ ID NO: 558606 - RNA, 64 nt, Homo Sapiens; identical to SEQ ID NO: 80225

SEQ ID NO: 558607 - RNA, 64 nt, Homo Sapiens; identical to SEQ ID NO: 80226

SEQ ID NO: 558608 - RNA, 64 nt, Homo Sapiens; identical to SEQ ID NO: 80227

SEQ ID NO: 558609 - RNA, 64 nt, Homo Sapiens; identical to SEQ ID NO: 80228

SEQ ID NO: 558610 - RNA, 64 nt, Homo Sapiens; identical to SEQ ID NO: 80229

SEQ ID NO: 558611 - RNA, 64 nt, Homo Sapiens; identical to SEQ ID NO: 80230

SEQ ID NO: 558612 - RNA, 64 nt, Homo Sapiens; identical to SEQ ID NO: 80231

SEQ ID NO: 558613 - RNA, 52 nt, Homo Sapiens; identical to SEQ ID NO: 80232

SEQ ID NO: 558614 - RNA, 64 nt, Homo Sapiens; identical to SEQ ID NO: 80233

SEQ ID NO: 558615 - RNA, 64 nt, Homo Sapiens; identical to SEQ ID NO: 80234

SEQ ID NO: 558616 - RNA, 64 nt, Homo Sapiens; identical to SEQ ID NO: 80235

SEQ ID NO: 558617 - RNA, 64 nt, Homo Sapiens; identical to SEQ ID NO: 80236

SEQ ID NO: 558618 - RNA, 64 nt, Homo Sapiens; identical to SEQ ID NO: 80237

SEQ ID NO: 558619 - RNA, 64 nt, Homo Sapiens; identical to SEQ ID NO: 80238

SEQ ID NO: 558620 - RNA, 64 nt, Homo Sapiens; identical to SEQ ID NO: 80239

SEQ ID NO: 558621 - RNA, 64 nt, Homo Sapiens; identical to SEQ ID NO: 80240

SEQ ID NO: 558622 - RNA, 64 nt, Homo Sapiens; identical to SEQ ID NO: 80241

SEQ ID NO: 558623 - RNA, 64 nt, Homo Sapiens; identical to SEQ ID NO: 80242

SEQ ID NO: 558624 - RNA, 64 nt, Homo Sapiens; identical to SEQ ID NO: 80243

SEQ ID NO: 558625 - RNA, 64 nt, Homo Sapiens; identical to SEQ ID NO: 80244

SEQ ID NO: 558626 - RNA, 64 nt, Homo Sapiens; identical to SEQ ID NO: 80245

SEQ ID NO: 558627 - RNA, 64 nt, Homo Sapiens; identical to SEQ ID NO: 80246

SEQ ID NO: 558628 - RNA, 64 nt, Homo Sapiens; identical to SEQ ID NO: 80247

SEQ ID NO: 558629 - RNA, 64 nt, Homo Sapiens; identical to SEQ ID NO: 80248

SEQ ID NO: 558630 - RNA, 64 nt, Homo Sapiens; identical to SEQ ID NO: 80249

SEQ ID NO: 558631 - RNA, 64 nt, Homo Sapiens; identical to SEQ ID NO: 80250

SEQ ID NO: 558632 - RNA, 64 nt, Homo Sapiens; identical to SEQ ID NO: 80251

SEQ ID NO: 558633 - RNA, 64 nt, Homo Sapiens; identical to SEQ ID NO: 80252

SEQ ID NO: 558634 - RNA, 64 nt, Homo Sapiens; identical to SEQ ID NO: 80253

SEQ ID NO: 558635 - RNA, 64 nt, Homo Sapiens; identical to SEQ ID NO: 80254

SEQ ID NO: 558636 - RNA, 64 nt, Homo Sapiens; identical to SEQ ID NO: 80255

SEQ ID NO: 558637 - RNA, 64 nt, Homo Sapiens; identical to SEQ ID NO: 80256

SEQ ID NO: 558638 - RNA, 64 nt, Homo Sapiens; identical to SEQ ID NO: 80257

SEQ ID NO: 558639 - RNA, 64 nt, Homo Sapiens; identical to SEQ ID NO: 80258

SEQ ID NO: 558640 - RNA, 64 nt, Homo Sapiens; identical to SEQ ID NO: 80259

SEQ ID NO: 558641 - RNA, 64 nt, Homo Sapiens; identical to SEQ ID NO: 80260

SEQ ID NO: 558642 - RNA, 64 nt, Homo Sapiens; identical to SEQ ID NO: 80261

SEQ ID NO: 558643 - RNA, 64 nt, Homo Sapiens; identical to SEQ ID NO: 80262

SEQ ID NO: 558644 - RNA, 64 nt, Homo Sapiens; identical to SEQ ID NO: 80263

SEQ ID NO: 558645 - RNA, 64 nt, Homo Sapiens; identical to SEQ ID NO: 80264

SEQ ID NO: 558646 - RNA, 64 nt, Homo Sapiens; identical to SEQ ID NO: 80265

SEQ ID NO: 558647 - RNA, 64 nt, Homo Sapiens; identical to SEQ ID NO: 80266

SEQ ID NO: 558648 - RNA, 64 nt, Homo Sapiens; identical to SEQ ID NO: 80267

SEQ ID NO: 558649 - RNA, 64 nt, Homo Sapiens; identical to SEQ ID NO: 80268

SEQ ID NO: 558650 - RNA, 64 nt, Homo Sapiens; identical to SEQ ID NO: 80269

SEQ ID NO: 558651 - RNA, 64 nt, Homo Sapiens; identical to SEQ ID NO: 80270

SEQ ID NO: 558652 - RNA, 64 nt, Homo Sapiens; identical to SEQ ID NO: 80271

SEQ ID NO: 558653 - RNA, 64 nt, Homo Sapiens; identical to SEQ ID NO: 80272

SEQ ID NO: 558654 - RNA, 64 nt, Homo Sapiens; identical to SEQ ID NO: 80273

SEQ ID NO: 558655 - RNA, 64 nt, Homo Sapiens; identical to SEQ ID NO: 80274

SEQ ID NO: 558656 - RNA, 64 nt, Homo Sapiens; identical to SEQ ID NO: 80275

SEQ ID NO: 558657 - RNA, 64 nt, Homo Sapiens; identical to SEQ ID NO: 80276

SEQ ID NO: 558658 - RNA, 64 nt, Homo Sapiens; identical to SEQ ID NO: 80277

SEQ ID NO: 558659 - RNA, 64 nt, Homo Sapiens; identical to SEQ ID NO: 80278

SEQ ID NO: 558660 - RNA, 64 nt, Homo Sapiens; identical to SEQ ID NO: 80279

SEQ ID NO: 558661 - RNA, 64 nt, Homo Sapiens; identical to SEQ ID NO: 80280

SEQ ID NO: 558662 - RNA, 64 nt, Homo Sapiens; identical to SEQ ID NO: 80281

SEQ ID NO: 558663 - RNA, 64 nt, Homo Sapiens; identical to SEQ ID NO: 80282

SEQ ID NO: 558664 - RNA, 64 nt, Homo Sapiens; identical to SEQ ID NO: 80283

SEQ ID NO: 558665 - RNA, 64 nt, Homo Sapiens; identical to SEQ ID NO: 80284

SEQ ID NO: 558666 - RNA, 64 nt, Homo Sapiens; identical to SEQ ID NO: 80285

SEQ ID NO: 558667 - RNA, 64 nt, Homo Sapiens; identical to SEQ ID NO: 80286

SEQ ID NO: 558668 - RNA, 64 nt, Homo Sapiens; identical to SEQ ID NO: 80287

SEQ ID NO: 558669 - RNA, 64 nt, Homo Sapiens; identical to SEQ ID NO: 80288

SEQ ID NO: 558670 - RNA, 64 nt, Homo Sapiens; identical to SEQ ID NO: 80289

SEQ ID NO: 558671 - RNA, 64 nt, Homo Sapiens; identical to SEQ ID NO: 80290

SEQ ID NO: 558672 - RNA, 64 nt, Homo Sapiens; identical to SEQ ID NO: 80291

SEQ ID NO: 558673 - RNA, 64 nt, Homo Sapiens; identical to SEQ ID NO: 80292

SEQ ID NO: 558674 - RNA, 64 nt, Homo Sapiens; identical to SEQ ID NO: 80293

SEQ ID NO: 558675 - RNA, 64 nt, Homo Sapiens; identical to SEQ ID NO: 80294

SEQ ID NO: 558676 - RNA, 64 nt, Homo Sapiens; identical to SEQ ID NO: 80295

SEQ ID NO: 558677 - RNA, 64 nt, Homo Sapiens; identical to SEQ ID NO: 80296

SEQ ID NO: 558678 - RNA, 64 nt, Homo Sapiens; identical to SEQ ID NO: 80297

SEQ ID NO: 558679 - RNA, 64 nt, Homo Sapiens; identical to SEQ ID NO: 80298

SEQ ID NO: 558680 - RNA, 64 nt, Homo Sapiens; identical to SEQ ID NO: 80299

SEQ ID NO: 558681 - RNA, 64 nt, Homo Sapiens; identical to SEQ ID NO: 80300

SEQ ID NO: 558682 - RNA, 64 nt, Homo Sapiens; identical to SEQ ID NO: 80301

SEQ ID NO: 558683 - RNA, 64 nt, Homo Sapiens; identical to SEQ ID NO: 80302

SEQ ID NO: 558684 - RNA, 64 nt, Homo Sapiens; identical to SEQ ID NO: 80303

SEQ ID NO: 558685 - RNA, 64 nt, Homo Sapiens; identical to SEQ ID NO: 80304

SEQ ID NO: 558686 - RNA, 64 nt, Homo Sapiens; identical to SEQ ID NO: 80305

SEQ ID NO: 558687 - RNA, 64 nt, Homo Sapiens; identical to SEQ ID NO: 80306

SEQ ID NO: 558688 - RNA, 64 nt, Homo Sapiens; identical to SEQ ID NO: 80307

SEQ ID NO: 558689 - RNA, 64 nt, Homo Sapiens; identical to SEQ ID NO: 80308

SEQ ID NO: 558690 - RNA, 64 nt, Homo Sapiens; identical to SEQ ID NO: 80309

SEQ ID NO: 558691 - RNA, 64 nt, Homo Sapiens; identical to SEQ ID NO: 80310

SEQ ID NO: 558692 - RNA, 64 nt, Homo Sapiens; identical to SEQ ID NO: 80311

SEQ ID NO: 558693 - RNA, 64 nt, Homo Sapiens; identical to SEQ ID NO: 80312

SEQ ID NO: 558694 - RNA, 64 nt, Homo Sapiens; identical to SEQ ID NO: 80313

SEQ ID NO: 558695 - RNA, 64 nt, Homo Sapiens; identical to SEQ ID NO: 80314

SEQ ID NO: 558696 - RNA, 64 nt, Homo Sapiens; identical to SEQ ID NO: 80315

SEQ ID NO: 558697 - RNA, 64 nt, Homo Sapiens; identical to SEQ ID NO: 80316

SEQ ID NO: 558698 - RNA, 64 nt, Homo Sapiens; identical to SEQ ID NO: 80317

SEQ ID NO: 558699 - RNA, 64 nt, Homo Sapiens; identical to SEQ ID NO: 80318

SEQ ID NO: 558700 - RNA, 64 nt, Homo Sapiens; identical to SEQ ID NO: 80319

SEQ ID NO: 558701 - RNA, 64 nt, Homo Sapiens; identical to SEQ ID NO: 80320

SEQ ID NO: 558702 - RNA, 64 nt, Homo Sapiens; identical to SEQ ID NO: 80321

SEQ ID NO: 558703 - RNA, 64 nt, Homo Sapiens; identical to SEQ ID NO: 80322

SEQ ID NO: 558704 - RNA, 64 nt, Homo Sapiens; identical to SEQ ID NO: 80323

SEQ ID NO: 558705 - RNA, 64 nt, Homo Sapiens; identical to SEQ ID NO: 80324

SEQ ID NO: 558706 - RNA, 51 nt, Homo Sapiens; identical to SEQ ID NO: 80325

SEQ ID NO: 558707 - RNA, 64 nt, Homo Sapiens; identical to SEQ ID NO: 80326

SEQ ID NO: 558708 - RNA, 64 nt, Homo Sapiens; identical to SEQ ID NO: 80327

SEQ ID NO: 558709 - RNA, 64 nt, Homo Sapiens; identical to SEQ ID NO: 80328

SEQ ID NO: 558710 - RNA, 64 nt, Homo Sapiens; identical to SEQ ID NO: 80329

SEQ ID NO: 558711 - RNA, 64 nt, Homo Sapiens; identical to SEQ ID NO: 80330

SEQ ID NO: 558712 - RNA, 62 nt, Homo Sapiens; identical to SEQ ID NO: 80331

SEQ ID NO: 558713 - RNA, 64 nt, Homo Sapiens; identical to SEQ ID NO: 80332

SEQ ID NO: 558714 - RNA, 64 nt, Homo Sapiens; identical to SEQ ID NO: 80333

SEQ ID NO: 558715 - RNA, 64 nt, Homo Sapiens; identical to SEQ ID NO: 80334

SEQ ID NO: 558716 - RNA, 54 nt, Homo Sapiens; identical to SEQ ID NO: 80335

SEQ ID NO: 558717 - RNA, 64 nt, Homo Sapiens; identical to SEQ ID NO: 80336

SEQ ID NO: 558718 - RNA, 64 nt, Homo Sapiens; identical to SEQ ID NO: 80337

SEQ ID NO: 558719 - RNA, 64 nt, Homo Sapiens; identical to SEQ ID NO: 80338

SEQ ID NO: 558720 - RNA, 64 nt, Homo Sapiens; identical to SEQ ID NO: 80339

SEQ ID NO: 558721 - RNA, 64 nt, Homo Sapiens; identical to SEQ ID NO: 80340

SEQ ID NO: 558722 - RNA, 64 nt, Homo Sapiens; identical to SEQ ID NO: 80341

SEQ ID NO: 558723 - RNA, 64 nt, Homo Sapiens; identical to SEQ ID NO: 80342

SEQ ID NO: 558724 - RNA, 64 nt, Homo Sapiens; identical to SEQ ID NO: 80343

SEQ ID NO: 558725 - RNA, 64 nt, Homo Sapiens; identical to SEQ ID NO: 80344

SEQ ID NO: 558726 - RNA, 64 nt, Homo Sapiens; identical to SEQ ID NO: 80345

SEQ ID NO: 558727 - RNA, 64 nt, Homo Sapiens; identical to SEQ ID NO: 80346

SEQ ID NO: 558728 - RNA, 64 nt, Homo Sapiens; identical to SEQ ID NO: 80347

SEQ ID NO: 558729 - RNA, 64 nt, Homo Sapiens; identical to SEQ ID NO: 80348

SEQ ID NO: 558730 - RNA, 64 nt, Homo Sapiens; identical to SEQ ID NO: 80349

SEQ ID NO: 558731 - RNA, 64 nt, Homo Sapiens; identical to SEQ ID NO: 80350

SEQ ID NO: 558732 - RNA, 64 nt, Homo Sapiens; identical to SEQ ID NO: 80351

SEQ ID NO: 558733 - RNA, 59 nt, Homo Sapiens; identical to SEQ ID NO: 80352

SEQ ID NO: 558734 - RNA, 64 nt, Homo Sapiens; identical to SEQ ID NO: 80353

SEQ ID NO: 558735 - RNA, 64 nt, Homo Sapiens; identical to SEQ ID NO: 80354

SEQ ID NO: 558736 - RNA, 64 nt, Homo Sapiens; identical to SEQ ID NO: 80355

SEQ ID NO: 558737 - RNA, 64 nt, Homo Sapiens; identical to SEQ ID NO: 80356

SEQ ID NO: 558738 - RNA, 64 nt, Homo Sapiens; identical to SEQ ID NO: 80357

SEQ ID NO: 558739 - RNA, 64 nt, Homo Sapiens; identical to SEQ ID NO: 80358

SEQ ID NO: 558740 - RNA, 64 nt, Homo Sapiens; identical to SEQ ID NO: 80359

SEQ ID NO: 558741 - RNA, 64 nt, Homo Sapiens; identical to SEQ ID NO: 80360

SEQ ID NO: 558742 - RNA, 64 nt, Homo Sapiens; identical to SEQ ID NO: 80361

SEQ ID NO: 558743 - RNA, 64 nt, Homo Sapiens; identical to SEQ ID NO: 80362

SEQ ID NO: 558744 - RNA, 64 nt, Homo Sapiens; identical to SEQ ID NO: 80363

SEQ ID NO: 558745 - RNA, 64 nt, Homo Sapiens; identical to SEQ ID NO: 80364

SEQ ID NO: 558746 - RNA, 64 nt, Homo Sapiens; identical to SEQ ID NO: 80365

SEQ ID NO: 558747 - RNA, 64 nt, Homo Sapiens; identical to SEQ ID NO: 80366

SEQ ID NO: 558748 - RNA, 64 nt, Homo Sapiens; identical to SEQ ID NO: 80367

SEQ ID NO: 558749 - RNA, 64 nt, Homo Sapiens; identical to SEQ ID NO: 80368

SEQ ID NO: 558750 - RNA, 64 nt, Homo Sapiens; identical to SEQ ID NO: 80369

SEQ ID NO: 558751 - RNA, 64 nt, Homo Sapiens; identical to SEQ ID NO: 80370

SEQ ID NO: 558752 - RNA, 64 nt, Homo Sapiens; identical to SEQ ID NO: 80371

SEQ ID NO: 558753 - RNA, 64 nt, Homo Sapiens; identical to SEQ ID NO: 80372

SEQ ID NO: 558754 - RNA, 64 nt, Homo Sapiens; identical to SEQ ID NO: 80373

SEQ ID NO: 558755 - RNA, 64 nt, Homo Sapiens; identical to SEQ ID NO: 80374

SEQ ID NO: 558756 - RNA, 64 nt, Homo Sapiens; identical to SEQ ID NO: 80375

SEQ ID NO: 558757 - RNA, 64 nt, Homo Sapiens; identical to SEQ ID NO: 80376

SEQ ID NO: 558758 - RNA, 64 nt, Homo Sapiens; identical to SEQ ID NO: 80377

SEQ ID NO: 558759 - RNA, 64 nt, Homo Sapiens; identical to SEQ ID NO: 80378

SEQ ID NO: 558760 - RNA, 64 nt, Homo Sapiens; identical to SEQ ID NO: 80379

SEQ ID NO: 558761 - RNA, 64 nt, Homo Sapiens; identical to SEQ ID NO: 80380

SEQ ID NO: 558762 - RNA, 64 nt, Homo Sapiens; identical to SEQ ID NO: 80381

SEQ ID NO: 558763 - RNA, 64 nt, Homo Sapiens; identical to SEQ ID NO: 80382

SEQ ID NO: 558764 - RNA, 64 nt, Homo Sapiens; identical to SEQ ID NO: 80383

SEQ ID NO: 558765 - RNA, 64 nt, Homo Sapiens; identical to SEQ ID NO: 80384

SEQ ID NO: 558766 - RNA, 64 nt, Homo Sapiens; identical to SEQ ID NO: 80385

SEQ ID NO: 558767 - RNA, 64 nt, Homo Sapiens; identical to SEQ ID NO: 80386

SEQ ID NO: 558768 - RNA, 64 nt, Homo Sapiens; identical to SEQ ID NO: 80387

SEQ ID NO: 558769 - RNA, 64 nt, Homo Sapiens; identical to SEQ ID NO: 80388

SEQ ID NO: 558770 - RNA, 64 nt, Homo Sapiens; identical to SEQ ID NO: 80389

SEQ ID NO: 558771 - RNA, 64 nt, Homo Sapiens; identical to SEQ ID NO: 80390

SEQ ID NO: 558772 - RNA, 64 nt, Homo Sapiens; identical to SEQ ID NO: 80391

SEQ ID NO: 558773 - RNA, 53 nt, Homo Sapiens; identical to SEQ ID NO: 80392

SEQ ID NO: 558774 - RNA, 64 nt, Homo Sapiens; identical to SEQ ID NO: 80393

SEQ ID NO: 558775 - RNA, 64 nt, Homo Sapiens; identical to SEQ ID NO: 80394

SEQ ID NO: 558776 - RNA, 64 nt, Homo Sapiens; identical to SEQ ID NO: 80395

SEQ ID NO: 558777 - RNA, 64 nt, Homo Sapiens; identical to SEQ ID NO: 80396

SEQ ID NO: 558778 - RNA, 64 nt, Homo Sapiens; identical to SEQ ID NO: 80397

SEQ ID NO: 558779 - RNA, 64 nt, Homo Sapiens; identical to SEQ ID NO: 80398

SEQ ID NO: 558780 - RNA, 64 nt, Homo Sapiens; identical to SEQ ID NO: 80399

SEQ ID NO: 558781 - RNA, 64 nt, Homo Sapiens; identical to SEQ ID NO: 80400

SEQ ID NO: 558782 - RNA, 64 nt, Homo Sapiens; identical to SEQ ID NO: 80401

SEQ ID NO: 558783 - RNA, 64 nt, Homo Sapiens; identical to SEQ ID NO: 80402

SEQ ID NO: 558784 - RNA, 64 nt, Homo Sapiens; identical to SEQ ID NO: 80403

SEQ ID NO: 558785 - RNA, 64 nt, Homo Sapiens; identical to SEQ ID NO: 80404

SEQ ID NO: 558786 - RNA, 64 nt, Homo Sapiens; identical to SEQ ID NO: 80405

SEQ ID NO: 558787 - RNA, 64 nt, Homo Sapiens; identical to SEQ ID NO: 80406

SEQ ID NO: 558788 - RNA, 64 nt, Homo Sapiens; identical to SEQ ID NO: 80407

SEQ ID NO: 558789 - RNA, 64 nt, Homo Sapiens; identical to SEQ ID NO: 80408

SEQ ID NO: 558790 - RNA, 64 nt, Homo Sapiens; identical to SEQ ID NO: 80409

SEQ ID NO: 558791 - RNA, 64 nt, Homo Sapiens; identical to SEQ ID NO: 80410

SEQ ID NO: 558792 - RNA, 64 nt, Homo Sapiens; identical to SEQ ID NO: 80411

SEQ ID NO: 558793 - RNA, 64 nt, Homo Sapiens; identical to SEQ ID NO: 80412

SEQ ID NO: 558794 - RNA, 64 nt, Homo Sapiens; identical to SEQ ID NO: 80413

SEQ ID NO: 558795 - RNA, 64 nt, Homo Sapiens; identical to SEQ ID NO: 80414

SEQ ID NO: 558796 - RNA, 64 nt, Homo Sapiens; identical to SEQ ID NO: 80415

SEQ ID NO: 558797 - RNA, 64 nt, Homo Sapiens; identical to SEQ ID NO: 80416

SEQ ID NO: 558798 - RNA, 64 nt, Homo Sapiens; identical to SEQ ID NO: 80417

SEQ ID NO: 558799 - RNA, 64 nt, Homo Sapiens; identical to SEQ ID NO: 80418

SEQ ID NO: 558800 - RNA, 64 nt, Homo Sapiens; identical to SEQ ID NO: 44393

SEQ ID NO: 558801 - RNA, 64 nt, Homo Sapiens; identical to SEQ ID NO: 44394

SEQ ID NO: 558802 - RNA, 64 nt, Homo Sapiens; identical to SEQ ID NO: 44395

SEQ ID NO: 558803 - RNA, 64 nt, Homo Sapiens; identical to SEQ ID NO: 44396

SEQ ID NO: 558804 - RNA, 64 nt, Homo Sapiens; identical to SEQ ID NO: 44397

SEQ ID NO: 558805 - RNA, 64 nt, Homo Sapiens; identical to SEQ ID NO: 44398

SEQ ID NO: 558806 - RNA, 64 nt, Homo Sapiens
caccgaccuggccuucaagcaggcccgggacggcugcccggagcccucggcugccaugcuguga

SEQ ID NO: 558807 - RNA, 64 nt, Homo Sapiens
guggcauguccuccgaguggcagcggacaugguaugcccggaugcccccgcgagccccagcgcc

SEQ ID NO: 558808 - RNA, 63 nt, Homo Sapiens
ggaaaaaaggcagaguaacauuacuuaaaaaaaaaaggauauguuuacauuuaauuuuggcua

SEQ ID NO: 558809 - RNA, 63 nt, Homo Sapiens
gaggaggaaaagugaaucacggagagagaaaggaaaggauagaaucacaggcugcgucugcac

SEQ ID NO: 558810 - RNA, 63 nt, Homo Sapiens
uuugcuaaaaagaaccauauuauuuugauucucaaaggauaggccuuugaguguuagagaaag

SEQ ID NO: 558811 - RNA, 63 nt, Homo Sapiens
uuguuuuccuguaaaugcagauaguuaaaaucuaaaggauagaaugcuuuccuaaaacagaac

SEQ ID NO: 558812 - RNA, 63 nt, Homo Sapiens
auuacuuuuaaguguauuaugaaggcaguuuucaaaggauaugaccaguugggguaauucaaa

SEQ ID NO: 558813 - RNA, 63 nt, Homo Sapiens
ugcaccaguuucuggaggcccuugucauuucaaaaaggauagucucuuuucuuacucuggcaa

SEQ ID NO: 558814 - RNA, 63 nt, Homo Sapiens
uaaugagacaauuuuccuaccaaaggaagaacaaaaggauaaauauaauacaaaauauaugua

SEQ ID NO: 558815 - RNA, 63 nt, Homo Sapiens
ugaccuccuugccucuugucuugaaccauagcaaaaggauacugcaucucucauuacuguagu

SEQ ID NO: 558816 - RNA, 63 nt, Homo Sapiens
aguucuugcacucuuuguacagaauugguauaaaaaggauaauuccacacugaucuuguccca

SEQ ID NO: 558817 - RNA, 63 nt, Homo Sapiens
ugugugaacuacaguauauaaugauaacaauuaaaaggauauucuguggaugucacguauuuu

SEQ ID NO: 558818 - RNA, 63 nt, Homo Sapiens
cacuuuacuacaguuacuuuugcaaacagacagaaaggauacacuucuaaccacauuuuacuu

SEQ ID NO: 558819 - RNA, 63 nt, Homo Sapiens
gaagagaguuuuaaaaaacaaaacaauguaaguaaaggauauuucugaaucuuaaaauucauc

SEQ ID NO: 558820 - RNA, 63 nt, Homo Sapiens
auaaacucauaaaaauaauuuuaagaugucggaaaaggauacuuugauuaaauaaaaacacuc

SEQ ID NO: 558821 - RNA, 63 nt, Homo Sapiens
aucauaaagaaaaacuaaaaaugaaccaaagugaaaggauaacuuccaggcaguaucuuucua

SEQ ID NO: 558822 - RNA, 63 nt, Homo Sapiens
uaccacuuaagauaggagucuaaacuccacagaaaaggauaauaccaagagcuuguauuguua

SEQ ID NO: 558823 - RNA, 63 nt, Homo Sapiens
gaaucuggaccccagagucuggaagcaggccagaaaggauaaggcaaaugacugaacaguucc

SEQ ID NO: 558824 - RNA, 63 nt, Homo Sapiens
cguguacucacagagggagagaaagauguguacaaaggauauguauaaauauucuauuuaguc

SEQ ID NO: 558825 - RNA, 63 nt, Homo Sapiens
aucaauuucuggauucauaauagcaagauuagcaaaggauaaaugccgaaggucacuucauuc

SEQ ID NO: 558826 - RNA, 63 nt, Homo Sapiens
gguuuacaugcacugucucauuuaaucugagauaaaggauacuuaagcccaaacuauaucuaa

SEQ ID NO: 558827 - RNA, 63 nt, Homo Sapiens
ugaacauuaagcagauuggcucagacacaaugaaaaggauaauccaauguacgugcuggugca

SEQ ID NO: 558828 - RNA, 63 nt, Homo Sapiens
uaaaguucucuccuuccugccuccccuaaagaaaaaggauauuagauugcacacuauaauuuu

SEQ ID NO: 558829 - RNA, 63 nt, Homo Sapiens
aaaugaaucuaaucaaaaugugaauaguagucaaaaggauaauuuaauaagcauuuuacguua

SEQ ID NO: 558830 - RNA, 63 nt, Homo Sapiens
uuuuuuuuuuuuuuaugaugauuaagaaaauggaaaggauauggaugaauuguguaaacuuag

SEQ ID NO: 558831 - RNA, 63 nt, Homo Sapiens
auugauguauguauguucauucaaagaaugggaaaaggauaugacauauauuugccaguacuu

SEQ ID NO: 558832 - RNA, 63 nt, Homo Sapiens
ggugaggcccagcuaguaaucccuuuuagugggaaaggauauguucuaggagaaacaagcaau

SEQ ID NO: 558833 - RNA, 63 nt, Homo Sapiens
gacacugucuuaugaagguuugcuugggaugaaaaaggauauugcagcuucagcaguguugaa

SEQ ID NO: 558834 - RNA, 63 nt, Homo Sapiens
uagaaagguuuggguugauggggcagacuucaaaaaggauaguuugccucgcugauguugcau

SEQ ID NO: 558835 - RNA, 63 nt, Homo Sapiens
caggacucgcugggagagauccagaguguaaguaaaggauaacacacgccacugcccccgagg

SEQ ID NO: 558836 - RNA, 63 nt, Homo Sapiens
cagggucaaaucauguacaugaagugaaaaaaaaaaggauauucuuuuuaaaaaaugauguuu

SEQ ID NO: 558837 - RNA, 63 nt, Homo Sapiens
gcgauguuucaggaggcuggggaauugcuuaccaaaggauaguccucccccagcuaucuauau

SEQ ID NO: 558838 - RNA, 63 nt, Homo Sapiens
uaagaaaauacaauaaacuacugaaaauuccagaaaggauauuaauuuuuuuauguuuuguuu

SEQ ID NO: 558839 - RNA, 63 nt, Homo Sapiens
aaagcuuuggauauguauuuuuaaaucuauuuaaaaggauauaucccccaaagaguugaaauc

SEQ ID NO: 558840 - RNA, 63 nt, Homo Sapiens
uggagaaucaucaagauaugggcuaaaagggaaaaaggauauggaguuucucuuggguauaaa

SEQ ID NO: 558841 - RNA, 63 nt, Homo Sapiens
gauauuuggcucaccucguucaucaggaccaagaaaggauaagcaaguaacagcuucagaauu

SEQ ID NO: 558842 - RNA, 63 nt, Homo Sapiens
cacuuucagcgcuuauacuguuuuauaaaagcaaaaggauauuauaguuuauuguagugaugu

SEQ ID NO: 558843 - RNA, 63 nt, Homo Sapiens
uucuuccaagcaaaggugaaggcuaaugaagggaaaggauauucucaggaucaagaaaguguu

SEQ ID NO: 558844 - RNA, 63 nt, Homo Sapiens
uauuuaaauagaugacauugaacacucuauaacaaaggauacuggcccuuuuucaauaacugg

SEQ ID NO: 558845 - RNA, 63 nt, Homo Sapiens
uuuuuugaccuauuuuaggguuuuuaauugugcaaaggauaaaacuaucaauuuuaaggaaac

SEQ ID NO: 558846 - RNA, 63 nt, Homo Sapiens
aaaauuuuuaaagaaaagauagcagaucaacuuaaaggauaauuuccuuucuuuucauaauga

SEQ ID NO: 558847 - RNA, 63 nt, Homo Sapiens
aguauagauuaaugacuggacuuuacuuucaggaaaggauagagagagaaguaauggcaaggc

SEQ ID NO: 558848 - RNA, 63 nt, Homo Sapiens
uuugauuuuguguguuucauucuuuaaggagaaaaaggauaccucuaagaauccuucaggcau

SEQ ID NO: 558849 - RNA, 63 nt, Homo Sapiens
ugccagcagugcagagccugguugucacccauuaaaggauaggucuccccggagugcacagcu

SEQ ID NO: 558850 - RNA, 63 nt, Homo Sapiens
aaauugccaaagcccaaauuaacgaguauuauaaaaggauaauaaagcaucccugaagccaaa

SEQ ID NO: 558851 - RNA, 63 nt, Homo Sapiens
guuuugcauaauuauaaucggcauuguacauagaaaggauauggcuaccuuuuguuaaaucug

SEQ ID NO: 558852 - RNA, 63 nt, Homo Sapiens
cgggaguagcaguaguccaaaccuaguauagggaaaggauaaaaauaagucaccuucaccaag

SEQ ID NO: 558853 - RNA, 63 nt, Homo Sapiens
uccucgaaacuaguguguguuuauuaaaaggagaaaggauaacaauagaauguucuaaaacca

SEQ ID NO: 558854 - RNA, 63 nt, Homo Sapiens
gcccacaugaagagagggaaccuguuaguccagaaaggauacggauagauagccugucugacu

SEQ ID NO: 558855 - RNA, 63 nt, Homo Sapiens
aauuguauuugagggaaaaaaccaugaccaaguaaaggauaaauucaaaaaauagccucauga

SEQ ID NO: 558856 - RNA, 63 nt, Homo Sapiens
gcuaacgagggauuacuuuggccaaaaccuuucaaaggauaugcagaaagaugguagggagca

SEQ ID NO: 558857 - RNA, 63 nt, Homo Sapiens
aaugacugaauuuacuacaaaggcaaacuuucaaaaggauaucucauuuuuguuucuaaauau

SEQ ID NO: 558858 - RNA, 63 nt, Homo Sapiens
caaaaaaaaguuucugaagguaaaagauauacuaaaggauauacauauacugccucuucuaug

SEQ ID NO: 558859 - RNA, 63 nt, Homo Sapiens
ggacuccuugugcucccagcagcucagacagggaaaggauaguccccacucacggugacacca

SEQ ID NO: 558860 - RNA, 63 nt, Homo Sapiens
uauauagccuuuuaguagcagacuuaucagaugaaaggauauuaaacacuagagguuuaauaa

SEQ ID NO: 558861 - RNA, 63 nt, Homo Sapiens
aagguucuccauagguucuuaaucauauaauguaaaggauaucauaaaagcaaccucucuaua

SEQ ID NO: 558862 - RNA, 63 nt, Homo Sapiens
uuguaauaaguaaguggugucuauuuuaucaauaaaggauauuuuuuuuuuuuaaacucugag

SEQ ID NO: 558863 - RNA, 63 nt, Homo Sapiens
auuuuuauacaaauaucuuuguauauaaaaauaaaaggauagcgagugcgauuuauuuaaguu

SEQ ID NO: 558864 - RNA, 63 nt, Homo Sapiens
uucacaauuucccuucauaucuuucaaaagaguaaaggauacuacaguaaggcaaaggccaag

SEQ ID NO: 558865 - RNA, 63 nt, Homo Sapiens
uauuuggguguuuugagcuuuguuuauucauauaaaggauaaaauuguaauucauagggcuuu

SEQ ID NO: 558866 - RNA, 63 nt, Homo Sapiens
aagaaauacuauugcucuaguguccugcuaccuaaaggauauaucuuuacuauguccuagcuc

SEQ ID NO: 558867 - RNA, 63 nt, Homo Sapiens
guacuaaaaauaaaaugugagaugagcacugacaaaggauaugcccauuuuaaugugcauucu

SEQ ID NO: 558868 - RNA, 63 nt, Homo Sapiens
gacccaaaguuacuauagucaaccaagucuuucaaaggauaaaagaucauuuuauuaucuuua

SEQ ID NO: 558869 - RNA, 63 nt, Homo Sapiens
augccugucuuuaaaguguuauuuuauuaauuaaaaggauauggcuauuauuauauauucucu

SEQ ID NO: 558870 - RNA, 63 nt, Homo Sapiens
ggacuaggggagugguggggaggugaguggaccaaaggauauaggccccaggcaugcagaugg

SEQ ID NO: 558871 - RNA, 63 nt, Homo Sapiens
aggauaaaggaacugagaccagaugagaaaaagaaaggauauagauuccuugaguggaauagu

SEQ ID NO: 558872 - RNA, 63 nt, Homo Sapiens
aagacuuuuccugcaauagccugggaaggaauaaaaggauagaguguuuggguuuuuguguaa

SEQ ID NO: 558873 - RNA, 63 nt, Homo Sapiens
uauauucacaguuuuuuaaaaaugugucaaaauaaaggauaacucuguauuacagcuuucaca

SEQ ID NO: 558874 - RNA, 63 nt, Homo Sapiens
uauaaaaacuagucaagccuaaugcaacuggcuaaaggauaguaccacccucacccccaccau

SEQ ID NO: 558875 - RNA, 63 nt, Homo Sapiens
cuaaaauguguuucauucuaguaagaaaaccucaaaggauauuguaggauauaaaucuuacuu

SEQ ID NO: 558876 - RNA, 63 nt, Homo Sapiens
aauccuauaauauccuugaaaagaaacuauuaaaaaggauagacauuucugauguaaguaaaa

SEQ ID NO: 558877 - RNA, 63 nt, Homo Sapiens
uccuuuuuuugagguuuggauguugcagcuaguaaaggauauuuuugcucuguucagcaguuc

SEQ ID NO: 558878 - RNA, 63 nt, Homo Sapiens
ccucugucuacaaauauaagauuuucugggccuaaaggauagaucaaagucaaaaauagcaau

SEQ ID NO: 558879 - RNA, 63 nt, Homo Sapiens
aaagauuccacagagauguuuauggugagguuuaaaggauaugaaacucuacauuuaaacaag

SEQ ID NO: 558880 - RNA, 63 nt, Homo Sapiens
ccuugaguguaugaguagccaggguaagggguaaaaggauaguaagcauagaaaccacuagaa

SEQ ID NO: 558881 - RNA, 63 nt, Homo Sapiens
acagacugcacuaaauguuucagaaaaguuggaaaaggauaauucuucaaaaacuugcacaaa

SEQ ID NO: 558882 - RNA, 63 nt, Homo Sapiens
auguuuuaauaguagagcagcagauuaugaaugaaaggauaaacuucugauuauugaagaggu

SEQ ID NO: 558883 - RNA, 63 nt, Homo Sapiens
acacugcacugagucugaugccagcuuuucauuaaaggauaacagaguggugacuccauugac

SEQ ID NO: 558884 - RNA, 63 nt, Homo Sapiens
cauccuccaaaacgccuccaggcacgccaaagcaaaggauaaccugcagugauaccgaacugu

SEQ ID NO: 558885 - RNA, 63 nt, Homo Sapiens
ugaaugaugauaagucagucaagccacuaaauaaaaggauaaagaaucuaucuucuaggaucu

SEQ ID NO: 558886 - RNA, 63 nt, Homo Sapiens
augaacgcuauuugaggacuaaaaggaugacucaaaggauaaaauacuugaaggacuuuauau

SEQ ID NO: 558887 - RNA, 63 nt, Homo Sapiens
aagguggcuggcuaggaagguuuguuuugcaauaaaggauaugaaugaguuuuauuuuguuua

SEQ ID NO: 558888 - RNA, 63 nt, Homo Sapiens
acagugcaugcuguuuguucacaauuuuuaaauaaaggauaccacuacaacuguagucagcuc

SEQ ID NO: 558889 - RNA, 63 nt, Homo Sapiens
uuagaauugaguugugugaaauacaucucuguaaaaggauauucagcuuggaagcguuuauuu

SEQ ID NO: 558890 - RNA, 63 nt, Homo Sapiens
aaaucacaggugauagcagugcaauaucagcuaaaaggauaugaaaguuugggaagcucuuua

SEQ ID NO: 558891 - RNA, 63 nt, Homo Sapiens
gaaucauucuuuacaugcaacaauacaagauaaaaaggauaguuuuaaauguuuugacgauuu

SEQ ID NO: 558892 - RNA, 63 nt, Homo Sapiens
uuuuaaaaaaucuuuauaggcuuauucuauacuaaaggauaaacuuaaagugcucccuugaca

SEQ ID NO: 558893 - RNA, 63 nt, Homo Sapiens
ucaaauauucaaaaggccauauuaugaauuucaaaaggauaaagaaaaaucaaaaacuauuuu

SEQ ID NO: 558894 - RNA, 63 nt, Homo Sapiens
guaacacuuuacaauguucaucagaaucuacccaaaggauacucuuucgucuccagccccuuc

SEQ ID NO: 558895 - RNA, 63 nt, Homo Sapiens
cuguugcucuaucuaauuuuuuuuccuggagggaaaggauagggccauccaagugaugauggc

SEQ ID NO: 558896 - RNA, 63 nt, Homo Sapiens
acuuuaaacaguugauucuucauagagugaagaaaaggauaaguuuuuuguagaaguagcugu

SEQ ID NO: 558897 - RNA, 63 nt, Homo Sapiens
caaucaagccagcccucuccucuucugucacguaaaggauauuuggcacacucaugcgucauu

SEQ ID NO: 558898 - RNA, 58 nt, Homo Sapiens
cuaaaaaaaucauuuacuagaucacaugaaaggauaaagcaaacugaagucaugcuau

SEQ ID NO: 558899 - RNA, 63 nt, Homo Sapiens
acaagauccucccagcuuucucucuacauguagaaaggauaacauuucucaugaacccacugc

SEQ ID NO: 558900 - RNA, 63 nt, Homo Sapiens
uaggaacuacaacuucauaaaugaggaaccagaaaaggauagcugggaggcauuacauaguca

SEQ ID NO: 558901 - RNA, 63 nt, Homo Sapiens
cuacugggauaaaccucaauuccuuuauucaggaaaggauacuuuauugcauuauuguugcag

SEQ ID NO: 558902 - RNA, 63 nt, Homo Sapiens
ggcucaaaaccgaaaacaaugaagcuugguuuuaaaggauaaaguuuucuuuuuuguuuuccu

SEQ ID NO: 558903 - RNA, 63 nt, Homo Sapiens
aaauaagccuaucuuuuugugcuuacauacuuaaaaggauaucauuaaguauauaaacaauca

SEQ ID NO: 558904 - RNA, 63 nt, Homo Sapiens
aaagugcgauaacugaacauuuuuuuuuucugaaaaggauaccguuuauaaguuuugagauuu

SEQ ID NO: 558905 - RNA, 63 nt, Homo Sapiens
aaguuacagcuugguaggagagagagauuuguuaaaggauacacugcagcaaagggagacuag

SEQ ID NO: 558906 - RNA, 63 nt, Homo Sapiens
cucacauuuacaaguagugagcuaggguaagguaaaggauagaaccaaaucccugggguaaaa

SEQ ID NO: 558907 - RNA, 63 nt, Homo Sapiens
gcauuauucuagcagcaucccaguugucacaucaaaggauacagggggagggagauggaugcu

SEQ ID NO: 558908 - RNA, 63 nt, Homo Sapiens
aaagcuauaacuaaaaaaauucaugguuugaaaaaaggauaaauuuuuaagugucaaauauca

SEQ ID NO: 558909 - RNA, 63 nt, Homo Sapiens
gaccccgugcccuuuaaaccggcauuugcugcuaaaggauacccagaacccucacuacuguaa

SEQ ID NO: 558910 - RNA, 63 nt, Homo Sapiens
agcaaagaccacacauuuuuuacuacaaaauguaaaggauaaauguaaauccugcauaacuaa

SEQ ID NO: 558911 - RNA, 63 nt, Homo Sapiens
uauaacuccacuguacaucauccuuugaguaguaaaggauaaaagcauauauacuaccuauau

SEQ ID NO: 558912 - RNA, 63 nt, Homo Sapiens
cgcccaccaccuccuucccccucaucacaugacaaaggauaaugugcaagaaaaguauuuuua

SEQ ID NO: 558913 - RNA, 63 nt, Homo Sapiens
uaagaucaugaaacaauuccaguuacauuguaaaaaggauaucuuacgaguaauuuuauugaa

SEQ ID NO: 558914 - RNA, 63 nt, Homo Sapiens
cuucaagucaagaaauaaauuucuuuacauagaaaaggauacagauuuaguaccaagaacacu

SEQ ID NO: 558915 - RNA, 63 nt, Homo Sapiens
aacaaaaaacuguuuucauuugcucucuugaccaaaggauaggacuuuaguucuuuaagcauu

SEQ ID NO: 558916 - RNA, 63 nt, Homo Sapiens
ucuguaccagguggugguuauggggucugaaccaaaggauagcagcucuucauuccucuucug

SEQ ID NO: 558917 - RNA, 63 nt, Homo Sapiens
uauuuauaggccuuuuuuuuuccuuuuagagucaaaggauauuuuguuuuucuacuucauuuu

SEQ ID NO: 558918 - RNA, 63 nt, Homo Sapiens
cugacuuaagaaacuuuuugcauuuaaaacaugaaaggauaaugacuucuuuagaagaagcuu

SEQ ID NO: 558919 - RNA, 63 nt, Homo Sapiens
gcuucauuccauaccaaagaccuggugacuuugaaaggauagacuuagggcugggaacccgaa

SEQ ID NO: 558920 - RNA, 63 nt, Homo Sapiens
aaaaagcaaguggccaguguaagaaaccucaggaaaggauaugugcuauuuacuagcagugag

SEQ ID NO: 558921 - RNA, 63 nt, Homo Sapiens
ucagacuauacaaaaccuaagcagcuuaacaacaaaggauaaaagaauccuuauuucagucua

SEQ ID NO: 558922 - RNA, 63 nt, Homo Sapiens
cugugggguuagaacauaucaggucagcugucaaaaggauaacgcuuacauuuuauaaguuua

SEQ ID NO: 558923 - RNA, 63 nt, Homo Sapiens
cacaaaauuguuugaaaaacccagcucaggaugaaaggauagacuaucacauucucaauaguu

SEQ ID NO: 558924 - RNA, 63 nt, Homo Sapiens
cacaguaguacaguucucaaguguuaccauggaaaaggauauuaaguacgugugugugugugu

SEQ ID NO: 558925 - RNA, 63 nt, Homo Sapiens
ugucgaaaaaaagagcaaaauucuuucuguuugaaaggauauuuuuugaggugucucuuuggg

SEQ ID NO: 558926 - RNA, 63 nt, Homo Sapiens
agaguagcauaagcugcugagucacugggaaccaaaggauaaagcauuauuacugcauuguuu

SEQ ID NO: 558927 - RNA, 63 nt, Homo Sapiens
uaccauuagucagauuugaauaacgagguuuugaaaggauaaaaccuuuucuccaaugacagg

SEQ ID NO: 558928 - RNA, 63 nt, Homo Sapiens
uugcacauguuuuccccuaaaagcuuacucuagaaaggauauuuuuuggagagggaguguggg

SEQ ID NO: 558929 - RNA, 63 nt, Homo Sapiens
agaucugagacaugggauucccauuugagagccaaaggauaugcccugucaugguuucuguuu

SEQ ID NO: 558930 - RNA, 63 nt, Homo Sapiens
aaugaaugauguuugaaugauauauaacaaaccaaaggauauuacagaauauuagauucauua

SEQ ID NO: 558931 - RNA, 63 nt, Homo Sapiens
aagguuaguauuuuuguuguaguuaggauacuaaaaggauauuaguuacccaagagauccaau

SEQ ID NO: 558932 - RNA, 63 nt, Homo Sapiens
guaucucuuuucaucugaaaacuaauaccuggaaaaggauaaaaaaaaaaaggaauccgugac

SEQ ID NO: 558933 - RNA, 63 nt, Homo Sapiens
cagagaaauacugacgaaguuuucugauguggcaaaggauauuucccaucuaauaccaguuuc

SEQ ID NO: 558934 - RNA, 63 nt, Homo Sapiens
uacuuacuuuuauugcauguuuaaauggcuacuaaaggauaauaguggaaagaccagauaacu

SEQ ID NO: 558935 - RNA, 63 nt, Homo Sapiens
cagaggugcaucuuuuucugauuugcuaagaucaaaggauauuuguauacuuuuaaaaaaaag

SEQ ID NO: 558936 - RNA, 63 nt, Homo Sapiens
gauaaaagaggcaccccauuaggguugggaaauaaaggauaggcauggaucaagauccaguuu

SEQ ID NO: 558937 - RNA, 63 nt, Homo Sapiens
gucaaaaauggcguucuucuuuccuauacauacaaaggauauuggggguggcaaucauuuuuc

SEQ ID NO: 558938 - RNA, 63 nt, Homo Sapiens
aaucugagagaugcuguagaugaaauauaugugaaaggauaugaaccucugauuuauuuugua

SEQ ID NO: 558939 - RNA, 63 nt, Homo Sapiens
auuaguguguauaacagauuauuuaaagaaaugaaaggauacccacaaggaacuacauuccag

SEQ ID NO: 558940 - RNA, 63 nt, Homo Sapiens
cauggguuagaaggaagugugacaagguuuugaaaaggauaauuuggaacucugaaggauuua

SEQ ID NO: 558941 - RNA, 63 nt, Homo Sapiens
uccagaaaggauuaagaaagauaaaaaugaaccaaaggauauuguuuugccuagagaggggca

SEQ ID NO: 558942 - RNA, 63 nt, Homo Sapiens
ugcaacaaugaaacaggaaaaauuaccuaggguaaaggauagccuaaugauacugacaacaua

SEQ ID NO: 558943 - RNA, 63 nt, Homo Sapiens
ggaauacucaucuuacaggguguacugcagggaaaaggauauacuaacuuuuaaaucagugug

SEQ ID NO: 558944 - RNA, 63 nt, Homo Sapiens
uacuugucucucugcuuguuauugguuaagaaaaaaggauaugaggaauucauuuuaucaaug

SEQ ID NO: 558945 - RNA, 63 nt, Homo Sapiens
uauuuauucccuaguuugcagaacugucugaauaaaggauacaaggauuauuucaauguuacu

SEQ ID NO: 558946 - RNA, 63 nt, Homo Sapiens
cugugucagucuucauuuuaaauauggauacaaaaaggauacgccgagccaaucaaagacaag

SEQ ID NO: 558947 - RNA, 63 nt, Homo Sapiens
ggaaauuugaauuaaauacuguaucauacuuucaaaggauaaaaagacuaccccucugaaggu

SEQ ID NO: 558948 - RNA, 63 nt, Homo Sapiens
acaauuuuguuugaaauucauauaucuuauuucaaaggauagcauaauaucugcauuaugcug

SEQ ID NO: 558949 - RNA, 63 nt, Homo Sapiens
ccugacagacuacuucuggacuagacauaaaacaaaggauauaaguggucacagggcccaauu

SEQ ID NO: 558950 - RNA, 63 nt, Homo Sapiens
ggaagagagggaagcagaaggcaggaaggaaagaaaggauauaaaauggaaaaaugaaagaag

SEQ ID NO: 558951 - RNA, 63 nt, Homo Sapiens
cucgaugauguaaauccaccaaaagcaauggugaaaggauaacggcuuggugugaacucgcuu

SEQ ID NO: 558952 - RNA, 63 nt, Homo Sapiens
uaugccuuucuaaaguuguacuucucuggugugaaaggauaaacaugucuggcauugcauaaa

SEQ ID NO: 558953 - RNA, 63 nt, Homo Sapiens
ugcuaccguugagaagggaaugacuguguugggaaaggauaagcgguggagauacaaguucuc

SEQ ID NO: 558954 - RNA, 63 nt, Homo Sapiens
uuaacaaauaugaccgagucuaguuuuucuuuaaaaggauaguuuaugaguaaucuuuaaaac

SEQ ID NO: 558955 - RNA, 63 nt, Homo Sapiens
uggccuccccuggauauacucuauagugcaccaaaaggauaaagcaucuguacauguauuuuu

SEQ ID NO: 558956 - RNA, 63 nt, Homo Sapiens
gugucacugccacucuguuuuaucccugaaauuaaaggauaacauaaggaggacuugggccuu

SEQ ID NO: 558957 - RNA, 63 nt, Homo Sapiens
cccuggagauauuuuuucuuauuugaguccaccaaaggauaaugccaacuuauauaaguucuc

SEQ ID NO: 558958 - RNA, 63 nt, Homo Sapiens
cuuaaaagcagauuuuuaugggaacuuuuuucgaaaggauacaugaccaccuucuuaaauagu

SEQ ID NO: 558959 - RNA, 63 nt, Homo Sapiens
gugacuguuuuucaagaagaaauguguuucauaaaaggauauuuauaucucuguugcuuugac

SEQ ID NO: 558960 - RNA, 63 nt, Homo Sapiens
uuuaugucucuuuuguuaacagaaaccacuuuuaaaggauaguaauuauucuuguuuauaaca

SEQ ID NO: 558961 - RNA, 63 nt, Homo Sapiens
ggcgaguuuacaagcuguggaugcacaaaacauaaaggauaguucaaauuuguuccuuuccuc

SEQ ID NO: 558962 - RNA, 63 nt, Homo Sapiens
ucaaaugauuaugauuaguugaucauauaucauaaaggauauuuggugggguucuucgggugu

SEQ ID NO: 558963 - RNA, 63 nt, Homo Sapiens
uaaacaaagaaaugacaaaaacugccauuuaaaaaaggauaggcuucuuuugcaucauuuggg

SEQ ID NO: 558964 - RNA, 63 nt, Homo Sapiens
aaugccuugauuagaccuaaaaagguguuuuguaaaggauaucucuucauagcaaugucuccu

SEQ ID NO: 558965 - RNA, 63 nt, Homo Sapiens
auuucuuaguaaaaugaaaugaaaugauaauaaaaaggauauaauguugaacuuuguauacuu

SEQ ID NO: 558966 - RNA, 63 nt, Homo Sapiens
cgggaauugagcucagcucuacagaaaguuaaaaaaggauaucacauuagacacaccaacgag

SEQ ID NO: 558967 - RNA, 63 nt, Homo Sapiens
guuuguuuuuuucccuuuuacuguggaaggaagaaaggauauuaguuugaauaguagguaucu

SEQ ID NO: 558968 - RNA, 63 nt, Homo Sapiens
ccugaggggcucaucgacgccugugacagggagaaaggauacuucugaacaaggagccuccaa

SEQ ID NO: 558969 - RNA, 63 nt, Homo Sapiens
cacagaauuguuccaguacuauggagugcucacaaaggauacuuuuacagguuaagacaaagg

SEQ ID NO: 558970 - RNA, 63 nt, Homo Sapiens
aaaagacacgguugcucuauauaugaagugaaaaaaggauaugguagcauuuuauaguacuag

SEQ ID NO: 558971 - RNA, 63 nt, Homo Sapiens
uauuauguuguacaucauuaaagaucuaaauacaaaggauauacagucuugaaucuaaaauaa

SEQ ID NO: 558972 - RNA, 63 nt, Homo Sapiens
uaaauauuuugauauuauuuuccuuuuuaauauaaaggauagguuugaauuguacuuaaaaug

SEQ ID NO: 558973 - RNA, 63 nt, Homo Sapiens
aaccaggauccauuuagguaccacuugauauaaaaaggauauccauaaugaauauuuuauacu

SEQ ID NO: 558974 - RNA, 63 nt, Homo Sapiens
cacuuuuggacaaugcuaucccagcaggaaaaaaaaggauaauauaacuguuuuaaaacucuu

SEQ ID NO: 558975 - RNA, 63 nt, Homo Sapiens
aacagagcucuguugucugguuuuagucuuucuaaaggauauuuuaacuaaaacuauggagau

SEQ ID NO: 558976 - RNA, 63 nt, Homo Sapiens
uuucucuguuauuuauauaaaaauaauuuaucaaaaggauauuuuaaaaaagcuagucugucu

SEQ ID NO: 558977 - RNA, 63 nt, Homo Sapiens
auuucuaagauauuuugaauggguauguuaacuaaaggauagcaucaauguuacaaaauuuaa

SEQ ID NO: 558978 - RNA, 63 nt, Homo Sapiens
uuuauugacacauaaucuguuauguuauuggggaaaggauaugguuaguugagaaucagagca

SEQ ID NO: 558979 - RNA, 63 nt, Homo Sapiens
guacucuuugggggaugaguuugcugcugcuuuaaaggauaaauguacauaugugccuuguga

SEQ ID NO: 558980 - RNA, 63 nt, Homo Sapiens
aauguuaaaucuucuaggaacuuaaaaagauuaaaaggauacuuauguaugcaguaugccuua

SEQ ID NO: 558981 - RNA, 63 nt, Homo Sapiens
uuucacuuaauaaacacguucuuuuuuauuuuuaaaggauacgucauuuauauacaggcuucc

SEQ ID NO: 558982 - RNA, 63 nt, Homo Sapiens
cuuucuuuucauugacaacacucauuaauuuacaaaggauaauugcauaaaucaggauaccau

SEQ ID NO: 558983 - RNA, 63 nt, Homo Sapiens
uacuuaauguuaauacacagaggauaaagaauaaaaggauaauccaucuuauuuggcuaaugu

SEQ ID NO: 558984 - RNA, 63 nt, Homo Sapiens
caagggaaguuaaauuuugagacuuuuuuccccaaaggauacugacuguaauacaauuaccaa

SEQ ID NO: 558985 - RNA, 63 nt, Homo Sapiens
aaauuucauuuguaauuggaaaaaauccaauaaaaaggauauucauuuagaaaauagcuaaga

SEQ ID NO: 558986 - RNA, 63 nt, Homo Sapiens
ggucucaauaccugaagcuaucguaaaauuaagaaaggauaaaguugguaaaccuuuuauauu

SEQ ID NO: 558987 - RNA, 63 nt, Homo Sapiens
aaaaaaaaucaucuugcccacaggccuguggcaaaaggauaaaaaugugaacgaaguuuaaca

SEQ ID NO: 558988 - RNA, 63 nt, Homo Sapiens
auacaaaaguguguauaaaauguacguuuuaaaaaaggauaagugaacacccaugaaccuacu

SEQ ID NO: 558989 - RNA, 63 nt, Homo Sapiens
cuguuauaugagaaacauuuuaguaauuuaauaaaaggauaauguuuauuuaaaaaaccugac

SEQ ID NO: 558990 - RNA, 63 nt, Homo Sapiens
uuuugcaauguuauuagauguaucgauagcaaaaaaggauacuaguaauaccauuaacuguuu

SEQ ID NO: 558991 - RNA, 63 nt, Homo Sapiens
gaagcuacauagaagggacacgugugcuuuaccaaaggauaugcagcccacuuguagaagguc

SEQ ID NO: 558992 - RNA, 63 nt, Homo Sapiens
auaugacaaauucucacuuagcagauauaaaauaaaggauaauuauuccuuuauuaacuuagg

SEQ ID NO: 558993 - RNA, 63 nt, Homo Sapiens
gccuucccaaugcacaguuugcgauuuuaauaaaaaggauauggugaugcuuuuguauuugug

SEQ ID NO: 558994 - RNA, 63 nt, Homo Sapiens
auuguuugaauuuuuggguuacauuaaaaaucuaaaggauauugauugccauuucaauaaaug

SEQ ID NO: 558995 - RNA, 63 nt, Homo Sapiens
ccugaaccagaauaguuuucucguaccuuggacaaaggauacaugugaccgccaggccuccuc

SEQ ID NO: 558996 - RNA, 63 nt, Homo Sapiens
ucagugugcgauuucaauuuuugaguugcaauaaaaggauauuauuuucugguuuuugaaaau

SEQ ID NO: 558997 - RNA, 63 nt, Homo Sapiens
auugacauacccaaaguagcuaggugaagauugaaaggauagggaucuuaacuucacuuccau

SEQ ID NO: 558998 - RNA, 63 nt, Homo Sapiens
gugaaaucacuaauuaacuaggaucggccugcgaaaggauacuugagggaacgguuggagugg

SEQ ID NO: 558999 - RNA, 63 nt, Homo Sapiens
uaucaaauccagggauugcauguaaucgauuauaaaggauauuuauuucuagauauugauuag

SEQ ID NO: 559000 - RNA, 63 nt, Homo Sapiens
aagguguggaagugaauauaucgcuuuaguaagaaaggauaaaacuguguagaaacuaaauca

SEQ ID NO: 559001 - RNA, 63 nt, Homo Sapiens
agcaaaauauuguccuuacucauucaagaauuaaaaggauaaauuuuaaaaauguuaucuguc

SEQ ID NO: 559002 - RNA, 63 nt, Homo Sapiens
ucauuuguuuuuccugaccaguauuuaaaaccaaaaggauauucugaaaaauggccaacaauu

SEQ ID NO: 559003 - RNA, 63 nt, Homo Sapiens
gggcaucauuuuguuuugucuuucguagcagggaaaggauaugacaauggggaggacaguucu

SEQ ID NO: 559004 - RNA, 63 nt, Homo Sapiens
cugacugaaaacugaguuaacaagaugaaaucuaaaggauauucacagugacuucaauucagg

SEQ ID NO: 559005 - RNA, 63 nt, Homo Sapiens
auuauaucuuaagguauguuguagaauaaauuaaaaggauaaucuaaaucaccauuuagauua

SEQ ID NO: 559006 - RNA, 63 nt, Homo Sapiens
cccuaaauacacgucuguuuagcccgcaauuggaaaggauauauguggcaauauuaaccuggu

SEQ ID NO: 559007 - RNA, 63 nt, Homo Sapiens
uuugcacugauggugccaaagggcccugagucaaaaggauagccaaggguggaguggaaaaag

SEQ ID NO: 559008 - RNA, 63 nt, Homo Sapiens
cuagggcugaguugugucuccauuuugauaaggaaaggauaugcucagacucuugcuuguuca

SEQ ID NO: 559009 - RNA, 63 nt, Homo Sapiens
uggaaggcuuucaguuuuaauauggcugaaagcaaaggauaacgaauucagaauuaguaaugu

SEQ ID NO: 559010 - RNA, 63 nt, Homo Sapiens
uuauuuacaugucagagacauuuauaaaaagugaaaggauaaaaaaaaaaaaaaacaacuaau

SEQ ID NO: 559011 - RNA, 63 nt, Homo Sapiens
caguaugcuuaaugguagcaugguuauggccgaaaaggauaugauauaacaagugggugaaug

SEQ ID NO: 559012 - RNA, 63 nt, Homo Sapiens
aauaaacuccugcuucccaaguuaauacuuacaaaaggauaaaguguuuguugugauuaccga

SEQ ID NO: 559013 - RNA, 63 nt, Homo Sapiens
gaaggaugaugucuuuuuaucuuugcauauuauaaaggauaaacucauauaagacaaauauuc

SEQ ID NO: 559014 - RNA, 63 nt, Homo Sapiens
ggugaacauuuuaauggguucuguguacauuuuaaaggauaauguguaugugugguuucaguu

SEQ ID NO: 559015 - RNA, 63 nt, Homo Sapiens
aaaagauucaaagcucuaauaggaguaaagauaaaaggauagggagcugaggccauucccugu

SEQ ID NO: 559016 - RNA, 63 nt, Homo Sapiens
uccaggccauaggaauggcucugggcagguccaaaaggauagucagacagacaauugaaaaua

SEQ ID NO: 559017 - RNA, 63 nt, Homo Sapiens
aagcaucuaaaaguuuaggcgaagcauuuguucaaaggauagaaguuacaagcuuaagauaca

SEQ ID NO: 559018 - RNA, 63 nt, Homo Sapiens
agaaacccuuccccccuucuucacacaaaaaaaaaaggauaaauuucuguguuuugauagaag

SEQ ID NO: 559019 - RNA, 63 nt, Homo Sapiens
cuggcuaguuaaaaguaaauauaaaauuuuuaaaaaggauaaaucaaauugugcagagaaaca

SEQ ID NO: 559020 - RNA, 63 nt, Homo Sapiens
gaggagggguggcuuuuaugaguugcccaguugaaaggauaaguagaaucucccucacucuau

SEQ ID NO: 559021 - RNA, 63 nt, Homo Sapiens
uuccuuguucuuaccaagugaucauucauugguaaaggauauacugccuugcaggauccauuu

SEQ ID NO: 559022 - RNA, 63 nt, Homo Sapiens
aagaugccccucugguggguuguucccccuuccaaaggauacugggccacuauggaacccugc

SEQ ID NO: 559023 - RNA, 63 nt, Homo Sapiens
uuucauuccguuuggaugucuacauuccuuaucaaaggauauaaauacuguguaugcuuuuga

SEQ ID NO: 559024 - RNA, 63 nt, Homo Sapiens
uagcaaaguuaaacauucuuauuucucauauuuaaaggauaccacaauaagcugcugugugug

SEQ ID NO: 559025 - RNA, 63 nt, Homo Sapiens
caaggcugcuugauucacagauggaugugaccuaaaggauaaauaagcuauuacuuaugugcu

SEQ ID NO: 559026 - RNA, 63 nt, Homo Sapiens
cuccacauccuggaaucaaucacacugacagggaaaggauaaaugcuccuuuauaagccaaca

SEQ ID NO: 559027 - RNA, 63 nt, Homo Sapiens
ucccauagugcuucacacagcuccccugcuucuaaaggauaagguacuguagccuugguccug

SEQ ID NO: 559028 - RNA, 63 nt, Homo Sapiens
uguaauuagugggggaaaaaauauuuuuuaaacaaaggauauaaccauauuuaguuguacagu

SEQ ID NO: 559029 - RNA, 63 nt, Homo Sapiens
acauuaaaaacucuugagaauuuucuaacgugaaaaggauaaauggugcuauuuaaacaauuu

SEQ ID NO: 559030 - RNA, 63 nt, Homo Sapiens
uauauauuuucuuaaaacaguuuguacagaagaaaaggauauugguagggaauacuggagaua

SEQ ID NO: 559031 - RNA, 63 nt, Homo Sapiens
aaaacccaaacugaaauucuuaaaaaagaaaaaaaaggauaaaagcagaaaacauacuuauuu

SEQ ID NO: 559032 - RNA, 63 nt, Homo Sapiens
aaagaaaagagagcucaggcgccacgaugacccaaaggauaaguccacucacucaaaaucaga

SEQ ID NO: 559033 - RNA, 63 nt, Homo Sapiens
aaugcuuuauuuauacagauguuaugaauuuuaaaaggauaaaucuuauguuuuuuaaaugga

SEQ ID NO: 559034 - RNA, 63 nt, Homo Sapiens
caagagaaauuuuucaagcaacaugaaaauauuaaaggauauguaauucaauguguuuuuaac

SEQ ID NO: 559035 - RNA, 63 nt, Homo Sapiens
ccaagauggcuguaaacacacugccccacaugaaaaggauaagaagaaagcuguggaaaggac

SEQ ID NO: 559036 - RNA, 63 nt, Homo Sapiens
auggauuuuaaaagaauauaauguucaauauuaaaaggauaauucacauuugccaccauaaug

SEQ ID NO: 559037 - RNA, 63 nt, Homo Sapiens
aacuaauugacuuuagaaagcugacauugccaaaaaggauacauaaugggccacugaaaucug

SEQ ID NO: 559038 - RNA, 63 nt, Homo Sapiens
cuucugaagacaaaacugaaugcuauagcuuugaaaggauaaaaagcccugaagugcucauca

SEQ ID NO: 559039 - RNA, 63 nt, Homo Sapiens
cuaccugagaccagcugugauguuuaaagacauaaaggauaaaguuuacuuuuaaaggguuuc

SEQ ID NO: 559040 - RNA, 63 nt, Homo Sapiens
agggcaauauuuuaucauauuggauacaugguuaaaggauagacuccccaucaaaaaaaaaaa

SEQ ID NO: 559041 - RNA, 63 nt, Homo Sapiens
caguuauacuugugaauugugaucuaacugcagaaaggauacauuauuaaaauacuuugccuu

SEQ ID NO: 559042 - RNA, 63 nt, Homo Sapiens
uacauuuacacucccaaauugcaggcuuuauuuaaaggauaaaauuuaaaggauaaaaaaaca

SEQ ID NO: 559043 - RNA, 63 nt, Homo Sapiens
caaauugcaggcuuuauuuaaaggauaaaauuuaaaggauaaaaaaacagucacucuguuaag

SEQ ID NO: 559044 - RNA, 63 nt, Homo Sapiens
gaaacucuaaauaguugaaaggcuaaccugcucaaaggauaccaaauaaugguuuaacuggac

SEQ ID NO: 559045 - RNA, 63 nt, Homo Sapiens
gacauugaaaaggaagaggcauagucaugaucaaaaggauauauugacaguuaucuauagcca

SEQ ID NO: 559046 - RNA, 63 nt, Homo Sapiens
gucauaccuacauucaaggagaggggaccaugcaaaggauaaacugcaggugaagaacuugag

SEQ ID NO: 559047 - RNA, 63 nt, Homo Sapiens
auguacuccuguuugccaagcucaauaauggacaaaggauacaaacacacacacaucuacuau

SEQ ID NO: 559048 - RNA, 63 nt, Homo Sapiens
cuaauugaaugccuugaaagcuuagaauacugcaaaggauaaggugaucgucaaugugaauag

SEQ ID NO: 559049 - RNA, 62 nt, Homo Sapiens
uuugaagaaaaacaaauugucuuuguccuucuaaaggauauacgaaaaagucacgaaucuga

SEQ ID NO: 559050 - RNA, 63 nt, Homo Sapiens
aggccggaugugguggcucacgcuuauuuuuugaaaggauauucuucuuauuuguauggaaug

SEQ ID NO: 559051 - RNA, 63 nt, Homo Sapiens
agggaggccugcgcaaagcuaguuuuauuucuuaaaggauaacagucauacauagaauacuag

SEQ ID NO: 559052 - RNA, 63 nt, Homo Sapiens
gaaaugugugagaguguuacuuacugaaaacugaaaggauaugacaugcuggaacaggcaaaa

SEQ ID NO: 559053 - RNA, 63 nt, Homo Sapiens
uaggagcaugaaguuugaguuuuguguuuuuccaaaggauacuuccuuggcccuuuuucuuua

SEQ ID NO: 559054 - RNA, 63 nt, Homo Sapiens
ggaaucugugaacgccuagaaaaugagcagaauaaaggauauuaucuuuggaagucuuagaug

SEQ ID NO: 559055 - RNA, 63 nt, Homo Sapiens
acugguuuguuugcuuaauuuccuucuguuaagaaaggauauaaaaggauguuacaaguuugc

SEQ ID NO: 559056 - RNA, 63 nt, Homo Sapiens
uaagagguggccuucaugguccaaggggcaggaaaaggauauggaggaaucaaggggccauua

SEQ ID NO: 559057 - RNA, 63 nt, Homo Sapiens
ccuggagaaaaccagagauccaguacagaaaggaaaggauauuuauugauuaacagaaguugu

SEQ ID NO: 559058 - RNA, 63 nt, Homo Sapiens
cauuauuuucaaauggcuuugccacuugacaagaaaggauauuaauuguaacaauaaaucaca

SEQ ID NO: 559059 - RNA, 63 nt, Homo Sapiens
auuuuucuaauaaaugcggcgaaaggaauuuccaaaggauaaugcccuggagccaaucuucaa

SEQ ID NO: 559060 - RNA, 63 nt, Homo Sapiens
uuaaacuuaauuaaagaaaaacuauuuaaagguaaaggauauuuuguugacaucgguggcucg

SEQ ID NO: 559061 - RNA, 63 nt, Homo Sapiens
gcuggagucccaugaggaugugggcccuuuaauaaaggauagcaaacagggagcuuguggccu

SEQ ID NO: 559062 - RNA, 63 nt, Homo Sapiens
cagggaaucaaacuaaauguccaucagugguagaaaggauaaagaaaaugugguggcagggag

SEQ ID NO: 559063 - RNA, 63 nt, Homo Sapiens
uaguauuggcuucaguccgagccacaggcaauaaaaggauaucagcuguaguucucagcuaca

SEQ ID NO: 559064 - RNA, 63 nt, Homo Sapiens
auuguaugggacuuuccuuuggaucccccaaucaaaggauaagcaaugcguaagccugugucc

SEQ ID NO: 559065 - RNA, 63 nt, Homo Sapiens
uuuuuuggacagaguguggaaagggagccccccaaaggauagcuucuuuuucaugaugccagg

SEQ ID NO: 559066 - RNA, 63 nt, Homo Sapiens
ggugucauuuccauuauuuauauuaguuuagccaaaggauaaguguccccuauggggaugguc

SEQ ID NO: 559067 - RNA, 63 nt, Homo Sapiens
gguguuauuuccauuauuuauauuaguuuagccaaaggauaaguguccccuauggggaugguc

SEQ ID NO: 559068 - RNA, 63 nt, Homo Sapiens
ucugucucccuauaaugcuggagcggcuacuaaaaaggauaaaauguaucacuuaaauguuac

SEQ ID NO: 559069 - RNA, 63 nt, Homo Sapiens
aaggauggaacuauggguucucuucgcaaagccaaaggauaguguuuaacaagccagcuggcu

SEQ ID NO: 559070 - RNA, 63 nt, Homo Sapiens
aaaacaggagaggagaaauaucucauacaagugaaaggauacuggagagagaaauuacccauu

SEQ ID NO: 559071 - RNA, 63 nt, Homo Sapiens
ggucccgaaagauugcaacuuuggcugcuacagaaaggauagaaccuuuuuggggggagggug

SEQ ID NO: 559072 - RNA, 63 nt, Homo Sapiens
uuaauaaguucuuucugcuuuaauuguguaaagaaaggauauucaugaagcaaaauacuaauc

SEQ ID NO: 559073 - RNA, 63 nt, Homo Sapiens
cccauuugauccuaaccuuuauggauuucuuuaaaaggauauguaugaacuuuaaaugauuau

SEQ ID NO: 559074 - RNA, 63 nt, Homo Sapiens
ccacggagcaacuggaaaaccuugcaucuucacaaaggauaaaguuuccaacucugauuguca

SEQ ID NO: 559075 - RNA, 63 nt, Homo Sapiens
aucuaccuguucuguagcuuuuguacaauaugaaaaggauauugucugucagguuugguuuuu

SEQ ID NO: 559076 - RNA, 63 nt, Homo Sapiens
gcaaaaauuauguaauagaugauguauaaugaaaaaggauaaucaguagaaugauuucauuua

SEQ ID NO: 559077 - RNA, 63 nt, Homo Sapiens
gugucuuuaacucuuaaauugcacuggguggggaaaggauaguaaaagaaaguuacagguauu

SEQ ID NO: 559078 - RNA, 63 nt, Homo Sapiens
ucuucaucugggaccuggaaauccugaaauaaaaaaggauaaugcaauaaacacaguugcagg

SEQ ID NO: 559079 - RNA, 63 nt, Homo Sapiens
gaauauuacuccuauuuuuguaaacuggaauuaaaaggauaguauuuuuauccaugacaggcc

SEQ ID NO: 559080 - RNA, 63 nt, Homo Sapiens
uccucuggcccucccuuuuccuccacgaggauuaaaggauacaagcugaccaggccucacagg

SEQ ID NO: 559081 - RNA, 63 nt, Homo Sapiens
uuuugcauuuuuaauuauaauuuauuuauuuagaaaggauacuaauuuuuuuuauuacuccua

SEQ ID NO: 559082 - RNA, 63 nt, Homo Sapiens
cuauuuuauucuuggggggaucaaaccuuaggaaaaggauaucuauauaucuauauagcuaua

SEQ ID NO: 559083 - RNA, 63 nt, Homo Sapiens
ugaaaacaaccccaagcuauauauuaccagaugaaaggauaaacaaaauaugguccauccaua

SEQ ID NO: 559084 - RNA, 63 nt, Homo Sapiens
cuuucccucaucauaauguagauaaaaagaaaaaaaggauaugguuaccuguaaucuuaccaa

SEQ ID NO: 559085 - RNA, 63 nt, Homo Sapiens
uuccugaagaccggggcaucgggguggggugauaaaggauacaaccugcacagggggaaguua

SEQ ID NO: 559086 - RNA, 63 nt, Homo Sapiens
uauaaaagcaagguuuauuauaaaagauacuacaaaggauacagaugaagaggcacauagggc

SEQ ID NO: 559087 - RNA, 63 nt, Homo Sapiens
caaaaugugguccauccauaauauuaccagaugaaaggauaaaugaaaacaaccccaagcuau

SEQ ID NO: 559088 - RNA, 63 nt, Homo Sapiens
cuuuaucaguucauuauuuauugaccauaucccaaaggauagucaaaaaggcaaauguacccu

SEQ ID NO: 559089 - RNA, 63 nt, Homo Sapiens
ucaauuuuguaucuauuucuaagcaugguaguuaaaggauacugguggaagggaaauguuacc

SEQ ID NO: 559090 - RNA, 63 nt, Homo Sapiens
uauauacucaguucccaaaaaaagaauggauugaaaggauauguggauaaauuauguaaaacu

SEQ ID NO: 559091 - RNA, 63 nt, Homo Sapiens
guuuucauaauuuuuuauugggacuaaauaacaaaaggauaaugaaaagaacuccauuucauu

SEQ ID NO: 559092 - RNA, 63 nt, Homo Sapiens
gauuucauaauuuucuauuugacuaaauaaucaaaaggauaauaaaaauacucaauguuauug

SEQ ID NO: 559093 - RNA, 63 nt, Homo Sapiens
guuuucauaauuuuuuauuggacuaaauaaucaaaaggauaauaaaaaaacucaauguuauug

SEQ ID NO: 559094 - RNA, 63 nt, Homo Sapiens
gaaagagacccagaaaaaggagggacagagccaaaaggauagaacucuguccagacaugauag

SEQ ID NO: 559095 - RNA, 63 nt, Homo Sapiens
ccccgauauugggaccucacgcugggacugaggaaaggauaaauugguuggagagcugaacag

SEQ ID NO: 559096 - RNA, 63 nt, Homo Sapiens
aaagcuggaugguggcucauaaaaaaaaaaaaaaaaggauauccagugagaaucugucucaaa

SEQ ID NO: 559097 - RNA, 63 nt, Homo Sapiens
augcauuggaaaaagcuguguauaugaaguaauaaaggauaaacucaagaguauuaaaaggau

SEQ ID NO: 559098 - RNA, 63 nt, Homo Sapiens
cacuuuguagaaacaagaacuucucacauauggaaaggauacaaaguuuguauuuccucagag

SEQ ID NO: 559099 - RNA, 63 nt, Homo Sapiens
gaauuguauauacauacuuacaugaaggaauaaaaaggauacacacugcaucaguauacauaa

SEQ ID NO: 559100 - RNA, 63 nt, Homo Sapiens
caaaaaacuggguggagaaauaauuguuucuuuaaaggauaugaguuagaaucacccccuguu

SEQ ID NO: 559101 - RNA, 63 nt, Homo Sapiens
uuuucuuuucucuuuuacugcuaagcagccuggaaaggauaaaugaauauuagacuaagauuu

SEQ ID NO: 559102 - RNA, 63 nt, Homo Sapiens
cuccuuuugaacuugucacgaauuccaucuuguaaaggauauuaaauguugcuuuaaccugaa

SEQ ID NO: 559103 - RNA, 63 nt, Homo Sapiens
ccauuacacuagagcagggcucuauuuauuuuuaaaggauauggccguguguuuugauaaaac

SEQ ID NO: 559104 - RNA, 63 nt, Homo Sapiens
cugugcguugggucaguuucuguuacguaacgaaaaggauaaacaucucccacgggagaggcc

SEQ ID NO: 559105 - RNA, 63 nt, Homo Sapiens
aauagcuuuauccugcacucggccugguuguucaaaggauaagaagaaaaaaaaagccuuagu

SEQ ID NO: 559106 - RNA, 63 nt, Homo Sapiens
gccuucucaagaucauaggcugcagacccucccaaaggauacuuggcucaagauuuggcccca

SEQ ID NO: 559107 - RNA, 63 nt, Homo Sapiens
aaugauuccugagcaccuccagggaggaaguugaaaggauacuaugaagcaggcaugagccag

SEQ ID NO: 559108 - RNA, 63 nt, Homo Sapiens
aacuugguaguucauaaagguuuacagugaauaaaaggauaucaucuugaguauagcaauauc

SEQ ID NO: 559109 - RNA, 63 nt, Homo Sapiens
uaaucccaggcuggccauucauucagguuuuuuaaaggauauuuaacuuuuauggacuagaag

SEQ ID NO: 559110 - RNA, 63 nt, Homo Sapiens
uauccaauaaaaaaaaaccuuaaacaacucuuuaaaggauaauauuuuuaaagucuaaacugu

SEQ ID NO: 559111 - RNA, 63 nt, Homo Sapiens
auaaaccgccuuuuuggcagccuaccaaugccaaaaggauaaaugucuuuccaaaagugugua

SEQ ID NO: 559112 - RNA, 63 nt, Homo Sapiens
gcuaguuuuaaaauaaugaucucagauuuuuaaaaaggauauaggaaccugcauugucauucu

SEQ ID NO: 559113 - RNA, 63 nt, Homo Sapiens
cuaauucguuuuccuauuucuuuucauacaaauaaaggauaccuggauuuauuuagguuauua

SEQ ID NO: 559114 - RNA, 63 nt, Homo Sapiens
aaaugaauuuaucauuuuaguauaguuuucgauaaaggauauagcaacaucuuuugauaauug

SEQ ID NO: 559115 - RNA, 63 nt, Homo Sapiens
gauuuuagcauauguuaagaggaauugcagugaaaaggauaacauuuuuccauaguaaauugu

SEQ ID NO: 559116 - RNA, 63 nt, Homo Sapiens
uuucugauauagaauugcaauuuuaacacacauaaaggauaaacuuuuagaaacuuaucuuac

SEQ ID NO: 559117 - RNA, 63 nt, Homo Sapiens
guaagagagauuguaaaugauaaaccgagcuuuaaaggauaaaguguuaauaaagaaaggaag

SEQ ID NO: 559118 - RNA, 63 nt, Homo Sapiens
auuuucaguuauuauauuuacaaaugggaaacaaaaggauaaugaauacuuuauaaaggauua

SEQ ID NO: 559119 - RNA, 63 nt, Homo Sapiens
uuaucacuaauaagcaucaguuuguuguuuuuaaaaggauauuuaagugagcauuuucuaguu

SEQ ID NO: 559120 - RNA, 63 nt, Homo Sapiens
auauuaaaacugcuuugcauagaaugggggaagaaaggauagacaaacggugaauauuauaga

SEQ ID NO: 559121 - RNA, 63 nt, Homo Sapiens
aacagccauucuuuggacugaaucuguucagccaaaggauacuuguguucuaauuaacacagu

SEQ ID NO: 559122 - RNA, 63 nt, Homo Sapiens
ggagaccuguuuuagaaggauuugcaaaauaauaaaggauauucaugugugcaugugaguaug

SEQ ID NO: 559123 - RNA, 63 nt, Homo Sapiens
cauuagcaugacugcuuuguuucacuguuuuggaaaggauagcagagaaaagcuccuuuucuc

SEQ ID NO: 559124 - RNA, 63 nt, Homo Sapiens
auaagcauuaggaaggcuaguacaaaagccaaaaaaggauaaauugacagauuuguagacaau

SEQ ID NO: 559125 - RNA, 63 nt, Homo Sapiens
cacacacacacacacgugcacacacacacauuuaaaggauauaaaaagaagagguugaaagau

SEQ ID NO: 559126 - RNA, 63 nt, Homo Sapiens
accaaauaauaaauauuaagaagaaugggggaaaaaggauagaauauuaaaacugcuuugcau

SEQ ID NO: 559127 - RNA, 63 nt, Homo Sapiens
ggcagacgugcuuuauagcuaaaugaacaaagcaaaggauacagagguauguucucucuuaga

SEQ ID NO: 559128 - RNA, 64 nt, Homo Sapiens
aggaaaaaaggcagaguaacauuacuuaaaaaaaaaaggauauguuuacauuuaauuuuggcua

SEQ ID NO: 559129 - RNA, 64 nt, Homo Sapiens
agaggaggaaaagugaaucacggagagagaaaggaaaggauagaaucacaggcugcgucugcac

SEQ ID NO: 559130 - RNA, 64 nt, Homo Sapiens
cuuugcuaaaaagaaccauauuauuuugauucucaaaggauaggccuuugaguguuagagaaag

SEQ ID NO: 559131 - RNA, 64 nt, Homo Sapiens
uuuguuuuccuguaaaugcagauaguuaaaaucuaaaggauagaaugcuuuccuaaaacagaac

SEQ ID NO: 559132 - RNA, 64 nt, Homo Sapiens
cauuacuuuuaaguguauuaugaaggcaguuuucaaaggauaugaccaguugggguaauucaaa

SEQ ID NO: 559133 - RNA, 64 nt, Homo Sapiens
uugcaccaguuucuggaggcccuugucauuucaaaaaggauagucucuuuucuuacucuggcaa

SEQ ID NO: 559134 - RNA, 64 nt, Homo Sapiens
uuaaugagacaauuuuccuaccaaaggaagaacaaaaggauaaauauaauacaaaauauaugua

SEQ ID NO: 559135 - RNA, 64 nt, Homo Sapiens
cugaccuccuugccucuugucuugaaccauagcaaaaggauacugcaucucucauuacuguagu

SEQ ID NO: 559136 - RNA, 64 nt, Homo Sapiens
caguucuugcacucuuuguacagaauugguauaaaaaggauaauuccacacugaucuuguccca

SEQ ID NO: 559137 - RNA, 64 nt, Homo Sapiens
uugugugaacuacaguauauaaugauaacaauuaaaaggauauucuguggaugucacguauuuu

SEQ ID NO: 559138 - RNA, 64 nt, Homo Sapiens
ucacuuuacuacaguuacuuuugcaaacagacagaaaggauacacuucuaaccacauuuuacuu

SEQ ID NO: 559139 - RNA, 64 nt, Homo Sapiens; identical to SEQ ID NO: 164644

SEQ ID NO: 559140 - RNA, 64 nt, Homo Sapiens; identical to SEQ ID NO: 164645

SEQ ID NO: 559141 - RNA, 64 nt, Homo Sapiens
aaucauaaagaaaaacuaaaaaugaaccaaagugaaaggauaacuuccaggcaguaucuuucua

SEQ ID NO: 559142 - RNA, 64 nt, Homo Sapiens
auaccacuuaagauaggagucuaaacuccacagaaaaggauaauaccaagagcuuguauuguua

SEQ ID NO: 559143 - RNA, 64 nt, Homo Sapiens
agaaucuggaccccagagucuggaagcaggccagaaaggauaaggcaaaugacugaacaguucc

SEQ ID NO: 559144 - RNA, 64 nt, Homo Sapiens; identical to SEQ ID NO: 164646

SEQ ID NO: 559145 - RNA, 64 nt, Homo Sapiens; identical to SEQ ID NO: 164647

SEQ ID NO: 559146 - RNA, 64 nt, Homo Sapiens
ugguuuacaugcacugucucauuuaaucugagauaaaggauacuuaagcccaaacuauaucuaa

SEQ ID NO: 559147 - RNA, 64 nt, Homo Sapiens; identical to SEQ ID NO: 164648

SEQ ID NO: 559148 - RNA, 64 nt, Homo Sapiens; identical to SEQ ID NO: 164649

SEQ ID NO: 559149 - RNA, 64 nt, Homo Sapiens
uaaaugaaucuaaucaaaaugugaauaguagucaaaaggauaauuuaauaagcauuuuacguua

SEQ ID NO: 559150 - RNA, 64 nt, Homo Sapiens
uuuuuuuuuuuuuuuaugaugauuaagaaaauggaaaggauauggaugaauuguguaaacuuag

SEQ ID NO: 559151 - RNA, 64 nt, Homo Sapiens; identical to SEQ ID NO: 164650

SEQ ID NO: 559152 - RNA, 64 nt, Homo Sapiens; identical to SEQ ID NO: 164651

SEQ ID NO: 559153 - RNA, 64 nt, Homo Sapiens
ggacacugucuuaugaagguuugcuugggaugaaaaaggauauugcagcuucagcaguguugaa

SEQ ID NO: 559154 - RNA, 64 nt, Homo Sapiens
uagaaagguuuggguugaugugggcagacuucaaaaaggauagucuugccucgcugauguugca

SEQ ID NO: 559155 - RNA, 64 nt, Homo Sapiens
caggacucgcugggagagaugccagaguguaaguaaaggauaaccacacgccacugcccccgag

SEQ ID NO: 559156 - RNA, 64 nt, Homo Sapiens
cagggucaaaucauguacauugaagugaaaaaaaaaaggauauuacuuuuuaaaaaaugauguu

SEQ ID NO: 559157 - RNA, 64 nt, Homo Sapiens; identical to SEQ ID NO: 164652

SEQ ID NO: 559158 - RNA, 64 nt, Homo Sapiens; identical to SEQ ID NO: 164653

SEQ ID NO: 559159 - RNA, 64 nt, Homo Sapiens
aaagcuuuggauauguauuucuuaaaucuauuuaaaaggauauauucccccaaagaguugaaau

SEQ ID NO: 559160 - RNA, 64 nt, Homo Sapiens
uggagaaucaucaagauaugaggcuaaaagggaaaaaggauaugugaguuucucuuggguauaa

SEQ ID NO: 559161 - RNA, 64 nt, Homo Sapiens
gauauuuggcucaccucguuucaucaggaccaagaaaggauaaggcaaguaacagcuucagaau

SEQ ID NO: 559162 - RNA, 64 nt, Homo Sapiens
cacuuucagcgcuuauacuguuuuuauaaaagcaaaaggauauugauaguuuauuguagugaug

SEQ ID NO: 559163 - RNA, 64 nt, Homo Sapiens
uucuuccaagcaaaggugaauggcuaaugaagggaaaggauauuucucaggaucaagaaagugu

SEQ ID NO: 559164 - RNA, 64 nt, Homo Sapiens
uauuuaaauagaugacauuggaacacucuauaacaaaggauacugggcccuuuuucaauaacug

SEQ ID NO: 559165 - RNA, 64 nt, Homo Sapiens
uuuuuugaccuauuuuagggcuuuuuaauugugcaaaggauaaacacuaucaauuuuaaggaaa

SEQ ID NO: 559166 - RNA, 64 nt, Homo Sapiens
aaaauuuuuaaagaaaagauaagcagaucaacuuaaaggauaauuuuccuuucuuuucauaaug

SEQ ID NO: 559167 - RNA, 64 nt, Homo Sapiens
aguauagauuaaugacuggaccuuuacuuucaggaaaggauagaugagagaaguaauggcaagg

SEQ ID NO: 559168 - RNA, 64 nt, Homo Sapiens
uuugauuuuguguguuucauuucuuuaaggagaaaaaggauaccgucuaagaauccuucaggca

SEQ ID NO: 559169 - RNA, 64 nt, Homo Sapiens
uugccagcagugcagagccugguugucacccauuaaaggauaggucuccccggagugcacagcu

SEQ ID NO: 559170 - RNA, 64 nt, Homo Sapiens
gaaauugccaaagcccaaauuaacgaguauuauaaaaggauaauaaagcaucccugaagccaaa

SEQ ID NO: 559171 - RNA, 64 nt, Homo Sapiens
aguuuugcauaauuauaaucggcauuguacauagaaaggauauggcuaccuuuuguuaaaucug

SEQ ID NO: 559172 - RNA, 64 nt, Homo Sapiens
gcgggaguagcaguaguccaaaccuaguauagggaaaggauaaaaauaagucaccuucaccaag

SEQ ID NO: 559173 - RNA, 64 nt, Homo Sapiens
uuccucgaaacuaguguguguuuauuaaaaggagaaaggauaacaauagaauguucuaaaacca

SEQ ID NO: 559174 - RNA, 64 nt, Homo Sapiens
ggcccacaugaagagagggaaccuguuaguccagaaaggauacggauagauagccugucugacu

SEQ ID NO: 559175 - RNA, 64 nt, Homo Sapiens
aaauuguauuugagggaaaaaaccaugaccaaguaaaggauaaauucaaaaaauagccucauga

SEQ ID NO: 559176 - RNA, 64 nt, Homo Sapiens
ggcuaacgagggauuacuuuggccaaaaccuuucaaaggauaugcagaaagaugguagggagca

SEQ ID NO: 559177 - RNA, 64 nt, Homo Sapiens
gaaugacugaauuuacuacaaaggcaaacuuucaaaaggauaucucauuuuuguuucuaaauau

SEQ ID NO: 559178 - RNA, 64 nt, Homo Sapiens
ccaaaaaaaaguuucugaagguaaaagauauacuaaaggauauacauauacugccucuucuaug

SEQ ID NO: 559179 - RNA, 64 nt, Homo Sapiens
aggacuccuugugcucccagcagcucagacagggaaaggauaguccccacucacggugacacca

SEQ ID NO: 559180 - RNA, 64 nt, Homo Sapiens
uauauagccuuuuaguagcaagacuuaucagaugaaaggauauucaaacacuagagguuuaaua

SEQ ID NO: 559181 - RNA, 64 nt, Homo Sapiens
aagguucuccauagguucuuaaaucauauaauguaaaggauaucgauaaaagcaaccucucuau

SEQ ID NO: 559182 - RNA, 64 nt, Homo Sapiens
uuguaauaaguaaguggugugcuauuuuaucaauaaaggauauuuuuuuuuuuuuaaacucuga

SEQ ID NO: 559183 - RNA, 64 nt, Homo Sapiens
auuuuuauacaaauaucuuuuguauauaaaaauaaaaggauagccgagugcgauuuauuuaagu

SEQ ID NO: 559184 - RNA, 64 nt, Homo Sapiens
uucacaauuucccuucauaugcuuucaaaagaguaaaggauacucacaguaaggcaaaggccaa

SEQ ID NO: 559185 - RNA, 64 nt, Homo Sapiens
uauuuggguguuuugagcuuuuguuuauucauauaaaggauaaauauuguaauucauagggcuu

SEQ ID NO: 559186 - RNA, 64 nt, Homo Sapiens
aagaaauacuauugcucuagcuguccugcuaccuaaaggauauacucuuuacuauguccuagcu

SEQ ID NO: 559187 - RNA, 64 nt, Homo Sapiens
guacuaaaaauaaaaugugaugaugagcacugacaaaggauaugacccauuuuaaugugcauuc

SEQ ID NO: 559188 - RNA, 64 nt, Homo Sapiens
agacccaaaguuacuauagucaaccaagucuuucaaaggauaaaagaucauuuuauuaucuuua

SEQ ID NO: 559189 - RNA, 64 nt, Homo Sapiens
uaugccugucuuuaaaguguuauuuuauuaauuaaaaggauauggcuauuauuauauauucucu

SEQ ID NO: 559190 - RNA, 64 nt, Homo Sapiens
gggacuaggggagugguggggaggugaguggaccaaaggauauaggccccaggcaugcagaugg

SEQ ID NO: 559191 - RNA, 64 nt, Homo Sapiens
gaggauaaaggaacugagaccagaugagaaaaagaaaggauauagauuccuugaguggaauagu

SEQ ID NO: 559192 - RNA, 64 nt, Homo Sapiens
caagacuuuuccugcaauagccugggaaggaauaaaaggauagaguguuuggguuuuuguguaa

SEQ ID NO: 559193 - RNA, 64 nt, Homo Sapiens
uuauauucacaguuuuuuaaaaaugugucaaaauaaaggauaacucuguauuacagcuuucaca

SEQ ID NO: 559194 - RNA, 64 nt, Homo Sapiens
uuauaaaaacuagucaagccuaaugcaacuggcuaaaggauaguaccacccucacccccaccau

SEQ ID NO: 559195 - RNA, 64 nt, Homo Sapiens
ccuaaaauguguuucauucuaguaagaaaaccucaaaggauauuguaggauauaaaucuuacuu

SEQ ID NO: 559196 - RNA, 64 nt, Homo Sapiens
aaauccuauaauauccuugaaaagaaacuauuaaaaaggauagacauuucugauguaaguaaaa

SEQ ID NO: 559197 - RNA, 64 nt, Homo Sapiens
uuccuuuuuuugagguuuggauguugcagcuaguaaaggauauuuuugcucuguucagcaguuc

SEQ ID NO: 559198 - RNA, 64 nt, Homo Sapiens
cccucugucuacaaauauaagauuuucugggccuaaaggauagaucaaagucaaaaauagcaau

SEQ ID NO: 559199 - RNA, 64 nt, Homo Sapiens
gaaagauuccacagagauguuuauggugagguuuaaaggauaugaaacucuacauuuaaacaag

SEQ ID NO: 559200 - RNA, 64 nt, Homo Sapiens
uccuugaguguaugaguagccaggguaagggguaaaaggauaguaagcauagaaaccacuagaa

SEQ ID NO: 559201 - RNA, 64 nt, Homo Sapiens
acagacugcacuaaauguuuacagaaaaguuggaaaaggauaauaucuucaaaaacuugcacaa

SEQ ID NO: 559202 - RNA, 64 nt, Homo Sapiens
auguuuuaauaguagagcagucagauuaugaaugaaaggauaaagcuucugauuauugaagagg

SEQ ID NO: 559203 - RNA, 64 nt, Homo Sapiens
acacugcacugagucugaugcccagcuuuucauuaaaggauaacgagaguggugacuccauuga

SEQ ID NO: 559204 - RNA, 64 nt, Homo Sapiens
cauccuccaaaacgccuccauggcacgccaaagcaaaggauaacacugcagugauaccgaacug

SEQ ID NO: 559205 - RNA, 64 nt, Homo Sapiens
ugaaugaugauaagucagucuaagccacuaaauaaaaggauaaaggaaucuaucuucuaggauc

SEQ ID NO: 559206 - RNA, 64 nt, Homo Sapiens
augaacgcuauuugaggacuuaaaaggaugacucaaaggauaaagauacuugaaggacuuuaua

SEQ ID NO: 559207 - RNA, 64 nt, Homo Sapiens
aagguggcuggcuaggaaggauuuguuuugcaauaaaggauaugcaaugaguuuuauuuuguuu

SEQ ID NO: 559208 - RNA, 64 nt, Homo Sapiens
acagugcaugcuguuuguuccacaauuuuuaaauaaaggauacccacuacaacuguagucagcu

SEQ ID NO: 559209 - RNA, 64 nt, Homo Sapiens
uuagaauugaguugugugaauauacaucucuguaaaaggauauuacagcuuggaagcguuuauu

SEQ ID NO: 559210 - RNA, 64 nt, Homo Sapiens
aaaucacaggugauagcaguagcaauaucagcuaaaaggauaugaaaaguuugggaagcucuuu

SEQ ID NO: 559211 - RNA, 64 nt, Homo Sapiens
gaaucauucuuuacaugcaaucaauacaagauaaaaaggauaguuuuuaaauguuuugacgauu

SEQ ID NO: 559212 - RNA, 64 nt, Homo Sapiens
uuuuaaaaaaucuuuauaggacuuauucuauacuaaaggauaaagcuuaaagugcucccuugac

SEQ ID NO: 559213 - RNA, 64 nt, Homo Sapiens
ucaaauauucaaaaggccauuauuaugaauuucaaaaggauaaaugaaaaaucaaaaacuauuu

SEQ ID NO: 559214 - RNA, 64 nt, Homo Sapiens
guaacacuuuacaauguucacucagaaucuacccaaaggauacugcuuucgucuccagccccuu

SEQ ID NO: 559215 - RNA, 64 nt, Homo Sapiens
cuguugcucuaucuaauuuucuuuuccuggagggaaaggauaggugccauccaagugaugaugg

SEQ ID NO: 559216 - RNA, 64 nt, Homo Sapiens
acuuuaaacaguugauucuuucauagagugaagaaaaggauaaguuuuuuuguagaaguagcug

SEQ ID NO: 559217 - RNA, 64 nt, Homo Sapiens
ucaaucaagccagcccucuccucuucugucacguaaaggauauuuggcacacucaugcgucauu

SEQ ID NO: 559218 - RNA, 58 nt, Homo Sapiens; identical to SEQ ID NO: 558898

SEQ ID NO: 559219 - RNA, 64 nt, Homo Sapiens
aacaagauccucccagcuuucucucuacauguagaaaggauaacauuucucaugaacccacugc

SEQ ID NO: 559220 - RNA, 64 nt, Homo Sapiens
auaggaacuacaacuucauaaaugaggaaccagaaaaggauagcugggaggcauuacauaguca

SEQ ID NO: 559221 - RNA, 64 nt, Homo Sapiens
ucuacugggauaaaccucaauuccuuuauucaggaaaggauacuuuauugcauuauuguugcag

SEQ ID NO: 559222 - RNA, 64 nt, Homo Sapiens
uggcucaaaaccgaaaacaaugaagcuugguuuuaaaggauaaaguuuucuuuuuuguuuuccu

SEQ ID NO: 559223 - RNA, 64 nt, Homo Sapiens
uaaauaagccuaucuuuuugugcuuacauacuuaaaaggauaucauuaaguauauaaacaauca

SEQ ID NO: 559224 - RNA, 64 nt, Homo Sapiens
aaagugcgauaacugaacauuuuuuuuuuucugaaaaggauaccuguuuauaaguuuugagauu

SEQ ID NO: 559225 - RNA, 64 nt, Homo Sapiens
aaguuacagcuugguaggaggagagagauuuguuaaaggauacagcugcagcaaagggagacua

SEQ ID NO: 559226 - RNA, 64 nt, Homo Sapiens
cucacauuuacaaguagugaagcuaggguaagguaaaggauagauaccaaaucccugggguaaa

SEQ ID NO: 559227 - RNA, 64 nt, Homo Sapiens
gcauuauucuagcagcauccucaguugucacaucaaaggauacaagggggagggagauggaugc

SEQ ID NO: 559228 - RNA, 64 nt, Homo Sapiens
aaagcuauaacuaaaaaaauaucaugguuugaaaaaaggauaaauuuuuuaagugucaaauauc

SEQ ID NO: 559229 - RNA, 64 nt, Homo Sapiens
agaccccgugcccuuuaaaccggcauuugcugcuaaaggauacccagaacccucacuacuguaa

SEQ ID NO: 559230 - RNA, 64 nt, Homo Sapiens
aagcaaagaccacacauuuuuuacuacaaaauguaaaggauaaauguaaauccugcauaacuaa

SEQ ID NO: 559231 - RNA, 64 nt, Homo Sapiens
auauaacuccacuguacaucauccuuugaguaguaaaggauaaaagcauauauacuaccuauau

SEQ ID NO: 559232 - RNA, 64 nt, Homo Sapiens
ccgcccaccaccuccuucccccucaucacaugacaaaggauaaugugcaagaaaaguauuuuua

SEQ ID NO: 559233 - RNA, 64 nt, Homo Sapiens
uuaagaucaugaaacaauuccaguuacauuguaaaaaggauaucuuacgaguaauuuuauugaa

SEQ ID NO: 559234 - RNA, 64 nt, Homo Sapiens
ucuucaagucaagaaauaaauuucuuuacauagaaaaggauacagauuuaguaccaagaacacu

SEQ ID NO: 559235 - RNA, 64 nt, Homo Sapiens
aaacaaaaaacuguuuucauuugcucucuugaccaaaggauaggacuuuaguucuuuaagcauu

SEQ ID NO: 559236 - RNA, 64 nt, Homo Sapiens
gucuguaccagguggugguuauggggucugaaccaaaggauagcagcucuucauuccucuucug

SEQ ID NO: 559237 - RNA, 64 nt, Homo Sapiens
uauuuauaggccuuuuuuuuuuccuuuuagagucaaaggauauuauuguuuuucuacuucauuu

SEQ ID NO: 559238 - RNA, 64 nt, Homo Sapiens
cugacuuaagaaacuuuuugucauuuaaaacaugaaaggauaauggacuucuuuagaagaagcu

SEQ ID NO: 559239 - RNA, 64 nt, Homo Sapiens
gcuucauuccauaccaaagaaccuggugacuuugaaaggauagaacuuagggcugggaacccga

SEQ ID NO: 559240 - RNA, 64 nt, Homo Sapiens
aaaaagcaaguggccagugugaagaaaccucaggaaaggauaugcugcuauuuacuagcaguga

SEQ ID NO: 559241 - RNA, 64 nt, Homo Sapiens
ucagacuauacaaaaccuaaagcagcuuaacaacaaaggauaaaaagaauccuuauuucagucu

SEQ ID NO: 559242 - RNA, 64 nt, Homo Sapiens
cugugggguuagaacauaucaaggucagcugucaaaaggauaacugcuuacauuuuauaaguuu

SEQ ID NO: 559243 - RNA, 64 nt, Homo Sapiens
cacaaaauuguuugaaaaacuccagcucaggaugaaaggauagaucuaucacauucucaauagu

SEQ ID NO: 559244 - RNA, 64 nt, Homo Sapiens
cacaguaguacaguucucaauguguuaccauggaaaaggauauugaaguacgugugugugugug

SEQ ID NO: 559245 - RNA, 64 nt, Homo Sapiens
ugucgaaaaaaagagcaaaaguucuuucuguuugaaaggauauuauuuugaggugucucuuugg

SEQ ID NO: 559246 - RNA, 64 nt, Homo Sapiens
agaguagcauaagcugcugaugucacugggaaccaaaggauaaaggcauuauuacugcauuguu

SEQ ID NO: 559247 - RNA, 64 nt, Homo Sapiens
auaccauuagucagauuugaauaacgagguuuugaaaggauaaaaccuuuucuccaaugacagg

SEQ ID NO: 559248 - RNA, 64 nt, Homo Sapiens
guugcacauguuuuccccuaaaagcuuacucuagaaaggauauuuuuuggagagggaguguggg

SEQ ID NO: 559249 - RNA, 64 nt, Homo Sapiens
aagaucugagacaugggauucccauuugagagccaaaggauaugcccugucaugguuucuguuu

SEQ ID NO: 559250 - RNA, 64 nt, Homo Sapiens
gaaugaaugauguuugaaugauauauaacaaaccaaaggauauuacagaauauuagauucauua

SEQ ID NO: 559251 - RNA, 64 nt, Homo Sapiens
aaagguuaguauuuuuguuguaguuaggauacuaaaaggauauuaguuacccaagagauccaau

SEQ ID NO: 559252 - RNA, 64 nt, Homo Sapiens
cguaucucuuuucaucugaaaacuaauaccuggaaaaggauaaaaaaaaaaaggaauccgugac

SEQ ID NO: 559253 - RNA, 64 nt, Homo Sapiens
ccagagaaauacugacgaaguuuucugauguggcaaaggauauuucccaucuaauaccaguuuc

SEQ ID NO: 559254 - RNA, 64 nt, Homo Sapiens
uacuuacuuuuauugcauguuuuaaauggcuacuaaaggauaauuaguggaaagaccagauaac

SEQ ID NO: 559255 - RNA, 64 nt, Homo Sapiens
cagaggugcaucuuuuucuggauuugcuaagaucaaaggauauuauguauacuuuuaaaaaaaa

SEQ ID NO: 559256 - RNA, 64 nt, Homo Sapiens
gauaaaagaggcaccccauuuaggguugggaaauaaaggauaggccauggaucaagauccaguu

SEQ ID NO: 559257 - RNA, 64 nt, Homo Sapiens
gucaaaaauggcguucuucucuuccuauacauacaaaggauauugggggguggcaaucauuuuu

SEQ ID NO: 559258 - RNA, 64 nt, Homo Sapiens
aaucugagagaugcuguagaaugaaauauaugugaaaggauauggaaccucugauuuauuuugu

SEQ ID NO: 559259 - RNA, 64 nt, Homo Sapiens
auuaguguguauaacagauugauuuaaagaaaugaaaggauaccacacaaggaacuacauucca

SEQ ID NO: 559260 - RNA, 64 nt, Homo Sapiens
cauggguuagaaggaaguguagacaagguuuugaaaaggauaauuuuggaacucugaaggauuu

SEQ ID NO: 559261 - RNA, 64 nt, Homo Sapiens
uccagaaaggauuaagaaagaauaaaaaugaaccaaaggauauuuguuuugccuagagaggggc

SEQ ID NO: 559262 - RNA, 64 nt, Homo Sapiens
ugcaacaaugaaacaggaaaaaauuaccuaggguaaaggauagcucuaaugauacugacaacau

SEQ ID NO: 559263 - RNA, 64 nt, Homo Sapiens
ggaauacucaucuuacagggguguacugcagggaaaaggauauaacuaacuuuuaaaucagugu

SEQ ID NO: 559264 - RNA, 64 nt, Homo Sapiens
guacuugucucucugcuuguuauugguuaagaaaaaaggauaugaggaauucauuuuaucaaug

SEQ ID NO: 559265 - RNA, 64 nt, Homo Sapiens
uuauuuauucccuaguuugcagaacugucugaauaaaggauacaaggauuauuucaauguuacu

SEQ ID NO: 559266 - RNA, 64 nt, Homo Sapiens
ucugugucagucuucauuuuaaauauggauacaaaaaggauacgccgagccaaucaaagacaag

SEQ ID NO: 559267 - RNA, 64 nt, Homo Sapiens
uggaaauuugaauuaaauacuguaucauacuuucaaaggauaaaaagacuaccccucugaaggu

SEQ ID NO: 559268 - RNA, 64 nt, Homo Sapiens
gacaauuuuguuugaaauucauauaucuuauuucaaaggauagcauaauaucugcauuaugcug

SEQ ID NO: 559269 - RNA, 64 nt, Homo Sapiens
ccugacagacuacuucuggaucuagacauaaaacaaaggauauacaguggucacagggcccaau

SEQ ID NO: 559270 - RNA, 64 nt, Homo Sapiens
ggaagagagggaagcagaagggcaggaaggaaagaaaggauauagaaauggaaaaaugaaagaa

SEQ ID NO: 559271 - RNA, 64 nt, Homo Sapiens
cucgaugauguaaauccaccuaaaagcaauggugaaaggauaacuggcuuggugugaacucgcu

SEQ ID NO: 559272 - RNA, 64 nt, Homo Sapiens
uaugccuuucuaaaguuguaacuucucuggugugaaaggauaaaccaugucuggcauugcauaa

SEQ ID NO: 559273 - RNA, 64 nt, Homo Sapiens
ugcuaccguugagaagggaacugacuguguugggaaaggauaagccgguggagauacaaguucu

SEQ ID NO: 559274 - RNA, 64 nt, Homo Sapiens
uuuaacaaauaugaccgagucuaguuuuucuuuaaaaggauaguuuaugaguaaucuuuaaaac

SEQ ID NO: 559275 - RNA, 64 nt, Homo Sapiens
cuggccuccccuggauauacucuauagugcaccaaaaggauaaagcaucuguacauguauuuuu

SEQ ID NO: 559276 - RNA, 64 nt, Homo Sapiens
ugugucacugccacucuguuuuaucccugaaauuaaaggauaacauaaggaggacuugggccuu

SEQ ID NO: 559277 - RNA, 64 nt, Homo Sapiens
acccuggagauauuuuuucuuauuugaguccaccaaaggauaaugccaacuuauauaaguucuc

SEQ ID NO: 559278 - RNA, 64 nt, Homo Sapiens
acuuaaaagcagauuuuuaugggaacuuuuuucgaaaggauacaugaccaccuucuuaaauagu

SEQ ID NO: 559279 - RNA, 64 nt, Homo Sapiens; identical to SEQ ID NO: 164654

SEQ ID NO: 559280 - RNA, 64 nt, Homo Sapiens; identical to SEQ ID NO: 164655

SEQ ID NO: 559281 - RNA, 64 nt, Homo Sapiens
ggcgaguuuacaagcuguggcaugcacaaaacauaaaggauaguaucaaauuuguuccuuuccu

SEQ ID NO: 559282 - RNA, 64 nt, Homo Sapiens
ucaaaugauuaugauuaguuugaucauauaucauaaaggauauuauggugggguucuucgggug

SEQ ID NO: 559283 - RNA, 64 nt, Homo Sapiens
uaaacaaagaaaugacaaaagacugccauuuaaaaaaggauagggcuucuuuugcaucauuugg

SEQ ID NO: 559284 - RNA, 64 nt, Homo Sapiens
aaugccuugauuagaccuaauaaagguguuuuguaaaggauaucaucuucauagcaaugucucc

SEQ ID NO: 559285 - RNA, 64 nt, Homo Sapiens
auuucuuaguaaaaugaaauugaaaugauaauaaaaaggauauauauguugaacuuuguauacu

SEQ ID NO: 559286 - RNA, 64 nt, Homo Sapiens
cgggaauugagcucagcucugacagaaaguuaaaaaaggauaucaacauuagacacaccaacga

SEQ ID NO: 559287 - RNA, 64 nt, Homo Sapiens
guuuguuuuuuucccuuuuaucuguggaaggaagaaaggauauucaguuugaauaguagguauc

SEQ ID NO: 559288 - RNA, 64 nt, Homo Sapiens
gccugaggggcucaucgacgccugugacagggagaaaggauacuucugaacaaggagccuccaa

SEQ ID NO: 559289 - RNA, 64 nt, Homo Sapiens
acacagaauuguuccaguacuauggagugcucacaaaggauacuuuuacagguuaagacaaagg

SEQ ID NO: 559290 - RNA, 64 nt, Homo Sapiens
aaaaagacacgguugcucuauauaugaagugaaaaaaggauaugguagcauuuuauaguacuag

SEQ ID NO: 559291 - RNA, 64 nt, Homo Sapiens
guauuauguuguacaucauuaaagaucuaaauacaaaggauauacagucuugaaucuaaaauaa

SEQ ID NO: 559292 - RNA, 64 nt, Homo Sapiens
auaaauauuuugauauuauuuuccuuuuuaauauaaaggauagguuugaauuguacuuaaaaug

SEQ ID NO: 559293 - RNA, 64 nt, Homo Sapiens
aaaccaggauccauuuagguaccacuugauauaaaaaggauauccauaaugaauauuuuauacu

SEQ ID NO: 559294 - RNA, 64 nt, Homo Sapiens
gcacuuuuggacaaugcuaucccagcaggaaaaaaaaggauaauauaacuguuuuaaaacucuu

SEQ ID NO: 559295 - RNA, 64 nt, Homo Sapiens
uaacagagcucuguugucugguuuuagucuuucuaaaggauauuuuaacuaaaacuauggagau

SEQ ID NO: 559296 - RNA, 64 nt, Homo Sapiens
cuuucucuguuauuuauauaaaaauaauuuaucaaaaggauauuuuaaaaaagcuagucugucu

SEQ ID NO: 559297 - RNA, 64 nt, Homo Sapiens
auuucuaagauauuuugaauaggguauguuaacuaaaggauagcaaucaauguuacaaaauuua

SEQ ID NO: 559298 - RNA, 64 nt, Homo Sapiens
uuuauugacacauaaucuguauauguuauuggggaaaggauaugaguuaguugagaaucagagc

SEQ ID NO: 559299 - RNA, 64 nt, Homo Sapiens
guacucuuugggggaugaguauugcugcugcuuuaaaggauaaauuguacauaugugccuugug

SEQ ID NO: 559300 - RNA, 64 nt, Homo Sapiens; identical to SEQ ID NO: 164656

SEQ ID NO: 559301 - RNA, 64 nt, Homo Sapiens; identical to SEQ ID NO: 164657

SEQ ID NO: 559302 - RNA, 64 nt, Homo Sapiens
cuuucuuuucauugacaacaucucauuaauuuacaaaggauaauaugcauaaaucaggauacca

SEQ ID NO: 559303 - RNA, 64 nt, Homo Sapiens
uacuuaauguuaauacacaguaggauaaagaauaaaaggauaaugccaucuuauuuggcuaaug

SEQ ID NO: 559304 - RNA, 64 nt, Homo Sapiens
acaagggaaguuaaauuuugagacuuuuuuccccaaaggauacugacuguaauacaauuaccaa

SEQ ID NO: 559305 - RNA, 64 nt, Homo Sapiens
gaaauuucauuuguaauuggaaaaaauccaauaaaaaggauauucauuuagaaaauagcuaaga

SEQ ID NO: 559306 - RNA, 64 nt, Homo Sapiens
aggucucaauaccugaagcuaucguaaaauuaagaaaggauaaaguugguaaaccuuuuauauu

SEQ ID NO: 559307 - RNA, 64 nt, Homo Sapiens
gaaaaaaaaucaucuugcccacaggccuguggcaaaaggauaaaaaugugaacgaaguuuaaca

SEQ ID NO: 559308 - RNA, 64 nt, Homo Sapiens
cauacaaaaguguguauaaaauguacguuuuaaaaaaggauaagugaacacccaugaaccuacu

SEQ ID NO: 559309 - RNA, 64 nt, Homo Sapiens
acuguuauaugagaaacauuuuaguaauuuaauaaaaggauaauguuuauuuaaaaaaccugac

SEQ ID NO: 559310 - RNA, 64 nt, Homo Sapiens
uuuugcaauguuauuagauguuaucgauagcaaaaaaggauacucaguaauaccauuaacuguu

SEQ ID NO: 559311 - RNA, 64 nt, Homo Sapiens
gaagcuacauagaagggacaccgugugcuuuaccaaaggauaugucagcccacuuguagaaggu

SEQ ID NO: 559312 - RNA, 64 nt, Homo Sapiens
auaugacaaauucucacuuaggcagauauaaaauaaaggauaauuuauuccuuuauuaacuuag

SEQ ID NO: 559313 - RNA, 64 nt, Homo Sapiens
gccuucccaaugcacaguuuggcgauuuuaauaaaaaggauaugagugaugcuuuuguauuugu

SEQ ID NO: 559314 - RNA, 64 nt, Homo Sapiens
auuguuugaauuuuuggguugacauuaaaaaucuaaaggauauuugauugccauuucaauaaau

SEQ ID NO: 559315 - RNA, 64 nt, Homo Sapiens
ccugaaccagaauaguuuuccucguaccuuggacaaaggauacaaugugaccgccaggccuccu

SEQ ID NO: 559316 - RNA, 64 nt, Homo Sapiens
ucagugugcgauuucaauuuuuugaguugcaauaaaaggauauugauuuucugguuuuugaaaa

SEQ ID NO: 559317 - RNA, 64 nt, Homo Sapiens
auugacauacccaaaguagcuuaggugaagauugaaaggauaggugaucuuaacuucacuucca

SEQ ID NO: 559318 - RNA, 64 nt, Homo Sapiens
gugaaaucacuaauuaacuagggaucggccugcgaaaggauacucugagggaacgguuggagug

SEQ ID NO: 559319 - RNA, 64 nt, Homo Sapiens
uaucaaauccagggauugcaguguaaucgauuauaaaggauauuauauuucuagauauugauua

SEQ ID NO: 559320 - RNA, 64 nt, Homo Sapiens
aagguguggaagugaauauaaucgcuuuaguaagaaaggauaaaaacuguguagaaacuaaauc

SEQ ID NO: 559321 - RNA, 64 nt, Homo Sapiens
cagcaaaauauuguccuuacucauucaagaauuaaaaggauaaauuuuaaaaauguuaucuguc

SEQ ID NO: 559322 - RNA, 64 nt, Homo Sapiens; identical to SEQ ID NO: 164658

SEQ ID NO: 559323 - RNA, 64 nt, Homo Sapiens; identical to SEQ ID NO: 164659

SEQ ID NO: 559324 - RNA, 64 nt, Homo Sapiens
ucugacugaaaacugaguuaacaagaugaaaucuaaaggauauucacagugacuucaauucagg

SEQ ID NO: 559325 - RNA, 64 nt, Homo Sapiens
aauuauaucuuaagguauguuguagaauaaauuaaaaggauaaucuaaaucaccauuuagauua

SEQ ID NO: 559326 - RNA, 64 nt, Homo Sapiens
acccuaaauacacgucuguuuagcccgcaauuggaaaggauauauguggcaauauuaaccuggu

SEQ ID NO: 559327 - RNA, 64 nt, Homo Sapiens
uuuugcacugauggugccaaagggcccugagucaaaaggauagccaaggguggaguggaaaaag

SEQ ID NO: 559328 - RNA, 64 nt, Homo Sapiens
acuagggcugaguugugucuccauuuugauaaggaaaggauaugcucagacucuugcuuguuca

SEQ ID NO: 559329 - RNA, 64 nt, Homo Sapiens
auggaaggcuuucaguuuuaauauggcugaaagcaaaggauaacgaauucagaauuaguaaugu

SEQ ID NO: 559330 - RNA, 64 nt, Homo Sapiens
guuauuuacaugucagagacauuuauaaaaagugaaaggauaaaaaaaaaaaaaaacaacuaau

SEQ ID NO: 559331 - RNA, 64 nt, Homo Sapiens
caguaugcuuaaugguagcagugguuauggccgaaaaggauaugaauauaacaagugggugaau

SEQ ID NO: 559332 - RNA, 64 nt, Homo Sapiens
aauaaacuccugcuucccaaaguuaauacuuacaaaaggauaaacguguuuguugugauuaccg

SEQ ID NO: 559333 - RNA, 64 nt, Homo Sapiens
gaaggaugaugucuuuuuauccuuugcauauuauaaaggauaaaucucauauaagacaaauauu

SEQ ID NO: 559334 - RNA, 64 nt, Homo Sapiens
ggugaacauuuuaauggguuucuguguacauuuuaaaggauaauuguguaugugugguuucagu

SEQ ID NO: 559335 - RNA, 64 nt, Homo Sapiens
aaaagauucaaagcucuaauuaggaguaaagauaaaaggauaggggagcugaggccauucccug

SEQ ID NO: 559336 - RNA, 64 nt, Homo Sapiens
uccaggccauaggaauggcuacugggcagguccaaaaggauagugcagacagacaauugaaaau

SEQ ID NO: 559337 - RNA, 64 nt, Homo Sapiens
aagcaucuaaaaguuuaggcagaagcauuuguucaaaggauagaaaguuacaagcuuaagauac

SEQ ID NO: 559338 - RNA, 64 nt, Homo Sapiens
agaaacccuuccccccuucugucacacaaaaaaaaaaggauaaaauuucuguguuuugauagaa

SEQ ID NO: 559339 - RNA, 64 nt, Homo Sapiens
cuggcuaguuaaaaguaaauaauaaaauuuuuaaaaaggauaaauucaaauugugcagagaaac

SEQ ID NO: 559340 - RNA, 64 nt, Homo Sapiens
gaggagggguggcuuuuauguaguugcccaguugaaaggauaaguuagaaucucccucacucua

SEQ ID NO: 559341 - RNA, 64 nt, Homo Sapiens
uuccuuguucuuaccaaguguaucauucauugguaaaggauauaucugccuugcaggauccauu

SEQ ID NO: 559342 - RNA, 64 nt, Homo Sapiens
aagaugccccucuggugggucuguucccccuuccaaaggauacuagggccacuauggaacccug

SEQ ID NO: 559343 - RNA, 64 nt, Homo Sapiens
cuuucauuccguuuggaugucuacauuccuuaucaaaggauauaaauacuguguaugcuuuuga

SEQ ID NO: 559344 - RNA, 64 nt, Homo Sapiens
auagcaaaguuaaacauucuuauuucucauauuuaaaggauaccacaauaagcugcugugugug

SEQ ID NO: 559345 - RNA, 64 nt, Homo Sapiens
gcaaggcugcuugauucacagauggaugugaccuaaaggauaaauaagcuauuacuuaugugcu

SEQ ID NO: 559346 - RNA, 64 nt, Homo Sapiens
ccuccacauccuggaaucaaucacacugacagggaaaggauaaaugcuccuuuauaagccaaca

SEQ ID NO: 559347 - RNA, 64 nt, Homo Sapiens
uucccauagugcuucacacagcuccccugcuucuaaaggauaagguacuguagccuugguccug

SEQ ID NO: 559348 - RNA, 64 nt, Homo Sapiens
guguaauuagugggggaaaaaauauuuuuuaaacaaaggauauaaccauauuuaguuguacagu

SEQ ID NO: 559349 - RNA, 64 nt, Homo Sapiens
acauuaaaaacucuugagaauuuuucuaacgugaaaaggauaaaauggugcuauuuaaacaauu

SEQ ID NO: 559350 - RNA, 64 nt, Homo Sapiens
uauauauuuucuuaaaacagauuuguacagaagaaaaggauauuggguagggaauacuggagau

SEQ ID NO: 559351 - RNA, 64 nt, Homo Sapiens
aaaacccaaacugaaauucuuuaaaaaagaaaaaaaaggauaaaaagcagaaaacauacuuauu

SEQ ID NO: 559352 - RNA, 64 nt, Homo Sapiens
aaagaaaagagagcucaggcagccacgaugacccaaaggauaagcuccacucacucaaaaucag

SEQ ID NO: 559353 - RNA, 64 nt, Homo Sapiens
aaugcuuuauuuauacagauaguuaugaauuuuaaaaggauaaaaucuuauguuuuuuaaaugg

SEQ ID NO: 559354 - RNA, 64 nt, Homo Sapiens
caagagaaauuuuucaagcacacaugaaaauauuaaaggauaugauaauucaauguguuuuuaa

SEQ ID NO: 559355 - RNA, 64 nt, Homo Sapiens
ccaagauggcuguaaacacaccugccccacaugaaaaggauaagaaagaaagcuguggaaagga

SEQ ID NO: 559356 - RNA, 64 nt, Homo Sapiens
gauggauuuuaaaagaauauaauguucaauauuaaaaggauaauucacauuugccaccauaaug

SEQ ID NO: 559357 - RNA, 64 nt, Homo Sapiens
aaacuaauugacuuuagaaagcugacauugccaaaaaggauacauaaugggccacugaaaucug

SEQ ID NO: 559358 - RNA, 64 nt, Homo Sapiens
ucuucugaagacaaaacugaaugcuauagcuuugaaaggauaaaaagcccugaagugcucauca

SEQ ID NO: 559359 - RNA, 64 nt, Homo Sapiens
acuaccugagaccagcugugauguuuaaagacauaaaggauaaaguuuacuuuuaaaggguuuc

SEQ ID NO: 559360 - RNA, 64 nt, Homo Sapiens
agggcaauauuuuaucauauauggauacaugguuaaaggauagaacuccccaucaaaaaaaaaa

SEQ ID NO: 559361 - RNA, 64 nt, Homo Sapiens
ucaguuauacuugugaauugugaucuaacugcagaaaggauacauuauuaaaauacuuugccuu

SEQ ID NO: 559362 - RNA, 64 nt, Homo Sapiens; identical to SEQ ID NO: 164660

SEQ ID NO: 559363 - RNA, 64 nt, Homo Sapiens; identical to SEQ ID NO: 164661

SEQ ID NO: 559364 - RNA, 64 nt, Homo Sapiens
agaaacucuaaauaguugaaaggcuaaccugcucaaaggauaccaaauaaugguuuaacuggac

SEQ ID NO: 559365 - RNA, 64 nt, Homo Sapiens
agacauugaaaaggaagaggcauagucaugaucaaaaggauauauugacaguuaucuauagcca

SEQ ID NO: 559366 - RNA, 64 nt, Homo Sapiens
agucauaccuacauucaaggagaggggaccaugcaaaggauaaacugcaggugaagaacuugag

SEQ ID NO: 559367 - RNA, 64 nt, Homo Sapiens
uauguacuccuguuugccaagcucaauaauggacaaaggauacaaacacacacacaucuacuau

SEQ ID NO: 559368 - RNA, 64 nt, Homo Sapiens
cuaauugaaugccuugaaaggcuuagaauacugcaaaggauaagugugaucgucaaugugaaua

SEQ ID NO: 559369 - RNA, 62 nt, Homo Sapiens; identical to SEQ ID NO: 559049

SEQ ID NO: 559370 - RNA, 64 nt, Homo Sapiens
aggccggaugugguggcucagcgcuuauuuuuugaaaggauauuccuucuuauuuguauggaau

SEQ ID NO: 559371 - RNA, 64 nt, Homo Sapiens
aagggaggccugcgcaaagcuaguuuuauuucuuaaaggauaacagucauacauagaauacuag

SEQ ID NO: 559372 - RNA, 64 nt, Homo Sapiens
ugaaaugugugagaguguuacuuacugaaaacugaaaggauaugacaugcuggaacaggcaaaa

SEQ ID NO: 559373 - RNA, 64 nt, Homo Sapiens
cuaggagcaugaaguuugaguuuuguguuuuuccaaaggauacuuccuuggcccuuuuucuuua

SEQ ID NO: 559374 - RNA, 64 nt, Homo Sapiens
gggaaucugugaacgccuagaaaaugagcagaauaaaggauauuaucuuuggaagucuuagaug

SEQ ID NO: 559375 - RNA, 64 nt, Homo Sapiens
gacugguuuguuugcuuaauuuccuucuguuaagaaaggauauaaaaggauguuacaaguuugc

SEQ ID NO: 559376 - RNA, 64 nt, Homo Sapiens
uaagagguggccuucaugguaccaaggggcaggaaaaggauaugugaggaaucaaggggccauu

SEQ ID NO: 559377 - RNA, 64 nt, Homo Sapiens
gccuggagaaaaccagagauccaguacagaaaggaaaggauauuuauugauuaacagaaguugu

SEQ ID NO: 559378 - RNA, 64 nt, Homo Sapiens
cauuauuuucaaauggcuuuagccacuugacaagaaaggauauucaauuguaacaauaaaucac

SEQ ID NO: 559379 - RNA, 64 nt, Homo Sapiens
auuuuucuaauaaaugcggcagaaaggaauuuccaaaggauaaucgcccuggagccaaucuuca

SEQ ID NO: 559380 - RNA, 64 nt, Homo Sapiens
uuuaaacuuaauuaaagaaaaacuauuuaaagguaaaggauauuuuguugacaucgguggcucg

SEQ ID NO: 559381 - RNA, 64 nt, Homo Sapiens
ggcuggagucccaugaggaugugggcccuuuaauaaaggauagcaaacagggagcuuguggccu

SEQ ID NO: 559382 - RNA, 64 nt, Homo Sapiens
ucagggaaucaaacuaaauguccaucagugguagaaaggauaaagaaaaugugguggcagggag

SEQ ID NO: 559383 - RNA, 64 nt, Homo Sapiens
auaguauuggcuucaguccgagccacaggcaauaaaaggauaucagcuguaguucucagcuaca

SEQ ID NO: 559384 - RNA, 64 nt, Homo Sapiens
cauuguaugggacuuuccuuuggaucccccaaucaaaggauaagcaaugcguaagccugugucc

SEQ ID NO: 559385 - RNA, 64 nt, Homo Sapiens
uuuuuuuggacagaguguggaaagggagccccccaaaggauagcuucuuuuucaugaugccagg

SEQ ID NO: 559386 - RNA, 64 nt, Homo Sapiens
aggugucauuuccauuauuuauauuaguuuagccaaaggauaaguguccccuauggggaugguc

SEQ ID NO: 559387 - RNA, 64 nt, Homo Sapiens
agguguuauuuccauuauuuauauuaguuuagccaaaggauaaguguccccuauggggaugguc

SEQ ID NO: 559388 - RNA, 64 nt, Homo Sapiens
cucugucucccuauaaugcuggagcggcuacuaaaaaggauaaaauguaucacuuaaauguuac

SEQ ID NO: 559389 - RNA, 64 nt, Homo Sapiens
aaaggauggaacuauggguucucuucgcaaagccaaaggauaguguuuaacaagccagcuggcu

SEQ ID NO: 559390 - RNA, 64 nt, Homo Sapiens
gaaaacaggagaggagaaauaucucauacaagugaaaggauacuggagagagaaauuacccauu

SEQ ID NO: 559391 - RNA, 64 nt, Homo Sapiens
uggucccgaaagauugcaacuuuggcugcuacagaaaggauagaaccuuuuuggggggagggug

SEQ ID NO: 559392 - RNA, 64 nt, Homo Sapiens; identical to SEQ ID NO: 164662

SEQ ID NO: 559393 - RNA, 64 nt, Homo Sapiens; identical to SEQ ID NO: 164663

SEQ ID NO: 559394 - RNA, 64 nt, Homo Sapiens
ccacggagcaacuggaaaacacuugcaucuucacaaaggauaaacguuuccaacucugauuguc

SEQ ID NO: 559395 - RNA, 64 nt, Homo Sapiens
aucuaccuguucuguagcuuuuuguacaauaugaaaaggauauuagucugucagguuugguuuu

SEQ ID NO: 559396 - RNA, 64 nt, Homo Sapiens
gcaaaaauuauguaauagauagauguauaaugaaaaaggauaauucaguagaaugauuucauuu

SEQ ID NO: 559397 - RNA, 64 nt, Homo Sapiens
gugucuuuaacucuuaaauuugcacuggguggggaaaggauagucaaaagaaaguuacagguau

SEQ ID NO: 559398 - RNA, 64 nt, Homo Sapiens
cucuucaucugggaccuggaaauccugaaauaaaaaaggauaaugcaauaaacacaguugcagg

SEQ ID NO: 559399 - RNA, 64 nt, Homo Sapiens
ugaauauuacuccuauuuuuguaaacuggaauuaaaaggauaguauuuuuauccaugacaggcc

SEQ ID NO: 559400 - RNA, 64 nt, Homo Sapiens
uuccucuggcccucccuuuuccuccacgaggauuaaaggauacaagcugaccaggccucacagg

SEQ ID NO: 559401 - RNA, 64 nt, Homo Sapiens
guuuugcauuuuuaauuauaauuuauuuauuuagaaaggauacuaauuuuuuuuauuacuccua

SEQ ID NO: 559402 - RNA, 64 nt, Homo Sapiens
ucuauuuuauucuuggggggaucaaaccuuaggaaaaggauaucuauauaucuauauagcuaua

SEQ ID NO: 559403 - RNA, 64 nt, Homo Sapiens
augaaaacaaccccaagcuauauauuaccagaugaaaggauaaacaaaauaugguccauccaua

SEQ ID NO: 559404 - RNA, 64 nt, Homo Sapiens
gcuuucccucaucauaauguagauaaaaagaaaaaaaggauaugguuaccuguaaucuuaccaa

SEQ ID NO: 559405 - RNA, 64 nt, Homo Sapiens
uuuccugaagaccggggcaucgggguggggugauaaaggauacaaccugcacagggggaaguua

SEQ ID NO: 559406 - RNA, 64 nt, Homo Sapiens
uuauaaaagcaagguuuauuauaaaagauacuacaaaggauacagaugaagaggcacauagggc

SEQ ID NO: 559407 - RNA, 64 nt, Homo Sapiens
caaaaugugguccauccauauauauuaccagaugaaaggauaaaaugaaaacaaccccaagcua

SEQ ID NO: 559408 - RNA, 64 nt, Homo Sapiens
cuuuaucaguucauuauuuauuugaccauaucccaaaggauaguacaaaaaggcaaauguaccc

SEQ ID NO: 559409 - RNA, 64 nt, Homo Sapiens; identical to SEQ ID NO: 164664

SEQ ID NO: 559410 - RNA, 64 nt, Homo Sapiens; identical to SEQ ID NO: 164665

SEQ ID NO: 559411 - RNA, 64 nt, Homo Sapiens
guuuucauaauuuuuuauuguggacuaaauaacaaaaggauaauagaaaagaacuccauuucau

SEQ ID NO: 559412 - RNA, 64 nt, Homo Sapiens
gauuucauaauuuucuauuuggacuaaauaaucaaaaggauaaugaaaaauacucaauguuauu

SEQ ID NO: 559413 - RNA, 64 nt, Homo Sapiens
guuuucauaauuuuuuauugggacuaaauaaucaaaaggauaaugaaaaaaacucaauguuauu

SEQ ID NO: 559414 - RNA, 64 nt, Homo Sapiens
gaaagagacccagaaaaagggagggacagagccaaaaggauagauacucuguccagacaugaua

SEQ ID NO: 559415 - RNA, 64 nt, Homo Sapiens
ccccgauauugggaccucacggcugggacugaggaaaggauaaacuugguuggagagcugaaca

SEQ ID NO: 559416 - RNA, 64 nt, Homo Sapiens
aaagcuggaugguggcucauaaaaaaaaaaaaaaaaaggauaucacagugagaaucugucucaa

SEQ ID NO: 559417 - RNA, 64 nt, Homo Sapiens
augcauuggaaaaagcuguguuauaugaaguaauaaaggauaaaucucaagaguauuaaaagga

SEQ ID NO: 559418 - RNA, 64 nt, Homo Sapiens
cacuuuguagaaacaagaacguucucacauauggaaaggauacacaaguuuguauuuccucaga

SEQ ID NO: 559419 - RNA, 64 nt, Homo Sapiens
gaauuguauauacauacuuaacaugaaggaauaaaaaggauacaacacugcaucaguauacaua

SEQ ID NO: 559420 - RNA, 64 nt, Homo Sapiens
ucaaaaaacuggguggagaaauaauuguuucuuuaaaggauaugaguuagaaucacccccuguu

SEQ ID NO: 559421 - RNA, 64 nt, Homo Sapiens
guuuucuuuucucuuuuacugcuaagcagccuggaaaggauaaaugaauauuagacuaagauuu

SEQ ID NO: 559422 - RNA, 64 nt, Homo Sapiens
ucuccuuuugaacuugucacgaauuccaucuuguaaaggauauuaaauguugcuuuaaccugaa

SEQ ID NO: 559423 - RNA, 64 nt, Homo Sapiens
cccauuacacuagagcagggcucuauuuauuuuuaaaggauauggccguguguuuugauaaaac

SEQ ID NO: 559424 - RNA, 64 nt, Homo Sapiens
ucugugcguugggucaguuucuguuacguaacgaaaaggauaaacaucucccacgggagaggcc

SEQ ID NO: 559425 - RNA, 64 nt, Homo Sapiens
aauagcuuuauccugcacucuggccugguuguucaaaggauaagaaagaaaaaaaaagccuuag

SEQ ID NO: 559426 - RNA, 64 nt, Homo Sapiens
gccuucucaagaucauaggcaugcagacccucccaaaggauacuguggcucaagauuuggcccc

SEQ ID NO: 559427 - RNA, 64 nt, Homo Sapiens
aaugauuccugagcaccuccgagggaggaaguugaaaggauacucaugaagcaggcaugagcca

SEQ ID NO: 559428 - RNA, 64 nt, Homo Sapiens
gaacuugguaguucauaaagguuuacagugaauaaaaggauaucaucuugaguauagcaauauc

SEQ ID NO: 559429 - RNA, 64 nt, Homo Sapiens
guaaucccaggcuggccauucauucagguuuuuuaaaggauauuuaacuuuuauggacuagaag

SEQ ID NO: 559430 - RNA, 64 nt, Homo Sapiens
uauccaauaaaaaaaaaccuuuaaacaacucuuuaaaggauaaucauuuuuaaagucuaaacug

SEQ ID NO: 559431 - RNA, 64 nt, Homo Sapiens
aauaaaccgccuuuuuggcagccuaccaaugccaaaaggauaaaugucuuuccaaaagugugua

SEQ ID NO: 559432 - RNA, 64 nt, Homo Sapiens
agcuaguuuuaaaauaaugaucucagauuuuuaaaaaggauauaggaaccugcauugucauucu

SEQ ID NO: 559433 - RNA, 64 nt, Homo Sapiens
ccuaauucguuuuccuauuucuuuucauacaaauaaaggauaccuggauuuauuuagguuauua

SEQ ID NO: 559434 - RNA, 64 nt, Homo Sapiens
caaaugaauuuaucauuuuaguauaguuuucgauaaaggauauagcaacaucuuuugauaauug

SEQ ID NO: 559435 - RNA, 64 nt, Homo Sapiens
ggauuuuagcauauguuaagaggaauugcagugaaaaggauaacauuuuuccauaguaaauugu

SEQ ID NO: 559436 - RNA, 64 nt, Homo Sapiens
auuucugauauagaauugcaauuuuaacacacauaaaggauaaacuuuuagaaacuuaucuuac

SEQ ID NO: 559437 - RNA, 64 nt, Homo Sapiens
aguaagagagauuguaaaugauaaaccgagcuuuaaaggauaaaguguuaauaaagaaaggaag

SEQ ID NO: 559438 - RNA, 64 nt, Homo Sapiens
uauuuucaguuauuauauuuacaaaugggaaacaaaaggauaaugaauacuuuauaaaggauua

SEQ ID NO: 559439 - RNA, 64 nt, Homo Sapiens
auuaucacuaauaagcaucaguuuguuguuuuuaaaaggauauuuaagugagcauuuucuaguu

SEQ ID NO: 559440 - RNA, 64 nt, Homo Sapiens
auauuaaaacugcuuugcauaagaaugggggaagaaaggauagaccaaacggugaauauuauag

SEQ ID NO: 559441 - RNA, 64 nt, Homo Sapiens
aacagccauucuuuggacuguaaucuguucagccaaaggauacucuguguucuaauuaacacag

SEQ ID NO: 559442 - RNA, 64 nt, Homo Sapiens
ggagaccuguuuuagaaggaguuugcaaaauaauaaaggauauugcaugugugcaugugaguau

SEQ ID NO: 559443 - RNA, 64 nt, Homo Sapiens
cauuagcaugacugcuuugucuucacuguuuuggaaaggauagcgagagaaaagcuccuuuucu

SEQ ID NO: 559444 - RNA, 64 nt, Homo Sapiens
auaagcauuaggaaggcuaguuacaaaagccaaaaaaggauaaaguugacagauuuguagacaa

SEQ ID NO: 559445 - RNA, 64 nt, Homo Sapiens
acacacacacacacacgugcacacacacacauuuaaaggauauaaaaagaagagguugaaagau

SEQ ID NO: 559446 - RNA, 64 nt, Homo Sapiens
caccaaauaauaaauauuaagaagaaugggggaaaaaggauagaauauuaaaacugcuuugcau

SEQ ID NO: 559447 - RNA, 64 nt, Homo Sapiens
aggcagacgugcuuuauagcuaaaugaacaaagcaaaggauacagagguauguucucucuuaga

SEQ ID NO: 559448 - RNA, 64 nt, Homo Sapiens; identical to SEQ ID NO: 520271

SEQ ID NO: 559449 - RNA, 64 nt, Homo Sapiens; identical to SEQ ID NO: 520272

SEQ ID NO: 559450 - RNA, 64 nt, Homo Sapiens; identical to SEQ ID NO: 520273

SEQ ID NO: 559451 - RNA, 64 nt, Homo Sapiens; identical to SEQ ID NO: 520274

SEQ ID NO: 559452 - RNA, 64 nt, Homo Sapiens; identical to SEQ ID NO: 520275

SEQ ID NO: 559453 - RNA, 64 nt, Homo Sapiens; identical to SEQ ID NO: 520276

SEQ ID NO: 559454 - RNA, 64 nt, Homo Sapiens; identical to SEQ ID NO: 520277

SEQ ID NO: 559455 - RNA, 64 nt, Homo Sapiens; identical to SEQ ID NO: 520278

SEQ ID NO: 559456 - RNA, 64 nt, Homo Sapiens; identical to SEQ ID NO: 520279

SEQ ID NO: 559457 - RNA, 64 nt, Homo Sapiens; identical to SEQ ID NO: 520280

SEQ ID NO: 559458 - RNA, 64 nt, Homo Sapiens; identical to SEQ ID NO: 520281

SEQ ID NO: 559459 - RNA, 64 nt, Homo Sapiens; identical to SEQ ID NO: 520282

SEQ ID NO: 559460 - RNA, 64 nt, Homo Sapiens; identical to SEQ ID NO: 520283

SEQ ID NO: 559461 - RNA, 64 nt, Homo Sapiens; identical to SEQ ID NO: 520284

SEQ ID NO: 559462 - RNA, 64 nt, Homo Sapiens; identical to SEQ ID NO: 520285

SEQ ID NO: 559463 - RNA, 64 nt, Homo Sapiens; identical to SEQ ID NO: 520286

SEQ ID NO: 559464 - RNA, 63 nt, Homo Sapiens
caaugccugcugccuccagaggagauccaggcugcuggagaucgacuuggugggaaguaagcu

SEQ ID NO: 559465 - RNA, 63 nt, Homo Sapiens
caggcugcuggagauccaauuggugggaaguaagcuggagaucaccuccacuguaccaagacu

SEQ ID NO: 559466 - RNA, 63 nt, Homo Sapiens
augccugaaaucccacuacuuugggaggcugaggcuggagaauugcuugaggcuagugagcug

SEQ ID NO: 559467 - RNA, 63 nt, Homo Sapiens
caguuuauacucuuaauuuaauuuucuuucugagcuggagaacuggcuuugcacuuugguuac

SEQ ID NO: 559468 - RNA, 63 nt, Homo Sapiens
ggaagaauugugccuugcauugauuuuucuaaagcuggagaaaucagggcugggccauguggu

SEQ ID NO: 559469 - RNA, 63 nt, Homo Sapiens
acaggagcucacccagggcugggugagcgagaggcuggagaacggccaggauagccaagcccu

SEQ ID NO: 559470 - RNA, 63 nt, Homo Sapiens
uccauguacuuuggaaucuccaacugauaaagagcuggagaacggccacgaugaaacagauuu

SEQ ID NO: 559471 - RNA, 63 nt, Homo Sapiens
gcggggucucugaagguccugucuggccaggaggcuggagaaugaucaagcucaucgacuuug

SEQ ID NO: 559472 - RNA, 63 nt, Homo Sapiens
cagguuaagagauccuguuuuucuaauccccaagcuggagaaaaugagcucacuggaaauuca

SEQ ID NO: 559473 - RNA, 63 nt, Homo Sapiens
ccccccgacccucagcguacggcaggauggggagcuggagagccggagcagugucugucugac

SEQ ID NO: 559474 - RNA, 63 nt, Homo Sapiens
augcagagcgccgugaguucagacgggugggcggcuggagaccgccgcuccagggguggcugg

SEQ ID NO: 559475 - RNA, 63 nt, Homo Sapiens
ggugggcggcuggagaccaucgcuccagggguggcuggagacgcucugccgccuccccacggc

SEQ ID NO: 559476 - RNA, 63 nt, Homo Sapiens
guggggagaugggcauuuggagagucucauguagcuggagacguuaagagcugagcacaccac

SEQ ID NO: 559477 - RNA, 63 nt, Homo Sapiens
gcauggagggcuguaaagccacggauuccccucgcuggagaggcuccugucugauagcgguag

SEQ ID NO: 559478 - RNA, 63 nt, Homo Sapiens
cccauggccacgaggaagcaucuaaaagcuguagcuggagaagauauuaauuauuuuccaaaa

SEQ ID NO: 559479 - RNA, 63 nt, Homo Sapiens
auuuaaguacuaucuuugucagaauucuauuuugcuggagacuaaugggaaaguauuuuugaa

SEQ ID NO: 559480 - RNA, 63 nt, Homo Sapiens
gagcaaguuguggggagccaugagaggggcagggcuggagaagaaagaaagcauuguuuuaau

SEQ ID NO: 559481 - RNA, 63 nt, Homo Sapiens
ggugugaacccaggaggcgguugggaggcugaggcuggagaaugcgccuguagucccagcagc

SEQ ID NO: 559482 - RNA, 63 nt, Homo Sapiens
uguccugaauaaggagauccagagccagcagcggcuggagagccuguccgagacacccgggcc

SEQ ID NO: 559483 - RNA, 63 nt, Homo Sapiens
uagcaacagcaauuuccgggaggucuuggagaagcuggagagcgaccccgucugccagcgccu

SEQ ID NO: 559484 - RNA, 63 nt, Homo Sapiens
gugccuguagucccagcuacucgggaggcugaggcuggagaguugcucaaacccgggaggcgg

SEQ ID NO: 559485 - RNA, 63 nt, Homo Sapiens
caaugugcaccaauaugccuaacuagcuagccagcuggagauaauuuaccagggaauguuuca

SEQ ID NO: 559486 - RNA, 63 nt, Homo Sapiens
cugccaccaugcucugcgugaccagcuaagaaugcuggagacuagccauccccacccacuugu

SEQ ID NO: 559487 - RNA, 63 nt, Homo Sapiens
acuggaaaggugucucagucuuccucuuuuacagcuggagauccaggagcugugccaagcacu

SEQ ID NO: 559488 - RNA, 63 nt, Homo Sapiens
gcucugcucagcccugagagaguguucgcucgcgcuggagaagugccugccgaggcgggacag

SEQ ID NO: 559489 - RNA, 63 nt, Homo Sapiens
gacccagcccucuggcugagaaggaccggcgcugcuggagacugugggcaagaaggagcuggc

SEQ ID NO: 559490 - RNA, 63 nt, Homo Sapiens
aguccugcuuucucuggaguagcagguguccgggcuggagaaggugauugaaagccauugagg

SEQ ID NO: 559491 - RNA, 63 nt, Homo Sapiens
aagccuggggcacguccuguacguggcagugcagcuggagagggcggggcucuuguuggccgc

SEQ ID NO: 559492 - RNA, 63 nt, Homo Sapiens
uaucccccgccccucaagcaucuccuugaggcagcuggagagcaaagauccaggcccuccacu

SEQ ID NO: 559493 - RNA, 63 nt, Homo Sapiens
gugucugcuuucugccuccugaggagugacagggcuggagacuucugggguauuuccccugcu

SEQ ID NO: 559494 - RNA, 63 nt, Homo Sapiens
gacugagccccaguaacccccuuggcucuuccagcuggagaagcugggcucuccagagcuggg

SEQ ID NO: 559495 - RNA, 63 nt, Homo Sapiens
gaaccugauguaccugaagcagauccuguauuugcuggagaaauucguggcugugcuaggggg

SEQ ID NO: 559496 - RNA, 63 nt, Homo Sapiens
ugccuggcgccgugcccuuccuuuguccugcccgcuggagacaguguuugucgugggcguggu

SEQ ID NO: 559497 - RNA, 63 nt, Homo Sapiens
ugauaccuauaaguucacccccaccccacagcugcuggagagaaaucccaagaggcagcccuu

SEQ ID NO: 559498 - RNA, 63 nt, Homo Sapiens
aacaggaccugugagcagcugcauuggccuggagcuggagaguaaggcuguaggaucuuugga

SEQ ID NO: 559499 - RNA, 63 nt, Homo Sapiens
gcuggacccagccaccuuguaugagguggaagagcuggagacggccacugagcgcuaccugca

SEQ ID NO: 559500 - RNA, 63 nt, Homo Sapiens
gagcgcuaccugcacguacgcccccagccuuuggcuggagaggaucccccugcuuaccaggcc

SEQ ID NO: 559501 - RNA, 63 nt, Homo Sapiens
ugagaggcuguggcagcaggagacucugcaggagcuggagaggcugcgggagcuggagaggau

SEQ ID NO: 559502 - RNA, 63 nt, Homo Sapiens
ggagacucugcaggagcuggagaggcugcgggagcuggagaggaugcuggagcugggguggga

SEQ ID NO: 559503 - RNA, 63 nt, Homo Sapiens
cugacaggacagcuuuaagcaccugcggaaggagcuggagaaugcuacaagcagaggcugaac

SEQ ID NO: 559504 - RNA, 63 nt, Homo Sapiens
cuggcaggacagcuuuaagcaccugcggaaggagcuggagaaugcuacaagcagaggcugaac

SEQ ID NO: 559505 - RNA, 63 nt, Homo Sapiens
aaggcaggaaagucugaguugggagugacaguggcuggagagaagcagaucugugcaacgugc

SEQ ID NO: 559506 - RNA, 63 nt, Homo Sapiens
aguuuuguuugauucugagacucucuugggaacgcuggagagcuugugcacagccucuggaag

SEQ ID NO: 559507 - RNA, 63 nt, Homo Sapiens
aaccuggucugauuccuuccaacgugcacuucagcuggagaaagaaaccaagaagggaagcgg

SEQ ID NO: 559508 - RNA, 63 nt, Homo Sapiens
cagucuuguuccagugacaguuggaaggccucugcuggagagacaccagcucucagggcagag

SEQ ID NO: 559509 - RNA, 63 nt, Homo Sapiens
ggagaacugaacccggaccugcucacugcccuggcuggagaggagcacaacagaugccacguc

SEQ ID NO: 559510 - RNA, 63 nt, Homo Sapiens
gaggcucaccacaagccuggcauuucagccagggcuggagaaggcagggacgccugggugaga

SEQ ID NO: 559511 - RNA, 63 nt, Homo Sapiens
uacuuuacccuuaauacacauaagauaauuaaugcuggagagaaacccuacaaaugugaagaa

SEQ ID NO: 559512 - RNA, 63 nt, Homo Sapiens
uccucaacccuuacuacacauuagauaauucaugcuggagagaaacccuacaaaugugaaaaa

SEQ ID NO: 559513 - RNA, 63 nt, Homo Sapiens
uggccacaccugggcuaaaguaauaauaauaaagcuggagacugacucugucucaaauaauaa

SEQ ID NO: 559514 - RNA, 63 nt, Homo Sapiens
aaagguaaguugugggagcuacuaugagcaguggcuggagaucugacgaggacgaggaggagg

SEQ ID NO: 559515 - RNA, 63 nt, Homo Sapiens
gugggagagggaugaugaagagagagagggccugcuggagagcauagggucuggaacaccagg

SEQ ID NO: 559516 - RNA, 63 nt, Homo Sapiens
gauauaaugcgggugagaguaaugaggcuuggggcuggagaggacaagauggguaaacccuca

SEQ ID NO: 559517 - RNA, 63 nt, Homo Sapiens
ugugcagagguuugugucuccagggaacccacggcuggagagaaauagggagaugcaggaagu

SEQ ID NO: 559518 - RNA, 63 nt, Homo Sapiens
ucacugccaggccagcggcuuccgcugagacucgcuggagaggcggcucccguguccguccac

SEQ ID NO: 559519 - RNA, 63 nt, Homo Sapiens
ugaucgccuaggagagggccucguaguggcacagcuggagauaguuucaaagucuaaaccacc

SEQ ID NO: 559520 - RNA, 63 nt, Homo Sapiens
cuuaaaaugacaaaaaguguccauaaagaggcugcuggagagugcguggccauagggagccga

SEQ ID NO: 559521 - RNA, 64 nt, Homo Sapiens
auuugugcaaaauaaaauaugagcccugaggaguuauuggcaagguccucuagauuuagauuau

SEQ ID NO: 559522 - RNA, 64 nt, Homo Sapiens
auguauuucuaccauuguaaucuugcuaacauuuuauuggcaguuguacagucauuuuuaaauc

SEQ ID NO: 559523 - RNA, 64 nt, Homo Sapiens
ccaaaauucagcuaaaggaauaaagaguaagugcuauuggcauuuauaucaauaaauaaauuuu

SEQ ID NO: 559524 - RNA, 64 nt, Homo Sapiens
cugagaaauucauuuuguagucauauuuuuaugauauuggcacauauaguuaguguaauauaau

SEQ ID NO: 559525 - RNA, 64 nt, Homo Sapiens
aauucagugcaggggcauagaauaaaauauuaaauauuggcagauguaugaaaagaagugugag

SEQ ID NO: 559526 - RNA, 64 nt, Homo Sapiens
uguaugaaaagaagugugaguuaaaaauauugaauauuggcaggugugaaaacaagugucaaaa

SEQ ID NO: 559527 - RNA, 64 nt, Homo Sapiens
caccacaaaccuuagcuaagucaguagcugggauuauuggcauggugauucuccugccucaccc

SEQ ID NO: 559528 - RNA, 64 nt, Homo Sapiens
gcaaagaucaucagauuaguuugccaucuuuaauuauuggcaguguuaccauuuagcccauugg

SEQ ID NO: 559529 - RNA, 64 nt, Homo Sapiens; identical to SEQ ID NO: 285349

SEQ ID NO: 559530 - RNA, 64 nt, Homo Sapiens; identical to SEQ ID NO: 285350

SEQ ID NO: 559531 - RNA, 64 nt, Homo Sapiens; identical to SEQ ID NO: 285351

SEQ ID NO: 559532 - RNA, 64 nt, Homo Sapiens; identical to SEQ ID NO: 285352

SEQ ID NO: 559533 - RNA, 63 nt, Homo Sapiens; identical to SEQ ID NO: 285353

SEQ ID NO: 559534 - RNA, 64 nt, Homo Sapiens; identical to SEQ ID NO: 285354

SEQ ID NO: 559535 - RNA, 64 nt, Homo Sapiens; identical to SEQ ID NO: 285355

SEQ ID NO: 559536 - RNA, 64 nt, Homo Sapiens; identical to SEQ ID NO: 285356

SEQ ID NO: 559537 - RNA, 64 nt, Homo Sapiens; identical to SEQ ID NO: 285357

SEQ ID NO: 559538 - RNA, 64 nt, Homo Sapiens; identical to SEQ ID NO: 285358

SEQ ID NO: 559539 - RNA, 64 nt, Homo Sapiens; identical to SEQ ID NO: 285359

SEQ ID NO: 559540 - RNA, 64 nt, Homo Sapiens; identical to SEQ ID NO: 285360

SEQ ID NO: 559541 - RNA, 64 nt, Homo Sapiens; identical to SEQ ID NO: 285361

SEQ ID NO: 559542 - RNA, 64 nt, Homo Sapiens; identical to SEQ ID NO: 285362

SEQ ID NO: 559543 - RNA, 64 nt, Homo Sapiens; identical to SEQ ID NO: 285363

SEQ ID NO: 559544 - RNA, 64 nt, Homo Sapiens; identical to SEQ ID NO: 285364

SEQ ID NO: 559545 - RNA, 64 nt, Homo Sapiens; identical to SEQ ID NO: 285365

SEQ ID NO: 559546 - RNA, 64 nt, Homo Sapiens; identical to SEQ ID NO: 285366

SEQ ID NO: 559547 - RNA, 64 nt, Homo Sapiens; identical to SEQ ID NO: 285367

SEQ ID NO: 559548 - RNA, 64 nt, Homo Sapiens; identical to SEQ ID NO: 285368

SEQ ID NO: 559549 - RNA, 64 nt, Homo Sapiens; identical to SEQ ID NO: 285369

SEQ ID NO: 559550 - RNA, 64 nt, Homo Sapiens; identical to SEQ ID NO: 285370

SEQ ID NO: 559551 - RNA, 64 nt, Homo Sapiens; identical to SEQ ID NO: 285371

SEQ ID NO: 559552 - RNA, 64 nt, Homo Sapiens; identical to SEQ ID NO: 285372

SEQ ID NO: 559553 - RNA, 64 nt, Homo Sapiens; identical to SEQ ID NO: 285373

SEQ ID NO: 559554 - RNA, 64 nt, Homo Sapiens; identical to SEQ ID NO: 285374

SEQ ID NO: 559555 - RNA, 64 nt, Homo Sapiens; identical to SEQ ID NO: 285375

SEQ ID NO: 559556 - RNA, 64 nt, Homo Sapiens; identical to SEQ ID NO: 285376

SEQ ID NO: 559557 - RNA, 64 nt, Homo Sapiens; identical to SEQ ID NO: 285377

SEQ ID NO: 559558 - RNA, 64 nt, Homo Sapiens; identical to SEQ ID NO: 285378

SEQ ID NO: 559559 - RNA, 64 nt, Homo Sapiens; identical to SEQ ID NO: 285379

SEQ ID NO: 559560 - RNA, 64 nt, Homo Sapiens; identical to SEQ ID NO: 285380

SEQ ID NO: 559561 - RNA, 64 nt, Homo Sapiens; identical to SEQ ID NO: 285381

SEQ ID NO: 559562 - RNA, 64 nt, Homo Sapiens; identical to SEQ ID NO: 285382

SEQ ID NO: 559563 - RNA, 64 nt, Homo Sapiens; identical to SEQ ID NO: 285383

SEQ ID NO: 559564 - RNA, 64 nt, Homo Sapiens; identical to SEQ ID NO: 285384

SEQ ID NO: 559565 - RNA, 64 nt, Homo Sapiens; identical to SEQ ID NO: 285385

SEQ ID NO: 559566 - RNA, 64 nt, Homo Sapiens; identical to SEQ ID NO: 285386

SEQ ID NO: 559567 - RNA, 64 nt, Homo Sapiens; identical to SEQ ID NO: 285387

SEQ ID NO: 559568 - RNA, 64 nt, Homo Sapiens; identical to SEQ ID NO: 285388

SEQ ID NO: 559569 - RNA, 64 nt, Homo Sapiens; identical to SEQ ID NO: 285389

SEQ ID NO: 559570 - RNA, 64 nt, Homo Sapiens; identical to SEQ ID NO: 285390

SEQ ID NO: 559571 - RNA, 64 nt, Homo Sapiens; identical to SEQ ID NO: 285391

SEQ ID NO: 559572 - RNA, 64 nt, Homo Sapiens; identical to SEQ ID NO: 285392

SEQ ID NO: 559573 - RNA, 64 nt, Homo Sapiens; identical to SEQ ID NO: 285393

SEQ ID NO: 559574 - RNA, 64 nt, Homo Sapiens; identical to SEQ ID NO: 285394

SEQ ID NO: 559575 - RNA, 64 nt, Homo Sapiens; identical to SEQ ID NO: 285395

SEQ ID NO: 559576 - RNA, 64 nt, Homo Sapiens; identical to SEQ ID NO: 285396

SEQ ID NO: 559577 - RNA, 64 nt, Homo Sapiens; identical to SEQ ID NO: 285397

SEQ ID NO: 559578 - RNA, 64 nt, Homo Sapiens; identical to SEQ ID NO: 285398

SEQ ID NO: 559579 - RNA, 64 nt, Homo Sapiens; identical to SEQ ID NO: 285399

SEQ ID NO: 559580 - RNA, 64 nt, Homo Sapiens; identical to SEQ ID NO: 285400

SEQ ID NO: 559581 - RNA, 64 nt, Homo Sapiens; identical to SEQ ID NO: 285401

SEQ ID NO: 559582 - RNA, 64 nt, Homo Sapiens; identical to SEQ ID NO: 285402

SEQ ID NO: 559583 - RNA, 64 nt, Homo Sapiens; identical to SEQ ID NO: 285403

SEQ ID NO: 559584 - RNA, 64 nt, Homo Sapiens; identical to SEQ ID NO: 285404

SEQ ID NO: 559585 - RNA, 64 nt, Homo Sapiens; identical to SEQ ID NO: 285405

SEQ ID NO: 559586 - RNA, 64 nt, Homo Sapiens; identical to SEQ ID NO: 285406

SEQ ID NO: 559587 - RNA, 64 nt, Homo Sapiens; identical to SEQ ID NO: 285407

SEQ ID NO: 559588 - RNA, 64 nt, Homo Sapiens; identical to SEQ ID NO: 285408

SEQ ID NO: 559589 - RNA, 64 nt, Homo Sapiens; identical to SEQ ID NO: 285409

SEQ ID NO: 559590 - RNA, 64 nt, Homo Sapiens; identical to SEQ ID NO: 285410

SEQ ID NO: 559591 - RNA, 64 nt, Homo Sapiens; identical to SEQ ID NO: 285411

SEQ ID NO: 559592 - RNA, 64 nt, Homo Sapiens; identical to SEQ ID NO: 285412

SEQ ID NO: 559593 - RNA, 64 nt, Homo Sapiens; identical to SEQ ID NO: 285413

SEQ ID NO: 559594 - RNA, 64 nt, Homo Sapiens; identical to SEQ ID NO: 285414

SEQ ID NO: 559595 - RNA, 64 nt, Homo Sapiens; identical to SEQ ID NO: 285415

SEQ ID NO: 559596 - RNA, 64 nt, Homo Sapiens; identical to SEQ ID NO: 285416

SEQ ID NO: 559597 - RNA, 64 nt, Homo Sapiens; identical to SEQ ID NO: 285417

SEQ ID NO: 559598 - RNA, 64 nt, Homo Sapiens; identical to SEQ ID NO: 285418

SEQ ID NO: 559599 - RNA, 64 nt, Homo Sapiens; identical to SEQ ID NO: 285419

SEQ ID NO: 559600 - RNA, 64 nt, Homo Sapiens; identical to SEQ ID NO: 285420

SEQ ID NO: 559601 - RNA, 64 nt, Homo Sapiens; identical to SEQ ID NO: 285421

SEQ ID NO: 559602 - RNA, 64 nt, Homo Sapiens; identical to SEQ ID NO: 285422

SEQ ID NO: 559603 - RNA, 64 nt, Homo Sapiens; identical to SEQ ID NO: 285423

SEQ ID NO: 559604 - RNA, 64 nt, Homo Sapiens; identical to SEQ ID NO: 285424

SEQ ID NO: 559605 - RNA, 64 nt, Homo Sapiens; identical to SEQ ID NO: 285425

SEQ ID NO: 559606 - RNA, 64 nt, Homo Sapiens; identical to SEQ ID NO: 285426

SEQ ID NO: 559607 - RNA, 64 nt, Homo Sapiens; identical to SEQ ID NO: 285427

SEQ ID NO: 559608 - RNA, 64 nt, Homo Sapiens; identical to SEQ ID NO: 285428

SEQ ID NO: 559609 - RNA, 64 nt, Homo Sapiens; identical to SEQ ID NO: 285429

SEQ ID NO: 559610 - RNA, 64 nt, Homo Sapiens; identical to SEQ ID NO: 285430

SEQ ID NO: 559611 - RNA, 64 nt, Homo Sapiens; identical to SEQ ID NO: 285431

SEQ ID NO: 559612 - RNA, 64 nt, Homo Sapiens; identical to SEQ ID NO: 285432

SEQ ID NO: 559613 - RNA, 64 nt, Homo Sapiens; identical to SEQ ID NO: 285433

SEQ ID NO: 559614 - RNA, 64 nt, Homo Sapiens; identical to SEQ ID NO: 285434

SEQ ID NO: 559615 - RNA, 64 nt, Homo Sapiens; identical to SEQ ID NO: 285435

SEQ ID NO: 559616 - RNA, 64 nt, Homo Sapiens; identical to SEQ ID NO: 285436

SEQ ID NO: 559617 - RNA, 64 nt, Homo Sapiens; identical to SEQ ID NO: 285437

SEQ ID NO: 559618 - RNA, 64 nt, Homo Sapiens; identical to SEQ ID NO: 285438

SEQ ID NO: 559619 - RNA, 64 nt, Homo Sapiens; identical to SEQ ID NO: 285439

SEQ ID NO: 559620 - RNA, 64 nt, Homo Sapiens; identical to SEQ ID NO: 285440

SEQ ID NO: 559621 - RNA, 64 nt, Homo Sapiens; identical to SEQ ID NO: 285441

SEQ ID NO: 559622 - RNA, 64 nt, Homo Sapiens; identical to SEQ ID NO: 285442

SEQ ID NO: 559623 - RNA, 55 nt, Homo Sapiens; identical to SEQ ID NO: 221797

SEQ ID NO: 559624 - RNA, 64 nt, Homo Sapiens; identical to SEQ ID NO: 285444

SEQ ID NO: 559625 - RNA, 64 nt, Homo Sapiens; identical to SEQ ID NO: 285445

SEQ ID NO: 559626 - RNA, 64 nt, Homo Sapiens; identical to SEQ ID NO: 285446

SEQ ID NO: 559627 - RNA, 64 nt, Homo Sapiens; identical to SEQ ID NO: 285447

SEQ ID NO: 559628 - RNA, 64 nt, Homo Sapiens; identical to SEQ ID NO: 285448

SEQ ID NO: 559629 - RNA, 64 nt, Homo Sapiens; identical to SEQ ID NO: 285449

SEQ ID NO: 559630 - RNA, 64 nt, Homo Sapiens; identical to SEQ ID NO: 285450

SEQ ID NO: 559631 - RNA, 64 nt, Homo Sapiens; identical to SEQ ID NO: 285451

SEQ ID NO: 559632 - RNA, 64 nt, Homo Sapiens; identical to SEQ ID NO: 285452

SEQ ID NO: 559633 - RNA, 64 nt, Homo Sapiens; identical to SEQ ID NO: 285453

SEQ ID NO: 559634 - RNA, 64 nt, Homo Sapiens; identical to SEQ ID NO: 285454

SEQ ID NO: 559635 - RNA, 64 nt, Homo Sapiens; identical to SEQ ID NO: 285455

SEQ ID NO: 559636 - RNA, 64 nt, Homo Sapiens; identical to SEQ ID NO: 285456

SEQ ID NO: 559637 - RNA, 64 nt, Homo Sapiens; identical to SEQ ID NO: 285457

SEQ ID NO: 559638 - RNA, 64 nt, Homo Sapiens; identical to SEQ ID NO: 285458

SEQ ID NO: 559639 - RNA, 64 nt, Homo Sapiens; identical to SEQ ID NO: 285459

SEQ ID NO: 559640 - RNA, 64 nt, Homo Sapiens; identical to SEQ ID NO: 285460

SEQ ID NO: 559641 - RNA, 52 nt, Homo Sapiens; identical to SEQ ID NO: 221815

SEQ ID NO: 559642 - RNA, 64 nt, Homo Sapiens; identical to SEQ ID NO: 285462

SEQ ID NO: 559643 - RNA, 64 nt, Homo Sapiens; identical to SEQ ID NO: 285463

SEQ ID NO: 559644 - RNA, 64 nt, Homo Sapiens; identical to SEQ ID NO: 285464

SEQ ID NO: 559645 - RNA, 64 nt, Homo Sapiens; identical to SEQ ID NO: 285465

SEQ ID NO: 559646 - RNA, 64 nt, Homo Sapiens; identical to SEQ ID NO: 285466

SEQ ID NO: 559647 - RNA, 64 nt, Homo Sapiens; identical to SEQ ID NO: 285467

SEQ ID NO: 559648 - RNA, 64 nt, Homo Sapiens; identical to SEQ ID NO: 285468

SEQ ID NO: 559649 - RNA, 64 nt, Homo Sapiens; identical to SEQ ID NO: 285469

SEQ ID NO: 559650 - RNA, 64 nt, Homo Sapiens; identical to SEQ ID NO: 285470

SEQ ID NO: 559651 - RNA, 64 nt, Homo Sapiens; identical to SEQ ID NO: 285471

SEQ ID NO: 559652 - RNA, 64 nt, Homo Sapiens; identical to SEQ ID NO: 285472

SEQ ID NO: 559653 - RNA, 64 nt, Homo Sapiens; identical to SEQ ID NO: 285473

SEQ ID NO: 559654 - RNA, 64 nt, Homo Sapiens; identical to SEQ ID NO: 285474

SEQ ID NO: 559655 - RNA, 64 nt, Homo Sapiens; identical to SEQ ID NO: 285475

SEQ ID NO: 559656 - RNA, 64 nt, Homo Sapiens; identical to SEQ ID NO: 285476

SEQ ID NO: 559657 - RNA, 64 nt, Homo Sapiens; identical to SEQ ID NO: 285477

SEQ ID NO: 559658 - RNA, 64 nt, Homo Sapiens; identical to SEQ ID NO: 285478

SEQ ID NO: 559659 - RNA, 64 nt, Homo Sapiens; identical to SEQ ID NO: 285479

SEQ ID NO: 559660 - RNA, 64 nt, Homo Sapiens; identical to SEQ ID NO: 285480

SEQ ID NO: 559661 - RNA, 64 nt, Homo Sapiens; identical to SEQ ID NO: 285481

SEQ ID NO: 559662 - RNA, 64 nt, Homo Sapiens; identical to SEQ ID NO: 285482

SEQ ID NO: 559663 - RNA, 64 nt, Homo Sapiens; identical to SEQ ID NO: 285483

SEQ ID NO: 559664 - RNA, 64 nt, Homo Sapiens; identical to SEQ ID NO: 285484

SEQ ID NO: 559665 - RNA, 64 nt, Homo Sapiens; identical to SEQ ID NO: 285485

SEQ ID NO: 559666 - RNA, 64 nt, Homo Sapiens; identical to SEQ ID NO: 285486

SEQ ID NO: 559667 - RNA, 64 nt, Homo Sapiens; identical to SEQ ID NO: 285487

SEQ ID NO: 559668 - RNA, 64 nt, Homo Sapiens; identical to SEQ ID NO: 285488

SEQ ID NO: 559669 - RNA, 64 nt, Homo Sapiens; identical to SEQ ID NO: 285489

SEQ ID NO: 559670 - RNA, 64 nt, Homo Sapiens; identical to SEQ ID NO: 285490

SEQ ID NO: 559671 - RNA, 64 nt, Homo Sapiens; identical to SEQ ID NO: 285491

SEQ ID NO: 559672 - RNA, 64 nt, Homo Sapiens; identical to SEQ ID NO: 285492

SEQ ID NO: 559673 - RNA, 64 nt, Homo Sapiens; identical to SEQ ID NO: 285493

SEQ ID NO: 559674 - RNA, 64 nt, Homo Sapiens; identical to SEQ ID NO: 285494

SEQ ID NO: 559675 - RNA, 64 nt, Homo Sapiens; identical to SEQ ID NO: 285495

SEQ ID NO: 559676 - RNA, 64 nt, Homo Sapiens; identical to SEQ ID NO: 285496

SEQ ID NO: 559677 - RNA, 64 nt, Homo Sapiens; identical to SEQ ID NO: 285497

SEQ ID NO: 559678 - RNA, 64 nt, Homo Sapiens; identical to SEQ ID NO: 285498

SEQ ID NO: 559679 - RNA, 64 nt, Homo Sapiens; identical to SEQ ID NO: 285499

SEQ ID NO: 559680 - RNA, 64 nt, Homo Sapiens; identical to SEQ ID NO: 285500

SEQ ID NO: 559681 - RNA, 64 nt, Homo Sapiens; identical to SEQ ID NO: 285501

SEQ ID NO: 559682 - RNA, 64 nt, Homo Sapiens; identical to SEQ ID NO: 285502

SEQ ID NO: 559683 - RNA, 64 nt, Homo Sapiens; identical to SEQ ID NO: 285503

SEQ ID NO: 559684 - RNA, 64 nt, Homo Sapiens; identical to SEQ ID NO: 285504

SEQ ID NO: 559685 - RNA, 64 nt, Homo Sapiens; identical to SEQ ID NO: 285505

SEQ ID NO: 559686 - RNA, 64 nt, Homo Sapiens; identical to SEQ ID NO: 285506

SEQ ID NO: 559687 - RNA, 64 nt, Homo Sapiens; identical to SEQ ID NO: 285507

SEQ ID NO: 559688 - RNA, 64 nt, Homo Sapiens; identical to SEQ ID NO: 285508

SEQ ID NO: 559689 - RNA, 64 nt, Homo Sapiens; identical to SEQ ID NO: 285509

SEQ ID NO: 559690 - RNA, 64 nt, Homo Sapiens; identical to SEQ ID NO: 285510

SEQ ID NO: 559691 - RNA, 64 nt, Homo Sapiens; identical to SEQ ID NO: 285511

SEQ ID NO: 559692 - RNA, 64 nt, Homo Sapiens; identical to SEQ ID NO: 285512

SEQ ID NO: 559693 - RNA, 64 nt, Homo Sapiens; identical to SEQ ID NO: 285513

SEQ ID NO: 559694 - RNA, 64 nt, Homo Sapiens; identical to SEQ ID NO: 285514

SEQ ID NO: 559695 - RNA, 64 nt, Homo Sapiens; identical to SEQ ID NO: 285515

SEQ ID NO: 559696 - RNA, 64 nt, Homo Sapiens; identical to SEQ ID NO: 285516

SEQ ID NO: 559697 - RNA, 64 nt, Homo Sapiens; identical to SEQ ID NO: 285517

SEQ ID NO: 559698 - RNA, 64 nt, Homo Sapiens; identical to SEQ ID NO: 285518

SEQ ID NO: 559699 - RNA, 64 nt, Homo Sapiens; identical to SEQ ID NO: 285519

SEQ ID NO: 559700 - RNA, 64 nt, Homo Sapiens; identical to SEQ ID NO: 285520

SEQ ID NO: 559701 - RNA, 64 nt, Homo Sapiens; identical to SEQ ID NO: 285521

SEQ ID NO: 559702 - RNA, 64 nt, Homo Sapiens; identical to SEQ ID NO: 285522

SEQ ID NO: 559703 - RNA, 64 nt, Homo Sapiens; identical to SEQ ID NO: 285523

SEQ ID NO: 559704 - RNA, 64 nt, Homo Sapiens; identical to SEQ ID NO: 285524

SEQ ID NO: 559705 - RNA, 64 nt, Homo Sapiens; identical to SEQ ID NO: 285525

SEQ ID NO: 559706 - RNA, 64 nt, Homo Sapiens; identical to SEQ ID NO: 285526

SEQ ID NO: 559707 - RNA, 64 nt, Homo Sapiens; identical to SEQ ID NO: 285527

SEQ ID NO: 559708 - RNA, 64 nt, Homo Sapiens; identical to SEQ ID NO: 285528

SEQ ID NO: 559709 - RNA, 64 nt, Homo Sapiens; identical to SEQ ID NO: 285529

SEQ ID NO: 559710 - RNA, 64 nt, Homo Sapiens; identical to SEQ ID NO: 285530

SEQ ID NO: 559711 - RNA, 64 nt, Homo Sapiens; identical to SEQ ID NO: 285531

SEQ ID NO: 559712 - RNA, 64 nt, Homo Sapiens; identical to SEQ ID NO: 285532

SEQ ID NO: 559713 - RNA, 64 nt, Homo Sapiens; identical to SEQ ID NO: 285533

SEQ ID NO: 559714 - RNA, 64 nt, Homo Sapiens; identical to SEQ ID NO: 285534

SEQ ID NO: 559715 - RNA, 64 nt, Homo Sapiens; identical to SEQ ID NO: 285535

SEQ ID NO: 559716 - RNA, 64 nt, Homo Sapiens
auaggcaaaucuguuugagauuucguuuauaugaaauguccagaaaagguuucacguuguauga

SEQ ID NO: 559717 - RNA, 64 nt, Homo Sapiens
aaugaauaaauggauaaacaguaaaaacaacccaaauguccaaguugcucauaauagccaauaa

SEQ ID NO: 559718 - RNA, 64 nt, Homo Sapiens
cauuacucaaaagucaaacgguagcaacaacccaaauguccauccacagaugaauuaagacaug

SEQ ID NO: 559719 - RNA, 64 nt, Homo Sapiens
cuaagugaaagaagccaaucacgaguuuaugugaaauguccagaauaggcaaaucuguguauca

SEQ ID NO: 559720 - RNA, 64 nt, Homo Sapiens
uagaaaaucacagucagauguuuaaucaauccaaaauguccacuauuucuuaugucauucguua

SEQ ID NO: 559721 - RNA, 64 nt, Homo Sapiens
cuuaaauuguauaaaauauccccuaacauguuuaaauguccauuuuuauucauuaugcuuugaa

SEQ ID NO: 559722 - RNA, 64 nt, Homo Sapiens
cuuaaauuugauauaacaucuccuaacuuguuuaaauguccauuuuuauucuuuauguuugaaa

SEQ ID NO: 559723 - RNA, 64 nt, Homo Sapiens
ccauuuuuuaguuacuucuuucuauccaaauuugaauguccaaauuaugaaaauaaauuuuauu

SEQ ID NO: 559724 - RNA, 64 nt, Homo Sapiens
aagcauggaauuuaccaugcgcuuuauucccucgaauguccauuaauuugauaguguauaaggu

SEQ ID NO: 559725 - RNA, 64 nt, Homo Sapiens
uugcuugccuggaauuuuaaaguccccuuuuuuaaauguccauuagggccagauuccccucucu

SEQ ID NO: 559726 - RNA, 64 nt, Homo Sapiens
uuugagugacuguaguaugggcucuaccccuagaaauguccagugggagaaaguaacuacuuug

SEQ ID NO: 559727 - RNA, 64 nt, Homo Sapiens; identical to SEQ ID NO: 557304

SEQ ID NO: 559728 - RNA, 64 nt, Homo Sapiens; identical to SEQ ID NO: 557305

SEQ ID NO: 559729 - RNA, 64 nt, Homo Sapiens; identical to SEQ ID NO: 557306

SEQ ID NO: 559730 - RNA, 64 nt, Homo Sapiens; identical to SEQ ID NO: 557307

SEQ ID NO: 559731 - RNA, 64 nt, Homo Sapiens; identical to SEQ ID NO: 557308

SEQ ID NO: 559732 - RNA, 64 nt, Homo Sapiens; identical to SEQ ID NO: 557309

SEQ ID NO: 559733 - RNA, 64 nt, Homo Sapiens; identical to SEQ ID NO: 557310

SEQ ID NO: 559734 - RNA, 64 nt, Homo Sapiens; identical to SEQ ID NO: 557311

SEQ ID NO: 559735 - RNA, 64 nt, Homo Sapiens; identical to SEQ ID NO: 557312

SEQ ID NO: 559736 - RNA, 64 nt, Homo Sapiens; identical to SEQ ID NO: 557313

SEQ ID NO: 559737 - RNA, 64 nt, Homo Sapiens; identical to SEQ ID NO: 557314

SEQ ID NO: 559738 - RNA, 64 nt, Homo Sapiens; identical to SEQ ID NO: 557315

SEQ ID NO: 559739 - RNA, 64 nt, Homo Sapiens; identical to SEQ ID NO: 557316

SEQ ID NO: 559740 - RNA, 64 nt, Homo Sapiens; identical to SEQ ID NO: 557317

SEQ ID NO: 559741 - RNA, 64 nt, Homo Sapiens; identical to SEQ ID NO: 557318

SEQ ID NO: 559742 - RNA, 64 nt, Homo Sapiens; identical to SEQ ID NO: 557319

SEQ ID NO: 559743 - RNA, 64 nt, Homo Sapiens; identical to SEQ ID NO: 557320

SEQ ID NO: 559744 - RNA, 64 nt, Homo Sapiens; identical to SEQ ID NO: 557321

SEQ ID NO: 559745 - RNA, 64 nt, Homo Sapiens; identical to SEQ ID NO: 557322

SEQ ID NO: 559746 - RNA, 64 nt, Homo Sapiens; identical to SEQ ID NO: 557323

SEQ ID NO: 559747 - RNA, 64 nt, Homo Sapiens; identical to SEQ ID NO: 557324

SEQ ID NO: 559748 - RNA, 64 nt, Homo Sapiens; identical to SEQ ID NO: 557325

SEQ ID NO: 559749 - RNA, 64 nt, Homo Sapiens; identical to SEQ ID NO: 557326

SEQ ID NO: 559750 - RNA, 64 nt, Homo Sapiens; identical to SEQ ID NO: 557327

SEQ ID NO: 559751 - RNA, 64 nt, Homo Sapiens; identical to SEQ ID NO: 323858

SEQ ID NO: 559752 - RNA, 64 nt, Homo Sapiens; identical to SEQ ID NO: 323859

SEQ ID NO: 559753 - RNA, 64 nt, Homo Sapiens; identical to SEQ ID NO: 323860

SEQ ID NO: 559754 - RNA, 64 nt, Homo Sapiens; identical to SEQ ID NO: 323861

SEQ ID NO: 559755 - RNA, 64 nt, Homo Sapiens; identical to SEQ ID NO: 323862

SEQ ID NO: 559756 - RNA, 64 nt, Homo Sapiens; identical to SEQ ID NO: 323863

SEQ ID NO: 559757 - RNA, 64 nt, Homo Sapiens; identical to SEQ ID NO: 323864

SEQ ID NO: 559758 - RNA, 64 nt, Homo Sapiens; identical to SEQ ID NO: 323865

SEQ ID NO: 559759 - RNA, 64 nt, Homo Sapiens; identical to SEQ ID NO: 323866

SEQ ID NO: 559760 - RNA, 64 nt, Homo Sapiens; identical to SEQ ID NO: 323867

SEQ ID NO: 559761 - RNA, 64 nt, Homo Sapiens; identical to SEQ ID NO: 323868

SEQ ID NO: 559762 - RNA, 64 nt, Homo Sapiens; identical to SEQ ID NO: 323869

SEQ ID NO: 559763 - RNA, 64 nt, Homo Sapiens; identical to SEQ ID NO: 323870

SEQ ID NO: 559764 - RNA, 64 nt, Homo Sapiens; identical to SEQ ID NO: 323871

SEQ ID NO: 559765 - RNA, 64 nt, Homo Sapiens; identical to SEQ ID NO: 323872

SEQ ID NO: 559766 - RNA, 64 nt, Homo Sapiens; identical to SEQ ID NO: 323873

SEQ ID NO: 559767 - RNA, 64 nt, Homo Sapiens; identical to SEQ ID NO: 323874

SEQ ID NO: 559768 - RNA, 64 nt, Homo Sapiens; identical to SEQ ID NO: 323875

SEQ ID NO: 559769 - RNA, 64 nt, Homo Sapiens; identical to SEQ ID NO: 323876

SEQ ID NO: 559770 - RNA, 64 nt, Homo Sapiens; identical to SEQ ID NO: 323877

SEQ ID NO: 559771 - RNA, 64 nt, Homo Sapiens; identical to SEQ ID NO: 323878

SEQ ID NO: 559772 - RNA, 64 nt, Homo Sapiens; identical to SEQ ID NO: 323879

SEQ ID NO: 559773 - RNA, 64 nt, Homo Sapiens; identical to SEQ ID NO: 323880

SEQ ID NO: 559774 - RNA, 64 nt, Homo Sapiens; identical to SEQ ID NO: 323881

SEQ ID NO: 559775 - RNA, 64 nt, Homo Sapiens; identical to SEQ ID NO: 323882

SEQ ID NO: 559776 - RNA, 64 nt, Homo Sapiens; identical to SEQ ID NO: 323883

SEQ ID NO: 559777 - RNA, 64 nt, Homo Sapiens; identical to SEQ ID NO: 323884

SEQ ID NO: 559778 - RNA, 64 nt, Homo Sapiens; identical to SEQ ID NO: 323885

SEQ ID NO: 559779 - RNA, 64 nt, Homo Sapiens; identical to SEQ ID NO: 323886

SEQ ID NO: 559780 - RNA, 64 nt, Homo Sapiens; identical to SEQ ID NO: 323887

SEQ ID NO: 559781 - RNA, 64 nt, Homo Sapiens; identical to SEQ ID NO: 323888

SEQ ID NO: 559782 - RNA, 64 nt, Homo Sapiens; identical to SEQ ID NO: 323889

SEQ ID NO: 559783 - RNA, 64 nt, Homo Sapiens; identical to SEQ ID NO: 323890

SEQ ID NO: 559784 - RNA, 64 nt, Homo Sapiens; identical to SEQ ID NO: 323891

SEQ ID NO: 559785 - RNA, 64 nt, Homo Sapiens; identical to SEQ ID NO: 323892

SEQ ID NO: 559786 - RNA, 64 nt, Homo Sapiens; identical to SEQ ID NO: 323893

SEQ ID NO: 559787 - RNA, 64 nt, Homo Sapiens; identical to SEQ ID NO: 323894

SEQ ID NO: 559788 - RNA, 64 nt, Homo Sapiens; identical to SEQ ID NO: 323895

SEQ ID NO: 559789 - RNA, 64 nt, Homo Sapiens; identical to SEQ ID NO: 323896

SEQ ID NO: 559790 - RNA, 64 nt, Homo Sapiens; identical to SEQ ID NO: 323897

SEQ ID NO: 559791 - RNA, 64 nt, Homo Sapiens; identical to SEQ ID NO: 323898

SEQ ID NO: 559792 - RNA, 64 nt, Homo Sapiens; identical to SEQ ID NO: 323899

SEQ ID NO: 559793 - RNA, 64 nt, Homo Sapiens; identical to SEQ ID NO: 323900

SEQ ID NO: 559794 - RNA, 64 nt, Homo Sapiens; identical to SEQ ID NO: 323901

SEQ ID NO: 559795 - RNA, 64 nt, Homo Sapiens; identical to SEQ ID NO: 323902

SEQ ID NO: 559796 - RNA, 64 nt, Homo Sapiens; identical to SEQ ID NO: 323903

SEQ ID NO: 559797 - RNA, 64 nt, Homo Sapiens; identical to SEQ ID NO: 323904

SEQ ID NO: 559798 - RNA, 64 nt, Homo Sapiens; identical to SEQ ID NO: 323905

SEQ ID NO: 559799 - RNA, 64 nt, Homo Sapiens; identical to SEQ ID NO: 323906

SEQ ID NO: 559800 - RNA, 64 nt, Homo Sapiens; identical to SEQ ID NO: 323907

SEQ ID NO: 559801 - RNA, 64 nt, Homo Sapiens; identical to SEQ ID NO: 323908

SEQ ID NO: 559802 - RNA, 64 nt, Homo Sapiens; identical to SEQ ID NO: 323909

SEQ ID NO: 559803 - RNA, 64 nt, Homo Sapiens; identical to SEQ ID NO: 301531

SEQ ID NO: 559804 - RNA, 64 nt, Homo Sapiens; identical to SEQ ID NO: 301532

SEQ ID NO: 559805 - RNA, 64 nt, Homo Sapiens; identical to SEQ ID NO: 301533

SEQ ID NO: 559806 - RNA, 64 nt, Homo Sapiens; identical to SEQ ID NO: 301534

SEQ ID NO: 559807 - RNA, 64 nt, Homo Sapiens; identical to SEQ ID NO: 301535

SEQ ID NO: 559808 - RNA, 64 nt, Homo Sapiens; identical to SEQ ID NO: 301536

SEQ ID NO: 559809 - RNA, 64 nt, Homo Sapiens; identical to SEQ ID NO: 301537

SEQ ID NO: 559810 - RNA, 64 nt, Homo Sapiens; identical to SEQ ID NO: 301538

SEQ ID NO: 559811 - RNA, 64 nt, Homo Sapiens; identical to SEQ ID NO: 301539

SEQ ID NO: 559812 - RNA, 64 nt, Homo Sapiens; identical to SEQ ID NO: 301540

SEQ ID NO: 559813 - RNA, 64 nt, Homo Sapiens; identical to SEQ ID NO: 301541

SEQ ID NO: 559814 - RNA, 64 nt, Homo Sapiens; identical to SEQ ID NO: 301542

SEQ ID NO: 559815 - RNA, 64 nt, Homo Sapiens; identical to SEQ ID NO: 301543

SEQ ID NO: 559816 - RNA, 64 nt, Homo Sapiens; identical to SEQ ID NO: 301544

SEQ ID NO: 559817 - RNA, 64 nt, Homo Sapiens; identical to SEQ ID NO: 301545

SEQ ID NO: 559818 - RNA, 64 nt, Homo Sapiens; identical to SEQ ID NO: 301546

SEQ ID NO: 559819 - RNA, 64 nt, Homo Sapiens; identical to SEQ ID NO: 301547

SEQ ID NO: 559820 - RNA, 64 nt, Homo Sapiens; identical to SEQ ID NO: 301548

SEQ ID NO: 559821 - RNA, 64 nt, Homo Sapiens; identical to SEQ ID NO: 301549

SEQ ID NO: 559822 - RNA, 64 nt, Homo Sapiens; identical to SEQ ID NO: 301550

SEQ ID NO: 559823 - RNA, 64 nt, Homo Sapiens; identical to SEQ ID NO: 301551

SEQ ID NO: 559824 - RNA, 64 nt, Homo Sapiens; identical to SEQ ID NO: 301552

SEQ ID NO: 559825 - RNA, 64 nt, Homo Sapiens; identical to SEQ ID NO: 301553

SEQ ID NO: 559826 - RNA, 64 nt, Homo Sapiens; identical to SEQ ID NO: 301554

SEQ ID NO: 559827 - RNA, 64 nt, Homo Sapiens; identical to SEQ ID NO: 301555

SEQ ID NO: 559828 - RNA, 64 nt, Homo Sapiens; identical to SEQ ID NO: 301556

SEQ ID NO: 559829 - RNA, 64 nt, Homo Sapiens; identical to SEQ ID NO: 301557

SEQ ID NO: 559830 - RNA, 64 nt, Homo Sapiens; identical to SEQ ID NO: 301558

SEQ ID NO: 559831 - RNA, 64 nt, Homo Sapiens; identical to SEQ ID NO: 301559

SEQ ID NO: 559832 - RNA, 64 nt, Homo Sapiens; identical to SEQ ID NO: 301560

SEQ ID NO: 559833 - RNA, 60 nt, Homo Sapiens; identical to SEQ ID NO: 301561

SEQ ID NO: 559834 - RNA, 64 nt, Homo Sapiens; identical to SEQ ID NO: 301562

SEQ ID NO: 559835 - RNA, 64 nt, Homo Sapiens; identical to SEQ ID NO: 301563

SEQ ID NO: 559836 - RNA, 64 nt, Homo Sapiens; identical to SEQ ID NO: 301564

SEQ ID NO: 559837 - RNA, 64 nt, Homo Sapiens; identical to SEQ ID NO: 301565

SEQ ID NO: 559838 - RNA, 64 nt, Homo Sapiens; identical to SEQ ID NO: 301566

SEQ ID NO: 559839 - RNA, 64 nt, Homo Sapiens; identical to SEQ ID NO: 301567

SEQ ID NO: 559840 - RNA, 64 nt, Homo Sapiens; identical to SEQ ID NO: 301568

SEQ ID NO: 559841 - RNA, 64 nt, Homo Sapiens; identical to SEQ ID NO: 301569

SEQ ID NO: 559842 - RNA, 64 nt, Homo Sapiens; identical to SEQ ID NO: 301570

SEQ ID NO: 559843 - RNA, 64 nt, Homo Sapiens; identical to SEQ ID NO: 301571

SEQ ID NO: 559844 - RNA, 64 nt, Homo Sapiens; identical to SEQ ID NO: 301572

SEQ ID NO: 559845 - RNA, 64 nt, Homo Sapiens; identical to SEQ ID NO: 301573

SEQ ID NO: 559846 - RNA, 64 nt, Homo Sapiens; identical to SEQ ID NO: 301574

SEQ ID NO: 559847 - RNA, 64 nt, Homo Sapiens; identical to SEQ ID NO: 301575

SEQ ID NO: 559848 - RNA, 64 nt, Homo Sapiens; identical to SEQ ID NO: 301576

SEQ ID NO: 559849 - RNA, 64 nt, Homo Sapiens; identical to SEQ ID NO: 301577

SEQ ID NO: 559850 - RNA, 64 nt, Homo Sapiens; identical to SEQ ID NO: 301578

SEQ ID NO: 559851 - RNA, 64 nt, Homo Sapiens; identical to SEQ ID NO: 301579

SEQ ID NO: 559852 - RNA, 64 nt, Homo Sapiens; identical to SEQ ID NO: 301580

SEQ ID NO: 559853 - RNA, 64 nt, Homo Sapiens; identical to SEQ ID NO: 301581

SEQ ID NO: 559854 - RNA, 64 nt, Homo Sapiens; identical to SEQ ID NO: 301582

SEQ ID NO: 559855 - RNA, 64 nt, Homo Sapiens; identical to SEQ ID NO: 301583

SEQ ID NO: 559856 - RNA, 64 nt, Homo Sapiens; identical to SEQ ID NO: 301584

SEQ ID NO: 559857 - RNA, 64 nt, Homo Sapiens; identical to SEQ ID NO: 301585

SEQ ID NO: 559858 - RNA, 64 nt, Homo Sapiens; identical to SEQ ID NO: 301586

SEQ ID NO: 559859 - RNA, 64 nt, Homo Sapiens; identical to SEQ ID NO: 301587

SEQ ID NO: 559860 - RNA, 64 nt, Homo Sapiens; identical to SEQ ID NO: 301588

SEQ ID NO: 559861 - RNA, 64 nt, Homo Sapiens; identical to SEQ ID NO: 301589

SEQ ID NO: 559862 - RNA, 64 nt, Homo Sapiens; identical to SEQ ID NO: 301590

SEQ ID NO: 559863 - RNA, 64 nt, Homo Sapiens; identical to SEQ ID NO: 301591

SEQ ID NO: 559864 - RNA, 64 nt, Homo Sapiens; identical to SEQ ID NO: 301592

SEQ ID NO: 559865 - RNA, 64 nt, Homo Sapiens; identical to SEQ ID NO: 301593

SEQ ID NO: 559866 - RNA, 64 nt, Homo Sapiens; identical to SEQ ID NO: 301594

SEQ ID NO: 559867 - RNA, 64 nt, Homo Sapiens; identical to SEQ ID NO: 301595

SEQ ID NO: 559868 - RNA, 64 nt, Homo Sapiens; identical to SEQ ID NO: 301596

SEQ ID NO: 559869 - RNA, 64 nt, Homo Sapiens; identical to SEQ ID NO: 301597

SEQ ID NO: 559870 - RNA, 64 nt, Homo Sapiens; identical to SEQ ID NO: 301598

SEQ ID NO: 559871 - RNA, 64 nt, Homo Sapiens; identical to SEQ ID NO: 301599

SEQ ID NO: 559872 - RNA, 64 nt, Homo Sapiens; identical to SEQ ID NO: 301600

SEQ ID NO: 559873 - RNA, 64 nt, Homo Sapiens; identical to SEQ ID NO: 301601

SEQ ID NO: 559874 - RNA, 64 nt, Homo Sapiens; identical to SEQ ID NO: 301602

SEQ ID NO: 559875 - RNA, 64 nt, Homo Sapiens; identical to SEQ ID NO: 301603

SEQ ID NO: 559876 - RNA, 64 nt, Homo Sapiens; identical to SEQ ID NO: 301604

SEQ ID NO: 559877 - RNA, 64 nt, Homo Sapiens; identical to SEQ ID NO: 301605

SEQ ID NO: 559878 - RNA, 64 nt, Homo Sapiens; identical to SEQ ID NO: 301606

SEQ ID NO: 559879 - RNA, 64 nt, Homo Sapiens; identical to SEQ ID NO: 301607

SEQ ID NO: 559880 - RNA, 64 nt, Homo Sapiens; identical to SEQ ID NO: 301608

SEQ ID NO: 559881 - RNA, 64 nt, Homo Sapiens; identical to SEQ ID NO: 301609

SEQ ID NO: 559882 - RNA, 64 nt, Homo Sapiens; identical to SEQ ID NO: 301610

SEQ ID NO: 559883 - RNA, 64 nt, Homo Sapiens; identical to SEQ ID NO: 301611

SEQ ID NO: 559884 - RNA, 64 nt, Homo Sapiens; identical to SEQ ID NO: 301612

SEQ ID NO: 559885 - RNA, 64 nt, Homo Sapiens; identical to SEQ ID NO: 301613

SEQ ID NO: 559886 - RNA, 64 nt, Homo Sapiens; identical to SEQ ID NO: 301614

SEQ ID NO: 559887 - RNA, 64 nt, Homo Sapiens; identical to SEQ ID NO: 301615

SEQ ID NO: 559888 - RNA, 64 nt, Homo Sapiens; identical to SEQ ID NO: 301616

SEQ ID NO: 559889 - RNA, 64 nt, Homo Sapiens; identical to SEQ ID NO: 301617

SEQ ID NO: 559890 - RNA, 64 nt, Homo Sapiens; identical to SEQ ID NO: 301618

SEQ ID NO: 559891 - RNA, 64 nt, Homo Sapiens; identical to SEQ ID NO: 301619

SEQ ID NO: 559892 - RNA, 64 nt, Homo Sapiens; identical to SEQ ID NO: 301620

SEQ ID NO: 559893 - RNA, 64 nt, Homo Sapiens; identical to SEQ ID NO: 301621

SEQ ID NO: 559894 - RNA, 64 nt, Homo Sapiens; identical to SEQ ID NO: 301622

SEQ ID NO: 559895 - RNA, 64 nt, Homo Sapiens; identical to SEQ ID NO: 301623

SEQ ID NO: 559896 - RNA, 64 nt, Homo Sapiens; identical to SEQ ID NO: 301624

SEQ ID NO: 559897 - RNA, 64 nt, Homo Sapiens; identical to SEQ ID NO: 301625

SEQ ID NO: 559898 - RNA, 64 nt, Homo Sapiens; identical to SEQ ID NO: 301626

SEQ ID NO: 559899 - RNA, 64 nt, Homo Sapiens; identical to SEQ ID NO: 301627

SEQ ID NO: 559900 - RNA, 64 nt, Homo Sapiens; identical to SEQ ID NO: 301628

SEQ ID NO: 559901 - RNA, 64 nt, Homo Sapiens; identical to SEQ ID NO: 301629

SEQ ID NO: 559902 - RNA, 64 nt, Homo Sapiens; identical to SEQ ID NO: 301630

SEQ ID NO: 559903 - RNA, 64 nt, Homo Sapiens; identical to SEQ ID NO: 301631

SEQ ID NO: 559904 - RNA, 64 nt, Homo Sapiens; identical to SEQ ID NO: 301632

SEQ ID NO: 559905 - RNA, 64 nt, Homo Sapiens; identical to SEQ ID NO: 301633

SEQ ID NO: 559906 - RNA, 64 nt, Homo Sapiens; identical to SEQ ID NO: 301634

SEQ ID NO: 559907 - RNA, 64 nt, Homo Sapiens; identical to SEQ ID NO: 301635

SEQ ID NO: 559908 - RNA, 64 nt, Homo Sapiens; identical to SEQ ID NO: 301636

SEQ ID NO: 559909 - RNA, 64 nt, Homo Sapiens; identical to SEQ ID NO: 301637

SEQ ID NO: 559910 - RNA, 64 nt, Homo Sapiens; identical to SEQ ID NO: 301638

SEQ ID NO: 559911 - RNA, 64 nt, Homo Sapiens; identical to SEQ ID NO: 301639

SEQ ID NO: 559912 - RNA, 64 nt, Homo Sapiens; identical to SEQ ID NO: 301640

SEQ ID NO: 559913 - RNA, 64 nt, Homo Sapiens; identical to SEQ ID NO: 301641

SEQ ID NO: 559914 - RNA, 64 nt, Homo Sapiens; identical to SEQ ID NO: 301642

SEQ ID NO: 559915 - RNA, 64 nt, Homo Sapiens; identical to SEQ ID NO: 301643

SEQ ID NO: 559916 - RNA, 64 nt, Homo Sapiens; identical to SEQ ID NO: 301644

SEQ ID NO: 559917 - RNA, 64 nt, Homo Sapiens; identical to SEQ ID NO: 301645

SEQ ID NO: 559918 - RNA, 64 nt, Homo Sapiens; identical to SEQ ID NO: 301646

SEQ ID NO: 559919 - RNA, 64 nt, Homo Sapiens; identical to SEQ ID NO: 301647

SEQ ID NO: 559920 - RNA, 64 nt, Homo Sapiens; identical to SEQ ID NO: 301648

SEQ ID NO: 559921 - RNA, 64 nt, Homo Sapiens; identical to SEQ ID NO: 301649

SEQ ID NO: 559922 - RNA, 64 nt, Homo Sapiens; identical to SEQ ID NO: 301650

SEQ ID NO: 559923 - RNA, 64 nt, Homo Sapiens; identical to SEQ ID NO: 301651

SEQ ID NO: 559924 - RNA, 64 nt, Homo Sapiens; identical to SEQ ID NO: 301652

SEQ ID NO: 559925 - RNA, 64 nt, Homo Sapiens; identical to SEQ ID NO: 301653

SEQ ID NO: 559926 - RNA, 64 nt, Homo Sapiens; identical to SEQ ID NO: 301654

SEQ ID NO: 559927 - RNA, 64 nt, Homo Sapiens; identical to SEQ ID NO: 301655

SEQ ID NO: 559928 - RNA, 64 nt, Homo Sapiens; identical to SEQ ID NO: 301656

SEQ ID NO: 559929 - RNA, 64 nt, Homo Sapiens; identical to SEQ ID NO: 301657

SEQ ID NO: 559930 - RNA, 64 nt, Homo Sapiens; identical to SEQ ID NO: 301658

SEQ ID NO: 559931 - RNA, 64 nt, Homo Sapiens; identical to SEQ ID NO: 301659

SEQ ID NO: 559932 - RNA, 64 nt, Homo Sapiens; identical to SEQ ID NO: 301660

SEQ ID NO: 559933 - RNA, 64 nt, Homo Sapiens; identical to SEQ ID NO: 301661

SEQ ID NO: 559934 - RNA, 64 nt, Homo Sapiens; identical to SEQ ID NO: 301662

SEQ ID NO: 559935 - RNA, 64 nt, Homo Sapiens; identical to SEQ ID NO: 301663

SEQ ID NO: 559936 - RNA, 64 nt, Homo Sapiens; identical to SEQ ID NO: 301664

SEQ ID NO: 559937 - RNA, 64 nt, Homo Sapiens; identical to SEQ ID NO: 301665

SEQ ID NO: 559938 - RNA, 64 nt, Homo Sapiens; identical to SEQ ID NO: 301666

SEQ ID NO: 559939 - RNA, 64 nt, Homo Sapiens; identical to SEQ ID NO: 301667

SEQ ID NO: 559940 - RNA, 62 nt, Homo Sapiens; identical to SEQ ID NO: 301668

SEQ ID NO: 559941 - RNA, 59 nt, Homo Sapiens; identical to SEQ ID NO: 301669

SEQ ID NO: 559942 - RNA, 64 nt, Homo Sapiens; identical to SEQ ID NO: 301670

SEQ ID NO: 559943 - RNA, 64 nt, Homo Sapiens; identical to SEQ ID NO: 301671

SEQ ID NO: 559944 - RNA, 64 nt, Homo Sapiens; identical to SEQ ID NO: 301672

SEQ ID NO: 559945 - RNA, 64 nt, Homo Sapiens; identical to SEQ ID NO: 301673

SEQ ID NO: 559946 - RNA, 64 nt, Homo Sapiens; identical to SEQ ID NO: 301674

SEQ ID NO: 559947 - RNA, 64 nt, Homo Sapiens; identical to SEQ ID NO: 301675

SEQ ID NO: 559948 - RNA, 64 nt, Homo Sapiens; identical to SEQ ID NO: 301676

SEQ ID NO: 559949 - RNA, 64 nt, Homo Sapiens; identical to SEQ ID NO: 301677

SEQ ID NO: 559950 - RNA, 64 nt, Homo Sapiens; identical to SEQ ID NO: 301678

SEQ ID NO: 559951 - RNA, 64 nt, Homo Sapiens; identical to SEQ ID NO: 301679

SEQ ID NO: 559952 - RNA, 64 nt, Homo Sapiens; identical to SEQ ID NO: 301680

SEQ ID NO: 559953 - RNA, 64 nt, Homo Sapiens; identical to SEQ ID NO: 301681

SEQ ID NO: 559954 - RNA, 64 nt, Homo Sapiens; identical to SEQ ID NO: 301682

SEQ ID NO: 559955 - RNA, 64 nt, Homo Sapiens; identical to SEQ ID NO: 301683

SEQ ID NO: 559956 - RNA, 64 nt, Homo Sapiens; identical to SEQ ID NO: 301684

SEQ ID NO: 559957 - RNA, 64 nt, Homo Sapiens; identical to SEQ ID NO: 301685

SEQ ID NO: 559958 - RNA, 64 nt, Homo Sapiens; identical to SEQ ID NO: 301686

SEQ ID NO: 559959 - RNA, 64 nt, Homo Sapiens; identical to SEQ ID NO: 301687

SEQ ID NO: 559960 - RNA, 64 nt, Homo Sapiens; identical to SEQ ID NO: 301688

SEQ ID NO: 559961 - RNA, 64 nt, Homo Sapiens; identical to SEQ ID NO: 301689

SEQ ID NO: 559962 - RNA, 64 nt, Homo Sapiens; identical to SEQ ID NO: 301690

SEQ ID NO: 559963 - RNA, 64 nt, Homo Sapiens; identical to SEQ ID NO: 301691

SEQ ID NO: 559964 - RNA, 64 nt, Homo Sapiens; identical to SEQ ID NO: 301692

SEQ ID NO: 559965 - RNA, 64 nt, Homo Sapiens; identical to SEQ ID NO: 301693

SEQ ID NO: 559966 - RNA, 64 nt, Homo Sapiens; identical to SEQ ID NO: 301694

SEQ ID NO: 559967 - RNA, 64 nt, Homo Sapiens; identical to SEQ ID NO: 301695

SEQ ID NO: 559968 - RNA, 64 nt, Homo Sapiens; identical to SEQ ID NO: 301696

SEQ ID NO: 559969 - RNA, 64 nt, Homo Sapiens; identical to SEQ ID NO: 301697

SEQ ID NO: 559970 - RNA, 64 nt, Homo Sapiens; identical to SEQ ID NO: 301698

SEQ ID NO: 559971 - RNA, 64 nt, Homo Sapiens; identical to SEQ ID NO: 301699

SEQ ID NO: 559972 - RNA, 64 nt, Homo Sapiens; identical to SEQ ID NO: 301700

SEQ ID NO: 559973 - RNA, 64 nt, Homo Sapiens; identical to SEQ ID NO: 301701

SEQ ID NO: 559974 - RNA, 64 nt, Homo Sapiens; identical to SEQ ID NO: 301702

SEQ ID NO: 559975 - RNA, 64 nt, Homo Sapiens
uagauaaauaccuuucaagugugagcuuagacgucaacccuaaaauacuuaaccguaaugcuaa

SEQ ID NO: 559976 - RNA, 64 nt, Homo Sapiens
guuuucugcaguuauuucucuuguucuggccaaacaacccuaaaaauccuuaccauuccacaaa

SEQ ID NO: 559977 - RNA, 64 nt, Homo Sapiens
gugugcaaaggcaaggcuugcuuuuccugucuuucaacccuaucuugcuuuuccugucuuucaa

SEQ ID NO: 559978 - RNA, 64 nt, Homo Sapiens
ugucuuucaacccuaucuugcuuuuccugucuuucaacccuaucuugcuuucauugucuucauc

SEQ ID NO: 559979 - RNA, 64 nt, Homo Sapiens
cuaucuccugaagauuuaauugcuauuguuacccauucgaaaucagcuguacugugugaacgaa

SEQ ID NO: 559980 - RNA, 64 nt, Homo Sapiens
auucgaugggacuuuggggaccuguguccuguagauucgaaaaugggaaucugaaugucuagag

SEQ ID NO: 559981 - RNA, 64 nt, Homo Sapiens
gaaccucccagguguggaucccaacaaugaagccauucgaaaugcuaugggcucccuggccucc

SEQ ID NO: 559982 - RNA, 64 nt, Homo Sapiens
uucuaugaggaauuuaguaccucuucacugugaaauucgaaauaaugauuuuuauaaaagcaaa

SEQ ID NO: 559983 - RNA, 64 nt, Homo Sapiens
acuugcaguaugcauuucuugagucagaacauuaauucgaaacaagguugcauuauaauaacaa

SEQ ID NO: 559984 - RNA, 64 nt, Homo Sapiens
ugaaaaauaaggcuaguguaaacuuagaguaaaaauucgaaaacuaaagauaaucacugugagc

SEQ ID NO: 559985 - RNA, 64 nt, Homo Sapiens
uauuccaggacuaauucuuacuacagaguuagaaauucgaaaacuuuacaauuguguuuuagau

SEQ ID NO: 559986 - RNA, 64 nt, Homo Sapiens
aagugagacuaugguucaccuguucaguccuaaaauucgaaauaaaauaucugaaccuucuuuc

SEQ ID NO: 559987 - RNA, 64 nt, Homo Sapiens
uuuaaggacguucuuuauuaugaaacuuuaucacauucgaaauguuuguuuacagugggauuuu

SEQ ID NO: 559988 - RNA, 64 nt, Homo Sapiens
ccuagagcaaugaucuuuuucacgcauuugcuuuauucgaaaagaggcuuuuaaaaugugcaug

SEQ ID NO: 559989 - RNA, 64 nt, Homo Sapiens
uugacucagggguucuuaacuuaacuaaagggcuauucgaaaucgcauuuuuuuuuuuuacaca

SEQ ID NO: 559990 - RNA, 64 nt, Homo Sapiens
cauauuuuauuacauuuuucucccuuaauaaaauauucgaaauugaaauccaggaauuaaauca

SEQ ID NO: 559991 - RNA, 64 nt, Homo Sapiens
cuacugguuaaaggaccaccauuuaauuaacaugauucgaaagccuuccucggguucaaagcug

SEQ ID NO: 559992 - RNA, 64 nt, Homo Sapiens
uccauucagugauaaaaugaucagccaugugaagauucgaaacuucgaguucuuuugaaauuca

SEQ ID NO: 559993 - RNA, 64 nt, Homo Sapiens
uauccuaugauacaacucuaaguguuaucacuugauucgaaagggucagaagaccaguuuuuua

SEQ ID NO: 559994 - RNA, 64 nt, Homo Sapiens
caugcagugcaguauauuuucccugaaauaacgcauucgaaauccagagucacuaugugguccu

SEQ ID NO: 559995 - RNA, 64 nt, Homo Sapiens
caugauacuacuauaaguugacggccagaagaccauucgaaauuccaguuaaguaguuuucuga

SEQ ID NO: 559996 - RNA, 64 nt, Homo Sapiens
aaaauuauuugaaaacauauaaagcacuauacagauucgaaacuccauugagucauuauccuug

SEQ ID NO: 559997 - RNA, 64 nt, Homo Sapiens
ucaauagaaaugggcaaugugggaaagacucccuauucgaaaauuagugcuggaauaucuggcc

SEQ ID NO: 559998 - RNA, 64 nt, Homo Sapiens
aggcagaauuccauuccuccgugcuguaggauuaauucgaaaauuggcuguuaguuuuuaguga

SEQ ID NO: 559999 - RNA, 64 nt, Homo Sapiens
agcucaaauugauuuuuuaacauacuuguucuguauucgaaaugggcaggacuuccaucugugc

SEQ ID NO: 560000 - RNA, 64 nt, Homo Sapiens
uuaauuucucuuuuuaauuuaagugaucuuucuaauucgaaagcuguguucuuuuugaauaccg

SEQ ID NO: 560001 - RNA, 64 nt, Homo Sapiens
gcucuauagucauuagaagcgaaacauggcucauauucgaaauuuaaaagaagaauucugcaua

SEQ ID NO: 560002 - RNA, 64 nt, Homo Sapiens
ugcugccaguuccucuuugauaaauauauaguuaauucgaaauaaaauccauugcaauucauuu

SEQ ID NO: 560003 - RNA, 64 nt, Homo Sapiens
uuuuauacaaacuuuuauaggugacaugauaccuauucgaaacauuuuaucuguaacucucugg

SEQ ID NO: 560004 - RNA, 64 nt, Homo Sapiens
aaaguggggcugggacacacacccugaguuuuaaauucgaaaauccugggaaccccaggaauug

SEQ ID NO: 560005 - RNA, 64 nt, Homo Sapiens
aagaagacuauguaaaacucaaucagccaauuggauucgaaacacagccucuagaaugguaaca

SEQ ID NO: 560006 - RNA, 64 nt, Homo Sapiens
cuucauuuucuucucuuuuuagauugcaauagacauucgaaagguucugucuuuuaaaacaauc

SEQ ID NO: 560007 - RNA, 64 nt, Homo Sapiens
uagaaauuguaaaucagaggaaaauuuguccuacauucgaaaaacaaguuuuacuaaauacuuu

SEQ ID NO: 560008 - RNA, 64 nt, Homo Sapiens
ugguucacaguuuagcauuguuauaaaccauuccauucgaaaagcacuuugaaaaauuguuccc

SEQ ID NO: 560009 - RNA, 64 nt, Homo Sapiens
auaaagaaaagaugagcaaacauuaguucgagaaauucgaaaacuguugaugaugccuucuaua

SEQ ID NO: 560010 - RNA, 64 nt, Homo Sapiens
uaacagcaauuauaguaauaaaaggcuuaucuagauucgaaaaucagcaacauaugagaagaaa

SEQ ID NO: 560011 - RNA, 64 nt, Homo Sapiens
uguuugaaauauggaacuguaauaacuucuagguauucgaaaccugugauuucugugccauuuu

SEQ ID NO: 560012 - RNA, 64 nt, Homo Sapiens
acauagcaaaauucaugugacggaugauaaauugauucgaaaagcuggucccccaggaucuaau

SEQ ID NO: 560013 - RNA, 64 nt, Homo Sapiens
aaagugaaggcagagugagcaggcaaaguagaaaauucgaaaagguccucaacgaguuuguaca

SEQ ID NO: 560014 - RNA, 64 nt, Homo Sapiens
accaguccauuuuuccuuuugccuucugggccaaauucgaaauagcacaucaagaguuaacucu

SEQ ID NO: 560015 - RNA, 64 nt, Homo Sapiens
ggguacggcaaccacaugucccagaucgucuccaauucgaaaacaaccguccugcugucccugu

SEQ ID NO: 560016 - RNA, 64 nt, Homo Sapiens
uuuggggaacgaaugcaacaugaacuuuuuaaaaauucgaaaaccugcgcuucgaauccuuguu

SEQ ID NO: 560017 - RNA, 63 nt, Homo Sapiens
aagagaguuuguacucauagccuuggaaccuuaauucgaaauguacugaagaaaaaguaacag

SEQ ID NO: 560018 - RNA, 64 nt, Homo Sapiens
cugugccauggcauauauguauuuuaaucaucagauucgaaauuuaacuaucauuauuuaccug

SEQ ID NO: 560019 - RNA, 64 nt, Homo Sapiens
auaaccauguggauaaaaugccagacaucuuuuuauucgaaaauuuuacuuuucaugcuucugu

SEQ ID NO: 560020 - RNA, 64 nt, Homo Sapiens
gaggccaaggagggaggaucgcuuaagcccaggaauucgaaaucagccuaggcaacauaguaag

SEQ ID NO: 560021 - RNA, 64 nt, Homo Sapiens
acaucuuuuaaauuaagccaauuuucuaggauucauucgaaagcucucuguguaaagacagauu

SEQ ID NO: 560022 - RNA, 64 nt, Homo Sapiens
agaaaguaacuuaauuuuaauaccacuacuaaaaauucgaaaauuucuucuuuaaucacauuca

SEQ ID NO: 560023 - RNA, 64 nt, Homo Sapiens
caauacacugccucguucucccaugaccguuugcauucgaaacaaaacucagguuaacuugggu

SEQ ID NO: 560024 - RNA, 64 nt, Homo Sapiens; identical to SEQ ID NO: 112183

SEQ ID NO: 560025 - RNA, 64 nt, Homo Sapiens; identical to SEQ ID NO: 112184

SEQ ID NO: 560026 - RNA, 64 nt, Homo Sapiens; identical to SEQ ID NO: 112185

SEQ ID NO: 560027 - RNA, 64 nt, Homo Sapiens; identical to SEQ ID NO: 112186

SEQ ID NO: 560028 - RNA, 64 nt, Homo Sapiens; identical to SEQ ID NO: 112187

SEQ ID NO: 560029 - RNA, 64 nt, Homo Sapiens; identical to SEQ ID NO: 112188

SEQ ID NO: 560030 - RNA, 64 nt, Homo Sapiens; identical to SEQ ID NO: 112189

SEQ ID NO: 560031 - RNA, 64 nt, Homo Sapiens; identical to SEQ ID NO: 112190

SEQ ID NO: 560032 - RNA, 64 nt, Homo Sapiens; identical to SEQ ID NO: 112191

SEQ ID NO: 560033 - RNA, 64 nt, Homo Sapiens; identical to SEQ ID NO: 112192

SEQ ID NO: 560034 - RNA, 64 nt, Homo Sapiens; identical to SEQ ID NO: 112193

SEQ ID NO: 560035 - RNA, 64 nt, Homo Sapiens; identical to SEQ ID NO: 112194

SEQ ID NO: 560036 - RNA, 64 nt, Homo Sapiens; identical to SEQ ID NO: 112195

SEQ ID NO: 560037 - RNA, 64 nt, Homo Sapiens; identical to SEQ ID NO: 112196

SEQ ID NO: 560038 - RNA, 64 nt, Homo Sapiens; identical to SEQ ID NO: 112197

SEQ ID NO: 560039 - RNA, 64 nt, Homo Sapiens; identical to SEQ ID NO: 112198

SEQ ID NO: 560040 - RNA, 64 nt, Homo Sapiens; identical to SEQ ID NO: 112199

SEQ ID NO: 560041 - RNA, 64 nt, Homo Sapiens; identical to SEQ ID NO: 112200

SEQ ID NO: 560042 - RNA, 64 nt, Homo Sapiens; identical to SEQ ID NO: 112201

SEQ ID NO: 560043 - RNA, 64 nt, Homo Sapiens; identical to SEQ ID NO: 112202

SEQ ID NO: 560044 - RNA, 64 nt, Homo Sapiens; identical to SEQ ID NO: 112203

SEQ ID NO: 560045 - RNA, 64 nt, Homo Sapiens; identical to SEQ ID NO: 112204

SEQ ID NO: 560046 - RNA, 64 nt, Homo Sapiens; identical to SEQ ID NO: 112205

SEQ ID NO: 560047 - RNA, 64 nt, Homo Sapiens; identical to SEQ ID NO: 112206

SEQ ID NO: 560048 - RNA, 64 nt, Homo Sapiens; identical to SEQ ID NO: 112207

SEQ ID NO: 560049 - RNA, 64 nt, Homo Sapiens; identical to SEQ ID NO: 112208

SEQ ID NO: 560050 - RNA, 64 nt, Homo Sapiens; identical to SEQ ID NO: 112209

SEQ ID NO: 560051 - RNA, 64 nt, Homo Sapiens; identical to SEQ ID NO: 112210

SEQ ID NO: 560052 - RNA, 64 nt, Homo Sapiens; identical to SEQ ID NO: 112211

SEQ ID NO: 560053 - RNA, 64 nt, Homo Sapiens; identical to SEQ ID NO: 112212

SEQ ID NO: 560054 - RNA, 64 nt, Homo Sapiens; identical to SEQ ID NO: 112213

SEQ ID NO: 560055 - RNA, 64 nt, Homo Sapiens; identical to SEQ ID NO: 112214

SEQ ID NO: 560056 - RNA, 64 nt, Homo Sapiens; identical to SEQ ID NO: 112215

SEQ ID NO: 560057 - RNA, 64 nt, Homo Sapiens; identical to SEQ ID NO: 112216

SEQ ID NO: 560058 - RNA, 64 nt, Homo Sapiens; identical to SEQ ID NO: 112217

SEQ ID NO: 560059 - RNA, 64 nt, Homo Sapiens; identical to SEQ ID NO: 112218

SEQ ID NO: 560060 - RNA, 64 nt, Homo Sapiens; identical to SEQ ID NO: 112219

SEQ ID NO: 560061 - RNA, 64 nt, Homo Sapiens; identical to SEQ ID NO: 112220

SEQ ID NO: 560062 - RNA, 64 nt, Homo Sapiens; identical to SEQ ID NO: 112221

SEQ ID NO: 560063 - RNA, 64 nt, Homo Sapiens; identical to SEQ ID NO: 112222

SEQ ID NO: 560064 - RNA, 64 nt, Homo Sapiens; identical to SEQ ID NO: 112223

SEQ ID NO: 560065 - RNA, 64 nt, Homo Sapiens; identical to SEQ ID NO: 112224

SEQ ID NO: 560066 - RNA, 64 nt, Homo Sapiens; identical to SEQ ID NO: 112225

SEQ ID NO: 560067 - RNA, 64 nt, Homo Sapiens; identical to SEQ ID NO: 112226

SEQ ID NO: 560068 - RNA, 64 nt, Homo Sapiens; identical to SEQ ID NO: 112227

SEQ ID NO: 560069 - RNA, 64 nt, Homo Sapiens; identical to SEQ ID NO: 112228

SEQ ID NO: 560070 - RNA, 64 nt, Homo Sapiens; identical to SEQ ID NO: 112229

SEQ ID NO: 560071 - RNA, 64 nt, Homo Sapiens
gccucuucuuuguggagccucucagugugggcagcccucgcaugcuggggucgggccagcucuc

SEQ ID NO: 560072 - RNA, 64 nt, Homo Sapiens
gaaaugaacucacugcauuucugugcucccuccucccucgcaccaaacuccuagcucuacaagu

SEQ ID NO: 560073 - RNA, 64 nt, Homo Sapiens
ccagaaaagccaugccagcugagaggacacuggccccucgcacugucuggagucuccccccggg

SEQ ID NO: 560074 - RNA, 64 nt, Homo Sapiens
guggagaaagcagugacacauucacacagcuguucccucgcauguuauuucaugaacaugaccu

SEQ ID NO: 560075 - RNA, 64 nt, Homo Sapiens
ugauuuugcuuuccaagcuugguuuguggcgucucccucgcagagcccuucucguuucuuuuuu

SEQ ID NO: 560076 - RNA, 64 nt, Homo Sapiens
gggaggcagcgugggcucugccaaugugggcugccccucgcacacagggcucacagggcaggcc

SEQ ID NO: 560077 - RNA, 64 nt, Homo Sapiens
gaaugggaagggagaacauaucuauccucucagacccucgcagcagcagcaacucauacuuggc

SEQ ID NO: 560078 - RNA, 64 nt, Homo Sapiens
caacucagccaguguugggaugggccaugcgggccccucgcagcaaacgacccucuguggccga

SEQ ID NO: 560079 - RNA, 64 nt, Homo Sapiens
ugugaauggugccacacagcgcccacagacugggcccucgcacccuugggugcucccggccgcc

SEQ ID NO: 560080 - RNA, 64 nt, Homo Sapiens
gcuacagccaaauagcuuauagaaaaauuuuaugcccucgcauucauuauguuccuccguagca

SEQ ID NO: 560081 - RNA, 64 nt, Homo Sapiens
cucuccuccgcucaggcccccaaggccgcccuuucccucgcacacaggccccacccccacaguu

SEQ ID NO: 560082 - RNA, 64 nt, Homo Sapiens
cuugcuggauguuccccuguuccugagccuuaaccccucgcacagccauccccccccccguccu

SEQ ID NO: 560083 - RNA, 64 nt, Homo Sapiens
ugcuucuugcuuuucuuuccggaccgcaucuucucccucgcagcagcccauccguccucgcgug

SEQ ID NO: 560084 - RNA, 64 nt, Homo Sapiens
ccucugcuuuuccaagaauguuaagguauuuuaacccucgcauuagaaaucaucuccuugcccu

SEQ ID NO: 560085 - RNA, 64 nt, Homo Sapiens
cuggggucuucucuaccgaaacuuuucuuugcuucccucgcaaagucaggauggaaauaccugg

SEQ ID NO: 560086 - RNA, 64 nt, Homo Sapiens
agcacugccgcuuccaccugggccacccaccggacccucgcacgccgugccaggccugccccag

SEQ ID NO: 560087 - RNA, 64 nt, Homo Sapiens
ccccaggccaccaacggcaggugaacugccccuccccucgcaucaguucggagagagcugcgau

SEQ ID NO: 560088 - RNA, 64 nt, Homo Sapiens
aggugcaagagacagagcccgauucugggauggacccucgcagcaccaucacugaguggcuugu

SEQ ID NO: 560089 - RNA, 64 nt, Homo Sapiens
uacaaccugaagcgcaggaaagaaaggcccauuccccucgcacagccgagcuuuuacucccuga

SEQ ID NO: 560090 - RNA, 64 nt, Homo Sapiens
cagaagaagacggucaccauccccucaggcagcacccucgcauuccggguggcccagcugguua

SEQ ID NO: 560091 - RNA, 64 nt, Homo Sapiens
cugguggcaggugccuuguccuucacccauaagccccucgcacugucgguuuggucuguuuugc

SEQ ID NO: 560092 - RNA, 64 nt, Homo Sapiens
gggugagagccuagauuccuccugugucaagggucccucgcauucuuuuacuguaaacaaacaa

SEQ ID NO: 560093 - RNA, 64 nt, Homo Sapiens
guugcuuugcucuugagaauaguuucucgugucccccucgcaggccucauucuuugaacaucga

SEQ ID NO: 560094 - RNA, 64 nt, Homo Sapiens
cucgugaaaggccugccccgucuuucugccgcagcccucgcagagggcgggugcacagcgccau

SEQ ID NO: 560095 - RNA, 64 nt, Homo Sapiens
cuggccucagacugcacccaggaggggaacacugcccucgcacggccccgaagggcccccacau

SEQ ID NO: 560096 - RNA, 64 nt, Homo Sapiens
gcccgggcucccggccgcccagggucgccgccgccccucgcaccgcuaggucugcgcaccaucu

SEQ ID NO: 560097 - RNA, 64 nt, Homo Sapiens
aacuccgcauccuugucccucacguggaccgucucccucgcaggcagaaagcacacggucaauc

SEQ ID NO: 560098 - RNA, 64 nt, Homo Sapiens
gcuggcggaggcuccgcaucggggcugcuucccucccucgcaggacagacagaaaaccugccau

SEQ ID NO: 560099 - RNA, 64 nt, Homo Sapiens
caccacaugucucagggcuauuggggguccuucucccucgcagcccagcgcugcuccucaaggg

SEQ ID NO: 560100 - RNA, 64 nt, Homo Sapiens
gccucgcacaaaccacauuguagcccaagccugucccucgcacaccaacucaccucccuucucu

SEQ ID NO: 560101 - RNA, 64 nt, Homo Sapiens
cagcuuucucgcgcccucccccaugggggugagacccucgcagaccuaagcccugccccgggau

SEQ ID NO: 560102 - RNA, 64 nt, Homo Sapiens
uggagcagcaaagggccucaauuccuauaagagacccucgcagcccagaggcgcccagaggaag

SEQ ID NO: 560103 - RNA, 64 nt, Homo Sapiens
gggaacuguaauggccacugaagcacgugagagacccucgcaaaaugaugugaaaggaccaguu

SEQ ID NO: 560104 - RNA, 64 nt, Homo Sapiens
ccugugaggcuuuugcaggucugggagcuggggccccucgcacugugaggcuccaucggccgcc

SEQ ID NO: 560105 - RNA, 64 nt, Homo Sapiens
ucucccuccaguccucuguauccucuuuccucuucccucgcauguuccauccaguuccuuacuc

SEQ ID NO: 560106 - RNA, 64 nt, Homo Sapiens
acugcccccuugaucuuugaaggaguccucaggccccucgcagcauaaggauguuuugcaacuu

SEQ ID NO: 560107 - RNA, 64 nt, Homo Sapiens
uuccagcccuugaagguaguggacccagaucauccccucgcagcacuuguucguaaggcacagg

SEQ ID NO: 560108 - RNA, 64 nt, Homo Sapiens
agggagcucagcgaggcagaccuugcacccgaggcccucgcagcgagauagagaccugccuccc

SEQ ID NO: 560109 - RNA, 64 nt, Homo Sapiens
guguuccguaguuucuucucuuuucuaggcuucucccucgcaggaccuuuuggcccuuucuuuc

SEQ ID NO: 560110 - RNA, 64 nt, Homo Sapiens
uggccuuagccaagcaguuuguuaguuacauauucccucgcaaaccuggagugcagaccacagg

SEQ ID NO: 560111 - RNA, 64 nt, Homo Sapiens
ccugccugucaccugggagguugucaguggggaccccucgcaacuccuuuucucuccugugugc

SEQ ID NO: 560112 - RNA, 64 nt, Homo Sapiens
uaccucaaaaguuuguuuuauuaauuguacucaacccucgcagaacaguaaaacugaagauuau

SEQ ID NO: 560113 - RNA, 64 nt, Homo Sapiens
uguccacgcgugccguggcagccuucacacagaccccucgcaacuauugaagcucgugacaagu

SEQ ID NO: 560114 - RNA, 64 nt, Homo Sapiens
guguggaugugaguugugugaauaaucuuucugucccucgcacagaagccaguaauuagcaucu

SEQ ID NO: 560115 - RNA, 64 nt, Homo Sapiens
gcccuugugucccucccagaguccuucagguaggcccucgcagaugcugcuugcucagaaacaa

SEQ ID NO: 560116 - RNA, 64 nt, Homo Sapiens
gcacugaaaggcccggccgaagucagcuccuucccccucgcaaugacacacugggaaccgucag

SEQ ID NO: 560117 - RNA, 64 nt, Homo Sapiens
gggacuugcucuaguucucugagccgcggacaugcccucgcauugcuucccgcagagugcagag

SEQ ID NO: 560118 - RNA, 64 nt, Homo Sapiens
ugccgccagaaccgggcucugcccccauacgcugcccucgcagccuggcggccuccgcuguggc

SEQ ID NO: 560119 - RNA, 64 nt, Homo Sapiens
cccgcccggccccugcccccuccaacccuucuggcccucgcaccacugugacucugccaucuuc

SEQ ID NO: 560120 - RNA, 64 nt, Homo Sapiens
aaaaaaaaagaagaaacaagacaugccaccuuuccccucgcacuguugcuuuuccugaugguua

SEQ ID NO: 560121 - RNA, 64 nt, Homo Sapiens
cuccauggucacgaagcagcguugugcugugugucccucgcaagaagcacaggaaagagaaguu

SEQ ID NO: 560122 - RNA, 64 nt, Homo Sapiens
cacgcugcccgcaugccacgcucgcaugccugcacccucgcauguugucugcugccaaugucgu

SEQ ID NO: 560123 - RNA, 64 nt, Homo Sapiens
uccugugccaggacucucuuucuuccacuacccucccucgcauccgccucugagccaggagccu

SEQ ID NO: 560124 - RNA, 64 nt, Homo Sapiens
gcgaugcugacacugccaaccuccaguauccucacccucgcagacgauaucucucucggccucu

SEQ ID NO: 560125 - RNA, 64 nt, Homo Sapiens
uccugccgucugccaccccgccacguguauuuaacccucgcacuuucuccacuguggagauggc

SEQ ID NO: 560126 - RNA, 64 nt, Homo Sapiens
gguggcuuaggaucuucggaucggccacccucgccccucgcaccccagcccagggcggcgggga

SEQ ID NO: 560127 - RNA, 64 nt, Homo Sapiens
cagcaacuccccgcccagggaccccucccggccucccucgcacacugggaggaggaagccgccg

SEQ ID NO: 560128 - RNA, 64 nt, Homo Sapiens
ggggggccauagcuggcacugcccaccguaaaggcccucgcacauuuucccccuuccuguacac

SEQ ID NO: 560129 - RNA, 64 nt, Homo Sapiens
gucaaggcagggagaggccggcuggagccaggcccccucgcacgcagcccccaaaucauggacg

SEQ ID NO: 560130 - RNA, 64 nt, Homo Sapiens
cugcccauccccccaccacccuccauccugggggcccucgcacaaaucuggggugggaggggcu

SEQ ID NO: 560131 - RNA, 64 nt, Homo Sapiens
aaaaccaacucuaaaaucacccuauccaugcacccccucgcaaugagcccucuuuccaccuucc

SEQ ID NO: 560132 - RNA, 64 nt, Homo Sapiens
gcuccccaccccacucagcgggagccccugggagcccucgcaccuccaacagaagccacaggcc

SEQ ID NO: 560133 - RNA, 64 nt, Homo Sapiens
uguggacauuucuguuccugguguaaaagaaaaucccucgcagucaauaaacgcucuguggcca

SEQ ID NO: 560134 - RNA, 64 nt, Homo Sapiens
cugccguguaacacccuuccucugaucgcaccgccccucgcagagaguguaucaucuguuuuau

SEQ ID NO: 560135 - RNA, 64 nt, Homo Sapiens
cucccagguucaagugauucuccugccucagccucccucgcaaguagcugggauuacaggcgcc

SEQ ID NO: 560136 - RNA, 64 nt, Homo Sapiens
acacagguaggcccugacgcguuacagcgucagccccucgcaagaguagacaaagagagcgaca

SEQ ID NO: 560137 - RNA, 64 nt, Homo Sapiens
gucccaggcccagaagaggcgcggacaggaccgucccucgcagguacugccagccgggagcugg

SEQ ID NO: 560138 - RNA, 64 nt, Homo Sapiens
gcucgccgcggacacaccguccgucuccgggacgcccucgcaccccuggacaccagaccggacu

SEQ ID NO: 560139 - RNA, 64 nt, Homo Sapiens
cgaguggaccaaucggaagccuaagugacgaugacccucgcauguccuaggucccuggguggac

SEQ ID NO: 560140 - RNA, 64 nt, Homo Sapiens
cacacacacacacacacugcauaucugagcgcgccccucgcacugggucucaccuugcaccuuc

SEQ ID NO: 560141 - RNA, 64 nt, Homo Sapiens
acuguuacagcuuucugugccaauaauuacuguacccucgcaugggugagaaauuugccuuguu

SEQ ID NO: 560142 - RNA, 64 nt, Homo Sapiens
guuggggcgggggcugauacauguagaacggggacccucgcaggcuagcccuccccuccccggg

SEQ ID NO: 560143 - RNA, 64 nt, Homo Sapiens
ccccacccgcugcucaguggcucugaccacacuccccucgcagcgucagugguacgacccuucc

SEQ ID NO: 560144 - RNA, 64 nt, Homo Sapiens
uggaauguuuaaucauauuugcuaagaaauguuucugcuguaguuggauuugcccauauuuaug

SEQ ID NO: 560145 - RNA, 64 nt, Homo Sapiens
caauuuccucaucuugaaaugaggauaauaauaccugcuguaccuaccucacagggcuguugug

SEQ ID NO: 560146 - RNA, 64 nt, Homo Sapiens
ucugcacuccuccgagcccgguggagaaugcaggcugcuguagucucagguaaugaaggcacag

SEQ ID NO: 560147 - RNA, 64 nt, Homo Sapiens
ccugucauagcugcugcugcugccaugcgcagagcugcuguaacagcucuuccuguucugcucc

SEQ ID NO: 560148 - RNA, 64 nt, Homo Sapiens
uuaccagaaaguguucuauaccucuuguuuuuugcugcuguaacacucuugcuuaaaaaggaug

SEQ ID NO: 560149 - RNA, 54 nt, Homo Sapiens; identical to SEQ ID NO: 234085

SEQ ID NO: 560150 - RNA, 64 nt, Homo Sapiens
uuccagugcaagauaauucaguauuagaaggcaucugcuguaacagaagggggacaugccacau

SEQ ID NO: 560151 - RNA, 64 nt, Homo Sapiens
agggggacaugccacauguaaguccguuaucacucugcuguagaggugcuucuagcccugucuc

SEQ ID NO: 560152 - RNA, 64 nt, Homo Sapiens
cucaucccugcacugagcacgacuucgccucuuccugcuguauguuuucuguaaaugaaaugcu

SEQ ID NO: 560153 - RNA, 64 nt, Homo Sapiens
uguuuuauggucuacauaguuuaauggcagagcacugcuguaucugugauaacucauaauuauu

SEQ ID NO: 560154 - RNA, 64 nt, Homo Sapiens
ucugcauuaagcucacaugaauguuuuuguuuuucugcuguaaugacaaaggaaauuaaugaaa

SEQ ID NO: 560155 - RNA, 64 nt, Homo Sapiens
uauccugugcagaacuaggauuuucccaugucuucugcuguaauauuggugauugccaugggac

SEQ ID NO: 560156 - RNA, 64 nt, Homo Sapiens
ugguuuaggcccuguuccagcaauaagaaccaaucugcuguacaaucugaggacuuggcucugu

SEQ ID NO: 560157 - RNA, 64 nt, Homo Sapiens
agucacuugcaguuuugcuuuucucugcauuucucugcuguaagaugacuguugcauuguugaa

SEQ ID NO: 560158 - RNA, 64 nt, Homo Sapiens
gguacaauuuugggaucuaguuccccuggaaaagcugcuguauuuuuaauuuuuaauggaaugu

SEQ ID NO: 560159 - RNA, 64 nt, Homo Sapiens
ccuuaacaucugagagcaguaacacugauuuuaucugcuguaugagacuuugugcauuuuacuu

SEQ ID NO: 560160 - RNA, 64 nt, Homo Sapiens
agugaaagagcaucaggagauggugugaaaaacccugcuguaguugcauugggaccaaugaauc

SEQ ID NO: 560161 - RNA, 64 nt, Homo Sapiens
agcaauaguggagaaaaauguucugcugcuuuugcugcuguaacgcagcccccucugccagccu

SEQ ID NO: 560162 - RNA, 64 nt, Homo Sapiens
uuuuuuuuuuuuuuuuuuuugcauguccaacacucugcuguaucggcuuccuuggaguggcuuu

SEQ ID NO: 560163 - RNA, 64 nt, Homo Sapiens
acgaugccauaucuggcugcucaggguccauucccugcuguagaguugagccccaaaucauugc

SEQ ID NO: 560164 - RNA, 64 nt, Homo Sapiens
uuuuuguuuuuuuuucccccaugcuuuuguuuggcugcuguaauuuuuaaguauuugaguuuga

SEQ ID NO: 560165 - RNA, 64 nt, Homo Sapiens
uagagcaguccaacccagaauggcacacacugcucugcuguagcaucaugucagggcuuccugg

SEQ ID NO: 560166 - RNA, 64 nt, Homo Sapiens
ugucuuuuagaguaggaaucugggugaaugcuuucugcuguaaguauuuccuucauaaugguca

SEQ ID NO: 560167 - RNA, 64 nt, Homo Sapiens
uguucuggguagauggaguaggugccuauuuuuucugcuguaauauucuugggaagacuuugga

SEQ ID NO: 560168 - RNA, 64 nt, Homo Sapiens
agguaauaaacuggaauucuguugaugaauauagcugcuguacuguauauuaauauuuaauaga

SEQ ID NO: 560169 - RNA, 64 nt, Homo Sapiens
ggguguagguagugucagugaguggcucuugugccugcuguagacauuaggccugcacuagggc

SEQ ID NO: 560170 - RNA, 64 nt, Homo Sapiens
uguaaaagaccaagcaaaugcacucugcuuuuugcugcuguaagaccaccaaaaaugagucaga

SEQ ID NO: 560171 - RNA, 64 nt, Homo Sapiens
gcgaggccagaacuaguuuaucugaacaccucagcugcuguaagcuucuccucucucaccccgu

SEQ ID NO: 560172 - RNA, 64 nt, Homo Sapiens
ggcagcaccaggugaguguguauucaccaucccccugcuguaccacccacaggagugauugguc

SEQ ID NO: 560173 - RNA, 64 nt, Homo Sapiens
ggaaggacacgaggacgucacaaaaguggcggaccugcuguacucugcauuggcccacagaagg

SEQ ID NO: 560174 - RNA, 64 nt, Homo Sapiens
gaacagucuccuucaacaguucggccaagcagaacugcuguaccucugaccacuuguguuagga

SEQ ID NO: 560175 - RNA, 64 nt, Homo Sapiens
auggcagucugauggacugcggguuuggauaccacugcuguaauguaacccucuuuguuuagau

SEQ ID NO: 560176 - RNA, 64 nt, Homo Sapiens
gaaugacucaugccucugagcuucuaaacugaagcugcuguaacuaaaggaaucugaaaagaac

SEQ ID NO: 560177 - RNA, 64 nt, Homo Sapiens
uuuucuuuaaaucaguauuccaucaggcagauaacugcuguauucaugaaucuugagaguguuc

SEQ ID NO: 560178 - RNA, 64 nt, Homo Sapiens; identical to SEQ ID NO: 463476

SEQ ID NO: 560179 - RNA, 64 nt, Homo Sapiens; identical to SEQ ID NO: 463477

SEQ ID NO: 560180 - RNA, 64 nt, Homo Sapiens; identical to SEQ ID NO: 463478

SEQ ID NO: 560181 - RNA, 64 nt, Homo Sapiens; identical to SEQ ID NO: 463479

SEQ ID NO: 560182 - RNA, 64 nt, Homo Sapiens; identical to SEQ ID NO: 463480

SEQ ID NO: 560183 - RNA, 64 nt, Homo Sapiens; identical to SEQ ID NO: 463481

SEQ ID NO: 560184 - RNA, 64 nt, Homo Sapiens; identical to SEQ ID NO: 463482

SEQ ID NO: 560185 - RNA, 64 nt, Homo Sapiens; identical to SEQ ID NO: 463483

SEQ ID NO: 560186 - RNA, 64 nt, Homo Sapiens; identical to SEQ ID NO: 463484

SEQ ID NO: 560187 - RNA, 64 nt, Homo Sapiens; identical to SEQ ID NO: 463485

SEQ ID NO: 560188 - RNA, 64 nt, Homo Sapiens; identical to SEQ ID NO: 463486

SEQ ID NO: 560189 - RNA, 64 nt, Homo Sapiens; identical to SEQ ID NO: 463487

SEQ ID NO: 560190 - RNA, 64 nt, Homo Sapiens; identical to SEQ ID NO: 463488

SEQ ID NO: 560191 - RNA, 64 nt, Homo Sapiens; identical to SEQ ID NO: 463489

SEQ ID NO: 560192 - RNA, 64 nt, Homo Sapiens; identical to SEQ ID NO: 463490

SEQ ID NO: 560193 - RNA, 64 nt, Homo Sapiens; identical to SEQ ID NO: 463491

SEQ ID NO: 560194 - RNA, 64 nt, Homo Sapiens; identical to SEQ ID NO: 463492

SEQ ID NO: 560195 - RNA, 64 nt, Homo Sapiens; identical to SEQ ID NO: 463493

SEQ ID NO: 560196 - RNA, 64 nt, Homo Sapiens; identical to SEQ ID NO: 463494

SEQ ID NO: 560197 - RNA, 64 nt, Homo Sapiens; identical to SEQ ID NO: 463495

SEQ ID NO: 560198 - RNA, 64 nt, Homo Sapiens; identical to SEQ ID NO: 463496

SEQ ID NO: 560199 - RNA, 64 nt, Homo Sapiens; identical to SEQ ID NO: 463497

SEQ ID NO: 560200 - RNA, 64 nt, Homo Sapiens; identical to SEQ ID NO: 463498

SEQ ID NO: 560201 - RNA, 64 nt, Homo Sapiens; identical to SEQ ID NO: 463499

SEQ ID NO: 560202 - RNA, 64 nt, Homo Sapiens; identical to SEQ ID NO: 463500

SEQ ID NO: 560203 - RNA, 64 nt, Homo Sapiens; identical to SEQ ID NO: 463501

SEQ ID NO: 560204 - RNA, 64 nt, Homo Sapiens; identical to SEQ ID NO: 463502

SEQ ID NO: 560205 - RNA, 64 nt, Homo Sapiens; identical to SEQ ID NO: 463503

SEQ ID NO: 560206 - RNA, 64 nt, Homo Sapiens; identical to SEQ ID NO: 463504

SEQ ID NO: 560207 - RNA, 64 nt, Homo Sapiens; identical to SEQ ID NO: 463505

SEQ ID NO: 560208 - RNA, 64 nt, Homo Sapiens; identical to SEQ ID NO: 463506

SEQ ID NO: 560209 - RNA, 64 nt, Homo Sapiens; identical to SEQ ID NO: 463507

SEQ ID NO: 560210 - RNA, 64 nt, Homo Sapiens; identical to SEQ ID NO: 463508

SEQ ID NO: 560211 - RNA, 64 nt, Homo Sapiens; identical to SEQ ID NO: 463509

SEQ ID NO: 560212 - RNA, 64 nt, Homo Sapiens; identical to SEQ ID NO: 463510

SEQ ID NO: 560213 - RNA, 64 nt, Homo Sapiens; identical to SEQ ID NO: 463511

SEQ ID NO: 560214 - RNA, 56 nt, Homo Sapiens; identical to SEQ ID NO: 463512

SEQ ID NO: 560215 - RNA, 64 nt, Homo Sapiens; identical to SEQ ID NO: 463513

SEQ ID NO: 560216 - RNA, 64 nt, Homo Sapiens; identical to SEQ ID NO: 463514

SEQ ID NO: 560217 - RNA, 64 nt, Homo Sapiens; identical to SEQ ID NO: 463515

SEQ ID NO: 560218 - RNA, 64 nt, Homo Sapiens; identical to SEQ ID NO: 463516

SEQ ID NO: 560219 - RNA, 64 nt, Homo Sapiens; identical to SEQ ID NO: 463517

SEQ ID NO: 560220 - RNA, 64 nt, Homo Sapiens; identical to SEQ ID NO: 463518

SEQ ID NO: 560221 - RNA, 64 nt, Homo Sapiens; identical to SEQ ID NO: 463519

SEQ ID NO: 560222 - RNA, 64 nt, Homo Sapiens; identical to SEQ ID NO: 463520

SEQ ID NO: 560223 - RNA, 64 nt, Homo Sapiens; identical to SEQ ID NO: 463521

SEQ ID NO: 560224 - RNA, 64 nt, Homo Sapiens; identical to SEQ ID NO: 463522

SEQ ID NO: 560225 - RNA, 64 nt, Homo Sapiens; identical to SEQ ID NO: 463523

SEQ ID NO: 560226 - RNA, 64 nt, Homo Sapiens; identical to SEQ ID NO: 463524

SEQ ID NO: 560227 - RNA, 64 nt, Homo Sapiens; identical to SEQ ID NO: 463525

SEQ ID NO: 560228 - RNA, 64 nt, Homo Sapiens; identical to SEQ ID NO: 463526

SEQ ID NO: 560229 - RNA, 64 nt, Homo Sapiens; identical to SEQ ID NO: 463527

SEQ ID NO: 560230 - RNA, 64 nt, Homo Sapiens; identical to SEQ ID NO: 463528

SEQ ID NO: 560231 - RNA, 64 nt, Homo Sapiens; identical to SEQ ID NO: 463529

SEQ ID NO: 560232 - RNA, 64 nt, Homo Sapiens; identical to SEQ ID NO: 463530

SEQ ID NO: 560233 - RNA, 64 nt, Homo Sapiens; identical to SEQ ID NO: 463531

SEQ ID NO: 560234 - RNA, 64 nt, Homo Sapiens; identical to SEQ ID NO: 463532

SEQ ID NO: 560235 - RNA, 64 nt, Homo Sapiens; identical to SEQ ID NO: 463533

SEQ ID NO: 560236 - RNA, 64 nt, Homo Sapiens; identical to SEQ ID NO: 463534

SEQ ID NO: 560237 - RNA, 64 nt, Homo Sapiens; identical to SEQ ID NO: 463535

SEQ ID NO: 560238 - RNA, 64 nt, Homo Sapiens; identical to SEQ ID NO: 463536

SEQ ID NO: 560239 - RNA, 64 nt, Homo Sapiens; identical to SEQ ID NO: 463537

SEQ ID NO: 560240 - RNA, 64 nt, Homo Sapiens; identical to SEQ ID NO: 463538

SEQ ID NO: 560241 - RNA, 64 nt, Homo Sapiens; identical to SEQ ID NO: 463539

SEQ ID NO: 560242 - RNA, 64 nt, Homo Sapiens; identical to SEQ ID NO: 463540

SEQ ID NO: 560243 - RNA, 64 nt, Homo Sapiens; identical to SEQ ID NO: 463541

SEQ ID NO: 560244 - RNA, 64 nt, Homo Sapiens; identical to SEQ ID NO: 463542

SEQ ID NO: 560245 - RNA, 64 nt, Homo Sapiens; identical to SEQ ID NO: 463543

SEQ ID NO: 560246 - RNA, 64 nt, Homo Sapiens; identical to SEQ ID NO: 463544

SEQ ID NO: 560247 - RNA, 64 nt, Homo Sapiens; identical to SEQ ID NO: 463545

SEQ ID NO: 560248 - RNA, 64 nt, Homo Sapiens; identical to SEQ ID NO: 463546

SEQ ID NO: 560249 - RNA, 64 nt, Homo Sapiens; identical to SEQ ID NO: 463547

SEQ ID NO: 560250 - RNA, 64 nt, Homo Sapiens; identical to SEQ ID NO: 463548

SEQ ID NO: 560251 - RNA, 64 nt, Homo Sapiens; identical to SEQ ID NO: 463549

SEQ ID NO: 560252 - RNA, 64 nt, Homo Sapiens; identical to SEQ ID NO: 463550

SEQ ID NO: 560253 - RNA, 64 nt, Homo Sapiens; identical to SEQ ID NO: 463551

SEQ ID NO: 560254 - RNA, 64 nt, Homo Sapiens; identical to SEQ ID NO: 463552

SEQ ID NO: 560255 - RNA, 64 nt, Homo Sapiens; identical to SEQ ID NO: 463553

SEQ ID NO: 560256 - RNA, 64 nt, Homo Sapiens; identical to SEQ ID NO: 463554

SEQ ID NO: 560257 - RNA, 64 nt, Homo Sapiens; identical to SEQ ID NO: 463555

SEQ ID NO: 560258 - RNA, 64 nt, Homo Sapiens; identical to SEQ ID NO: 463556

SEQ ID NO: 560259 - RNA, 64 nt, Homo Sapiens; identical to SEQ ID NO: 463557

SEQ ID NO: 560260 - RNA, 64 nt, Homo Sapiens; identical to SEQ ID NO: 463558

SEQ ID NO: 560261 - RNA, 64 nt, Homo Sapiens; identical to SEQ ID NO: 463559

SEQ ID NO: 560262 - RNA, 64 nt, Homo Sapiens; identical to SEQ ID NO: 463560

SEQ ID NO: 560263 - RNA, 64 nt, Homo Sapiens; identical to SEQ ID NO: 463561

SEQ ID NO: 560264 - RNA, 64 nt, Homo Sapiens; identical to SEQ ID NO: 463562

SEQ ID NO: 560265 - RNA, 64 nt, Homo Sapiens; identical to SEQ ID NO: 463563

SEQ ID NO: 560266 - RNA, 64 nt, Homo Sapiens; identical to SEQ ID NO: 463564

SEQ ID NO: 560267 - RNA, 64 nt, Homo Sapiens; identical to SEQ ID NO: 463565

SEQ ID NO: 560268 - RNA, 64 nt, Homo Sapiens; identical to SEQ ID NO: 463566

SEQ ID NO: 560269 - RNA, 64 nt, Homo Sapiens; identical to SEQ ID NO: 463567

SEQ ID NO: 560270 - RNA, 64 nt, Homo Sapiens; identical to SEQ ID NO: 463568

SEQ ID NO: 560271 - RNA, 64 nt, Homo Sapiens; identical to SEQ ID NO: 463569

SEQ ID NO: 560272 - RNA, 64 nt, Homo Sapiens; identical to SEQ ID NO: 463570

SEQ ID NO: 560273 - RNA, 64 nt, Homo Sapiens; identical to SEQ ID NO: 463571

SEQ ID NO: 560274 - RNA, 64 nt, Homo Sapiens; identical to SEQ ID NO: 463572

SEQ ID NO: 560275 - RNA, 64 nt, Homo Sapiens; identical to SEQ ID NO: 463573

SEQ ID NO: 560276 - RNA, 64 nt, Homo Sapiens; identical to SEQ ID NO: 463574

SEQ ID NO: 560277 - RNA, 64 nt, Homo Sapiens; identical to SEQ ID NO: 463575

SEQ ID NO: 560278 - RNA, 64 nt, Homo Sapiens; identical to SEQ ID NO: 463576

SEQ ID NO: 560279 - RNA, 64 nt, Homo Sapiens; identical to SEQ ID NO: 463577

SEQ ID NO: 560280 - RNA, 64 nt, Homo Sapiens; identical to SEQ ID NO: 463578

SEQ ID NO: 560281 - RNA, 64 nt, Homo Sapiens; identical to SEQ ID NO: 463579

SEQ ID NO: 560282 - RNA, 64 nt, Homo Sapiens; identical to SEQ ID NO: 463580

SEQ ID NO: 560283 - RNA, 64 nt, Homo Sapiens; identical to SEQ ID NO: 463581

SEQ ID NO: 560284 - RNA, 64 nt, Homo Sapiens; identical to SEQ ID NO: 463582

SEQ ID NO: 560285 - RNA, 64 nt, Homo Sapiens; identical to SEQ ID NO: 463583

SEQ ID NO: 560286 - RNA, 64 nt, Homo Sapiens; identical to SEQ ID NO: 463584

SEQ ID NO: 560287 - RNA, 64 nt, Homo Sapiens; identical to SEQ ID NO: 463585

SEQ ID NO: 560288 - RNA, 64 nt, Homo Sapiens; identical to SEQ ID NO: 463586

SEQ ID NO: 560289 - RNA, 64 nt, Homo Sapiens; identical to SEQ ID NO: 463587

SEQ ID NO: 560290 - RNA, 64 nt, Homo Sapiens; identical to SEQ ID NO: 463588

SEQ ID NO: 560291 - RNA, 64 nt, Homo Sapiens; identical to SEQ ID NO: 463589

SEQ ID NO: 560292 - RNA, 64 nt, Homo Sapiens; identical to SEQ ID NO: 463590

SEQ ID NO: 560293 - RNA, 64 nt, Homo Sapiens; identical to SEQ ID NO: 463591

SEQ ID NO: 560294 - RNA, 64 nt, Homo Sapiens; identical to SEQ ID NO: 463592

SEQ ID NO: 560295 - RNA, 64 nt, Homo Sapiens; identical to SEQ ID NO: 463593

SEQ ID NO: 560296 - RNA, 54 nt, Homo Sapiens; identical to SEQ ID NO: 463594

SEQ ID NO: 560297 - RNA, 64 nt, Homo Sapiens; identical to SEQ ID NO: 463595

SEQ ID NO: 560298 - RNA, 64 nt, Homo Sapiens; identical to SEQ ID NO: 463596

SEQ ID NO: 560299 - RNA, 64 nt, Homo Sapiens; identical to SEQ ID NO: 463597

SEQ ID NO: 560300 - RNA, 64 nt, Homo Sapiens; identical to SEQ ID NO: 463598

SEQ ID NO: 560301 - RNA, 64 nt, Homo Sapiens; identical to SEQ ID NO: 463599

SEQ ID NO: 560302 - RNA, 64 nt, Homo Sapiens; identical to SEQ ID NO: 463600

SEQ ID NO: 560303 - RNA, 64 nt, Homo Sapiens; identical to SEQ ID NO: 463601

SEQ ID NO: 560304 - RNA, 64 nt, Homo Sapiens; identical to SEQ ID NO: 463602

SEQ ID NO: 560305 - RNA, 64 nt, Homo Sapiens; identical to SEQ ID NO: 463603

SEQ ID NO: 560306 - RNA, 64 nt, Homo Sapiens; identical to SEQ ID NO: 463604

SEQ ID NO: 560307 - RNA, 64 nt, Homo Sapiens; identical to SEQ ID NO: 463605

SEQ ID NO: 560308 - RNA, 64 nt, Homo Sapiens; identical to SEQ ID NO: 463606

SEQ ID NO: 560309 - RNA, 64 nt, Homo Sapiens; identical to SEQ ID NO: 463607

SEQ ID NO: 560310 - RNA, 64 nt, Homo Sapiens; identical to SEQ ID NO: 463608

SEQ ID NO: 560311 - RNA, 64 nt, Homo Sapiens; identical to SEQ ID NO: 463609

SEQ ID NO: 560312 - RNA, 64 nt, Homo Sapiens; identical to SEQ ID NO: 463610

SEQ ID NO: 560313 - RNA, 64 nt, Homo Sapiens
ucaucaucuccagaacucccagcggggcucccugagcucucaaggagaugcugccaucacuggg

SEQ ID NO: 560314 - RNA, 64 nt, Homo Sapiens
gcaggagaugggcaaagaaaacuggggugcacucagcucucacagggguaaucaucucaagugg

SEQ ID NO: 560315 - RNA, 64 nt, Homo Sapiens
gaaaugcuggguaucccuguaauccucuugcaccagcucucagagaaaugagcccuucaggauu

SEQ ID NO: 560316 - RNA, 64 nt, Homo Sapiens
ggcucagacuaaaucagaggagaaaugggccgugagcucucacagagccuagggcaagaaggcc

SEQ ID NO: 560317 - RNA, 64 nt, Homo Sapiens
agugcagccuccauaaccaugacauucccgcccaagcucucagugccuaauccugcuuugucau

SEQ ID NO: 560318 - RNA, 64 nt, Homo Sapiens
gacuuugaaugaaugcaagguuagugagauccuaagcucucaaaauagcauauucccuagagcu

SEQ ID NO: 560319 - RNA, 64 nt, Homo Sapiens
cuuaggaaggaagcacguggaaggucuucaguugagcucucagcccaucugucauuuauugggg

SEQ ID NO: 560320 - RNA, 64 nt, Homo Sapiens
uacuccugaaacgggcagagccgccaccuauucaagcucucagcggggugguggugggagcuua

SEQ ID NO: 560321 - RNA, 64 nt, Homo Sapiens
ccccucucuggcagcagagcgcucucagucccacagcucucagggcacugaagugcugccgcca

SEQ ID NO: 560322 - RNA, 62 nt, Homo Sapiens
cccacagcucucaggccccuagugcugccgccagcucucaguggaagagcuacaagcacuga

SEQ ID NO: 560323 - RNA, 64 nt, Homo Sapiens
acagcuguuugucgugggcuuacuccucccagggagcucucagguaauggggaucggauguugg

SEQ ID NO: 560324 - RNA, 64 nt, Homo Sapiens
cagcucuuuuaauugacacaguccagaccccaugagcucucagccacuucccugggaaaccuaa

SEQ ID NO: 560325 - RNA, 64 nt, Homo Sapiens
ccaagucagugaauugucaagaucugcuauugccagcucucaacggaagaaccuaaauugcaaa

SEQ ID NO: 560326 - RNA, 64 nt, Homo Sapiens
gugcaguucaggaauuaagagaacaccauuucagagcucucaguagcugcaagaauguugcagu

SEQ ID NO: 560327 - RNA, 64 nt, Homo Sapiens
aggguuaccaaagaaggcguaaaguccuacuuugagcucucaucuggccuuaggauaucugcuu

SEQ ID NO: 560328 - RNA, 64 nt, Homo Sapiens
aacaacuucuugguaaaagcguugaacugaaugcagcucucacugaaaggaaccgagaaagaaa

SEQ ID NO: 560329 - RNA, 64 nt, Homo Sapiens
gugacaguuggaaggccucugcuggagagacaccagcucucagggcagagauuggcuuggggcc

SEQ ID NO: 560330 - RNA, 64 nt, Homo Sapiens
uuuuggugaagcaggagaugcaccccacagcucuagcucucaaauggcuucacaguccuuacuu

SEQ ID NO: 560331 - RNA, 64 nt, Homo Sapiens
gaguuuuuaauagaagcuuccuccaucaauuggcagaaccuaaagaagauuuuaaggggcaaaa

SEQ ID NO: 560332 - RNA, 64 nt, Homo Sapiens
cucacgcaaucucaguagaguacaacguagauacagaaccuaggagagucaacaucuggaggau

SEQ ID NO: 560333 - RNA, 64 nt, Homo Sapiens
aguauuauucaaaccaauuugugcuggguuauucagaaccuaaaccacccucuguuuaaaauuu

SEQ ID NO: 560334 - RNA, 64 nt, Homo Sapiens
guuccuuucagaugaccuuuuuaggagaauucacagaaccuacuccuuaacaucccuccugcuu

SEQ ID NO: 560335 - RNA, 64 nt, Homo Sapiens
cuagaaccaagaagggcuagaaccuggaggggcuagaaccuagagaagcuaaaaccugagcuag

SEQ ID NO: 560336 - RNA, 64 nt, Homo Sapiens
agcuagaaccuggagggcuagaaccuggagagcuagaaccuagaagggcuagaaccuggagggc

SEQ ID NO: 560337 - RNA, 64 nt, Homo Sapiens
agcuagaaccuggagggcuagaaccuggagggcuagaaccuagaagggcuagaaccuggagggc

SEQ ID NO: 560338 - RNA, 64 nt, Homo Sapiens; identical to SEQ ID NO: 560337

SEQ ID NO: 560339 - RNA, 64 nt, Homo Sapiens
ggcuagaaccuggagggcuagaaccuggcagguuagaaccuagaagggcuagaaccuggagagc

SEQ ID NO: 560340 - RNA, 64 nt, Homo Sapiens; identical to SEQ ID NO: 326592

SEQ ID NO: 560341 - RNA, 64 nt, Homo Sapiens; identical to SEQ ID NO: 326593

SEQ ID NO: 560342 - RNA, 64 nt, Homo Sapiens; identical to SEQ ID NO: 326594

SEQ ID NO: 560343 - RNA, 64 nt, Homo Sapiens; identical to SEQ ID NO: 326595

SEQ ID NO: 560344 - RNA, 64 nt, Homo Sapiens; identical to SEQ ID NO: 326596

SEQ ID NO: 560345 - RNA, 64 nt, Homo Sapiens; identical to SEQ ID NO: 326597

SEQ ID NO: 560346 - RNA, 64 nt, Homo Sapiens; identical to SEQ ID NO: 326598

SEQ ID NO: 560347 - RNA, 64 nt, Homo Sapiens; identical to SEQ ID NO: 326599

SEQ ID NO: 560348 - RNA, 64 nt, Homo Sapiens; identical to SEQ ID NO: 326600

SEQ ID NO: 560349 - RNA, 64 nt, Homo Sapiens; identical to SEQ ID NO: 326601

SEQ ID NO: 560350 - RNA, 64 nt, Homo Sapiens; identical to SEQ ID NO: 326602

SEQ ID NO: 560351 - RNA, 64 nt, Homo Sapiens; identical to SEQ ID NO: 326603

SEQ ID NO: 560352 - RNA, 64 nt, Homo Sapiens; identical to SEQ ID NO: 326604

SEQ ID NO: 560353 - RNA, 64 nt, Homo Sapiens; identical to SEQ ID NO: 326605

SEQ ID NO: 560354 - RNA, 64 nt, Homo Sapiens; identical to SEQ ID NO: 326606

SEQ ID NO: 560355 - RNA, 64 nt, Homo Sapiens; identical to SEQ ID NO: 326607

SEQ ID NO: 560356 - RNA, 64 nt, Homo Sapiens; identical to SEQ ID NO: 326608

SEQ ID NO: 560357 - RNA, 64 nt, Homo Sapiens; identical to SEQ ID NO: 326609

SEQ ID NO: 560358 - RNA, 64 nt, Homo Sapiens; identical to SEQ ID NO: 326610

SEQ ID NO: 560359 - RNA, 64 nt, Homo Sapiens; identical to SEQ ID NO: 326611

SEQ ID NO: 560360 - RNA, 64 nt, Homo Sapiens; identical to SEQ ID NO: 326612

SEQ ID NO: 560361 - RNA, 64 nt, Homo Sapiens; identical to SEQ ID NO: 326613

SEQ ID NO: 560362 - RNA, 64 nt, Homo Sapiens; identical to SEQ ID NO: 326614

SEQ ID NO: 560363 - RNA, 64 nt, Homo Sapiens; identical to SEQ ID NO: 326615

SEQ ID NO: 560364 - RNA, 64 nt, Homo Sapiens; identical to SEQ ID NO: 326616

SEQ ID NO: 560365 - RNA, 64 nt, Homo Sapiens; identical to SEQ ID NO: 326617

SEQ ID NO: 560366 - RNA, 64 nt, Homo Sapiens; identical to SEQ ID NO: 326618

SEQ ID NO: 560367 - RNA, 64 nt, Homo Sapiens; identical to SEQ ID NO: 326619

SEQ ID NO: 560368 - RNA, 64 nt, Homo Sapiens; identical to SEQ ID NO: 326620

SEQ ID NO: 560369 - RNA, 64 nt, Homo Sapiens; identical to SEQ ID NO: 326621

SEQ ID NO: 560370 - RNA, 64 nt, Homo Sapiens; identical to SEQ ID NO: 326622

SEQ ID NO: 560371 - RNA, 64 nt, Homo Sapiens; identical to SEQ ID NO: 326623

SEQ ID NO: 560372 - RNA, 64 nt, Homo Sapiens; identical to SEQ ID NO: 326624

SEQ ID NO: 560373 - RNA, 64 nt, Homo Sapiens; identical to SEQ ID NO: 326625

SEQ ID NO: 560374 - RNA, 64 nt, Homo Sapiens; identical to SEQ ID NO: 326626

SEQ ID NO: 560375 - RNA, 64 nt, Homo Sapiens; identical to SEQ ID NO: 326627

SEQ ID NO: 560376 - RNA, 59 nt, Homo Sapiens
gggaaaauaagcaaauguuuaacaacuuucuuuugcacugauaaagguaaguugacuug

SEQ ID NO: 560377 - RNA, 59 nt, Homo Sapiens
agaaacuucagcaagcuagaauuuuuguacuuuugcagaguuuaguucuuaguggguua

SEQ ID NO: 560378 - RNA, 59 nt, Homo Sapiens
aagauuggugugaaauacuaagcacagcacuuuugcaguaacuugaauugauuguaugu

SEQ ID NO: 560379 - RNA, 59 nt, Homo Sapiens
ugauugcagaugagagcuuugaugcucugcuuuugcauuguuucagagccucugaguag

SEQ ID NO: 560380 - RNA, 59 nt, Homo Sapiens
uaauauaaauguauagacauuauguggaucuuuugcauaaacauacacaaaugguaaau

SEQ ID NO: 560381 - RNA, 59 nt, Homo Sapiens
uguuacaguugcugcggccuuuuuaauuacuuuugcagcuuaguaauacccaaguaaua

SEQ ID NO: 560382 - RNA, 59 nt, Homo Sapiens
ucucucuauucaccaacuucucuacacagcuuuugcauacuuacaguuucuguuccuuu

SEQ ID NO: 560383 - RNA, 59 nt, Homo Sapiens
ggugccugcagaaguuggggagaaggauacuuuugcacagccuccaugaugucuuuauu

SEQ ID NO: 560384 - RNA, 59 nt, Homo Sapiens
cugacacagucaauucugauuuucuuuuucuuuugcaagucuaaauguuagaaaacuuu

SEQ ID NO: 560385 - RNA, 59 nt, Homo Sapiens
ucucugaucucccccuuccuaagacuucucuuuugcacaucuagugaggugaaaauuug

SEQ ID NO: 560386 - RNA, 59 nt, Homo Sapiens
uuuaauucaacaugaguaucacaccuuuacuuuugcacuuaauuugaagcuauuuacaa

SEQ ID NO: 560387 - RNA, 59 nt, Homo Sapiens
cuuccaacagggauguauccuguaugugucuuuugcaagaaaucaaauauguaccacag

SEQ ID NO: 560388 - RNA, 59 nt, Homo Sapiens
uguaguuuuauguacuguuaugccauuuucuuuugcaauuuucccgggacauuuuuuuc

SEQ ID NO: 560389 - RNA, 59 nt, Homo Sapiens
uuuaguuuuauguacuguuauuucauuuucuuuugcaaugaacuuugacuauuuaaaag

SEQ ID NO: 560390 - RNA, 59 nt, Homo Sapiens
gucaaugguguugagccgcugucauaacgcuuuugcagggugaagaacgugcuucuuag

SEQ ID NO: 560391 - RNA, 59 nt, Homo Sapiens
aaguauuuguuacauaaucauuuuuucaucuuuugcaaacaaaugauuuuacaguuuua

SEQ ID NO: 560392 - RNA, 59 nt, Homo Sapiens
uaauggaguagggaagaagauacuuccugcuuuugcaaaaguaauagaguuaaauuuga

SEQ ID NO: 560393 - RNA, 59 nt, Homo Sapiens
uuaaacccauuguagcuuaccuuacuuaacuuuugcaaaaagccuuguuuaaaacauuu

SEQ ID NO: 560394 - RNA, 59 nt, Homo Sapiens
uuugcauccccagcauuuccucccccugccuuuugcacgcagucucagccugggcagcu

SEQ ID NO: 560395 - RNA, 59 nt, Homo Sapiens
aaugacuuuucuuugaaucaguauuuuuccuuuugcacgcauuaugaaauguuaaacaa

SEQ ID NO: 560396 - RNA, 59 nt, Homo Sapiens
ugauuauaaauugauagcugguaguguuucuuuugcaagaaugcauuucuaaggcaaaa

SEQ ID NO: 560397 - RNA, 59 nt, Homo Sapiens
cucuuuuacauuuuuuuacuucgccuuugcuuuugcacuuucccaauauccacaaagcu

SEQ ID NO: 560398 - RNA, 59 nt, Homo Sapiens
acgugcaauuugcauccaccgcaggagaucuuuugcacgugcauucucuaccaaaucaa

SEQ ID NO: 560399 - RNA, 59 nt, Homo Sapiens
gaugaccggcauagggcaugcggggguggcuuuugcaaauuugguuucuugucugucca

SEQ ID NO: 560400 - RNA, 59 nt, Homo Sapiens
uucacauaugauguacuuuugcugcauugcuuuugcauguaaaaucuccguucuuuccg

SEQ ID NO: 560401 - RNA, 59 nt, Homo Sapiens
cgggaaaggaaacgccccgggcaaagggucuuuugcagcuuuugcagacgggcaagaag

SEQ ID NO: 560402 - RNA, 59 nt, Homo Sapiens
aaacgccccgggcaaagggucuuuugcagcuuuugcagacgggcaagaagcugcuucug

SEQ ID NO: 560403 - RNA, 59 nt, Homo Sapiens
augagaucacugaacuuuucaaaauaaagcuuuugcauagaauaaugaagaucuuuguu

SEQ ID NO: 560404 - RNA, 59 nt, Homo Sapiens
acugauggcaauauuaagacagacgccugcuuuugcaaauaacuuacaagacuguaaau

SEQ ID NO: 560405 - RNA, 59 nt, Homo Sapiens
gguuuuauuuguaaaagcuggagcuauugcuuuugcagcauuaucaguuuuauuuguaa

SEQ ID NO: 560406 - RNA, 59 nt, Homo Sapiens
uacgggggcaucugaguccauggauguugcuuuugcaccuuucagggaggagugagaug

SEQ ID NO: 560407 - RNA, 59 nt, Homo Sapiens
uggaguuggaagugcuauuuuccuauggacuuuugcauuauuucauugugcaugcaucc

SEQ ID NO: 560408 - RNA, 59 nt, Homo Sapiens
ccacacacaugguaaauuaaguauaaauucuuuugcaaaauuauaguucaugucauuga

SEQ ID NO: 560409 - RNA, 59 nt, Homo Sapiens
ggcucgcacugcuguggccauagaugccgcuuuugcagugcagggugaggaugggggag

SEQ ID NO: 560410 - RNA, 59 nt, Homo Sapiens
gagguuucuagacagcagaagucacagaccuuuugcaaauuggguacgaagugugcaaa

SEQ ID NO: 560411 - RNA, 59 nt, Homo Sapiens
uuugauagaaaggaacacguuuuuacauacuuuugcaaaauaaguaaauaauaaauaaa

SEQ ID NO: 560412 - RNA, 59 nt, Homo Sapiens
gcuuuguaggugagaugcaacaagcccugcuuuugcauaaugcaaucaaaaauaugugu

SEQ ID NO: 560413 - RNA, 59 nt, Homo Sapiens
gguuguucuucaagcaaguucugcuugcacuuuugcauuugccuaacagacuuuugcag

SEQ ID NO: 560414 - RNA, 59 nt, Homo Sapiens
ugcuugcacuuuugcauuugccuaacagacuuuugcagaggcgauggcagagagcagcu

SEQ ID NO: 560415 - RNA, 59 nt, Homo Sapiens
guaauuguagcuguauaaucguuauuuuucuuuugcaucuuaagucuuagaaauuaaga

SEQ ID NO: 560416 - RNA, 59 nt, Homo Sapiens
guuuuuuucccccuaauuacccaaaagaucuuuugcaaacuauguuacaugaaugcuuc

SEQ ID NO: 560417 - RNA, 59 nt, Homo Sapiens
uugggauguguuuugggggcuuguuauuccuuuugcagaaccaaaugauauuugaguuu

SEQ ID NO: 560418 - RNA, 59 nt, Homo Sapiens
auguggaggcguccucaggacagaaagaccuuuugcaggguaaggcaaacagcgacugc

SEQ ID NO: 560419 - RNA, 59 nt, Homo Sapiens
gucuaggucuguuguugucuucucuugcucuuuugcaucuaauaauuuuuggcugaaug

SEQ ID NO: 560420 - RNA, 59 nt, Homo Sapiens
agaagugccugcacaaugaggcuugcccacuuuugcagcucuuuggaauccugaaccca

SEQ ID NO: 560421 - RNA, 64 nt, Homo Sapiens; identical to SEQ ID NO: 193776

SEQ ID NO: 560422 - RNA, 64 nt, Homo Sapiens; identical to SEQ ID NO: 193777

SEQ ID NO: 560423 - RNA, 64 nt, Homo Sapiens; identical to SEQ ID NO: 193778

SEQ ID NO: 560424 - RNA, 64 nt, Homo Sapiens; identical to SEQ ID NO: 193779

SEQ ID NO: 560425 - RNA, 64 nt, Homo Sapiens; identical to SEQ ID NO: 193780

SEQ ID NO: 560426 - RNA, 64 nt, Homo Sapiens; identical to SEQ ID NO: 193781

SEQ ID NO: 560427 - RNA, 64 nt, Homo Sapiens; identical to SEQ ID NO: 193782

SEQ ID NO: 560428 - RNA, 64 nt, Homo Sapiens; identical to SEQ ID NO: 193783

SEQ ID NO: 560429 - RNA, 64 nt, Homo Sapiens; identical to SEQ ID NO: 193784

SEQ ID NO: 560430 - RNA, 64 nt, Homo Sapiens; identical to SEQ ID NO: 193785

SEQ ID NO: 560431 - RNA, 64 nt, Homo Sapiens; identical to SEQ ID NO: 193786

SEQ ID NO: 560432 - RNA, 64 nt, Homo Sapiens; identical to SEQ ID NO: 193787

SEQ ID NO: 560433 - RNA, 64 nt, Homo Sapiens; identical to SEQ ID NO: 193788

SEQ ID NO: 560434 - RNA, 64 nt, Homo Sapiens; identical to SEQ ID NO: 193789

SEQ ID NO: 560435 - RNA, 64 nt, Homo Sapiens; identical to SEQ ID NO: 193790

SEQ ID NO: 560436 - RNA, 64 nt, Homo Sapiens
acgcagucuuguaggcagcugccaccuuaugcagugcaucgaaaccuuuugcuuggggaugugc

SEQ ID NO: 560437 - RNA, 64 nt, Homo Sapiens
cuguaaaccagagcugguucccaccuccagcuccugcaucgaguacaggcugguaaugugcugg

SEQ ID NO: 560438 - RNA, 64 nt, Homo Sapiens
ugaguguaaacauaacuuauuuuucuucuuuaugugcaucgacuauuuagccguuuccuccaga

SEQ ID NO: 560439 - RNA, 64 nt, Homo Sapiens
agaggucaugccugggaggaagggaucgucaugcugcaucgaauccucucuccgccguguggcc

SEQ ID NO: 560440 - RNA, 64 nt, Homo Sapiens
agucccagcugcuuuucauuuggaagaggagagaugcaucgagcugccuucuccgcgucauugu

SEQ ID NO: 560441 - RNA, 64 nt, Homo Sapiens
cccagccugguguuguucuuaauaagcaaaaaacugcaucgaucagcaggacuaacaacuggga

SEQ ID NO: 560442 - RNA, 64 nt, Homo Sapiens
caaaacucaaaugcuuggcuuccccacugccuacugcaucgaguguccccaaaccugcaagggc

SEQ ID NO: 560443 - RNA, 64 nt, Homo Sapiens
accugaauaaaucaugccacaccuccagguuauaugcaucgagauuauagaucagcguuuaguc

SEQ ID NO: 560444 - RNA, 64 nt, Homo Sapiens
auggacuacuaaaugccuuuaguaugugacaaucugcaucgaucguacccgcaaaacgggacau

SEQ ID NO: 560445 - RNA, 64 nt, Homo Sapiens
uuuuuacuagagaauuuuacuuuguagcauggguugcaucgacuuauggcuuucucacuuuuau

SEQ ID NO: 560446 - RNA, 64 nt, Homo Sapiens
uguaacugaaaguauagaucagugaaaguuaugcugcaucgaauuguauacaaauucuuccuua

SEQ ID NO: 560447 - RNA, 64 nt, Homo Sapiens
cccccgguguggaaaaggcuaaauaaggugacagugcaucgaugcucccccgcguggccuuugg

SEQ ID NO: 560448 - RNA, 64 nt, Homo Sapiens
aaaugcauguuuagggauggcuaaaauuccaaggugcaucgacauuaacccacucauuuaguaa

SEQ ID NO: 560449 - RNA, 64 nt, Homo Sapiens
uauaugaaaauguacugauuuuuuuuuaauaaacugcaucgagauccaaccgacugaauuguua

SEQ ID NO: 560450 - RNA, 64 nt, Homo Sapiens
ccuauuggaauucgagacuuaauuaaugaagcuuugcaucgagaaacgaugggucugaagucca

SEQ ID NO: 560451 - RNA, 64 nt, Homo Sapiens
uguauucaccuuucuuuuguccuaaacaaccuggugcaucgaaaacacacaguuacugacuuag

SEQ ID NO: 560452 - RNA, 64 nt, Homo Sapiens
gguggacauuuggaucguuucauuuuauuuaucaugcaucgauuuguauggaaugguaguacua

SEQ ID NO: 560453 - RNA, 64 nt, Homo Sapiens
aacucuugacaguugccucaagauggagugaaauugcaucgaggguaagacuguguccacaggu

SEQ ID NO: 560454 - RNA, 64 nt, Homo Sapiens
agaacuugcagaguguguauucuuggauggcugaugcaucgacuugcauucccacuuaacacuu

SEQ ID NO: 560455 - RNA, 64 nt, Homo Sapiens
gauaguguguucuuuccgggacgcccaugcgguuugcaucgacuucagacaacgacugaugaaa

SEQ ID NO: 560456 - RNA, 64 nt, Homo Sapiens
ucugcccaacccaagggcccgugcgcuccaacccugcaucgaacugccaacauaguacaccuuu

SEQ ID NO: 560457 - RNA, 64 nt, Homo Sapiens
aaaacugcauggcagauacgugacugccacaauaugcaucgaagacaaacuuacuauaaagaug

SEQ ID NO: 560458 - RNA, 64 nt, Homo Sapiens
uguagccguggaccgaauacgcacucuugaaagcugcaucgagaacccgcccaagcgccaccug

SEQ ID NO: 560459 - RNA, 64 nt, Homo Sapiens
uguaccucacuuagcccuugcuauggcagcuacuugcaucgacuccugggauaaacugggagaa

SEQ ID NO: 560460 - RNA, 64 nt, Homo Sapiens
aucacuguguaaaacuaagugucucuaaauguaaugcaucgauuuagugucuggaacauaauaa

SEQ ID NO: 560461 - RNA, 64 nt, Homo Sapiens
aaugucacuggacucggccuaacaguugggcuguugcaucgaguagaaccaggaucucuggaga

SEQ ID NO: 560462 - RNA, 64 nt, Homo Sapiens
gguccccucagcaucaagcagcccaaccaaggcgugcaucgagccuugcaccucaacaaaaggc

SEQ ID NO: 560463 - RNA, 64 nt, Homo Sapiens
cuaaaaacugaucaguguaaucuuuaagguauugugcaucgacauaaguucuuaaugucaacca

SEQ ID NO: 560464 - RNA, 64 nt, Homo Sapiens
acagucccugugucucacagcgguaaucguguguugcaucgaugcguuuguggucaccacgaag

SEQ ID NO: 560465 - RNA, 64 nt, Homo Sapiens
ggcugaguggaaaauggugugagccccaccgcugugcaucgaaugagggaaguggcagcagaga

SEQ ID NO: 560466 - RNA, 64 nt, Homo Sapiens
uaaucagaaugaagaccgcaaacauaaaagaaauugcaucgauggacacacugguuaaaaauua

SEQ ID NO: 560467 - RNA, 64 nt, Homo Sapiens
aucuuuuuguuuguaaacguuuaggacuggccuaugcaucgaaagguccccauuaugggaugca

SEQ ID NO: 560468 - RNA, 64 nt, Homo Sapiens
uucuccuggggugugugccagcuacacagcugugugcaucgacggagagugguuuccguuugca

SEQ ID NO: 560469 - RNA, 64 nt, Homo Sapiens
gagaguaacugugcuuggaauagaaaagcccugcugcaucgagacacaaugcuggcagcugcgg

SEQ ID NO: 560470 - RNA, 64 nt, Homo Sapiens
aaagcuuggacuccauuuuauauuauaaagcaauugcaucgauauuguuugauuuuuucuuuua

SEQ ID NO: 560471 - RNA, 64 nt, Homo Sapiens
aaaguagcauaaauauuuucauucacaaaaugaggaagauaaggucauugcaauaaaagccagc

SEQ ID NO: 560472 - RNA, 64 nt, Homo Sapiens
ugaacuaaacaaacauauuuaaucagagaaaugugaagauaagaacugguccugcagcuuauug

SEQ ID NO: 560473 - RNA, 64 nt, Homo Sapiens
caaaaggacugguacgguagucuguggaaaccaggaagauaaaacaacagccacaaaagagaaa

SEQ ID NO: 560474 - RNA, 64 nt, Homo Sapiens
ucugccaauauacguuuuuucuguugguuuaagagaagauaacugacagcuuuaccuacuuccu

SEQ ID NO: 560475 - RNA, 64 nt, Homo Sapiens
uauuuuuaaagguuaugaaauccacuaaauuguugaagauaaauuugaagaaauugauuacagu

SEQ ID NO: 560476 - RNA, 60 nt, Homo Sapiens
agaagugacaucucuuguacguauguuaaugaagauaaaaauauuucaggaggagaauga

SEQ ID NO: 560477 - RNA, 64 nt, Homo Sapiens
ugauugugacuucuaguucuggaacuauuguauagaagauaauaauguucuacuugucagggcu

SEQ ID NO: 560478 - RNA, 64 nt, Homo Sapiens
uuguuaaaguauuuuuuauaccccguaaaaaguagaagauaaguuuuguugaucaagugacugu

SEQ ID NO: 560479 - RNA, 64 nt, Homo Sapiens
cccugggucccucccacaacaugugggaauuccagaagauaaauucaaguugcaauuucagugg

SEQ ID NO: 560480 - RNA, 64 nt, Homo Sapiens
uguuaauuugaggacugggcugucuuggggcucagaagauaaagaacuauuugagcagaugugu

SEQ ID NO: 560481 - RNA, 64 nt, Homo Sapiens
uaauugggggccaucuagaauugucuguuucuaugaagauaaaagugaaaccguugguccauuu

SEQ ID NO: 560482 - RNA, 64 nt, Homo Sapiens
cagauauuucugugggaaauaacuuauuagaauggaagauaaugacugaaauguuugugucuuc

SEQ ID NO: 560483 - RNA, 64 nt, Homo Sapiens
uuugaauuaaauugauacaccaucuuuguauucugaagauaagguuaguuuaucuuguaguauu

SEQ ID NO: 560484 - RNA, 64 nt, Homo Sapiens
ccuaccccucucccccaaauagcuggggugcuuugaagauaaucucugaccuucucaucaagag

SEQ ID NO: 560485 - RNA, 64 nt, Homo Sapiens
gaauguacugagcaagcaaacuugagucucaauugaagauaaaaauaaugcaagcauacccucc

SEQ ID NO: 560486 - RNA, 64 nt, Homo Sapiens
auguguuggacaagcauagacaacuugggauccugaagauaaauaccuaaaucucuuugccuaa

SEQ ID NO: 560487 - RNA, 63 nt, Homo Sapiens
uuuaaucaagcaggaaaaaguucucaugauuaugccaacuauaauaguaauccucacugagug

SEQ ID NO: 560488 - RNA, 63 nt, Homo Sapiens
gaauucuuaccauacugccauuaaaauaaauuugccaacuaguaaugcauacuggaaaucaaa

SEQ ID NO: 560489 - RNA, 64 nt, Homo Sapiens
ggagcagaggggugcggguaaacgaggaguggggcgaggaaagcgggaugggaacaaguggccu

SEQ ID NO: 560490 - RNA, 64 nt, Homo Sapiens
uuuuucuggggccucaauccagucuugauaacagcgaggaaagagguauugaagaaacaggggu

SEQ ID NO: 560491 - RNA, 64 nt, Homo Sapiens
gcauagagauuuguucguauuuagaaugggaucacgaggaaaagagaaggaaagugauuuuuuu

SEQ ID NO: 560492 - RNA, 64 nt, Homo Sapiens
aaguaaaaguugggcacuaaucuggauuaacauucgaggaaaucaguugagcugaauuuaaguu

SEQ ID NO: 560493 - RNA, 64 nt, Homo Sapiens
gagauucacugcuaaugaguugggaggaggauugcgaggaaauggaugaguacuugccuaggac

SEQ ID NO: 560494 - RNA, 64 nt, Homo Sapiens
aagacguuuugauauaguguugauguaggaagcacgaggaaaggguuguacuaggcaaacacac

SEQ ID NO: 560495 - RNA, 64 nt, Homo Sapiens
ugauaccugcaguaacccaugugaauagcacagucgaggaaaauuuuuuggacuuaacaaaguu

SEQ ID NO: 560496 - RNA, 64 nt, Homo Sapiens
accuuccccugaaccccuaacccuccuccuuucacgaggaaaagcugccagucagccacagaga

SEQ ID NO: 560497 - RNA, 64 nt, Homo Sapiens
gcuuggauuaggagagucuuagacguuaggaaagcgaggaaaguguggggucccuuuguugcca

SEQ ID NO: 560498 - RNA, 64 nt, Homo Sapiens
ugcuccccaacgugcucuccaucaaaccucagcccgaggaaacaccuucuccaaaccagaucca

SEQ ID NO: 560499 - RNA, 64 nt, Homo Sapiens
cguuccaacagcauucacugccaguucuaauaggcgaggaaaaugcccgaggcgcugucuucug

SEQ ID NO: 560500 - RNA, 64 nt, Homo Sapiens
aaagcgauucuccuugaguuuauuacaacaucggcgaggaaaugauuacauuuauguuccuaua

SEQ ID NO: 560501 - RNA, 64 nt, Homo Sapiens
cauaaaguuauaaauuagccuaauaaacuuguaucgaggaaauccuuguauauggagaauaaac

SEQ ID NO: 560502 - RNA, 64 nt, Homo Sapiens
cuaaacauguuuuuaccugcuguaacuuggaaagcgaggaaacauaaaucugcucaagauaaaa

SEQ ID NO: 560503 - RNA, 64 nt, Homo Sapiens
uggagcaguuuucucugguuccugagaaguacugcgaggaaaugaaaaucugcuagucgcuagc

SEQ ID NO: 560504 - RNA, 64 nt, Homo Sapiens
caaacacuuuccgccucucugaugucccaugcuucgaggaaaacuuuugaauaccaugaucgau

SEQ ID NO: 560505 - RNA, 64 nt, Homo Sapiens
guuuguaagaggggaaagaacgaguuucuaaaggcgaggaaaugggcgcguuuggguuugaugg

SEQ ID NO: 560506 - RNA, 64 nt, Homo Sapiens
cccucaaaacuaacuuguuucggcaggaggaccacgaggaaauauggaacauggggacgaguga

SEQ ID NO: 560507 - RNA, 64 nt, Homo Sapiens
aucuagugggauuagcaaggagcuaggauucuaccgaggaaaaccaugcacauggaaacccaug

SEQ ID NO: 560508 - RNA, 64 nt, Homo Sapiens
gacucuuuuaggaucagaucugugagcacguuggcgaggaaaaacaaaacaaacaaaaaaaaga

SEQ ID NO: 560509 - RNA, 64 nt, Homo Sapiens
guuaauaauuuguuuuauaauugaguaguacaagcgaggaaaaaauacggaggauaaccacuau

SEQ ID NO: 560510 - RNA, 64 nt, Homo Sapiens
uuucugcucuugugaagaaaaaaaaaagcauuuucgaggaaagaauuaugcaauuucuuuuguu

SEQ ID NO: 560511 - RNA, 64 nt, Homo Sapiens
ccuggagggaaucacaugugucacccaggagccucgaggaaagcuccagccauggucagacagg

SEQ ID NO: 560512 - RNA, 64 nt, Homo Sapiens
agagugaggauuuucauuaacagaacuaaaaauacgaggaaaggauaaaggcagagagaagaga

SEQ ID NO: 560513 - RNA, 64 nt, Homo Sapiens
ggacugaggauccucuccuccagaaaagcccccucgaggaaauaaauuagugcgguucucuuug
